United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 63

SEQ ID NO: 2861681 - RNA, 20 nt, Human
aaauaaacuuuuuuucaaug

SEQ ID NO: 2861682 - RNA, 21 nt, Human
aaauaaacuuuuuuucaaugu

SEQ ID NO: 2861683 - RNA, 22 nt, Human
aaauaaacuuuuuuucaaugug

SEQ ID NO: 2861684 - RNA, 19 nt, Human
aaauaaagacaaccauauu

SEQ ID NO: 2861685 - RNA, 13 nt, Human
aaauaaaauuaug

SEQ ID NO: 2861686 - RNA, 22 nt, Human
aaauaaaauuaaagcugaaaac

SEQ ID NO: 2861687 - RNA, 15 nt, Human
aaauaaaauggauuu

SEQ ID NO: 2861688 - RNA, 11 nt, Human
aaagugcuggg

SEQ ID NO: 2861689 - RNA, 13 nt, Human
aaagugcugagau

SEQ ID NO: 2861690 - RNA, 21 nt, Human
aaagugcuaagguucuaaggc

SEQ ID NO: 2861691 - RNA, 23 nt, Human
aaagugcuaagguucuaaggccu

SEQ ID NO: 2861692 - RNA, 16 nt, Human
aaagugcuaagguucu

SEQ ID NO: 2861693 - RNA, 17 nt, Human
aaagugcuaagguucua

SEQ ID NO: 2861694 - RNA, 18 nt, Human
aaagugcuaagguucuaa

SEQ ID NO: 2861695 - RNA, 20 nt, Human
aaagugcuaagguucuaagg

SEQ ID NO: 2861696 - RNA, 13 nt, Human
aaagugacacagc

SEQ ID NO: 2861697 - RNA, 14 nt, Human
aaagugacacagca

SEQ ID NO: 2861698 - RNA, 14 nt, Human
aaagugcugggauu

SEQ ID NO: 2861699 - RNA, 12 nt, Human
aaagugcuggga

SEQ ID NO: 2861700 - RNA, 22 nt, Human
aaauaaaagugaaugaaagauu

SEQ ID NO: 2861701 - RNA, 14 nt, Human
aaauaaaauaaagc

SEQ ID NO: 2861702 - RNA, 17 nt, Human
aaauaaaaguuuuacaa

SEQ ID NO: 2861703 - RNA, 16 nt, Human
aaaggcuugaagcugu

SEQ ID NO: 2861704 - RNA, 17 nt, Human
aaaggcuugaagcugug

SEQ ID NO: 2861705 - RNA, 18 nt, Human
aaagggaaguugugccuu

SEQ ID NO: 2861706 - RNA, 15 nt, Human
aaagucucuaauucu

SEQ ID NO: 2861707 - RNA, 18 nt, Human
aaagucucuaauucuauu

SEQ ID NO: 2861708 - RNA, 22 nt, Human
aaagucugugugaugaacuuuc

SEQ ID NO: 2861709 - RNA, 23 nt, Human
aaagucugugugaugaacuuucu

SEQ ID NO: 2861710 - RNA, 20 nt, Human
aaagugaaaguccagaaacu

SEQ ID NO: 2861711 - RNA, 14 nt, Human
aaagugaauaaacu

SEQ ID NO: 2861712 - RNA, 15 nt, Human
aaagugaauaaacuu

SEQ ID NO: 2861713 - RNA, 16 nt, Human
aaagugaauaaacuuc

SEQ ID NO: 2861714 - RNA, 18 nt, Human
aaagugaauaaacuucag

SEQ ID NO: 2861715 - RNA, 19 nt, Human
aaagugaauaaacuucagc

SEQ ID NO: 2861716 - RNA, 20 nt, Human
aaagugaauaaacuucagca

SEQ ID NO: 2861717 - RNA, 21 nt, Human
aaagugaauaaacuucagcac

SEQ ID NO: 2861718 - RNA, 15 nt, Human
aaagugaaugaaaga

SEQ ID NO: 2861719 - RNA, 16 nt, Human
aaagugaaugaaagau

SEQ ID NO: 2861720 - RNA, 22 nt, Human
aaagugaaugaaagauuaaaca

SEQ ID NO: 2861721 - RNA, 18 nt, Human
aaagugaauuguugacaa

SEQ ID NO: 2861722 - RNA, 23 nt, Human
aaagucuuuggggucuacacugc

SEQ ID NO: 2861723 - RNA, 15 nt, Human
aaauaacaaaaugga

SEQ ID NO: 2861724 - RNA, 16 nt, Human
aaauaaauuuauauga

SEQ ID NO: 2861725 - RNA, 17 nt, Human
aaauaaauuuauaugaa

SEQ ID NO: 2861726 - RNA, 17 nt, Human
aaauaacaaugugcucu

SEQ ID NO: 2861727 - RNA, 14 nt, Human
aaauaacaaugugc

SEQ ID NO: 2861728 - RNA, 14 nt, Human
aaauaacaauguua

SEQ ID NO: 2861729 - RNA, 15 nt, Human
aaauaacaauguuaa

SEQ ID NO: 2861730 - RNA, 16 nt, Human
aaauaacaauguuaag

SEQ ID NO: 2861731 - RNA, 22 nt, Human
aaauaacaaguaccaaaguuuu

SEQ ID NO: 2861732 - RNA, 23 nt, Human
aaagaugaacucugaacuuugga

SEQ ID NO: 2861733 - RNA, 21 nt, Human
aaagaucuguuuugaaggcaa

SEQ ID NO: 2861734 - RNA, 15 nt, Human
aaagaucuucaaaag

SEQ ID NO: 2861735 - RNA, 14 nt, Human
aaagaaagaaggaa

SEQ ID NO: 2861736 - RNA, 16 nt, Human
aaagaaaauaaagaca

SEQ ID NO: 2861737 - RNA, 16 nt, Human
aaagaaaagaaaauuu

SEQ ID NO: 2861738 - RNA, 17 nt, Human
aaacugaauuuguacuu

SEQ ID NO: 2861739 - RNA, 13 nt, Human
aaacugacuauca

SEQ ID NO: 2861740 - RNA, 14 nt, Human
aaagaaagcaacuu

SEQ ID NO: 2861741 - RNA, 23 nt, Human
aaagaaaguugcacggcugcuga

SEQ ID NO: 2861742 - RNA, 14 nt, Human
aaagaaauaaccac

SEQ ID NO: 2861743 - RNA, 21 nt, Human
aaagaaauaaccacugcaagu

SEQ ID NO: 2861744 - RNA, 15 nt, Human
aaagaaauaauaaua

SEQ ID NO: 2861745 - RNA, 16 nt, Human
aaagaaauaauaauau

SEQ ID NO: 2861746 - RNA, 12 nt, Human
aaagaacauaaa

SEQ ID NO: 2861747 - RNA, 14 nt, Human
aaagaaauaccuug

SEQ ID NO: 2861748 - RNA, 14 nt, Human
aaagaaauuuacua

SEQ ID NO: 2861749 - RNA, 17 nt, Human
aaagaaauuuacuauau

SEQ ID NO: 2861750 - RNA, 21 nt, Human
aaagaaauuuacuauauauau

SEQ ID NO: 2861751 - RNA, 17 nt, Human
aaagaaaugucuuaauu

SEQ ID NO: 2861752 - RNA, 19 nt, Human
aaagauagagucauugcug

SEQ ID NO: 2861753 - RNA, 15 nt, Human
aaagauagauaucca

SEQ ID NO: 2861754 - RNA, 15 nt, Human
aaagauaucuuuucu

SEQ ID NO: 2861755 - RNA, 14 nt, Human
aaagauauggagaa

SEQ ID NO: 2861756 - RNA, 18 nt, Human
aaagaguagaauugcauu

SEQ ID NO: 2861757 - RNA, 13 nt, Human
aaagaguagaauu

SEQ ID NO: 2861758 - RNA, 13 nt, Human
aaaauugcuaugu

SEQ ID NO: 2861759 - RNA, 20 nt, Human
aaaauugcuauguuacuauu

SEQ ID NO: 2861760 - RNA, 22 nt, Human
aaaauugcuauguuacuauuuu

SEQ ID NO: 2861761 - RNA, 17 nt, Human
aaacacucggcauuuca

SEQ ID NO: 2861762 - RNA, 20 nt, Human
aaacacucggcauuucaaau

SEQ ID NO: 2861763 - RNA, 21 nt, Human
aaacacucggcauuucaaaug

SEQ ID NO: 2861764 - RNA, 14 nt, Human
aaacacugcaggca

SEQ ID NO: 2861765 - RNA, 13 nt, Human
aaacacugaaaaa

SEQ ID NO: 2861766 - RNA, 15 nt, Human
aaacacugcaggcau

SEQ ID NO: 2861767 - RNA, 13 nt, Human
aaacacugccauc

SEQ ID NO: 2861768 - RNA, 13 nt, Human
aaaauucauuuca

SEQ ID NO: 2861769 - RNA, 14 nt, Human
aaaauucauuucac

SEQ ID NO: 2861770 - RNA, 16 nt, Human
aaaauucauuucacau

SEQ ID NO: 2861771 - RNA, 13 nt, Human
aaaauucagugga

SEQ ID NO: 2861772 - RNA, 16 nt, Human
aaaauucagcaaacca

SEQ ID NO: 2861773 - RNA, 18 nt, Human
aaaauucagcaaaccauu

SEQ ID NO: 2861774 - RNA, 21 nt, Human
aaaauucagcaaaccauuuuu

SEQ ID NO: 2861775 - RNA, 22 nt, Human
aaaacacacgcgcgcacacaca

SEQ ID NO: 2861776 - RNA, 11 nt, Human
aaaacacagag

SEQ ID NO: 2861777 - RNA, 12 nt, Human
aaaacacagagg

SEQ ID NO: 2861778 - RNA, 16 nt, Human
aaaacacauguuuuua

SEQ ID NO: 2861779 - RNA, 12 nt, Human
aaaacacauugc

SEQ ID NO: 2861780 - RNA, 14 nt, Human
aaaauucaaaaagu

SEQ ID NO: 2861781 - RNA, 16 nt, Human
aaaauucaaaaagugu

SEQ ID NO: 2861782 - RNA, 17 nt, Human
aaaauucaaaaaguguu

SEQ ID NO: 2861783 - RNA, 18 nt, Human
aaaauucaaaaaguguuu

SEQ ID NO: 2861784 - RNA, 17 nt, Human
aaacacugccuuuuuau

SEQ ID NO: 2861785 - RNA, 13 nt, Human
aaacacugccuuu

SEQ ID NO: 2861786 - RNA, 23 nt, Human
aaacacugccaucuuaguuugga

SEQ ID NO: 2861787 - RNA, 15 nt, Human
aaacacuucaauaau

SEQ ID NO: 2861788 - RNA, 15 nt, Human
aaacacuucuguccu

SEQ ID NO: 2861789 - RNA, 20 nt, Human
aaacagacucgauucauauu

SEQ ID NO: 2861790 - RNA, 20 nt, Human
aaacagaggccauggcagaa

SEQ ID NO: 2861791 - RNA, 21 nt, Human
aaacagaugaugagaauuucu

SEQ ID NO: 2861792 - RNA, 22 nt, Human
aaacagaugaugagaauuucua

SEQ ID NO: 2861793 - RNA, 13 nt, Human
aaacagauaccau

SEQ ID NO: 2861794 - RNA, 14 nt, Human
aaacagauaccaua

SEQ ID NO: 2861795 - RNA, 19 nt, Human
aaacagauaccauacucau

SEQ ID NO: 2861796 - RNA, 13 nt, Human
aaacagcaaacca

SEQ ID NO: 2861797 - RNA, 14 nt, Human
aaacagcaaaccaa

SEQ ID NO: 2861798 - RNA, 15 nt, Human
aaacagcaaaccaag

SEQ ID NO: 2861799 - RNA, 13 nt, Human
aagaaaugauguu

SEQ ID NO: 2861800 - RNA, 12 nt, Human
aagaaaugaugu

SEQ ID NO: 2861801 - RNA, 15 nt, Human
aagaaaugacuaauu

SEQ ID NO: 2861802 - RNA, 16 nt, Human
aagaaaugacuaauua

SEQ ID NO: 2861803 - RNA, 17 nt, Human
aacuuuucaaugacauu

SEQ ID NO: 2861804 - RNA, 23 nt, Human
aagaaaucccuguuuaauauuua

SEQ ID NO: 2861805 - RNA, 15 nt, Human
aagaaaaaaaaaaga

SEQ ID NO: 2861806 - RNA, 17 nt, Human
aagaaaaaaaaaagaag

SEQ ID NO: 2861807 - RNA, 12 nt, Human
aagaaaugaaca

SEQ ID NO: 2861808 - RNA, 14 nt, Human
aagaaaugaacauu

SEQ ID NO: 2861809 - RNA, 16 nt, Human
aagaaaugaacauucc

SEQ ID NO: 2861810 - RNA, 13 nt, Human
aacuuuuuuucaa

SEQ ID NO: 2861811 - RNA, 14 nt, Human
aacuuuuuuucaau

SEQ ID NO: 2861812 - RNA, 15 nt, Human
aacuuuuuuucaaug

SEQ ID NO: 2861813 - RNA, 16 nt, Human
aacuuuuuuucaaugu

SEQ ID NO: 2861814 - RNA, 17 nt, Human
aacuuuuuuucaaugug

SEQ ID NO: 2861815 - RNA, 13 nt, Human
aacuuuuuuccac

SEQ ID NO: 2861816 - RNA, 14 nt, Human
aacuuuuuuaaaua

SEQ ID NO: 2861817 - RNA, 15 nt, Human
aacuuuuuuaaauaa

SEQ ID NO: 2861818 - RNA, 16 nt, Human
aacuuuuuuaaauaaa

SEQ ID NO: 2861819 - RNA, 17 nt, Human
aacuuuuuuaaauaaac

SEQ ID NO: 2861820 - RNA, 18 nt, Human
aacuuuuuuaaauaaacu

SEQ ID NO: 2861821 - RNA, 19 nt, Human
aacuuuuuuaaauaaacuu

SEQ ID NO: 2861822 - RNA, 20 nt, Human
aacuuuuuuaaauaaacuuu

SEQ ID NO: 2861823 - RNA, 21 nt, Human
aacuuuuuuaaauaaacuuuu

SEQ ID NO: 2861824 - RNA, 22 nt, Human
aacuuuuuuaaauaaacuuuuu

SEQ ID NO: 2861825 - RNA, 21 nt, Human
aacuuuuguaagacaaagguu

SEQ ID NO: 2861826 - RNA, 11 nt, Human
aacuuuuguaa

SEQ ID NO: 2861827 - RNA, 15 nt, Human
aacuuuuguaaagaa

SEQ ID NO: 2861828 - RNA, 18 nt, Human
aacuuuuguaaagaaauu

SEQ ID NO: 2861829 - RNA, 20 nt, Human
aacuuuuguguaaugaaaau

SEQ ID NO: 2861830 - RNA, 21 nt, Human
aacuuuuucuuuucccucaau

SEQ ID NO: 2861831 - RNA, 12 nt, Human
aacuuuucucag

SEQ ID NO: 2861832 - RNA, 14 nt, Human
aacuuuuaucuauu

SEQ ID NO: 2861833 - RNA, 20 nt, Human
aacuuuucaaggcuuauauu

SEQ ID NO: 2861834 - RNA, 15 nt, Human
aacuuuuaaacuaca

SEQ ID NO: 2861835 - RNA, 11 nt, Human
aacuuucugua

SEQ ID NO: 2861836 - RNA, 15 nt, Human
aacuuucuguaaacu

SEQ ID NO: 2861837 - RNA, 23 nt, Human
aacuuucuguuggauuccaugcu

SEQ ID NO: 2861838 - RNA, 15 nt, Human
aacuuucuuauccua

SEQ ID NO: 2861839 - RNA, 18 nt, Human
aacuuucucuucauacuu

SEQ ID NO: 2861840 - RNA, 23 nt, Human
aacuuucugaguuuuucagaugu

SEQ ID NO: 2861841 - RNA, 22 nt, Human
aacuuuggagagugagcuacag

SEQ ID NO: 2861842 - RNA, 18 nt, Human
aacuuuggaguccccuca

SEQ ID NO: 2861843 - RNA, 11 nt, Human
aacugacacag

SEQ ID NO: 2861844 - RNA, 12 nt, Human
aacugacacagg

SEQ ID NO: 2861845 - RNA, 13 nt, Human
aacugacacagga

SEQ ID NO: 2861846 - RNA, 14 nt, Human
aacugacacaggaa

SEQ ID NO: 2861847 - RNA, 20 nt, Human
aacugacacucccacccagu

SEQ ID NO: 2861848 - RNA, 14 nt, Human
aacugaccagccuc

SEQ ID NO: 2861849 - RNA, 12 nt, Human
aacugacaugau

SEQ ID NO: 2861850 - RNA, 20 nt, Human
aacugacaugauuagcagaa

SEQ ID NO: 2861851 - RNA, 15 nt, Human
aacuguuuuggguag

SEQ ID NO: 2861852 - RNA, 21 nt, Human
aacuguuuuggguagcugcca

SEQ ID NO: 2861853 - RNA, 13 nt, Human
aacuuaaaaaugu

SEQ ID NO: 2861854 - RNA, 17 nt, Human
aacuuaaaaauguaaau

SEQ ID NO: 2861855 - RNA, 18 nt, Human
aacuuaaaaauguaaaua

SEQ ID NO: 2861856 - RNA, 21 nt, Human
aacuuaaaaauguaaauauuc

SEQ ID NO: 2861857 - RNA, 11 nt, Human
aacuuaaaaua

SEQ ID NO: 2861858 - RNA, 19 nt, Human
aacuuaguguaauauacca

SEQ ID NO: 2861859 - RNA, 16 nt, Human
aacuuagguggcaagc

SEQ ID NO: 2861860 - RNA, 20 nt, Human
aacuuagugacaaaauagac

SEQ ID NO: 2861861 - RNA, 13 nt, Human
aacuuauucugua

SEQ ID NO: 2861862 - RNA, 14 nt, Human
aacuuauucuguag

SEQ ID NO: 2861863 - RNA, 14 nt, Human
aacuuauguagaua

SEQ ID NO: 2861864 - RNA, 17 nt, Human
aacuuauguagauauuu

SEQ ID NO: 2861865 - RNA, 18 nt, Human
aacuuauguagauauuug

SEQ ID NO: 2861866 - RNA, 19 nt, Human
aacuuauguagauauuugg

SEQ ID NO: 2861867 - RNA, 20 nt, Human
aacuuauguagauauuuggc

SEQ ID NO: 2861868 - RNA, 21 nt, Human
aacuuauguagauauuuggcu

SEQ ID NO: 2861869 - RNA, 22 nt, Human
aacuuauguagauauuuggcuu

SEQ ID NO: 2861870 - RNA, 12 nt, Human
aacuuauguuuu

SEQ ID NO: 2861871 - RNA, 19 nt, Human
aacuuauccuaaaacaaau

SEQ ID NO: 2861872 - RNA, 12 nt, Human
aacuuaugaaug

SEQ ID NO: 2861873 - RNA, 14 nt, Human
aacuuaugaauguu

SEQ ID NO: 2861874 - RNA, 15 nt, Human
aacuuaugaauguuu

SEQ ID NO: 2861875 - RNA, 16 nt, Human
aacuuaugaauguuuc

SEQ ID NO: 2861876 - RNA, 15 nt, Human
aacuuauggccacag

SEQ ID NO: 2861877 - RNA, 14 nt, Human
aacuuauaaaucau

SEQ ID NO: 2861878 - RNA, 15 nt, Human
aacuuauaaaucaua

SEQ ID NO: 2861879 - RNA, 19 nt, Human
aacuuauaaaucauauuga

SEQ ID NO: 2861880 - RNA, 20 nt, Human
aacuuauauacuauuucccu

SEQ ID NO: 2861881 - RNA, 12 nt, Human
aacuuauauuga

SEQ ID NO: 2861882 - RNA, 13 nt, Human
aacuuauauugaa

SEQ ID NO: 2861883 - RNA, 19 nt, Human
aacuuauauugaagacaau

SEQ ID NO: 2861884 - RNA, 14 nt, Human
aacucacaaaugau

SEQ ID NO: 2861885 - RNA, 20 nt, Human
aacucaccagccccacugcc

SEQ ID NO: 2861886 - RNA, 13 nt, Human
aacucagggacag

SEQ ID NO: 2861887 - RNA, 16 nt, Human
aacucagggacagagc

SEQ ID NO: 2861888 - RNA, 17 nt, Human
aacucagggacagagcc

SEQ ID NO: 2861889 - RNA, 21 nt, Human
aacucauaaucuauaaacaau

SEQ ID NO: 2861890 - RNA, 18 nt, Human
aacucagggacagagcca

SEQ ID NO: 2861891 - RNA, 22 nt, Human
aacucagucauuagacuccucc

SEQ ID NO: 2861892 - RNA, 23 nt, Human
aacucagucauuagacuccuccu

SEQ ID NO: 2861893 - RNA, 20 nt, Human
aacucaguccuguacucugg

SEQ ID NO: 2861894 - RNA, 20 nt, Human
aacucaccuggggcugcugg

SEQ ID NO: 2861895 - RNA, 22 nt, Human
aacucacucaguuuaugcugug

SEQ ID NO: 2861896 - RNA, 17 nt, Human
aacucagaucugucuga

SEQ ID NO: 2861897 - RNA, 15 nt, Human
aacucaccuggggcu

SEQ ID NO: 2861898 - RNA, 16 nt, Human
aacucagccugggaca

SEQ ID NO: 2861899 - RNA, 17 nt, Human
aacucagccugggacag

SEQ ID NO: 2861900 - RNA, 15 nt, Human
aacugaagauguuga

SEQ ID NO: 2861901 - RNA, 17 nt, Human
aacugaagauguugaga

SEQ ID NO: 2861902 - RNA, 23 nt, Human
aacugaacucugacaacagacuu

SEQ ID NO: 2861903 - RNA, 15 nt, Human
aacugaacuuugaag

SEQ ID NO: 2861904 - RNA, 16 nt, Human
aacugaacuuugaaga

SEQ ID NO: 2861905 - RNA, 20 nt, Human
aacugaacuuugaagacccg

SEQ ID NO: 2861906 - RNA, 13 nt, Human
aacugaagagaca

SEQ ID NO: 2861907 - RNA, 14 nt, Human
aacugaagagacag

SEQ ID NO: 2861908 - RNA, 15 nt, Human
aacugaagagacagu

SEQ ID NO: 2861909 - RNA, 16 nt, Human
aacugaacucugacaa

SEQ ID NO: 2861910 - RNA, 14 nt, Human
aacugaacucugac

SEQ ID NO: 2861911 - RNA, 20 nt, Human
aacugaacucugacaacaga

SEQ ID NO: 2861912 - RNA, 19 nt, Human
aacugaacucugacaacag

SEQ ID NO: 2861913 - RNA, 16 nt, Human
aacuucacaacuaggc

SEQ ID NO: 2861914 - RNA, 17 nt, Human
aacuuauuuuauuucca

SEQ ID NO: 2861915 - RNA, 23 nt, Human
aacuuauucuguagauucugugg

SEQ ID NO: 2861916 - RNA, 16 nt, Human
aacuuauugcugauuu

SEQ ID NO: 2861917 - RNA, 17 nt, Human
aacuuauugcugauuuu

SEQ ID NO: 2861918 - RNA, 21 nt, Human
aacuuauugcugauuuuaaug

SEQ ID NO: 2861919 - RNA, 22 nt, Human
aacuuauugcugauuuuaaugg

SEQ ID NO: 2861920 - RNA, 13 nt, Human
aacuuauuuagag

SEQ ID NO: 2861921 - RNA, 13 nt, Human
aacuucaaauuuu

SEQ ID NO: 2861922 - RNA, 14 nt, Human
aacuucaacauuua

SEQ ID NO: 2861923 - RNA, 19 nt, Human
aacuucaacauuuacaugu

SEQ ID NO: 2861924 - RNA, 17 nt, Human
aacaccuuccagcuccu

SEQ ID NO: 2861925 - RNA, 19 nt, Human
aacaccugggcuuaagaaa

SEQ ID NO: 2861926 - RNA, 11 nt, Human
aacaagaaugc

SEQ ID NO: 2861927 - RNA, 12 nt, Human
aacaagaaugca

SEQ ID NO: 2861928 - RNA, 13 nt, Human
aacaagaaugcau

SEQ ID NO: 2861929 - RNA, 15 nt, Human
aacaagaaugcauug

SEQ ID NO: 2861930 - RNA, 16 nt, Human
aacaagaaugcauuga

SEQ ID NO: 2861931 - RNA, 17 nt, Human
aacaagaaugcauugau

SEQ ID NO: 2861932 - RNA, 12 nt, Human
aacaagaauugg

SEQ ID NO: 2861933 - RNA, 13 nt, Human
aacaagaagauga

SEQ ID NO: 2861934 - RNA, 14 nt, Human
aacaagaagaugaa

SEQ ID NO: 2861935 - RNA, 20 nt, Human
aacacauuuugguucuucuc

SEQ ID NO: 2861936 - RNA, 22 nt, Human
aacacauuuugguucuucucaa

SEQ ID NO: 2861937 - RNA, 12 nt, Human
aacaaagaaaua

SEQ ID NO: 2861938 - RNA, 13 nt, Human
aacaaagaaauau

SEQ ID NO: 2861939 - RNA, 14 nt, Human
aacaaagaaauauu

SEQ ID NO: 2861940 - RNA, 15 nt, Human
aacaaagcacagugu

SEQ ID NO: 2861941 - RNA, 11 nt, Human
aacaaagauau

SEQ ID NO: 2861942 - RNA, 19 nt, Human
aacaaagauaucuuuucuu

SEQ ID NO: 2861943 - RNA, 22 nt, Human
aacaaagauaucuuuucuuuag

SEQ ID NO: 2861944 - RNA, 16 nt, Human
aacaaagcacaguguu

SEQ ID NO: 2861945 - RNA, 17 nt, Human
aacaaagcacaguguua

SEQ ID NO: 2861946 - RNA, 12 nt, Human
aacaaagcuguu

SEQ ID NO: 2861947 - RNA, 15 nt, Human
aacaaagcuguuaaa

SEQ ID NO: 2861948 - RNA, 17 nt, Human
aacaaagcuguuaaacu

SEQ ID NO: 2861949 - RNA, 18 nt, Human
aacaaagcuguuaaacug

SEQ ID NO: 2861950 - RNA, 19 nt, Human
aacaaagcuguuaaacugu

SEQ ID NO: 2861951 - RNA, 22 nt, Human
aacaaagcuguuaaacuguuag

SEQ ID NO: 2861952 - RNA, 22 nt, Human
aacaaccuggccgcguuuagac

SEQ ID NO: 2861953 - RNA, 22 nt, Human
aacaaaggauuaauugcugcaa

SEQ ID NO: 2861954 - RNA, 17 nt, Human
aacaaaggcaaguuaag

SEQ ID NO: 2861955 - RNA, 19 nt, Human
aacaaaggcaaguuaagag

SEQ ID NO: 2861956 - RNA, 20 nt, Human
aacaaaggcaaguuaagaga

SEQ ID NO: 2861957 - RNA, 21 nt, Human
aacaaaggcaaguuaagagaa

SEQ ID NO: 2861958 - RNA, 22 nt, Human
aacaacgcuugugaauguauuu

SEQ ID NO: 2861959 - RNA, 21 nt, Human
aacaacuccuagggccacuga

SEQ ID NO: 2861960 - RNA, 14 nt, Human
aacaaaaagcuucc

SEQ ID NO: 2861961 - RNA, 16 nt, Human
aacaaaaagcuucccc

SEQ ID NO: 2861962 - RNA, 12 nt, Human
aacaaaacaaaa

SEQ ID NO: 2861963 - RNA, 14 nt, Human
aacaaaacaaaaca

SEQ ID NO: 2861964 - RNA, 18 nt, Human
aacaaaacaaaacaacau

SEQ ID NO: 2861965 - RNA, 16 nt, Human
aacaaaacaaaacuau

SEQ ID NO: 2861966 - RNA, 9 nt, Human
aacaaaacu

SEQ ID NO: 2861967 - RNA, 14 nt, Human
aacaaaacuauacu

SEQ ID NO: 2861968 - RNA, 17 nt, Human
aacaaaacuauacuuga

SEQ ID NO: 2861969 - RNA, 13 nt, Human
aacaaaagaugaa

SEQ ID NO: 2861970 - RNA, 21 nt, Human
aacaaaagcgacccauucaga

SEQ ID NO: 2861971 - RNA, 12 nt, Human
aacaaaaggguc

SEQ ID NO: 2861972 - RNA, 13 nt, Human
aacaaaaggguca

SEQ ID NO: 2861973 - RNA, 15 nt, Human
aacaaaaguguuuaa

SEQ ID NO: 2861974 - RNA, 13 nt, Human
aacaaaaguuccc

SEQ ID NO: 2861975 - RNA, 12 nt, Human
aacaaaauagaa

SEQ ID NO: 2861976 - RNA, 20 nt, Human
aacaaaaucuccucuuuuag

SEQ ID NO: 2861977 - RNA, 13 nt, Human
aacaaaaucuguu

SEQ ID NO: 2861978 - RNA, 22 nt, Human
aacaaacuuuucaaggcuuaua

SEQ ID NO: 2861979 - RNA, 15 nt, Human
aacaaaauuacagac

SEQ ID NO: 2861980 - RNA, 21 nt, Human
aaauugauguguuuauuuaua

SEQ ID NO: 2861981 - RNA, 12 nt, Human
aaauugcacaau

SEQ ID NO: 2861982 - RNA, 20 nt, Human
aaauugcacacacucagugc

SEQ ID NO: 2861983 - RNA, 19 nt, Human
aaauugcacagaaguccug

SEQ ID NO: 2861984 - RNA, 20 nt, Human
aaauugcacagaaguccugu

SEQ ID NO: 2861985 - RNA, 16 nt, Human
aaauugcauaaagcau

SEQ ID NO: 2861986 - RNA, 17 nt, Human
aaauugcauaaagcaua

SEQ ID NO: 2861987 - RNA, 13 nt, Human
aaauugcaaaucu

SEQ ID NO: 2861988 - RNA, 19 nt, Human
aaauugcaaaucuugaaau

SEQ ID NO: 2861989 - RNA, 14 nt, Human
aaauugcaaaucuu

SEQ ID NO: 2861990 - RNA, 18 nt, Human
aaauugcauuuccugaca

SEQ ID NO: 2861991 - RNA, 14 nt, Human
aaauugcugugcuu

SEQ ID NO: 2861992 - RNA, 23 nt, Human
aaauugcugugcuuuauggauag

SEQ ID NO: 2861993 - RNA, 21 nt, Human
aaauuggccugguauggcugc

SEQ ID NO: 2861994 - RNA, 22 nt, Human
aaauuggccugguauggcugca

SEQ ID NO: 2861995 - RNA, 16 nt, Human
aaauuggaacagaaug

SEQ ID NO: 2861996 - RNA, 19 nt, Human
aaauuggaacagaauguuu

SEQ ID NO: 2861997 - RNA, 23 nt, Human
aaauuggacuuucaaaauuaaau

SEQ ID NO: 2861998 - RNA, 23 nt, Human
aaauuggauucccuuaaacaaaa

SEQ ID NO: 2861999 - RNA, 19 nt, Human
aacaccuucuuauuauaua

SEQ ID NO: 2862000 - RNA, 20 nt, Human
aacaccuucuuauuauauau

SEQ ID NO: 2862001 - RNA, 21 nt, Human
aacaccuucuuauuauauaua

SEQ ID NO: 2862002 - RNA, 22 nt, Human
aacaccuucuuauuauauauau

SEQ ID NO: 2862003 - RNA, 12 nt, Human
aacacgaaacuu

SEQ ID NO: 2862004 - RNA, 14 nt, Human
aacacgaaacuugu

SEQ ID NO: 2862005 - RNA, 15 nt, Human
aacacgaaacuuguu

SEQ ID NO: 2862006 - RNA, 16 nt, Human
aacacgaaacuuguua

SEQ ID NO: 2862007 - RNA, 19 nt, Human
aacacgaaacuuguuauug

SEQ ID NO: 2862008 - RNA, 20 nt, Human
aacacgaaacuuguuauugu

SEQ ID NO: 2862009 - RNA, 15 nt, Human
aacacgaaagaaaug

SEQ ID NO: 2862010 - RNA, 13 nt, Human
aaccagugccaag

SEQ ID NO: 2862011 - RNA, 14 nt, Human
aaccagugccaagg

SEQ ID NO: 2862012 - RNA, 15 nt, Human
aaccagugccaagga

SEQ ID NO: 2862013 - RNA, 16 nt, Human
aaccagugccaaggac

SEQ ID NO: 2862014 - RNA, 14 nt, Human
aaccaguguagccu

SEQ ID NO: 2862015 - RNA, 23 nt, Human
aaccagcuugcgaauaacagucc

SEQ ID NO: 2862016 - RNA, 21 nt, Human
aaccagcaucccuugaccagg

SEQ ID NO: 2862017 - RNA, 22 nt, Human
aaccagcuguaacacagcugag

SEQ ID NO: 2862018 - RNA, 18 nt, Human
aaccacgucugucuucac

SEQ ID NO: 2862019 - RNA, 21 nt, Human
aaccacgucugucuucacagc

SEQ ID NO: 2862020 - RNA, 18 nt, Human
aaccacucccagucccca

SEQ ID NO: 2862021 - RNA, 16 nt, Human
aaccacugcaaguccu

SEQ ID NO: 2862022 - RNA, 20 nt, Human
aaccacugcaaguccuuuug

SEQ ID NO: 2862023 - RNA, 23 nt, Human
aaccacugcaaguccuuuuguaa

SEQ ID NO: 2862024 - RNA, 16 nt, Human
aacagcugcauuagaa

SEQ ID NO: 2862025 - RNA, 17 nt, Human
aacagcugcauuagaaa

SEQ ID NO: 2862026 - RNA, 18 nt, Human
aacagcugcauuagaaaa

SEQ ID NO: 2862027 - RNA, 16 nt, Human
aacagcucgauccaaa

SEQ ID NO: 2862028 - RNA, 19 nt, Human
aacagcucgauccaaauug

SEQ ID NO: 2862029 - RNA, 24 nt, Human
aacagcucgauccaaauugugcuu

SEQ ID NO: 2862030 - RNA, 22 nt, Human
aacagcucucuucaaugacaua

SEQ ID NO: 2862031 - RNA, 23 nt, Human
aacagcucucuucaaugacauag

SEQ ID NO: 2862032 - RNA, 20 nt, Human
aacagcucugcaggcuuaau

SEQ ID NO: 2862033 - RNA, 21 nt, Human
aacagcucugcaggcuuaaua

SEQ ID NO: 2862034 - RNA, 13 nt, Human
aacagcucgacuu

SEQ ID NO: 2862035 - RNA, 15 nt, Human
aacaucauuagaaca

SEQ ID NO: 2862036 - RNA, 19 nt, Human
aacaugcaauuuugcauuu

SEQ ID NO: 2862037 - RNA, 22 nt, Human
aacaugcaauuuugcauuugaa

SEQ ID NO: 2862038 - RNA, 21 nt, Human
aacaugccugccccaaacaaa

SEQ ID NO: 2862039 - RNA, 22 nt, Human
aacaugccugccccaaacaaau

SEQ ID NO: 2862040 - RNA, 20 nt, Human
aacauguaaccggcauguuu

SEQ ID NO: 2862041 - RNA, 12 nt, Human
aacauguaauau

SEQ ID NO: 2862042 - RNA, 18 nt, Human
aacauguaauauaaagau

SEQ ID NO: 2862043 - RNA, 19 nt, Human
aacauguaauauaaagaug

SEQ ID NO: 2862044 - RNA, 22 nt, Human
aacauguaauauaaagauguua

SEQ ID NO: 2862045 - RNA, 17 nt, Human
aacaucacugaaaugcu

SEQ ID NO: 2862046 - RNA, 18 nt, Human
aacaucacuauccaugca

SEQ ID NO: 2862047 - RNA, 13 nt, Human
aacaucacacaca

SEQ ID NO: 2862048 - RNA, 14 nt, Human
aacaucaucaaggc

SEQ ID NO: 2862049 - RNA, 16 nt, Human
aacaucaucaaggcac

SEQ ID NO: 2862050 - RNA, 21 nt, Human
aacaucaucaaggcacugccu

SEQ ID NO: 2862051 - RNA, 14 nt, Human
aacaucauuagaac

SEQ ID NO: 2862052 - RNA, 22 nt, Human
aacaucaucaaggcacugccug

SEQ ID NO: 2862053 - RNA, 22 nt, Human
aacaucaugaauuuauugcaca

SEQ ID NO: 2862054 - RNA, 16 nt, Human
aacccuguuacaaagc

SEQ ID NO: 2862055 - RNA, 18 nt, Human
acaacuaugauuuggaaa

SEQ ID NO: 2862056 - RNA, 15 nt, Human
acaaagacauugauu

SEQ ID NO: 2862057 - RNA, 21 nt, Human
acaaaccuaccaaaauggaau

SEQ ID NO: 2862058 - RNA, 14 nt, Human
acaaaccugccugg

SEQ ID NO: 2862059 - RNA, 18 nt, Human
acaaaccugccuggguuu

SEQ ID NO: 2862060 - RNA, 21 nt, Human
acaaacuacagaccugcuuuu

SEQ ID NO: 2862061 - RNA, 14 nt, Human
acaaagaauuuaaa

SEQ ID NO: 2862062 - RNA, 20 nt, Human
aauuuugaguucuacauaag

SEQ ID NO: 2862063 - RNA, 17 nt, Human
aauuuugacuuaaugug

SEQ ID NO: 2862064 - RNA, 16 nt, Human
aauuuugagauuaaga

SEQ ID NO: 2862065 - RNA, 11 nt, Human
acaaaauggac

SEQ ID NO: 2862066 - RNA, 18 nt, Human
acaaaccuaccaaaaugg

SEQ ID NO: 2862067 - RNA, 12 nt, Human
acaaaccugccu

SEQ ID NO: 2862068 - RNA, 14 nt, Human
acaaaccaugcaaa

SEQ ID NO: 2862069 - RNA, 19 nt, Human
acaaaccacaacugacaca

SEQ ID NO: 2862070 - RNA, 20 nt, Human
acaaaccacaacugacacag

SEQ ID NO: 2862071 - RNA, 21 nt, Human
acaaaccacaacugacacagg

SEQ ID NO: 2862072 - RNA, 23 nt, Human
acaaaccacaacugacacaggaa

SEQ ID NO: 2862073 - RNA, 21 nt, Human
aauuuuauaagcaaauuucaa

SEQ ID NO: 2862074 - RNA, 19 nt, Human
aauuuuaguagagacaggg

SEQ ID NO: 2862075 - RNA, 13 nt, Human
aauuuuaguauuc

SEQ ID NO: 2862076 - RNA, 14 nt, Human
aauuuuaguauuca

SEQ ID NO: 2862077 - RNA, 17 nt, Human
aauuuuaguccaaauaa

SEQ ID NO: 2862078 - RNA, 12 nt, Human
aauuuuaggaac

SEQ ID NO: 2862079 - RNA, 21 nt, Human
aauuuuaggaacuucagagau

SEQ ID NO: 2862080 - RNA, 23 nt, Human
aauuuuaggcacucuuaaaugau

SEQ ID NO: 2862081 - RNA, 14 nt, Human
aauuauaagucaca

SEQ ID NO: 2862082 - RNA, 16 nt, Human
aauuauaagucacaaa

SEQ ID NO: 2862083 - RNA, 18 nt, Human
aauuauaaagauaaagcu

SEQ ID NO: 2862084 - RNA, 16 nt, Human
acaacuauuuuuccaa

SEQ ID NO: 2862085 - RNA, 17 nt, Human
acaacuauggaucagaa

SEQ ID NO: 2862086 - RNA, 17 nt, Human
acaacuauuucggccuu

SEQ ID NO: 2862087 - RNA, 19 nt, Human
acaacuauuucggccuuuu

SEQ ID NO: 2862088 - RNA, 17 nt, Human
acaacuucaauauccaa

SEQ ID NO: 2862089 - RNA, 18 nt, Human
acaacuucccagugaauu

SEQ ID NO: 2862090 - RNA, 16 nt, Human
acaaguauacuuauau

SEQ ID NO: 2862091 - RNA, 19 nt, Human
acaaguauacuuauauuuc

SEQ ID NO: 2862092 - RNA, 22 nt, Human
acaaguaccaaaguuuuaucaa

SEQ ID NO: 2862093 - RNA, 15 nt, Human
acaaguaagagacuc

SEQ ID NO: 2862094 - RNA, 23 nt, Human
acaaguaagagacucagccugca

SEQ ID NO: 2862095 - RNA, 18 nt, Human
acaacuauccugacuucu

SEQ ID NO: 2862096 - RNA, 21 nt, Human
acaaguaugaauaaagacacc

SEQ ID NO: 2862097 - RNA, 23 nt, Human
acaaguaugaauaaagacaccua

SEQ ID NO: 2862098 - RNA, 15 nt, Human
acaaguccugugaau

SEQ ID NO: 2862099 - RNA, 20 nt, Human
acaaguccuggauguugugu

SEQ ID NO: 2862100 - RNA, 21 nt, Human
acaaguccuggauguugugug

SEQ ID NO: 2862101 - RNA, 16 nt, Human
acaaguccugugaauu

SEQ ID NO: 2862102 - RNA, 17 nt, Human
acaaguccugugaauuu

SEQ ID NO: 2862103 - RNA, 19 nt, Human
acaaguccugugaauuucu

SEQ ID NO: 2862104 - RNA, 13 nt, Human
acaagucuuccag

SEQ ID NO: 2862105 - RNA, 20 nt, Human
acaagugacuguaucugugu

SEQ ID NO: 2862106 - RNA, 19 nt, Human
acaagugacuguaucugug

SEQ ID NO: 2862107 - RNA, 18 nt, Human
acaagugacuguaucugu

SEQ ID NO: 2862108 - RNA, 23 nt, Human
acaagugaaauaacaaaauggac

SEQ ID NO: 2862109 - RNA, 22 nt, Human
acaagugacuguaucuguguag

SEQ ID NO: 2862110 - RNA, 15 nt, Human
acacaaaccugccug

SEQ ID NO: 2862111 - RNA, 13 nt, Human
acaauuuucuugu

SEQ ID NO: 2862112 - RNA, 18 nt, Human
acaauuuucuugugacag

SEQ ID NO: 2862113 - RNA, 17 nt, Human
acacaaacacauuguua

SEQ ID NO: 2862114 - RNA, 19 nt, Human
acacaaaccacaacugaca

SEQ ID NO: 2862115 - RNA, 20 nt, Human
acacaaaccacaacugacac

SEQ ID NO: 2862116 - RNA, 22 nt, Human
acacaaaccacaacugacacag

SEQ ID NO: 2862117 - RNA, 16 nt, Human
acacaaacuguaaaua

SEQ ID NO: 2862118 - RNA, 15 nt, Human
acacaaacuguaaau

SEQ ID NO: 2862119 - RNA, 14 nt, Human
acacaaacuguaaa

SEQ ID NO: 2862120 - RNA, 16 nt, Human
acacaaaccugccugg

SEQ ID NO: 2862121 - RNA, 17 nt, Human
acacaaaccugccuggg

SEQ ID NO: 2862122 - RNA, 21 nt, Human
acacagaaacacugccuuuuu

SEQ ID NO: 2862123 - RNA, 17 nt, Human
acacagaaacacugccu

SEQ ID NO: 2862124 - RNA, 16 nt, Human
acacagaaacacugcc

SEQ ID NO: 2862125 - RNA, 14 nt, Human
acacagaaacacug

SEQ ID NO: 2862126 - RNA, 13 nt, Human
acacagaaacacu

SEQ ID NO: 2862127 - RNA, 12 nt, Human
acacagaaacac

SEQ ID NO: 2862128 - RNA, 20 nt, Human
acacagaaaauguugagaau

SEQ ID NO: 2862129 - RNA, 19 nt, Human
acacaaacuguaaauaaaa

SEQ ID NO: 2862130 - RNA, 17 nt, Human
acaauuaauaguuuguc

SEQ ID NO: 2862131 - RNA, 11 nt, Human
acaauguuaag

SEQ ID NO: 2862132 - RNA, 15 nt, Human
acaauguguuuuucu

SEQ ID NO: 2862133 - RNA, 18 nt, Human
acaauguguuuuucucca

SEQ ID NO: 2862134 - RNA, 19 nt, Human
acaauguguuuuucuccag

SEQ ID NO: 2862135 - RNA, 21 nt, Human
acaauguggccgaggacuuug

SEQ ID NO: 2862136 - RNA, 14 nt, Human
acaauguuaaggaa

SEQ ID NO: 2862137 - RNA, 19 nt, Human
acaauguuaaggaaacucu

SEQ ID NO: 2862138 - RNA, 20 nt, Human
acaauguuaaggaaacucuu

SEQ ID NO: 2862139 - RNA, 21 nt, Human
acaauguuaaggaaacucuua

SEQ ID NO: 2862140 - RNA, 22 nt, Human
acaauguuaaggaaacucuuau

SEQ ID NO: 2862141 - RNA, 12 nt, Human
acaauguucuuu

SEQ ID NO: 2862142 - RNA, 13 nt, Human
acaauguucuuua

SEQ ID NO: 2862143 - RNA, 14 nt, Human
acaauguucuuuau

SEQ ID NO: 2862144 - RNA, 16 nt, Human
acaauguucuuuauau

SEQ ID NO: 2862145 - RNA, 17 nt, Human
acaauguucuuuauaua

SEQ ID NO: 2862146 - RNA, 16 nt, Human
acaauuuccuuuauau

SEQ ID NO: 2862147 - RNA, 17 nt, Human
acaauuuccuuuauauu

SEQ ID NO: 2862148 - RNA, 21 nt, Human
acaauuaaaaaccugauggaa

SEQ ID NO: 2862149 - RNA, 23 nt, Human
acaauuugggcuuccuguuugua

SEQ ID NO: 2862150 - RNA, 20 nt, Human
acaauuugcacuaaaucaga

SEQ ID NO: 2862151 - RNA, 20 nt, Human
acaauuuccuuuauauuuag

SEQ ID NO: 2862152 - RNA, 23 nt, Human
acaauuuccuuuauauuuaguga

SEQ ID NO: 2862153 - RNA, 13 nt, Human
acaauuugauaca

SEQ ID NO: 2862154 - RNA, 14 nt, Human
acaauuugauacau

SEQ ID NO: 2862155 - RNA, 15 nt, Human
acaauuugauacaua

SEQ ID NO: 2862156 - RNA, 16 nt, Human
acaauuugauacauaa

SEQ ID NO: 2862157 - RNA, 17 nt, Human
acaauuugauacauaau

SEQ ID NO: 2862158 - RNA, 18 nt, Human
acaauuugauacauaaua

SEQ ID NO: 2862159 - RNA, 21 nt, Human
acaauuugauacauaauaaaa

SEQ ID NO: 2862160 - RNA, 12 nt, Human
acaccagagccc

SEQ ID NO: 2862161 - RNA, 16 nt, Human
acacgcuccuuccucu

SEQ ID NO: 2862162 - RNA, 18 nt, Human
acaccagagcagaugcag

SEQ ID NO: 2862163 - RNA, 19 nt, Human
acaccagagcagaugcaga

SEQ ID NO: 2862164 - RNA, 20 nt, Human
acaccagagcagaugcagag

SEQ ID NO: 2862165 - RNA, 22 nt, Human
acaccagagcagaugcagagag

SEQ ID NO: 2862166 - RNA, 19 nt, Human
acacgcuccuuccucugag

SEQ ID NO: 2862167 - RNA, 17 nt, Human
acacgcuccuuccucug

SEQ ID NO: 2862168 - RNA, 14 nt, Human
acaccagacagaca

SEQ ID NO: 2862169 - RNA, 13 nt, Human
acaccagagcaga

SEQ ID NO: 2862170 - RNA, 17 nt, Human
acaccagagcagaugca

SEQ ID NO: 2862171 - RNA, 18 nt, Human
acaccacagacacacaca

SEQ ID NO: 2862172 - RNA, 21 nt, Human
acaccacagacacacacacgc

SEQ ID NO: 2862173 - RNA, 22 nt, Human
acaccacagacacacacacgca

SEQ ID NO: 2862174 - RNA, 17 nt, Human
acaccacacccagccuc

SEQ ID NO: 2862175 - RNA, 18 nt, Human
acaccacacccagccuca

SEQ ID NO: 2862176 - RNA, 12 nt, Human
acaccacagaca

SEQ ID NO: 2862177 - RNA, 13 nt, Human
acaccacagacac

SEQ ID NO: 2862178 - RNA, 14 nt, Human
acaccacagacaca

SEQ ID NO: 2862179 - RNA, 15 nt, Human
acaccacagacacac

SEQ ID NO: 2862180 - RNA, 16 nt, Human
acaccacagacacaca

SEQ ID NO: 2862181 - RNA, 17 nt, Human
acaccacagacacacac

SEQ ID NO: 2862182 - RNA, 12 nt, Human
acacagcucugu

SEQ ID NO: 2862183 - RNA, 11 nt, Human
acacagcucug

SEQ ID NO: 2862184 - RNA, 21 nt, Human
acacagcuaacacacagcucc

SEQ ID NO: 2862185 - RNA, 11 nt, Human
acaccacacac

SEQ ID NO: 2862186 - RNA, 12 nt, Human
acaccacacaca

SEQ ID NO: 2862187 - RNA, 13 nt, Human
acaccacacacaa

SEQ ID NO: 2862188 - RNA, 16 nt, Human
acaccacacacaacag

SEQ ID NO: 2862189 - RNA, 17 nt, Human
acaccacacacaacagc

SEQ ID NO: 2862190 - RNA, 19 nt, Human
acaccacacacaacagcca

SEQ ID NO: 2862191 - RNA, 20 nt, Human
acaccacacacaacagccaa

SEQ ID NO: 2862192 - RNA, 13 nt, Human
acaccacacccag

SEQ ID NO: 2862193 - RNA, 14 nt, Human
acaccacacccagc

SEQ ID NO: 2862194 - RNA, 15 nt, Human
acaccacacccagcc

SEQ ID NO: 2862195 - RNA, 16 nt, Human
acaccacacccagccu

SEQ ID NO: 2862196 - RNA, 11 nt, Human
acacagaccac

SEQ ID NO: 2862197 - RNA, 12 nt, Human
acacagaccacc

SEQ ID NO: 2862198 - RNA, 23 nt, Human
acacagacugcgauuugucccag

SEQ ID NO: 2862199 - RNA, 14 nt, Human
acacagccugggcc

SEQ ID NO: 2862200 - RNA, 20 nt, Human
acacagccugggccccagcu

SEQ ID NO: 2862201 - RNA, 17 nt, Human
acacagcgucccuagca

SEQ ID NO: 2862202 - RNA, 18 nt, Human
acacagcgucccuagcag

SEQ ID NO: 2862203 - RNA, 21 nt, Human
acacagcgucccuagcaguga

SEQ ID NO: 2862204 - RNA, 18 nt, Human
acacagccugggccccag

SEQ ID NO: 2862205 - RNA, 23 nt, Human
acacagacucauccugaacagca

SEQ ID NO: 2862206 - RNA, 19 nt, Human
acacagccugggccccagc

SEQ ID NO: 2862207 - RNA, 20 nt, Human
acacagcuaacacacagcuc

SEQ ID NO: 2862208 - RNA, 23 nt, Human
acacagcuaacacacagcuccca

SEQ ID NO: 2862209 - RNA, 15 nt, Human
acacagcuacagcuu

SEQ ID NO: 2862210 - RNA, 13 nt, Human
acacagaaaccuu

SEQ ID NO: 2862211 - RNA, 19 nt, Human
acacagaaaccuuuuuaaa

SEQ ID NO: 2862212 - RNA, 18 nt, Human
acacagaaaccuuuuuaa

SEQ ID NO: 2862213 - RNA, 21 nt, Human
acacagaaaccuuuuuaaaaa

SEQ ID NO: 2862214 - RNA, 12 nt, Human
acacagaaauau

SEQ ID NO: 2862215 - RNA, 14 nt, Human
acacagaaauauau

SEQ ID NO: 2862216 - RNA, 16 nt, Human
acacagaaauauauau

SEQ ID NO: 2862217 - RNA, 21 nt, Human
acacagaaauauauauacaua

SEQ ID NO: 2862218 - RNA, 15 nt, Human
acacuaaccacgcug

SEQ ID NO: 2862219 - RNA, 14 nt, Human
acacuaaccacgcu

SEQ ID NO: 2862220 - RNA, 18 nt, Human
acacggagcccagcccuc

SEQ ID NO: 2862221 - RNA, 22 nt, Human
acacggagcccagcccucccca

SEQ ID NO: 2862222 - RNA, 14 nt, Human
acacuaaaaauaaa

SEQ ID NO: 2862223 - RNA, 12 nt, Human
acacuaaaauuu

SEQ ID NO: 2862224 - RNA, 14 nt, Human
acacuaaaauuuua

SEQ ID NO: 2862225 - RNA, 15 nt, Human
acacuaaaauuuuag

SEQ ID NO: 2862226 - RNA, 18 nt, Human
acacuaaaauuuuaggca

SEQ ID NO: 2862227 - RNA, 15 nt, Human
acacgcuguucuaau

SEQ ID NO: 2862228 - RNA, 17 nt, Human
acacuaaagauccaaga

SEQ ID NO: 2862229 - RNA, 14 nt, Human
acacuaaccaaauc

SEQ ID NO: 2862230 - RNA, 18 nt, Human
acacuaaccaaaucucuc

SEQ ID NO: 2862231 - RNA, 14 nt, Human
acagcuccucccac

SEQ ID NO: 2862232 - RNA, 13 nt, Human
acagcucuagaca

SEQ ID NO: 2862233 - RNA, 15 nt, Human
acagcucugacuuua

SEQ ID NO: 2862234 - RNA, 17 nt, Human
acagcucugacuuuaca

SEQ ID NO: 2862235 - RNA, 14 nt, Human
acagcuccuucugu

SEQ ID NO: 2862236 - RNA, 13 nt, Human
acagcuccuucug

SEQ ID NO: 2862237 - RNA, 12 nt, Human
acagcuccuucu

SEQ ID NO: 2862238 - RNA, 23 nt, Human
acaggugugaaccaccacaccca

SEQ ID NO: 2862239 - RNA, 20 nt, Human
acaggugugaaccaccacac

SEQ ID NO: 2862240 - RNA, 22 nt, Human
acaggugugagccaccacgccc

SEQ ID NO: 2862241 - RNA, 15 nt, Human
acaggucccuccccu

SEQ ID NO: 2862242 - RNA, 13 nt, Human
acaggucuagacu

SEQ ID NO: 2862243 - RNA, 21 nt, Human
acaggugugagccaccacgcc

SEQ ID NO: 2862244 - RNA, 13 nt, Human
acaggucccuccc

SEQ ID NO: 2862245 - RNA, 13 nt, Human
acaggucccaccu

SEQ ID NO: 2862246 - RNA, 18 nt, Human
acaggucccaccuccagc

SEQ ID NO: 2862247 - RNA, 19 nt, Human
acaggucccaccuccagcc

SEQ ID NO: 2862248 - RNA, 20 nt, Human
acaggucccaccuccagccc

SEQ ID NO: 2862249 - RNA, 21 nt, Human
acaggucccaccuccagcccg

SEQ ID NO: 2862250 - RNA, 19 nt, Human
acaggucaggggugacaca

SEQ ID NO: 2862251 - RNA, 20 nt, Human
acaggucaggggugacacag

SEQ ID NO: 2862252 - RNA, 21 nt, Human
acaggucaggggugacacaga

SEQ ID NO: 2862253 - RNA, 22 nt, Human
acaggucaggggugacacagac

SEQ ID NO: 2862254 - RNA, 12 nt, Human
acagguauuuug

SEQ ID NO: 2862255 - RNA, 17 nt, Human
acagguauuuuguuucu

SEQ ID NO: 2862256 - RNA, 18 nt, Human
acagguauuuuguuucuu

SEQ ID NO: 2862257 - RNA, 21 nt, Human
acagguauuuuguuucuuuua

SEQ ID NO: 2862258 - RNA, 15 nt, Human
acagguaauauaaaa

SEQ ID NO: 2862259 - RNA, 18 nt, Human
acagguaaacuaucuugg

SEQ ID NO: 2862260 - RNA, 16 nt, Human
acaggcaagcaccucc

SEQ ID NO: 2862261 - RNA, 15 nt, Human
acaggcaagcaccuc

SEQ ID NO: 2862262 - RNA, 18 nt, Human
acaggcaagcaccuccug

SEQ ID NO: 2862263 - RNA, 21 nt, Human
acagcugcucaauaaaguaca

SEQ ID NO: 2862264 - RNA, 15 nt, Human
acagcucgauccaaa

SEQ ID NO: 2862265 - RNA, 12 nt, Human
acagcucuggcc

SEQ ID NO: 2862266 - RNA, 15 nt, Human
acagcucuggccaca

SEQ ID NO: 2862267 - RNA, 22 nt, Human
acaggggcgugaggucccagga

SEQ ID NO: 2862268 - RNA, 16 nt, Human
acaggggaggugauag

SEQ ID NO: 2862269 - RNA, 22 nt, Human
acaggggaggugauagcauugc

SEQ ID NO: 2862270 - RNA, 23 nt, Human
acaggggaggugauagcauugcu

SEQ ID NO: 2862271 - RNA, 18 nt, Human
acaggguaacugugcuga

SEQ ID NO: 2862272 - RNA, 23 nt, Human
acaggguaacugugcugaaugcu

SEQ ID NO: 2862273 - RNA, 20 nt, Human
acagccacuccccuccacuc

SEQ ID NO: 2862274 - RNA, 14 nt, Human
acagccagggggau

SEQ ID NO: 2862275 - RNA, 19 nt, Human
acagccacggccaggccag

SEQ ID NO: 2862276 - RNA, 16 nt, Human
acagcauggcacuccc

SEQ ID NO: 2862277 - RNA, 17 nt, Human
acagcauggcacucccu

SEQ ID NO: 2862278 - RNA, 23 nt, Human
acagcauggcacucccuccagca

SEQ ID NO: 2862279 - RNA, 14 nt, Human
acagcaucuguagu

SEQ ID NO: 2862280 - RNA, 12 nt, Human
acagcaugugcc

SEQ ID NO: 2862281 - RNA, 15 nt, Human
acagcaugugcccuc

SEQ ID NO: 2862282 - RNA, 16 nt, Human
acagcaugugcccucc

SEQ ID NO: 2862283 - RNA, 18 nt, Human
acagcaugugcccuccug

SEQ ID NO: 2862284 - RNA, 20 nt, Human
acagcaugugcccuccugag

SEQ ID NO: 2862285 - RNA, 21 nt, Human
acagccagugggagauguuag

SEQ ID NO: 2862286 - RNA, 16 nt, Human
acagccaugcccgcau

SEQ ID NO: 2862287 - RNA, 13 nt, Human
acagcaguguucc

SEQ ID NO: 2862288 - RNA, 19 nt, Human
acagcaguguuccccaucu

SEQ ID NO: 2862289 - RNA, 21 nt, Human
acagcauccccaaaacaaagu

SEQ ID NO: 2862290 - RNA, 22 nt, Human
acagcauccccaaaacaaaguc

SEQ ID NO: 2862291 - RNA, 19 nt, Human
acagagucucacuguugcc

SEQ ID NO: 2862292 - RNA, 17 nt, Human
acagagucucacuguug

SEQ ID NO: 2862293 - RNA, 13 nt, Human
acagcaguagaca

SEQ ID NO: 2862294 - RNA, 15 nt, Human
acagcaguagacauu

SEQ ID NO: 2862295 - RNA, 16 nt, Human
acagcaguagacauuu

SEQ ID NO: 2862296 - RNA, 20 nt, Human
acagcaguagacauuuuaac

SEQ ID NO: 2862297 - RNA, 24 nt, Human
acagcaguagacauuuuaacaaga

SEQ ID NO: 2862298 - RNA, 18 nt, Human
acagcagguccuccaucc

SEQ ID NO: 2862299 - RNA, 14 nt, Human
acagagucucacug

SEQ ID NO: 2862300 - RNA, 12 nt, Human
acagagucucac

SEQ ID NO: 2862301 - RNA, 13 nt, Human
acagaguaagaca

SEQ ID NO: 2862302 - RNA, 14 nt, Human
acagaguaagacau

SEQ ID NO: 2862303 - RNA, 15 nt, Human
acagaguaagacauu

SEQ ID NO: 2862304 - RNA, 16 nt, Human
acagaguaagacauug

SEQ ID NO: 2862305 - RNA, 17 nt, Human
acagaguaagacauugg

SEQ ID NO: 2862306 - RNA, 19 nt, Human
acagagggucacaguguuu

SEQ ID NO: 2862307 - RNA, 22 nt, Human
acagagggucacaguguuuaca

SEQ ID NO: 2862308 - RNA, 23 nt, Human
acagaguaugaacaccugggcuu

SEQ ID NO: 2862309 - RNA, 18 nt, Human
acagaagucaugaagccc

SEQ ID NO: 2862310 - RNA, 13 nt, Human
acagaaguccugu

SEQ ID NO: 2862311 - RNA, 14 nt, Human
acagaaguccugua

SEQ ID NO: 2862312 - RNA, 15 nt, Human
acagaaguccuguau

SEQ ID NO: 2862313 - RNA, 21 nt, Human
acagaaguccuguaugucugu

SEQ ID NO: 2862314 - RNA, 22 nt, Human
acagaaguccuguaugucuguc

SEQ ID NO: 2862315 - RNA, 22 nt, Human
acacugccuuuuuauuuauaug

SEQ ID NO: 2862316 - RNA, 23 nt, Human
acacugccuuuuuauuuauaugu

SEQ ID NO: 2862317 - RNA, 18 nt, Human
acacugcgcuuuauuuuc

SEQ ID NO: 2862318 - RNA, 21 nt, Human
acacugcgcuuuauuuucuua

SEQ ID NO: 2862319 - RNA, 20 nt, Human
acacugccuuuuuauuuaua

SEQ ID NO: 2862320 - RNA, 19 nt, Human
acacugccuuuuuauuuau

SEQ ID NO: 2862321 - RNA, 16 nt, Human
acacugccugggcuga

SEQ ID NO: 2862322 - RNA, 14 nt, Human
acacugccuguaua

SEQ ID NO: 2862323 - RNA, 16 nt, Human
acacugccuguauacu

SEQ ID NO: 2862324 - RNA, 18 nt, Human
acacugccuguauacuuu

SEQ ID NO: 2862325 - RNA, 19 nt, Human
acacugccuguauacuuua

SEQ ID NO: 2862326 - RNA, 20 nt, Human
acacugccuguauacuuuag

SEQ ID NO: 2862327 - RNA, 22 nt, Human
acacugccuguauacuuuagua

SEQ ID NO: 2862328 - RNA, 15 nt, Human
acacugccugggcug

SEQ ID NO: 2862329 - RNA, 14 nt, Human
acacugccugggcu

SEQ ID NO: 2862330 - RNA, 13 nt, Human
acacugccugggc

SEQ ID NO: 2862331 - RNA, 12 nt, Human
acacugccuggg

SEQ ID NO: 2862332 - RNA, 17 nt, Human
acacugucaugcuucau

SEQ ID NO: 2862333 - RNA, 21 nt, Human
acacugucaugcuucaucauu

SEQ ID NO: 2862334 - RNA, 21 nt, Human
acacuguauuuguaucucuga

SEQ ID NO: 2862335 - RNA, 22 nt, Human
acacugucugguuucaccgagg

SEQ ID NO: 2862336 - RNA, 13 nt, Human
acacugugacaca

SEQ ID NO: 2862337 - RNA, 15 nt, Human
acacugugacacacu

SEQ ID NO: 2862338 - RNA, 18 nt, Human
acacugugacacacuaca

SEQ ID NO: 2862339 - RNA, 19 nt, Human
acacugugacacacuacac

SEQ ID NO: 2862340 - RNA, 13 nt, Human
acacugugcuaua

SEQ ID NO: 2862341 - RNA, 15 nt, Human
acacugugcuauaaa

SEQ ID NO: 2862342 - RNA, 22 nt, Human
acacugugcccagcccggaccu

SEQ ID NO: 2862343 - RNA, 23 nt, Human
acacugugcccagcccggaccuu

SEQ ID NO: 2862344 - RNA, 21 nt, Human
acagaacacauaauucaggaa

SEQ ID NO: 2862345 - RNA, 18 nt, Human
acagaacagcuucagguu

SEQ ID NO: 2862346 - RNA, 20 nt, Human
acagaacagcuucagguuau

SEQ ID NO: 2862347 - RNA, 13 nt, Human
acagaacaggguc

SEQ ID NO: 2862348 - RNA, 14 nt, Human
acagaacaggguca

SEQ ID NO: 2862349 - RNA, 15 nt, Human
acagaacagggucau

SEQ ID NO: 2862350 - RNA, 12 nt, Human
acagaacagcuu

SEQ ID NO: 2862351 - RNA, 13 nt, Human
acagaacagcuuc

SEQ ID NO: 2862352 - RNA, 14 nt, Human
acagaacagcuuca

SEQ ID NO: 2862353 - RNA, 15 nt, Human
acagaacagcuucag

SEQ ID NO: 2862354 - RNA, 16 nt, Human
acagaacagcuucagg

SEQ ID NO: 2862355 - RNA, 17 nt, Human
acagaacagcuucaggu

SEQ ID NO: 2862356 - RNA, 18 nt, Human
acagaagcacaugcaccu

SEQ ID NO: 2862357 - RNA, 14 nt, Human
acagaagcacaugc

SEQ ID NO: 2862358 - RNA, 17 nt, Human
acagaagucaugaagcc

SEQ ID NO: 2862359 - RNA, 22 nt, Human
acagaagcaguugagucgucau

SEQ ID NO: 2862360 - RNA, 12 nt, Human
acagaagcauuu

SEQ ID NO: 2862361 - RNA, 13 nt, Human
acagaagcauuug

SEQ ID NO: 2862362 - RNA, 14 nt, Human
acagaagcauuugu

SEQ ID NO: 2862363 - RNA, 15 nt, Human
acagaagcauuugua

SEQ ID NO: 2862364 - RNA, 16 nt, Human
acagaagcauuuguau

SEQ ID NO: 2862365 - RNA, 17 nt, Human
acagaagcauuuguauu

SEQ ID NO: 2862366 - RNA, 20 nt, Human
acagaagcauuuguauuuug

SEQ ID NO: 2862367 - RNA, 21 nt, Human
acagaagcauuuguauuuugu

SEQ ID NO: 2862368 - RNA, 22 nt, Human
acagaagcauuuguauuuugug

SEQ ID NO: 2862369 - RNA, 23 nt, Human
acagaagcauuuguauuuugugu

SEQ ID NO: 2862370 - RNA, 22 nt, Human
acacugccaucuuaguuuggau

SEQ ID NO: 2862371 - RNA, 15 nt, Human
acacugcccucgcac

SEQ ID NO: 2862372 - RNA, 22 nt, Human
acacugaugcuuagauguucca

SEQ ID NO: 2862373 - RNA, 14 nt, Human
acacugagcuguca

SEQ ID NO: 2862374 - RNA, 17 nt, Human
acacugaccauccacuc

SEQ ID NO: 2862375 - RNA, 22 nt, Human
acacugaccuuggagagacaca

SEQ ID NO: 2862376 - RNA, 23 nt, Human
acacugaccuuggagagacacag

SEQ ID NO: 2862377 - RNA, 13 nt, Human
acacugacuugag

SEQ ID NO: 2862378 - RNA, 14 nt, Human
acauguuauauauu

SEQ ID NO: 2862379 - RNA, 15 nt, Human
acauguuauauauuu

SEQ ID NO: 2862380 - RNA, 14 nt, Human
acauguuguaaauu

SEQ ID NO: 2862381 - RNA, 21 nt, Human
acauguuguaaauuaggaggc

SEQ ID NO: 2862382 - RNA, 21 nt, Human
acaugcaauuuauuaaaauga

SEQ ID NO: 2862383 - RNA, 11 nt, Human
acaugcacaca

SEQ ID NO: 2862384 - RNA, 12 nt, Human
acaugcacacac

SEQ ID NO: 2862385 - RNA, 21 nt, Human
acauuaaaggcauaaaugacu

SEQ ID NO: 2862386 - RNA, 23 nt, Human
acauguuuuuguuuucuuugaau

SEQ ID NO: 2862387 - RNA, 15 nt, Human
acauuaaaaaaugaa

SEQ ID NO: 2862388 - RNA, 14 nt, Human
acauuaaaaaugga

SEQ ID NO: 2862389 - RNA, 15 nt, Human
acauuaaaaauggaa

SEQ ID NO: 2862390 - RNA, 16 nt, Human
acauuaaaaauggaac

SEQ ID NO: 2862391 - RNA, 18 nt, Human
acauaaagguaaaacaaa

SEQ ID NO: 2862392 - RNA, 11 nt, Human
acaucagccag

SEQ ID NO: 2862393 - RNA, 12 nt, Human
acaucagccagc

SEQ ID NO: 2862394 - RNA, 13 nt, Human
acaucagccagcu

SEQ ID NO: 2862395 - RNA, 14 nt, Human
acaucagccagcug

SEQ ID NO: 2862396 - RNA, 20 nt, Human
acauaaauugcauaaagcau

SEQ ID NO: 2862397 - RNA, 11 nt, Human
acauaaaugca

SEQ ID NO: 2862398 - RNA, 16 nt, Human
acauaaaugcagccca

SEQ ID NO: 2862399 - RNA, 17 nt, Human
acauaaaugcagcccau

SEQ ID NO: 2862400 - RNA, 16 nt, Human
acaucgcgaugggaac

SEQ ID NO: 2862401 - RNA, 18 nt, Human
acauccuuugcagggcag

SEQ ID NO: 2862402 - RNA, 19 nt, Human
acauccuuugcagggcagc

SEQ ID NO: 2862403 - RNA, 20 nt, Human
acauccuuugcagggcagcc

SEQ ID NO: 2862404 - RNA, 21 nt, Human
acauccuuugcagggcagccc

SEQ ID NO: 2862405 - RNA, 23 nt, Human
acauccuuugcagggcagcccca

SEQ ID NO: 2862406 - RNA, 12 nt, Human
acauccacccca

SEQ ID NO: 2862407 - RNA, 18 nt, Human
acauccauguuuguaaaa

SEQ ID NO: 2862408 - RNA, 14 nt, Human
acaucccagcccaa

SEQ ID NO: 2862409 - RNA, 23 nt, Human
acaucccagcccaauccagguac

SEQ ID NO: 2862410 - RNA, 11 nt, Human
acauccauguc

SEQ ID NO: 2862411 - RNA, 13 nt, Human
acauccauguccu

SEQ ID NO: 2862412 - RNA, 21 nt, Human
acauccauguccuauguguga

SEQ ID NO: 2862413 - RNA, 20 nt, Human
acauccauguuuguaaaacu

SEQ ID NO: 2862414 - RNA, 13 nt, Human
acauccauuccca

SEQ ID NO: 2862415 - RNA, 17 nt, Human
acauccauucccaagaa

SEQ ID NO: 2862416 - RNA, 18 nt, Human
acauccauucccaagaaa

SEQ ID NO: 2862417 - RNA, 20 nt, Human
acauccauucccaagaaaug

SEQ ID NO: 2862418 - RNA, 21 nt, Human
acauccauucccaagaaaugc

SEQ ID NO: 2862419 - RNA, 22 nt, Human
acauaaaaaggacaucagcaaa

SEQ ID NO: 2862420 - RNA, 21 nt, Human
acauaaaaaggacaucagcaa

SEQ ID NO: 2862421 - RNA, 20 nt, Human
acauaaaaaggacaucagca

SEQ ID NO: 2862422 - RNA, 14 nt, Human
acauaaaagaauuu

SEQ ID NO: 2862423 - RNA, 11 nt, Human
acauaaaacaa

SEQ ID NO: 2862424 - RNA, 14 nt, Human
acauaaaaaggaca

SEQ ID NO: 2862425 - RNA, 13 nt, Human
acauaaacaauga

SEQ ID NO: 2862426 - RNA, 16 nt, Human
acauaaagccauguuu

SEQ ID NO: 2862427 - RNA, 15 nt, Human
acauaaaaaggacau

SEQ ID NO: 2862428 - RNA, 16 nt, Human
acagguuuucacauaa

SEQ ID NO: 2862429 - RNA, 15 nt, Human
acagguuggaagaga

SEQ ID NO: 2862430 - RNA, 16 nt, Human
acagguuggaagagaa

SEQ ID NO: 2862431 - RNA, 20 nt, Human
acagguuggaagagaaucac

SEQ ID NO: 2862432 - RNA, 12 nt, Human
acauuuggaaua

SEQ ID NO: 2862433 - RNA, 20 nt, Human
acauuuggaacuaacacgug

SEQ ID NO: 2862434 - RNA, 21 nt, Human
acauuuggaacuaacacguga

SEQ ID NO: 2862435 - RNA, 15 nt, Human
acauuuguacagaau

SEQ ID NO: 2862436 - RNA, 17 nt, Human
acauuuguacagaauuu

SEQ ID NO: 2862437 - RNA, 17 nt, Human
accaacguuacucaggg

SEQ ID NO: 2862438 - RNA, 20 nt, Human
accaacguuacucagggcuc

SEQ ID NO: 2862439 - RNA, 21 nt, Human
accaacguuacucagggcucc

SEQ ID NO: 2862440 - RNA, 23 nt, Human
accaacugucacucauugcugag

SEQ ID NO: 2862441 - RNA, 11 nt, Human
accaacugugu

SEQ ID NO: 2862442 - RNA, 13 nt, Human
accaacuguguug

SEQ ID NO: 2862443 - RNA, 15 nt, Human
accaacuguguugua

SEQ ID NO: 2862444 - RNA, 16 nt, Human
accaacuguguuguau

SEQ ID NO: 2862445 - RNA, 18 nt, Human
accaacuguguuguauua

SEQ ID NO: 2862446 - RNA, 21 nt, Human
accaacuguguuguauuaaca

SEQ ID NO: 2862447 - RNA, 22 nt, Human
accaacuguguuguauuaacaa

SEQ ID NO: 2862448 - RNA, 23 nt, Human
accaacuguguuguauuaacaaa

SEQ ID NO: 2862449 - RNA, 14 nt, Human
accaacugggccca

SEQ ID NO: 2862450 - RNA, 14 nt, Human
acauuuguaguuga

SEQ ID NO: 2862451 - RNA, 17 nt, Human
acauuuguaguuggagu

SEQ ID NO: 2862452 - RNA, 18 nt, Human
acauuuggaauacuuuuu

SEQ ID NO: 2862453 - RNA, 17 nt, Human
acauuuggaauacuuuu

SEQ ID NO: 2862454 - RNA, 16 nt, Human
acauuuggaauacuuu

SEQ ID NO: 2862455 - RNA, 15 nt, Human
acauuuggaauacuu

SEQ ID NO: 2862456 - RNA, 19 nt, Human
acauuuggauaaacaacau

SEQ ID NO: 2862457 - RNA, 17 nt, Human
accagcaucaccugccu

SEQ ID NO: 2862458 - RNA, 16 nt, Human
accagcaucaccugcc

SEQ ID NO: 2862459 - RNA, 17 nt, Human
accacuacaugcagccc

SEQ ID NO: 2862460 - RNA, 16 nt, Human
accacuaacuccugag

SEQ ID NO: 2862461 - RNA, 17 nt, Human
accacuaacuccugaga

SEQ ID NO: 2862462 - RNA, 20 nt, Human
accacgcccggcuaauuuuu

SEQ ID NO: 2862463 - RNA, 14 nt, Human
accacgcccggcua

SEQ ID NO: 2862464 - RNA, 11 nt, Human
accaaggaaac

SEQ ID NO: 2862465 - RNA, 20 nt, Human
accaaggaaacgcuaccucu

SEQ ID NO: 2862466 - RNA, 21 nt, Human
accaaggaaacgcuaccucuc

SEQ ID NO: 2862467 - RNA, 13 nt, Human
accaacuuucugu

SEQ ID NO: 2862468 - RNA, 17 nt, Human
accaagcuauccuggcu

SEQ ID NO: 2862469 - RNA, 14 nt, Human
accaagcuauuccu

SEQ ID NO: 2862470 - RNA, 19 nt, Human
accaagcuauuccuuuccc

SEQ ID NO: 2862471 - RNA, 21 nt, Human
accaagcuauuccuuucccuu

SEQ ID NO: 2862472 - RNA, 22 nt, Human
accaagcuauuccuuucccuuc

SEQ ID NO: 2862473 - RNA, 15 nt, Human
accaagcuauccugg

SEQ ID NO: 2862474 - RNA, 14 nt, Human
accaacuuucugua

SEQ ID NO: 2862475 - RNA, 12 nt, Human
accaacuuucug

SEQ ID NO: 2862476 - RNA, 20 nt, Human
accaacuugguucugcuuca

SEQ ID NO: 2862477 - RNA, 22 nt, Human
accaacuugguucugcuucaau

SEQ ID NO: 2862478 - RNA, 19 nt, Human
accagcaucaccugccugu

SEQ ID NO: 2862479 - RNA, 18 nt, Human
accagcaucaccugccug

SEQ ID NO: 2862480 - RNA, 22 nt, Human
accagcaucccuugaccaggcc

SEQ ID NO: 2862481 - RNA, 10 nt, Human
accaacugug

SEQ ID NO: 2862482 - RNA, 12 nt, Human
acccaauuuccc

SEQ ID NO: 2862483 - RNA, 14 nt, Human
acccacaaaaaugu

SEQ ID NO: 2862484 - RNA, 14 nt, Human
acccaauccaaaug

SEQ ID NO: 2862485 - RNA, 13 nt, Human
acccaauccaaau

SEQ ID NO: 2862486 - RNA, 19 nt, Human
acccaucuaguacuugaaa

SEQ ID NO: 2862487 - RNA, 13 nt, Human
acccaucugggcu

SEQ ID NO: 2862488 - RNA, 11 nt, Human
acccaugaaaa

SEQ ID NO: 2862489 - RNA, 17 nt, Human
acccaagggcagaaagu

SEQ ID NO: 2862490 - RNA, 20 nt, Human
acccaagggcagaaaguaga

SEQ ID NO: 2862491 - RNA, 17 nt, Human
acccaauagcugcccau

SEQ ID NO: 2862492 - RNA, 21 nt, Human
acccaauagcugcccauuucg

SEQ ID NO: 2862493 - RNA, 13 nt, Human
acccaaggacuga

SEQ ID NO: 2862494 - RNA, 20 nt, Human
acccaugaggcaaugucagg

SEQ ID NO: 2862495 - RNA, 13 nt, Human
acccaugaggcaa

SEQ ID NO: 2862496 - RNA, 20 nt, Human
acccaugaagacaggacagu

SEQ ID NO: 2862497 - RNA, 12 nt, Human
acccaugaagau

SEQ ID NO: 2862498 - RNA, 19 nt, Human
acccaugaagacaggacag

SEQ ID NO: 2862499 - RNA, 23 nt, Human
acccaugacuuuauauggaugau

SEQ ID NO: 2862500 - RNA, 14 nt, Human
acccauuuucacau

SEQ ID NO: 2862501 - RNA, 16 nt, Human
accccaaacaccuucc

SEQ ID NO: 2862502 - RNA, 18 nt, Human
accccaaacaccuuccag

SEQ ID NO: 2862503 - RNA, 20 nt, Human
accccaaacaccuuccagcu

SEQ ID NO: 2862504 - RNA, 23 nt, Human
accccaaacaccuuccagcuccu

SEQ ID NO: 2862505 - RNA, 19 nt, Human
accccgccugcccucaugg

SEQ ID NO: 2862506 - RNA, 13 nt, Human
accccggcaggcc

SEQ ID NO: 2862507 - RNA, 14 nt, Human
accccggcaggccc

SEQ ID NO: 2862508 - RNA, 15 nt, Human
accccggcaggcccu

SEQ ID NO: 2862509 - RNA, 16 nt, Human
accccggcaggcccug

SEQ ID NO: 2862510 - RNA, 17 nt, Human
accccggcaggcccugc

SEQ ID NO: 2862511 - RNA, 18 nt, Human
accccggcaggcccugca

SEQ ID NO: 2862512 - RNA, 19 nt, Human
accccggcaggcccugcag

SEQ ID NO: 2862513 - RNA, 20 nt, Human
accccggcaggcccugcagu

SEQ ID NO: 2862514 - RNA, 21 nt, Human
accccggcaggcccugcagug

SEQ ID NO: 2862515 - RNA, 22 nt, Human
accccggcaggcccugcagugu

SEQ ID NO: 2862516 - RNA, 15 nt, Human
accccgggcucucug

SEQ ID NO: 2862517 - RNA, 13 nt, Human
accccgggcucuc

SEQ ID NO: 2862518 - RNA, 21 nt, Human
accccgggcucucugcuguac

SEQ ID NO: 2862519 - RNA, 18 nt, Human
accccgggcucucugcug

SEQ ID NO: 2862520 - RNA, 17 nt, Human
accccgggcucucugcu

SEQ ID NO: 2862521 - RNA, 16 nt, Human
accccgggcucucugc

SEQ ID NO: 2862522 - RNA, 21 nt, Human
accccgguggcggccccagca

SEQ ID NO: 2862523 - RNA, 19 nt, Human
accccgguggcggccccag

SEQ ID NO: 2862524 - RNA, 20 nt, Human
accccgucgaggggcucuca

SEQ ID NO: 2862525 - RNA, 15 nt, Human
accccguuacagcuc

SEQ ID NO: 2862526 - RNA, 18 nt, Human
accccguuacagcucccc

SEQ ID NO: 2862527 - RNA, 20 nt, Human
accccguuacagcuccccaa

SEQ ID NO: 2862528 - RNA, 22 nt, Human
accccuaaagagauacuuugau

SEQ ID NO: 2862529 - RNA, 14 nt, Human
accccuaguucccu

SEQ ID NO: 2862530 - RNA, 15 nt, Human
accccuaguucccuc

SEQ ID NO: 2862531 - RNA, 17 nt, Human
accccuaguucccucug

SEQ ID NO: 2862532 - RNA, 19 nt, Human
accccuaguucccucugcu

SEQ ID NO: 2862533 - RNA, 20 nt, Human
accccuaguucccucugcuc

SEQ ID NO: 2862534 - RNA, 21 nt, Human
accccuaguucccucugcuca

SEQ ID NO: 2862535 - RNA, 14 nt, Human
accccgccugcccu

SEQ ID NO: 2862536 - RNA, 14 nt, Human
accccgaggcccug

SEQ ID NO: 2862537 - RNA, 15 nt, Human
accccgaggcccugc

SEQ ID NO: 2862538 - RNA, 16 nt, Human
accccgaggcccugca

SEQ ID NO: 2862539 - RNA, 17 nt, Human
accccgaggcccugcau

SEQ ID NO: 2862540 - RNA, 20 nt, Human
accccgaggcccugcauggg

SEQ ID NO: 2862541 - RNA, 17 nt, Human
accccgauguggaccuc

SEQ ID NO: 2862542 - RNA, 18 nt, Human
accccgaccaccugccca

SEQ ID NO: 2862543 - RNA, 23 nt, Human
acccccuucucugcuccaccaca

SEQ ID NO: 2862544 - RNA, 20 nt, Human
acccccuucucugcuccacc

SEQ ID NO: 2862545 - RNA, 19 nt, Human
acccccuucucugcuccac

SEQ ID NO: 2862546 - RNA, 18 nt, Human
acccccuucucugcucca

SEQ ID NO: 2862547 - RNA, 17 nt, Human
acccccuucucugcucc

SEQ ID NO: 2862548 - RNA, 14 nt, Human
acccccuucucugc

SEQ ID NO: 2862549 - RNA, 16 nt, Human
acccccuucucugcuc

SEQ ID NO: 2862550 - RNA, 18 nt, Human
accccaaagccccuugcu

SEQ ID NO: 2862551 - RNA, 16 nt, Human
accccaaagccccuug

SEQ ID NO: 2862552 - RNA, 15 nt, Human
accccaaagccccuu

SEQ ID NO: 2862553 - RNA, 15 nt, Human
accccaacaaaccau

SEQ ID NO: 2862554 - RNA, 14 nt, Human
accaucaugucugg

SEQ ID NO: 2862555 - RNA, 17 nt, Human
accaucaugucuggcua

SEQ ID NO: 2862556 - RNA, 16 nt, Human
accaucaugucuggcu

SEQ ID NO: 2862557 - RNA, 15 nt, Human
acccaagcuuagaac

SEQ ID NO: 2862558 - RNA, 13 nt, Human
acccaagcuccuc

SEQ ID NO: 2862559 - RNA, 15 nt, Human
acccaagcuccuccu

SEQ ID NO: 2862560 - RNA, 17 nt, Human
acccaaggaaaacugca

SEQ ID NO: 2862561 - RNA, 21 nt, Human
acccaaggaaaacugcaugga

SEQ ID NO: 2862562 - RNA, 17 nt, Human
acccaaggacugaggga

SEQ ID NO: 2862563 - RNA, 15 nt, Human
acccaaggagcacag

SEQ ID NO: 2862564 - RNA, 16 nt, Human
acccaaggagcacagg

SEQ ID NO: 2862565 - RNA, 19 nt, Human
acccaaggagcacaggucc

SEQ ID NO: 2862566 - RNA, 21 nt, Human
acccaaggagcacagguccca

SEQ ID NO: 2862567 - RNA, 22 nt, Human
acccaaggagcacaggucccac

SEQ ID NO: 2862568 - RNA, 14 nt, Human
accccuaagagacu

SEQ ID NO: 2862569 - RNA, 16 nt, Human
accccuacaugaaaca

SEQ ID NO: 2862570 - RNA, 13 nt, Human
accccuaccccug

SEQ ID NO: 2862571 - RNA, 22 nt, Human
acuucuuuuauaacuaguccuu

SEQ ID NO: 2862572 - RNA, 15 nt, Human
acuucuuuuauaacu

SEQ ID NO: 2862573 - RNA, 21 nt, Human
acuucuuugcuuugcccagca

SEQ ID NO: 2862574 - RNA, 16 nt, Human
acuucuuugcuuugcc

SEQ ID NO: 2862575 - RNA, 18 nt, Human
acuucuuugcuuugccca

SEQ ID NO: 2862576 - RNA, 20 nt, Human
acuucuuugcuuugcccagc

SEQ ID NO: 2862577 - RNA, 12 nt, Human
acuucuuucuau

SEQ ID NO: 2862578 - RNA, 13 nt, Human
acuucuuucuauu

SEQ ID NO: 2862579 - RNA, 14 nt, Human
acuucuuucuauuu

SEQ ID NO: 2862580 - RNA, 18 nt, Human
acuucugccauauucugu

SEQ ID NO: 2862581 - RNA, 20 nt, Human
acuuguaaaugugguaaaga

SEQ ID NO: 2862582 - RNA, 17 nt, Human
acuuguaauauuuuuau

SEQ ID NO: 2862583 - RNA, 22 nt, Human
acuuguaauauuuuuauauaca

SEQ ID NO: 2862584 - RNA, 18 nt, Human
acuuguaaaugugguaaa

SEQ ID NO: 2862585 - RNA, 19 nt, Human
acuucuuuugcucuuagcu

SEQ ID NO: 2862586 - RNA, 13 nt, Human
acuuauuuaaugc

SEQ ID NO: 2862587 - RNA, 18 nt, Human
acuguuuuggguagcugc

SEQ ID NO: 2862588 - RNA, 19 nt, Human
acuguuuuggguagcugcc

SEQ ID NO: 2862589 - RNA, 22 nt, Human
acuguuuucucucggcucccca

SEQ ID NO: 2862590 - RNA, 23 nt, Human
acuguuuucucucggcuccccau

SEQ ID NO: 2862591 - RNA, 13 nt, Human
acuuauuguaaau

SEQ ID NO: 2862592 - RNA, 19 nt, Human
acuuauuguggauaacaaa

SEQ ID NO: 2862593 - RNA, 20 nt, Human
acuuauuguggauaacaaag

SEQ ID NO: 2862594 - RNA, 21 nt, Human
acuuauuguggauaacaaaga

SEQ ID NO: 2862595 - RNA, 22 nt, Human
acuuauuguggauaacaaagau

SEQ ID NO: 2862596 - RNA, 15 nt, Human
acuguuuauuucugu

SEQ ID NO: 2862597 - RNA, 19 nt, Human
acuguuuauuucuguuucu

SEQ ID NO: 2862598 - RNA, 22 nt, Human
acuguuuauuucuguuucucau

SEQ ID NO: 2862599 - RNA, 17 nt, Human
acuguuuauauguguug

SEQ ID NO: 2862600 - RNA, 21 nt, Human
acuguuuauauguguugaaaa

SEQ ID NO: 2862601 - RNA, 14 nt, Human
acuguuuuaucugg

SEQ ID NO: 2862602 - RNA, 13 nt, Human
acuguuuucaaau

SEQ ID NO: 2862603 - RNA, 18 nt, Human
acuguuuaauguucugug

SEQ ID NO: 2862604 - RNA, 20 nt, Human
acuguuuaauguucugugau

SEQ ID NO: 2862605 - RNA, 14 nt, Human
acuggaagcacagc

SEQ ID NO: 2862606 - RNA, 15 nt, Human
acuggaagcacagcu

SEQ ID NO: 2862607 - RNA, 21 nt, Human
acugccacacucuccaucacc

SEQ ID NO: 2862608 - RNA, 16 nt, Human
acugccacuuugcaca

SEQ ID NO: 2862609 - RNA, 17 nt, Human
acugccacuuugcacau

SEQ ID NO: 2862610 - RNA, 18 nt, Human
acugccacuuugcacauu

SEQ ID NO: 2862611 - RNA, 20 nt, Human
acugccacuuugcacauuuu

SEQ ID NO: 2862612 - RNA, 22 nt, Human
acugccacuuugcacauuuuga

SEQ ID NO: 2862613 - RNA, 18 nt, Human
acugcccccucugcccug

SEQ ID NO: 2862614 - RNA, 19 nt, Human
acugcccccucugcccugc

SEQ ID NO: 2862615 - RNA, 20 nt, Human
acugcccccucugcccugcg

SEQ ID NO: 2862616 - RNA, 14 nt, Human
acuggacuccggcc

SEQ ID NO: 2862617 - RNA, 16 nt, Human
acuggacuccggcccu

SEQ ID NO: 2862618 - RNA, 19 nt, Human
acuggacuccggcccuccu

SEQ ID NO: 2862619 - RNA, 14 nt, Human
acuggacucuucaa

SEQ ID NO: 2862620 - RNA, 19 nt, Human
acuggacucuucaaaaacu

SEQ ID NO: 2862621 - RNA, 22 nt, Human
acuggacucuucaaaaacuguu

SEQ ID NO: 2862622 - RNA, 18 nt, Human
acuggacuccggcccucc

SEQ ID NO: 2862623 - RNA, 22 nt, Human
acuggacuugagcuuggcagcu

SEQ ID NO: 2862624 - RNA, 14 nt, Human
acugggugucauuu

SEQ ID NO: 2862625 - RNA, 17 nt, Human
acugggugucauuucau

SEQ ID NO: 2862626 - RNA, 20 nt, Human
acugggugucauuucauucc

SEQ ID NO: 2862627 - RNA, 21 nt, Human
acugggugucauuucauucca

SEQ ID NO: 2862628 - RNA, 22 nt, Human
acugggugucauuucauuccau

SEQ ID NO: 2862629 - RNA, 20 nt, Human
acuggguuucucuguauagu

SEQ ID NO: 2862630 - RNA, 20 nt, Human
acuggguugacuuucaggua

SEQ ID NO: 2862631 - RNA, 13 nt, Human
acuggguugacuu

SEQ ID NO: 2862632 - RNA, 12 nt, Human
acucuuaaagca

SEQ ID NO: 2862633 - RNA, 13 nt, Human
acucuuaaagcaa

SEQ ID NO: 2862634 - RNA, 23 nt, Human
acugaaggcagcauguauaguug

SEQ ID NO: 2862635 - RNA, 13 nt, Human
acugaagugcuua

SEQ ID NO: 2862636 - RNA, 17 nt, Human
acugaagugcuuagugu

SEQ ID NO: 2862637 - RNA, 16 nt, Human
acugaaggugauucac

SEQ ID NO: 2862638 - RNA, 19 nt, Human
acugaaguagugugcaguu

SEQ ID NO: 2862639 - RNA, 18 nt, Human
acugccacacucuccauc

SEQ ID NO: 2862640 - RNA, 21 nt, Human
acugccaaagggaaauaucau

SEQ ID NO: 2862641 - RNA, 17 nt, Human
acugucuuuaaaagaga

SEQ ID NO: 2862642 - RNA, 18 nt, Human
acugucuuuaaaagagag

SEQ ID NO: 2862643 - RNA, 19 nt, Human
acugucuuuaaaagagaga

SEQ ID NO: 2862644 - RNA, 13 nt, Human
acugugaugaagc

SEQ ID NO: 2862645 - RNA, 21 nt, Human
acugugaugaagccgaccuua

SEQ ID NO: 2862646 - RNA, 23 nt, Human
acugugaugaagccgaccuuaga

SEQ ID NO: 2862647 - RNA, 17 nt, Human
acugucugguuuuaaca

SEQ ID NO: 2862648 - RNA, 18 nt, Human
acugucugguuuuaacaa

SEQ ID NO: 2862649 - RNA, 19 nt, Human
acugucugguuuuaacaau

SEQ ID NO: 2862650 - RNA, 13 nt, Human
acugucugguuuu

SEQ ID NO: 2862651 - RNA, 18 nt, Human
acugucugauuggcuugu

SEQ ID NO: 2862652 - RNA, 12 nt, Human
acugugcagagu

SEQ ID NO: 2862653 - RNA, 21 nt, Human
acugugcagagucuagaaguu

SEQ ID NO: 2862654 - RNA, 20 nt, Human
acugugcaggugcuauuguu

SEQ ID NO: 2862655 - RNA, 21 nt, Human
acugugcaggugcuauuguua

SEQ ID NO: 2862656 - RNA, 22 nt, Human
acugugcaggugcuauuguuac

SEQ ID NO: 2862657 - RNA, 23 nt, Human
acugugcaggugcuauuguuacu

SEQ ID NO: 2862658 - RNA, 16 nt, Human
acugugcauagugcug

SEQ ID NO: 2862659 - RNA, 17 nt, Human
acugugcauagugcugg

SEQ ID NO: 2862660 - RNA, 19 nt, Human
acugugcauagugcuggga

SEQ ID NO: 2862661 - RNA, 14 nt, Human
acugucggaggaaa

SEQ ID NO: 2862662 - RNA, 16 nt, Human
acugucggaggaaaga

SEQ ID NO: 2862663 - RNA, 17 nt, Human
acugucggaggaaagac

SEQ ID NO: 2862664 - RNA, 19 nt, Human
acugucggaggaaagacaa

SEQ ID NO: 2862665 - RNA, 20 nt, Human
acugucggaggaaagacaac

SEQ ID NO: 2862666 - RNA, 21 nt, Human
acugucggaggaaagacaaca

SEQ ID NO: 2862667 - RNA, 16 nt, Human
acugucuaacuuuaga

SEQ ID NO: 2862668 - RNA, 17 nt, Human
acuggugugaccugagg

SEQ ID NO: 2862669 - RNA, 14 nt, Human
acuggugugaccug

SEQ ID NO: 2862670 - RNA, 23 nt, Human
acugguggcccgacagccuggca

SEQ ID NO: 2862671 - RNA, 21 nt, Human
acuggugugaccugagggcag

SEQ ID NO: 2862672 - RNA, 19 nt, Human
acugguguuugaaaguagg

SEQ ID NO: 2862673 - RNA, 21 nt, Human
acugguggcccgacagccugg

SEQ ID NO: 2862674 - RNA, 22 nt, Human
acugguggcccgacagccuggc

SEQ ID NO: 2862675 - RNA, 20 nt, Human
acugguggcccgacagccug

SEQ ID NO: 2862676 - RNA, 16 nt, Human
acugguacuuagaguu

SEQ ID NO: 2862677 - RNA, 17 nt, Human
acugguacuuagaguuu

SEQ ID NO: 2862678 - RNA, 20 nt, Human
acugguacuuagaguuucug

SEQ ID NO: 2862679 - RNA, 23 nt, Human
acugguacuuagaguuucuguuu

SEQ ID NO: 2862680 - RNA, 21 nt, Human
acuuuuaucuauucugagaaa

SEQ ID NO: 2862681 - RNA, 23 nt, Human
acuuuuauacucuuucuguauau

SEQ ID NO: 2862682 - RNA, 17 nt, Human
acuuuuccucccucagu

SEQ ID NO: 2862683 - RNA, 14 nt, Human
agaaaaguagacaa

SEQ ID NO: 2862684 - RNA, 15 nt, Human
agaaaaguagacaau

SEQ ID NO: 2862685 - RNA, 19 nt, Human
agaaaaguagacaaucauu

SEQ ID NO: 2862686 - RNA, 23 nt, Human
agaaaaguagacaaucauuguuu

SEQ ID NO: 2862687 - RNA, 12 nt, Human
agaaaaguauuu

SEQ ID NO: 2862688 - RNA, 13 nt, Human
agaaaaguauuuu

SEQ ID NO: 2862689 - RNA, 15 nt, Human
agaaaaguauuuuga

SEQ ID NO: 2862690 - RNA, 16 nt, Human
agaaaaguauuuugaa

SEQ ID NO: 2862691 - RNA, 17 nt, Human
agaaaaguauuuugaag

SEQ ID NO: 2862692 - RNA, 18 nt, Human
agaaaaguauuuugaagu

SEQ ID NO: 2862693 - RNA, 19 nt, Human
agaaaaguauuuugaaguu

SEQ ID NO: 2862694 - RNA, 23 nt, Human
agaaaaguauuuugaaguuuaca

SEQ ID NO: 2862695 - RNA, 23 nt, Human
agaaaagggaaguugugccuuuu

SEQ ID NO: 2862696 - RNA, 22 nt, Human
agaaaaguugacaccugagaaa

SEQ ID NO: 2862697 - RNA, 21 nt, Human
agaaaagugcauauuuaucca

SEQ ID NO: 2862698 - RNA, 11 nt, Human
agaaaaguuau

SEQ ID NO: 2862699 - RNA, 12 nt, Human
agaaaaguuauu

SEQ ID NO: 2862700 - RNA, 13 nt, Human
agaaaaguuauua

SEQ ID NO: 2862701 - RNA, 23 nt, Human
agaaaauauuauguguuuccaua

SEQ ID NO: 2862702 - RNA, 15 nt, Human
agaaaauggacacug

SEQ ID NO: 2862703 - RNA, 20 nt, Human
agaaaaugguuuauuuugua

SEQ ID NO: 2862704 - RNA, 21 nt, Human
agaaaaugguuuauuuuguau

SEQ ID NO: 2862705 - RNA, 15 nt, Human
acuuuuccuuaccuu

SEQ ID NO: 2862706 - RNA, 14 nt, Human
agaaaauucuccug

SEQ ID NO: 2862707 - RNA, 17 nt, Human
agaaaauguugagaauc

SEQ ID NO: 2862708 - RNA, 18 nt, Human
agaaaauuaaacacaaag

SEQ ID NO: 2862709 - RNA, 16 nt, Human
agaaaauguugagaau

SEQ ID NO: 2862710 - RNA, 22 nt, Human
agaaacaaacuuuucaaggcuu

SEQ ID NO: 2862711 - RNA, 21 nt, Human
agaaaauuuaauaacuuuuua

SEQ ID NO: 2862712 - RNA, 12 nt, Human
agaaacaaacuu

SEQ ID NO: 2862713 - RNA, 13 nt, Human
agaaacaaacuuu

SEQ ID NO: 2862714 - RNA, 16 nt, Human
agaaaauuuuuguagu

SEQ ID NO: 2862715 - RNA, 22 nt, Human
agaaaauuuuuguaguagcguu

SEQ ID NO: 2862716 - RNA, 20 nt, Human
agaaaauuuuuguaguagcg

SEQ ID NO: 2862717 - RNA, 22 nt, Human
agaaaauaucugaaaugugaua

SEQ ID NO: 2862718 - RNA, 14 nt, Human
agaaaauauaugua

SEQ ID NO: 2862719 - RNA, 15 nt, Human
agaaaauauauguau

SEQ ID NO: 2862720 - RNA, 17 nt, Human
agaaaauauauguauuu

SEQ ID NO: 2862721 - RNA, 23 nt, Human
agaaaauauauguauuuuuauau

SEQ ID NO: 2862722 - RNA, 16 nt, Human
agaaaauaaagacaac

SEQ ID NO: 2862723 - RNA, 21 nt, Human
agaaaauaaagacaaccauau

SEQ ID NO: 2862724 - RNA, 22 nt, Human
acuuuauaagucauuguauguu

SEQ ID NO: 2862725 - RNA, 12 nt, Human
acuuuauacauu

SEQ ID NO: 2862726 - RNA, 16 nt, Human
acuuuauacauuagua

SEQ ID NO: 2862727 - RNA, 19 nt, Human
acuuuauacauuaguaaau

SEQ ID NO: 2862728 - RNA, 22 nt, Human
acuuuauacauuaguaaauguc

SEQ ID NO: 2862729 - RNA, 19 nt, Human
acuuucauccugacucugc

SEQ ID NO: 2862730 - RNA, 21 nt, Human
acuuucauccugacucugccc

SEQ ID NO: 2862731 - RNA, 23 nt, Human
acuuucauccugacucugccccc

SEQ ID NO: 2862732 - RNA, 19 nt, Human
acuuuaggguaaaaauugc

SEQ ID NO: 2862733 - RNA, 22 nt, Human
acuuuaggguaaaaauugccau

SEQ ID NO: 2862734 - RNA, 13 nt, Human
acuuuaguaugac

SEQ ID NO: 2862735 - RNA, 23 nt, Human
acuuuaguaugacgcugauacau

SEQ ID NO: 2862736 - RNA, 17 nt, Human
acuuuccuuuccccagc

SEQ ID NO: 2862737 - RNA, 18 nt, Human
acuuuccuuuccccagcc

SEQ ID NO: 2862738 - RNA, 22 nt, Human
acuuuccuuuccccagcccagg

SEQ ID NO: 2862739 - RNA, 21 nt, Human
acuuuccuuuucuauuccuuc

SEQ ID NO: 2862740 - RNA, 19 nt, Human
acuuuccuuuccccagccc

SEQ ID NO: 2862741 - RNA, 15 nt, Human
acuuucguacauugg

SEQ ID NO: 2862742 - RNA, 16 nt, Human
acuuucguacauuggc

SEQ ID NO: 2862743 - RNA, 15 nt, Human
acuuucuaauguuuc

SEQ ID NO: 2862744 - RNA, 17 nt, Human
acuuucuaauguuucug

SEQ ID NO: 2862745 - RNA, 17 nt, Human
acuuuccacuucuuccu

SEQ ID NO: 2862746 - RNA, 18 nt, Human
acuuuccacuucuuccuu

SEQ ID NO: 2862747 - RNA, 22 nt, Human
acuuuccacuucuuccuuucuc

SEQ ID NO: 2862748 - RNA, 17 nt, Human
acuuuccuggaugucug

SEQ ID NO: 2862749 - RNA, 18 nt, Human
acuuuccuggaugucuga

SEQ ID NO: 2862750 - RNA, 23 nt, Human
acuuuccuggaugucugaacuuu

SEQ ID NO: 2862751 - RNA, 15 nt, Human
acuuuuaaacaguga

SEQ ID NO: 2862752 - RNA, 12 nt, Human
acuuuuaaacag

SEQ ID NO: 2862753 - RNA, 13 nt, Human
agaaauaaaagug

SEQ ID NO: 2862754 - RNA, 23 nt, Human
agaaauaaaagugaaugaaagau

SEQ ID NO: 2862755 - RNA, 23 nt, Human
agaaaggaggggauagagagaga

SEQ ID NO: 2862756 - RNA, 20 nt, Human
agaaaggaggggauagagag

SEQ ID NO: 2862757 - RNA, 11 nt, Human
agaaaggagac

SEQ ID NO: 2862758 - RNA, 16 nt, Human
acuagccugucauccu

SEQ ID NO: 2862759 - RNA, 21 nt, Human
acuagccccuguggagacugg

SEQ ID NO: 2862760 - RNA, 17 nt, Human
acuagccuuuggcucug

SEQ ID NO: 2862761 - RNA, 18 nt, Human
acuagccuuuggcucugg

SEQ ID NO: 2862762 - RNA, 19 nt, Human
acuagccuuuggcucugga

SEQ ID NO: 2862763 - RNA, 20 nt, Human
acuagccuuuggcucuggag

SEQ ID NO: 2862764 - RNA, 22 nt, Human
acuagccuuuggcucuggagac

SEQ ID NO: 2862765 - RNA, 21 nt, Human
acuagccuaggucauaaagag

SEQ ID NO: 2862766 - RNA, 20 nt, Human
acuagccaggaaguacuucc

SEQ ID NO: 2862767 - RNA, 17 nt, Human
acuaggacucugaggcu

SEQ ID NO: 2862768 - RNA, 16 nt, Human
acuaggacucugaggc

SEQ ID NO: 2862769 - RNA, 16 nt, Human
acuagcuuuucaaaca

SEQ ID NO: 2862770 - RNA, 16 nt, Human
acuaggguccugggga

SEQ ID NO: 2862771 - RNA, 19 nt, Human
acuagggauucaggcugcu

SEQ ID NO: 2862772 - RNA, 18 nt, Human
acuagggauucaggcugc

SEQ ID NO: 2862773 - RNA, 17 nt, Human
acuagggauucaggcug

SEQ ID NO: 2862774 - RNA, 16 nt, Human
acuagggauucaggcu

SEQ ID NO: 2862775 - RNA, 21 nt, Human
acuagggauucaggcugcuug

SEQ ID NO: 2862776 - RNA, 15 nt, Human
acuaggguccugggg

SEQ ID NO: 2862777 - RNA, 16 nt, Human
acucaguuuaugcugu

SEQ ID NO: 2862778 - RNA, 20 nt, Human
acucaguuuauguuguacaa

SEQ ID NO: 2862779 - RNA, 23 nt, Human
acucaguuuauguuguacaaugu

SEQ ID NO: 2862780 - RNA, 18 nt, Human
acucagggccaugccugc

SEQ ID NO: 2862781 - RNA, 14 nt, Human
acucaguggggagg

SEQ ID NO: 2862782 - RNA, 14 nt, Human
acucagcuccccag

SEQ ID NO: 2862783 - RNA, 15 nt, Human
acucagcuccccaga

SEQ ID NO: 2862784 - RNA, 19 nt, Human
acucagcuccccagagucc

SEQ ID NO: 2862785 - RNA, 14 nt, Human
acucagcuccguga

SEQ ID NO: 2862786 - RNA, 22 nt, Human
acucagcucuuggcuccacugg

SEQ ID NO: 2862787 - RNA, 14 nt, Human
acucaggcucucca

SEQ ID NO: 2862788 - RNA, 12 nt, Human
acucaggcugga

SEQ ID NO: 2862789 - RNA, 13 nt, Human
acucagggacaga

SEQ ID NO: 2862790 - RNA, 15 nt, Human
acucagggacagagc

SEQ ID NO: 2862791 - RNA, 17 nt, Human
acucagggacagagcca

SEQ ID NO: 2862792 - RNA, 18 nt, Human
acucagggacagagccau

SEQ ID NO: 2862793 - RNA, 20 nt, Human
acucagggacagagccaugc

SEQ ID NO: 2862794 - RNA, 14 nt, Human
acuccccuguuuca

SEQ ID NO: 2862795 - RNA, 21 nt, Human
acuccccuguuucaaucacug

SEQ ID NO: 2862796 - RNA, 23 nt, Human
acuccccuguuucaaucacuguc

SEQ ID NO: 2862797 - RNA, 17 nt, Human
acuccccgaagucuuuu

SEQ ID NO: 2862798 - RNA, 21 nt, Human
acucauaaaaagccugcaauu

SEQ ID NO: 2862799 - RNA, 13 nt, Human
acucaguuuucuu

SEQ ID NO: 2862800 - RNA, 16 nt, Human
acuccccgaagucuuu

SEQ ID NO: 2862801 - RNA, 14 nt, Human
acuccccgaagucu

SEQ ID NO: 2862802 - RNA, 21 nt, Human
acucccccuaaaccccugucc

SEQ ID NO: 2862803 - RNA, 22 nt, Human
acucccccuaaaccccuguccc

SEQ ID NO: 2862804 - RNA, 20 nt, Human
acucaaaauauuuguacaua

SEQ ID NO: 2862805 - RNA, 19 nt, Human
acucaaaauauuuguacau

SEQ ID NO: 2862806 - RNA, 17 nt, Human
acucaaaauauuuguac

SEQ ID NO: 2862807 - RNA, 15 nt, Human
acucaaaauauuugu

SEQ ID NO: 2862808 - RNA, 18 nt, Human
acuauaaaaugucuucaa

SEQ ID NO: 2862809 - RNA, 19 nt, Human
acuauaaaaugucuucaag

SEQ ID NO: 2862810 - RNA, 17 nt, Human
acuauaacauauguaca

SEQ ID NO: 2862811 - RNA, 22 nt, Human
acuauaacauauguacauaaau

SEQ ID NO: 2862812 - RNA, 17 nt, Human
acuaguuuuaguuuucu

SEQ ID NO: 2862813 - RNA, 20 nt, Human
acuauaaagaaguaacaaaa

SEQ ID NO: 2862814 - RNA, 12 nt, Human
acuauaaagaga

SEQ ID NO: 2862815 - RNA, 13 nt, Human
acuauaaagagaa

SEQ ID NO: 2862816 - RNA, 14 nt, Human
acuauaaagagaag

SEQ ID NO: 2862817 - RNA, 21 nt, Human
acucaaauaugaguacaaaug

SEQ ID NO: 2862818 - RNA, 23 nt, Human
acucaaauaugaguacaaaugcc

SEQ ID NO: 2862819 - RNA, 16 nt, Human
acucaaacuucuggcu

SEQ ID NO: 2862820 - RNA, 17 nt, Human
acucaaacuucuggcuc

SEQ ID NO: 2862821 - RNA, 22 nt, Human
acucaaacuucuggcucccucu

SEQ ID NO: 2862822 - RNA, 23 nt, Human
acucagccggcguggcaaauaua

SEQ ID NO: 2862823 - RNA, 12 nt, Human
acucagccugca

SEQ ID NO: 2862824 - RNA, 15 nt, Human
acucagccugcaguu

SEQ ID NO: 2862825 - RNA, 16 nt, Human
acucagccugcaguua

SEQ ID NO: 2862826 - RNA, 17 nt, Human
acucagccugcaguuaa

SEQ ID NO: 2862827 - RNA, 21 nt, Human
acucagccugcaguuaauuag

SEQ ID NO: 2862828 - RNA, 12 nt, Human
acucagccugcu

SEQ ID NO: 2862829 - RNA, 15 nt, Human
acucagccugcugcc

SEQ ID NO: 2862830 - RNA, 16 nt, Human
acucagccugcugccc

SEQ ID NO: 2862831 - RNA, 18 nt, Human
acucagccugcugcccag

SEQ ID NO: 2862832 - RNA, 22 nt, Human
acucagccugcugcccaggcug

SEQ ID NO: 2862833 - RNA, 16 nt, Human
acucagccugggacag

SEQ ID NO: 2862834 - RNA, 14 nt, Human
acucagcccugagg

SEQ ID NO: 2862835 - RNA, 15 nt, Human
acucagcccugaggu

SEQ ID NO: 2862836 - RNA, 16 nt, Human
acucagaucugucuga

SEQ ID NO: 2862837 - RNA, 15 nt, Human
acucagcagaauggu

SEQ ID NO: 2862838 - RNA, 13 nt, Human
acucccuccagca

SEQ ID NO: 2862839 - RNA, 14 nt, Human
acucccuccagcac

SEQ ID NO: 2862840 - RNA, 15 nt, Human
acucccuccagcaca

SEQ ID NO: 2862841 - RNA, 16 nt, Human
acucccuccagcacaa

SEQ ID NO: 2862842 - RNA, 19 nt, Human
acucccuugguggcaagag

SEQ ID NO: 2862843 - RNA, 21 nt, Human
acucccuugguggcaagagcc

SEQ ID NO: 2862844 - RNA, 22 nt, Human
acucccuugguggcaagagccc

SEQ ID NO: 2862845 - RNA, 17 nt, Human
acucuggggugcugccu

SEQ ID NO: 2862846 - RNA, 17 nt, Human
acucugggcugcuaccc

SEQ ID NO: 2862847 - RNA, 16 nt, Human
acucugggcuccagag

SEQ ID NO: 2862848 - RNA, 14 nt, Human
acucugggcuccag

SEQ ID NO: 2862849 - RNA, 11 nt, Human
acucuggccuc

SEQ ID NO: 2862850 - RNA, 15 nt, Human
acucuggcuuggccu

SEQ ID NO: 2862851 - RNA, 16 nt, Human
acucuggcuuggccua

SEQ ID NO: 2862852 - RNA, 22 nt, Human
acucuggcuuggccuaucuccu

SEQ ID NO: 2862853 - RNA, 20 nt, Human
acucugggcacacucugcca

SEQ ID NO: 2862854 - RNA, 18 nt, Human
acucugggcuauggacac

SEQ ID NO: 2862855 - RNA, 19 nt, Human
acucugggcuauggacaca

SEQ ID NO: 2862856 - RNA, 20 nt, Human
acucugggcuauggacacag

SEQ ID NO: 2862857 - RNA, 22 nt, Human
acucugggcuauggacacaggg

SEQ ID NO: 2862858 - RNA, 23 nt, Human
acucugggcucaagcaauccucu

SEQ ID NO: 2862859 - RNA, 16 nt, Human
acucugugucaggugg

SEQ ID NO: 2862860 - RNA, 16 nt, Human
acucuguggggccuug

SEQ ID NO: 2862861 - RNA, 17 nt, Human
acucuguggggccuugg

SEQ ID NO: 2862862 - RNA, 13 nt, Human
acucuguuguacu

SEQ ID NO: 2862863 - RNA, 19 nt, Human
acucuguuguacuauggaa

SEQ ID NO: 2862864 - RNA, 21 nt, Human
acucuuaaaaauguuuuuuca

SEQ ID NO: 2862865 - RNA, 23 nt, Human
acgugcaccuguacucaggaggc

SEQ ID NO: 2862866 - RNA, 21 nt, Human
acgugcaccuguacucaggag

SEQ ID NO: 2862867 - RNA, 20 nt, Human
acgugcaccuguacucagga

SEQ ID NO: 2862868 - RNA, 19 nt, Human
acgugcaacugacacuccc

SEQ ID NO: 2862869 - RNA, 23 nt, Human
acgugcaacugacacucccaccc

SEQ ID NO: 2862870 - RNA, 23 nt, Human
acgccacugcacuccagccuggg

SEQ ID NO: 2862871 - RNA, 22 nt, Human
acgugauucaauucaacacucc

SEQ ID NO: 2862872 - RNA, 14 nt, Human
acuaauaaauacau

SEQ ID NO: 2862873 - RNA, 15 nt, Human
acuaauaaauacaua

SEQ ID NO: 2862874 - RNA, 13 nt, Human
acgauuccuucuc

SEQ ID NO: 2862875 - RNA, 16 nt, Human
acgauuccuucucuga

SEQ ID NO: 2862876 - RNA, 15 nt, Human
acgaugugucuguau

SEQ ID NO: 2862877 - RNA, 23 nt, Human
acgaugugucuguauuucaugug

SEQ ID NO: 2862878 - RNA, 18 nt, Human
acgccacugcacuauagc

SEQ ID NO: 2862879 - RNA, 22 nt, Human
acgccacugcacuccagccugg

SEQ ID NO: 2862880 - RNA, 20 nt, Human
acgccacugcacuccagccu

SEQ ID NO: 2862881 - RNA, 14 nt, Human
acgaucaggcacag

SEQ ID NO: 2862882 - RNA, 17 nt, Human
acgaucaggcacagguc

SEQ ID NO: 2862883 - RNA, 18 nt, Human
acgaucaggcacagguca

SEQ ID NO: 2862884 - RNA, 19 nt, Human
acgauccugccacccugua

SEQ ID NO: 2862885 - RNA, 20 nt, Human
acgauccugccacccuguag

SEQ ID NO: 2862886 - RNA, 21 nt, Human
acgauccugccacccuguagc

SEQ ID NO: 2862887 - RNA, 12 nt, Human
accuuggcugca

SEQ ID NO: 2862888 - RNA, 14 nt, Human
accuuggcucaagu

SEQ ID NO: 2862889 - RNA, 12 nt, Human
accuuggcucaa

SEQ ID NO: 2862890 - RNA, 17 nt, Human
accuguaugucuccagu

SEQ ID NO: 2862891 - RNA, 12 nt, Human
accuguauuuaa

SEQ ID NO: 2862892 - RNA, 22 nt, Human
accugucaaugauacagucccu

SEQ ID NO: 2862893 - RNA, 14 nt, Human
accuguauuuaagc

SEQ ID NO: 2862894 - RNA, 15 nt, Human
accuguauuuaagca

SEQ ID NO: 2862895 - RNA, 18 nt, Human
accuguauuuaagcaaau

SEQ ID NO: 2862896 - RNA, 21 nt, Human
accuguauuuaagcaaauacu

SEQ ID NO: 2862897 - RNA, 11 nt, Human
accuguaucuu

SEQ ID NO: 2862898 - RNA, 12 nt, Human
accuguaucuuu

SEQ ID NO: 2862899 - RNA, 18 nt, Human
accuguaucuuucuaugc

SEQ ID NO: 2862900 - RNA, 23 nt, Human
accuguaucuuucuaugcugcuu

SEQ ID NO: 2862901 - RNA, 12 nt, Human
accuguacucag

SEQ ID NO: 2862902 - RNA, 17 nt, Human
accuguauaacccuguu

SEQ ID NO: 2862903 - RNA, 20 nt, Human
accuguauaacccuguuaca

SEQ ID NO: 2862904 - RNA, 16 nt, Human
accuguacacugacuu

SEQ ID NO: 2862905 - RNA, 11 nt, Human
accuguacagu

SEQ ID NO: 2862906 - RNA, 20 nt, Human
accugccccuccucucugcc

SEQ ID NO: 2862907 - RNA, 13 nt, Human
accuuuauucuuu

SEQ ID NO: 2862908 - RNA, 14 nt, Human
accuuuauucuuuu

SEQ ID NO: 2862909 - RNA, 17 nt, Human
accuuuauucuuuucca

SEQ ID NO: 2862910 - RNA, 22 nt, Human
accuuuauuggguaucaagaca

SEQ ID NO: 2862911 - RNA, 13 nt, Human
accuuuauucugg

SEQ ID NO: 2862912 - RNA, 12 nt, Human
accuuuauucug

SEQ ID NO: 2862913 - RNA, 14 nt, Human
accuuggcugcagg

SEQ ID NO: 2862914 - RNA, 14 nt, Human
accuugugaucaug

SEQ ID NO: 2862915 - RNA, 18 nt, Human
accuugugucuguacacg

SEQ ID NO: 2862916 - RNA, 21 nt, Human
accuugugucuguacacgugu

SEQ ID NO: 2862917 - RNA, 12 nt, Human
accuugugucug

SEQ ID NO: 2862918 - RNA, 13 nt, Human
accuugugucugu

SEQ ID NO: 2862919 - RNA, 15 nt, Human
accuugugucuguac

SEQ ID NO: 2862920 - RNA, 17 nt, Human
accuuucaaauuucaca

SEQ ID NO: 2862921 - RNA, 18 nt, Human
accuuucaccuuugugua

SEQ ID NO: 2862922 - RNA, 21 nt, Human
accuuucaccuuuguguauuu

SEQ ID NO: 2862923 - RNA, 14 nt, Human
accucuuccccaga

SEQ ID NO: 2862924 - RNA, 13 nt, Human
accucuuccccag

SEQ ID NO: 2862925 - RNA, 18 nt, Human
accugccccuccucucug

SEQ ID NO: 2862926 - RNA, 14 nt, Human
accugccccuccuc

SEQ ID NO: 2862927 - RNA, 15 nt, Human
accugcccccuggug

SEQ ID NO: 2862928 - RNA, 13 nt, Human
accugcccccugg

SEQ ID NO: 2862929 - RNA, 14 nt, Human
accucuucuggcuc

SEQ ID NO: 2862930 - RNA, 13 nt, Human
accugcccaaccu

SEQ ID NO: 2862931 - RNA, 23 nt, Human
accucuuccccagaaaggagacu

SEQ ID NO: 2862932 - RNA, 22 nt, Human
accucuuccccagaaaggagac

SEQ ID NO: 2862933 - RNA, 15 nt, Human
accucuucacccccc

SEQ ID NO: 2862934 - RNA, 16 nt, Human
accucuucuggcucaa

SEQ ID NO: 2862935 - RNA, 21 nt, Human
accugcccaaccugcucuccu

SEQ ID NO: 2862936 - RNA, 15 nt, Human
accugcccaucacag

SEQ ID NO: 2862937 - RNA, 16 nt, Human
auaauuagguuaacau

SEQ ID NO: 2862938 - RNA, 17 nt, Human
auaauuagguuaacauu

SEQ ID NO: 2862939 - RNA, 15 nt, Human
auacacaacacacac

SEQ ID NO: 2862940 - RNA, 22 nt, Human
auacccccugcaaagcccagcu

SEQ ID NO: 2862941 - RNA, 21 nt, Human
auacccccugcaaagcccagc

SEQ ID NO: 2862942 - RNA, 15 nt, Human
auacacacacacaca

SEQ ID NO: 2862943 - RNA, 15 nt, Human
auaaguauacaguuc

SEQ ID NO: 2862944 - RNA, 16 nt, Human
auacacacacacacac

SEQ ID NO: 2862945 - RNA, 10 nt, Human
auacacacac

SEQ ID NO: 2862946 - RNA, 11 nt, Human
auacacacaca

SEQ ID NO: 2862947 - RNA, 13 nt, Human
auacacacacaca

SEQ ID NO: 2862948 - RNA, 17 nt, Human
auaccugcuaucagcag

SEQ ID NO: 2862949 - RNA, 13 nt, Human
auaccuaaguacu

SEQ ID NO: 2862950 - RNA, 14 nt, Human
auaccuaaguacug

SEQ ID NO: 2862951 - RNA, 15 nt, Human
auaccuaaguacugu

SEQ ID NO: 2862952 - RNA, 16 nt, Human
auaccuaaguacugua

SEQ ID NO: 2862953 - RNA, 17 nt, Human
auaccuaaguacuguaa

SEQ ID NO: 2862954 - RNA, 20 nt, Human
auaccuaaguacuguaauaa

SEQ ID NO: 2862955 - RNA, 21 nt, Human
auaccuaaguacuguaauaau

SEQ ID NO: 2862956 - RNA, 22 nt, Human
auaccuaaguacuguaauaaua

SEQ ID NO: 2862957 - RNA, 19 nt, Human
auacccuggccgcccccug

SEQ ID NO: 2862958 - RNA, 15 nt, Human
auacccuucuuuuau

SEQ ID NO: 2862959 - RNA, 19 nt, Human
auacccuucuuuuaugagc

SEQ ID NO: 2862960 - RNA, 12 nt, Human
auacccugcccu

SEQ ID NO: 2862961 - RNA, 14 nt, Human
auacccugcccuug

SEQ ID NO: 2862962 - RNA, 15 nt, Human
auaccggaauuacuu

SEQ ID NO: 2862963 - RNA, 16 nt, Human
auaccggaauuacuuu

SEQ ID NO: 2862964 - RNA, 13 nt, Human
auaccuaaaacau

SEQ ID NO: 2862965 - RNA, 14 nt, Human
auaccuaaaacaua

SEQ ID NO: 2862966 - RNA, 16 nt, Human
auaccucugugugcuc

SEQ ID NO: 2862967 - RNA, 14 nt, Human
auaccucugugugc

SEQ ID NO: 2862968 - RNA, 17 nt, Human
auaccucugugugcucc

SEQ ID NO: 2862969 - RNA, 24 nt, Human
auacuuacugaacuguguguaauu

SEQ ID NO: 2862970 - RNA, 17 nt, Human
auacuuagcaaaaagug

SEQ ID NO: 2862971 - RNA, 18 nt, Human
auacuuagcaaaaagugg

SEQ ID NO: 2862972 - RNA, 19 nt, Human
auacuuagcaaaaaguggg

SEQ ID NO: 2862973 - RNA, 23 nt, Human
auacuuagcaaaaaguggggcag

SEQ ID NO: 2862974 - RNA, 13 nt, Human
auacuuacauucu

SEQ ID NO: 2862975 - RNA, 22 nt, Human
auacuuacauucucuaauaaga

SEQ ID NO: 2862976 - RNA, 23 nt, Human
auacuuacauucucuaauaagaa

SEQ ID NO: 2862977 - RNA, 16 nt, Human
auacuuaucucucugu

SEQ ID NO: 2862978 - RNA, 17 nt, Human
auacuuaucucucugug

SEQ ID NO: 2862979 - RNA, 18 nt, Human
auacuuaucucucugugc

SEQ ID NO: 2862980 - RNA, 20 nt, Human
auacuuaucucucugugcug

SEQ ID NO: 2862981 - RNA, 15 nt, Human
auacuuaucucucug

SEQ ID NO: 2862982 - RNA, 22 nt, Human
auacuuagcaaaguuuuaccug

SEQ ID NO: 2862983 - RNA, 15 nt, Human
auacuuauauuuccc

SEQ ID NO: 2862984 - RNA, 17 nt, Human
auacuuauauuucccua

SEQ ID NO: 2862985 - RNA, 14 nt, Human
auacuuauauuuuc

SEQ ID NO: 2862986 - RNA, 22 nt, Human
auacuuauauuuucguaugaaa

SEQ ID NO: 2862987 - RNA, 23 nt, Human
auacuuauauuuucguaugaaaa

SEQ ID NO: 2862988 - RNA, 21 nt, Human
auaaguguguggucccaaguu

SEQ ID NO: 2862989 - RNA, 15 nt, Human
auaaguauuuauaau

SEQ ID NO: 2862990 - RNA, 19 nt, Human
auaaguguacgauucuuaa

SEQ ID NO: 2862991 - RNA, 15 nt, Human
auaaguggugugugu

SEQ ID NO: 2862992 - RNA, 19 nt, Human
auaaguauuuauaauagca

SEQ ID NO: 2862993 - RNA, 16 nt, Human
auaagucauuguaugu

SEQ ID NO: 2862994 - RNA, 17 nt, Human
auaacacccuuccuucu

SEQ ID NO: 2862995 - RNA, 21 nt, Human
auaacacccuuccuucuguaa

SEQ ID NO: 2862996 - RNA, 13 nt, Human
auaacaccugcca

SEQ ID NO: 2862997 - RNA, 14 nt, Human
auaacaccugccac

SEQ ID NO: 2862998 - RNA, 15 nt, Human
auaacacuaaaauuu

SEQ ID NO: 2862999 - RNA, 18 nt, Human
auaacaggcauuuguuca

SEQ ID NO: 2863000 - RNA, 16 nt, Human
auaacagauacauuuc

SEQ ID NO: 2863001 - RNA, 16 nt, Human
auaacaguaaaugugc

SEQ ID NO: 2863002 - RNA, 14 nt, Human
auaucagaaaaggg

SEQ ID NO: 2863003 - RNA, 14 nt, Human
auauccaccaccuc

SEQ ID NO: 2863004 - RNA, 17 nt, Human
auaucagaaaagggaag

SEQ ID NO: 2863005 - RNA, 13 nt, Human
auauccccugcua

SEQ ID NO: 2863006 - RNA, 14 nt, Human
auaucccaaacugu

SEQ ID NO: 2863007 - RNA, 16 nt, Human
auaucccaaacuguga

SEQ ID NO: 2863008 - RNA, 20 nt, Human
auaucccaaacugugaugaa

SEQ ID NO: 2863009 - RNA, 16 nt, Human
auaucccaagugcacu

SEQ ID NO: 2863010 - RNA, 16 nt, Human
auauccaccaccuccc

SEQ ID NO: 2863011 - RNA, 18 nt, Human
auauccaggucaacagaa

SEQ ID NO: 2863012 - RNA, 19 nt, Human
auauccaggucaacagaau

SEQ ID NO: 2863013 - RNA, 21 nt, Human
auauccaggucaacagaauga

SEQ ID NO: 2863014 - RNA, 22 nt, Human
auauccaggucaacagaaugaa

SEQ ID NO: 2863015 - RNA, 18 nt, Human
auauggaacuucuaauau

SEQ ID NO: 2863016 - RNA, 20 nt, Human
auauggaacuucuaauauau

SEQ ID NO: 2863017 - RNA, 16 nt, Human
auaugcaguuuuccuu

SEQ ID NO: 2863018 - RNA, 20 nt, Human
auauggacacuuaauacuac

SEQ ID NO: 2863019 - RNA, 15 nt, Human
auauggacacuuaau

SEQ ID NO: 2863020 - RNA, 15 nt, Human
auauggacaagaggu

SEQ ID NO: 2863021 - RNA, 16 nt, Human
auauggacaagaggua

SEQ ID NO: 2863022 - RNA, 18 nt, Human
auauggacucaguuuucu

SEQ ID NO: 2863023 - RNA, 21 nt, Human
auaugccuguaauucagugua

SEQ ID NO: 2863024 - RNA, 14 nt, Human
auaugcuaauuugg

SEQ ID NO: 2863025 - RNA, 15 nt, Human
auaugcuaauuuggg

SEQ ID NO: 2863026 - RNA, 17 nt, Human
auaugcuaauuugggga

SEQ ID NO: 2863027 - RNA, 19 nt, Human
auaugcccacauuuagucu

SEQ ID NO: 2863028 - RNA, 21 nt, Human
auaugcccacauuuagucucu

SEQ ID NO: 2863029 - RNA, 22 nt, Human
auaugcccacauuuagucucuu

SEQ ID NO: 2863030 - RNA, 16 nt, Human
auauccuuucuaacaa

SEQ ID NO: 2863031 - RNA, 15 nt, Human
auauccuuucuaaca

SEQ ID NO: 2863032 - RNA, 20 nt, Human
auauccugugacugucucac

SEQ ID NO: 2863033 - RNA, 17 nt, Human
auauccuuaucagagcu

SEQ ID NO: 2863034 - RNA, 18 nt, Human
auauccuuaucagagcua

SEQ ID NO: 2863035 - RNA, 17 nt, Human
auaugcaguuuuccuua

SEQ ID NO: 2863036 - RNA, 11 nt, Human
auaucccuucc

SEQ ID NO: 2863037 - RNA, 14 nt, Human
auauccugugacug

SEQ ID NO: 2863038 - RNA, 13 nt, Human
auauccugugacu

SEQ ID NO: 2863039 - RNA, 21 nt, Human
auauuuauuuucuuucuguaa

SEQ ID NO: 2863040 - RNA, 22 nt, Human
auauuuauuuucuuuugaauug

SEQ ID NO: 2863041 - RNA, 17 nt, Human
auauuuaguauugaaua

SEQ ID NO: 2863042 - RNA, 17 nt, Human
auauucagaauuaugau

SEQ ID NO: 2863043 - RNA, 17 nt, Human
auauuuauaaaugagca

SEQ ID NO: 2863044 - RNA, 21 nt, Human
auauuuaguuauaguuucaga

SEQ ID NO: 2863045 - RNA, 22 nt, Human
auauuuaguuauaguuucagau

SEQ ID NO: 2863046 - RNA, 13 nt, Human
auauuuauaacuc

SEQ ID NO: 2863047 - RNA, 11 nt, Human
auauuuauaac

SEQ ID NO: 2863048 - RNA, 22 nt, Human
auauuuauuaaauaaaaucaau

SEQ ID NO: 2863049 - RNA, 23 nt, Human
auauuuauuaaauaaaaucaauu

SEQ ID NO: 2863050 - RNA, 19 nt, Human
auauuuagauuguuaaaau

SEQ ID NO: 2863051 - RNA, 14 nt, Human
auauucagagaaua

SEQ ID NO: 2863052 - RNA, 17 nt, Human
auauucagagaauauca

SEQ ID NO: 2863053 - RNA, 13 nt, Human
auauuaguugcuu

SEQ ID NO: 2863054 - RNA, 18 nt, Human
auauuaguugcuuuguua

SEQ ID NO: 2863055 - RNA, 15 nt, Human
auauuauaaauauau

SEQ ID NO: 2863056 - RNA, 19 nt, Human
auauuuauuuuuuuuaagu

SEQ ID NO: 2863057 - RNA, 16 nt, Human
auaguaugguggcugg

SEQ ID NO: 2863058 - RNA, 18 nt, Human
auauaauucacucaagca

SEQ ID NO: 2863059 - RNA, 12 nt, Human
auauaauucugu

SEQ ID NO: 2863060 - RNA, 14 nt, Human
auauaauucuguaa

SEQ ID NO: 2863061 - RNA, 16 nt, Human
auauaauucuguaaau

SEQ ID NO: 2863062 - RNA, 17 nt, Human
auauaauucuguaaaug

SEQ ID NO: 2863063 - RNA, 15 nt, Human
auaguaugguggcug

SEQ ID NO: 2863064 - RNA, 19 nt, Human
auaguaugaguaaugcuua

SEQ ID NO: 2863065 - RNA, 13 nt, Human
auaguaguaugau

SEQ ID NO: 2863066 - RNA, 16 nt, Human
auacuucacuacuuua

SEQ ID NO: 2863067 - RNA, 17 nt, Human
auacuucauuuaaaaaa

SEQ ID NO: 2863068 - RNA, 20 nt, Human
auacuucauuuaaaaaaauc

SEQ ID NO: 2863069 - RNA, 23 nt, Human
auauagccauugaucauaaacug

SEQ ID NO: 2863070 - RNA, 14 nt, Human
auauacauauguag

SEQ ID NO: 2863071 - RNA, 19 nt, Human
auauacaugaaaauuuuaa

SEQ ID NO: 2863072 - RNA, 14 nt, Human
auauaccauuuauc

SEQ ID NO: 2863073 - RNA, 17 nt, Human
auauacccccccaugca

SEQ ID NO: 2863074 - RNA, 14 nt, Human
auauaccuauaaug

SEQ ID NO: 2863075 - RNA, 15 nt, Human
auauaccuauaaugu

SEQ ID NO: 2863076 - RNA, 17 nt, Human
auauaccuauaaugugu

SEQ ID NO: 2863077 - RNA, 18 nt, Human
auauaccuauaaugugug

SEQ ID NO: 2863078 - RNA, 19 nt, Human
auauaccuauaaugugugu

SEQ ID NO: 2863079 - RNA, 20 nt, Human
auauaccuauaaugugugua

SEQ ID NO: 2863080 - RNA, 21 nt, Human
auauaccuauaauguguguau

SEQ ID NO: 2863081 - RNA, 16 nt, Human
auauacgaacaaaaca

SEQ ID NO: 2863082 - RNA, 13 nt, Human
auauacaugugug

SEQ ID NO: 2863083 - RNA, 14 nt, Human
auauacaugugugu

SEQ ID NO: 2863084 - RNA, 15 nt, Human
auauacaugugugua

SEQ ID NO: 2863085 - RNA, 16 nt, Human
auauacauguguguau

SEQ ID NO: 2863086 - RNA, 17 nt, Human
auauacauguguguaua

SEQ ID NO: 2863087 - RNA, 18 nt, Human
auauacauguguguauau

SEQ ID NO: 2863088 - RNA, 21 nt, Human
auauacauguguguauauaug

SEQ ID NO: 2863089 - RNA, 22 nt, Human
auauacauguguguauauaugu

SEQ ID NO: 2863090 - RNA, 23 nt, Human
auauacauguguguauauaugug

SEQ ID NO: 2863091 - RNA, 12 nt, Human
auauacauacac

SEQ ID NO: 2863092 - RNA, 13 nt, Human
auauacauacacu

SEQ ID NO: 2863093 - RNA, 16 nt, Human
auauacauacacuugu

SEQ ID NO: 2863094 - RNA, 21 nt, Human
auauacauacacuuguauaaa

SEQ ID NO: 2863095 - RNA, 12 nt, Human
auauagccuuua

SEQ ID NO: 2863096 - RNA, 18 nt, Human
auauagcguucccaacaa

SEQ ID NO: 2863097 - RNA, 21 nt, Human
auauagcguucccaacaacau

SEQ ID NO: 2863098 - RNA, 13 nt, Human
auauagcuggcaa

SEQ ID NO: 2863099 - RNA, 16 nt, Human
auauagcuggcaagaa

SEQ ID NO: 2863100 - RNA, 19 nt, Human
auauagcuggcaagaaugg

SEQ ID NO: 2863101 - RNA, 17 nt, Human
auauagcagcaaaaaua

SEQ ID NO: 2863102 - RNA, 19 nt, Human
auauagcagcaaaaauaua

SEQ ID NO: 2863103 - RNA, 20 nt, Human
auauagcagcaaaaauauaa

SEQ ID NO: 2863104 - RNA, 19 nt, Human
auauagcaaaacuuuuaaa

SEQ ID NO: 2863105 - RNA, 20 nt, Human
auauagcaaaacuuuuaaac

SEQ ID NO: 2863106 - RNA, 21 nt, Human
auauagcaaaacuuuuaaacu

SEQ ID NO: 2863107 - RNA, 22 nt, Human
auauagcaaaacuuuuaaacua

SEQ ID NO: 2863108 - RNA, 19 nt, Human
aguugucaagucucugcug

SEQ ID NO: 2863109 - RNA, 16 nt, Human
aguugucacaucagau

SEQ ID NO: 2863110 - RNA, 15 nt, Human
aguugucacugcuuu

SEQ ID NO: 2863111 - RNA, 21 nt, Human
aguugucacugcuuuuggccu

SEQ ID NO: 2863112 - RNA, 23 nt, Human
aguugucacugcuuuuggccugg

SEQ ID NO: 2863113 - RNA, 16 nt, Human
aguuguagcagauugu

SEQ ID NO: 2863114 - RNA, 18 nt, Human
aguuguagcagauuguuu

SEQ ID NO: 2863115 - RNA, 20 nt, Human
aguugaauggccugccuuga

SEQ ID NO: 2863116 - RNA, 21 nt, Human
aguugaaugacaacagaagcu

SEQ ID NO: 2863117 - RNA, 22 nt, Human
aguuaagaagcuguuguacauu

SEQ ID NO: 2863118 - RNA, 13 nt, Human
aguuaagagaaac

SEQ ID NO: 2863119 - RNA, 14 nt, Human
aguuaagagaaacu

SEQ ID NO: 2863120 - RNA, 15 nt, Human
aguuaagagaaacuu

SEQ ID NO: 2863121 - RNA, 16 nt, Human
aguuaagagaaacuuu

SEQ ID NO: 2863122 - RNA, 17 nt, Human
aguuaagagaaacuuua

SEQ ID NO: 2863123 - RNA, 19 nt, Human
aguuaagagaaacuuuaua

SEQ ID NO: 2863124 - RNA, 21 nt, Human
aguuaagagaaacuuuauaca

SEQ ID NO: 2863125 - RNA, 22 nt, Human
aguuaagagaaacuuuauacau

SEQ ID NO: 2863126 - RNA, 23 nt, Human
aguuaagagaaacuuuauacauu

SEQ ID NO: 2863127 - RNA, 19 nt, Human
agugauucucaugccucag

SEQ ID NO: 2863128 - RNA, 14 nt, Human
agugaucacagcag

SEQ ID NO: 2863129 - RNA, 15 nt, Human
agugaucacagcagc

SEQ ID NO: 2863130 - RNA, 16 nt, Human
agugaucacagcagcu

SEQ ID NO: 2863131 - RNA, 18 nt, Human
agugauucucaugccuca

SEQ ID NO: 2863132 - RNA, 13 nt, Human
agugugaacaaaa

SEQ ID NO: 2863133 - RNA, 22 nt, Human
agugugaacaaaagaugcucuu

SEQ ID NO: 2863134 - RNA, 23 nt, Human
agugugacaaggauugcuacugu

SEQ ID NO: 2863135 - RNA, 11 nt, Human
agugugacagg

SEQ ID NO: 2863136 - RNA, 14 nt, Human
agugugacagggcc

SEQ ID NO: 2863137 - RNA, 15 nt, Human
agugugacagggcca

SEQ ID NO: 2863138 - RNA, 16 nt, Human
agugugaaguacaaua

SEQ ID NO: 2863139 - RNA, 17 nt, Human
agugugaaguacaauaa

SEQ ID NO: 2863140 - RNA, 12 nt, Human
aguuaagaagcu

SEQ ID NO: 2863141 - RNA, 15 nt, Human
aguuaagaagcuguu

SEQ ID NO: 2863142 - RNA, 16 nt, Human
aguuaagaagcuguug

SEQ ID NO: 2863143 - RNA, 20 nt, Human
aguuaagacaugauuuccuu

SEQ ID NO: 2863144 - RNA, 19 nt, Human
aguuaagacaugauuuccu

SEQ ID NO: 2863145 - RNA, 17 nt, Human
aguuaagaagcuguugu

SEQ ID NO: 2863146 - RNA, 18 nt, Human
aguuaagaagcuguugua

SEQ ID NO: 2863147 - RNA, 20 nt, Human
aguuaagaagcuguuguaca

SEQ ID NO: 2863148 - RNA, 21 nt, Human
aguuaagaagcuguuguacau

SEQ ID NO: 2863149 - RNA, 14 nt, Human
agucaagaagaaaa

SEQ ID NO: 2863150 - RNA, 15 nt, Human
agucaagaagaaaaa

SEQ ID NO: 2863151 - RNA, 15 nt, Human
agucaaccaacccca

SEQ ID NO: 2863152 - RNA, 18 nt, Human
agucaaggguaggguggg

SEQ ID NO: 2863153 - RNA, 18 nt, Human
aguccaaggaaaccacag

SEQ ID NO: 2863154 - RNA, 13 nt, Human
agucauugcugua

SEQ ID NO: 2863155 - RNA, 16 nt, Human
agucauugcuguagga

SEQ ID NO: 2863156 - RNA, 14 nt, Human
aguccaauguggca

SEQ ID NO: 2863157 - RNA, 14 nt, Human
aguccaauuuuaau

SEQ ID NO: 2863158 - RNA, 15 nt, Human
aguccaauuuuaauu

SEQ ID NO: 2863159 - RNA, 17 nt, Human
aguccaauuuuaauuua

SEQ ID NO: 2863160 - RNA, 19 nt, Human
aguccaauuuuaauuuagu

SEQ ID NO: 2863161 - RNA, 21 nt, Human
aguccaauuuuaauuuaguaa

SEQ ID NO: 2863162 - RNA, 21 nt, Human
aguccaaggaaaccacagcug

SEQ ID NO: 2863163 - RNA, 23 nt, Human
aguccaaggaaaccacagcugcu

SEQ ID NO: 2863164 - RNA, 13 nt, Human
aguccaagguuua

SEQ ID NO: 2863165 - RNA, 16 nt, Human
aguccaagguuuaaag

SEQ ID NO: 2863166 - RNA, 13 nt, Human
aguccaauaagac

SEQ ID NO: 2863167 - RNA, 12 nt, Human
agucauuccuuc

SEQ ID NO: 2863168 - RNA, 20 nt, Human
agucauuccuucuuuuuaaa

SEQ ID NO: 2863169 - RNA, 14 nt, Human
agucauuagacucc

SEQ ID NO: 2863170 - RNA, 15 nt, Human
agucauuagacuccu

SEQ ID NO: 2863171 - RNA, 16 nt, Human
agucauuagacuccuc

SEQ ID NO: 2863172 - RNA, 18 nt, Human
agucauuagacuccuccu

SEQ ID NO: 2863173 - RNA, 19 nt, Human
agucauuagacuccuccuc

SEQ ID NO: 2863174 - RNA, 20 nt, Human
agucauuagacuccuccucc

SEQ ID NO: 2863175 - RNA, 13 nt, Human
agugauccuccca

SEQ ID NO: 2863176 - RNA, 13 nt, Human
agugauauuucuc

SEQ ID NO: 2863177 - RNA, 14 nt, Human
agugauauuucucu

SEQ ID NO: 2863178 - RNA, 15 nt, Human
agugauauuucucua

SEQ ID NO: 2863179 - RNA, 16 nt, Human
agugauauuucucuag

SEQ ID NO: 2863180 - RNA, 22 nt, Human
agugauauuucucuaguaguua

SEQ ID NO: 2863181 - RNA, 19 nt, Human
agugauauggcagaagaca

SEQ ID NO: 2863182 - RNA, 24 nt, Human
agugauauggcagaagacaccaga

SEQ ID NO: 2863183 - RNA, 21 nt, Human
agugauauggcagaagacacc

SEQ ID NO: 2863184 - RNA, 22 nt, Human
agugauauggcagaagacacca

SEQ ID NO: 2863185 - RNA, 17 nt, Human
aguccuggauguugugu

SEQ ID NO: 2863186 - RNA, 18 nt, Human
aguccuggauguugugug

SEQ ID NO: 2863187 - RNA, 14 nt, Human
agugacaaaauaga

SEQ ID NO: 2863188 - RNA, 13 nt, Human
agugacaaaccau

SEQ ID NO: 2863189 - RNA, 13 nt, Human
agugacacagcag

SEQ ID NO: 2863190 - RNA, 13 nt, Human
aguccugcuccag

SEQ ID NO: 2863191 - RNA, 14 nt, Human
aguccugcuccaga

SEQ ID NO: 2863192 - RNA, 15 nt, Human
aguccugcuccagaa

SEQ ID NO: 2863193 - RNA, 18 nt, Human
aguccugcuccagaauuu

SEQ ID NO: 2863194 - RNA, 23 nt, Human
aguccugcuccagaauuuggaaa

SEQ ID NO: 2863195 - RNA, 21 nt, Human
aguccuggagcaaucacagau

SEQ ID NO: 2863196 - RNA, 22 nt, Human
aguccuggagcaaucacagaug

SEQ ID NO: 2863197 - RNA, 21 nt, Human
aguccugccuggccaggcaga

SEQ ID NO: 2863198 - RNA, 20 nt, Human
aguccugccuggccaggcag

SEQ ID NO: 2863199 - RNA, 17 nt, Human
aguccugccuggccagg

SEQ ID NO: 2863200 - RNA, 16 nt, Human
aguccugccuggccag

SEQ ID NO: 2863201 - RNA, 15 nt, Human
aguccugccuggcca

SEQ ID NO: 2863202 - RNA, 14 nt, Human
aguccugccuggcc

SEQ ID NO: 2863203 - RNA, 13 nt, Human
aguccugccuggc

SEQ ID NO: 2863204 - RNA, 16 nt, Human
aguccugccucagccu

SEQ ID NO: 2863205 - RNA, 23 nt, Human
agugacacagcagcuucaccaga

SEQ ID NO: 2863206 - RNA, 17 nt, Human
agugacacagcagcuuc

SEQ ID NO: 2863207 - RNA, 18 nt, Human
agugacacagcagcuuca

SEQ ID NO: 2863208 - RNA, 21 nt, Human
agugacagaccacaucuuuau

SEQ ID NO: 2863209 - RNA, 18 nt, Human
aucaucugugugaaaaug

SEQ ID NO: 2863210 - RNA, 19 nt, Human
aucaucugugugaaaaugg

SEQ ID NO: 2863211 - RNA, 18 nt, Human
aucaucuguggaacccau

SEQ ID NO: 2863212 - RNA, 13 nt, Human
aucaucuguguga

SEQ ID NO: 2863213 - RNA, 16 nt, Human
aucaucugugugaaaa

SEQ ID NO: 2863214 - RNA, 18 nt, Human
aucaucuauaaagaagaa

SEQ ID NO: 2863215 - RNA, 14 nt, Human
aucaucuauuuuga

SEQ ID NO: 2863216 - RNA, 15 nt, Human
aucaucuauuuugau

SEQ ID NO: 2863217 - RNA, 16 nt, Human
aucaucuauuuugaug

SEQ ID NO: 2863218 - RNA, 19 nt, Human
aucaucuauuuugaugcag

SEQ ID NO: 2863219 - RNA, 21 nt, Human
aucaucuauuuugaugcagca

SEQ ID NO: 2863220 - RNA, 23 nt, Human
aucaucuauuuugaugcagcauu

SEQ ID NO: 2863221 - RNA, 23 nt, Human
aucaucugaaggggcaaauucuu

SEQ ID NO: 2863222 - RNA, 23 nt, Human
aucaugguguaauaagacauaac

SEQ ID NO: 2863223 - RNA, 11 nt, Human
aucauguaaag

SEQ ID NO: 2863224 - RNA, 14 nt, Human
aucauguaaagaaa

SEQ ID NO: 2863225 - RNA, 17 nt, Human
aucauguaaagaaaugu

SEQ ID NO: 2863226 - RNA, 18 nt, Human
aucauguaaagaaauguc

SEQ ID NO: 2863227 - RNA, 17 nt, Human
aucaugguguaauaaga

SEQ ID NO: 2863228 - RNA, 18 nt, Human
aucaugguguaauaagac

SEQ ID NO: 2863229 - RNA, 19 nt, Human
aucaugguguaauaagaca

SEQ ID NO: 2863230 - RNA, 20 nt, Human
aucaugguguaauaagacau

SEQ ID NO: 2863231 - RNA, 21 nt, Human
aucaugguguaauaagacaua

SEQ ID NO: 2863232 - RNA, 14 nt, Human
aucaugguguaaua

SEQ ID NO: 2863233 - RNA, 16 nt, Human
aucaugguguaauaag

SEQ ID NO: 2863234 - RNA, 16 nt, Human
aucaucuauaaagaag

SEQ ID NO: 2863235 - RNA, 22 nt, Human
aucaugguagagaaucucuccc

SEQ ID NO: 2863236 - RNA, 15 nt, Human
aucaccugccuguua

SEQ ID NO: 2863237 - RNA, 21 nt, Human
aucaccuggcuuguuuauuuu

SEQ ID NO: 2863238 - RNA, 14 nt, Human
aucaccugccuguu

SEQ ID NO: 2863239 - RNA, 12 nt, Human
aucaccugccug

SEQ ID NO: 2863240 - RNA, 12 nt, Human
aucaccugaggu

SEQ ID NO: 2863241 - RNA, 20 nt, Human
aucaccucuguaauuuuuca

SEQ ID NO: 2863242 - RNA, 15 nt, Human
aucaccucaggccag

SEQ ID NO: 2863243 - RNA, 12 nt, Human
aucaccucaggc

SEQ ID NO: 2863244 - RNA, 13 nt, Human
aucaccugcccug

SEQ ID NO: 2863245 - RNA, 12 nt, Human
aucaccugcccu

SEQ ID NO: 2863246 - RNA, 14 nt, Human
aucaccucaggcca

SEQ ID NO: 2863247 - RNA, 15 nt, Human
aucagccucuuaaag

SEQ ID NO: 2863248 - RNA, 13 nt, Human
aucagccucuuaa

SEQ ID NO: 2863249 - RNA, 11 nt, Human
aucagccucuu

SEQ ID NO: 2863250 - RNA, 15 nt, Human
aucagccacauucua

SEQ ID NO: 2863251 - RNA, 13 nt, Human
aucagccagacau

SEQ ID NO: 2863252 - RNA, 12 nt, Human
aucagccagcug

SEQ ID NO: 2863253 - RNA, 13 nt, Human
aucagccagcugc

SEQ ID NO: 2863254 - RNA, 14 nt, Human
aucagccagcugcc

SEQ ID NO: 2863255 - RNA, 20 nt, Human
aucagcccaacgggaagcaa

SEQ ID NO: 2863256 - RNA, 16 nt, Human
auccacccaccucagc

SEQ ID NO: 2863257 - RNA, 20 nt, Human
auccacccaccucagccucc

SEQ ID NO: 2863258 - RNA, 18 nt, Human
auccacccaccucagccu

SEQ ID NO: 2863259 - RNA, 13 nt, Human
aucccgagucugg

SEQ ID NO: 2863260 - RNA, 15 nt, Human
aucccgagucuggga

SEQ ID NO: 2863261 - RNA, 16 nt, Human
aucccgagucugggac

SEQ ID NO: 2863262 - RNA, 17 nt, Human
aucccgagucugggaca

SEQ ID NO: 2863263 - RNA, 13 nt, Human
aucccgaagaaug

SEQ ID NO: 2863264 - RNA, 21 nt, Human
aucccgaagaauggagaggaa

SEQ ID NO: 2863265 - RNA, 22 nt, Human
aucccgaagaauggagaggaac

SEQ ID NO: 2863266 - RNA, 16 nt, Human
auccacccauauguua

SEQ ID NO: 2863267 - RNA, 10 nt, Human
auccacccca

SEQ ID NO: 2863268 - RNA, 15 nt, Human
aucccggaggaaauc

SEQ ID NO: 2863269 - RNA, 16 nt, Human
aucccggaggaaaucu

SEQ ID NO: 2863270 - RNA, 17 nt, Human
aucccggaggaaaucug

SEQ ID NO: 2863271 - RNA, 14 nt, Human
aucccggcugcccu

SEQ ID NO: 2863272 - RNA, 21 nt, Human
aucccuagacuuuaggcuuuc

SEQ ID NO: 2863273 - RNA, 22 nt, Human
aucccuagacuuuaggcuuuca

SEQ ID NO: 2863274 - RNA, 21 nt, Human
aucccucacacauccagacau

SEQ ID NO: 2863275 - RNA, 16 nt, Human
auccuccguccagccg

SEQ ID NO: 2863276 - RNA, 15 nt, Human
auccuccguccagcc

SEQ ID NO: 2863277 - RNA, 18 nt, Human
aucccucaccuucugagu

SEQ ID NO: 2863278 - RNA, 12 nt, Human
auccucccaggc

SEQ ID NO: 2863279 - RNA, 16 nt, Human
aucccucaccuucuga

SEQ ID NO: 2863280 - RNA, 17 nt, Human
aucccucaccuucugag

SEQ ID NO: 2863281 - RNA, 13 nt, Human
auccuuucuaaca

SEQ ID NO: 2863282 - RNA, 15 nt, Human
auccuuucugccgac

SEQ ID NO: 2863283 - RNA, 16 nt, Human
auccuuucugccgacc

SEQ ID NO: 2863284 - RNA, 19 nt, Human
auccuuuguuuucugacua

SEQ ID NO: 2863285 - RNA, 21 nt, Human
auccuuuguuuucugacuaau

SEQ ID NO: 2863286 - RNA, 23 nt, Human
auccuuuguuuucugacuaauua

SEQ ID NO: 2863287 - RNA, 15 nt, Human
auccuuugcagggca

SEQ ID NO: 2863288 - RNA, 16 nt, Human
auccuuugcagggcag

SEQ ID NO: 2863289 - RNA, 17 nt, Human
auccuuugcagggcagc

SEQ ID NO: 2863290 - RNA, 20 nt, Human
auccuuugcagggcagcccc

SEQ ID NO: 2863291 - RNA, 18 nt, Human
auccuuugccugccuggu

SEQ ID NO: 2863292 - RNA, 15 nt, Human
auccuuuucugcaga

SEQ ID NO: 2863293 - RNA, 15 nt, Human
auccuuuucuucuau

SEQ ID NO: 2863294 - RNA, 16 nt, Human
auccuuuucuucuaug

SEQ ID NO: 2863295 - RNA, 18 nt, Human
auccuuuucuucuaugua

SEQ ID NO: 2863296 - RNA, 11 nt, Human
auccuuuugua

SEQ ID NO: 2863297 - RNA, 13 nt, Human
auccuuuuguaga

SEQ ID NO: 2863298 - RNA, 18 nt, Human
auccuuuuguagaaugaa

SEQ ID NO: 2863299 - RNA, 21 nt, Human
aucgagugagacaaaauuuua

SEQ ID NO: 2863300 - RNA, 16 nt, Human
aucgauguuuuauuau

SEQ ID NO: 2863301 - RNA, 17 nt, Human
aucugggccagaauuuc

SEQ ID NO: 2863302 - RNA, 12 nt, Human
aucugggccugg

SEQ ID NO: 2863303 - RNA, 13 nt, Human
aucugggccuggg

SEQ ID NO: 2863304 - RNA, 14 nt, Human
aucugggccugggc

SEQ ID NO: 2863305 - RNA, 16 nt, Human
aucugggccugggcua

SEQ ID NO: 2863306 - RNA, 22 nt, Human
aucugggcuccuaaccuuccug

SEQ ID NO: 2863307 - RNA, 21 nt, Human
aucuggaaucuggagaccagg

SEQ ID NO: 2863308 - RNA, 21 nt, Human
aucuggaagggccaaggucug

SEQ ID NO: 2863309 - RNA, 14 nt, Human
aucuggaagaaaaa

SEQ ID NO: 2863310 - RNA, 18 nt, Human
aucugggcauagaugcag

SEQ ID NO: 2863311 - RNA, 15 nt, Human
aucugggccagaauu

SEQ ID NO: 2863312 - RNA, 15 nt, Human
aucuucucaaguucu

SEQ ID NO: 2863313 - RNA, 16 nt, Human
aucuucucaaguucua

SEQ ID NO: 2863314 - RNA, 18 nt, Human
aucuucucaaguucuaag

SEQ ID NO: 2863315 - RNA, 19 nt, Human
aucuucucaaguucuaaga

SEQ ID NO: 2863316 - RNA, 20 nt, Human
aucuucucaaguucuaagau

SEQ ID NO: 2863317 - RNA, 23 nt, Human
aucuucucaaguucuaagauucu

SEQ ID NO: 2863318 - RNA, 17 nt, Human
aucuuauaguucuaggc

SEQ ID NO: 2863319 - RNA, 15 nt, Human
aucuuauaguucuag

SEQ ID NO: 2863320 - RNA, 13 nt, Human
aucuuauacugua

SEQ ID NO: 2863321 - RNA, 16 nt, Human
aucuuauacuguacaa

SEQ ID NO: 2863322 - RNA, 17 nt, Human
aucuuauacuguacaau

SEQ ID NO: 2863323 - RNA, 19 nt, Human
aucuuauacuguacaauaa

SEQ ID NO: 2863324 - RNA, 15 nt, Human
aucuuauagcacuuu

SEQ ID NO: 2863325 - RNA, 17 nt, Human
aucuuauagcacuuuga

SEQ ID NO: 2863326 - RNA, 18 nt, Human
aucuuauagcacuuugaa

SEQ ID NO: 2863327 - RNA, 21 nt, Human
aucuuauagcacuuugaaaua

SEQ ID NO: 2863328 - RNA, 17 nt, Human
aucuucacccaggccua

SEQ ID NO: 2863329 - RNA, 19 nt, Human
aucuucacccaggccuaug

SEQ ID NO: 2863330 - RNA, 22 nt, Human
aucucucuacuccuaccucagc

SEQ ID NO: 2863331 - RNA, 21 nt, Human
aucucucuacuccuaccucag

SEQ ID NO: 2863332 - RNA, 13 nt, Human
aucucuauuuaau

SEQ ID NO: 2863333 - RNA, 14 nt, Human
aucucuauuuaaua

SEQ ID NO: 2863334 - RNA, 15 nt, Human
aucucuauuuaauau

SEQ ID NO: 2863335 - RNA, 16 nt, Human
aucucuauuuaauauu

SEQ ID NO: 2863336 - RNA, 13 nt, Human
aucucuauacugc

SEQ ID NO: 2863337 - RNA, 21 nt, Human
aucucuauauaaaaacaaaaa

SEQ ID NO: 2863338 - RNA, 22 nt, Human
aucucuaauauggcaaaaaugg

SEQ ID NO: 2863339 - RNA, 13 nt, Human
aucucuaauaugg

SEQ ID NO: 2863340 - RNA, 15 nt, Human
aucucuaauauggca

SEQ ID NO: 2863341 - RNA, 22 nt, Human
aucucguuuuucuucuuaagac

SEQ ID NO: 2863342 - RNA, 23 nt, Human
aucucguuuuucuucuuaagacu

SEQ ID NO: 2863343 - RNA, 13 nt, Human
aucugcuccuccc

SEQ ID NO: 2863344 - RNA, 18 nt, Human
aucugcuggaguuucaug

SEQ ID NO: 2863345 - RNA, 14 nt, Human
aucugcuggaguuu

SEQ ID NO: 2863346 - RNA, 14 nt, Human
aucucucugcagcu

SEQ ID NO: 2863347 - RNA, 15 nt, Human
aucucucugcagcug

SEQ ID NO: 2863348 - RNA, 16 nt, Human
aucucucugcagcugc

SEQ ID NO: 2863349 - RNA, 17 nt, Human
aucucucugcagcugcc

SEQ ID NO: 2863350 - RNA, 18 nt, Human
aucucucugcagcugccg

SEQ ID NO: 2863351 - RNA, 19 nt, Human
aucucucugcagcugccgg

SEQ ID NO: 2863352 - RNA, 23 nt, Human
aucucucuacuccuaccucagcc

SEQ ID NO: 2863353 - RNA, 18 nt, Human
aucucucugugcugugga

SEQ ID NO: 2863354 - RNA, 23 nt, Human
aucucucugugcuguggaagcaa

SEQ ID NO: 2863355 - RNA, 23 nt, Human
aucuugaaauuaagaaggcaaaa

SEQ ID NO: 2863356 - RNA, 22 nt, Human
aucuugaaauuaagaaggcaaa

SEQ ID NO: 2863357 - RNA, 21 nt, Human
aucuugaaauuaagaaggcaa

SEQ ID NO: 2863358 - RNA, 12 nt, Human
aucuugaaauua

SEQ ID NO: 2863359 - RNA, 19 nt, Human
aucuucugaaaugaaacaa

SEQ ID NO: 2863360 - RNA, 13 nt, Human
aucuucuccagau

SEQ ID NO: 2863361 - RNA, 20 nt, Human
augaaacacucaguuguuca

SEQ ID NO: 2863362 - RNA, 13 nt, Human
augaaacagaaac

SEQ ID NO: 2863363 - RNA, 13 nt, Human
augaaaauuugag

SEQ ID NO: 2863364 - RNA, 19 nt, Human
augaaaauuugagacuauu

SEQ ID NO: 2863365 - RNA, 17 nt, Human
augaaaauuuuaaaaau

SEQ ID NO: 2863366 - RNA, 21 nt, Human
augaaaauuuuaccagcagaa

SEQ ID NO: 2863367 - RNA, 16 nt, Human
augaaacaaauaauca

SEQ ID NO: 2863368 - RNA, 12 nt, Human
augaaacacagc

SEQ ID NO: 2863369 - RNA, 22 nt, Human
augaaacagaaacaaaaacacu

SEQ ID NO: 2863370 - RNA, 18 nt, Human
augaaacagaaacaaaaa

SEQ ID NO: 2863371 - RNA, 17 nt, Human
augaaaagauucuucug

SEQ ID NO: 2863372 - RNA, 19 nt, Human
augaaaagauucuucugug

SEQ ID NO: 2863373 - RNA, 13 nt, Human
augaaaagauuua

SEQ ID NO: 2863374 - RNA, 15 nt, Human
augaaaagauuuaag

SEQ ID NO: 2863375 - RNA, 12 nt, Human
augaaaacucau

SEQ ID NO: 2863376 - RNA, 14 nt, Human
augaaaacuauaca

SEQ ID NO: 2863377 - RNA, 15 nt, Human
augaaaacuauacaa

SEQ ID NO: 2863378 - RNA, 17 nt, Human
augaaaacuauacaaca

SEQ ID NO: 2863379 - RNA, 13 nt, Human
augaaaagacaag

SEQ ID NO: 2863380 - RNA, 18 nt, Human
augaaaagacaagaaaau

SEQ ID NO: 2863381 - RNA, 22 nt, Human
augaaaagacaagaaaaucagg

SEQ ID NO: 2863382 - RNA, 16 nt, Human
augaaaauaaauagcu

SEQ ID NO: 2863383 - RNA, 21 nt, Human
aucuuuuuuguuaacugauuu

SEQ ID NO: 2863384 - RNA, 14 nt, Human
aucuuuuuucacaa

SEQ ID NO: 2863385 - RNA, 17 nt, Human
aucuuuuuucacaaauu

SEQ ID NO: 2863386 - RNA, 14 nt, Human
aucuuuuuucaaaa

SEQ ID NO: 2863387 - RNA, 22 nt, Human
augacccaggcugggcaaggag

SEQ ID NO: 2863388 - RNA, 16 nt, Human
augacccaggcugggc

SEQ ID NO: 2863389 - RNA, 20 nt, Human
augaccucauuaaccgaugc

SEQ ID NO: 2863390 - RNA, 20 nt, Human
augaccucuguccucccucu

SEQ ID NO: 2863391 - RNA, 23 nt, Human
augacccugcgaaggggcccugg

SEQ ID NO: 2863392 - RNA, 14 nt, Human
augacucagaauau

SEQ ID NO: 2863393 - RNA, 19 nt, Human
augacucaggacauccccc

SEQ ID NO: 2863394 - RNA, 17 nt, Human
augacucacaugaugca

SEQ ID NO: 2863395 - RNA, 15 nt, Human
augacuauguaaacu

SEQ ID NO: 2863396 - RNA, 16 nt, Human
augacuauguaaacua

SEQ ID NO: 2863397 - RNA, 23 nt, Human
augacuacuuagcauccuaagaa

SEQ ID NO: 2863398 - RNA, 14 nt, Human
augaccuggauaac

SEQ ID NO: 2863399 - RNA, 22 nt, Human
augacucccuuaaaauagaaau

SEQ ID NO: 2863400 - RNA, 16 nt, Human
augagcuauuaaaacu

SEQ ID NO: 2863401 - RNA, 17 nt, Human
augagcuauuaaaacuc

SEQ ID NO: 2863402 - RNA, 22 nt, Human
augagcuauuaaaacucagccu

SEQ ID NO: 2863403 - RNA, 17 nt, Human
auguaauaacugugaag

SEQ ID NO: 2863404 - RNA, 19 nt, Human
auguaaucucucugcagcu

SEQ ID NO: 2863405 - RNA, 20 nt, Human
auguaaucucucugcagcug

SEQ ID NO: 2863406 - RNA, 21 nt, Human
auguaaucucucugcagcugc

SEQ ID NO: 2863407 - RNA, 22 nt, Human
auguaaucucucugcagcugcc

SEQ ID NO: 2863408 - RNA, 23 nt, Human
auguaaucucucugcagcugccg

SEQ ID NO: 2863409 - RNA, 24 nt, Human
auguaagauuauagauucuaaaga

SEQ ID NO: 2863410 - RNA, 14 nt, Human
auggucuaaaaaua

SEQ ID NO: 2863411 - RNA, 14 nt, Human
auggucucagaaac

SEQ ID NO: 2863412 - RNA, 18 nt, Human
auggucucagaaaccaaa

SEQ ID NO: 2863413 - RNA, 13 nt, Human
auggucuggucua

SEQ ID NO: 2863414 - RNA, 14 nt, Human
auggucuggucuau

SEQ ID NO: 2863415 - RNA, 16 nt, Human
auggucuggucuaugu

SEQ ID NO: 2863416 - RNA, 15 nt, Human
auggucuucagccuc

SEQ ID NO: 2863417 - RNA, 17 nt, Human
auggucuucagccucuu

SEQ ID NO: 2863418 - RNA, 12 nt, Human
auggugaaaaug

SEQ ID NO: 2863419 - RNA, 14 nt, Human
auggugaaaaugua

SEQ ID NO: 2863420 - RNA, 17 nt, Human
auggugaaauuuauuag

SEQ ID NO: 2863421 - RNA, 16 nt, Human
auguaacuuuuguaag

SEQ ID NO: 2863422 - RNA, 14 nt, Human
auguaacuuuugua

SEQ ID NO: 2863423 - RNA, 16 nt, Human
auggugaaaauguacu

SEQ ID NO: 2863424 - RNA, 17 nt, Human
auggugaaaauguacug

SEQ ID NO: 2863425 - RNA, 21 nt, Human
auguaagauuauagauucuaa

SEQ ID NO: 2863426 - RNA, 22 nt, Human
auguaagauuauagauucuaaa

SEQ ID NO: 2863427 - RNA, 15 nt, Human
auguaagauuauaga

SEQ ID NO: 2863428 - RNA, 17 nt, Human
auguaagauuauagauu

SEQ ID NO: 2863429 - RNA, 19 nt, Human
auguaagauuauagauucu

SEQ ID NO: 2863430 - RNA, 20 nt, Human
auguaagauuauagauucua

SEQ ID NO: 2863431 - RNA, 19 nt, Human
auguaagaauucagaagac

SEQ ID NO: 2863432 - RNA, 18 nt, Human
auguaacuuuuguaagac

SEQ ID NO: 2863433 - RNA, 17 nt, Human
auguaacuuuuguaaga

SEQ ID NO: 2863434 - RNA, 17 nt, Human
augucacaggcaggucc

SEQ ID NO: 2863435 - RNA, 16 nt, Human
augucacaggcagguc

SEQ ID NO: 2863436 - RNA, 14 nt, Human
augucacaggcagg

SEQ ID NO: 2863437 - RNA, 15 nt, Human
augucacaggcaggu

SEQ ID NO: 2863438 - RNA, 16 nt, Human
augucacguacugucu

SEQ ID NO: 2863439 - RNA, 19 nt, Human
augucacguacugucugau

SEQ ID NO: 2863440 - RNA, 20 nt, Human
augucacguacugucugauu

SEQ ID NO: 2863441 - RNA, 21 nt, Human
augucacguacugucugauug

SEQ ID NO: 2863442 - RNA, 14 nt, Human
augucacuagaaug

SEQ ID NO: 2863443 - RNA, 16 nt, Human
augucacuagaaugga

SEQ ID NO: 2863444 - RNA, 22 nt, Human
augucacuagaauggauaaaau

SEQ ID NO: 2863445 - RNA, 19 nt, Human
augucagacagaacuugaa

SEQ ID NO: 2863446 - RNA, 16 nt, Human
augucagacuggcugg

SEQ ID NO: 2863447 - RNA, 23 nt, Human
augucagacauccauguuuguaa

SEQ ID NO: 2863448 - RNA, 14 nt, Human
augucagauacaau

SEQ ID NO: 2863449 - RNA, 16 nt, Human
augucagauacaaugu

SEQ ID NO: 2863450 - RNA, 18 nt, Human
augucagauacaauguau

SEQ ID NO: 2863451 - RNA, 14 nt, Human
auguacaagaugaa

SEQ ID NO: 2863452 - RNA, 23 nt, Human
auguaaucugauggcuucuccag

SEQ ID NO: 2863453 - RNA, 23 nt, Human
auguacaauugugggcauaaacu

SEQ ID NO: 2863454 - RNA, 13 nt, Human
auguacagacaga

SEQ ID NO: 2863455 - RNA, 18 nt, Human
auguacagacauauuuaa

SEQ ID NO: 2863456 - RNA, 19 nt, Human
auguacagacauauuuaac

SEQ ID NO: 2863457 - RNA, 23 nt, Human
auguacagacauauuuaacuggu

SEQ ID NO: 2863458 - RNA, 21 nt, Human
augucaaacaugagaugugug

SEQ ID NO: 2863459 - RNA, 15 nt, Human
auguacaugagaagg

SEQ ID NO: 2863460 - RNA, 15 nt, Human
augucaagaggcuga

SEQ ID NO: 2863461 - RNA, 20 nt, Human
augucaaagagaaaacuuau

SEQ ID NO: 2863462 - RNA, 20 nt, Human
augucuuggacacuguacaa

SEQ ID NO: 2863463 - RNA, 16 nt, Human
augucuuggacacugu

SEQ ID NO: 2863464 - RNA, 19 nt, Human
augucuuggacacuguaca

SEQ ID NO: 2863465 - RNA, 14 nt, Human
augucuuguacaug

SEQ ID NO: 2863466 - RNA, 17 nt, Human
augucuuguacaugugu

SEQ ID NO: 2863467 - RNA, 22 nt, Human
augucuuguacauguguagccu

SEQ ID NO: 2863468 - RNA, 13 nt, Human
augucuuggacac

SEQ ID NO: 2863469 - RNA, 19 nt, Human
augucuugcuguugacaua

SEQ ID NO: 2863470 - RNA, 20 nt, Human
augucuugcuguugacauau

SEQ ID NO: 2863471 - RNA, 22 nt, Human
augucuugcuguugacauauuu

SEQ ID NO: 2863472 - RNA, 23 nt, Human
auggugacuuccucgccucuccc

SEQ ID NO: 2863473 - RNA, 15 nt, Human
augugguuacacacu

SEQ ID NO: 2863474 - RNA, 15 nt, Human
augugguucuucaaa

SEQ ID NO: 2863475 - RNA, 16 nt, Human
augugguugaagagca

SEQ ID NO: 2863476 - RNA, 19 nt, Human
augugguuuauagagggcc

SEQ ID NO: 2863477 - RNA, 17 nt, Human
augugguuugguuccuc

SEQ ID NO: 2863478 - RNA, 19 nt, Human
augugguuugguuccucuc

SEQ ID NO: 2863479 - RNA, 21 nt, Human
augugguuugguuccucucug

SEQ ID NO: 2863480 - RNA, 22 nt, Human
augugguuugguuccucucugg

SEQ ID NO: 2863481 - RNA, 13 nt, Human
augugguuuauag

SEQ ID NO: 2863482 - RNA, 14 nt, Human
augugggucuucca

SEQ ID NO: 2863483 - RNA, 15 nt, Human
augugggucuuccag

SEQ ID NO: 2863484 - RNA, 17 nt, Human
augugggucuuccaggg

SEQ ID NO: 2863485 - RNA, 13 nt, Human
auguggugaugau

SEQ ID NO: 2863486 - RNA, 13 nt, Human
auguggucucagg

SEQ ID NO: 2863487 - RNA, 14 nt, Human
auguggucucagga

SEQ ID NO: 2863488 - RNA, 15 nt, Human
auguggucucaggau

SEQ ID NO: 2863489 - RNA, 18 nt, Human
augugguggcacaggccc

SEQ ID NO: 2863490 - RNA, 22 nt, Human
augugguggcacaggcccccuu

SEQ ID NO: 2863491 - RNA, 16 nt, Human
auguggguugccuggu

SEQ ID NO: 2863492 - RNA, 20 nt, Human
augugggcuaguugggcuuc

SEQ ID NO: 2863493 - RNA, 18 nt, Human
auuaaauucacaaacuuu

SEQ ID NO: 2863494 - RNA, 17 nt, Human
auuaaauucacaaacuu

SEQ ID NO: 2863495 - RNA, 16 nt, Human
auuaaauucacaaacu

SEQ ID NO: 2863496 - RNA, 14 nt, Human
auuaaauucacaaa

SEQ ID NO: 2863497 - RNA, 13 nt, Human
auuaaauucacaa

SEQ ID NO: 2863498 - RNA, 15 nt, Human
auuaaauaagauucu

SEQ ID NO: 2863499 - RNA, 16 nt, Human
auuaaauaagauucua

SEQ ID NO: 2863500 - RNA, 19 nt, Human
auuaaauaagauucuaacg

SEQ ID NO: 2863501 - RNA, 16 nt, Human
auuaaaguuugcuugu

SEQ ID NO: 2863502 - RNA, 23 nt, Human
auuaaaguuugcuuguuucuugg

SEQ ID NO: 2863503 - RNA, 13 nt, Human
auuaaauaaaauc

SEQ ID NO: 2863504 - RNA, 14 nt, Human
auuaaauaaaauca

SEQ ID NO: 2863505 - RNA, 19 nt, Human
auuaaauaaaaucaauuuu

SEQ ID NO: 2863506 - RNA, 21 nt, Human
auuaaauaaaaucaauuuuua

SEQ ID NO: 2863507 - RNA, 18 nt, Human
auguuuuaagaggcaggg

SEQ ID NO: 2863508 - RNA, 16 nt, Human
auguuuuaagaggcag

SEQ ID NO: 2863509 - RNA, 16 nt, Human
auguuugcacuuguga

SEQ ID NO: 2863510 - RNA, 13 nt, Human
auguuugcagggg

SEQ ID NO: 2863511 - RNA, 18 nt, Human
auguuugaggagcauguu

SEQ ID NO: 2863512 - RNA, 19 nt, Human
auguuugaggagcauguuu

SEQ ID NO: 2863513 - RNA, 22 nt, Human
auguuugaggagcauguuuugu

SEQ ID NO: 2863514 - RNA, 18 nt, Human
auguuuguggccucagaa

SEQ ID NO: 2863515 - RNA, 14 nt, Human
auguuuguuaaaaa

SEQ ID NO: 2863516 - RNA, 17 nt, Human
auguuuguuaaaaauaa

SEQ ID NO: 2863517 - RNA, 14 nt, Human
auguuuuaaaugua

SEQ ID NO: 2863518 - RNA, 15 nt, Human
auguuuuaaauguac

SEQ ID NO: 2863519 - RNA, 18 nt, Human
auguuuuaaauguacaga

SEQ ID NO: 2863520 - RNA, 17 nt, Human
auuaaagugcuaagguu

SEQ ID NO: 2863521 - RNA, 18 nt, Human
auuaaagugcuaagguuc

SEQ ID NO: 2863522 - RNA, 19 nt, Human
auuaaagugcuaagguucu

SEQ ID NO: 2863523 - RNA, 20 nt, Human
auuaaagugcuaagguucua

SEQ ID NO: 2863524 - RNA, 21 nt, Human
auuaaaguucuguaaaauaua

SEQ ID NO: 2863525 - RNA, 23 nt, Human
auuaaagugcuaagguucuaagg

SEQ ID NO: 2863526 - RNA, 21 nt, Human
auuaaagugcuaagguucuaa

SEQ ID NO: 2863527 - RNA, 22 nt, Human
auuaaagugcuaagguucuaag

SEQ ID NO: 2863528 - RNA, 20 nt, Human
auguucuuaugcaaaaugga

SEQ ID NO: 2863529 - RNA, 21 nt, Human
auguucuuaugcaaaauggaa

SEQ ID NO: 2863530 - RNA, 19 nt, Human
auguucuugcagucaucag

SEQ ID NO: 2863531 - RNA, 11 nt, Human
auguucuuuau

SEQ ID NO: 2863532 - RNA, 13 nt, Human
auguucuuuauau

SEQ ID NO: 2863533 - RNA, 16 nt, Human
auguucuuuauauaca

SEQ ID NO: 2863534 - RNA, 20 nt, Human
auguucuuuauauacaauaa

SEQ ID NO: 2863535 - RNA, 22 nt, Human
auguucuuuauauacaauaaug

SEQ ID NO: 2863536 - RNA, 12 nt, Human
auguuugaaaug

SEQ ID NO: 2863537 - RNA, 22 nt, Human
auguuugaaaugaggucuguuu

SEQ ID NO: 2863538 - RNA, 11 nt, Human
auguuugaaua

SEQ ID NO: 2863539 - RNA, 13 nt, Human
auguuugaauaug

SEQ ID NO: 2863540 - RNA, 17 nt, Human
auguuugaauauggaca

SEQ ID NO: 2863541 - RNA, 21 nt, Human
auguuugaauauggacaagag

SEQ ID NO: 2863542 - RNA, 18 nt, Human
auguucucugaggacacu

SEQ ID NO: 2863543 - RNA, 21 nt, Human
augugucaacuucaacauuua

SEQ ID NO: 2863544 - RNA, 20 nt, Human
augugucccgaauccacagu

SEQ ID NO: 2863545 - RNA, 18 nt, Human
auguguccuaucuaucuu

SEQ ID NO: 2863546 - RNA, 19 nt, Human
auguguccuaucuaucuuc

SEQ ID NO: 2863547 - RNA, 22 nt, Human
auguguccuaucuaucuuccaa

SEQ ID NO: 2863548 - RNA, 13 nt, Human
auguguccugguu

SEQ ID NO: 2863549 - RNA, 16 nt, Human
augugucuguauuuca

SEQ ID NO: 2863550 - RNA, 18 nt, Human
augugucuguauuucaug

SEQ ID NO: 2863551 - RNA, 20 nt, Human
augugucuguauuucaugug

SEQ ID NO: 2863552 - RNA, 21 nt, Human
augugucuguauuucaugugg

SEQ ID NO: 2863553 - RNA, 18 nt, Human
auguguccucagggagca

SEQ ID NO: 2863554 - RNA, 17 nt, Human
auguguccucagggagc

SEQ ID NO: 2863555 - RNA, 20 nt, Human
auguguauguacguuuguau

SEQ ID NO: 2863556 - RNA, 14 nt, Human
augugucacuugug

SEQ ID NO: 2863557 - RNA, 15 nt, Human
augugucacuugugc

SEQ ID NO: 2863558 - RNA, 17 nt, Human
augugucacuugugcuu

SEQ ID NO: 2863559 - RNA, 21 nt, Human
augugucaguggggcucucug

SEQ ID NO: 2863560 - RNA, 22 nt, Human
augugucaguggggcucucuga

SEQ ID NO: 2863561 - RNA, 15 nt, Human
augugucaugcauga

SEQ ID NO: 2863562 - RNA, 14 nt, Human
auguguauuucuua

SEQ ID NO: 2863563 - RNA, 16 nt, Human
auguguauuucuuaua

SEQ ID NO: 2863564 - RNA, 14 nt, Human
auguguacauggca

SEQ ID NO: 2863565 - RNA, 16 nt, Human
auguguacauggcaga

SEQ ID NO: 2863566 - RNA, 22 nt, Human
auguguacauggcagaguuugu

SEQ ID NO: 2863567 - RNA, 15 nt, Human
auguguacucuaacu

SEQ ID NO: 2863568 - RNA, 14 nt, Human
auguguagccuaug

SEQ ID NO: 2863569 - RNA, 15 nt, Human
auguguagccuaugu

SEQ ID NO: 2863570 - RNA, 18 nt, Human
auguguacaauguacaca

SEQ ID NO: 2863571 - RNA, 20 nt, Human
auguguacaauguacacacu

SEQ ID NO: 2863572 - RNA, 23 nt, Human
auggagccagcucccucuauuua

SEQ ID NO: 2863573 - RNA, 12 nt, Human
auggagcccagg

SEQ ID NO: 2863574 - RNA, 13 nt, Human
auggagcccaggc

SEQ ID NO: 2863575 - RNA, 14 nt, Human
auggagcccaggcg

SEQ ID NO: 2863576 - RNA, 23 nt, Human
auggagcccaggcgggagcggug

SEQ ID NO: 2863577 - RNA, 16 nt, Human
auggauccuggaggau

SEQ ID NO: 2863578 - RNA, 15 nt, Human
auggagccucuucug

SEQ ID NO: 2863579 - RNA, 14 nt, Human
auggagcucagaga

SEQ ID NO: 2863580 - RNA, 22 nt, Human
auggagcucagagagggcaggc

SEQ ID NO: 2863581 - RNA, 23 nt, Human
auggagcgcaccugcccccuggu

SEQ ID NO: 2863582 - RNA, 17 nt, Human
auggagcgcaccugccc

SEQ ID NO: 2863583 - RNA, 20 nt, Human
auggagccuggcacaggacu

SEQ ID NO: 2863584 - RNA, 21 nt, Human
auggagccuggcacaggacug

SEQ ID NO: 2863585 - RNA, 22 nt, Human
auggagccuggcacaggacuga

SEQ ID NO: 2863586 - RNA, 23 nt, Human
auggagccuggcacaggacugau

SEQ ID NO: 2863587 - RNA, 20 nt, Human
auggauuaaauuuaauucuu

SEQ ID NO: 2863588 - RNA, 23 nt, Human
auggcuccgaacacccucgaagc

SEQ ID NO: 2863589 - RNA, 13 nt, Human
auggaugcaaagu

SEQ ID NO: 2863590 - RNA, 19 nt, Human
auggaugcaaaguacaaug

SEQ ID NO: 2863591 - RNA, 22 nt, Human
auggaugcaaaguacaaugugu

SEQ ID NO: 2863592 - RNA, 13 nt, Human
auggaugauucag

SEQ ID NO: 2863593 - RNA, 18 nt, Human
auggaugauucagaaauu

SEQ ID NO: 2863594 - RNA, 13 nt, Human
auggagcuggccg

SEQ ID NO: 2863595 - RNA, 20 nt, Human
auggaugaaucucccacucc

SEQ ID NO: 2863596 - RNA, 21 nt, Human
auggaugaaucucccacucca

SEQ ID NO: 2863597 - RNA, 22 nt, Human
auggaugaaucucccacuccag

SEQ ID NO: 2863598 - RNA, 21 nt, Human
auggaugauucagaaauugga

SEQ ID NO: 2863599 - RNA, 23 nt, Human
auggaugccaauauuaaaucugc

SEQ ID NO: 2863600 - RNA, 22 nt, Human
auggaugccaauauuaaaucug

SEQ ID NO: 2863601 - RNA, 13 nt, Human
auggaugccaaua

SEQ ID NO: 2863602 - RNA, 16 nt, Human
augggaauaauugcuu

SEQ ID NO: 2863603 - RNA, 17 nt, Human
augggaauaauugcuuu

SEQ ID NO: 2863604 - RNA, 14 nt, Human
auggcucugcaccc

SEQ ID NO: 2863605 - RNA, 17 nt, Human
auggcucugcaccccuc

SEQ ID NO: 2863606 - RNA, 22 nt, Human
auggcucugcaccccucugccc

SEQ ID NO: 2863607 - RNA, 23 nt, Human
auggcucugcaccccucugcccu

SEQ ID NO: 2863608 - RNA, 12 nt, Human
auggcucuggac

SEQ ID NO: 2863609 - RNA, 17 nt, Human
auggcucuggacucuaa

SEQ ID NO: 2863610 - RNA, 19 nt, Human
auggcucuggacucuaaag

SEQ ID NO: 2863611 - RNA, 22 nt, Human
auggcucuggacucuaaagacc

SEQ ID NO: 2863612 - RNA, 18 nt, Human
auggcugacuuugcucuu

SEQ ID NO: 2863613 - RNA, 14 nt, Human
auggcugcaguccu

SEQ ID NO: 2863614 - RNA, 15 nt, Human
auggcugcaguccuc

SEQ ID NO: 2863615 - RNA, 18 nt, Human
auggaacacaaacacauu

SEQ ID NO: 2863616 - RNA, 14 nt, Human
auggaaaagagaua

SEQ ID NO: 2863617 - RNA, 13 nt, Human
auggaaauguuua

SEQ ID NO: 2863618 - RNA, 16 nt, Human
augcuuuuugaauguu

SEQ ID NO: 2863619 - RNA, 22 nt, Human
augcuuuuugaauguuauuugu

SEQ ID NO: 2863620 - RNA, 19 nt, Human
auggaaaaaaaaaaaagag

SEQ ID NO: 2863621 - RNA, 23 nt, Human
auggaaaaaaaaaaaagaggaaa

SEQ ID NO: 2863622 - RNA, 14 nt, Human
auggaaaaaaugau

SEQ ID NO: 2863623 - RNA, 21 nt, Human
auggaaaaaccauuugaagug

SEQ ID NO: 2863624 - RNA, 15 nt, Human
auggaaaaacuugug

SEQ ID NO: 2863625 - RNA, 21 nt, Human
auggaaaaacuugugcuauaa

SEQ ID NO: 2863626 - RNA, 23 nt, Human
augcuuuuuauuucugcauaugu

SEQ ID NO: 2863627 - RNA, 19 nt, Human
augcuuuuuauuucugcau

SEQ ID NO: 2863628 - RNA, 16 nt, Human
augcuuuuuauuucug

SEQ ID NO: 2863629 - RNA, 22 nt, Human
augcuuuuuauuauuauuauuu

SEQ ID NO: 2863630 - RNA, 13 nt, Human
augcuuuugucua

SEQ ID NO: 2863631 - RNA, 17 nt, Human
augcuuuuacugaacuu

SEQ ID NO: 2863632 - RNA, 21 nt, Human
augcuuuuacugaacuuucuu

SEQ ID NO: 2863633 - RNA, 15 nt, Human
augcuucuuccuuac

SEQ ID NO: 2863634 - RNA, 19 nt, Human
augcaauuagccucauagu

SEQ ID NO: 2863635 - RNA, 21 nt, Human
augcaauuagguuuuuccuua

SEQ ID NO: 2863636 - RNA, 16 nt, Human
augcaauucaucccag

SEQ ID NO: 2863637 - RNA, 19 nt, Human
augcaauuuauuaaaauga

SEQ ID NO: 2863638 - RNA, 13 nt, Human
augcacagauaua

SEQ ID NO: 2863639 - RNA, 15 nt, Human
augcacagauauacu

SEQ ID NO: 2863640 - RNA, 16 nt, Human
augcacagauauacuu

SEQ ID NO: 2863641 - RNA, 17 nt, Human
augcacagauauacuuu

SEQ ID NO: 2863642 - RNA, 18 nt, Human
augcacagauauacuuug

SEQ ID NO: 2863643 - RNA, 19 nt, Human
augcacagauauacuuugu

SEQ ID NO: 2863644 - RNA, 22 nt, Human
augcacagauauacuuugugga

SEQ ID NO: 2863645 - RNA, 17 nt, Human
augaugugaaacacuuu

SEQ ID NO: 2863646 - RNA, 20 nt, Human
augaugugaaacacuuugcc

SEQ ID NO: 2863647 - RNA, 14 nt, Human
augaugugccuggg

SEQ ID NO: 2863648 - RNA, 16 nt, Human
augaugugccugggug

SEQ ID NO: 2863649 - RNA, 23 nt, Human
augauguauguugaagccuuugu

SEQ ID NO: 2863650 - RNA, 22 nt, Human
augcaauagaagugcuccccuc

SEQ ID NO: 2863651 - RNA, 23 nt, Human
augcaauagaagugcuccccucu

SEQ ID NO: 2863652 - RNA, 16 nt, Human
augcaauaaaauuauu

SEQ ID NO: 2863653 - RNA, 18 nt, Human
augcaauaaaauuauuug

SEQ ID NO: 2863654 - RNA, 19 nt, Human
augcaauaaaauuauuugc

SEQ ID NO: 2863655 - RNA, 20 nt, Human
augcaauaaaauuauuugca

SEQ ID NO: 2863656 - RNA, 21 nt, Human
augcaauaaaauuauuugcag

SEQ ID NO: 2863657 - RNA, 22 nt, Human
augcaauaaaauuauuugcagg

SEQ ID NO: 2863658 - RNA, 16 nt, Human
augaugugugaaaacu

SEQ ID NO: 2863659 - RNA, 14 nt, Human
augauguguauaua

SEQ ID NO: 2863660 - RNA, 22 nt, Human
augcaauauguuuaucaacuca

SEQ ID NO: 2863661 - RNA, 13 nt, Human
augcaauauuugu

SEQ ID NO: 2863662 - RNA, 14 nt, Human
augcaauauuugua

SEQ ID NO: 2863663 - RNA, 15 nt, Human
augcaauauuuguaa

SEQ ID NO: 2863664 - RNA, 18 nt, Human
augccuggucuuuccucu

SEQ ID NO: 2863665 - RNA, 13 nt, Human
augccuggcuucg

SEQ ID NO: 2863666 - RNA, 16 nt, Human
augccuggucuuuccu

SEQ ID NO: 2863667 - RNA, 17 nt, Human
augccugguggcagcug

SEQ ID NO: 2863668 - RNA, 12 nt, Human
augccuuugaga

SEQ ID NO: 2863669 - RNA, 13 nt, Human
augccuuugagac

SEQ ID NO: 2863670 - RNA, 14 nt, Human
augccuuugagaca

SEQ ID NO: 2863671 - RNA, 16 nt, Human
augccugguggcagcu

SEQ ID NO: 2863672 - RNA, 15 nt, Human
augccugguggcagc

SEQ ID NO: 2863673 - RNA, 16 nt, Human
augcaugacagccucu

SEQ ID NO: 2863674 - RNA, 12 nt, Human
augcauuugacu

SEQ ID NO: 2863675 - RNA, 16 nt, Human
augcauuguaguuuaa

SEQ ID NO: 2863676 - RNA, 18 nt, Human
augcacauauggacucug

SEQ ID NO: 2863677 - RNA, 12 nt, Human
augcauggaaac

SEQ ID NO: 2863678 - RNA, 20 nt, Human
augcauggaaaccugaaaaa

SEQ ID NO: 2863679 - RNA, 23 nt, Human
augcauggaaaccugaaaaaaag

SEQ ID NO: 2863680 - RNA, 23 nt, Human
augccuuugagacaguuucuuag

SEQ ID NO: 2863681 - RNA, 21 nt, Human
augccuuugagacaguuucuu

SEQ ID NO: 2863682 - RNA, 22 nt, Human
augccuuugagacaguuucuua

SEQ ID NO: 2863683 - RNA, 15 nt, Human
augccuuugagacag

SEQ ID NO: 2863684 - RNA, 16 nt, Human
augccuuugagacagu

SEQ ID NO: 2863685 - RNA, 19 nt, Human
augccuuugagacaguuuc

SEQ ID NO: 2863686 - RNA, 20 nt, Human
augccuuugagacaguuucu

SEQ ID NO: 2863687 - RNA, 21 nt, Human
agcuucagaaguuuggcaaua

SEQ ID NO: 2863688 - RNA, 21 nt, Human
agcuucagauggugaagcauu

SEQ ID NO: 2863689 - RNA, 19 nt, Human
agcuuccuucugugaaagu

SEQ ID NO: 2863690 - RNA, 23 nt, Human
agcuucagguuaucgaaauaaca

SEQ ID NO: 2863691 - RNA, 16 nt, Human
agcuucagaaguuugg

SEQ ID NO: 2863692 - RNA, 13 nt, Human
agcuucagguuau

SEQ ID NO: 2863693 - RNA, 18 nt, Human
agcuucagcuagcuuuua

SEQ ID NO: 2863694 - RNA, 11 nt, Human
agcuucagguu

SEQ ID NO: 2863695 - RNA, 19 nt, Human
agcuucucauccugcaggc

SEQ ID NO: 2863696 - RNA, 20 nt, Human
agcuucuguugcugccucau

SEQ ID NO: 2863697 - RNA, 22 nt, Human
agcuucuguugcugccucaugc

SEQ ID NO: 2863698 - RNA, 21 nt, Human
agcuucuguugcugccucaug

SEQ ID NO: 2863699 - RNA, 17 nt, Human
agcuucuaccaugaaca

SEQ ID NO: 2863700 - RNA, 18 nt, Human
agcuucuaccaugaacag

SEQ ID NO: 2863701 - RNA, 17 nt, Human
agcuucuaauaaauuau

SEQ ID NO: 2863702 - RNA, 18 nt, Human
agcuucuaauaaauuaua

SEQ ID NO: 2863703 - RNA, 23 nt, Human
agcuucuaauaaauuauacaaau

SEQ ID NO: 2863704 - RNA, 16 nt, Human
agcuuuucccuucuuu

SEQ ID NO: 2863705 - RNA, 14 nt, Human
aggaaaaacagguc

SEQ ID NO: 2863706 - RNA, 23 nt, Human
agcuucuguugcugccucaugcu

SEQ ID NO: 2863707 - RNA, 13 nt, Human
agcuuuucccuuc

SEQ ID NO: 2863708 - RNA, 17 nt, Human
agcuuuuauuguauaaa

SEQ ID NO: 2863709 - RNA, 15 nt, Human
agcuuuuauuguaua

SEQ ID NO: 2863710 - RNA, 13 nt, Human
agcuucuuaauua

SEQ ID NO: 2863711 - RNA, 14 nt, Human
agcuucuuaauuaa

SEQ ID NO: 2863712 - RNA, 19 nt, Human
agcuuuuauuguauaaacu

SEQ ID NO: 2863713 - RNA, 12 nt, Human
agcuuuucaaac

SEQ ID NO: 2863714 - RNA, 16 nt, Human
agcuuuucaaacaaga

SEQ ID NO: 2863715 - RNA, 20 nt, Human
agcuuuucaaacaagaaugu

SEQ ID NO: 2863716 - RNA, 12 nt, Human
agcuuuucaccu

SEQ ID NO: 2863717 - RNA, 14 nt, Human
agcuuuucaccuuu

SEQ ID NO: 2863718 - RNA, 22 nt, Human
agcuuuucaccuuuacuuuaga

SEQ ID NO: 2863719 - RNA, 16 nt, Human
aggaaaucucacccca

SEQ ID NO: 2863720 - RNA, 11 nt, Human
aggaaaucugu

SEQ ID NO: 2863721 - RNA, 22 nt, Human
aggaaccuuccuuccugcuuga

SEQ ID NO: 2863722 - RNA, 20 nt, Human
aggaaccuuccuuccugcuu

SEQ ID NO: 2863723 - RNA, 22 nt, Human
aggaacguaaucguguccccua

SEQ ID NO: 2863724 - RNA, 13 nt, Human
aggaaccuguccu

SEQ ID NO: 2863725 - RNA, 19 nt, Human
aggaaccuuccuuccugcu

SEQ ID NO: 2863726 - RNA, 14 nt, Human
aggaaccuuccuuc

SEQ ID NO: 2863727 - RNA, 14 nt, Human
aggaaaucucaccc

SEQ ID NO: 2863728 - RNA, 17 nt, Human
aggaaauccaggguggu

SEQ ID NO: 2863729 - RNA, 15 nt, Human
aggaaauccagggug

SEQ ID NO: 2863730 - RNA, 14 nt, Human
aggaaaaagaaaau

SEQ ID NO: 2863731 - RNA, 12 nt, Human
aggaaaaagcuc

SEQ ID NO: 2863732 - RNA, 13 nt, Human
aggaaaaagcucc

SEQ ID NO: 2863733 - RNA, 18 nt, Human
aggaaaaagcuccaugug

SEQ ID NO: 2863734 - RNA, 19 nt, Human
agcuguacuucgucuucua

SEQ ID NO: 2863735 - RNA, 21 nt, Human
agcuguacuucgucuucuaau

SEQ ID NO: 2863736 - RNA, 20 nt, Human
agcuguaguagcccuuucug

SEQ ID NO: 2863737 - RNA, 21 nt, Human
agcuguaguagcccuuucugu

SEQ ID NO: 2863738 - RNA, 23 nt, Human
agcuguaguagcccuuucugugu

SEQ ID NO: 2863739 - RNA, 11 nt, Human
agcuguagugg

SEQ ID NO: 2863740 - RNA, 14 nt, Human
agcuggugcccgga

SEQ ID NO: 2863741 - RNA, 22 nt, Human
agcuguaguagcccuuucugug

SEQ ID NO: 2863742 - RNA, 19 nt, Human
agcuggucccacucagucc

SEQ ID NO: 2863743 - RNA, 21 nt, Human
agcuggucccacucaguccau

SEQ ID NO: 2863744 - RNA, 20 nt, Human
agcuggguggcacugccaug

SEQ ID NO: 2863745 - RNA, 18 nt, Human
agcuggugagugaugcgg

SEQ ID NO: 2863746 - RNA, 22 nt, Human
agcugggugucaagagggucug

SEQ ID NO: 2863747 - RNA, 17 nt, Human
agcugggugucaagagg

SEQ ID NO: 2863748 - RNA, 18 nt, Human
agcuggguggcacugcca

SEQ ID NO: 2863749 - RNA, 19 nt, Human
agcuggguggcacugccau

SEQ ID NO: 2863750 - RNA, 21 nt, Human
agcugcucugaaaucuccuuu

SEQ ID NO: 2863751 - RNA, 14 nt, Human
agcugauauaaauu

SEQ ID NO: 2863752 - RNA, 15 nt, Human
agcugauauaaauuc

SEQ ID NO: 2863753 - RNA, 16 nt, Human
agcugauauaaauucu

SEQ ID NO: 2863754 - RNA, 17 nt, Human
agcugauauaaauucug

SEQ ID NO: 2863755 - RNA, 18 nt, Human
agcugauauaaauucugu

SEQ ID NO: 2863756 - RNA, 19 nt, Human
agcugauauaaauucugug

SEQ ID NO: 2863757 - RNA, 21 nt, Human
agcugauacaaauugcagacu

SEQ ID NO: 2863758 - RNA, 16 nt, Human
agcugauacuucauuu

SEQ ID NO: 2863759 - RNA, 20 nt, Human
agcugauacuucauuuaaaa

SEQ ID NO: 2863760 - RNA, 21 nt, Human
agcugauacuucauuuaaaaa

SEQ ID NO: 2863761 - RNA, 20 nt, Human
agcugaucauaagugaauuu

SEQ ID NO: 2863762 - RNA, 16 nt, Human
agcugaguuaugaugu

SEQ ID NO: 2863763 - RNA, 16 nt, Human
agcugaguuguugugg

SEQ ID NO: 2863764 - RNA, 16 nt, Human
agcugagguuucaccc

SEQ ID NO: 2863765 - RNA, 18 nt, Human
agcugagguuucacccuu

SEQ ID NO: 2863766 - RNA, 20 nt, Human
agcugagucucccuaaggca

SEQ ID NO: 2863767 - RNA, 16 nt, Human
agcugacauugccaaa

SEQ ID NO: 2863768 - RNA, 18 nt, Human
agcugacauugccaaaaa

SEQ ID NO: 2863769 - RNA, 19 nt, Human
agcugacacaaaccugccu

SEQ ID NO: 2863770 - RNA, 20 nt, Human
agcugacacaaaccugccug

SEQ ID NO: 2863771 - RNA, 21 nt, Human
agcugacacaaaccugccugg

SEQ ID NO: 2863772 - RNA, 22 nt, Human
agcugacacaaaccugccuggg

SEQ ID NO: 2863773 - RNA, 23 nt, Human
agcugacacaaaccugccugggu

SEQ ID NO: 2863774 - RNA, 14 nt, Human
agcugacacaaacc

SEQ ID NO: 2863775 - RNA, 12 nt, Human
agcuccuguccu

SEQ ID NO: 2863776 - RNA, 13 nt, Human
agcuccuguccuc

SEQ ID NO: 2863777 - RNA, 13 nt, Human
agcuccuggggcg

SEQ ID NO: 2863778 - RNA, 22 nt, Human
agcuccuggggcguccaggccg

SEQ ID NO: 2863779 - RNA, 11 nt, Human
agcuccuguaa

SEQ ID NO: 2863780 - RNA, 13 nt, Human
agcuccucuuccu

SEQ ID NO: 2863781 - RNA, 15 nt, Human
agcuccucuguccug

SEQ ID NO: 2863782 - RNA, 21 nt, Human
agcuccucuguccugcuucug

SEQ ID NO: 2863783 - RNA, 16 nt, Human
agcuccuccucggaac

SEQ ID NO: 2863784 - RNA, 20 nt, Human
agcuccuccucggaaccgcu

SEQ ID NO: 2863785 - RNA, 15 nt, Human
agcuccucauccagg

SEQ ID NO: 2863786 - RNA, 18 nt, Human
agcuccucauccagggcu

SEQ ID NO: 2863787 - RNA, 14 nt, Human
agcuccucacugug

SEQ ID NO: 2863788 - RNA, 15 nt, Human
agcuccucacugugg

SEQ ID NO: 2863789 - RNA, 12 nt, Human
agcuccucccac

SEQ ID NO: 2863790 - RNA, 19 nt, Human
agcuccucauccagggcuc

SEQ ID NO: 2863791 - RNA, 21 nt, Human
agcuccucauccagggcucug

SEQ ID NO: 2863792 - RNA, 20 nt, Human
aggauguucugggacacagu

SEQ ID NO: 2863793 - RNA, 18 nt, Human
aggauguucugggacaca

SEQ ID NO: 2863794 - RNA, 17 nt, Human
aggaggggauagagaga

SEQ ID NO: 2863795 - RNA, 16 nt, Human
aggaggggaacacugc

SEQ ID NO: 2863796 - RNA, 20 nt, Human
aggaggggaacacugcccuc

SEQ ID NO: 2863797 - RNA, 14 nt, Human
aggaggggaagcug

SEQ ID NO: 2863798 - RNA, 16 nt, Human
aggaggggaagcugca

SEQ ID NO: 2863799 - RNA, 19 nt, Human
aggaggggaagcugcagcu

SEQ ID NO: 2863800 - RNA, 23 nt, Human
aggaccucauccaaacaauuuaa

SEQ ID NO: 2863801 - RNA, 19 nt, Human
aggaggggccccccugccc

SEQ ID NO: 2863802 - RNA, 23 nt, Human
aggaggggccccccugcccugug

SEQ ID NO: 2863803 - RNA, 21 nt, Human
aggaggggccccccugcccug

SEQ ID NO: 2863804 - RNA, 15 nt, Human
aggaggguacagcug

SEQ ID NO: 2863805 - RNA, 17 nt, Human
aggaggguacagcuggg

SEQ ID NO: 2863806 - RNA, 18 nt, Human
aggaggguacagcugggc

SEQ ID NO: 2863807 - RNA, 19 nt, Human
aggaggguacagcugggcu

SEQ ID NO: 2863808 - RNA, 14 nt, Human
aggauucuaaaaug

SEQ ID NO: 2863809 - RNA, 12 nt, Human
aggauucuaaaa

SEQ ID NO: 2863810 - RNA, 14 nt, Human
aggauucagccgga

SEQ ID NO: 2863811 - RNA, 16 nt, Human
aggauucagccggagg

SEQ ID NO: 2863812 - RNA, 14 nt, Human
aggcacugcugccc

SEQ ID NO: 2863813 - RNA, 16 nt, Human
aggcacugcugcccag

SEQ ID NO: 2863814 - RNA, 22 nt, Human
aggcacugcugcccagccucca

SEQ ID NO: 2863815 - RNA, 14 nt, Human
aggcacugccugau

SEQ ID NO: 2863816 - RNA, 17 nt, Human
aggcacuguaguucuaa

SEQ ID NO: 2863817 - RNA, 19 nt, Human
aggcacuguaguucuaaga

SEQ ID NO: 2863818 - RNA, 16 nt, Human
aggcacuguacuaggc

SEQ ID NO: 2863819 - RNA, 16 nt, Human
aggcacuguaguucua

SEQ ID NO: 2863820 - RNA, 13 nt, Human
aggcacugccuga

SEQ ID NO: 2863821 - RNA, 13 nt, Human
aggagaagcugca

SEQ ID NO: 2863822 - RNA, 20 nt, Human
aggagagccugcugcauggg

SEQ ID NO: 2863823 - RNA, 13 nt, Human
aggagaggagaga

SEQ ID NO: 2863824 - RNA, 14 nt, Human
aggagaggagagag

SEQ ID NO: 2863825 - RNA, 15 nt, Human
aggagaggagagagg

SEQ ID NO: 2863826 - RNA, 16 nt, Human
aggagaggagagaggc

SEQ ID NO: 2863827 - RNA, 17 nt, Human
aggagaggagagaggca

SEQ ID NO: 2863828 - RNA, 18 nt, Human
aggagaggagagaggcag

SEQ ID NO: 2863829 - RNA, 18 nt, Human
aggaccucugaaacccug

SEQ ID NO: 2863830 - RNA, 13 nt, Human
aggaccucccuuc

SEQ ID NO: 2863831 - RNA, 15 nt, Human
aggaccucccuuccg

SEQ ID NO: 2863832 - RNA, 16 nt, Human
aggaccucccuuccga

SEQ ID NO: 2863833 - RNA, 18 nt, Human
aggaccuccucuuccccc

SEQ ID NO: 2863834 - RNA, 19 nt, Human
aggaccuccucuucccccu

SEQ ID NO: 2863835 - RNA, 22 nt, Human
aggaccuccucuucccccuucc

SEQ ID NO: 2863836 - RNA, 17 nt, Human
aggacccggaggggccu

SEQ ID NO: 2863837 - RNA, 12 nt, Human
aggagaacaaau

SEQ ID NO: 2863838 - RNA, 13 nt, Human
aggagaacaaaua

SEQ ID NO: 2863839 - RNA, 14 nt, Human
aggagaacaaauau

SEQ ID NO: 2863840 - RNA, 20 nt, Human
aggaccucugaaacccugga

SEQ ID NO: 2863841 - RNA, 15 nt, Human
aggagaaccacuaca

SEQ ID NO: 2863842 - RNA, 14 nt, Human
aggagaaccacuac

SEQ ID NO: 2863843 - RNA, 15 nt, Human
aggagaagaguugag

SEQ ID NO: 2863844 - RNA, 18 nt, Human
aggagaagaguugaggaa

SEQ ID NO: 2863845 - RNA, 20 nt, Human
aggaccccuccaugugggcu

SEQ ID NO: 2863846 - RNA, 23 nt, Human
aggaccaauaaaauuucuaagag

SEQ ID NO: 2863847 - RNA, 19 nt, Human
aggaccacaggugugagcc

SEQ ID NO: 2863848 - RNA, 14 nt, Human
aggaccacucagcc

SEQ ID NO: 2863849 - RNA, 15 nt, Human
aggaccacucagccc

SEQ ID NO: 2863850 - RNA, 17 nt, Human
aggaccacucagccccu

SEQ ID NO: 2863851 - RNA, 18 nt, Human
aggaccacucagccccua

SEQ ID NO: 2863852 - RNA, 19 nt, Human
aggaccacucagccccuag

SEQ ID NO: 2863853 - RNA, 14 nt, Human
aggaacuccuuggc

SEQ ID NO: 2863854 - RNA, 13 nt, Human
aggaacugcagca

SEQ ID NO: 2863855 - RNA, 17 nt, Human
aggaacugcagcaaucu

SEQ ID NO: 2863856 - RNA, 21 nt, Human
aggaacugcagcaaucuuuga

SEQ ID NO: 2863857 - RNA, 17 nt, Human
agguuccaacuguauau

SEQ ID NO: 2863858 - RNA, 18 nt, Human
agguuccaacuguauaua

SEQ ID NO: 2863859 - RNA, 12 nt, Human
agguuccacaga

SEQ ID NO: 2863860 - RNA, 14 nt, Human
agguuccacagagu

SEQ ID NO: 2863861 - RNA, 16 nt, Human
agguuccauccuuuac

SEQ ID NO: 2863862 - RNA, 22 nt, Human
agguucccugccuuguuuggau

SEQ ID NO: 2863863 - RNA, 11 nt, Human
agguucccugu

SEQ ID NO: 2863864 - RNA, 18 nt, Human
agguucccuguucuuccu

SEQ ID NO: 2863865 - RNA, 19 nt, Human
agguucccuguucuuccuc

SEQ ID NO: 2863866 - RNA, 20 nt, Human
agguucccuguucuuccucc

SEQ ID NO: 2863867 - RNA, 11 nt, Human
agguucuaaag

SEQ ID NO: 2863868 - RNA, 12 nt, Human
agguucuaaagu

SEQ ID NO: 2863869 - RNA, 13 nt, Human
agguucagcuugu

SEQ ID NO: 2863870 - RNA, 16 nt, Human
agguucacuaaagcag

SEQ ID NO: 2863871 - RNA, 16 nt, Human
agguucacgugcagcu

SEQ ID NO: 2863872 - RNA, 20 nt, Human
agguucaguauuauguaguu

SEQ ID NO: 2863873 - RNA, 21 nt, Human
agguucaugccaccauggcca

SEQ ID NO: 2863874 - RNA, 22 nt, Human
agguuaauuccaauuauaugag

SEQ ID NO: 2863875 - RNA, 15 nt, Human
agguuaauuccaauu

SEQ ID NO: 2863876 - RNA, 14 nt, Human
agguggcagcccug

SEQ ID NO: 2863877 - RNA, 13 nt, Human
agguggcagcccu

SEQ ID NO: 2863878 - RNA, 15 nt, Human
agguggcagcccugu

SEQ ID NO: 2863879 - RNA, 21 nt, Human
aggucgaccccaaagccccuu

SEQ ID NO: 2863880 - RNA, 19 nt, Human
agguccugugaucuuauuu

SEQ ID NO: 2863881 - RNA, 20 nt, Human
agguccugugaucuuauuuu

SEQ ID NO: 2863882 - RNA, 23 nt, Human
agguccugugaucuuauuuuucu

SEQ ID NO: 2863883 - RNA, 16 nt, Human
aggugcugccauccag

SEQ ID NO: 2863884 - RNA, 17 nt, Human
aggugcuccccugacag

SEQ ID NO: 2863885 - RNA, 17 nt, Human
aggugcugccauccagg

SEQ ID NO: 2863886 - RNA, 14 nt, Human
aggugcuggaggug

SEQ ID NO: 2863887 - RNA, 17 nt, Human
aggugcuggagguggga

SEQ ID NO: 2863888 - RNA, 19 nt, Human
aggugcuggaggugggagc

SEQ ID NO: 2863889 - RNA, 23 nt, Human
aggugcuggaggugggagcagga

SEQ ID NO: 2863890 - RNA, 23 nt, Human
agguggauuuuguuuaaaaaauc

SEQ ID NO: 2863891 - RNA, 19 nt, Human
agguggauuuuguuuaaaa

SEQ ID NO: 2863892 - RNA, 14 nt, Human
agguggcaaggcug

SEQ ID NO: 2863893 - RNA, 15 nt, Human
agguggcaaggcugu

SEQ ID NO: 2863894 - RNA, 16 nt, Human
agguggcaaggcugug

SEQ ID NO: 2863895 - RNA, 18 nt, Human
agguggcaaggcugugcu

SEQ ID NO: 2863896 - RNA, 22 nt, Human
agguucuaaggccuaggauucu

SEQ ID NO: 2863897 - RNA, 15 nt, Human
agguucuaaggccua

SEQ ID NO: 2863898 - RNA, 19 nt, Human
agguucuaaggccuaggau

SEQ ID NO: 2863899 - RNA, 23 nt, Human
agguucuaaaguucuaagauucu

SEQ ID NO: 2863900 - RNA, 14 nt, Human
agguucuaacccua

SEQ ID NO: 2863901 - RNA, 12 nt, Human
agguucuaaggc

SEQ ID NO: 2863902 - RNA, 13 nt, Human
agguucuaaggcc

SEQ ID NO: 2863903 - RNA, 13 nt, Human
agguucuaaaguu

SEQ ID NO: 2863904 - RNA, 14 nt, Human
agguucuaaaguuc

SEQ ID NO: 2863905 - RNA, 15 nt, Human
agguucuaaaguucu

SEQ ID NO: 2863906 - RNA, 16 nt, Human
agguucuaaaguucua

SEQ ID NO: 2863907 - RNA, 17 nt, Human
agguucuaaaguucuaa

SEQ ID NO: 2863908 - RNA, 18 nt, Human
agguucuaaaguucuaag

SEQ ID NO: 2863909 - RNA, 19 nt, Human
agguucuaaaguucuaaga

SEQ ID NO: 2863910 - RNA, 20 nt, Human
agguucuaaaguucuaagau

SEQ ID NO: 2863911 - RNA, 18 nt, Human
agguaaucgaccugccuc

SEQ ID NO: 2863912 - RNA, 17 nt, Human
agguaaucgaccugccu

SEQ ID NO: 2863913 - RNA, 18 nt, Human
agguaauauaaaaagcuu

SEQ ID NO: 2863914 - RNA, 18 nt, Human
agguaaucaaugaauauu

SEQ ID NO: 2863915 - RNA, 13 nt, Human
agguaaguuuuuu

SEQ ID NO: 2863916 - RNA, 21 nt, Human
agguaccuugaccuuuguaca

SEQ ID NO: 2863917 - RNA, 22 nt, Human
agguaccuugaccuuuguacag

SEQ ID NO: 2863918 - RNA, 17 nt, Human
agguaccccuuucuggc

SEQ ID NO: 2863919 - RNA, 21 nt, Human
agguaccccuuucuggcucuc

SEQ ID NO: 2863920 - RNA, 22 nt, Human
agguaccagcaauauguaaaua

SEQ ID NO: 2863921 - RNA, 18 nt, Human
agguacccaauagcugcc

SEQ ID NO: 2863922 - RNA, 20 nt, Human
agguacccaauagcugccca

SEQ ID NO: 2863923 - RNA, 23 nt, Human
agguacccaauagcugcccauuu

SEQ ID NO: 2863924 - RNA, 18 nt, Human
agguacagagaccucccu

SEQ ID NO: 2863925 - RNA, 11 nt, Human
agguacagggu

SEQ ID NO: 2863926 - RNA, 18 nt, Human
agguacaggguuuuuacc

SEQ ID NO: 2863927 - RNA, 19 nt, Human
agguacaggguuuuuaccu

SEQ ID NO: 2863928 - RNA, 19 nt, Human
agggcacagcaucuguagu

SEQ ID NO: 2863929 - RNA, 13 nt, Human
aggcagacagcag

SEQ ID NO: 2863930 - RNA, 15 nt, Human
aggcagacagcaggc

SEQ ID NO: 2863931 - RNA, 19 nt, Human
aggcagacagcaggcagcg

SEQ ID NO: 2863932 - RNA, 22 nt, Human
aggcagacagcaggcagcgcca

SEQ ID NO: 2863933 - RNA, 23 nt, Human
aggcagacagcaggcagcgccaa

SEQ ID NO: 2863934 - RNA, 18 nt, Human
aggcagacuacacaggau

SEQ ID NO: 2863935 - RNA, 18 nt, Human
aggcagaauaagaaaaca

SEQ ID NO: 2863936 - RNA, 14 nt, Human
agggacgcuuuguc

SEQ ID NO: 2863937 - RNA, 17 nt, Human
agggacgcuuugucugu

SEQ ID NO: 2863938 - RNA, 14 nt, Human
agggacucugaagc

SEQ ID NO: 2863939 - RNA, 19 nt, Human
agggacucugaagccucug

SEQ ID NO: 2863940 - RNA, 17 nt, Human
aggcugaguuuucucuu

SEQ ID NO: 2863941 - RNA, 17 nt, Human
aggcugccccucucacc

SEQ ID NO: 2863942 - RNA, 15 nt, Human
aggcugccccucuca

SEQ ID NO: 2863943 - RNA, 12 nt, Human
aggcugccccuc

SEQ ID NO: 2863944 - RNA, 20 nt, Human
aggcugcccccggcccccug

SEQ ID NO: 2863945 - RNA, 22 nt, Human
aggcugcccccggcccccuggu

SEQ ID NO: 2863946 - RNA, 23 nt, Human
aggcugcagauaacagaaaggcu

SEQ ID NO: 2863947 - RNA, 12 nt, Human
aggcugcccccg

SEQ ID NO: 2863948 - RNA, 15 nt, Human
aggcugcccccggcc

SEQ ID NO: 2863949 - RNA, 20 nt, Human
aggcugugcugcccugaaga

SEQ ID NO: 2863950 - RNA, 17 nt, Human
aggcugugcugcccuga

SEQ ID NO: 2863951 - RNA, 16 nt, Human
aggcugugcugcccug

SEQ ID NO: 2863952 - RNA, 15 nt, Human
aggcugugcugcccu

SEQ ID NO: 2863953 - RNA, 13 nt, Human
aggcugugcuccc

SEQ ID NO: 2863954 - RNA, 14 nt, Human
aggcugugcucccu

SEQ ID NO: 2863955 - RNA, 20 nt, Human
aggcugugcucccugguucu

SEQ ID NO: 2863956 - RNA, 24 nt, Human
aggcugugcucccugguucugaug

SEQ ID NO: 2863957 - RNA, 18 nt, Human
aggcugugcagcgcagcu

SEQ ID NO: 2863958 - RNA, 22 nt, Human
aggcugugcugcccugaagaau

SEQ ID NO: 2863959 - RNA, 21 nt, Human
aggcugugcugcccugaagaa

SEQ ID NO: 2863960 - RNA, 22 nt, Human
aggcugugucccucuucucuuc

SEQ ID NO: 2863961 - RNA, 22 nt, Human
aggcuauggacagggcaugcca

SEQ ID NO: 2863962 - RNA, 15 nt, Human
aggcucuuucugggc

SEQ ID NO: 2863963 - RNA, 14 nt, Human
aggcucuucuccuu

SEQ ID NO: 2863964 - RNA, 20 nt, Human
aggcucuuucugggccaagu

SEQ ID NO: 2863965 - RNA, 18 nt, Human
aggcucuuucugggccaa

SEQ ID NO: 2863966 - RNA, 21 nt, Human
aggcugaacuuguuuucuggg

SEQ ID NO: 2863967 - RNA, 20 nt, Human
aggcugaacuuguuuucugg

SEQ ID NO: 2863968 - RNA, 22 nt, Human
aggcugaggggaggaucacugg

SEQ ID NO: 2863969 - RNA, 19 nt, Human
aggggcacuucauugagag

SEQ ID NO: 2863970 - RNA, 12 nt, Human
aggggccgcccu

SEQ ID NO: 2863971 - RNA, 12 nt, Human
aggggcccuggu

SEQ ID NO: 2863972 - RNA, 21 nt, Human
aggggauagagagagaccacu

SEQ ID NO: 2863973 - RNA, 16 nt, Human
aggggauagagagaga

SEQ ID NO: 2863974 - RNA, 23 nt, Human
agggcggggcacagauuggagag

SEQ ID NO: 2863975 - RNA, 17 nt, Human
aggggaugguagaccuu

SEQ ID NO: 2863976 - RNA, 13 nt, Human
aggggauauuuaa

SEQ ID NO: 2863977 - RNA, 14 nt, Human
aggggauauuuaag

SEQ ID NO: 2863978 - RNA, 21 nt, Human
aggggauauuuaagguagcuu

SEQ ID NO: 2863979 - RNA, 19 nt, Human
aggggaucauaaaguuaga

SEQ ID NO: 2863980 - RNA, 20 nt, Human
aggggaucauaaaguuagaa

SEQ ID NO: 2863981 - RNA, 19 nt, Human
aggggaucuggaagggcca

SEQ ID NO: 2863982 - RNA, 19 nt, Human
aggggauggaauucuuccu

SEQ ID NO: 2863983 - RNA, 17 nt, Human
aggggcaaauucuuuug

SEQ ID NO: 2863984 - RNA, 19 nt, Human
agggcgggaggauguucug

SEQ ID NO: 2863985 - RNA, 21 nt, Human
agggcacaccgggcacucaga

SEQ ID NO: 2863986 - RNA, 20 nt, Human
agggcacaccgggcacucag

SEQ ID NO: 2863987 - RNA, 17 nt, Human
agggcacaccgggcacu

SEQ ID NO: 2863988 - RNA, 14 nt, Human
agggcacacacugu

SEQ ID NO: 2863989 - RNA, 12 nt, Human
agggcaagucuu

SEQ ID NO: 2863990 - RNA, 20 nt, Human
agggcacaaguccuggaugu

SEQ ID NO: 2863991 - RNA, 14 nt, Human
agggcaauuggaac

SEQ ID NO: 2863992 - RNA, 17 nt, Human
agggcaauuggaacaaa

SEQ ID NO: 2863993 - RNA, 19 nt, Human
agacugcaagaggcuccug

SEQ ID NO: 2863994 - RNA, 21 nt, Human
agacugcaagaggcuccuguc

SEQ ID NO: 2863995 - RNA, 14 nt, Human
agagaaagagagag

SEQ ID NO: 2863996 - RNA, 17 nt, Human
agagaaaggccugcaca

SEQ ID NO: 2863997 - RNA, 18 nt, Human
agagaaaggccugcacac

SEQ ID NO: 2863998 - RNA, 19 nt, Human
agagaaaggccugcacaca

SEQ ID NO: 2863999 - RNA, 20 nt, Human
agagaaaggccugcacacaa

SEQ ID NO: 2864000 - RNA, 18 nt, Human
agagaaagcacgugucuc

SEQ ID NO: 2864001 - RNA, 13 nt, Human
agagaaagccagg

SEQ ID NO: 2864002 - RNA, 14 nt, Human
agagaaagccaggc

SEQ ID NO: 2864003 - RNA, 16 nt, Human
agagaaagccaggcag

SEQ ID NO: 2864004 - RNA, 17 nt, Human
agagaaagccaggcagg

SEQ ID NO: 2864005 - RNA, 19 nt, Human
agagaaagccaggcaggua

SEQ ID NO: 2864006 - RNA, 22 nt, Human
agagaaagccaggcagguagcc

SEQ ID NO: 2864007 - RNA, 13 nt, Human
agagaagauaauu

SEQ ID NO: 2864008 - RNA, 15 nt, Human
agagaagauaauugu

SEQ ID NO: 2864009 - RNA, 20 nt, Human
agagaagauaauuguugaaa

SEQ ID NO: 2864010 - RNA, 21 nt, Human
agagaagauaauuguugaaau

SEQ ID NO: 2864011 - RNA, 13 nt, Human
agagaagcaauuu

SEQ ID NO: 2864012 - RNA, 12 nt, Human
agagaagcugcu

SEQ ID NO: 2864013 - RNA, 13 nt, Human
agagaagcugcug

SEQ ID NO: 2864014 - RNA, 14 nt, Human
agagaagcugcuga

SEQ ID NO: 2864015 - RNA, 12 nt, Human
agagaagcuggg

SEQ ID NO: 2864016 - RNA, 17 nt, Human
agagaagcggauuucca

SEQ ID NO: 2864017 - RNA, 18 nt, Human
agagaagcggauuuccag

SEQ ID NO: 2864018 - RNA, 18 nt, Human
agagagcuuaaugauaau

SEQ ID NO: 2864019 - RNA, 17 nt, Human
agagagcuuagccugga

SEQ ID NO: 2864020 - RNA, 23 nt, Human
agagagcuucuguugcugccuca

SEQ ID NO: 2864021 - RNA, 20 nt, Human
agagagcuucuguugcugcc

SEQ ID NO: 2864022 - RNA, 22 nt, Human
agagaaggggaagcacucgugu

SEQ ID NO: 2864023 - RNA, 18 nt, Human
agagaaggccucccuagc

SEQ ID NO: 2864024 - RNA, 21 nt, Human
agagaagggcauaaaacagcu

SEQ ID NO: 2864025 - RNA, 18 nt, Human
agagaaggggugugcaug

SEQ ID NO: 2864026 - RNA, 16 nt, Human
agagagcuucuguugc

SEQ ID NO: 2864027 - RNA, 23 nt, Human
agagaggguggugaccucugccu

SEQ ID NO: 2864028 - RNA, 15 nt, Human
agagaggagaggaga

SEQ ID NO: 2864029 - RNA, 13 nt, Human
agagaggagagga

SEQ ID NO: 2864030 - RNA, 14 nt, Human
agagaguggcuccu

SEQ ID NO: 2864031 - RNA, 16 nt, Human
agagaguggcuccucc

SEQ ID NO: 2864032 - RNA, 15 nt, Human
agagccccuggggcc

SEQ ID NO: 2864033 - RNA, 16 nt, Human
agagccccuggggccu

SEQ ID NO: 2864034 - RNA, 19 nt, Human
agagccccuggggccuaga

SEQ ID NO: 2864035 - RNA, 12 nt, Human
agagcccccagg

SEQ ID NO: 2864036 - RNA, 13 nt, Human
agagcccccagga

SEQ ID NO: 2864037 - RNA, 17 nt, Human
agagccugcugcauggg

SEQ ID NO: 2864038 - RNA, 15 nt, Human
agagccugcugcaug

SEQ ID NO: 2864039 - RNA, 21 nt, Human
agacugcaaugugaucuaugu

SEQ ID NO: 2864040 - RNA, 14 nt, Human
agacugcacccagg

SEQ ID NO: 2864041 - RNA, 15 nt, Human
agacugcacccagga

SEQ ID NO: 2864042 - RNA, 16 nt, Human
agacugcacccaggag

SEQ ID NO: 2864043 - RNA, 17 nt, Human
agacugcacccaggagg

SEQ ID NO: 2864044 - RNA, 18 nt, Human
agacugcacccaggaggg

SEQ ID NO: 2864045 - RNA, 20 nt, Human
agacugcacccaggagggga

SEQ ID NO: 2864046 - RNA, 18 nt, Human
agacugcagguuggaccc

SEQ ID NO: 2864047 - RNA, 21 nt, Human
agacugcagguuggaccccag

SEQ ID NO: 2864048 - RNA, 19 nt, Human
agacggagucccaccuugg

SEQ ID NO: 2864049 - RNA, 20 nt, Human
agacggcacggucuucccuc

SEQ ID NO: 2864050 - RNA, 14 nt, Human
agacguguuugugu

SEQ ID NO: 2864051 - RNA, 13 nt, Human
agacuaagaaaua

SEQ ID NO: 2864052 - RNA, 14 nt, Human
agacuaagaaauau

SEQ ID NO: 2864053 - RNA, 17 nt, Human
agacuaagaaauauucc

SEQ ID NO: 2864054 - RNA, 19 nt, Human
agacuaagaaauauuccaa

SEQ ID NO: 2864055 - RNA, 14 nt, Human
agacuaauuuaaaa

SEQ ID NO: 2864056 - RNA, 15 nt, Human
agacuaauuuaaaaa

SEQ ID NO: 2864057 - RNA, 15 nt, Human
agacuacacaggaug

SEQ ID NO: 2864058 - RNA, 16 nt, Human
agacuacacaggauga

SEQ ID NO: 2864059 - RNA, 14 nt, Human
agacuacuaagagg

SEQ ID NO: 2864060 - RNA, 16 nt, Human
agacuacuauuuucuu

SEQ ID NO: 2864061 - RNA, 18 nt, Human
agacuacuauuuucuuuu

SEQ ID NO: 2864062 - RNA, 19 nt, Human
agacuacuauuuucuuuuu

SEQ ID NO: 2864063 - RNA, 14 nt, Human
agacacaacuauuu

SEQ ID NO: 2864064 - RNA, 16 nt, Human
agaccaccacuucgaa

SEQ ID NO: 2864065 - RNA, 15 nt, Human
agaccaccaccucag

SEQ ID NO: 2864066 - RNA, 13 nt, Human
agaccacaucuuu

SEQ ID NO: 2864067 - RNA, 23 nt, Human
agaccacaucuuuaucuguucuu

SEQ ID NO: 2864068 - RNA, 17 nt, Human
agaccacagagcuguca

SEQ ID NO: 2864069 - RNA, 16 nt, Human
agaccacaaaaauuga

SEQ ID NO: 2864070 - RNA, 23 nt, Human
agaccaaggcgggagcaucucuu

SEQ ID NO: 2864071 - RNA, 17 nt, Human
agaccaaggcgggagca

SEQ ID NO: 2864072 - RNA, 14 nt, Human
agaccaaggcggga

SEQ ID NO: 2864073 - RNA, 11 nt, Human
agaccaaggaa

SEQ ID NO: 2864074 - RNA, 12 nt, Human
agaccaaggaac

SEQ ID NO: 2864075 - RNA, 14 nt, Human
agaccaaggaacaa

SEQ ID NO: 2864076 - RNA, 19 nt, Human
agacacaacaacuccuagg

SEQ ID NO: 2864077 - RNA, 18 nt, Human
agaccaacguuacucagg

SEQ ID NO: 2864078 - RNA, 21 nt, Human
agaccaacguuacucagggcu

SEQ ID NO: 2864079 - RNA, 22 nt, Human
agaccaacguuacucagggcuc

SEQ ID NO: 2864080 - RNA, 15 nt, Human
agaccagggagccuu

SEQ ID NO: 2864081 - RNA, 16 nt, Human
agaccaggcaaagcaa

SEQ ID NO: 2864082 - RNA, 13 nt, Human
agaccagcucuuc

SEQ ID NO: 2864083 - RNA, 16 nt, Human
agaccaggauuucuaa

SEQ ID NO: 2864084 - RNA, 16 nt, Human
agaccaccaccucaga

SEQ ID NO: 2864085 - RNA, 17 nt, Human
agaccaggcaaagcaag

SEQ ID NO: 2864086 - RNA, 13 nt, Human
agaccaggcccug

SEQ ID NO: 2864087 - RNA, 15 nt, Human
agaccaggcuguguc

SEQ ID NO: 2864088 - RNA, 16 nt, Human
agaccaggcugugucc

SEQ ID NO: 2864089 - RNA, 22 nt, Human
agaccaguugaauaaaagugca

SEQ ID NO: 2864090 - RNA, 15 nt, Human
agacacaacaacucc

SEQ ID NO: 2864091 - RNA, 18 nt, Human
agacacaacaacuccuag

SEQ ID NO: 2864092 - RNA, 12 nt, Human
agacacaaaugc

SEQ ID NO: 2864093 - RNA, 13 nt, Human
agacaauuugaua

SEQ ID NO: 2864094 - RNA, 16 nt, Human
agacaauuugauacau

SEQ ID NO: 2864095 - RNA, 17 nt, Human
agacaauuugauacaua

SEQ ID NO: 2864096 - RNA, 18 nt, Human
agacaauuugauacauaa

SEQ ID NO: 2864097 - RNA, 22 nt, Human
agacaauuugauacauaauaaa

SEQ ID NO: 2864098 - RNA, 23 nt, Human
agacaauuugauacauaauaaaa

SEQ ID NO: 2864099 - RNA, 13 nt, Human
agacaauuugcac

SEQ ID NO: 2864100 - RNA, 18 nt, Human
agacaauuugcacaucuu

SEQ ID NO: 2864101 - RNA, 17 nt, Human
agacaauacguuugaua

SEQ ID NO: 2864102 - RNA, 11 nt, Human
agacaauauac

SEQ ID NO: 2864103 - RNA, 13 nt, Human
agacaauauacaa

SEQ ID NO: 2864104 - RNA, 15 nt, Human
agacaauauacaagc

SEQ ID NO: 2864105 - RNA, 18 nt, Human
agacaauaugugagugcc

SEQ ID NO: 2864106 - RNA, 20 nt, Human
agacaauaugugagugccuu

SEQ ID NO: 2864107 - RNA, 21 nt, Human
agacaauaugugagugccuuu

SEQ ID NO: 2864108 - RNA, 14 nt, Human
agacaaucauuguu

SEQ ID NO: 2864109 - RNA, 15 nt, Human
agacaaucauuguuu

SEQ ID NO: 2864110 - RNA, 16 nt, Human
agacaaucauuguuuu

SEQ ID NO: 2864111 - RNA, 22 nt, Human
agacaaucauuguuuugaauau

SEQ ID NO: 2864112 - RNA, 23 nt, Human
agacaaucauuguuuugaauauu

SEQ ID NO: 2864113 - RNA, 14 nt, Human
agauaguaacugua

SEQ ID NO: 2864114 - RNA, 11 nt, Human
agauaguuuau

SEQ ID NO: 2864115 - RNA, 15 nt, Human
agauagguaaauacc

SEQ ID NO: 2864116 - RNA, 22 nt, Human
agauagggcugggcaaggaaaa

SEQ ID NO: 2864117 - RNA, 23 nt, Human
agauagggcugggcaaggaaaaa

SEQ ID NO: 2864118 - RNA, 23 nt, Human
agauggcugugccucugccuguc

SEQ ID NO: 2864119 - RNA, 19 nt, Human
agaugagggaugggccugg

SEQ ID NO: 2864120 - RNA, 20 nt, Human
agaugagggaugggccuggc

SEQ ID NO: 2864121 - RNA, 21 nt, Human
agaugagggaugggccuggca

SEQ ID NO: 2864122 - RNA, 22 nt, Human
agaugagggaugggccuggcau

SEQ ID NO: 2864123 - RNA, 21 nt, Human
agaugagcccagcccuguucu

SEQ ID NO: 2864124 - RNA, 15 nt, Human
agaugagauuggcau

SEQ ID NO: 2864125 - RNA, 19 nt, Human
agaugagauuggcauggcu

SEQ ID NO: 2864126 - RNA, 15 nt, Human
agaucuucugaaaug

SEQ ID NO: 2864127 - RNA, 17 nt, Human
agaucuucugaaaugaa

SEQ ID NO: 2864128 - RNA, 15 nt, Human
agaucuuagauucuc

SEQ ID NO: 2864129 - RNA, 13 nt, Human
agaucuuagguau

SEQ ID NO: 2864130 - RNA, 23 nt, Human
agaucuuagguauagaggacccu

SEQ ID NO: 2864131 - RNA, 18 nt, Human
agaucuguuuugaaggca

SEQ ID NO: 2864132 - RNA, 15 nt, Human
agaugacugaguccu

SEQ ID NO: 2864133 - RNA, 14 nt, Human
agaugacugagucc

SEQ ID NO: 2864134 - RNA, 15 nt, Human
agaugaccucauuaa

SEQ ID NO: 2864135 - RNA, 14 nt, Human
agaucuuagauucu

SEQ ID NO: 2864136 - RNA, 11 nt, Human
agaugagaaca

SEQ ID NO: 2864137 - RNA, 13 nt, Human
agaugagaacaaa

SEQ ID NO: 2864138 - RNA, 15 nt, Human
agaugagaacaaagc

SEQ ID NO: 2864139 - RNA, 16 nt, Human
agaugagaacaaagcu

SEQ ID NO: 2864140 - RNA, 18 nt, Human
agaugagaacaaagcugu

SEQ ID NO: 2864141 - RNA, 19 nt, Human
agaugagaacaaagcuguu

SEQ ID NO: 2864142 - RNA, 16 nt, Human
agaucugugccccaug

SEQ ID NO: 2864143 - RNA, 14 nt, Human
agaucugugcccca

SEQ ID NO: 2864144 - RNA, 13 nt, Human
agaucugugcccc

SEQ ID NO: 2864145 - RNA, 12 nt, Human
agaucugugccc

SEQ ID NO: 2864146 - RNA, 19 nt, Human
agaucugugccccaugccu

SEQ ID NO: 2864147 - RNA, 14 nt, Human
agaucuguuuugaa

SEQ ID NO: 2864148 - RNA, 21 nt, Human
agaucuguuuugaaggcaaaa

SEQ ID NO: 2864149 - RNA, 23 nt, Human
agaguuaaauagaguauaugcac

SEQ ID NO: 2864150 - RNA, 22 nt, Human
agagguaacagaacagcuucag

SEQ ID NO: 2864151 - RNA, 20 nt, Human
agagguaacagaacagcuuc

SEQ ID NO: 2864152 - RNA, 23 nt, Human
agaggguuuuagguagaaaaaca

SEQ ID NO: 2864153 - RNA, 23 nt, Human
agaggauuuuagcuaggauuuga

SEQ ID NO: 2864154 - RNA, 15 nt, Human
agagggugucaucua

SEQ ID NO: 2864155 - RNA, 16 nt, Human
agagguaacagaacag

SEQ ID NO: 2864156 - RNA, 17 nt, Human
agagguaacagaacagc

SEQ ID NO: 2864157 - RNA, 18 nt, Human
agagguaacagaacagcu

SEQ ID NO: 2864158 - RNA, 23 nt, Human
agaggguggugaccucugccuga

SEQ ID NO: 2864159 - RNA, 20 nt, Human
agaguuaagaagcuguugua

SEQ ID NO: 2864160 - RNA, 21 nt, Human
agaguuaagaagcuguuguac

SEQ ID NO: 2864161 - RNA, 12 nt, Human
agaguuaagaag

SEQ ID NO: 2864162 - RNA, 13 nt, Human
agaguuaagaagc

SEQ ID NO: 2864163 - RNA, 14 nt, Human
agaguuaagaagcu

SEQ ID NO: 2864164 - RNA, 15 nt, Human
agaguuaagaagcug

SEQ ID NO: 2864165 - RNA, 16 nt, Human
agaguuaagaagcugu

SEQ ID NO: 2864166 - RNA, 17 nt, Human
agaguuaagaagcuguu

SEQ ID NO: 2864167 - RNA, 18 nt, Human
agaguuaagaagcuguug

SEQ ID NO: 2864168 - RNA, 16 nt, Human
agauagauuuggaaua

SEQ ID NO: 2864169 - RNA, 17 nt, Human
agauagauuuggaauag

SEQ ID NO: 2864170 - RNA, 17 nt, Human
agauacuuuuucuuuug

SEQ ID NO: 2864171 - RNA, 19 nt, Human
agauacuuuuucuuuugua

SEQ ID NO: 2864172 - RNA, 20 nt, Human
agauacuuuuucuuuuguaa

SEQ ID NO: 2864173 - RNA, 21 nt, Human
agauacuuuuucuuuuguaag

SEQ ID NO: 2864174 - RNA, 22 nt, Human
agauacuuuuucuuuuguaagu

SEQ ID NO: 2864175 - RNA, 23 nt, Human
agauacuuuuucuuuuguaagug

SEQ ID NO: 2864176 - RNA, 14 nt, Human
agauagaaagcauu

SEQ ID NO: 2864177 - RNA, 15 nt, Human
agauagaaagcauua

SEQ ID NO: 2864178 - RNA, 16 nt, Human
agaggagaggagagag

SEQ ID NO: 2864179 - RNA, 17 nt, Human
agaggagaggagagagg

SEQ ID NO: 2864180 - RNA, 12 nt, Human
agaggagaggag

SEQ ID NO: 2864181 - RNA, 15 nt, Human
agaggagaggagaga

SEQ ID NO: 2864182 - RNA, 11 nt, Human
agaggagccuu

SEQ ID NO: 2864183 - RNA, 15 nt, Human
agaggagcccucauc

SEQ ID NO: 2864184 - RNA, 12 nt, Human
agaggagccaga

SEQ ID NO: 2864185 - RNA, 15 nt, Human
agaggagccagacag

SEQ ID NO: 2864186 - RNA, 17 nt, Human
agaggagccagacagac

SEQ ID NO: 2864187 - RNA, 14 nt, Human
agaggggacucugg

SEQ ID NO: 2864188 - RNA, 15 nt, Human
agaggggacucuggg

SEQ ID NO: 2864189 - RNA, 18 nt, Human
agaggggacucugggcua

SEQ ID NO: 2864190 - RNA, 22 nt, Human
agaggggaaaccaguguagccu

SEQ ID NO: 2864191 - RNA, 12 nt, Human
agaggggaagga

SEQ ID NO: 2864192 - RNA, 22 nt, Human
agaggggaacagacuggaagca

SEQ ID NO: 2864193 - RNA, 14 nt, Human
agagggcuugugaa

SEQ ID NO: 2864194 - RNA, 18 nt, Human
agagggcuugugaacaga

SEQ ID NO: 2864195 - RNA, 19 nt, Human
agaggaugucucaaacuuc

SEQ ID NO: 2864196 - RNA, 13 nt, Human
agaggaugugcaa

SEQ ID NO: 2864197 - RNA, 22 nt, Human
agaggauuagguuccauccuuu

SEQ ID NO: 2864198 - RNA, 20 nt, Human
agaggaugagcucuacccag

SEQ ID NO: 2864199 - RNA, 22 nt, Human
agaggaugagagcccagaggua

SEQ ID NO: 2864200 - RNA, 13 nt, Human
agaggaugagagc

SEQ ID NO: 2864201 - RNA, 14 nt, Human
agaggaugagagcc

SEQ ID NO: 2864202 - RNA, 17 nt, Human
agaggaugagagcccag

SEQ ID NO: 2864203 - RNA, 18 nt, Human
agaggaugagagcccaga

SEQ ID NO: 2864204 - RNA, 22 nt, Human
agccgcugugagccccuggucc

SEQ ID NO: 2864205 - RNA, 18 nt, Human
agccggccaauggaaacc

SEQ ID NO: 2864206 - RNA, 19 nt, Human
agccucccaaagugcuggg

SEQ ID NO: 2864207 - RNA, 18 nt, Human
agccucccaaagugcugg

SEQ ID NO: 2864208 - RNA, 14 nt, Human
agccgcagccuccc

SEQ ID NO: 2864209 - RNA, 18 nt, Human
agccgauucaccugagca

SEQ ID NO: 2864210 - RNA, 16 nt, Human
agccgcugugagcccc

SEQ ID NO: 2864211 - RNA, 19 nt, Human
agccgcugugagccccugg

SEQ ID NO: 2864212 - RNA, 18 nt, Human
agccgcagccucccucug

SEQ ID NO: 2864213 - RNA, 21 nt, Human
agccgagaucacgccacugca

SEQ ID NO: 2864214 - RNA, 17 nt, Human
agccucccgaguagcug

SEQ ID NO: 2864215 - RNA, 22 nt, Human
agccucccgaauagcugggacu

SEQ ID NO: 2864216 - RNA, 20 nt, Human
agccucccgaauagcuggga

SEQ ID NO: 2864217 - RNA, 19 nt, Human
agccucccgaauagcuggg

SEQ ID NO: 2864218 - RNA, 18 nt, Human
agccucccgaauagcugg

SEQ ID NO: 2864219 - RNA, 20 nt, Human
agccucccaaagugcuggga

SEQ ID NO: 2864220 - RNA, 17 nt, Human
agccucccaaagugcug

SEQ ID NO: 2864221 - RNA, 22 nt, Human
agccucccgaguagcugggacu

SEQ ID NO: 2864222 - RNA, 21 nt, Human
agccucccucugaccugcagg

SEQ ID NO: 2864223 - RNA, 15 nt, Human
agccucccucugacc

SEQ ID NO: 2864224 - RNA, 14 nt, Human
agccucccucugac

SEQ ID NO: 2864225 - RNA, 13 nt, Human
agccucccucuga

SEQ ID NO: 2864226 - RNA, 11 nt, Human
agccucccuga

SEQ ID NO: 2864227 - RNA, 22 nt, Human
agccucccucugaccugcaggc

SEQ ID NO: 2864228 - RNA, 12 nt, Human
agccucccugaa

SEQ ID NO: 2864229 - RNA, 11 nt, Human
agccuccucug

SEQ ID NO: 2864230 - RNA, 12 nt, Human
agccuccucugu

SEQ ID NO: 2864231 - RNA, 15 nt, Human
agccuccucugucug

SEQ ID NO: 2864232 - RNA, 16 nt, Human
agccuccucugucugc

SEQ ID NO: 2864233 - RNA, 18 nt, Human
agccuccucugucugccc

SEQ ID NO: 2864234 - RNA, 19 nt, Human
agccuccucugucugcccu

SEQ ID NO: 2864235 - RNA, 20 nt, Human
agccuccucugucugcccuu

SEQ ID NO: 2864236 - RNA, 21 nt, Human
agccuccucugucugcccuuc

SEQ ID NO: 2864237 - RNA, 11 nt, Human
agccuccugag

SEQ ID NO: 2864238 - RNA, 19 nt, Human
agccucccgaguagggagg

SEQ ID NO: 2864239 - RNA, 21 nt, Human
agcccaacgggaagcaaccuc

SEQ ID NO: 2864240 - RNA, 20 nt, Human
agcccaaaggggacaggccu

SEQ ID NO: 2864241 - RNA, 21 nt, Human
agcccaaaggggacaggccuc

SEQ ID NO: 2864242 - RNA, 23 nt, Human
agcccaaaggggacaggccucac

SEQ ID NO: 2864243 - RNA, 18 nt, Human
agccccacugccagcagc

SEQ ID NO: 2864244 - RNA, 17 nt, Human
agccccacugccagcag

SEQ ID NO: 2864245 - RNA, 16 nt, Human
agccccacugccagca

SEQ ID NO: 2864246 - RNA, 15 nt, Human
agccccacugccagc

SEQ ID NO: 2864247 - RNA, 14 nt, Human
agccccacugccag

SEQ ID NO: 2864248 - RNA, 12 nt, Human
agccccacugcc

SEQ ID NO: 2864249 - RNA, 20 nt, Human
agccccacugccagcagcag

SEQ ID NO: 2864250 - RNA, 19 nt, Human
agccccacugccagcagca

SEQ ID NO: 2864251 - RNA, 12 nt, Human
agccccagagca

SEQ ID NO: 2864252 - RNA, 15 nt, Human
agccccagcacuaac

SEQ ID NO: 2864253 - RNA, 12 nt, Human
agccccagcacu

SEQ ID NO: 2864254 - RNA, 16 nt, Human
agccccagagcagggu

SEQ ID NO: 2864255 - RNA, 20 nt, Human
agccgagaucacgccacugc

SEQ ID NO: 2864256 - RNA, 19 nt, Human
agccgagaucacgccacug

SEQ ID NO: 2864257 - RNA, 22 nt, Human
agcccugaggugaaagggagcu

SEQ ID NO: 2864258 - RNA, 21 nt, Human
agcccugaggugaaagggagc

SEQ ID NO: 2864259 - RNA, 24 nt, Human
agcccuacucccugcagaugccac

SEQ ID NO: 2864260 - RNA, 15 nt, Human
agcccuagagccugc

SEQ ID NO: 2864261 - RNA, 16 nt, Human
agcccuagagccugcc

SEQ ID NO: 2864262 - RNA, 17 nt, Human
agcccuagagccugccu

SEQ ID NO: 2864263 - RNA, 20 nt, Human
agcccuagagccugccugga

SEQ ID NO: 2864264 - RNA, 22 nt, Human
agcccuagagccugccuggagc

SEQ ID NO: 2864265 - RNA, 19 nt, Human
agcccugacgcaaugaaaa

SEQ ID NO: 2864266 - RNA, 18 nt, Human
agcccugagaaagcccug

SEQ ID NO: 2864267 - RNA, 19 nt, Human
agcccugagaaagcccugu

SEQ ID NO: 2864268 - RNA, 18 nt, Human
agcccuacucccugcaga

SEQ ID NO: 2864269 - RNA, 17 nt, Human
agcccuacucccugcag

SEQ ID NO: 2864270 - RNA, 16 nt, Human
agcccuacucccugca

SEQ ID NO: 2864271 - RNA, 15 nt, Human
agcccuacucccugc

SEQ ID NO: 2864272 - RNA, 21 nt, Human
agcccuacucccugcagaugc

SEQ ID NO: 2864273 - RNA, 20 nt, Human
agcccuacucccugcagaug

SEQ ID NO: 2864274 - RNA, 14 nt, Human
agcccuagagccug

SEQ ID NO: 2864275 - RNA, 21 nt, Human
agcccuaaccccuuccagauc

SEQ ID NO: 2864276 - RNA, 18 nt, Human
agcccuaaccccuuccag

SEQ ID NO: 2864277 - RNA, 17 nt, Human
agcccuaaccccuucca

SEQ ID NO: 2864278 - RNA, 13 nt, Human
agcccuacucccu

SEQ ID NO: 2864279 - RNA, 15 nt, Human
agcccuacagagcug

SEQ ID NO: 2864280 - RNA, 17 nt, Human
agcccuacagagcugug

SEQ ID NO: 2864281 - RNA, 18 nt, Human
agcccuacagagcugugg

SEQ ID NO: 2864282 - RNA, 16 nt, Human
agccccagugcccaca

SEQ ID NO: 2864283 - RNA, 23 nt, Human
agccccagggucuucccuaccuc

SEQ ID NO: 2864284 - RNA, 18 nt, Human
agccccagggugcccaga

SEQ ID NO: 2864285 - RNA, 23 nt, Human
agccccauaauuuuuuuuuuccu

SEQ ID NO: 2864286 - RNA, 21 nt, Human
agccccaggccucuguguccu

SEQ ID NO: 2864287 - RNA, 18 nt, Human
agccccagggucuucccu

SEQ ID NO: 2864288 - RNA, 22 nt, Human
agccccagggucuucccuaccu

SEQ ID NO: 2864289 - RNA, 20 nt, Human
agccccagggucuucccuac

SEQ ID NO: 2864290 - RNA, 12 nt, Human
agccccaggccu

SEQ ID NO: 2864291 - RNA, 15 nt, Human
agccccaggccucug

SEQ ID NO: 2864292 - RNA, 16 nt, Human
agccccaggccucugu

SEQ ID NO: 2864293 - RNA, 18 nt, Human
agccccaggccucugugu

SEQ ID NO: 2864294 - RNA, 14 nt, Human
agauguaauguuuu

SEQ ID NO: 2864295 - RNA, 17 nt, Human
agauguaauguuuucuu

SEQ ID NO: 2864296 - RNA, 23 nt, Human
agauguaauguuuucuuugcaaa

SEQ ID NO: 2864297 - RNA, 16 nt, Human
agauguaccuggugga

SEQ ID NO: 2864298 - RNA, 14 nt, Human
agcagucucugccu

SEQ ID NO: 2864299 - RNA, 15 nt, Human
agcagucucugccuu

SEQ ID NO: 2864300 - RNA, 16 nt, Human
agcagucucugccuug

SEQ ID NO: 2864301 - RNA, 17 nt, Human
agcagucucugccuugc

SEQ ID NO: 2864302 - RNA, 19 nt, Human
agcagucucugccuugccu

SEQ ID NO: 2864303 - RNA, 20 nt, Human
agcagucucugccuugccuu

SEQ ID NO: 2864304 - RNA, 13 nt, Human
agcagugagcaga

SEQ ID NO: 2864305 - RNA, 16 nt, Human
agcagugagaaaaagc

SEQ ID NO: 2864306 - RNA, 21 nt, Human
agcagugagaaaaagcuccug

SEQ ID NO: 2864307 - RNA, 22 nt, Human
agcagugagaaaaagcuccugu

SEQ ID NO: 2864308 - RNA, 12 nt, Human
agcagcccaaau

SEQ ID NO: 2864309 - RNA, 13 nt, Human
agcagcccaaauu

SEQ ID NO: 2864310 - RNA, 15 nt, Human
agcagccccgggagg

SEQ ID NO: 2864311 - RNA, 19 nt, Human
agcacuaaggugugcucug

SEQ ID NO: 2864312 - RNA, 16 nt, Human
agcacuaacguaaaua

SEQ ID NO: 2864313 - RNA, 13 nt, Human
agcacugccagga

SEQ ID NO: 2864314 - RNA, 20 nt, Human
agcacugggaucacaggugu

SEQ ID NO: 2864315 - RNA, 23 nt, Human
agcaguugagucgucaucacuuu

SEQ ID NO: 2864316 - RNA, 13 nt, Human
agcaguuguguca

SEQ ID NO: 2864317 - RNA, 17 nt, Human
agccagauccucuuggu

SEQ ID NO: 2864318 - RNA, 16 nt, Human
agccauugcacccagc

SEQ ID NO: 2864319 - RNA, 20 nt, Human
agccauugcacccagcccag

SEQ ID NO: 2864320 - RNA, 20 nt, Human
agccauuaccauggagacaa

SEQ ID NO: 2864321 - RNA, 18 nt, Human
agccauuaccauggagac

SEQ ID NO: 2864322 - RNA, 14 nt, Human
agccauuaaaugaa

SEQ ID NO: 2864323 - RNA, 17 nt, Human
agccauuaaaugaauau

SEQ ID NO: 2864324 - RNA, 18 nt, Human
agccauuaaaugaauauu

SEQ ID NO: 2864325 - RNA, 21 nt, Human
agccauuaaaugaauauuuug

SEQ ID NO: 2864326 - RNA, 22 nt, Human
agccauuaaaugaauauuuuga

SEQ ID NO: 2864327 - RNA, 16 nt, Human
agcaugccaacaagaa

SEQ ID NO: 2864328 - RNA, 17 nt, Human
agcaugccaacaagaau

SEQ ID NO: 2864329 - RNA, 18 nt, Human
agcaugccaacaagaaug

SEQ ID NO: 2864330 - RNA, 19 nt, Human
agcaugccaacaagaaugc

SEQ ID NO: 2864331 - RNA, 20 nt, Human
agcaugccaacaagaaugca

SEQ ID NO: 2864332 - RNA, 12 nt, Human
agccagauccuc

SEQ ID NO: 2864333 - RNA, 14 nt, Human
agccagauccucuu

SEQ ID NO: 2864334 - RNA, 15 nt, Human
agccagauccucuug

SEQ ID NO: 2864335 - RNA, 16 nt, Human
agccagauccucuugg

SEQ ID NO: 2864336 - RNA, 23 nt, Human
agccaaagcuaggccuggccaga

SEQ ID NO: 2864337 - RNA, 20 nt, Human
agccaaagcuaggccuggcc

SEQ ID NO: 2864338 - RNA, 19 nt, Human
agccaaagcuaggccuggc

SEQ ID NO: 2864339 - RNA, 18 nt, Human
agccaaagcuaggccugg

SEQ ID NO: 2864340 - RNA, 21 nt, Human
agcaugaaaggcuuuuaaauu

SEQ ID NO: 2864341 - RNA, 12 nt, Human
agcaucuucugg

SEQ ID NO: 2864342 - RNA, 12 nt, Human
aaaaaauuuaag

SEQ ID NO: 2864343 - RNA, 14 nt, Human
aaaaacacaaaagu

SEQ ID NO: 2864344 - RNA, 11 nt, Human
aaaaacaaaaa

SEQ ID NO: 2864345 - RNA, 14 nt, Human
aaaaaauuuaagug

SEQ ID NO: 2864346 - RNA, 12 nt, Human
aaaaacaaccaa

SEQ ID NO: 2864347 - RNA, 14 nt, Human
aaaacaaccaagcg

SEQ ID NO: 2864348 - RNA, 15 nt, Human
aaaacaaaauuuuau

SEQ ID NO: 2864349 - RNA, 14 nt, Human
aaaacaaaacuaua

SEQ ID NO: 2864350 - RNA, 20 nt, Human
aaaacaaaacuauacuugaa

SEQ ID NO: 2864351 - RNA, 10 nt, Human
aaaacaaaac

SEQ ID NO: 2864352 - RNA, 14 nt, Human
aaaacaaaacaaaa

SEQ ID NO: 2864353 - RNA, 16 nt, Human
aaaacaaaacaaaacu

SEQ ID NO: 2864354 - RNA, 22 nt, Human
aaaaauuuuauaaaauuaagca

SEQ ID NO: 2864355 - RNA, 17 nt, Human
aaaaauuugaacacugg

SEQ ID NO: 2864356 - RNA, 13 nt, Human
aaaaauuuaagug

SEQ ID NO: 2864357 - RNA, 22 nt, Human
aaaacaacuauggaucagaaua

SEQ ID NO: 2864358 - RNA, 22 nt, Human
aaaacaacuuaauaaaaacuua

SEQ ID NO: 2864359 - RNA, 12 nt, Human
aaaacaagugaa

SEQ ID NO: 2864360 - RNA, 15 nt, Human
aaaacaagugaaaua

SEQ ID NO: 2864361 - RNA, 15 nt, Human
aaaacaagaaugaaa

SEQ ID NO: 2864362 - RNA, 19 nt, Human
aaaacaaucauuugcuuuu

SEQ ID NO: 2864363 - RNA, 19 nt, Human
aaaacaaucuggaagaaaa

SEQ ID NO: 2864364 - RNA, 16 nt, Human
aaaacaaucacacuca

SEQ ID NO: 2864365 - RNA, 19 nt, Human
aaaaauuccuuuguguuuc

SEQ ID NO: 2864366 - RNA, 13 nt, Human
aaaaauuccagaa

SEQ ID NO: 2864367 - RNA, 18 nt, Human
aaaaauuccuaagaauca

SEQ ID NO: 2864368 - RNA, 13 nt, Human
aaaaauugaagag

SEQ ID NO: 2864369 - RNA, 19 nt, Human
aaaaauugaagagagauau

SEQ ID NO: 2864370 - RNA, 18 nt, Human
aaaaauugguucuuuauu

SEQ ID NO: 2864371 - RNA, 14 nt, Human
aaaaauugucuuca

SEQ ID NO: 2864372 - RNA, 19 nt, Human
aaaaagacuuuaaaaguga

SEQ ID NO: 2864373 - RNA, 19 nt, Human
aaaaagagaauuagauuau

SEQ ID NO: 2864374 - RNA, 14 nt, Human
aaaaagacagggcu

SEQ ID NO: 2864375 - RNA, 15 nt, Human
aaaaagacucuuuuu

SEQ ID NO: 2864376 - RNA, 13 nt, Human
aaaaagacaaaca

SEQ ID NO: 2864377 - RNA, 22 nt, Human
aaaaauucagcaaaccauuuuu

SEQ ID NO: 2864378 - RNA, 16 nt, Human
aaaaacauagaaaaau

SEQ ID NO: 2864379 - RNA, 14 nt, Human
aaaaacauauucuu

SEQ ID NO: 2864380 - RNA, 15 nt, Human
aaaaacauauucuug

SEQ ID NO: 2864381 - RNA, 14 nt, Human
aaaaaccaaaacug

SEQ ID NO: 2864382 - RNA, 16 nt, Human
aaaaaccacacaaaga

SEQ ID NO: 2864383 - RNA, 12 nt, Human
aaaaacauugcc

SEQ ID NO: 2864384 - RNA, 15 nt, Human
aaaaacauugccuuu

SEQ ID NO: 2864385 - RNA, 15 nt, Human
aaaaacugucuuuaa

SEQ ID NO: 2864386 - RNA, 20 nt, Human
aaaaacugucuuuaaaagag

SEQ ID NO: 2864387 - RNA, 21 nt, Human
aaaaacuuagugacaaaauag

SEQ ID NO: 2864388 - RNA, 22 nt, Human
aaaaacuugugcuauaaagcua

SEQ ID NO: 2864389 - RNA, 22 nt, Human
aaaaacuggaacggugaaggug

SEQ ID NO: 2864390 - RNA, 15 nt, Human
aaaaacuugaaaaua

SEQ ID NO: 2864391 - RNA, 22 nt, Human
cacuucugugagacccccacac

SEQ ID NO: 2864392 - RNA, 18 nt, Human
cacuucuuguuccccacu

SEQ ID NO: 2864393 - RNA, 21 nt, Human
cacuucugugagacccccaca

SEQ ID NO: 2864394 - RNA, 20 nt, Human
cacuucugugagacccccac

SEQ ID NO: 2864395 - RNA, 12 nt, Human
cacuucuuccuu

SEQ ID NO: 2864396 - RNA, 13 nt, Human
cacuucuuccuuu

SEQ ID NO: 2864397 - RNA, 15 nt, Human
cacuucuuccuuucu

SEQ ID NO: 2864398 - RNA, 16 nt, Human
cacuucuuccuuucuc

SEQ ID NO: 2864399 - RNA, 17 nt, Human
cacuucuuccuuucucu

SEQ ID NO: 2864400 - RNA, 19 nt, Human
cacuucuuccuuucucuuu

SEQ ID NO: 2864401 - RNA, 19 nt, Human
cacuucuggucaaucaaca

SEQ ID NO: 2864402 - RNA, 14 nt, Human
cacuucuguccaua

SEQ ID NO: 2864403 - RNA, 14 nt, Human
cacuucuguccugu

SEQ ID NO: 2864404 - RNA, 16 nt, Human
cacuucuguccuguga

SEQ ID NO: 2864405 - RNA, 18 nt, Human
cacuucuguccugugagg

SEQ ID NO: 2864406 - RNA, 13 nt, Human
cacuugcagacuc

SEQ ID NO: 2864407 - RNA, 23 nt, Human
cacuugaugauacaaugaacacu

SEQ ID NO: 2864408 - RNA, 14 nt, Human
cacuugauucauaa

SEQ ID NO: 2864409 - RNA, 15 nt, Human
cacuugauucauaaa

SEQ ID NO: 2864410 - RNA, 18 nt, Human
cacuugaggucaggaguu

SEQ ID NO: 2864411 - RNA, 19 nt, Human
cacuugaugacccccaacc

SEQ ID NO: 2864412 - RNA, 17 nt, Human
cacuugaaauucuuuca

SEQ ID NO: 2864413 - RNA, 17 nt, Human
cacuugaacaaaaucug

SEQ ID NO: 2864414 - RNA, 18 nt, Human
cacuugaacaaaaucugu

SEQ ID NO: 2864415 - RNA, 22 nt, Human
cacuugaacaaaaucuguugcc

SEQ ID NO: 2864416 - RNA, 15 nt, Human
cacuucuuuuauaac

SEQ ID NO: 2864417 - RNA, 13 nt, Human
cacuugccugggu

SEQ ID NO: 2864418 - RNA, 17 nt, Human
cacuuggcaucagcugg

SEQ ID NO: 2864419 - RNA, 19 nt, Human
cacuuggcaucagcuggcg

SEQ ID NO: 2864420 - RNA, 19 nt, Human
cacuuggggagauuugcca

SEQ ID NO: 2864421 - RNA, 19 nt, Human
cacuuggcccaaguggcag

SEQ ID NO: 2864422 - RNA, 22 nt, Human
cacuuggcccaaguggcagagc

SEQ ID NO: 2864423 - RNA, 22 nt, Human
cacuugcagacucuacagaggc

SEQ ID NO: 2864424 - RNA, 19 nt, Human
cacuugcagacucuacaga

SEQ ID NO: 2864425 - RNA, 18 nt, Human
cacuugcagacucuacag

SEQ ID NO: 2864426 - RNA, 14 nt, Human
cacuugcagacucu

SEQ ID NO: 2864427 - RNA, 24 nt, Human
cacuugcagacucuacagaggcca

SEQ ID NO: 2864428 - RNA, 14 nt, Human
cacuugauuccuug

SEQ ID NO: 2864429 - RNA, 12 nt, Human
cacuugcauguc

SEQ ID NO: 2864430 - RNA, 12 nt, Human
cacuugcauuuc

SEQ ID NO: 2864431 - RNA, 12 nt, Human
cacuugccuggg

SEQ ID NO: 2864432 - RNA, 15 nt, Human
cacuugcuacccuga

SEQ ID NO: 2864433 - RNA, 22 nt, Human
cacuugccgcgucgcccuccca

SEQ ID NO: 2864434 - RNA, 13 nt, Human
cacuugcccugcu

SEQ ID NO: 2864435 - RNA, 14 nt, Human
cacuugcccugcuc

SEQ ID NO: 2864436 - RNA, 17 nt, Human
cacuugcccugcucccu

SEQ ID NO: 2864437 - RNA, 18 nt, Human
cacuucaauaauugucca

SEQ ID NO: 2864438 - RNA, 19 nt, Human
cacuucaauaauuguccau

SEQ ID NO: 2864439 - RNA, 15 nt, Human
cacuucaaugcacau

SEQ ID NO: 2864440 - RNA, 17 nt, Human
cacuucaaggugacaga

SEQ ID NO: 2864441 - RNA, 18 nt, Human
cacuucaaggugacagaa

SEQ ID NO: 2864442 - RNA, 22 nt, Human
cacuucaaggugacagaaggac

SEQ ID NO: 2864443 - RNA, 18 nt, Human
cacuucacuccagccugg

SEQ ID NO: 2864444 - RNA, 16 nt, Human
cacuucagaauuccau

SEQ ID NO: 2864445 - RNA, 14 nt, Human
cacuguugauguau

SEQ ID NO: 2864446 - RNA, 15 nt, Human
cacuguugauguauc

SEQ ID NO: 2864447 - RNA, 16 nt, Human
cacuguugauguaucu

SEQ ID NO: 2864448 - RNA, 17 nt, Human
cacuguugauguaucug

SEQ ID NO: 2864449 - RNA, 18 nt, Human
cacuguugauguaucuga

SEQ ID NO: 2864450 - RNA, 13 nt, Human
cacuguugaauuu

SEQ ID NO: 2864451 - RNA, 17 nt, Human
cacuguugaaaauuauu

SEQ ID NO: 2864452 - RNA, 18 nt, Human
cacuguugaaaauuauuu

SEQ ID NO: 2864453 - RNA, 14 nt, Human
cacuguugaaaauu

SEQ ID NO: 2864454 - RNA, 16 nt, Human
cacuguugaaaauuau

SEQ ID NO: 2864455 - RNA, 17 nt, Human
cacuguugaauuuucuc

SEQ ID NO: 2864456 - RNA, 16 nt, Human
cacuuauuguaaauuu

SEQ ID NO: 2864457 - RNA, 21 nt, Human
cacuguugaaaauuauuuuaa

SEQ ID NO: 2864458 - RNA, 23 nt, Human
cacuucaggcucuucuccuuuca

SEQ ID NO: 2864459 - RNA, 16 nt, Human
cacuucauugagaguu

SEQ ID NO: 2864460 - RNA, 18 nt, Human
cacuucaggucaggaguu

SEQ ID NO: 2864461 - RNA, 14 nt, Human
cacuucaggcucuu

SEQ ID NO: 2864462 - RNA, 15 nt, Human
cacuucaggcucuuc

SEQ ID NO: 2864463 - RNA, 16 nt, Human
cacuucaggcucuucu

SEQ ID NO: 2864464 - RNA, 20 nt, Human
cacuucaggcucuucuccuu

SEQ ID NO: 2864465 - RNA, 22 nt, Human
cacuucugccauauucuguugg

SEQ ID NO: 2864466 - RNA, 16 nt, Human
cacuucucaucacaca

SEQ ID NO: 2864467 - RNA, 17 nt, Human
cacuucucaucacacac

SEQ ID NO: 2864468 - RNA, 18 nt, Human
cacuucucaucacacaca

SEQ ID NO: 2864469 - RNA, 19 nt, Human
cacuucucaucacacacau

SEQ ID NO: 2864470 - RNA, 20 nt, Human
cacuucucaucacacacaug

SEQ ID NO: 2864471 - RNA, 21 nt, Human
cacuucucaucacacacaugg

SEQ ID NO: 2864472 - RNA, 21 nt, Human
cacuucucuuaaacuugugaa

SEQ ID NO: 2864473 - RNA, 23 nt, Human
cacuucucuuaaacuugugaaug

SEQ ID NO: 2864474 - RNA, 21 nt, Human
cacuucgcgugcccucgcugc

SEQ ID NO: 2864475 - RNA, 17 nt, Human
cacuucggccagagcug

SEQ ID NO: 2864476 - RNA, 21 nt, Human
cacuucggccaggucacacga

SEQ ID NO: 2864477 - RNA, 23 nt, Human
cacuucggccaggucacacgacc

SEQ ID NO: 2864478 - RNA, 23 nt, Human
cacuucgggcuguguaaacacag

SEQ ID NO: 2864479 - RNA, 17 nt, Human
cacuucuaaauagcaau

SEQ ID NO: 2864480 - RNA, 18 nt, Human
cacuucuaaaugaagugc

SEQ ID NO: 2864481 - RNA, 17 nt, Human
cacuucuaaaugaagug

SEQ ID NO: 2864482 - RNA, 20 nt, Human
cacuucuaggguaugggaaa

SEQ ID NO: 2864483 - RNA, 21 nt, Human
cacuucucacaucuuaugcua

SEQ ID NO: 2864484 - RNA, 20 nt, Human
cacuuccaggggaaccugcc

SEQ ID NO: 2864485 - RNA, 22 nt, Human
cacuucauugagaguuuugucu

SEQ ID NO: 2864486 - RNA, 19 nt, Human
cacuuccaaaauucuuauu

SEQ ID NO: 2864487 - RNA, 20 nt, Human
cacuuccauaaucuggacuc

SEQ ID NO: 2864488 - RNA, 12 nt, Human
cacuuccagggg

SEQ ID NO: 2864489 - RNA, 17 nt, Human
cacuuccaggggaaccu

SEQ ID NO: 2864490 - RNA, 14 nt, Human
cacuuccaggggaa

SEQ ID NO: 2864491 - RNA, 17 nt, Human
cacuuccuguuuuauaa

SEQ ID NO: 2864492 - RNA, 23 nt, Human
cacuuccuacaagagcagccugu

SEQ ID NO: 2864493 - RNA, 17 nt, Human
cacuuccuacaagagca

SEQ ID NO: 2864494 - RNA, 12 nt, Human
cacuucccugcu

SEQ ID NO: 2864495 - RNA, 13 nt, Human
cacuucccugcug

SEQ ID NO: 2864496 - RNA, 14 nt, Human
cacuucccugcugc

SEQ ID NO: 2864497 - RNA, 15 nt, Human
cacuucccugcugcc

SEQ ID NO: 2864498 - RNA, 16 nt, Human
cacuucccugcugccu

SEQ ID NO: 2864499 - RNA, 18 nt, Human
cacuucccugcugccugu

SEQ ID NO: 2864500 - RNA, 15 nt, Human
cacuguggcugucug

SEQ ID NO: 2864501 - RNA, 19 nt, Human
cacuguggaacuaauaaau

SEQ ID NO: 2864502 - RNA, 20 nt, Human
cacuguggaacuaauaaaua

SEQ ID NO: 2864503 - RNA, 23 nt, Human
cacuguggaacuaauaaauacau

SEQ ID NO: 2864504 - RNA, 16 nt, Human
cacugugcucagggcu

SEQ ID NO: 2864505 - RNA, 13 nt, Human
cacugugcucagg

SEQ ID NO: 2864506 - RNA, 15 nt, Human
cacugugcucagggc

SEQ ID NO: 2864507 - RNA, 16 nt, Human
cacugugccaugugcc

SEQ ID NO: 2864508 - RNA, 15 nt, Human
cacugugccaugugc

SEQ ID NO: 2864509 - RNA, 18 nt, Human
cacugugccaugugccag

SEQ ID NO: 2864510 - RNA, 13 nt, Human
cacugugcaggug

SEQ ID NO: 2864511 - RNA, 22 nt, Human
cacugugcaggugcuauuguua

SEQ ID NO: 2864512 - RNA, 17 nt, Human
cacugugcccagcccgg

SEQ ID NO: 2864513 - RNA, 22 nt, Human
cacugugcccagcccggaccuu

SEQ ID NO: 2864514 - RNA, 14 nt, Human
cacugugcuauaaa

SEQ ID NO: 2864515 - RNA, 21 nt, Human
cacugugccuuugcaaaucag

SEQ ID NO: 2864516 - RNA, 22 nt, Human
cacugugccuuugcaaaucagu

SEQ ID NO: 2864517 - RNA, 16 nt, Human
cacugugggacucuuc

SEQ ID NO: 2864518 - RNA, 12 nt, Human
cacugugggugu

SEQ ID NO: 2864519 - RNA, 15 nt, Human
cacugugggugugug

SEQ ID NO: 2864520 - RNA, 16 nt, Human
cacuguggguguguga

SEQ ID NO: 2864521 - RNA, 19 nt, Human
cacugugggugugugacuc

SEQ ID NO: 2864522 - RNA, 20 nt, Human
cacugugggugugugacucu

SEQ ID NO: 2864523 - RNA, 18 nt, Human
cacugugguaaaugccac

SEQ ID NO: 2864524 - RNA, 19 nt, Human
cacugugguaaaugccaca

SEQ ID NO: 2864525 - RNA, 20 nt, Human
cacugugguaaaugccacac

SEQ ID NO: 2864526 - RNA, 13 nt, Human
cacugugguggca

SEQ ID NO: 2864527 - RNA, 14 nt, Human
cacuguucaugcug

SEQ ID NO: 2864528 - RNA, 16 nt, Human
cacuguucaugcuggc

SEQ ID NO: 2864529 - RNA, 17 nt, Human
cacuguucaugcuggcg

SEQ ID NO: 2864530 - RNA, 19 nt, Human
cacuguucaugcuggcgag

SEQ ID NO: 2864531 - RNA, 23 nt, Human
cacuguucuauucaucucaagga

SEQ ID NO: 2864532 - RNA, 21 nt, Human
cacuguucucccuucggugga

SEQ ID NO: 2864533 - RNA, 23 nt, Human
cacuguuacuuucguacauuggc

SEQ ID NO: 2864534 - RNA, 22 nt, Human
cacuguuagcuuuuuaaaacau

SEQ ID NO: 2864535 - RNA, 23 nt, Human
cacuguuagcuuuuuaaaacauu

SEQ ID NO: 2864536 - RNA, 17 nt, Human
cacuguauuuguaucuc

SEQ ID NO: 2864537 - RNA, 20 nt, Human
cacugucacccuccaccucu

SEQ ID NO: 2864538 - RNA, 14 nt, Human
cacuguauuuguau

SEQ ID NO: 2864539 - RNA, 16 nt, Human
cacugucacccuccac

SEQ ID NO: 2864540 - RNA, 16 nt, Human
cacugucaugcuucau

SEQ ID NO: 2864541 - RNA, 13 nt, Human
cacugucccuccu

SEQ ID NO: 2864542 - RNA, 14 nt, Human
cacugucccuccug

SEQ ID NO: 2864543 - RNA, 15 nt, Human
cacugucccuccugg

SEQ ID NO: 2864544 - RNA, 16 nt, Human
cacugucccuccuggu

SEQ ID NO: 2864545 - RNA, 20 nt, Human
cacugucccuccugguguca

SEQ ID NO: 2864546 - RNA, 18 nt, Human
cacuguccuccaagccag

SEQ ID NO: 2864547 - RNA, 22 nt, Human
cacuguccuccacacaagggaa

SEQ ID NO: 2864548 - RNA, 17 nt, Human
cacuguccuccaagcca

SEQ ID NO: 2864549 - RNA, 14 nt, Human
cacuguccuccaag

SEQ ID NO: 2864550 - RNA, 14 nt, Human
cacugugccaugug

SEQ ID NO: 2864551 - RNA, 16 nt, Human
cacugugaccuugacu

SEQ ID NO: 2864552 - RNA, 12 nt, Human
cacugugacaca

SEQ ID NO: 2864553 - RNA, 13 nt, Human
cacugugacacac

SEQ ID NO: 2864554 - RNA, 15 nt, Human
cacugugacacacua

SEQ ID NO: 2864555 - RNA, 16 nt, Human
cacugugacacacuac

SEQ ID NO: 2864556 - RNA, 17 nt, Human
cacugugacacacuaca

SEQ ID NO: 2864557 - RNA, 22 nt, Human
cacugugacacacuacaccaca

SEQ ID NO: 2864558 - RNA, 21 nt, Human
cacugucuuauggauucauuu

SEQ ID NO: 2864559 - RNA, 15 nt, Human
cacuguaugauuuau

SEQ ID NO: 2864560 - RNA, 22 nt, Human
cacuguaugauuuauaaacaga

SEQ ID NO: 2864561 - RNA, 18 nt, Human
cacuguaugcuggacggc

SEQ ID NO: 2864562 - RNA, 16 nt, Human
cacuguaugcuggacg

SEQ ID NO: 2864563 - RNA, 23 nt, Human
cacuguauaaauaggagaggaug

SEQ ID NO: 2864564 - RNA, 19 nt, Human
cacuguauaaauaggagag

SEQ ID NO: 2864565 - RNA, 21 nt, Human
cacuguauaaauaggagagga

SEQ ID NO: 2864566 - RNA, 15 nt, Human
cacuguauaaauagg

SEQ ID NO: 2864567 - RNA, 16 nt, Human
cacuguauaaauagga

SEQ ID NO: 2864568 - RNA, 17 nt, Human
cacuguauaaauaggag

SEQ ID NO: 2864569 - RNA, 18 nt, Human
cacuguauaaauaggaga

SEQ ID NO: 2864570 - RNA, 13 nt, Human
cacuguauaaaua

SEQ ID NO: 2864571 - RNA, 14 nt, Human
cacuguauaaauag

SEQ ID NO: 2864572 - RNA, 18 nt, Human
cacuguaguucuaagacu

SEQ ID NO: 2864573 - RNA, 20 nt, Human
cacuguaguucuaagacuca

SEQ ID NO: 2864574 - RNA, 14 nt, Human
cacuguaguucuaa

SEQ ID NO: 2864575 - RNA, 15 nt, Human
cacuguaguucuaag

SEQ ID NO: 2864576 - RNA, 16 nt, Human
cacuguaguucuaaga

SEQ ID NO: 2864577 - RNA, 17 nt, Human
cacuguaguucuaagac

SEQ ID NO: 2864578 - RNA, 18 nt, Human
cacuguagaaugauuuca

SEQ ID NO: 2864579 - RNA, 18 nt, Human
cacugcgcuuuauuuucu

SEQ ID NO: 2864580 - RNA, 17 nt, Human
cacuguaccauauagca

SEQ ID NO: 2864581 - RNA, 20 nt, Human
cacuguacaagguaccccuu

SEQ ID NO: 2864582 - RNA, 16 nt, Human
cacuggcuaaagauaa

SEQ ID NO: 2864583 - RNA, 13 nt, Human
cacuggccccuca

SEQ ID NO: 2864584 - RNA, 24 nt, Human
cacuggccccucaaaucguccagc

SEQ ID NO: 2864585 - RNA, 22 nt, Human
cacuguaagacucauucccuag

SEQ ID NO: 2864586 - RNA, 17 nt, Human
cacugacagccucccac

SEQ ID NO: 2864587 - RNA, 16 nt, Human
cacugacagccuccca

SEQ ID NO: 2864588 - RNA, 20 nt, Human
cacugacagccucccacccc

SEQ ID NO: 2864589 - RNA, 17 nt, Human
cacugaccauccacucu

SEQ ID NO: 2864590 - RNA, 16 nt, Human
cacugaccauccacuc

SEQ ID NO: 2864591 - RNA, 23 nt, Human
cacugaccauccacucuacccuc

SEQ ID NO: 2864592 - RNA, 14 nt, Human
cacugacccuucca

SEQ ID NO: 2864593 - RNA, 15 nt, Human
cacugacccuuccag

SEQ ID NO: 2864594 - RNA, 16 nt, Human
cacugacccuuccaga

SEQ ID NO: 2864595 - RNA, 18 nt, Human
cacugacccuuccagaca

SEQ ID NO: 2864596 - RNA, 19 nt, Human
cacugacccuuccagacau

SEQ ID NO: 2864597 - RNA, 21 nt, Human
cacugacccuuccagacauac

SEQ ID NO: 2864598 - RNA, 19 nt, Human
cacugacuacuggcucuca

SEQ ID NO: 2864599 - RNA, 20 nt, Human
cacugaccuuggagagacac

SEQ ID NO: 2864600 - RNA, 22 nt, Human
cacugaccuuggagagacacag

SEQ ID NO: 2864601 - RNA, 15 nt, Human
cacugacuacuggcu

SEQ ID NO: 2864602 - RNA, 23 nt, Human
cacugacauuguuggccaaagcc

SEQ ID NO: 2864603 - RNA, 15 nt, Human
cacugacagccuccc

SEQ ID NO: 2864604 - RNA, 14 nt, Human
cacugacagccucc

SEQ ID NO: 2864605 - RNA, 13 nt, Human
cacugacagccuc

SEQ ID NO: 2864606 - RNA, 19 nt, Human
cacucugucgcccagucug

SEQ ID NO: 2864607 - RNA, 16 nt, Human
cacucugucgcccagu

SEQ ID NO: 2864608 - RNA, 15 nt, Human
cacucugucgcccag

SEQ ID NO: 2864609 - RNA, 17 nt, Human
cacucugggcuccagag

SEQ ID NO: 2864610 - RNA, 18 nt, Human
cacucuggucuuggaauu

SEQ ID NO: 2864611 - RNA, 16 nt, Human
cacucugggcuccaga

SEQ ID NO: 2864612 - RNA, 13 nt, Human
cacucuggccuca

SEQ ID NO: 2864613 - RNA, 15 nt, Human
cacucugggcuccag

SEQ ID NO: 2864614 - RNA, 14 nt, Human
cacucugggcucca

SEQ ID NO: 2864615 - RNA, 12 nt, Human
cacucuggccuc

SEQ ID NO: 2864616 - RNA, 20 nt, Human
cacucugggcacacucugcc

SEQ ID NO: 2864617 - RNA, 21 nt, Human
cacucugggcacacucugcca

SEQ ID NO: 2864618 - RNA, 22 nt, Human
cacugauauuuuaccucuuauu

SEQ ID NO: 2864619 - RNA, 13 nt, Human
cacugcaaccucc

SEQ ID NO: 2864620 - RNA, 23 nt, Human
cacugcaaccuccgccucuuggg

SEQ ID NO: 2864621 - RNA, 16 nt, Human
cacugcaaccuccgcc

SEQ ID NO: 2864622 - RNA, 14 nt, Human
cacugcaaccuccg

SEQ ID NO: 2864623 - RNA, 16 nt, Human
cacugcaacuucugcc

SEQ ID NO: 2864624 - RNA, 23 nt, Human
cacugcaaccuucgccaccuggg

SEQ ID NO: 2864625 - RNA, 22 nt, Human
cacugcaaccuucgccaccugg

SEQ ID NO: 2864626 - RNA, 14 nt, Human
cacugcaaccuucg

SEQ ID NO: 2864627 - RNA, 17 nt, Human
cacugcaacuucugccu

SEQ ID NO: 2864628 - RNA, 18 nt, Human
cacugcaaucauauguga

SEQ ID NO: 2864629 - RNA, 12 nt, Human
cacugcaagucc

SEQ ID NO: 2864630 - RNA, 19 nt, Human
cacugcaaguccuuuugua

SEQ ID NO: 2864631 - RNA, 20 nt, Human
cacugcaaguccuuuuguaa

SEQ ID NO: 2864632 - RNA, 21 nt, Human
cacugcaaguccuuuuguaaa

SEQ ID NO: 2864633 - RNA, 22 nt, Human
cacugcaaguccuuuuguaaag

SEQ ID NO: 2864634 - RNA, 18 nt, Human
cacugcacagugcaucuc

SEQ ID NO: 2864635 - RNA, 19 nt, Human
cacugcacagugcaucuca

SEQ ID NO: 2864636 - RNA, 21 nt, Human
cacugcacagugcaucucagc

SEQ ID NO: 2864637 - RNA, 22 nt, Human
cacugcacagugcaucucagcc

SEQ ID NO: 2864638 - RNA, 16 nt, Human
cacugcaauccugucu

SEQ ID NO: 2864639 - RNA, 19 nt, Human
cacugcaauccugucuuuc

SEQ ID NO: 2864640 - RNA, 24 nt, Human
cacugaugggcaacccccagccug

SEQ ID NO: 2864641 - RNA, 18 nt, Human
cacugaugggcaaccccc

SEQ ID NO: 2864642 - RNA, 14 nt, Human
cacugaugggcaac

SEQ ID NO: 2864643 - RNA, 16 nt, Human
cacugaugcuuagaug

SEQ ID NO: 2864644 - RNA, 15 nt, Human
cacugaugcuuagau

SEQ ID NO: 2864645 - RNA, 17 nt, Human
cacugaugcuguucucu

SEQ ID NO: 2864646 - RNA, 23 nt, Human
cacugaugcuguucucuucuuca

SEQ ID NO: 2864647 - RNA, 19 nt, Human
cacugauauuuuaccucuu

SEQ ID NO: 2864648 - RNA, 18 nt, Human
cacugauauauuuuccag

SEQ ID NO: 2864649 - RNA, 13 nt, Human
cacugauauucag

SEQ ID NO: 2864650 - RNA, 15 nt, Human
cacugauauucagaa

SEQ ID NO: 2864651 - RNA, 16 nt, Human
cacugaggccugagac

SEQ ID NO: 2864652 - RNA, 19 nt, Human
cacugaggccugagaccca

SEQ ID NO: 2864653 - RNA, 21 nt, Human
cacugaggccugagacccagg

SEQ ID NO: 2864654 - RNA, 22 nt, Human
cacugaggccugagacccagga

SEQ ID NO: 2864655 - RNA, 23 nt, Human
cacugaggccugagacccaggac

SEQ ID NO: 2864656 - RNA, 15 nt, Human
cacugagcugucaug

SEQ ID NO: 2864657 - RNA, 19 nt, Human
cacugccuuuuuauuuaua

SEQ ID NO: 2864658 - RNA, 15 nt, Human
cacugccugggcuga

SEQ ID NO: 2864659 - RNA, 12 nt, Human
cacugccuuuuu

SEQ ID NO: 2864660 - RNA, 22 nt, Human
cacugccugauggaccugucac

SEQ ID NO: 2864661 - RNA, 15 nt, Human
cacugccucuggaau

SEQ ID NO: 2864662 - RNA, 19 nt, Human
cacugccugggcugacccc

SEQ ID NO: 2864663 - RNA, 13 nt, Human
cacugccuguaua

SEQ ID NO: 2864664 - RNA, 15 nt, Human
cacugccuguauacu

SEQ ID NO: 2864665 - RNA, 16 nt, Human
cacugccuguauacuu

SEQ ID NO: 2864666 - RNA, 17 nt, Human
cacugccuguauacuuu

SEQ ID NO: 2864667 - RNA, 23 nt, Human
cacugccuguauacuuuaguaug

SEQ ID NO: 2864668 - RNA, 13 nt, Human
cacugccugggcu

SEQ ID NO: 2864669 - RNA, 12 nt, Human
cacugccugggc

SEQ ID NO: 2864670 - RNA, 11 nt, Human
cacugccuggg

SEQ ID NO: 2864671 - RNA, 20 nt, Human
cacugccuucgauacaccgg

SEQ ID NO: 2864672 - RNA, 22 nt, Human
cacugccuucgauacaccgggc

SEQ ID NO: 2864673 - RNA, 17 nt, Human
cacugcucccugaagcc

SEQ ID NO: 2864674 - RNA, 18 nt, Human
cacugcucccugaagcca

SEQ ID NO: 2864675 - RNA, 19 nt, Human
cacugcucccugaagccag

SEQ ID NO: 2864676 - RNA, 20 nt, Human
cacugcucccugaagccagc

SEQ ID NO: 2864677 - RNA, 21 nt, Human
cacugcucccugaagccagcc

SEQ ID NO: 2864678 - RNA, 22 nt, Human
cacugcucccugaagccagccu

SEQ ID NO: 2864679 - RNA, 23 nt, Human
cacugcucccugaagccagccuu

SEQ ID NO: 2864680 - RNA, 14 nt, Human
cacugcucccugaa

SEQ ID NO: 2864681 - RNA, 11 nt, Human
cacugcucccu

SEQ ID NO: 2864682 - RNA, 12 nt, Human
cacugcucccua

SEQ ID NO: 2864683 - RNA, 21 nt, Human
cacugcucccuaagccagccu

SEQ ID NO: 2864684 - RNA, 22 nt, Human
cacugcucccuaagccagccug

SEQ ID NO: 2864685 - RNA, 23 nt, Human
cacugcucccuaagccagccugg

SEQ ID NO: 2864686 - RNA, 12 nt, Human
cacugcucuggu

SEQ ID NO: 2864687 - RNA, 20 nt, Human
cacugcucugaugaagagga

SEQ ID NO: 2864688 - RNA, 15 nt, Human
cacugcugcccagcc

SEQ ID NO: 2864689 - RNA, 17 nt, Human
cacugcucuccagccug

SEQ ID NO: 2864690 - RNA, 23 nt, Human
cacugcucuccagccugggaggc

SEQ ID NO: 2864691 - RNA, 13 nt, Human
cacugcugcagua

SEQ ID NO: 2864692 - RNA, 17 nt, Human
cacugcugcccagccuc

SEQ ID NO: 2864693 - RNA, 18 nt, Human
cacugcacuauagccuag

SEQ ID NO: 2864694 - RNA, 19 nt, Human
cacugcaccgggccacaga

SEQ ID NO: 2864695 - RNA, 18 nt, Human
cacugcaccgggccacag

SEQ ID NO: 2864696 - RNA, 16 nt, Human
cacugcaccgggccac

SEQ ID NO: 2864697 - RNA, 15 nt, Human
cacugcaccgggcca

SEQ ID NO: 2864698 - RNA, 14 nt, Human
cacugcaccgggcc

SEQ ID NO: 2864699 - RNA, 23 nt, Human
cacugcacagugcaucucagccc

SEQ ID NO: 2864700 - RNA, 12 nt, Human
cacugccucugc

SEQ ID NO: 2864701 - RNA, 13 nt, Human
cacugccucugcc

SEQ ID NO: 2864702 - RNA, 14 nt, Human
cacugccucugccu

SEQ ID NO: 2864703 - RNA, 15 nt, Human
cacugccucugccuu

SEQ ID NO: 2864704 - RNA, 16 nt, Human
cacugccucugccuua

SEQ ID NO: 2864705 - RNA, 23 nt, Human
cacugccucugccuuagaggagc

SEQ ID NO: 2864706 - RNA, 16 nt, Human
cacugccucuuccucc

SEQ ID NO: 2864707 - RNA, 15 nt, Human
cacugcccgcacacc

SEQ ID NO: 2864708 - RNA, 17 nt, Human
cacugcccgcacacccu

SEQ ID NO: 2864709 - RNA, 18 nt, Human
cacugcccgcacacccuc

SEQ ID NO: 2864710 - RNA, 19 nt, Human
cacugcccgcacacccuca

SEQ ID NO: 2864711 - RNA, 18 nt, Human
cacugcccucgcacggcc

SEQ ID NO: 2864712 - RNA, 20 nt, Human
cacugcuuuuggucugugug

SEQ ID NO: 2864713 - RNA, 18 nt, Human
cacugcuugaugaagcaa

SEQ ID NO: 2864714 - RNA, 19 nt, Human
cacugcuugaugaagcaag

SEQ ID NO: 2864715 - RNA, 23 nt, Human
cacugcuugaugaagcaaggaag

SEQ ID NO: 2864716 - RNA, 12 nt, Human
cacugcuggcug

SEQ ID NO: 2864717 - RNA, 13 nt, Human
cacugcuggcugc

SEQ ID NO: 2864718 - RNA, 14 nt, Human
cacugcuggcugcc

SEQ ID NO: 2864719 - RNA, 15 nt, Human
cacugcuggcugccu

SEQ ID NO: 2864720 - RNA, 16 nt, Human
cacugcuggcugccuu

SEQ ID NO: 2864721 - RNA, 21 nt, Human
cacugcuggcugccuuagaac

SEQ ID NO: 2864722 - RNA, 21 nt, Human
cacugcuuuuggucuguguga

SEQ ID NO: 2864723 - RNA, 13 nt, Human
cacugcuuuuggc

SEQ ID NO: 2864724 - RNA, 17 nt, Human
cacugcuuuuggccugg

SEQ ID NO: 2864725 - RNA, 18 nt, Human
cacugcuuuuggccugga

SEQ ID NO: 2864726 - RNA, 16 nt, Human
cacuggaccacugggc

SEQ ID NO: 2864727 - RNA, 15 nt, Human
cacuggacucaccuc

SEQ ID NO: 2864728 - RNA, 15 nt, Human
cacuggacuccggcc

SEQ ID NO: 2864729 - RNA, 16 nt, Human
cacuggacuccggccc

SEQ ID NO: 2864730 - RNA, 18 nt, Human
cacuggacucaccucccc

SEQ ID NO: 2864731 - RNA, 19 nt, Human
cacuggacuccggcccucc

SEQ ID NO: 2864732 - RNA, 20 nt, Human
cacuggagccaucucuuccu

SEQ ID NO: 2864733 - RNA, 18 nt, Human
cacuggcagacuguguaa

SEQ ID NO: 2864734 - RNA, 19 nt, Human
cacuggcagacuguguaaa

SEQ ID NO: 2864735 - RNA, 21 nt, Human
cacuggcagacuguguaaaau

SEQ ID NO: 2864736 - RNA, 14 nt, Human
cacuggccaucccu

SEQ ID NO: 2864737 - RNA, 23 nt, Human
cacuggaugcaaagaaaaucaga

SEQ ID NO: 2864738 - RNA, 19 nt, Human
cacuggaugcaaagaaaau

SEQ ID NO: 2864739 - RNA, 19 nt, Human
cacuggaguggcucgccag

SEQ ID NO: 2864740 - RNA, 20 nt, Human
cacuggaguggcucgccagg

SEQ ID NO: 2864741 - RNA, 21 nt, Human
cacuggaguggcucgccaggc

SEQ ID NO: 2864742 - RNA, 22 nt, Human
cacuggaguggcucgccaggcc

SEQ ID NO: 2864743 - RNA, 15 nt, Human
cacuggagcccagga

SEQ ID NO: 2864744 - RNA, 14 nt, Human
cacuggagcccagg

SEQ ID NO: 2864745 - RNA, 13 nt, Human
cacuggagcccag

SEQ ID NO: 2864746 - RNA, 12 nt, Human
cacuggagccca

SEQ ID NO: 2864747 - RNA, 11 nt, Human
cacuggagccc

SEQ ID NO: 2864748 - RNA, 23 nt, Human
cacgugguuggggcccugcccug

SEQ ID NO: 2864749 - RNA, 23 nt, Human
cacguguuuuauuccuguauguu

SEQ ID NO: 2864750 - RNA, 22 nt, Human
cacguguuuuauuccuguaugu

SEQ ID NO: 2864751 - RNA, 13 nt, Human
cacguguacuggc

SEQ ID NO: 2864752 - RNA, 16 nt, Human
cacguguacuggcucc

SEQ ID NO: 2864753 - RNA, 17 nt, Human
cacguguacuggcuccu

SEQ ID NO: 2864754 - RNA, 18 nt, Human
cacguguacuggcuccuc

SEQ ID NO: 2864755 - RNA, 16 nt, Human
cacgugggcucauaug

SEQ ID NO: 2864756 - RNA, 15 nt, Human
cacguguccuguagu

SEQ ID NO: 2864757 - RNA, 16 nt, Human
cacguguccuguaguu

SEQ ID NO: 2864758 - RNA, 14 nt, Human
cacgugucuuccac

SEQ ID NO: 2864759 - RNA, 14 nt, Human
cacuaaaauuuuag

SEQ ID NO: 2864760 - RNA, 15 nt, Human
cacuaaaauuuuagg

SEQ ID NO: 2864761 - RNA, 22 nt, Human
cacuaaacuuuacccaaaaacu

SEQ ID NO: 2864762 - RNA, 12 nt, Human
cacuaaagcagu

SEQ ID NO: 2864763 - RNA, 13 nt, Human
cacguucuuuccc

SEQ ID NO: 2864764 - RNA, 16 nt, Human
cacguugccucuacuu

SEQ ID NO: 2864765 - RNA, 18 nt, Human
cacguuccacaguugcca

SEQ ID NO: 2864766 - RNA, 14 nt, Human
cacguacacacaca

SEQ ID NO: 2864767 - RNA, 19 nt, Human
cacguacacacacauacac

SEQ ID NO: 2864768 - RNA, 18 nt, Human
cacguacacacacauaca

SEQ ID NO: 2864769 - RNA, 15 nt, Human
cacguauuccccuuc

SEQ ID NO: 2864770 - RNA, 20 nt, Human
cacgucacguguagugucca

SEQ ID NO: 2864771 - RNA, 20 nt, Human
cacgguuugaagccuggaac

SEQ ID NO: 2864772 - RNA, 20 nt, Human
cacguaaguuaauaagcaaa

SEQ ID NO: 2864773 - RNA, 19 nt, Human
cacgguuugaagccuggaa

SEQ ID NO: 2864774 - RNA, 15 nt, Human
cacguacaaaaucca

SEQ ID NO: 2864775 - RNA, 18 nt, Human
cacguggaggagcagugc

SEQ ID NO: 2864776 - RNA, 20 nt, Human
cacguggaggagcagugcag

SEQ ID NO: 2864777 - RNA, 21 nt, Human
cacguggaggagcagugcagg

SEQ ID NO: 2864778 - RNA, 23 nt, Human
cacguggagagcuggugcccgga

SEQ ID NO: 2864779 - RNA, 15 nt, Human
cacguggagagcugg

SEQ ID NO: 2864780 - RNA, 13 nt, Human
cacguggagagcu

SEQ ID NO: 2864781 - RNA, 21 nt, Human
cacgugcgcugggcacuuccc

SEQ ID NO: 2864782 - RNA, 22 nt, Human
cacguggcugcgugccccugcu

SEQ ID NO: 2864783 - RNA, 16 nt, Human
cacgugcagcucaagg

SEQ ID NO: 2864784 - RNA, 13 nt, Human
cacgugacagccg

SEQ ID NO: 2864785 - RNA, 15 nt, Human
cacgucugucuucac

SEQ ID NO: 2864786 - RNA, 14 nt, Human
cacgucugucuuca

SEQ ID NO: 2864787 - RNA, 18 nt, Human
cacgucuguaaucccagc

SEQ ID NO: 2864788 - RNA, 17 nt, Human
cacgguuugaagccugg

SEQ ID NO: 2864789 - RNA, 18 nt, Human
cacgguuugaagccugga

SEQ ID NO: 2864790 - RNA, 15 nt, Human
cacgguagugccuga

SEQ ID NO: 2864791 - RNA, 17 nt, Human
cacgguauuuauagaga

SEQ ID NO: 2864792 - RNA, 22 nt, Human
cacgguauuuauagagagagac

SEQ ID NO: 2864793 - RNA, 16 nt, Human
cacggucuucccucuu

SEQ ID NO: 2864794 - RNA, 14 nt, Human
cacgguagugccug

SEQ ID NO: 2864795 - RNA, 15 nt, Human
cacgggggcagcuga

SEQ ID NO: 2864796 - RNA, 22 nt, Human
cacgggggcagcugauacaaau

SEQ ID NO: 2864797 - RNA, 15 nt, Human
cacgggggccaagga

SEQ ID NO: 2864798 - RNA, 18 nt, Human
cacgggacggaagugcuu

SEQ ID NO: 2864799 - RNA, 12 nt, Human
cacggcugcuga

SEQ ID NO: 2864800 - RNA, 13 nt, Human
cacggcugcugag

SEQ ID NO: 2864801 - RNA, 20 nt, Human
cacggcucacugcagccuca

SEQ ID NO: 2864802 - RNA, 19 nt, Human
cacggcucacugcagccuc

SEQ ID NO: 2864803 - RNA, 17 nt, Human
cacggcucacugcagcc

SEQ ID NO: 2864804 - RNA, 16 nt, Human
cacggcucacugcagc

SEQ ID NO: 2864805 - RNA, 17 nt, Human
cacgcuggaccuugaac

SEQ ID NO: 2864806 - RNA, 14 nt, Human
cacgcuccuuccuc

SEQ ID NO: 2864807 - RNA, 20 nt, Human
cacgcuggaccuugaacugg

SEQ ID NO: 2864808 - RNA, 15 nt, Human
cacggcucacugcag

SEQ ID NO: 2864809 - RNA, 23 nt, Human
cacgcgugcacacaccagagccc

SEQ ID NO: 2864810 - RNA, 15 nt, Human
cacgcgcgcacacac

SEQ ID NO: 2864811 - RNA, 22 nt, Human
cacgcgcgcacacacacacaua

SEQ ID NO: 2864812 - RNA, 17 nt, Human
cacgcgcgcgcacacac

SEQ ID NO: 2864813 - RNA, 19 nt, Human
cacgcgcuucgacuuuucu

SEQ ID NO: 2864814 - RNA, 15 nt, Human
cacgcgggggccuug

SEQ ID NO: 2864815 - RNA, 14 nt, Human
cacgcguauuuaca

SEQ ID NO: 2864816 - RNA, 23 nt, Human
cacgcgcgcacacacacacauac

SEQ ID NO: 2864817 - RNA, 21 nt, Human
cacgcgugcacacaccagagc

SEQ ID NO: 2864818 - RNA, 16 nt, Human
cacgcgugcacacacc

SEQ ID NO: 2864819 - RNA, 15 nt, Human
cacgcgugcacacac

SEQ ID NO: 2864820 - RNA, 15 nt, Human
cacgccuuccccuca

SEQ ID NO: 2864821 - RNA, 16 nt, Human
cacgccuuccccucag

SEQ ID NO: 2864822 - RNA, 19 nt, Human
cacgcgccccccucccaga

SEQ ID NO: 2864823 - RNA, 20 nt, Human
cacgcgccccccucccagag

SEQ ID NO: 2864824 - RNA, 21 nt, Human
cacgcgccccccucccagagg

SEQ ID NO: 2864825 - RNA, 22 nt, Human
cacgcgccccccucccagaggc

SEQ ID NO: 2864826 - RNA, 23 nt, Human
cacgcgccccccucccagaggcg

SEQ ID NO: 2864827 - RNA, 17 nt, Human
cacgcgcccuuucuacc

SEQ ID NO: 2864828 - RNA, 13 nt, Human
cacgcgcgcacac

SEQ ID NO: 2864829 - RNA, 16 nt, Human
cacgccuguaauccca

SEQ ID NO: 2864830 - RNA, 23 nt, Human
cacgccugcaaacgcugccugcc

SEQ ID NO: 2864831 - RNA, 22 nt, Human
cacgccugcaaacgcugccugc

SEQ ID NO: 2864832 - RNA, 21 nt, Human
cacgccugcaaacgcugccug

SEQ ID NO: 2864833 - RNA, 22 nt, Human
cacgccucccacugggguccag

SEQ ID NO: 2864834 - RNA, 21 nt, Human
cacgccucucccuaggagaag

SEQ ID NO: 2864835 - RNA, 17 nt, Human
cacgccugcaaacgcug

SEQ ID NO: 2864836 - RNA, 17 nt, Human
cacgccucccacugggg

SEQ ID NO: 2864837 - RNA, 18 nt, Human
cacgccucccacuggggu

SEQ ID NO: 2864838 - RNA, 13 nt, Human
cacgccucccacu

SEQ ID NO: 2864839 - RNA, 14 nt, Human
cacgccucccacug

SEQ ID NO: 2864840 - RNA, 15 nt, Human
cacgccucccacugg

SEQ ID NO: 2864841 - RNA, 16 nt, Human
cacgccucccacuggg

SEQ ID NO: 2864842 - RNA, 22 nt, Human
cacgccuaugaucccagcacuu

SEQ ID NO: 2864843 - RNA, 21 nt, Human
cacgccuaugaucccagcacu

SEQ ID NO: 2864844 - RNA, 19 nt, Human
cacgccuaugaucccagca

SEQ ID NO: 2864845 - RNA, 18 nt, Human
cacgccuaugaucccagc

SEQ ID NO: 2864846 - RNA, 21 nt, Human
cacgcccuccccuccccugcu

SEQ ID NO: 2864847 - RNA, 16 nt, Human
cacgcccuccccuccc

SEQ ID NO: 2864848 - RNA, 20 nt, Human
cacgcccuccccuccccugc

SEQ ID NO: 2864849 - RNA, 24 nt, Human
cacgcccuccccuccccugcugca

SEQ ID NO: 2864850 - RNA, 21 nt, Human
cacgccgggaaccaagcagga

SEQ ID NO: 2864851 - RNA, 16 nt, Human
cacgagaccccggcuu

SEQ ID NO: 2864852 - RNA, 14 nt, Human
cacgauccugccac

SEQ ID NO: 2864853 - RNA, 15 nt, Human
cacgauccugccacc

SEQ ID NO: 2864854 - RNA, 19 nt, Human
cacgauccugccacccugu

SEQ ID NO: 2864855 - RNA, 13 nt, Human
cacgcaccugggu

SEQ ID NO: 2864856 - RNA, 12 nt, Human
cacgcacgcaca

SEQ ID NO: 2864857 - RNA, 13 nt, Human
cacgcacgcacac

SEQ ID NO: 2864858 - RNA, 14 nt, Human
cacgcacgcacaca

SEQ ID NO: 2864859 - RNA, 15 nt, Human
cacgcacgcacacac

SEQ ID NO: 2864860 - RNA, 14 nt, Human
cacgcacacacaca

SEQ ID NO: 2864861 - RNA, 13 nt, Human
cacgcacacacac

SEQ ID NO: 2864862 - RNA, 15 nt, Human
cacgcacacacacaa

SEQ ID NO: 2864863 - RNA, 12 nt, Human
cacgcacacaca

SEQ ID NO: 2864864 - RNA, 17 nt, Human
cacgauuuucuccagcu

SEQ ID NO: 2864865 - RNA, 19 nt, Human
cacgauuuucuccagcuca

SEQ ID NO: 2864866 - RNA, 21 nt, Human
cacgauuuucuccagcucaga

SEQ ID NO: 2864867 - RNA, 23 nt, Human
cacgauuuucuccagcucagaac

SEQ ID NO: 2864868 - RNA, 13 nt, Human
cacgcaacuugaa

SEQ ID NO: 2864869 - RNA, 15 nt, Human
cacgcaacuugaaau

SEQ ID NO: 2864870 - RNA, 15 nt, Human
cacgccacugcacua

SEQ ID NO: 2864871 - RNA, 13 nt, Human
cacgccacugcac

SEQ ID NO: 2864872 - RNA, 16 nt, Human
cacgcacgcacacaca

SEQ ID NO: 2864873 - RNA, 18 nt, Human
cacgcacauauacacaca

SEQ ID NO: 2864874 - RNA, 20 nt, Human
cacgcagauuagcaggccaa

SEQ ID NO: 2864875 - RNA, 22 nt, Human
cacgccacugcacuccagccug

SEQ ID NO: 2864876 - RNA, 14 nt, Human
cacgccacugcacu

SEQ ID NO: 2864877 - RNA, 15 nt, Human
cacgcccuccccucc

SEQ ID NO: 2864878 - RNA, 13 nt, Human
cacgcccuccccu

SEQ ID NO: 2864879 - RNA, 19 nt, Human
caccugugaguuuaaagca

SEQ ID NO: 2864880 - RNA, 20 nt, Human
caccugugaguuuaaagcaa

SEQ ID NO: 2864881 - RNA, 22 nt, Human
caccuguggaacauaaaaagga

SEQ ID NO: 2864882 - RNA, 10 nt, Human
caccuguggg

SEQ ID NO: 2864883 - RNA, 20 nt, Human
caccuguggguguagccagg

SEQ ID NO: 2864884 - RNA, 22 nt, Human
caccuguggguguagccaggua

SEQ ID NO: 2864885 - RNA, 22 nt, Human
caccuuagccugcccuccuuuc

SEQ ID NO: 2864886 - RNA, 13 nt, Human
caccuuagcuggc

SEQ ID NO: 2864887 - RNA, 17 nt, Human
caccuuaccaacuuucu

SEQ ID NO: 2864888 - RNA, 18 nt, Human
caccuuaccaacuuucug

SEQ ID NO: 2864889 - RNA, 19 nt, Human
caccuuaccaacuuucugu

SEQ ID NO: 2864890 - RNA, 14 nt, Human
caccuuccagcucc

SEQ ID NO: 2864891 - RNA, 15 nt, Human
caccuuccagcuccu

SEQ ID NO: 2864892 - RNA, 15 nt, Human
caccuucauuuugag

SEQ ID NO: 2864893 - RNA, 16 nt, Human
caccuucauuuugagg

SEQ ID NO: 2864894 - RNA, 22 nt, Human
caccuucauuuugaggggagga

SEQ ID NO: 2864895 - RNA, 18 nt, Human
caccuucccacuuuccca

SEQ ID NO: 2864896 - RNA, 16 nt, Human
caccuuccagcuccug

SEQ ID NO: 2864897 - RNA, 18 nt, Human
caccuuccagcuccugua

SEQ ID NO: 2864898 - RNA, 19 nt, Human
caccuucaauuccugggcc

SEQ ID NO: 2864899 - RNA, 18 nt, Human
caccuucaauuccugggc

SEQ ID NO: 2864900 - RNA, 17 nt, Human
caccuucaauuccuggg

SEQ ID NO: 2864901 - RNA, 18 nt, Human
cacgaauuugcuggggaa

SEQ ID NO: 2864902 - RNA, 22 nt, Human
cacgaauuugcuggggaaucuc

SEQ ID NO: 2864903 - RNA, 14 nt, Human
cacgaccggggcca

SEQ ID NO: 2864904 - RNA, 18 nt, Human
cacgaccggggccagcac

SEQ ID NO: 2864905 - RNA, 17 nt, Human
cacgaccuaggcaguag

SEQ ID NO: 2864906 - RNA, 23 nt, Human
cacgaccuaggcaguaggccggu

SEQ ID NO: 2864907 - RNA, 19 nt, Human
cacgacgcccucuccccac

SEQ ID NO: 2864908 - RNA, 15 nt, Human
cacgacgcugcagag

SEQ ID NO: 2864909 - RNA, 13 nt, Human
caccuugacaggg

SEQ ID NO: 2864910 - RNA, 23 nt, Human
caccuucguuuacuaugccugug

SEQ ID NO: 2864911 - RNA, 22 nt, Human
caccuucguuuacuaugccugu

SEQ ID NO: 2864912 - RNA, 21 nt, Human
caccuucguuuacuaugccug

SEQ ID NO: 2864913 - RNA, 13 nt, Human
caccuucccaugc

SEQ ID NO: 2864914 - RNA, 14 nt, Human
caccuucccaugcc

SEQ ID NO: 2864915 - RNA, 12 nt, Human
caccuucccuug

SEQ ID NO: 2864916 - RNA, 14 nt, Human
caccuucccuugcc

SEQ ID NO: 2864917 - RNA, 15 nt, Human
caccuucccuugcca

SEQ ID NO: 2864918 - RNA, 17 nt, Human
caccuucccuugccacu

SEQ ID NO: 2864919 - RNA, 18 nt, Human
caccuucccuugccacuu

SEQ ID NO: 2864920 - RNA, 19 nt, Human
caccuucccuugccacuuu

SEQ ID NO: 2864921 - RNA, 21 nt, Human
caccuucccuugccacuuugc

SEQ ID NO: 2864922 - RNA, 16 nt, Human
caccuugacagggcac

SEQ ID NO: 2864923 - RNA, 15 nt, Human
caccuugacagggca

SEQ ID NO: 2864924 - RNA, 18 nt, Human
caccuugacagggcacac

SEQ ID NO: 2864925 - RNA, 12 nt, Human
caccuucugagu

SEQ ID NO: 2864926 - RNA, 20 nt, Human
caccuucuuauuauauauau

SEQ ID NO: 2864927 - RNA, 14 nt, Human
cacucaagaagcag

SEQ ID NO: 2864928 - RNA, 15 nt, Human
cacucaagaagcagg

SEQ ID NO: 2864929 - RNA, 17 nt, Human
cacucaagaagcaggcu

SEQ ID NO: 2864930 - RNA, 13 nt, Human
cacucaagcuugg

SEQ ID NO: 2864931 - RNA, 13 nt, Human
cacucaagcacug

SEQ ID NO: 2864932 - RNA, 14 nt, Human
cacucaagcacuga

SEQ ID NO: 2864933 - RNA, 15 nt, Human
cacucaagcacugau

SEQ ID NO: 2864934 - RNA, 16 nt, Human
cacucaagcacugaua

SEQ ID NO: 2864935 - RNA, 23 nt, Human
cacucaagaagcaggcuacacug

SEQ ID NO: 2864936 - RNA, 19 nt, Human
cacucaagaagcaggcuac

SEQ ID NO: 2864937 - RNA, 20 nt, Human
cacucaagaagcaggcuaca

SEQ ID NO: 2864938 - RNA, 21 nt, Human
cacuauguugcccaggcaggu

SEQ ID NO: 2864939 - RNA, 20 nt, Human
cacuauguugcccaggcagg

SEQ ID NO: 2864940 - RNA, 12 nt, Human
cacuauuuuaga

SEQ ID NO: 2864941 - RNA, 19 nt, Human
cacuauuuaucugugcaaa

SEQ ID NO: 2864942 - RNA, 19 nt, Human
cacucagaagacacugaug

SEQ ID NO: 2864943 - RNA, 18 nt, Human
cacucagaagacacugau

SEQ ID NO: 2864944 - RNA, 22 nt, Human
cacucagaagacacugaugggc

SEQ ID NO: 2864945 - RNA, 17 nt, Human
cacuauaguuuaaaaca

SEQ ID NO: 2864946 - RNA, 12 nt, Human
cacucagaccug

SEQ ID NO: 2864947 - RNA, 20 nt, Human
cacucacauuuauucugcuc

SEQ ID NO: 2864948 - RNA, 19 nt, Human
cacucacauuuauucugcu

SEQ ID NO: 2864949 - RNA, 13 nt, Human
cacucacaugaca

SEQ ID NO: 2864950 - RNA, 14 nt, Human
cacucacaugacac

SEQ ID NO: 2864951 - RNA, 18 nt, Human
cacucaccaguguccccu

SEQ ID NO: 2864952 - RNA, 21 nt, Human
cacucaccaguguccccucca

SEQ ID NO: 2864953 - RNA, 14 nt, Human
cacucaccaugaag

SEQ ID NO: 2864954 - RNA, 17 nt, Human
cacucagaagacacuga

SEQ ID NO: 2864955 - RNA, 16 nt, Human
cacucagaagacacug

SEQ ID NO: 2864956 - RNA, 12 nt, Human
cacucagaagac

SEQ ID NO: 2864957 - RNA, 15 nt, Human
cacuaaaguauguaa

SEQ ID NO: 2864958 - RNA, 16 nt, Human
cacuaaaguauguaaa

SEQ ID NO: 2864959 - RNA, 15 nt, Human
cacuaaagccagccu

SEQ ID NO: 2864960 - RNA, 16 nt, Human
cacuaaagccagccug

SEQ ID NO: 2864961 - RNA, 17 nt, Human
cacuaaagccagccuga

SEQ ID NO: 2864962 - RNA, 18 nt, Human
cacuaaagccagccugac

SEQ ID NO: 2864963 - RNA, 20 nt, Human
cacuaaagccagccugaccu

SEQ ID NO: 2864964 - RNA, 21 nt, Human
cacuaaagccagccugaccuu

SEQ ID NO: 2864965 - RNA, 16 nt, Human
cacuaaaucagagaca

SEQ ID NO: 2864966 - RNA, 15 nt, Human
cacuaaaucagagac

SEQ ID NO: 2864967 - RNA, 13 nt, Human
cacuaaaucagag

SEQ ID NO: 2864968 - RNA, 22 nt, Human
cacuaaaguauguaaaguaugu

SEQ ID NO: 2864969 - RNA, 16 nt, Human
cacuaaccacgcugga

SEQ ID NO: 2864970 - RNA, 15 nt, Human
cacuaaccacgcugg

SEQ ID NO: 2864971 - RNA, 14 nt, Human
cacuaaccacgcug

SEQ ID NO: 2864972 - RNA, 19 nt, Human
cacuaacucaccagcccca

SEQ ID NO: 2864973 - RNA, 18 nt, Human
cacuaacucaccagcccc

SEQ ID NO: 2864974 - RNA, 15 nt, Human
cacuaacucaccagc

SEQ ID NO: 2864975 - RNA, 14 nt, Human
cacuaacucaccag

SEQ ID NO: 2864976 - RNA, 18 nt, Human
cacuaaccacgcuggacc

SEQ ID NO: 2864977 - RNA, 20 nt, Human
cacuaacguugagccccugg

SEQ ID NO: 2864978 - RNA, 18 nt, Human
cacuaaggugugcucuga

SEQ ID NO: 2864979 - RNA, 17 nt, Human
cacuaaggugugcucug

SEQ ID NO: 2864980 - RNA, 21 nt, Human
cacuagugaccccuucccugu

SEQ ID NO: 2864981 - RNA, 21 nt, Human
cacuauagccuaggugacaga

SEQ ID NO: 2864982 - RNA, 15 nt, Human
cacuauacaaacaaa

SEQ ID NO: 2864983 - RNA, 19 nt, Human
cacuaucauaguuaacaua

SEQ ID NO: 2864984 - RNA, 13 nt, Human
cacuauccaugca

SEQ ID NO: 2864985 - RNA, 16 nt, Human
cacuauccaugcacca

SEQ ID NO: 2864986 - RNA, 18 nt, Human
cacuauccaugcaccaaa

SEQ ID NO: 2864987 - RNA, 19 nt, Human
cacuauccaugcaccaaac

SEQ ID NO: 2864988 - RNA, 14 nt, Human
cacuauagccuagg

SEQ ID NO: 2864989 - RNA, 19 nt, Human
cacuauguugcccaggcag

SEQ ID NO: 2864990 - RNA, 18 nt, Human
cacuauguugcccaggca

SEQ ID NO: 2864991 - RNA, 17 nt, Human
cacuauguugcccaggc

SEQ ID NO: 2864992 - RNA, 16 nt, Human
cacuauguugcccagg

SEQ ID NO: 2864993 - RNA, 15 nt, Human
cacuauguugcccag

SEQ ID NO: 2864994 - RNA, 19 nt, Human
cacuaucccggcugcccuu

SEQ ID NO: 2864995 - RNA, 18 nt, Human
cacuaucccggcugcccu

SEQ ID NO: 2864996 - RNA, 13 nt, Human
cacucuccaucac

SEQ ID NO: 2864997 - RNA, 12 nt, Human
cacucuccccac

SEQ ID NO: 2864998 - RNA, 15 nt, Human
cacucuccccacacu

SEQ ID NO: 2864999 - RNA, 14 nt, Human
cacucuccccacac

SEQ ID NO: 2865000 - RNA, 21 nt, Human
cacucuccccacacuaaccug

SEQ ID NO: 2865001 - RNA, 21 nt, Human
cacucuacccucccacccccu

SEQ ID NO: 2865002 - RNA, 11 nt, Human
cacucuagauu

SEQ ID NO: 2865003 - RNA, 14 nt, Human
cacucuagauucca

SEQ ID NO: 2865004 - RNA, 17 nt, Human
cacucuacccucccacc

SEQ ID NO: 2865005 - RNA, 16 nt, Human
cacucuacccucccac

SEQ ID NO: 2865006 - RNA, 15 nt, Human
cacucuacccuccca

SEQ ID NO: 2865007 - RNA, 17 nt, Human
cacucuacccuauacaa

SEQ ID NO: 2865008 - RNA, 19 nt, Human
cacucuacccucccacccc

SEQ ID NO: 2865009 - RNA, 18 nt, Human
cacucuacccucccaccc

SEQ ID NO: 2865010 - RNA, 14 nt, Human
cacucuacuuagca

SEQ ID NO: 2865011 - RNA, 18 nt, Human
cacucuaccagugcaggc

SEQ ID NO: 2865012 - RNA, 22 nt, Human
cacucgugugcaacagacaagu

SEQ ID NO: 2865013 - RNA, 20 nt, Human
cacucgugugcaacagacaa

SEQ ID NO: 2865014 - RNA, 20 nt, Human
cacucgcuucccccauagcc

SEQ ID NO: 2865015 - RNA, 16 nt, Human
cacucgcuucccccau

SEQ ID NO: 2865016 - RNA, 14 nt, Human
cacucggcuuugga

SEQ ID NO: 2865017 - RNA, 22 nt, Human
cacucggcauuucaaaugugcu

SEQ ID NO: 2865018 - RNA, 11 nt, Human
cacuccuugca

SEQ ID NO: 2865019 - RNA, 15 nt, Human
cacuccuugcaucaa

SEQ ID NO: 2865020 - RNA, 13 nt, Human
cacucgcuucccc

SEQ ID NO: 2865021 - RNA, 15 nt, Human
cacucucuaccagau

SEQ ID NO: 2865022 - RNA, 13 nt, Human
cacucuccuugca

SEQ ID NO: 2865023 - RNA, 15 nt, Human
cacucuccuugcagu

SEQ ID NO: 2865024 - RNA, 17 nt, Human
cacucuccuugcaguuc

SEQ ID NO: 2865025 - RNA, 23 nt, Human
cacucugccccccccccccaucu

SEQ ID NO: 2865026 - RNA, 15 nt, Human
cacucugcucgccuu

SEQ ID NO: 2865027 - RNA, 18 nt, Human
cacucugcucgccuuagc

SEQ ID NO: 2865028 - RNA, 11 nt, Human
cacucugcccc

SEQ ID NO: 2865029 - RNA, 13 nt, Human
cacucucuggaag

SEQ ID NO: 2865030 - RNA, 14 nt, Human
cacucucuggaagc

SEQ ID NO: 2865031 - RNA, 17 nt, Human
cacucucuucccuuucc

SEQ ID NO: 2865032 - RNA, 20 nt, Human
cacucugacgcaaaaccacu

SEQ ID NO: 2865033 - RNA, 16 nt, Human
cacucugccagcaaag

SEQ ID NO: 2865034 - RNA, 17 nt, Human
cacucugccagcaaaga

SEQ ID NO: 2865035 - RNA, 20 nt, Human
cacucugccagcaaagagga

SEQ ID NO: 2865036 - RNA, 12 nt, Human
cacucugccagg

SEQ ID NO: 2865037 - RNA, 13 nt, Human
cacucugccaggg

SEQ ID NO: 2865038 - RNA, 14 nt, Human
cacucugccagggc

SEQ ID NO: 2865039 - RNA, 15 nt, Human
cacucugccagggca

SEQ ID NO: 2865040 - RNA, 16 nt, Human
cacucugccagggcag

SEQ ID NO: 2865041 - RNA, 19 nt, Human
cacucugccagggcagugc

SEQ ID NO: 2865042 - RNA, 16 nt, Human
cacucugauagaauua

SEQ ID NO: 2865043 - RNA, 15 nt, Human
cacucugcagacugc

SEQ ID NO: 2865044 - RNA, 18 nt, Human
cacucugcagacugcuag

SEQ ID NO: 2865045 - RNA, 14 nt, Human
cacucugcugcuua

SEQ ID NO: 2865046 - RNA, 11 nt, Human
cacucugcugc

SEQ ID NO: 2865047 - RNA, 12 nt, Human
cacucugcugcu

SEQ ID NO: 2865048 - RNA, 21 nt, Human
cacucaggaggcugaggcagg

SEQ ID NO: 2865049 - RNA, 16 nt, Human
cacucaguccauagca

SEQ ID NO: 2865050 - RNA, 22 nt, Human
cacucagcucuuggcuccacug

SEQ ID NO: 2865051 - RNA, 11 nt, Human
cacucagcccc

SEQ ID NO: 2865052 - RNA, 12 nt, Human
cacucagccccu

SEQ ID NO: 2865053 - RNA, 13 nt, Human
cacucagccccua

SEQ ID NO: 2865054 - RNA, 15 nt, Human
cacucagccccuagg

SEQ ID NO: 2865055 - RNA, 16 nt, Human
cacucagccccuagga

SEQ ID NO: 2865056 - RNA, 17 nt, Human
cacucagccccuaggag

SEQ ID NO: 2865057 - RNA, 18 nt, Human
cacucagccccuaggagu

SEQ ID NO: 2865058 - RNA, 22 nt, Human
cacucagccccuaggaguauau

SEQ ID NO: 2865059 - RNA, 19 nt, Human
cacucaggccaacaagcca

SEQ ID NO: 2865060 - RNA, 12 nt, Human
cacucaggcugg

SEQ ID NO: 2865061 - RNA, 13 nt, Human
cacucaggcugga

SEQ ID NO: 2865062 - RNA, 14 nt, Human
cacucaggcuggag

SEQ ID NO: 2865063 - RNA, 20 nt, Human
cacucaggcuggaguacagu

SEQ ID NO: 2865064 - RNA, 20 nt, Human
cacucaggggucacugaggc

SEQ ID NO: 2865065 - RNA, 20 nt, Human
cacucaggaggcugaggcag

SEQ ID NO: 2865066 - RNA, 19 nt, Human
cacucaggaggcugaggca

SEQ ID NO: 2865067 - RNA, 15 nt, Human
cacucauuccuguag

SEQ ID NO: 2865068 - RNA, 16 nt, Human
cacucauccccucacu

SEQ ID NO: 2865069 - RNA, 19 nt, Human
cacucagcuuccuacccac

SEQ ID NO: 2865070 - RNA, 19 nt, Human
cacucagugcagcaauaua

SEQ ID NO: 2865071 - RNA, 16 nt, Human
cacucaguuuaugcug

SEQ ID NO: 2865072 - RNA, 13 nt, Human
cacucauuccugu

SEQ ID NO: 2865073 - RNA, 14 nt, Human
cacuccugccaagg

SEQ ID NO: 2865074 - RNA, 13 nt, Human
cacuccugccaag

SEQ ID NO: 2865075 - RNA, 16 nt, Human
cacuccucagggcagc

SEQ ID NO: 2865076 - RNA, 13 nt, Human
cacuccucagggc

SEQ ID NO: 2865077 - RNA, 12 nt, Human
cacuccucccuc

SEQ ID NO: 2865078 - RNA, 13 nt, Human
cacuccucccucc

SEQ ID NO: 2865079 - RNA, 14 nt, Human
cacuccucccuccg

SEQ ID NO: 2865080 - RNA, 22 nt, Human
cacucccuucccaugacccagg

SEQ ID NO: 2865081 - RNA, 14 nt, Human
cacucccuccagca

SEQ ID NO: 2865082 - RNA, 15 nt, Human
cacucccuccagcac

SEQ ID NO: 2865083 - RNA, 17 nt, Human
cacucccuccagcacaa

SEQ ID NO: 2865084 - RNA, 19 nt, Human
cacucccuccagcacaaac

SEQ ID NO: 2865085 - RNA, 20 nt, Human
cacucccuccagcacaaaca

SEQ ID NO: 2865086 - RNA, 21 nt, Human
cacucccuugguggcaagagc

SEQ ID NO: 2865087 - RNA, 21 nt, Human
cacuccggugugccugcagcc

SEQ ID NO: 2865088 - RNA, 20 nt, Human
cacuccggugugccugcagc

SEQ ID NO: 2865089 - RNA, 19 nt, Human
cacuccggugugccugcag

SEQ ID NO: 2865090 - RNA, 17 nt, Human
cacuccggugugccugc

SEQ ID NO: 2865091 - RNA, 22 nt, Human
cacuccggugugccugcagccc

SEQ ID NO: 2865092 - RNA, 13 nt, Human
cacuccuaccugg

SEQ ID NO: 2865093 - RNA, 14 nt, Human
cacuccuaccuggu

SEQ ID NO: 2865094 - RNA, 12 nt, Human
cacuccuagaga

SEQ ID NO: 2865095 - RNA, 19 nt, Human
cacuccuagagaacgcagc

SEQ ID NO: 2865096 - RNA, 21 nt, Human
cacuccuagagaacgcagccc

SEQ ID NO: 2865097 - RNA, 22 nt, Human
cacuccuagagaacgcagcccu

SEQ ID NO: 2865098 - RNA, 13 nt, Human
caccucccugccc

SEQ ID NO: 2865099 - RNA, 14 nt, Human
caccucccugccca

SEQ ID NO: 2865100 - RNA, 15 nt, Human
caccucccugcccag

SEQ ID NO: 2865101 - RNA, 16 nt, Human
caccucccugcccagg

SEQ ID NO: 2865102 - RNA, 17 nt, Human
caccucccugcccaggc

SEQ ID NO: 2865103 - RNA, 23 nt, Human
caccucccugcccaggccggcca

SEQ ID NO: 2865104 - RNA, 14 nt, Human
caccuccucaugua

SEQ ID NO: 2865105 - RNA, 14 nt, Human
caccucccugaccc

SEQ ID NO: 2865106 - RNA, 11 nt, Human
caccuccugcc

SEQ ID NO: 2865107 - RNA, 13 nt, Human
caccuccugccuc

SEQ ID NO: 2865108 - RNA, 14 nt, Human
caccuccugccucg

SEQ ID NO: 2865109 - RNA, 22 nt, Human
caccuccuugucacuuuauuac

SEQ ID NO: 2865110 - RNA, 14 nt, Human
caccuccuucaauu

SEQ ID NO: 2865111 - RNA, 15 nt, Human
caccucuacccaaac

SEQ ID NO: 2865112 - RNA, 16 nt, Human
caccucuacccaaacc

SEQ ID NO: 2865113 - RNA, 18 nt, Human
caccucuacccaaacccu

SEQ ID NO: 2865114 - RNA, 21 nt, Human
caccucuacccaaacccuagg

SEQ ID NO: 2865115 - RNA, 22 nt, Human
caccucuacccaaacccuaggu

SEQ ID NO: 2865116 - RNA, 21 nt, Human
caccucccccaucucuucugg

SEQ ID NO: 2865117 - RNA, 14 nt, Human
caccucccccaucu

SEQ ID NO: 2865118 - RNA, 14 nt, Human
caccuccccacgcc

SEQ ID NO: 2865119 - RNA, 17 nt, Human
caccuccccacgcccuc

SEQ ID NO: 2865120 - RNA, 19 nt, Human
caccuccccacgcccuccc

SEQ ID NO: 2865121 - RNA, 21 nt, Human
caccuccccacgcccuccccu

SEQ ID NO: 2865122 - RNA, 9 nt, Human
caccucccc

SEQ ID NO: 2865123 - RNA, 13 nt, Human
caccuccccacgc

SEQ ID NO: 2865124 - RNA, 12 nt, Human
caccucccagga

SEQ ID NO: 2865125 - RNA, 11 nt, Human
caccucccagg

SEQ ID NO: 2865126 - RNA, 13 nt, Human
caccuccaguccc

SEQ ID NO: 2865127 - RNA, 22 nt, Human
caccuccagucccccuauccuu

SEQ ID NO: 2865128 - RNA, 12 nt, Human
caccuccagccc

SEQ ID NO: 2865129 - RNA, 14 nt, Human
caccuccagcccgg

SEQ ID NO: 2865130 - RNA, 16 nt, Human
caccuccagcccggga

SEQ ID NO: 2865131 - RNA, 17 nt, Human
caccuccagcccgggag

SEQ ID NO: 2865132 - RNA, 18 nt, Human
caccuccagcccgggagc

SEQ ID NO: 2865133 - RNA, 20 nt, Human
caccuccagcccgggagccu

SEQ ID NO: 2865134 - RNA, 21 nt, Human
caccuccagcccgggagccua

SEQ ID NO: 2865135 - RNA, 22 nt, Human
caccuccagcccgggagccuag

SEQ ID NO: 2865136 - RNA, 10 nt, Human
caccucccag

SEQ ID NO: 2865137 - RNA, 15 nt, Human
caccuccaucccaga

SEQ ID NO: 2865138 - RNA, 21 nt, Human
caccuccauuaaagucugaau

SEQ ID NO: 2865139 - RNA, 18 nt, Human
caccgggccacagagaaa

SEQ ID NO: 2865140 - RNA, 15 nt, Human
caccgggccacagag

SEQ ID NO: 2865141 - RNA, 22 nt, Human
caccgggcacucagaagacacu

SEQ ID NO: 2865142 - RNA, 15 nt, Human
caccgggcacucaga

SEQ ID NO: 2865143 - RNA, 18 nt, Human
caccgguccagcuggccu

SEQ ID NO: 2865144 - RNA, 17 nt, Human
caccgguccagcuggcc

SEQ ID NO: 2865145 - RNA, 16 nt, Human
caccgguccagcuggc

SEQ ID NO: 2865146 - RNA, 15 nt, Human
caccgguccagcugg

SEQ ID NO: 2865147 - RNA, 20 nt, Human
caccggggacaggccgcagc

SEQ ID NO: 2865148 - RNA, 15 nt, Human
caccggggccucgga

SEQ ID NO: 2865149 - RNA, 13 nt, Human
caccgggccugga

SEQ ID NO: 2865150 - RNA, 23 nt, Human
caccucaguucccuuggccucag

SEQ ID NO: 2865151 - RNA, 22 nt, Human
caccucaguucccuuggccuca

SEQ ID NO: 2865152 - RNA, 21 nt, Human
caccucaguucccuuggccuc

SEQ ID NO: 2865153 - RNA, 20 nt, Human
caccucaguucccuuggccu

SEQ ID NO: 2865154 - RNA, 19 nt, Human
caccucaguucccuuggcc

SEQ ID NO: 2865155 - RNA, 18 nt, Human
caccucaguucccuuggc

SEQ ID NO: 2865156 - RNA, 17 nt, Human
caccucaguucccuugg

SEQ ID NO: 2865157 - RNA, 11 nt, Human
caccucaguuc

SEQ ID NO: 2865158 - RNA, 23 nt, Human
caccucaggccaggugcaguggc

SEQ ID NO: 2865159 - RNA, 20 nt, Human
caccgugccuggccacgccc

SEQ ID NO: 2865160 - RNA, 14 nt, Human
caccguacugugga

SEQ ID NO: 2865161 - RNA, 15 nt, Human
caccgugccuggcca

SEQ ID NO: 2865162 - RNA, 18 nt, Human
caccggccgauggagaca

SEQ ID NO: 2865163 - RNA, 12 nt, Human
caccggcgcgcu

SEQ ID NO: 2865164 - RNA, 14 nt, Human
caccgggcacucag

SEQ ID NO: 2865165 - RNA, 13 nt, Human
caccgcccgucug

SEQ ID NO: 2865166 - RNA, 15 nt, Human
caccgcccgucugug

SEQ ID NO: 2865167 - RNA, 23 nt, Human
caccgcccucccuccccagcucc

SEQ ID NO: 2865168 - RNA, 15 nt, Human
caccgacuagccagg

SEQ ID NO: 2865169 - RNA, 21 nt, Human
caccgcggcgcuucccagcac

SEQ ID NO: 2865170 - RNA, 19 nt, Human
caccgcugcuccacgcgcu

SEQ ID NO: 2865171 - RNA, 18 nt, Human
caccgcuucugccuuuuc

SEQ ID NO: 2865172 - RNA, 19 nt, Human
caccgcuuuuguucucgca

SEQ ID NO: 2865173 - RNA, 23 nt, Human
caccugaagacucauucuucugu

SEQ ID NO: 2865174 - RNA, 15 nt, Human
caccugaagacucau

SEQ ID NO: 2865175 - RNA, 14 nt, Human
caccugaagacuca

SEQ ID NO: 2865176 - RNA, 14 nt, Human
caccucuucacccc

SEQ ID NO: 2865177 - RNA, 20 nt, Human
caccucuucaccccccacuc

SEQ ID NO: 2865178 - RNA, 22 nt, Human
caccucugugaccucaggcacu

SEQ ID NO: 2865179 - RNA, 12 nt, Human
caccucugugcc

SEQ ID NO: 2865180 - RNA, 13 nt, Human
caccucuguggca

SEQ ID NO: 2865181 - RNA, 20 nt, Human
caccucuguggcauugaaau

SEQ ID NO: 2865182 - RNA, 20 nt, Human
caccucugugaccucaggca

SEQ ID NO: 2865183 - RNA, 19 nt, Human
caccucuggacuggcuaga

SEQ ID NO: 2865184 - RNA, 13 nt, Human
caccucuguaauu

SEQ ID NO: 2865185 - RNA, 14 nt, Human
caccucuguaauuu

SEQ ID NO: 2865186 - RNA, 19 nt, Human
caccucugucauuuguugu

SEQ ID NO: 2865187 - RNA, 13 nt, Human
caccucugugacc

SEQ ID NO: 2865188 - RNA, 14 nt, Human
caccucugugaccu

SEQ ID NO: 2865189 - RNA, 15 nt, Human
caccucugugaccuc

SEQ ID NO: 2865190 - RNA, 17 nt, Human
caccucugugaccucag

SEQ ID NO: 2865191 - RNA, 18 nt, Human
caccucugugaccucagg

SEQ ID NO: 2865192 - RNA, 19 nt, Human
caccucugugaccucaggc

SEQ ID NO: 2865193 - RNA, 18 nt, Human
caccucuggacuggcuag

SEQ ID NO: 2865194 - RNA, 17 nt, Human
caccucuggacuggcua

SEQ ID NO: 2865195 - RNA, 13 nt, Human
caccucuggacug

SEQ ID NO: 2865196 - RNA, 12 nt, Human
caccucugcuuu

SEQ ID NO: 2865197 - RNA, 16 nt, Human
caccucugcuuucuga

SEQ ID NO: 2865198 - RNA, 22 nt, Human
caccucugcggaccccagcugu

SEQ ID NO: 2865199 - RNA, 20 nt, Human
caccucugcggaccccagcu

SEQ ID NO: 2865200 - RNA, 21 nt, Human
caccucugcggaccccagcug

SEQ ID NO: 2865201 - RNA, 12 nt, Human
caccucugcgga

SEQ ID NO: 2865202 - RNA, 18 nt, Human
caccucugcggaccccag

SEQ ID NO: 2865203 - RNA, 19 nt, Human
caccucugcggaccccagc

SEQ ID NO: 2865204 - RNA, 19 nt, Human
caccucugccagaagaucc

SEQ ID NO: 2865205 - RNA, 12 nt, Human
caccucugccag

SEQ ID NO: 2865206 - RNA, 13 nt, Human
caccucugccaga

SEQ ID NO: 2865207 - RNA, 16 nt, Human
caccucucuccuuugc

SEQ ID NO: 2865208 - RNA, 21 nt, Human
caccugagcaggaccucugaa

SEQ ID NO: 2865209 - RNA, 20 nt, Human
caccugagcaggaccucuga

SEQ ID NO: 2865210 - RNA, 19 nt, Human
caccugagcaggaccucug

SEQ ID NO: 2865211 - RNA, 16 nt, Human
caccugagcaggaccu

SEQ ID NO: 2865212 - RNA, 18 nt, Human
caccugagguuaggaguu

SEQ ID NO: 2865213 - RNA, 23 nt, Human
caccugcacuuaaggcacucugu

SEQ ID NO: 2865214 - RNA, 23 nt, Human
caccugagucacccuaccugugc

SEQ ID NO: 2865215 - RNA, 19 nt, Human
caccugagucacccuaccu

SEQ ID NO: 2865216 - RNA, 17 nt, Human
caccugcaaagcucugu

SEQ ID NO: 2865217 - RNA, 20 nt, Human
caccugcaaagcucuguggc

SEQ ID NO: 2865218 - RNA, 15 nt, Human
caccugcuggaguga

SEQ ID NO: 2865219 - RNA, 14 nt, Human
caccugcucuucua

SEQ ID NO: 2865220 - RNA, 19 nt, Human
caccucuccuacucacuua

SEQ ID NO: 2865221 - RNA, 15 nt, Human
caccugcagggcugc

SEQ ID NO: 2865222 - RNA, 14 nt, Human
caccuggcuuguuu

SEQ ID NO: 2865223 - RNA, 16 nt, Human
caccuggcuuguuuau

SEQ ID NO: 2865224 - RNA, 21 nt, Human
caccuggcuuguuuauuuugu

SEQ ID NO: 2865225 - RNA, 22 nt, Human
caccuggcuuguuuauuuugug

SEQ ID NO: 2865226 - RNA, 23 nt, Human
caccuguacucaggaggcugagg

SEQ ID NO: 2865227 - RNA, 11 nt, Human
caccuguacag

SEQ ID NO: 2865228 - RNA, 12 nt, Human
caccuguacagu

SEQ ID NO: 2865229 - RNA, 18 nt, Human
caccuguacaguggaacc

SEQ ID NO: 2865230 - RNA, 15 nt, Human
caccuguacucagga

SEQ ID NO: 2865231 - RNA, 22 nt, Human
caccuguacucaggaggcugag

SEQ ID NO: 2865232 - RNA, 16 nt, Human
caccuguacucaggag

SEQ ID NO: 2865233 - RNA, 18 nt, Human
caccugucucagccuccc

SEQ ID NO: 2865234 - RNA, 17 nt, Human
caccugucucagccucc

SEQ ID NO: 2865235 - RNA, 15 nt, Human
caccugucucagccu

SEQ ID NO: 2865236 - RNA, 19 nt, Human
caccugucucagccuccca

SEQ ID NO: 2865237 - RNA, 18 nt, Human
caccuguaaucccagcac

SEQ ID NO: 2865238 - RNA, 20 nt, Human
caccuguaaucccagcacac

SEQ ID NO: 2865239 - RNA, 16 nt, Human
caccuguaaucccagc

SEQ ID NO: 2865240 - RNA, 17 nt, Human
caccuguaaucccagca

SEQ ID NO: 2865241 - RNA, 18 nt, Human
caccuguaaagugccuua

SEQ ID NO: 2865242 - RNA, 14 nt, Human
caccuguaagaaac

SEQ ID NO: 2865243 - RNA, 20 nt, Human
caccugguacucccucucag

SEQ ID NO: 2865244 - RNA, 16 nt, Human
caccugggcuuaagaa

SEQ ID NO: 2865245 - RNA, 19 nt, Human
caccugggcuuaagaaauc

SEQ ID NO: 2865246 - RNA, 18 nt, Human
caccugggucuuuaugca

SEQ ID NO: 2865247 - RNA, 14 nt, Human
caccuggggcugcu

SEQ ID NO: 2865248 - RNA, 15 nt, Human
caccuggggcugcug

SEQ ID NO: 2865249 - RNA, 18 nt, Human
cacccucaaccucuucug

SEQ ID NO: 2865250 - RNA, 16 nt, Human
cacccuaguuucccug

SEQ ID NO: 2865251 - RNA, 17 nt, Human
cacccuaguuucccuga

SEQ ID NO: 2865252 - RNA, 20 nt, Human
cacccuagucccuuccccuc

SEQ ID NO: 2865253 - RNA, 18 nt, Human
cacccuagucccuucccc

SEQ ID NO: 2865254 - RNA, 15 nt, Human
cacccucacucugcc

SEQ ID NO: 2865255 - RNA, 16 nt, Human
cacccucacucugcca

SEQ ID NO: 2865256 - RNA, 17 nt, Human
cacccucacucugccag

SEQ ID NO: 2865257 - RNA, 18 nt, Human
cacccucacucugccagg

SEQ ID NO: 2865258 - RNA, 19 nt, Human
cacccucacucugccaggg

SEQ ID NO: 2865259 - RNA, 21 nt, Human
cacccucacucugccagggca

SEQ ID NO: 2865260 - RNA, 22 nt, Human
cacccucacucugccagggcag

SEQ ID NO: 2865261 - RNA, 17 nt, Human
cacccugucuaaaaaac

SEQ ID NO: 2865262 - RNA, 17 nt, Human
cacccgugagcgccugu

SEQ ID NO: 2865263 - RNA, 18 nt, Human
cacccgugagcgccugug

SEQ ID NO: 2865264 - RNA, 23 nt, Human
cacccgugagcgccugugcacac

SEQ ID NO: 2865265 - RNA, 17 nt, Human
cacccuagucccuuccc

SEQ ID NO: 2865266 - RNA, 16 nt, Human
cacccuagucccuucc

SEQ ID NO: 2865267 - RNA, 16 nt, Human
cacccuaccugugccu

SEQ ID NO: 2865268 - RNA, 16 nt, Human
cacccuagcccucucc

SEQ ID NO: 2865269 - RNA, 21 nt, Human
cacccggccccugcugguuca

SEQ ID NO: 2865270 - RNA, 18 nt, Human
cacccggccccugcuggu

SEQ ID NO: 2865271 - RNA, 17 nt, Human
cacccggccccugcugg

SEQ ID NO: 2865272 - RNA, 16 nt, Human
cacccggccccugcug

SEQ ID NO: 2865273 - RNA, 14 nt, Human
cacccggccccugc

SEQ ID NO: 2865274 - RNA, 13 nt, Human
cacccggccccug

SEQ ID NO: 2865275 - RNA, 12 nt, Human
cacccggccccu

SEQ ID NO: 2865276 - RNA, 16 nt, Human
caccccucugcccuca

SEQ ID NO: 2865277 - RNA, 10 nt, Human
caccccugcu

SEQ ID NO: 2865278 - RNA, 13 nt, Human
caccccuccagga

SEQ ID NO: 2865279 - RNA, 17 nt, Human
caccccuaccccuggcu

SEQ ID NO: 2865280 - RNA, 18 nt, Human
caccccuaccccuggcug

SEQ ID NO: 2865281 - RNA, 24 nt, Human
caccccuaccccuggcuguacugc

SEQ ID NO: 2865282 - RNA, 15 nt, Human
caccccuaaagagau

SEQ ID NO: 2865283 - RNA, 12 nt, Human
caccccucacuc

SEQ ID NO: 2865284 - RNA, 17 nt, Human
caccccucacucuggcc

SEQ ID NO: 2865285 - RNA, 18 nt, Human
caccccucaguugugcag

SEQ ID NO: 2865286 - RNA, 22 nt, Human
caccccuccagaacacggcuca

SEQ ID NO: 2865287 - RNA, 12 nt, Human
caccccuuagau

SEQ ID NO: 2865288 - RNA, 17 nt, Human
caccccuguccucacug

SEQ ID NO: 2865289 - RNA, 18 nt, Human
caccccuguccucacugc

SEQ ID NO: 2865290 - RNA, 20 nt, Human
caccccuguccucacugcuc

SEQ ID NO: 2865291 - RNA, 21 nt, Human
caccccuguccucacugcucc

SEQ ID NO: 2865292 - RNA, 23 nt, Human
caccccuguccucacugcucccu

SEQ ID NO: 2865293 - RNA, 23 nt, Human
cacccuuccccuccuucucccuu

SEQ ID NO: 2865294 - RNA, 13 nt, Human
cacccuuccuucu

SEQ ID NO: 2865295 - RNA, 22 nt, Human
cacccuuccccuccuucucccu

SEQ ID NO: 2865296 - RNA, 14 nt, Human
cacccuuccccucc

SEQ ID NO: 2865297 - RNA, 13 nt, Human
cacccuuccccuc

SEQ ID NO: 2865298 - RNA, 14 nt, Human
cacccuuagaaaau

SEQ ID NO: 2865299 - RNA, 15 nt, Human
cacccuuagaaaaug

SEQ ID NO: 2865300 - RNA, 19 nt, Human
cacccuuagaaaauguguc

SEQ ID NO: 2865301 - RNA, 18 nt, Human
cacccuguuuggauuuuu

SEQ ID NO: 2865302 - RNA, 19 nt, Human
cacccuguuuggauuuuua

SEQ ID NO: 2865303 - RNA, 20 nt, Human
cacccuguuuggauuuuuaa

SEQ ID NO: 2865304 - RNA, 21 nt, Human
cacccuguuuggauuuuuaau

SEQ ID NO: 2865305 - RNA, 22 nt, Human
cacccuguuuggauuuuuaauu

SEQ ID NO: 2865306 - RNA, 17 nt, Human
cacccuuaacccaagga

SEQ ID NO: 2865307 - RNA, 18 nt, Human
cacccuuaacccaaggag

SEQ ID NO: 2865308 - RNA, 20 nt, Human
cacccuuaacccaaggagca

SEQ ID NO: 2865309 - RNA, 23 nt, Human
cacccuuaacccaaggagcacag

SEQ ID NO: 2865310 - RNA, 15 nt, Human
cacccuguggcccug

SEQ ID NO: 2865311 - RNA, 16 nt, Human
cacccuguggcccugg

SEQ ID NO: 2865312 - RNA, 17 nt, Human
cacccuguggcccuggc

SEQ ID NO: 2865313 - RNA, 20 nt, Human
cacccuguggcccuggcucu

SEQ ID NO: 2865314 - RNA, 18 nt, Human
cacccuuggccugucuca

SEQ ID NO: 2865315 - RNA, 15 nt, Human
cacccuuggccuguc

SEQ ID NO: 2865316 - RNA, 13 nt, Human
cacccuuggccug

SEQ ID NO: 2865317 - RNA, 12 nt, Human
cacccuuggccu

SEQ ID NO: 2865318 - RNA, 13 nt, Human
cacccuucuuuuc

SEQ ID NO: 2865319 - RNA, 14 nt, Human
cacccuucuuuucu

SEQ ID NO: 2865320 - RNA, 15 nt, Human
cacccuucuuuucuc

SEQ ID NO: 2865321 - RNA, 16 nt, Human
cacccuucuuuucuca

SEQ ID NO: 2865322 - RNA, 19 nt, Human
cacccuucuuuucucaugu

SEQ ID NO: 2865323 - RNA, 20 nt, Human
cacccuucuuuucucaugug

SEQ ID NO: 2865324 - RNA, 21 nt, Human
cacccuucuuuucucaugugu

SEQ ID NO: 2865325 - RNA, 19 nt, Human
cacccuuggacaagacaaa

SEQ ID NO: 2865326 - RNA, 23 nt, Human
cacccuuggccugucucaucccc

SEQ ID NO: 2865327 - RNA, 21 nt, Human
cacccuuggccugucucaucc

SEQ ID NO: 2865328 - RNA, 13 nt, Human
caccccucccucu

SEQ ID NO: 2865329 - RNA, 19 nt, Human
cacccuuucuugacaaaac

SEQ ID NO: 2865330 - RNA, 21 nt, Human
caccgaaguggacuggccccu

SEQ ID NO: 2865331 - RNA, 19 nt, Human
caccgacgcgucuccuguu

SEQ ID NO: 2865332 - RNA, 22 nt, Human
caccgaaguggacuggccccug

SEQ ID NO: 2865333 - RNA, 23 nt, Human
caccgaaguggacuggccccugg

SEQ ID NO: 2865334 - RNA, 17 nt, Human
caccgacgcgucuccug

SEQ ID NO: 2865335 - RNA, 18 nt, Human
caccgacgcgucuccugu

SEQ ID NO: 2865336 - RNA, 12 nt, Human
caccgagugggg

SEQ ID NO: 2865337 - RNA, 21 nt, Human
cagacacugaccauccacucu

SEQ ID NO: 2865338 - RNA, 11 nt, Human
cagacauaaag

SEQ ID NO: 2865339 - RNA, 12 nt, Human
cagacauaaagc

SEQ ID NO: 2865340 - RNA, 13 nt, Human
cagacauaaagcc

SEQ ID NO: 2865341 - RNA, 14 nt, Human
cagacauaaagcca

SEQ ID NO: 2865342 - RNA, 15 nt, Human
cagacauaaagccau

SEQ ID NO: 2865343 - RNA, 22 nt, Human
cagacauaaagccauguuuccu

SEQ ID NO: 2865344 - RNA, 12 nt, Human
cagacauguuuu

SEQ ID NO: 2865345 - RNA, 18 nt, Human
cagacauguuuuccguga

SEQ ID NO: 2865346 - RNA, 22 nt, Human
cagacauguuuuccgugaaaac

SEQ ID NO: 2865347 - RNA, 23 nt, Human
cagacaugguggcaugcaccugc

SEQ ID NO: 2865348 - RNA, 22 nt, Human
cagacauccauguuuguaaaac

SEQ ID NO: 2865349 - RNA, 23 nt, Human
cagacauccauguuuguaaaacu

SEQ ID NO: 2865350 - RNA, 15 nt, Human
cagacaucucugcac

SEQ ID NO: 2865351 - RNA, 17 nt, Human
cagacaucucugcaccc

SEQ ID NO: 2865352 - RNA, 19 nt, Human
cagacauccauguuuguaa

SEQ ID NO: 2865353 - RNA, 17 nt, Human
cagacauacgaaacaca

SEQ ID NO: 2865354 - RNA, 18 nt, Human
cagacauacgaaacacaa

SEQ ID NO: 2865355 - RNA, 19 nt, Human
cagacauacgaaacacaaa

SEQ ID NO: 2865356 - RNA, 13 nt, Human
cagacauauuuaa

SEQ ID NO: 2865357 - RNA, 14 nt, Human
cagacauauuuaac

SEQ ID NO: 2865358 - RNA, 15 nt, Human
cagacauauuuaacu

SEQ ID NO: 2865359 - RNA, 17 nt, Human
cagacauauuuaacugg

SEQ ID NO: 2865360 - RNA, 15 nt, Human
cagacaucaugaauu

SEQ ID NO: 2865361 - RNA, 18 nt, Human
cagacacgccuuccccuc

SEQ ID NO: 2865362 - RNA, 19 nt, Human
cagacacgccuuccccuca

SEQ ID NO: 2865363 - RNA, 22 nt, Human
cagacaccuugacagggcacac

SEQ ID NO: 2865364 - RNA, 20 nt, Human
cagacaccuugacagggcac

SEQ ID NO: 2865365 - RNA, 19 nt, Human
cagacaccuugacagggca

SEQ ID NO: 2865366 - RNA, 14 nt, Human
cagacacccucaac

SEQ ID NO: 2865367 - RNA, 15 nt, Human
cagacacccucaacc

SEQ ID NO: 2865368 - RNA, 21 nt, Human
cagacacccucaaccucuucu

SEQ ID NO: 2865369 - RNA, 23 nt, Human
cagacacaggcccggcuccaggc

SEQ ID NO: 2865370 - RNA, 22 nt, Human
cagacacaggcccggcuccagg

SEQ ID NO: 2865371 - RNA, 21 nt, Human
cagacacaggcccggcuccag

SEQ ID NO: 2865372 - RNA, 18 nt, Human
cagacacaggcccggcuc

SEQ ID NO: 2865373 - RNA, 17 nt, Human
cagacacaggcccggcu

SEQ ID NO: 2865374 - RNA, 15 nt, Human
cagacacaggcccgg

SEQ ID NO: 2865375 - RNA, 14 nt, Human
cagacacaggcccg

SEQ ID NO: 2865376 - RNA, 13 nt, Human
cagacacaggccc

SEQ ID NO: 2865377 - RNA, 13 nt, Human
cagaauugaucau

SEQ ID NO: 2865378 - RNA, 15 nt, Human
cagaauugaaacacu

SEQ ID NO: 2865379 - RNA, 16 nt, Human
cagaauugaaacacuu

SEQ ID NO: 2865380 - RNA, 17 nt, Human
cagaauugaaacacuuu

SEQ ID NO: 2865381 - RNA, 21 nt, Human
cagaauugaaacacuuuuuug

SEQ ID NO: 2865382 - RNA, 19 nt, Human
cagaauugugcaaauggaa

SEQ ID NO: 2865383 - RNA, 20 nt, Human
cagaauuaugauggaagaca

SEQ ID NO: 2865384 - RNA, 21 nt, Human
cagaauuaugauggaagacag

SEQ ID NO: 2865385 - RNA, 13 nt, Human
cagaauuauuuuu

SEQ ID NO: 2865386 - RNA, 15 nt, Human
cagaauuauuuuuaa

SEQ ID NO: 2865387 - RNA, 21 nt, Human
cagaauuauuuuuaaaaagaa

SEQ ID NO: 2865388 - RNA, 18 nt, Human
cagaaugcugcaggacuu

SEQ ID NO: 2865389 - RNA, 15 nt, Human
cagaaucucgcucug

SEQ ID NO: 2865390 - RNA, 13 nt, Human
cagaaucuuuguu

SEQ ID NO: 2865391 - RNA, 15 nt, Human
cagaaucuuuguuaa

SEQ ID NO: 2865392 - RNA, 16 nt, Human
cagaaucuuuguuaag

SEQ ID NO: 2865393 - RNA, 12 nt, Human
cagaaugaaaaa

SEQ ID NO: 2865394 - RNA, 13 nt, Human
cagaaugaaaaau

SEQ ID NO: 2865395 - RNA, 14 nt, Human
cagaaugaaaaaug

SEQ ID NO: 2865396 - RNA, 15 nt, Human
cagaaugaaaaauga

SEQ ID NO: 2865397 - RNA, 16 nt, Human
cagaaugaaaaaugaa

SEQ ID NO: 2865398 - RNA, 17 nt, Human
cagaaugaaaaaugaaa

SEQ ID NO: 2865399 - RNA, 18 nt, Human
cagaaugaaaaaugaaag

SEQ ID NO: 2865400 - RNA, 19 nt, Human
cagaaugaaaaaugaaaga

SEQ ID NO: 2865401 - RNA, 21 nt, Human
cagaaugaaaaaugaaagaug

SEQ ID NO: 2865402 - RNA, 22 nt, Human
cagaaugaaaaaugaaagauga

SEQ ID NO: 2865403 - RNA, 23 nt, Human
cagaaugaaaaaugaaagaugau

SEQ ID NO: 2865404 - RNA, 19 nt, Human
cagaauggugaucacucca

SEQ ID NO: 2865405 - RNA, 21 nt, Human
cagaaugcuguacaucuauuu

SEQ ID NO: 2865406 - RNA, 18 nt, Human
cagaaugcuguacaucua

SEQ ID NO: 2865407 - RNA, 17 nt, Human
cagaaugcuguacaucu

SEQ ID NO: 2865408 - RNA, 16 nt, Human
cagaaugcuguacauc

SEQ ID NO: 2865409 - RNA, 11 nt, Human
cagaaugcugu

SEQ ID NO: 2865410 - RNA, 12 nt, Human
cagaauguaucu

SEQ ID NO: 2865411 - RNA, 13 nt, Human
cagaauguaucug

SEQ ID NO: 2865412 - RNA, 14 nt, Human
cagaauguaucugu

SEQ ID NO: 2865413 - RNA, 17 nt, Human
cagaauguaucugugaa

SEQ ID NO: 2865414 - RNA, 18 nt, Human
cagaauguaucugugaag

SEQ ID NO: 2865415 - RNA, 16 nt, Human
cagaauguuuuacugu

SEQ ID NO: 2865416 - RNA, 20 nt, Human
cagaauguuuuacugugaaa

SEQ ID NO: 2865417 - RNA, 17 nt, Human
cagaauguuuuuaaaau

SEQ ID NO: 2865418 - RNA, 15 nt, Human
cagaauuuuaggaac

SEQ ID NO: 2865419 - RNA, 21 nt, Human
cagaauuuuaggaacuucaga

SEQ ID NO: 2865420 - RNA, 23 nt, Human
cagaauuuuaggaacuucagaga

SEQ ID NO: 2865421 - RNA, 16 nt, Human
cagaauuuggaaaucc

SEQ ID NO: 2865422 - RNA, 22 nt, Human
cagaauuuggaaauccuaguuu

SEQ ID NO: 2865423 - RNA, 16 nt, Human
cagaauuuuggaagau

SEQ ID NO: 2865424 - RNA, 15 nt, Human
cagaauuuuuuuugu

SEQ ID NO: 2865425 - RNA, 18 nt, Human
cagaauuuuuuuuguugu

SEQ ID NO: 2865426 - RNA, 19 nt, Human
cagaauuuuuuuuguuguu

SEQ ID NO: 2865427 - RNA, 16 nt, Human
cagacaacagaaguca

SEQ ID NO: 2865428 - RNA, 15 nt, Human
cagacaacagaaguc

SEQ ID NO: 2865429 - RNA, 14 nt, Human
cagacaacagaagu

SEQ ID NO: 2865430 - RNA, 13 nt, Human
cagacaacagaag

SEQ ID NO: 2865431 - RNA, 22 nt, Human
cagacaaaugugguuacacacu

SEQ ID NO: 2865432 - RNA, 16 nt, Human
cagacaauacguuuga

SEQ ID NO: 2865433 - RNA, 17 nt, Human
cagacaauaugugagug

SEQ ID NO: 2865434 - RNA, 22 nt, Human
cagacaauaugugagugccuuu

SEQ ID NO: 2865435 - RNA, 21 nt, Human
cagacaagugacuguaucugu

SEQ ID NO: 2865436 - RNA, 21 nt, Human
cagacaaaguaauuccucuca

SEQ ID NO: 2865437 - RNA, 22 nt, Human
cagacaacagaagucaugaagc

SEQ ID NO: 2865438 - RNA, 17 nt, Human
cagacaacagaagucau

SEQ ID NO: 2865439 - RNA, 12 nt, Human
cagacacacaca

SEQ ID NO: 2865440 - RNA, 14 nt, Human
cagacacacacaca

SEQ ID NO: 2865441 - RNA, 11 nt, Human
cagacacacac

SEQ ID NO: 2865442 - RNA, 17 nt, Human
cagacaaggaaauaccc

SEQ ID NO: 2865443 - RNA, 13 nt, Human
cagacacacacac

SEQ ID NO: 2865444 - RNA, 14 nt, Human
cagacacacacacg

SEQ ID NO: 2865445 - RNA, 15 nt, Human
cagacacacacacgc

SEQ ID NO: 2865446 - RNA, 16 nt, Human
cagacacacacacgca

SEQ ID NO: 2865447 - RNA, 17 nt, Human
cagacacacacacgcac

SEQ ID NO: 2865448 - RNA, 18 nt, Human
cagacacacacacgcacg

SEQ ID NO: 2865449 - RNA, 21 nt, Human
cagacacacacacgcacgcac

SEQ ID NO: 2865450 - RNA, 22 nt, Human
cagacacacacacgcacgcaca

SEQ ID NO: 2865451 - RNA, 14 nt, Human
cagacuacacagga

SEQ ID NO: 2865452 - RNA, 16 nt, Human
cagacuacacaggaug

SEQ ID NO: 2865453 - RNA, 15 nt, Human
cagacuacuauuuuc

SEQ ID NO: 2865454 - RNA, 16 nt, Human
cagacuacuauuuucu

SEQ ID NO: 2865455 - RNA, 19 nt, Human
cagacuacuauuuucuuuu

SEQ ID NO: 2865456 - RNA, 20 nt, Human
cagacuacuauuuucuuuuu

SEQ ID NO: 2865457 - RNA, 22 nt, Human
cagacucaaaugcucagaccag

SEQ ID NO: 2865458 - RNA, 23 nt, Human
cagacucaaaugcucagaccagc

SEQ ID NO: 2865459 - RNA, 13 nt, Human
cagaccugcuuuu

SEQ ID NO: 2865460 - RNA, 20 nt, Human
cagaccugcuuuuugaaaug

SEQ ID NO: 2865461 - RNA, 21 nt, Human
cagaccugcuuuuugaaauga

SEQ ID NO: 2865462 - RNA, 23 nt, Human
cagaccugcuuuuugaaaugaaa

SEQ ID NO: 2865463 - RNA, 23 nt, Human
cagaccuccccagccccuagccc

SEQ ID NO: 2865464 - RNA, 12 nt, Human
cagaccucugga

SEQ ID NO: 2865465 - RNA, 13 nt, Human
cagaccucuggau

SEQ ID NO: 2865466 - RNA, 12 nt, Human
cagaccucccca

SEQ ID NO: 2865467 - RNA, 14 nt, Human
cagaccuccccagc

SEQ ID NO: 2865468 - RNA, 15 nt, Human
cagaccuccccagcc

SEQ ID NO: 2865469 - RNA, 16 nt, Human
cagaccuccccagccc

SEQ ID NO: 2865470 - RNA, 18 nt, Human
cagaccuccccagccccu

SEQ ID NO: 2865471 - RNA, 19 nt, Human
cagaccuccccagccccua

SEQ ID NO: 2865472 - RNA, 21 nt, Human
cagaccuccccagccccuagc

SEQ ID NO: 2865473 - RNA, 22 nt, Human
cagaccuccccagccccuagcc

SEQ ID NO: 2865474 - RNA, 23 nt, Human
cagacgccggggacagaggccug

SEQ ID NO: 2865475 - RNA, 13 nt, Human
cagaccuuuuauc

SEQ ID NO: 2865476 - RNA, 21 nt, Human
cagaccuucuaggacgccacc

SEQ ID NO: 2865477 - RNA, 23 nt, Human
cagagaaaguacuucuccacccu

SEQ ID NO: 2865478 - RNA, 19 nt, Human
cagagaaaguacuucucca

SEQ ID NO: 2865479 - RNA, 17 nt, Human
cagagaaaggcaaggga

SEQ ID NO: 2865480 - RNA, 15 nt, Human
cagagaaagggacaa

SEQ ID NO: 2865481 - RNA, 18 nt, Human
cagagaaagaggaagcuu

SEQ ID NO: 2865482 - RNA, 13 nt, Human
cagagaaagagga

SEQ ID NO: 2865483 - RNA, 15 nt, Human
cagagaaagaggaag

SEQ ID NO: 2865484 - RNA, 17 nt, Human
cagagaaagaggaagcu

SEQ ID NO: 2865485 - RNA, 15 nt, Human
cagacuuuuguacau

SEQ ID NO: 2865486 - RNA, 16 nt, Human
cagacuuuuguacauc

SEQ ID NO: 2865487 - RNA, 20 nt, Human
cagacuuuuuuuaaauagua

SEQ ID NO: 2865488 - RNA, 14 nt, Human
cagacuuggcucag

SEQ ID NO: 2865489 - RNA, 21 nt, Human
cagacuaggauaauguccaac

SEQ ID NO: 2865490 - RNA, 13 nt, Human
cagacuugucaag

SEQ ID NO: 2865491 - RNA, 24 nt, Human
cagacuuccuugagacacggagcc

SEQ ID NO: 2865492 - RNA, 18 nt, Human
cagacuugccaugugacu

SEQ ID NO: 2865493 - RNA, 19 nt, Human
cagacuugccaugugacuc

SEQ ID NO: 2865494 - RNA, 20 nt, Human
cagacuugccaugugacucu

SEQ ID NO: 2865495 - RNA, 21 nt, Human
cagacuugccaugugacucug

SEQ ID NO: 2865496 - RNA, 15 nt, Human
cagacuuccuugaga

SEQ ID NO: 2865497 - RNA, 21 nt, Human
cagacuucccugaauguauug

SEQ ID NO: 2865498 - RNA, 13 nt, Human
cagacucauccug

SEQ ID NO: 2865499 - RNA, 18 nt, Human
cagacucauccugaacag

SEQ ID NO: 2865500 - RNA, 19 nt, Human
cagacucauccugaacagc

SEQ ID NO: 2865501 - RNA, 20 nt, Human
cagacucauccugaacagca

SEQ ID NO: 2865502 - RNA, 22 nt, Human
cagacucauccugaacagcaug

SEQ ID NO: 2865503 - RNA, 21 nt, Human
cagaccaacguuacucagggc

SEQ ID NO: 2865504 - RNA, 23 nt, Human
cagaccaacguuacucagggcuc

SEQ ID NO: 2865505 - RNA, 22 nt, Human
cagaccaccccgccugcccuca

SEQ ID NO: 2865506 - RNA, 15 nt, Human
cagaccaccccgccu

SEQ ID NO: 2865507 - RNA, 19 nt, Human
cagaccaccccgccugccc

SEQ ID NO: 2865508 - RNA, 20 nt, Human
cagaccacaucuuuaucugu

SEQ ID NO: 2865509 - RNA, 13 nt, Human
cagaccaccccgc

SEQ ID NO: 2865510 - RNA, 13 nt, Human
cagaccagcucuu

SEQ ID NO: 2865511 - RNA, 13 nt, Human
cagaccccuggcu

SEQ ID NO: 2865512 - RNA, 14 nt, Human
cagaccccuggcuu

SEQ ID NO: 2865513 - RNA, 15 nt, Human
cagaccccuggcuuu

SEQ ID NO: 2865514 - RNA, 16 nt, Human
cagaccccuggcuuuu

SEQ ID NO: 2865515 - RNA, 18 nt, Human
cagaccccuggcuuuuca

SEQ ID NO: 2865516 - RNA, 13 nt, Human
cagaccccaggcu

SEQ ID NO: 2865517 - RNA, 14 nt, Human
cagacccggcugcg

SEQ ID NO: 2865518 - RNA, 12 nt, Human
cagacccggcug

SEQ ID NO: 2865519 - RNA, 23 nt, Human
cagaccccuggcuuuucacugcu

SEQ ID NO: 2865520 - RNA, 21 nt, Human
cagaccccuggcuuuucacug

SEQ ID NO: 2865521 - RNA, 22 nt, Human
cagaccccuggcuuuucacugc

SEQ ID NO: 2865522 - RNA, 16 nt, Human
cagacccggcugcgug

SEQ ID NO: 2865523 - RNA, 20 nt, Human
cagaagcacugggaucacag

SEQ ID NO: 2865524 - RNA, 14 nt, Human
cagaagaaaauucu

SEQ ID NO: 2865525 - RNA, 22 nt, Human
cagaagcaagggggugauguag

SEQ ID NO: 2865526 - RNA, 23 nt, Human
cagaagauccccucaggacugca

SEQ ID NO: 2865527 - RNA, 13 nt, Human
cagaagccucugg

SEQ ID NO: 2865528 - RNA, 23 nt, Human
cagaagcccugauguguccucag

SEQ ID NO: 2865529 - RNA, 23 nt, Human
cagaagcaguugagucgucauca

SEQ ID NO: 2865530 - RNA, 13 nt, Human
cagaagcauuugu

SEQ ID NO: 2865531 - RNA, 14 nt, Human
cagaagcauuugua

SEQ ID NO: 2865532 - RNA, 15 nt, Human
cagaagcauuuguau

SEQ ID NO: 2865533 - RNA, 17 nt, Human
cagaagcauuuguauuu

SEQ ID NO: 2865534 - RNA, 19 nt, Human
cagaagcauuuguauuuug

SEQ ID NO: 2865535 - RNA, 20 nt, Human
cagaagcauuuguauuuugu

SEQ ID NO: 2865536 - RNA, 21 nt, Human
cagaagcauuuguauuuugug

SEQ ID NO: 2865537 - RNA, 22 nt, Human
cagaagcauuuguauuuugugu

SEQ ID NO: 2865538 - RNA, 21 nt, Human
cagaagacacugaugggcaac

SEQ ID NO: 2865539 - RNA, 18 nt, Human
cagaagacaaaaagacaa

SEQ ID NO: 2865540 - RNA, 14 nt, Human
cagaagacaccaga

SEQ ID NO: 2865541 - RNA, 15 nt, Human
cagaagacaccagag

SEQ ID NO: 2865542 - RNA, 16 nt, Human
cagaagacaccagagc

SEQ ID NO: 2865543 - RNA, 17 nt, Human
cagaagacaccagagca

SEQ ID NO: 2865544 - RNA, 18 nt, Human
cagaagacaccagagcag

SEQ ID NO: 2865545 - RNA, 19 nt, Human
cagaagacaccagagcaga

SEQ ID NO: 2865546 - RNA, 20 nt, Human
cagaagauagcuucacccca

SEQ ID NO: 2865547 - RNA, 15 nt, Human
cagaagauccccuca

SEQ ID NO: 2865548 - RNA, 18 nt, Human
cagaagauccccucagga

SEQ ID NO: 2865549 - RNA, 19 nt, Human
cagaagauccccucaggac

SEQ ID NO: 2865550 - RNA, 23 nt, Human
cagaagaggguguguuugaaauc

SEQ ID NO: 2865551 - RNA, 20 nt, Human
cagaagaguugugcacgcag

SEQ ID NO: 2865552 - RNA, 16 nt, Human
cagaagagaggggaag

SEQ ID NO: 2865553 - RNA, 20 nt, Human
cagaagacaccagagcagau

SEQ ID NO: 2865554 - RNA, 21 nt, Human
cagaagacaccagagcagaug

SEQ ID NO: 2865555 - RNA, 21 nt, Human
cagaagaccacaaaaauugac

SEQ ID NO: 2865556 - RNA, 16 nt, Human
cagaagaccccugacu

SEQ ID NO: 2865557 - RNA, 16 nt, Human
cagaacuugaaugugu

SEQ ID NO: 2865558 - RNA, 14 nt, Human
cagaagaagagaag

SEQ ID NO: 2865559 - RNA, 17 nt, Human
cagaagaagagaagcug

SEQ ID NO: 2865560 - RNA, 18 nt, Human
cagaagaagagaagcugc

SEQ ID NO: 2865561 - RNA, 19 nt, Human
cagaagaagagaagcugcu

SEQ ID NO: 2865562 - RNA, 20 nt, Human
cagaagaagagaagcugcug

SEQ ID NO: 2865563 - RNA, 21 nt, Human
cagaagaagagaagcugcuga

SEQ ID NO: 2865564 - RNA, 23 nt, Human
cagaagaagagaagcugcugacc

SEQ ID NO: 2865565 - RNA, 15 nt, Human
cagaagaaaggaaca

SEQ ID NO: 2865566 - RNA, 16 nt, Human
cagaagaaaggaacau

SEQ ID NO: 2865567 - RNA, 12 nt, Human
cagaacuaaaug

SEQ ID NO: 2865568 - RNA, 14 nt, Human
cagaacuaaauguu

SEQ ID NO: 2865569 - RNA, 17 nt, Human
cagaacuaaauguucua

SEQ ID NO: 2865570 - RNA, 18 nt, Human
cagaacuaaauguucuau

SEQ ID NO: 2865571 - RNA, 21 nt, Human
cagaacggagccccaggccuc

SEQ ID NO: 2865572 - RNA, 21 nt, Human
cagaaccucuuccccagaaag

SEQ ID NO: 2865573 - RNA, 22 nt, Human
cagaacccuuggagccaaugga

SEQ ID NO: 2865574 - RNA, 23 nt, Human
cagaaccccuacaugaaacagaa

SEQ ID NO: 2865575 - RNA, 15 nt, Human
cagaaccauccauag

SEQ ID NO: 2865576 - RNA, 12 nt, Human
cagaacccaggg

SEQ ID NO: 2865577 - RNA, 13 nt, Human
cagaacccagggc

SEQ ID NO: 2865578 - RNA, 14 nt, Human
cagaacccagggcu

SEQ ID NO: 2865579 - RNA, 15 nt, Human
cagaacccagggcuc

SEQ ID NO: 2865580 - RNA, 18 nt, Human
cagaacccagggcucugc

SEQ ID NO: 2865581 - RNA, 19 nt, Human
cagaacccagggcucugcc

SEQ ID NO: 2865582 - RNA, 20 nt, Human
cagaacccagggcucugccc

SEQ ID NO: 2865583 - RNA, 21 nt, Human
cagaacccagggcucugcccc

SEQ ID NO: 2865584 - RNA, 22 nt, Human
cagaacccagggcucugcccca

SEQ ID NO: 2865585 - RNA, 18 nt, Human
cagaaccucuuccccaga

SEQ ID NO: 2865586 - RNA, 16 nt, Human
cagaaccucuucccca

SEQ ID NO: 2865587 - RNA, 15 nt, Human
cagaaccucuucccc

SEQ ID NO: 2865588 - RNA, 14 nt, Human
cagaaccucuuccc

SEQ ID NO: 2865589 - RNA, 12 nt, Human
cagaaccucuuc

SEQ ID NO: 2865590 - RNA, 19 nt, Human
cagaacccuuggcuugccc

SEQ ID NO: 2865591 - RNA, 14 nt, Human
cagaacccuuggcu

SEQ ID NO: 2865592 - RNA, 15 nt, Human
cagaacucacugggg

SEQ ID NO: 2865593 - RNA, 18 nt, Human
cagaacucacuggggccu

SEQ ID NO: 2865594 - RNA, 17 nt, Human
cagaacucuuaaaaaug

SEQ ID NO: 2865595 - RNA, 19 nt, Human
cagaacucuuaaaaauguu

SEQ ID NO: 2865596 - RNA, 20 nt, Human
cagaacucuuaaaaauguuu

SEQ ID NO: 2865597 - RNA, 15 nt, Human
cagaacuugaaugug

SEQ ID NO: 2865598 - RNA, 14 nt, Human
cagaacuucccuga

SEQ ID NO: 2865599 - RNA, 15 nt, Human
cagaacuucccugau

SEQ ID NO: 2865600 - RNA, 11 nt, Human
cagaacugcca

SEQ ID NO: 2865601 - RNA, 12 nt, Human
cagaacugccau

SEQ ID NO: 2865602 - RNA, 14 nt, Human
cagaacugccauua

SEQ ID NO: 2865603 - RNA, 19 nt, Human
cagaacugccauuauuuuc

SEQ ID NO: 2865604 - RNA, 20 nt, Human
cagaacugccauuauuuucu

SEQ ID NO: 2865605 - RNA, 21 nt, Human
cagaacugccauuauuuucug

SEQ ID NO: 2865606 - RNA, 22 nt, Human
cagaacugccauuauuuucugu

SEQ ID NO: 2865607 - RNA, 17 nt, Human
cagaaucuaaagccagu

SEQ ID NO: 2865608 - RNA, 15 nt, Human
cagaaucuaaagcca

SEQ ID NO: 2865609 - RNA, 16 nt, Human
cagaaucuaaagccag

SEQ ID NO: 2865610 - RNA, 17 nt, Human
cagaagucaugaagccc

SEQ ID NO: 2865611 - RNA, 16 nt, Human
cagaagucaugaagcc

SEQ ID NO: 2865612 - RNA, 22 nt, Human
cagaaggugccacuuuacccac

SEQ ID NO: 2865613 - RNA, 23 nt, Human
cagaagguugcucuagauugaga

SEQ ID NO: 2865614 - RNA, 12 nt, Human
cagaagggagca

SEQ ID NO: 2865615 - RNA, 13 nt, Human
cagaagggagcag

SEQ ID NO: 2865616 - RNA, 15 nt, Human
cagaagccucuggcu

SEQ ID NO: 2865617 - RNA, 14 nt, Human
cagaagccucuggc

SEQ ID NO: 2865618 - RNA, 19 nt, Human
cagaagccucuggcuagag

SEQ ID NO: 2865619 - RNA, 16 nt, Human
cagaagccucuggguc

SEQ ID NO: 2865620 - RNA, 15 nt, Human
cagaagccugaggcu

SEQ ID NO: 2865621 - RNA, 14 nt, Human
cagaagccugaggc

SEQ ID NO: 2865622 - RNA, 19 nt, Human
cagaagccugaggcuggga

SEQ ID NO: 2865623 - RNA, 16 nt, Human
cagaagcuucugccca

SEQ ID NO: 2865624 - RNA, 14 nt, Human
cagaagcuucagaa

SEQ ID NO: 2865625 - RNA, 17 nt, Human
cagaaggaugaaugagg

SEQ ID NO: 2865626 - RNA, 18 nt, Human
cagaaggauuuuuuaaag

SEQ ID NO: 2865627 - RNA, 20 nt, Human
cagaaggauuuuuuaaaguu

SEQ ID NO: 2865628 - RNA, 24 nt, Human
cagaaagaaguggggacagagcag

SEQ ID NO: 2865629 - RNA, 19 nt, Human
cagaaacuguucccaccug

SEQ ID NO: 2865630 - RNA, 17 nt, Human
cagaaacgcauccagca

SEQ ID NO: 2865631 - RNA, 21 nt, Human
cagaaaccuauccucacugcc

SEQ ID NO: 2865632 - RNA, 22 nt, Human
cagaaaccuauccucacugccc

SEQ ID NO: 2865633 - RNA, 14 nt, Human
cagaaacacugccu

SEQ ID NO: 2865634 - RNA, 13 nt, Human
cagaaacacugcc

SEQ ID NO: 2865635 - RNA, 12 nt, Human
cagaaacacugc

SEQ ID NO: 2865636 - RNA, 19 nt, Human
cagaaacacugccuuuuua

SEQ ID NO: 2865637 - RNA, 18 nt, Human
cagaaacacugccuuuuu

SEQ ID NO: 2865638 - RNA, 17 nt, Human
cagaaacacugccuuuu

SEQ ID NO: 2865639 - RNA, 15 nt, Human
cagaaacacugccuu

SEQ ID NO: 2865640 - RNA, 21 nt, Human
cagaaacacugccuuuuuauu

SEQ ID NO: 2865641 - RNA, 12 nt, Human
cagaaacuagaa

SEQ ID NO: 2865642 - RNA, 20 nt, Human
cagaaccaccccggcccccu

SEQ ID NO: 2865643 - RNA, 16 nt, Human
cagaacaucauuagaa

SEQ ID NO: 2865644 - RNA, 15 nt, Human
cagaacaucauuaga

SEQ ID NO: 2865645 - RNA, 17 nt, Human
cagaacaucauuagaac

SEQ ID NO: 2865646 - RNA, 18 nt, Human
cagaacaucauuagaaca

SEQ ID NO: 2865647 - RNA, 21 nt, Human
cagaacaucgcgaugggaacc

SEQ ID NO: 2865648 - RNA, 16 nt, Human
cagaaccaaagcucaa

SEQ ID NO: 2865649 - RNA, 18 nt, Human
cagaaagcugugaacagg

SEQ ID NO: 2865650 - RNA, 17 nt, Human
cagaaaagggaaguugu

SEQ ID NO: 2865651 - RNA, 18 nt, Human
cagaaaagggaaguugug

SEQ ID NO: 2865652 - RNA, 15 nt, Human
cagaaaacuuuaaaa

SEQ ID NO: 2865653 - RNA, 20 nt, Human
cagaaaacuuuaaaaaauau

SEQ ID NO: 2865654 - RNA, 12 nt, Human
cagaaaagcaua

SEQ ID NO: 2865655 - RNA, 16 nt, Human
cagaaaacgggaagcg

SEQ ID NO: 2865656 - RNA, 19 nt, Human
cagaaaauauuauguguuu

SEQ ID NO: 2865657 - RNA, 14 nt, Human
cagaaaauguugag

SEQ ID NO: 2865658 - RNA, 23 nt, Human
cagaaaauguugagaaucccaaa

SEQ ID NO: 2865659 - RNA, 18 nt, Human
cagaaaauguugagaauc

SEQ ID NO: 2865660 - RNA, 20 nt, Human
cagaaacaaaaacacuaaaa

SEQ ID NO: 2865661 - RNA, 18 nt, Human
cagaaacaaaaacacuaa

SEQ ID NO: 2865662 - RNA, 16 nt, Human
cagaaaauugcacaau

SEQ ID NO: 2865663 - RNA, 15 nt, Human
cacuuggucugccag

SEQ ID NO: 2865664 - RNA, 16 nt, Human
cacuuggucugccagg

SEQ ID NO: 2865665 - RNA, 18 nt, Human
cacuuggucugccaggcc

SEQ ID NO: 2865666 - RNA, 13 nt, Human
cacuuugauguca

SEQ ID NO: 2865667 - RNA, 20 nt, Human
cacuuugaugucauguguuc

SEQ ID NO: 2865668 - RNA, 23 nt, Human
cacuuugaugucauguguucccu

SEQ ID NO: 2865669 - RNA, 11 nt, Human
cacuuucucuu

SEQ ID NO: 2865670 - RNA, 22 nt, Human
cacuuucucuucuuguuucucc

SEQ ID NO: 2865671 - RNA, 12 nt, Human
cacuuugaaaua

SEQ ID NO: 2865672 - RNA, 15 nt, Human
cacuuugaaauaccu

SEQ ID NO: 2865673 - RNA, 16 nt, Human
cacuuugaaauaccuc

SEQ ID NO: 2865674 - RNA, 18 nt, Human
cacuuugaaauaccucau

SEQ ID NO: 2865675 - RNA, 21 nt, Human
cacuuugaaauaccucauguu

SEQ ID NO: 2865676 - RNA, 22 nt, Human
cacuuugaaauaccucauguuu

SEQ ID NO: 2865677 - RNA, 23 nt, Human
cacuuugcauaugagccgugaac

SEQ ID NO: 2865678 - RNA, 13 nt, Human
cacuuugccuccu

SEQ ID NO: 2865679 - RNA, 16 nt, Human
cacuuugccuccugug

SEQ ID NO: 2865680 - RNA, 17 nt, Human
cacuuugccuccugugu

SEQ ID NO: 2865681 - RNA, 14 nt, Human
cacuuugcacagcu

SEQ ID NO: 2865682 - RNA, 17 nt, Human
cacuuugcacagcucuc

SEQ ID NO: 2865683 - RNA, 13 nt, Human
cacuuugcacauu

SEQ ID NO: 2865684 - RNA, 14 nt, Human
cacuuugcacauuu

SEQ ID NO: 2865685 - RNA, 15 nt, Human
cacuuugcacauuuu

SEQ ID NO: 2865686 - RNA, 18 nt, Human
cacuuugcacauuuugau

SEQ ID NO: 2865687 - RNA, 19 nt, Human
cacuuugcacgacgcccuc

SEQ ID NO: 2865688 - RNA, 20 nt, Human
cacuuugcacgacgcccucu

SEQ ID NO: 2865689 - RNA, 21 nt, Human
cacuuugcacgacgcccucuc

SEQ ID NO: 2865690 - RNA, 23 nt, Human
cacuuugcacgacgcccucuccc

SEQ ID NO: 2865691 - RNA, 23 nt, Human
cacuuugggaggccaaggagggc

SEQ ID NO: 2865692 - RNA, 20 nt, Human
cacuuugguacauggccagu

SEQ ID NO: 2865693 - RNA, 19 nt, Human
cacuuugguacauggccag

SEQ ID NO: 2865694 - RNA, 12 nt, Human
cacuuuugcaag

SEQ ID NO: 2865695 - RNA, 21 nt, Human
cacuuuugcaagguuccacag

SEQ ID NO: 2865696 - RNA, 16 nt, Human
cacuuuuccucccuca

SEQ ID NO: 2865697 - RNA, 19 nt, Human
cacuuuuuauuagauaacg

SEQ ID NO: 2865698 - RNA, 16 nt, Human
cacuuuuaugagcuuc

SEQ ID NO: 2865699 - RNA, 20 nt, Human
cacuuugucgcccaggcugg

SEQ ID NO: 2865700 - RNA, 12 nt, Human
cacuuuguaaau

SEQ ID NO: 2865701 - RNA, 13 nt, Human
cacuuuguaaauu

SEQ ID NO: 2865702 - RNA, 13 nt, Human
cacuuuucaguga

SEQ ID NO: 2865703 - RNA, 12 nt, Human
cacuuuucaccu

SEQ ID NO: 2865704 - RNA, 18 nt, Human
cacuuuucaccuccuuca

SEQ ID NO: 2865705 - RNA, 18 nt, Human
cacuuuuauuuagcacca

SEQ ID NO: 2865706 - RNA, 17 nt, Human
cagaaaaaggcugugcu

SEQ ID NO: 2865707 - RNA, 21 nt, Human
cagaaaaauaacuucaagcaa

SEQ ID NO: 2865708 - RNA, 13 nt, Human
cagaaaaauggag

SEQ ID NO: 2865709 - RNA, 18 nt, Human
cagaaaaauggagcaaag

SEQ ID NO: 2865710 - RNA, 20 nt, Human
cagaaaaauggagcaaagug

SEQ ID NO: 2865711 - RNA, 14 nt, Human
cagaaaaccccagc

SEQ ID NO: 2865712 - RNA, 22 nt, Human
cacuuuuuuggggguaaaaaau

SEQ ID NO: 2865713 - RNA, 20 nt, Human
cagaaaaaaugucuguaaau

SEQ ID NO: 2865714 - RNA, 19 nt, Human
cagaaaaaaugucuguaaa

SEQ ID NO: 2865715 - RNA, 13 nt, Human
cacuuuuugaacu

SEQ ID NO: 2865716 - RNA, 16 nt, Human
cacuuuuugaacuaag

SEQ ID NO: 2865717 - RNA, 19 nt, Human
cacuuuuugaacuaagaaa

SEQ ID NO: 2865718 - RNA, 18 nt, Human
cagauaaucagccucuua

SEQ ID NO: 2865719 - RNA, 17 nt, Human
cagauaaucagccucuu

SEQ ID NO: 2865720 - RNA, 16 nt, Human
cagauaaucagccucu

SEQ ID NO: 2865721 - RNA, 15 nt, Human
cagauaaucagccuc

SEQ ID NO: 2865722 - RNA, 14 nt, Human
cagauaaucagugu

SEQ ID NO: 2865723 - RNA, 19 nt, Human
cagauaaucagccucuuaa

SEQ ID NO: 2865724 - RNA, 13 nt, Human
cagauacaaugua

SEQ ID NO: 2865725 - RNA, 14 nt, Human
cagauacaauguau

SEQ ID NO: 2865726 - RNA, 20 nt, Human
cagauaagacauaucucuaa

SEQ ID NO: 2865727 - RNA, 20 nt, Human
cagauaacugaggaggggag

SEQ ID NO: 2865728 - RNA, 17 nt, Human
cagauaaccagcuguaa

SEQ ID NO: 2865729 - RNA, 13 nt, Human
cagauaacugagg

SEQ ID NO: 2865730 - RNA, 17 nt, Human
cagauaacaaugcagca

SEQ ID NO: 2865731 - RNA, 20 nt, Human
cagauaacaaugcagcaagg

SEQ ID NO: 2865732 - RNA, 22 nt, Human
cagauaacaaugcagcaaggcc

SEQ ID NO: 2865733 - RNA, 16 nt, Human
cagauaacauaccuuu

SEQ ID NO: 2865734 - RNA, 15 nt, Human
cagauaacauuugug

SEQ ID NO: 2865735 - RNA, 14 nt, Human
cagauaacugagga

SEQ ID NO: 2865736 - RNA, 17 nt, Human
cagaguuuguguguugu

SEQ ID NO: 2865737 - RNA, 19 nt, Human
cagaguuuguguguugucu

SEQ ID NO: 2865738 - RNA, 22 nt, Human
cagaguuuguguguugucuuga

SEQ ID NO: 2865739 - RNA, 16 nt, Human
cagaguuugccuuccu

SEQ ID NO: 2865740 - RNA, 17 nt, Human
cagaguuugccuuccuu

SEQ ID NO: 2865741 - RNA, 19 nt, Human
cagaguuugccuuccuuuc

SEQ ID NO: 2865742 - RNA, 20 nt, Human
cagaguuugccuuccuuucu

SEQ ID NO: 2865743 - RNA, 22 nt, Human
cagaguuugccuuccuuucucc

SEQ ID NO: 2865744 - RNA, 13 nt, Human
cagaguuuggaua

SEQ ID NO: 2865745 - RNA, 17 nt, Human
cagaguguagccagguc

SEQ ID NO: 2865746 - RNA, 19 nt, Human
cagaguguagccagguccc

SEQ ID NO: 2865747 - RNA, 18 nt, Human
cagaguguggacucuggu

SEQ ID NO: 2865748 - RNA, 16 nt, Human
cagaguuccccaugca

SEQ ID NO: 2865749 - RNA, 18 nt, Human
cagaguuccccaugcaga

SEQ ID NO: 2865750 - RNA, 24 nt, Human
cagaguuccccaugcagacaugag

SEQ ID NO: 2865751 - RNA, 20 nt, Human
cagaguucuauacuguaaag

SEQ ID NO: 2865752 - RNA, 21 nt, Human
cagaguucuauacuguaaagc

SEQ ID NO: 2865753 - RNA, 20 nt, Human
cagaguugacaugagauuua

SEQ ID NO: 2865754 - RNA, 13 nt, Human
cagauccuuguuu

SEQ ID NO: 2865755 - RNA, 23 nt, Human
cagauccuggguacugaaagccu

SEQ ID NO: 2865756 - RNA, 17 nt, Human
cagauacaauguauuua

SEQ ID NO: 2865757 - RNA, 14 nt, Human
cagauacacacaca

SEQ ID NO: 2865758 - RNA, 14 nt, Human
cagauccuuguuuc

SEQ ID NO: 2865759 - RNA, 15 nt, Human
cagauccuuguuuca

SEQ ID NO: 2865760 - RNA, 16 nt, Human
cagauccuuguuucaa

SEQ ID NO: 2865761 - RNA, 18 nt, Human
cagauccuuguuucaaac

SEQ ID NO: 2865762 - RNA, 19 nt, Human
cagauccuuguuucaaaca

SEQ ID NO: 2865763 - RNA, 22 nt, Human
cagauacaggaaaagcugcuga

SEQ ID NO: 2865764 - RNA, 21 nt, Human
cagauacaggaaaagcugcug

SEQ ID NO: 2865765 - RNA, 20 nt, Human
cagauacaggaaaagcugcu

SEQ ID NO: 2865766 - RNA, 15 nt, Human
cagaucugugcccca

SEQ ID NO: 2865767 - RNA, 14 nt, Human
cagaucugugcccc

SEQ ID NO: 2865768 - RNA, 13 nt, Human
cagaucugugccc

SEQ ID NO: 2865769 - RNA, 12 nt, Human
cagaucugugcc

SEQ ID NO: 2865770 - RNA, 13 nt, Human
cagaucugucuga

SEQ ID NO: 2865771 - RNA, 18 nt, Human
cagaucuggucccuugca

SEQ ID NO: 2865772 - RNA, 17 nt, Human
cagaucuggucccuugc

SEQ ID NO: 2865773 - RNA, 14 nt, Human
cagaugcaaugacu

SEQ ID NO: 2865774 - RNA, 13 nt, Human
cagaugcaccagc

SEQ ID NO: 2865775 - RNA, 16 nt, Human
cagaugcaccagcccu

SEQ ID NO: 2865776 - RNA, 14 nt, Human
cagaugcaccagcc

SEQ ID NO: 2865777 - RNA, 22 nt, Human
cagaugcaccagcccuuagcag

SEQ ID NO: 2865778 - RNA, 17 nt, Human
cagaugcaccagcccuu

SEQ ID NO: 2865779 - RNA, 20 nt, Human
cagaugcagagagccauuuu

SEQ ID NO: 2865780 - RNA, 16 nt, Human
cagaugcagagagcca

SEQ ID NO: 2865781 - RNA, 18 nt, Human
cagaugcagagagccauu

SEQ ID NO: 2865782 - RNA, 15 nt, Human
cagaugaauguauuu

SEQ ID NO: 2865783 - RNA, 19 nt, Human
cagaugaauguauuuauuu

SEQ ID NO: 2865784 - RNA, 23 nt, Human
cagaugaauguauuuauuuggga

SEQ ID NO: 2865785 - RNA, 18 nt, Human
cagaucuuucuccuugaa

SEQ ID NO: 2865786 - RNA, 14 nt, Human
cagaugaaaauuug

SEQ ID NO: 2865787 - RNA, 15 nt, Human
cagaugaaaauuuga

SEQ ID NO: 2865788 - RNA, 17 nt, Human
cagaugaaaauuugaga

SEQ ID NO: 2865789 - RNA, 12 nt, Human
cagaugaauaaa

SEQ ID NO: 2865790 - RNA, 13 nt, Human
cagaugaauaaac

SEQ ID NO: 2865791 - RNA, 14 nt, Human
cagaugaauaaacu

SEQ ID NO: 2865792 - RNA, 20 nt, Human
cagaugaacucuuagaaaug

SEQ ID NO: 2865793 - RNA, 23 nt, Human
cagaucugugccccaugccuguc

SEQ ID NO: 2865794 - RNA, 21 nt, Human
cagaucugugccccaugccug

SEQ ID NO: 2865795 - RNA, 20 nt, Human
cagaucugugccccaugccu

SEQ ID NO: 2865796 - RNA, 18 nt, Human
cagaucugugccccaugc

SEQ ID NO: 2865797 - RNA, 18 nt, Human
cagaucugucugauagga

SEQ ID NO: 2865798 - RNA, 15 nt, Human
cagaucuuggacuca

SEQ ID NO: 2865799 - RNA, 14 nt, Human
cagaucuuggacuc

SEQ ID NO: 2865800 - RNA, 22 nt, Human
cagaucuuggacucaugaggag

SEQ ID NO: 2865801 - RNA, 20 nt, Human
cagaucuuggacucaugagg

SEQ ID NO: 2865802 - RNA, 19 nt, Human
cagaucuuggacucaugag

SEQ ID NO: 2865803 - RNA, 18 nt, Human
cagaucuuggacucauga

SEQ ID NO: 2865804 - RNA, 18 nt, Human
cagaugaucaacucuucg

SEQ ID NO: 2865805 - RNA, 14 nt, Human
cagaugauccauga

SEQ ID NO: 2865806 - RNA, 19 nt, Human
cagaugaugagaauuucua

SEQ ID NO: 2865807 - RNA, 22 nt, Human
cagaugaugagaauuucuaaaa

SEQ ID NO: 2865808 - RNA, 16 nt, Human
cagaugacaagauggu

SEQ ID NO: 2865809 - RNA, 14 nt, Human
cagaugagaacaaa

SEQ ID NO: 2865810 - RNA, 15 nt, Human
cagaugagaacaaag

SEQ ID NO: 2865811 - RNA, 16 nt, Human
cagaugagaacaaagc

SEQ ID NO: 2865812 - RNA, 17 nt, Human
cagaugagaacaaagcu

SEQ ID NO: 2865813 - RNA, 18 nt, Human
cagaugagaacaaagcug

SEQ ID NO: 2865814 - RNA, 19 nt, Human
cagaugagaacaaagcugu

SEQ ID NO: 2865815 - RNA, 21 nt, Human
cagaugagaacaaagcuguua

SEQ ID NO: 2865816 - RNA, 18 nt, Human
cagagugagacucugucu

SEQ ID NO: 2865817 - RNA, 17 nt, Human
cagagugagacucuguc

SEQ ID NO: 2865818 - RNA, 16 nt, Human
cagagugagacucugu

SEQ ID NO: 2865819 - RNA, 19 nt, Human
cagagugagacccugucuc

SEQ ID NO: 2865820 - RNA, 15 nt, Human
cagagugagacccug

SEQ ID NO: 2865821 - RNA, 23 nt, Human
cagagucucacuguugcccaggc

SEQ ID NO: 2865822 - RNA, 22 nt, Human
cagagucucacuguugcccagg

SEQ ID NO: 2865823 - RNA, 23 nt, Human
cagagucucgcucuguugcccag

SEQ ID NO: 2865824 - RNA, 20 nt, Human
cagagugagacucugucuca

SEQ ID NO: 2865825 - RNA, 19 nt, Human
cagagugagacucugucuc

SEQ ID NO: 2865826 - RNA, 23 nt, Human
cagagugcaagccccugcuccag

SEQ ID NO: 2865827 - RNA, 15 nt, Human
cagagugcacagcug

SEQ ID NO: 2865828 - RNA, 16 nt, Human
cagagugcacagcugu

SEQ ID NO: 2865829 - RNA, 17 nt, Human
cagagugcacagcuguc

SEQ ID NO: 2865830 - RNA, 18 nt, Human
cagagugcaagccccugc

SEQ ID NO: 2865831 - RNA, 20 nt, Human
cagagugagacccugucucu

SEQ ID NO: 2865832 - RNA, 20 nt, Human
cagagugcaagccccugcuc

SEQ ID NO: 2865833 - RNA, 15 nt, Human
cagagugcuuuucug

SEQ ID NO: 2865834 - RNA, 13 nt, Human
cagaguggccugg

SEQ ID NO: 2865835 - RNA, 12 nt, Human
cagaguggccug

SEQ ID NO: 2865836 - RNA, 23 nt, Human
cagaguggccuggccaggagcuc

SEQ ID NO: 2865837 - RNA, 22 nt, Human
cagaguggccuggccaggagcu

SEQ ID NO: 2865838 - RNA, 21 nt, Human
cagaguggccuggccaggagc

SEQ ID NO: 2865839 - RNA, 18 nt, Human
cagaguggccuggccagg

SEQ ID NO: 2865840 - RNA, 17 nt, Human
cagaguggccuggccag

SEQ ID NO: 2865841 - RNA, 16 nt, Human
cagaguggccuggcca

SEQ ID NO: 2865842 - RNA, 15 nt, Human
cagaguggccuggcc

SEQ ID NO: 2865843 - RNA, 23 nt, Human
cagagggagugacagaggcagcc

SEQ ID NO: 2865844 - RNA, 22 nt, Human
cagagggagugacagaggcagc

SEQ ID NO: 2865845 - RNA, 21 nt, Human
cagagggagugacagaggcag

SEQ ID NO: 2865846 - RNA, 20 nt, Human
cagagggagugacagaggca

SEQ ID NO: 2865847 - RNA, 18 nt, Human
cagagggcccaggcaggc

SEQ ID NO: 2865848 - RNA, 16 nt, Human
cagagggcccaggcag

SEQ ID NO: 2865849 - RNA, 15 nt, Human
cagagggcccaggca

SEQ ID NO: 2865850 - RNA, 13 nt, Human
cagagggcccagg

SEQ ID NO: 2865851 - RNA, 21 nt, Human
cagagucucacuguugcccag

SEQ ID NO: 2865852 - RNA, 20 nt, Human
cagagucucacuguugccca

SEQ ID NO: 2865853 - RNA, 19 nt, Human
cagagucucacuguugccc

SEQ ID NO: 2865854 - RNA, 17 nt, Human
cagagucucacuguugc

SEQ ID NO: 2865855 - RNA, 13 nt, Human
cagagucucacug

SEQ ID NO: 2865856 - RNA, 14 nt, Human
cagaguccuuucca

SEQ ID NO: 2865857 - RNA, 15 nt, Human
cagaguccuuuccaa

SEQ ID NO: 2865858 - RNA, 15 nt, Human
cagagcauuuaagag

SEQ ID NO: 2865859 - RNA, 16 nt, Human
cagaguccuuaaaaug

SEQ ID NO: 2865860 - RNA, 22 nt, Human
cagagggcccaggcaggccacc

SEQ ID NO: 2865861 - RNA, 20 nt, Human
cagaggcuauuauuuucacu

SEQ ID NO: 2865862 - RNA, 15 nt, Human
cagaggcgucccgca

SEQ ID NO: 2865863 - RNA, 19 nt, Human
cagaggcgucccgcaccug

SEQ ID NO: 2865864 - RNA, 22 nt, Human
cagaggcgucccgcaccugucu

SEQ ID NO: 2865865 - RNA, 13 nt, Human
cagaggccugccc

SEQ ID NO: 2865866 - RNA, 14 nt, Human
cagaggccugcccg

SEQ ID NO: 2865867 - RNA, 19 nt, Human
cagagggagugacagaggc

SEQ ID NO: 2865868 - RNA, 18 nt, Human
cagagggagugacagagg

SEQ ID NO: 2865869 - RNA, 16 nt, Human
cagagggagugacaga

SEQ ID NO: 2865870 - RNA, 14 nt, Human
cagagggagugaca

SEQ ID NO: 2865871 - RNA, 22 nt, Human
cagaggcugaguuuucucuuug

SEQ ID NO: 2865872 - RNA, 22 nt, Human
cagaggcagccccauucugccu

SEQ ID NO: 2865873 - RNA, 20 nt, Human
cagaggcagccccauucugc

SEQ ID NO: 2865874 - RNA, 19 nt, Human
cagaggcagccccauucug

SEQ ID NO: 2865875 - RNA, 18 nt, Human
cagaggcagccccauucu

SEQ ID NO: 2865876 - RNA, 15 nt, Human
cagaggcagccccau

SEQ ID NO: 2865877 - RNA, 14 nt, Human
cagaggcagcccca

SEQ ID NO: 2865878 - RNA, 13 nt, Human
cagaggcagcccc

SEQ ID NO: 2865879 - RNA, 12 nt, Human
cagaggcagccc

SEQ ID NO: 2865880 - RNA, 16 nt, Human
cagaggccaugggccu

SEQ ID NO: 2865881 - RNA, 19 nt, Human
cagaggccaugggccuccu

SEQ ID NO: 2865882 - RNA, 23 nt, Human
cagaggcagccccauucugccug

SEQ ID NO: 2865883 - RNA, 21 nt, Human
cagaggccaugggccuccugu

SEQ ID NO: 2865884 - RNA, 20 nt, Human
cagaggccaugggccuccug

SEQ ID NO: 2865885 - RNA, 14 nt, Human
cagaggccaacacu

SEQ ID NO: 2865886 - RNA, 17 nt, Human
cagaggccaacacugug

SEQ ID NO: 2865887 - RNA, 18 nt, Human
cagaggccaacacugugg

SEQ ID NO: 2865888 - RNA, 14 nt, Human
cagaggccauggca

SEQ ID NO: 2865889 - RNA, 14 nt, Human
cagagcccccagga

SEQ ID NO: 2865890 - RNA, 18 nt, Human
cagagcccccaggaagcc

SEQ ID NO: 2865891 - RNA, 16 nt, Human
cagagccccuacagca

SEQ ID NO: 2865892 - RNA, 21 nt, Human
cagagccccuacagcauuguu

SEQ ID NO: 2865893 - RNA, 12 nt, Human
cagagccugcag

SEQ ID NO: 2865894 - RNA, 19 nt, Human
cagagccucccaaggagaa

SEQ ID NO: 2865895 - RNA, 23 nt, Human
cagagccucccaaggagaacaaa

SEQ ID NO: 2865896 - RNA, 14 nt, Human
cagagccucgcucu

SEQ ID NO: 2865897 - RNA, 16 nt, Human
cagagccucgcucugu

SEQ ID NO: 2865898 - RNA, 17 nt, Human
cagaggaacuguccaga

SEQ ID NO: 2865899 - RNA, 19 nt, Human
cagaggaacuguccagaga

SEQ ID NO: 2865900 - RNA, 14 nt, Human
cagaggaaaucugu

SEQ ID NO: 2865901 - RNA, 18 nt, Human
cagaggaaaucuguaaca

SEQ ID NO: 2865902 - RNA, 13 nt, Human
cagagccugcagu

SEQ ID NO: 2865903 - RNA, 22 nt, Human
cagaggaacuguccagagagca

SEQ ID NO: 2865904 - RNA, 20 nt, Human
cagaggaacuguccagagag

SEQ ID NO: 2865905 - RNA, 21 nt, Human
cagaggaacuguccagagagc

SEQ ID NO: 2865906 - RNA, 14 nt, Human
cagaggagccuuuu

SEQ ID NO: 2865907 - RNA, 22 nt, Human
cagaggagccuuuuuaaaacac

SEQ ID NO: 2865908 - RNA, 15 nt, Human
cagaggagccuuuuu

SEQ ID NO: 2865909 - RNA, 21 nt, Human
cagaggaggcagaauaagaaa

SEQ ID NO: 2865910 - RNA, 20 nt, Human
cagaggagagauagccugug

SEQ ID NO: 2865911 - RNA, 21 nt, Human
cagaggagagauagccugugg

SEQ ID NO: 2865912 - RNA, 22 nt, Human
cagaggagagauagccuguggc

SEQ ID NO: 2865913 - RNA, 23 nt, Human
cagaggagagauagccuguggcc

SEQ ID NO: 2865914 - RNA, 11 nt, Human
cagaggcagcc

SEQ ID NO: 2865915 - RNA, 23 nt, Human
cagaggaugagcucuacccaggg

SEQ ID NO: 2865916 - RNA, 21 nt, Human
cagaggaguacaggugaagca

SEQ ID NO: 2865917 - RNA, 17 nt, Human
cagaggaguacagguga

SEQ ID NO: 2865918 - RNA, 21 nt, Human
cagaggaugagcucuacccag

SEQ ID NO: 2865919 - RNA, 19 nt, Human
cagaggaugagcucuaccc

SEQ ID NO: 2865920 - RNA, 17 nt, Human
cagaggaugagcucuac

SEQ ID NO: 2865921 - RNA, 15 nt, Human
cagaggaugagcucu

SEQ ID NO: 2865922 - RNA, 14 nt, Human
cagaggaccuguau

SEQ ID NO: 2865923 - RNA, 17 nt, Human
cagaggaccuguauuua

SEQ ID NO: 2865924 - RNA, 20 nt, Human
cagaggaccuguauuuaagc

SEQ ID NO: 2865925 - RNA, 21 nt, Human
cagaggaccuguauuuaagca

SEQ ID NO: 2865926 - RNA, 22 nt, Human
cagaggaccuguauuuaagcaa

SEQ ID NO: 2865927 - RNA, 23 nt, Human
cagaggaauccuggcagcccaga

SEQ ID NO: 2865928 - RNA, 17 nt, Human
cagaggaauuuauaccu

SEQ ID NO: 2865929 - RNA, 18 nt, Human
cagaggaauuuauaccuc

SEQ ID NO: 2865930 - RNA, 22 nt, Human
cagaggaauccuggcagcccag

SEQ ID NO: 2865931 - RNA, 21 nt, Human
cagaggaauccuggcagccca

SEQ ID NO: 2865932 - RNA, 20 nt, Human
cagaggaauccuggcagccc

SEQ ID NO: 2865933 - RNA, 19 nt, Human
cagaggaauccuggcagcc

SEQ ID NO: 2865934 - RNA, 18 nt, Human
cagaggaauccuggcagc

SEQ ID NO: 2865935 - RNA, 17 nt, Human
cagaggaauccuggcag

SEQ ID NO: 2865936 - RNA, 16 nt, Human
cagaggaauccuggca

SEQ ID NO: 2865937 - RNA, 20 nt, Human
cagagcccaccuuggcucaa

SEQ ID NO: 2865938 - RNA, 19 nt, Human
cagagcccaccuuggcuca

SEQ ID NO: 2865939 - RNA, 17 nt, Human
cagagcccaccuuggcu

SEQ ID NO: 2865940 - RNA, 15 nt, Human
cagagcccaccuugg

SEQ ID NO: 2865941 - RNA, 17 nt, Human
cagagccaugcugggaa

SEQ ID NO: 2865942 - RNA, 15 nt, Human
cagagcaggggcagg

SEQ ID NO: 2865943 - RNA, 14 nt, Human
cagagcaggggcag

SEQ ID NO: 2865944 - RNA, 13 nt, Human
cagagcaggcaau

SEQ ID NO: 2865945 - RNA, 21 nt, Human
cagagcaggaagcauucagag

SEQ ID NO: 2865946 - RNA, 12 nt, Human
cagagcaggacc

SEQ ID NO: 2865947 - RNA, 13 nt, Human
cagagcaggaccu

SEQ ID NO: 2865948 - RNA, 14 nt, Human
cagagcaggaccuc

SEQ ID NO: 2865949 - RNA, 15 nt, Human
cagagcaggaccucc

SEQ ID NO: 2865950 - RNA, 16 nt, Human
cagagcaggaccuccc

SEQ ID NO: 2865951 - RNA, 18 nt, Human
cagagcaggaccucccuu

SEQ ID NO: 2865952 - RNA, 19 nt, Human
cagagcaggaccucccuuc

SEQ ID NO: 2865953 - RNA, 22 nt, Human
cagagcaggaccucccuuccga

SEQ ID NO: 2865954 - RNA, 22 nt, Human
cagagccaccccuaaagagaua

SEQ ID NO: 2865955 - RNA, 21 nt, Human
cagagcauuuccaacaccaca

SEQ ID NO: 2865956 - RNA, 13 nt, Human
cagagccacacau

SEQ ID NO: 2865957 - RNA, 14 nt, Human
cagagccacacaug

SEQ ID NO: 2865958 - RNA, 15 nt, Human
cagagccacacaugg

SEQ ID NO: 2865959 - RNA, 17 nt, Human
cagagccacacaugggc

SEQ ID NO: 2865960 - RNA, 13 nt, Human
cagagcagaugca

SEQ ID NO: 2865961 - RNA, 14 nt, Human
cagagcagaugcag

SEQ ID NO: 2865962 - RNA, 15 nt, Human
cagagcagaugcaga

SEQ ID NO: 2865963 - RNA, 16 nt, Human
cagagcagaugcagag

SEQ ID NO: 2865964 - RNA, 19 nt, Human
cagagcagaugcagagagc

SEQ ID NO: 2865965 - RNA, 20 nt, Human
cagagcagaugcagagagcc

SEQ ID NO: 2865966 - RNA, 21 nt, Human
cagagcagaugcagagagcca

SEQ ID NO: 2865967 - RNA, 20 nt, Human
cagagcaccuuugcacagga

SEQ ID NO: 2865968 - RNA, 22 nt, Human
cagagcaccuuugcacaggaug

SEQ ID NO: 2865969 - RNA, 23 nt, Human
cagagcaccuuugcacaggaugc

SEQ ID NO: 2865970 - RNA, 21 nt, Human
cagagcacuagguucaauucc

SEQ ID NO: 2865971 - RNA, 22 nt, Human
cagagcacuagguucaauuccc

SEQ ID NO: 2865972 - RNA, 20 nt, Human
cagagaccguccucaccccu

SEQ ID NO: 2865973 - RNA, 17 nt, Human
cagagaccucccuguuc

SEQ ID NO: 2865974 - RNA, 18 nt, Human
cagagaccuccugccucc

SEQ ID NO: 2865975 - RNA, 15 nt, Human
cagagaccugaagug

SEQ ID NO: 2865976 - RNA, 19 nt, Human
cagagacccucugccacca

SEQ ID NO: 2865977 - RNA, 20 nt, Human
cagagacccucugccaccag

SEQ ID NO: 2865978 - RNA, 13 nt, Human
cagagaccguccu

SEQ ID NO: 2865979 - RNA, 16 nt, Human
cagagaccguccucac

SEQ ID NO: 2865980 - RNA, 17 nt, Human
cagagaccguccucacc

SEQ ID NO: 2865981 - RNA, 18 nt, Human
cagagaccguccucaccc

SEQ ID NO: 2865982 - RNA, 19 nt, Human
cagagaccguccucacccc

SEQ ID NO: 2865983 - RNA, 15 nt, Human
cagagacccucugcc

SEQ ID NO: 2865984 - RNA, 18 nt, Human
cagagcacagcagccccu

SEQ ID NO: 2865985 - RNA, 22 nt, Human
cagagauuggaaugggcagcuc

SEQ ID NO: 2865986 - RNA, 23 nt, Human
cagagauuggaaugggcagcuca

SEQ ID NO: 2865987 - RNA, 16 nt, Human
cagagaugugcaccca

SEQ ID NO: 2865988 - RNA, 21 nt, Human
cagagauuggaaugggcagcu

SEQ ID NO: 2865989 - RNA, 17 nt, Human
cagagauugaacuccaa

SEQ ID NO: 2865990 - RNA, 19 nt, Human
cagagauugaacuccaaga

SEQ ID NO: 2865991 - RNA, 15 nt, Human
cagagauugcuucuc

SEQ ID NO: 2865992 - RNA, 16 nt, Human
cagagauugcuucuca

SEQ ID NO: 2865993 - RNA, 16 nt, Human
cagagcaaaauaauuu

SEQ ID NO: 2865994 - RNA, 14 nt, Human
cagagcaaaauaau

SEQ ID NO: 2865995 - RNA, 19 nt, Human
cagagauuuauauaaaugu

SEQ ID NO: 2865996 - RNA, 20 nt, Human
cagagcaagauccugucuuu

SEQ ID NO: 2865997 - RNA, 18 nt, Human
cagagcaagauccugucu

SEQ ID NO: 2865998 - RNA, 15 nt, Human
cagagcaaccucuca

SEQ ID NO: 2865999 - RNA, 16 nt, Human
cagagcaacgaccagg

SEQ ID NO: 2866000 - RNA, 22 nt, Human
cagagcaacgaccagggccgag

SEQ ID NO: 2866001 - RNA, 14 nt, Human
cagagaugugcacc

SEQ ID NO: 2866002 - RNA, 18 nt, Human
cagagaugucaucagagc

SEQ ID NO: 2866003 - RNA, 23 nt, Human
cagagaugucaucagagcuccuc

SEQ ID NO: 2866004 - RNA, 16 nt, Human
cagagauucccaagcc

SEQ ID NO: 2866005 - RNA, 22 nt, Human
cagagauaguggggagacuucu

SEQ ID NO: 2866006 - RNA, 15 nt, Human
cagagaguggcuccu

SEQ ID NO: 2866007 - RNA, 18 nt, Human
cagagaguggcuccuccc

SEQ ID NO: 2866008 - RNA, 13 nt, Human
cagagaguggcuc

SEQ ID NO: 2866009 - RNA, 14 nt, Human
cagagaguggcucc

SEQ ID NO: 2866010 - RNA, 16 nt, Human
cagagaccuccugccu

SEQ ID NO: 2866011 - RNA, 15 nt, Human
cagagaguccugugc

SEQ ID NO: 2866012 - RNA, 21 nt, Human
cagagaaugaaagggcccaga

SEQ ID NO: 2866013 - RNA, 20 nt, Human
cagagaaugaaagggcccag

SEQ ID NO: 2866014 - RNA, 14 nt, Human
cagagaauucuuag

SEQ ID NO: 2866015 - RNA, 19 nt, Human
cagagaaucauacuuagca

SEQ ID NO: 2866016 - RNA, 19 nt, Human
cagagaauauaacaugaaa

SEQ ID NO: 2866017 - RNA, 22 nt, Human
cagagaauauaacaugaaauga

SEQ ID NO: 2866018 - RNA, 18 nt, Human
cagagaauaucaagauga

SEQ ID NO: 2866019 - RNA, 16 nt, Human
cagagaauaugucugc

SEQ ID NO: 2866020 - RNA, 20 nt, Human
cagagaauaugucugcuccu

SEQ ID NO: 2866021 - RNA, 19 nt, Human
cagagaaugaaagggccca

SEQ ID NO: 2866022 - RNA, 11 nt, Human
cagagaagggc

SEQ ID NO: 2866023 - RNA, 18 nt, Human
cagagaagggcauaaaac

SEQ ID NO: 2866024 - RNA, 22 nt, Human
cagagaagggcauaaaacagcu

SEQ ID NO: 2866025 - RNA, 20 nt, Human
cagagaagggcuccugcagg

SEQ ID NO: 2866026 - RNA, 21 nt, Human
cagagaagggcuccugcaggc

SEQ ID NO: 2866027 - RNA, 13 nt, Human
cagagaagcuggg

SEQ ID NO: 2866028 - RNA, 15 nt, Human
cagagaagcugggga

SEQ ID NO: 2866029 - RNA, 21 nt, Human
cagagaagcuggggaggagcu

SEQ ID NO: 2866030 - RNA, 19 nt, Human
cagagaagcggauuuccag

SEQ ID NO: 2866031 - RNA, 11 nt, Human
cagagaacagc

SEQ ID NO: 2866032 - RNA, 24 nt, Human
cagagaacagcgaaguagcuugcu

SEQ ID NO: 2866033 - RNA, 20 nt, Human
cagagacaaaauauuuccca

SEQ ID NO: 2866034 - RNA, 12 nt, Human
cagagacaaaau

SEQ ID NO: 2866035 - RNA, 23 nt, Human
cagagaauuucuaccauuucaga

SEQ ID NO: 2866036 - RNA, 22 nt, Human
cagagaauuucuaccauuucag

SEQ ID NO: 2866037 - RNA, 16 nt, Human
cagagaauuucuacca

SEQ ID NO: 2866038 - RNA, 15 nt, Human
cagagaauuucuacc

SEQ ID NO: 2866039 - RNA, 13 nt, Human
cagagaauuucua

SEQ ID NO: 2866040 - RNA, 15 nt, Human
cagagaccaggcccu

SEQ ID NO: 2866041 - RNA, 16 nt, Human
cagagaccaggcccug

SEQ ID NO: 2866042 - RNA, 22 nt, Human
cagagaccaggcccuggcuaag

SEQ ID NO: 2866043 - RNA, 15 nt, Human
cagagaccaggcugu

SEQ ID NO: 2866044 - RNA, 16 nt, Human
cagagaccaggcugug

SEQ ID NO: 2866045 - RNA, 18 nt, Human
cagagaccaggcuguguc

SEQ ID NO: 2866046 - RNA, 14 nt, Human
cagagacagcugau

SEQ ID NO: 2866047 - RNA, 21 nt, Human
cagagacagcugauacuucau

SEQ ID NO: 2866048 - RNA, 15 nt, Human
caggaaguacuucca

SEQ ID NO: 2866049 - RNA, 19 nt, Human
caggaaguacuuccaccuc

SEQ ID NO: 2866050 - RNA, 18 nt, Human
caggaaucaaaaauugaa

SEQ ID NO: 2866051 - RNA, 19 nt, Human
caggaauauugucauccuu

SEQ ID NO: 2866052 - RNA, 16 nt, Human
caggaaucaagagcug

SEQ ID NO: 2866053 - RNA, 17 nt, Human
caggaaucaagagcugc

SEQ ID NO: 2866054 - RNA, 18 nt, Human
caggaaucaagagcugcc

SEQ ID NO: 2866055 - RNA, 23 nt, Human
caggaaucaagagcugcccuccu

SEQ ID NO: 2866056 - RNA, 19 nt, Human
caggaaggcugagaggaga

SEQ ID NO: 2866057 - RNA, 23 nt, Human
caggaaggaggagccgaccggga

SEQ ID NO: 2866058 - RNA, 12 nt, Human
caggaaggccug

SEQ ID NO: 2866059 - RNA, 13 nt, Human
caggaaggccugg

SEQ ID NO: 2866060 - RNA, 14 nt, Human
caggaaggccuggg

SEQ ID NO: 2866061 - RNA, 15 nt, Human
caggaaggccugggu

SEQ ID NO: 2866062 - RNA, 18 nt, Human
caggaaggccugggugga

SEQ ID NO: 2866063 - RNA, 18 nt, Human
caggaaggagagccugcu

SEQ ID NO: 2866064 - RNA, 17 nt, Human
caggaaggagagccugc

SEQ ID NO: 2866065 - RNA, 21 nt, Human
caggaagggcaggaaggagag

SEQ ID NO: 2866066 - RNA, 19 nt, Human
caggaauguguggccugca

SEQ ID NO: 2866067 - RNA, 21 nt, Human
caggaauguguggccugcaca

SEQ ID NO: 2866068 - RNA, 23 nt, Human
caggaauguguggccugcacagu

SEQ ID NO: 2866069 - RNA, 16 nt, Human
caggaauguguggccu

SEQ ID NO: 2866070 - RNA, 17 nt, Human
caggaauguguggccug

SEQ ID NO: 2866071 - RNA, 14 nt, Human
caggaaugaucucu

SEQ ID NO: 2866072 - RNA, 15 nt, Human
caggaauuugggacc

SEQ ID NO: 2866073 - RNA, 18 nt, Human
caggaauuugggacccug

SEQ ID NO: 2866074 - RNA, 19 nt, Human
caggaauuugggacccugc

SEQ ID NO: 2866075 - RNA, 20 nt, Human
caggaauuugggacccugcu

SEQ ID NO: 2866076 - RNA, 21 nt, Human
caggaauuugggacccugcuu

SEQ ID NO: 2866077 - RNA, 22 nt, Human
caggaauuugggacccugcuuu

SEQ ID NO: 2866078 - RNA, 23 nt, Human
caggaauuugggacccugcuuua

SEQ ID NO: 2866079 - RNA, 13 nt, Human
caggaccugccug

SEQ ID NO: 2866080 - RNA, 21 nt, Human
caggaccucugaaacccugga

SEQ ID NO: 2866081 - RNA, 14 nt, Human
caggacaccacacc

SEQ ID NO: 2866082 - RNA, 17 nt, Human
caggacaccacacccag

SEQ ID NO: 2866083 - RNA, 19 nt, Human
caggacaccacacccagcc

SEQ ID NO: 2866084 - RNA, 20 nt, Human
caggacaccacacccagccu

SEQ ID NO: 2866085 - RNA, 21 nt, Human
caggacaccacacccagccuc

SEQ ID NO: 2866086 - RNA, 21 nt, Human
caggaagucccuugccauccu

SEQ ID NO: 2866087 - RNA, 19 nt, Human
caggaccugccuguagccc

SEQ ID NO: 2866088 - RNA, 15 nt, Human
caggaccugccugua

SEQ ID NO: 2866089 - RNA, 14 nt, Human
caggaccugccugu

SEQ ID NO: 2866090 - RNA, 13 nt, Human
caggaccuuuuga

SEQ ID NO: 2866091 - RNA, 20 nt, Human
caggaccuuuugaaguaguu

SEQ ID NO: 2866092 - RNA, 14 nt, Human
caggaaggaaguca

SEQ ID NO: 2866093 - RNA, 12 nt, Human
caggaaggagag

SEQ ID NO: 2866094 - RNA, 16 nt, Human
caggaaggagagccug

SEQ ID NO: 2866095 - RNA, 15 nt, Human
caggaaggagagccu

SEQ ID NO: 2866096 - RNA, 14 nt, Human
caggaaggagagcc

SEQ ID NO: 2866097 - RNA, 13 nt, Human
caggaaggagagc

SEQ ID NO: 2866098 - RNA, 21 nt, Human
caggaagccugcaguccugga

SEQ ID NO: 2866099 - RNA, 13 nt, Human
caggaagccugca

SEQ ID NO: 2866100 - RNA, 19 nt, Human
caggaagccugcaguccug

SEQ ID NO: 2866101 - RNA, 22 nt, Human
caggaagcauucagagagcagc

SEQ ID NO: 2866102 - RNA, 18 nt, Human
caggaagcauucagagag

SEQ ID NO: 2866103 - RNA, 19 nt, Human
caggaagcauucagagagc

SEQ ID NO: 2866104 - RNA, 20 nt, Human
caggaagcauucagagagca

SEQ ID NO: 2866105 - RNA, 15 nt, Human
caggaagcaccccau

SEQ ID NO: 2866106 - RNA, 14 nt, Human
caggaagcacccca

SEQ ID NO: 2866107 - RNA, 17 nt, Human
caggaagcaccccaugc

SEQ ID NO: 2866108 - RNA, 16 nt, Human
caggaagcaccccaug

SEQ ID NO: 2866109 - RNA, 14 nt, Human
caggaagcagcuuu

SEQ ID NO: 2866110 - RNA, 15 nt, Human
caggaacuauaaaaa

SEQ ID NO: 2866111 - RNA, 17 nt, Human
caggaacuauaaaaaca

SEQ ID NO: 2866112 - RNA, 19 nt, Human
caggaacuagacugccugg

SEQ ID NO: 2866113 - RNA, 21 nt, Human
caggaaccuguccuaaggaac

SEQ ID NO: 2866114 - RNA, 13 nt, Human
caggaacugggcc

SEQ ID NO: 2866115 - RNA, 12 nt, Human
caggaacugggc

SEQ ID NO: 2866116 - RNA, 21 nt, Human
cagcuucucauccugcaggca

SEQ ID NO: 2866117 - RNA, 19 nt, Human
cagcuucucauccugcagg

SEQ ID NO: 2866118 - RNA, 20 nt, Human
cagcuucucauccugcaggc

SEQ ID NO: 2866119 - RNA, 18 nt, Human
cagcuucucauccugcag

SEQ ID NO: 2866120 - RNA, 18 nt, Human
cagcuucuauccuugacu

SEQ ID NO: 2866121 - RNA, 21 nt, Human
cagcuucauuuccugugucuu

SEQ ID NO: 2866122 - RNA, 20 nt, Human
cagcuucauuuccugugucu

SEQ ID NO: 2866123 - RNA, 19 nt, Human
cagcuucauuuccuguguc

SEQ ID NO: 2866124 - RNA, 14 nt, Human
cagcuuccuaccca

SEQ ID NO: 2866125 - RNA, 19 nt, Human
cagcuuccuacccacaccu

SEQ ID NO: 2866126 - RNA, 20 nt, Human
cagcuuccuacccacaccuc

SEQ ID NO: 2866127 - RNA, 22 nt, Human
cagcuuccuacccacaccucug

SEQ ID NO: 2866128 - RNA, 12 nt, Human
cagcuuccuguc

SEQ ID NO: 2866129 - RNA, 13 nt, Human
cagcuuccuguca

SEQ ID NO: 2866130 - RNA, 18 nt, Human
cagcuuccuguccccauc

SEQ ID NO: 2866131 - RNA, 21 nt, Human
cagcuuccuguccccaucugu

SEQ ID NO: 2866132 - RNA, 17 nt, Human
cagcuucauuuguguca

SEQ ID NO: 2866133 - RNA, 17 nt, Human
cagcuguacuucgucuu

SEQ ID NO: 2866134 - RNA, 13 nt, Human
cagcuucauuugu

SEQ ID NO: 2866135 - RNA, 15 nt, Human
cagcuucauuugugu

SEQ ID NO: 2866136 - RNA, 21 nt, Human
cagcuugaggguugggcuggu

SEQ ID NO: 2866137 - RNA, 20 nt, Human
cagcuugaggguugggcugg

SEQ ID NO: 2866138 - RNA, 19 nt, Human
cagcuugaggguugggcug

SEQ ID NO: 2866139 - RNA, 18 nt, Human
cagcuugaggguugggcu

SEQ ID NO: 2866140 - RNA, 14 nt, Human
cagcuugcgaauaa

SEQ ID NO: 2866141 - RNA, 16 nt, Human
cagcuugcgaauaaca

SEQ ID NO: 2866142 - RNA, 17 nt, Human
cagcuugccagaugcug

SEQ ID NO: 2866143 - RNA, 20 nt, Human
cagcuugccagaugcugcag

SEQ ID NO: 2866144 - RNA, 21 nt, Human
cagcuugccagaugcugcaga

SEQ ID NO: 2866145 - RNA, 17 nt, Human
cagcuuggcccuuuccu

SEQ ID NO: 2866146 - RNA, 14 nt, Human
cagcuugggagagc

SEQ ID NO: 2866147 - RNA, 18 nt, Human
cagcuugggagagccccu

SEQ ID NO: 2866148 - RNA, 23 nt, Human
cagcuugggagagccccuggggc

SEQ ID NO: 2866149 - RNA, 15 nt, Human
cagcuugaggguugg

SEQ ID NO: 2866150 - RNA, 14 nt, Human
cagcuugaggguug

SEQ ID NO: 2866151 - RNA, 23 nt, Human
cagcuuucuccccgcuaaggaag

SEQ ID NO: 2866152 - RNA, 15 nt, Human
cagcuuucugaccuu

SEQ ID NO: 2866153 - RNA, 21 nt, Human
cagcuuucugaccuucagcuc

SEQ ID NO: 2866154 - RNA, 22 nt, Human
cagcuuucugaccuucagcuca

SEQ ID NO: 2866155 - RNA, 19 nt, Human
cagcuuucuugcucccuuc

SEQ ID NO: 2866156 - RNA, 21 nt, Human
cagcuuucuugcucccuucag

SEQ ID NO: 2866157 - RNA, 22 nt, Human
cagcuuucuugcucccuucagc

SEQ ID NO: 2866158 - RNA, 23 nt, Human
cagcuuucuugcucccuucagcc

SEQ ID NO: 2866159 - RNA, 23 nt, Human
cagcuuuccccaugucucgacuc

SEQ ID NO: 2866160 - RNA, 21 nt, Human
cagcuuucaucuuuguggaug

SEQ ID NO: 2866161 - RNA, 13 nt, Human
cagcuuuauguuc

SEQ ID NO: 2866162 - RNA, 16 nt, Human
cagcuuucaaagcauu

SEQ ID NO: 2866163 - RNA, 17 nt, Human
cagcuuucaaagcauuu

SEQ ID NO: 2866164 - RNA, 14 nt, Human
cagcuuucaagugc

SEQ ID NO: 2866165 - RNA, 17 nt, Human
cagcuuucaagugccuu

SEQ ID NO: 2866166 - RNA, 14 nt, Human
cagcuuucagggcc

SEQ ID NO: 2866167 - RNA, 16 nt, Human
cagcuuucagggccau

SEQ ID NO: 2866168 - RNA, 19 nt, Human
cagcuuucagggccauggu

SEQ ID NO: 2866169 - RNA, 20 nt, Human
cagcuugugugcaaaagcag

SEQ ID NO: 2866170 - RNA, 22 nt, Human
cagcuuuaaaaaauuaaucugg

SEQ ID NO: 2866171 - RNA, 19 nt, Human
cagcuuuacaugcaauuua

SEQ ID NO: 2866172 - RNA, 21 nt, Human
cagcuuuacaugcaauuuauu

SEQ ID NO: 2866173 - RNA, 22 nt, Human
cagcuuuaaacucagggacaga

SEQ ID NO: 2866174 - RNA, 18 nt, Human
cagcuuuacacacacaga

SEQ ID NO: 2866175 - RNA, 15 nt, Human
cagcuuuacaugcaa

SEQ ID NO: 2866176 - RNA, 13 nt, Human
cagcuuuaaacaa

SEQ ID NO: 2866177 - RNA, 15 nt, Human
cagcuuuaaacaaau

SEQ ID NO: 2866178 - RNA, 17 nt, Human
cagcuuuaaacucaggg

SEQ ID NO: 2866179 - RNA, 18 nt, Human
cagcuuuaaacucaggga

SEQ ID NO: 2866180 - RNA, 19 nt, Human
cagcuuuaaacucagggac

SEQ ID NO: 2866181 - RNA, 20 nt, Human
cagcuuuaaacucagggaca

SEQ ID NO: 2866182 - RNA, 21 nt, Human
cagcuuuaaacucagggacag

SEQ ID NO: 2866183 - RNA, 22 nt, Human
cagcuuguaaauagcucaggug

SEQ ID NO: 2866184 - RNA, 21 nt, Human
cagcuuguaaauagcucaggu

SEQ ID NO: 2866185 - RNA, 22 nt, Human
cagcuuggggccaccaaagcug

SEQ ID NO: 2866186 - RNA, 15 nt, Human
cagcuuguaggagcu

SEQ ID NO: 2866187 - RNA, 16 nt, Human
cagcuuguaggagcug

SEQ ID NO: 2866188 - RNA, 19 nt, Human
cagcuuguaugcaauggau

SEQ ID NO: 2866189 - RNA, 23 nt, Human
cagcuuguaugcaauggauuuuc

SEQ ID NO: 2866190 - RNA, 14 nt, Human
cagcuugugcacaa

SEQ ID NO: 2866191 - RNA, 15 nt, Human
cagcuugugcacaau

SEQ ID NO: 2866192 - RNA, 20 nt, Human
cagcuuguaaauagcucagg

SEQ ID NO: 2866193 - RNA, 19 nt, Human
cagcuuguaaauagcucag

SEQ ID NO: 2866194 - RNA, 18 nt, Human
cagcuuguaaauagcuca

SEQ ID NO: 2866195 - RNA, 21 nt, Human
cagcuuggggccaccaaagcu

SEQ ID NO: 2866196 - RNA, 20 nt, Human
cagcuuggggccaccaaagc

SEQ ID NO: 2866197 - RNA, 23 nt, Human
caggaacagcuaugggagcccca

SEQ ID NO: 2866198 - RNA, 22 nt, Human
caggaacagcuaugggagcccc

SEQ ID NO: 2866199 - RNA, 20 nt, Human
caggaacagcuaugggagcc

SEQ ID NO: 2866200 - RNA, 14 nt, Human
caggaacagcuaug

SEQ ID NO: 2866201 - RNA, 18 nt, Human
caggaacagaaggaugaa

SEQ ID NO: 2866202 - RNA, 15 nt, Human
caggaacagaaggau

SEQ ID NO: 2866203 - RNA, 14 nt, Human
caggaacagaagga

SEQ ID NO: 2866204 - RNA, 19 nt, Human
cagcuuuuugucuuuucug

SEQ ID NO: 2866205 - RNA, 16 nt, Human
cagcuuuuugucuuuu

SEQ ID NO: 2866206 - RNA, 13 nt, Human
cagcuuuuugucu

SEQ ID NO: 2866207 - RNA, 19 nt, Human
cagcuuuuuaaaguggguu

SEQ ID NO: 2866208 - RNA, 11 nt, Human
cagcuuuuaac

SEQ ID NO: 2866209 - RNA, 15 nt, Human
cagcuuuuaaccauc

SEQ ID NO: 2866210 - RNA, 16 nt, Human
cagcuuuuaaccaucu

SEQ ID NO: 2866211 - RNA, 21 nt, Human
cagcuuuuaaccaucugauau

SEQ ID NO: 2866212 - RNA, 20 nt, Human
cagcuuugagaagccuucag

SEQ ID NO: 2866213 - RNA, 19 nt, Human
cagcuuugagaagccuuca

SEQ ID NO: 2866214 - RNA, 16 nt, Human
cagcuuugaucccuga

SEQ ID NO: 2866215 - RNA, 17 nt, Human
cagcuuugaucccugac

SEQ ID NO: 2866216 - RNA, 20 nt, Human
cagcuuugaucccugacauc

SEQ ID NO: 2866217 - RNA, 18 nt, Human
cagcuuugagaagccuuc

SEQ ID NO: 2866218 - RNA, 16 nt, Human
cagcuuugagaagccu

SEQ ID NO: 2866219 - RNA, 14 nt, Human
cagcuuugauauuu

SEQ ID NO: 2866220 - RNA, 11 nt, Human
cagcuuugcua

SEQ ID NO: 2866221 - RNA, 22 nt, Human
cagcuuugcuaccaaagcaccu

SEQ ID NO: 2866222 - RNA, 18 nt, Human
cagcuguaacacagcuga

SEQ ID NO: 2866223 - RNA, 20 nt, Human
cagcuguaacacagcugaga

SEQ ID NO: 2866224 - RNA, 17 nt, Human
cagcuggguuggaaaac

SEQ ID NO: 2866225 - RNA, 16 nt, Human
cagcuggguuggaaaa

SEQ ID NO: 2866226 - RNA, 19 nt, Human
cagcuggguggcacugcca

SEQ ID NO: 2866227 - RNA, 20 nt, Human
cagcuggguggcacugccau

SEQ ID NO: 2866228 - RNA, 21 nt, Human
cagcuggguggcacugccaug

SEQ ID NO: 2866229 - RNA, 22 nt, Human
cagcuggguggcacugccaugc

SEQ ID NO: 2866230 - RNA, 16 nt, Human
cagcuggguggcacug

SEQ ID NO: 2866231 - RNA, 17 nt, Human
cagcuggguggcacugc

SEQ ID NO: 2866232 - RNA, 18 nt, Human
cagcuggguggcacugcc

SEQ ID NO: 2866233 - RNA, 22 nt, Human
cagcugcuuuugucuaugggac

SEQ ID NO: 2866234 - RNA, 18 nt, Human
cagcugcuggagacuccu

SEQ ID NO: 2866235 - RNA, 19 nt, Human
cagcugcuggagacuccua

SEQ ID NO: 2866236 - RNA, 23 nt, Human
cagcugcuggagacuccuaggca

SEQ ID NO: 2866237 - RNA, 12 nt, Human
cagcugcugucu

SEQ ID NO: 2866238 - RNA, 13 nt, Human
cagcugcugucuu

SEQ ID NO: 2866239 - RNA, 14 nt, Human
cagcugcugucuuc

SEQ ID NO: 2866240 - RNA, 23 nt, Human
cagcugcuuuugucuaugggacu

SEQ ID NO: 2866241 - RNA, 17 nt, Human
cagcuggaauuaugcug

SEQ ID NO: 2866242 - RNA, 13 nt, Human
cagcuggacagag

SEQ ID NO: 2866243 - RNA, 14 nt, Human
cagcuggacagagg

SEQ ID NO: 2866244 - RNA, 15 nt, Human
cagcuggacagaggg

SEQ ID NO: 2866245 - RNA, 16 nt, Human
cagcuggacagagggg

SEQ ID NO: 2866246 - RNA, 23 nt, Human
cagcuggacagaggggacucugg

SEQ ID NO: 2866247 - RNA, 24 nt, Human
cagcuggacagaggggacucuggg

SEQ ID NO: 2866248 - RNA, 18 nt, Human
cagcuggagaaauauggu

SEQ ID NO: 2866249 - RNA, 15 nt, Human
cagcuggacucugca

SEQ ID NO: 2866250 - RNA, 17 nt, Human
cagcuggacucugcauc

SEQ ID NO: 2866251 - RNA, 18 nt, Human
cagcuggacucugcaucc

SEQ ID NO: 2866252 - RNA, 19 nt, Human
cagcuggacucugcauccc

SEQ ID NO: 2866253 - RNA, 23 nt, Human
cagcuggacucugcaucccagca

SEQ ID NO: 2866254 - RNA, 16 nt, Human
cagcuggagaagaccc

SEQ ID NO: 2866255 - RNA, 18 nt, Human
cagcuggaugauggucuu

SEQ ID NO: 2866256 - RNA, 19 nt, Human
cagcuggccgggagccuga

SEQ ID NO: 2866257 - RNA, 15 nt, Human
cagcugggcucugca

SEQ ID NO: 2866258 - RNA, 16 nt, Human
cagcugggcucugcaa

SEQ ID NO: 2866259 - RNA, 23 nt, Human
cagcugggaucacauguggacuu

SEQ ID NO: 2866260 - RNA, 21 nt, Human
cagcucugcaggcuuaauaaa

SEQ ID NO: 2866261 - RNA, 17 nt, Human
cagcuggccuggacagu

SEQ ID NO: 2866262 - RNA, 16 nt, Human
cagcuggccuggacag

SEQ ID NO: 2866263 - RNA, 15 nt, Human
cagcuggccuggaca

SEQ ID NO: 2866264 - RNA, 14 nt, Human
cagcuggccuggac

SEQ ID NO: 2866265 - RNA, 13 nt, Human
cagcuggccugga

SEQ ID NO: 2866266 - RNA, 17 nt, Human
cagcugggcucugcaau

SEQ ID NO: 2866267 - RNA, 14 nt, Human
cagcugcuggagac

SEQ ID NO: 2866268 - RNA, 15 nt, Human
cagcugcuggagacu

SEQ ID NO: 2866269 - RNA, 20 nt, Human
cagcugcuauuuauuuuccu

SEQ ID NO: 2866270 - RNA, 21 nt, Human
cagcugcucaauaaaguacaa

SEQ ID NO: 2866271 - RNA, 22 nt, Human
cagcugcuauuuauuuuccuaa

SEQ ID NO: 2866272 - RNA, 16 nt, Human
cagcugaccuuuguca

SEQ ID NO: 2866273 - RNA, 17 nt, Human
cagcugaaugccuccug

SEQ ID NO: 2866274 - RNA, 20 nt, Human
cagcugaaugccuccugugg

SEQ ID NO: 2866275 - RNA, 21 nt, Human
cagcugaaugccuccuguggg

SEQ ID NO: 2866276 - RNA, 23 nt, Human
cagcugaaugccuccugugggga

SEQ ID NO: 2866277 - RNA, 18 nt, Human
cagcucuuggcuccacug

SEQ ID NO: 2866278 - RNA, 17 nt, Human
cagcucuuggcuccacu

SEQ ID NO: 2866279 - RNA, 16 nt, Human
cagcucuuggcuccac

SEQ ID NO: 2866280 - RNA, 22 nt, Human
cagcucuuugaaauagucugug

SEQ ID NO: 2866281 - RNA, 11 nt, Human
cagcucuuuuu

SEQ ID NO: 2866282 - RNA, 18 nt, Human
cagcucuuuuugugaagu

SEQ ID NO: 2866283 - RNA, 24 nt, Human
cagcugcgguccacccaggagccc

SEQ ID NO: 2866284 - RNA, 23 nt, Human
cagcugcgguccacccaggagcc

SEQ ID NO: 2866285 - RNA, 22 nt, Human
cagcugcgguccacccaggagc

SEQ ID NO: 2866286 - RNA, 21 nt, Human
cagcugcgguccacccaggag

SEQ ID NO: 2866287 - RNA, 20 nt, Human
cagcugcgguccacccagga

SEQ ID NO: 2866288 - RNA, 19 nt, Human
cagcugcgguccacccagg

SEQ ID NO: 2866289 - RNA, 15 nt, Human
cagcugcgcgggcuu

SEQ ID NO: 2866290 - RNA, 18 nt, Human
cagcugcgguccacccag

SEQ ID NO: 2866291 - RNA, 20 nt, Human
cagcucugccgucucuggag

SEQ ID NO: 2866292 - RNA, 19 nt, Human
cagcucugccgucucugga

SEQ ID NO: 2866293 - RNA, 11 nt, Human
cagcucugacu

SEQ ID NO: 2866294 - RNA, 18 nt, Human
cagcucugacuuuacacu

SEQ ID NO: 2866295 - RNA, 13 nt, Human
cagcucucuguau

SEQ ID NO: 2866296 - RNA, 16 nt, Human
cagcucucuguauaaa

SEQ ID NO: 2866297 - RNA, 18 nt, Human
cagcucucuguauaaaca

SEQ ID NO: 2866298 - RNA, 17 nt, Human
cagcucucaucugaggc

SEQ ID NO: 2866299 - RNA, 18 nt, Human
cagcucucaucugaggca

SEQ ID NO: 2866300 - RNA, 20 nt, Human
cagcucuagacacugccaca

SEQ ID NO: 2866301 - RNA, 15 nt, Human
cagcucuacuggucu

SEQ ID NO: 2866302 - RNA, 12 nt, Human
cagcucuccccu

SEQ ID NO: 2866303 - RNA, 16 nt, Human
cagcucggggagccuu

SEQ ID NO: 2866304 - RNA, 18 nt, Human
cagcucuaagucucaacu

SEQ ID NO: 2866305 - RNA, 15 nt, Human
cagcucuaauaaaac

SEQ ID NO: 2866306 - RNA, 16 nt, Human
cagcucuaauaaaaca

SEQ ID NO: 2866307 - RNA, 13 nt, Human
cagcucggggagc

SEQ ID NO: 2866308 - RNA, 19 nt, Human
cagcucgaauuaagaauau

SEQ ID NO: 2866309 - RNA, 14 nt, Human
cagcucgauccaaa

SEQ ID NO: 2866310 - RNA, 18 nt, Human
cagcucgauccaaauugu

SEQ ID NO: 2866311 - RNA, 20 nt, Human
cagcucgauccaaauugugc

SEQ ID NO: 2866312 - RNA, 22 nt, Human
cagcucgauccaaauugugcuu

SEQ ID NO: 2866313 - RNA, 19 nt, Human
cagcucgcaccccccuguu

SEQ ID NO: 2866314 - RNA, 22 nt, Human
cagcucgcaccccccuguucua

SEQ ID NO: 2866315 - RNA, 23 nt, Human
cagcucgcaccccccuguucuaa

SEQ ID NO: 2866316 - RNA, 14 nt, Human
cagcucaggggcag

SEQ ID NO: 2866317 - RNA, 15 nt, Human
cagcucaggggcagc

SEQ ID NO: 2866318 - RNA, 17 nt, Human
cagcucaggggcagcuc

SEQ ID NO: 2866319 - RNA, 18 nt, Human
cagcucaggggcagcuca

SEQ ID NO: 2866320 - RNA, 18 nt, Human
cagcucagucccaucaga

SEQ ID NO: 2866321 - RNA, 12 nt, Human
cagcucaguccc

SEQ ID NO: 2866322 - RNA, 15 nt, Human
cagcucaucucuguc

SEQ ID NO: 2866323 - RNA, 20 nt, Human
cagcucauagaguccccccu

SEQ ID NO: 2866324 - RNA, 15 nt, Human
cagcuccuguaacau

SEQ ID NO: 2866325 - RNA, 13 nt, Human
cagcucauucauu

SEQ ID NO: 2866326 - RNA, 16 nt, Human
cagcucauucauuuua

SEQ ID NO: 2866327 - RNA, 19 nt, Human
cagcucauucauuuuauau

SEQ ID NO: 2866328 - RNA, 20 nt, Human
cagcucauucauuuuauauu

SEQ ID NO: 2866329 - RNA, 23 nt, Human
cagcuccuucuguccuacucugu

SEQ ID NO: 2866330 - RNA, 21 nt, Human
cagcuccuucuguccuacucu

SEQ ID NO: 2866331 - RNA, 17 nt, Human
cagcuccuucuguccua

SEQ ID NO: 2866332 - RNA, 16 nt, Human
cagcuccuucuguccu

SEQ ID NO: 2866333 - RNA, 18 nt, Human
cagcucagcgccagccug

SEQ ID NO: 2866334 - RNA, 11 nt, Human
cagcucagcgc

SEQ ID NO: 2866335 - RNA, 13 nt, Human
cagcucagcgcca

SEQ ID NO: 2866336 - RNA, 17 nt, Human
cagcucagcgccagccu

SEQ ID NO: 2866337 - RNA, 23 nt, Human
cagcucuucuccaggcuguaucc

SEQ ID NO: 2866338 - RNA, 19 nt, Human
cagcucuucuccaggcugu

SEQ ID NO: 2866339 - RNA, 18 nt, Human
cagcucuucuccaggcug

SEQ ID NO: 2866340 - RNA, 17 nt, Human
cagcucuucuccaggcu

SEQ ID NO: 2866341 - RNA, 16 nt, Human
cagcucuucuccaggc

SEQ ID NO: 2866342 - RNA, 15 nt, Human
cagcucuucuccagg

SEQ ID NO: 2866343 - RNA, 14 nt, Human
cagcucuucuccag

SEQ ID NO: 2866344 - RNA, 13 nt, Human
cagcucuucucca

SEQ ID NO: 2866345 - RNA, 15 nt, Human
cagcucuuaaaugua

SEQ ID NO: 2866346 - RNA, 13 nt, Human
cagcucuucaucu

SEQ ID NO: 2866347 - RNA, 14 nt, Human
cagcucuucaucug

SEQ ID NO: 2866348 - RNA, 18 nt, Human
cagcucuucaucugccca

SEQ ID NO: 2866349 - RNA, 19 nt, Human
cagcucuucaucugcccaa

SEQ ID NO: 2866350 - RNA, 23 nt, Human
cagcucuguccugggagugagcu

SEQ ID NO: 2866351 - RNA, 21 nt, Human
cagcucuguguugccaugugu

SEQ ID NO: 2866352 - RNA, 17 nt, Human
cagcucuguguugccau

SEQ ID NO: 2866353 - RNA, 18 nt, Human
cagcucuguccugggagu

SEQ ID NO: 2866354 - RNA, 17 nt, Human
cagcucuguccugggag

SEQ ID NO: 2866355 - RNA, 16 nt, Human
cagcucuguccuggga

SEQ ID NO: 2866356 - RNA, 14 nt, Human
cagcucuguccugg

SEQ ID NO: 2866357 - RNA, 13 nt, Human
cagcucuguccug

SEQ ID NO: 2866358 - RNA, 12 nt, Human
cagcucuguccu

SEQ ID NO: 2866359 - RNA, 22 nt, Human
cagcucugccgucucuggagcg

SEQ ID NO: 2866360 - RNA, 12 nt, Human
cagcucuggcuu

SEQ ID NO: 2866361 - RNA, 14 nt, Human
cagcucuggcuucc

SEQ ID NO: 2866362 - RNA, 15 nt, Human
cagccuaccaugaga

SEQ ID NO: 2866363 - RNA, 21 nt, Human
cagccuagggcugagcugggg

SEQ ID NO: 2866364 - RNA, 13 nt, Human
cagccuaugagca

SEQ ID NO: 2866365 - RNA, 19 nt, Human
cagccuaugagcauccuga

SEQ ID NO: 2866366 - RNA, 21 nt, Human
cagccuaugagcauccugagc

SEQ ID NO: 2866367 - RNA, 22 nt, Human
cagccuaugagcauccugagcc

SEQ ID NO: 2866368 - RNA, 23 nt, Human
cagccuaugagcauccugagccc

SEQ ID NO: 2866369 - RNA, 18 nt, Human
cagccucaaccuccuggg

SEQ ID NO: 2866370 - RNA, 17 nt, Human
cagccucaaccuccugg

SEQ ID NO: 2866371 - RNA, 21 nt, Human
cagccucaaccuccugggcua

SEQ ID NO: 2866372 - RNA, 20 nt, Human
cagccucaaccuccugggcu

SEQ ID NO: 2866373 - RNA, 19 nt, Human
cagccucaaccuccugggc

SEQ ID NO: 2866374 - RNA, 15 nt, Human
cagccucacccuugc

SEQ ID NO: 2866375 - RNA, 16 nt, Human
cagccucacccuugcg

SEQ ID NO: 2866376 - RNA, 13 nt, Human
cagccucacuugg

SEQ ID NO: 2866377 - RNA, 21 nt, Human
cagccucacuuggucugccag

SEQ ID NO: 2866378 - RNA, 22 nt, Human
cagccucacuuggucugccagg

SEQ ID NO: 2866379 - RNA, 23 nt, Human
cagccucacuuggucugccaggc

SEQ ID NO: 2866380 - RNA, 15 nt, Human
cagccucaguccucc

SEQ ID NO: 2866381 - RNA, 16 nt, Human
cagccucaguccuccc

SEQ ID NO: 2866382 - RNA, 14 nt, Human
cagccuccaagcuc

SEQ ID NO: 2866383 - RNA, 19 nt, Human
cagccucaguccuccccuc

SEQ ID NO: 2866384 - RNA, 21 nt, Human
cagccucaguccuccccucac

SEQ ID NO: 2866385 - RNA, 22 nt, Human
cagccucaguccuccccucaca

SEQ ID NO: 2866386 - RNA, 23 nt, Human
cagccucaguccuccccucacag

SEQ ID NO: 2866387 - RNA, 20 nt, Human
cagccuccaacacaaggcuc

SEQ ID NO: 2866388 - RNA, 22 nt, Human
cagccuccaacacaaggcucca

SEQ ID NO: 2866389 - RNA, 20 nt, Human
cagccuccaagcuccaucuc

SEQ ID NO: 2866390 - RNA, 22 nt, Human
cagccucccgaauagcugggac

SEQ ID NO: 2866391 - RNA, 21 nt, Human
cagccucccgaauagcuggga

SEQ ID NO: 2866392 - RNA, 20 nt, Human
cagccucccgaauagcuggg

SEQ ID NO: 2866393 - RNA, 18 nt, Human
cagccucccacccccauc

SEQ ID NO: 2866394 - RNA, 16 nt, Human
cagccucccaccccca

SEQ ID NO: 2866395 - RNA, 19 nt, Human
cagccucccacccccaucu

SEQ ID NO: 2866396 - RNA, 14 nt, Human
cagccucccacccc

SEQ ID NO: 2866397 - RNA, 22 nt, Human
cagccucccaaagugcugagau

SEQ ID NO: 2866398 - RNA, 15 nt, Human
cagccucccaaagug

SEQ ID NO: 2866399 - RNA, 21 nt, Human
cagccucccaaagugcugaga

SEQ ID NO: 2866400 - RNA, 23 nt, Human
cagccucccaaagugcugggauu

SEQ ID NO: 2866401 - RNA, 21 nt, Human
cagccucccaaagugcuggga

SEQ ID NO: 2866402 - RNA, 20 nt, Human
cagccucccaaagugcuggg

SEQ ID NO: 2866403 - RNA, 19 nt, Human
cagccucccaaagugcugg

SEQ ID NO: 2866404 - RNA, 15 nt, Human
cagccuccaugcugc

SEQ ID NO: 2866405 - RNA, 17 nt, Human
cagccuccaugcugccu

SEQ ID NO: 2866406 - RNA, 20 nt, Human
cagccuccaugcugccucca

SEQ ID NO: 2866407 - RNA, 14 nt, Human
cagccuccagccug

SEQ ID NO: 2866408 - RNA, 15 nt, Human
cagccuccagccugc

SEQ ID NO: 2866409 - RNA, 14 nt, Human
cagccucccaaagu

SEQ ID NO: 2866410 - RNA, 18 nt, Human
cagccuccaugcugccuc

SEQ ID NO: 2866411 - RNA, 14 nt, Human
cagccuccaugcug

SEQ ID NO: 2866412 - RNA, 12 nt, Human
cagccuacaguu

SEQ ID NO: 2866413 - RNA, 9 nt, Human
cagccgugc

SEQ ID NO: 2866414 - RNA, 14 nt, Human
cagccgugccuuca

SEQ ID NO: 2866415 - RNA, 16 nt, Human
cagccgugccuucagc

SEQ ID NO: 2866416 - RNA, 18 nt, Human
cagccgugccuucagcuc

SEQ ID NO: 2866417 - RNA, 20 nt, Human
cagccgugccuucagcucua

SEQ ID NO: 2866418 - RNA, 23 nt, Human
cagcccugcuuugggcugcccug

SEQ ID NO: 2866419 - RNA, 21 nt, Human
cagcccugcuuugggcugccc

SEQ ID NO: 2866420 - RNA, 22 nt, Human
cagcccugcuuugggcugcccu

SEQ ID NO: 2866421 - RNA, 11 nt, Human
cagcccugcuu

SEQ ID NO: 2866422 - RNA, 13 nt, Human
cagcccugcuuug

SEQ ID NO: 2866423 - RNA, 19 nt, Human
cagcccugcuuugggcugc

SEQ ID NO: 2866424 - RNA, 20 nt, Human
cagcccugcuuugggcugcc

SEQ ID NO: 2866425 - RNA, 21 nt, Human
cagcccuggcagggggcaugc

SEQ ID NO: 2866426 - RNA, 12 nt, Human
cagcccuggcuc

SEQ ID NO: 2866427 - RNA, 15 nt, Human
cagcccuggcucugc

SEQ ID NO: 2866428 - RNA, 16 nt, Human
cagcccuggcucugca

SEQ ID NO: 2866429 - RNA, 13 nt, Human
cagcccuggggcu

SEQ ID NO: 2866430 - RNA, 14 nt, Human
cagcccuggggcug

SEQ ID NO: 2866431 - RNA, 18 nt, Human
cagcccugagaaagcccu

SEQ ID NO: 2866432 - RNA, 19 nt, Human
cagcccugagaaagcccug

SEQ ID NO: 2866433 - RNA, 22 nt, Human
cagcccugaggugaaagggagc

SEQ ID NO: 2866434 - RNA, 12 nt, Human
cagcccugaggu

SEQ ID NO: 2866435 - RNA, 21 nt, Human
cagcccuccccauggagccag

SEQ ID NO: 2866436 - RNA, 16 nt, Human
cagcccucccugcccc

SEQ ID NO: 2866437 - RNA, 17 nt, Human
cagcccucccugccccu

SEQ ID NO: 2866438 - RNA, 18 nt, Human
cagcccucccugccccuc

SEQ ID NO: 2866439 - RNA, 22 nt, Human
cagcccucccugccccucccuu

SEQ ID NO: 2866440 - RNA, 22 nt, Human
cagcccuccaucuaaacugccc

SEQ ID NO: 2866441 - RNA, 20 nt, Human
cagcccuccccauggagcca

SEQ ID NO: 2866442 - RNA, 23 nt, Human
cagcccuccaucuaaacugcccc

SEQ ID NO: 2866443 - RNA, 13 nt, Human
cagcccucccugc

SEQ ID NO: 2866444 - RNA, 15 nt, Human
cagcccucccugccc

SEQ ID NO: 2866445 - RNA, 23 nt, Human
cagcccuagagccugccuggagc

SEQ ID NO: 2866446 - RNA, 18 nt, Human
cagcccuagagccugccu

SEQ ID NO: 2866447 - RNA, 20 nt, Human
cagcccuagagccugccugg

SEQ ID NO: 2866448 - RNA, 21 nt, Human
cagcccuagagccugccugga

SEQ ID NO: 2866449 - RNA, 22 nt, Human
cagcccuagagccugccuggag

SEQ ID NO: 2866450 - RNA, 12 nt, Human
cagcccuagagc

SEQ ID NO: 2866451 - RNA, 15 nt, Human
cagcccuagagccug

SEQ ID NO: 2866452 - RNA, 16 nt, Human
cagcccuagagccugc

SEQ ID NO: 2866453 - RNA, 14 nt, Human
cagcccgggagccu

SEQ ID NO: 2866454 - RNA, 15 nt, Human
cagcccgggagccua

SEQ ID NO: 2866455 - RNA, 16 nt, Human
cagcccgggagccuag

SEQ ID NO: 2866456 - RNA, 19 nt, Human
cagcccgggagccuaggac

SEQ ID NO: 2866457 - RNA, 20 nt, Human
cagcccgggagccuaggacc

SEQ ID NO: 2866458 - RNA, 21 nt, Human
cagcccgggagccuaggacca

SEQ ID NO: 2866459 - RNA, 15 nt, Human
cagccccuuuccaaa

SEQ ID NO: 2866460 - RNA, 23 nt, Human
cagccccuuuccaaaauuuuuca

SEQ ID NO: 2866461 - RNA, 17 nt, Human
cagcccggccgcuccac

SEQ ID NO: 2866462 - RNA, 18 nt, Human
cagcccggaccuuggcag

SEQ ID NO: 2866463 - RNA, 15 nt, Human
cagcccggaccuugg

SEQ ID NO: 2866464 - RNA, 14 nt, Human
cagccccauucugc

SEQ ID NO: 2866465 - RNA, 13 nt, Human
cagccccauucug

SEQ ID NO: 2866466 - RNA, 18 nt, Human
cagccccauucugccugc

SEQ ID NO: 2866467 - RNA, 17 nt, Human
cagccccauucugccug

SEQ ID NO: 2866468 - RNA, 16 nt, Human
cagccccauucugccu

SEQ ID NO: 2866469 - RNA, 13 nt, Human
cagccccaucugu

SEQ ID NO: 2866470 - RNA, 17 nt, Human
cagccccaucugugcau

SEQ ID NO: 2866471 - RNA, 20 nt, Human
cagccccaucugugcauucu

SEQ ID NO: 2866472 - RNA, 18 nt, Human
cagccccagugcccacag

SEQ ID NO: 2866473 - RNA, 17 nt, Human
cagccccagugcccaca

SEQ ID NO: 2866474 - RNA, 16 nt, Human
cagccccagugcccac

SEQ ID NO: 2866475 - RNA, 15 nt, Human
cagccccagugccca

SEQ ID NO: 2866476 - RNA, 14 nt, Human
cagccccagugccc

SEQ ID NO: 2866477 - RNA, 13 nt, Human
cagccccagugcc

SEQ ID NO: 2866478 - RNA, 20 nt, Human
cagccccacugccagcagca

SEQ ID NO: 2866479 - RNA, 19 nt, Human
cagccccacugccagcagc

SEQ ID NO: 2866480 - RNA, 18 nt, Human
cagccccacugccagcag

SEQ ID NO: 2866481 - RNA, 16 nt, Human
cagccccacugccagc

SEQ ID NO: 2866482 - RNA, 15 nt, Human
cagccccacugccag

SEQ ID NO: 2866483 - RNA, 14 nt, Human
cagccccacugcca

SEQ ID NO: 2866484 - RNA, 13 nt, Human
cagccccacugcc

SEQ ID NO: 2866485 - RNA, 12 nt, Human
cagccccacugc

SEQ ID NO: 2866486 - RNA, 22 nt, Human
cagccccacugccagcagcagc

SEQ ID NO: 2866487 - RNA, 21 nt, Human
cagccccacugccagcagcag

SEQ ID NO: 2866488 - RNA, 15 nt, Human
cagccccagagcagg

SEQ ID NO: 2866489 - RNA, 19 nt, Human
cagcccagaagaaaauucu

SEQ ID NO: 2866490 - RNA, 22 nt, Human
cagccccacccaggagggaggg

SEQ ID NO: 2866491 - RNA, 21 nt, Human
cagccccacccaggagggagg

SEQ ID NO: 2866492 - RNA, 16 nt, Human
cagccccacccaggag

SEQ ID NO: 2866493 - RNA, 15 nt, Human
cagccccacccagga

SEQ ID NO: 2866494 - RNA, 14 nt, Human
cagccccacccagg

SEQ ID NO: 2866495 - RNA, 13 nt, Human
cagccccacccag

SEQ ID NO: 2866496 - RNA, 12 nt, Human
cagccccaccca

SEQ ID NO: 2866497 - RNA, 11 nt, Human
cagccccaccc

SEQ ID NO: 2866498 - RNA, 15 nt, Human
cagcuacuuccuccu

SEQ ID NO: 2866499 - RNA, 19 nt, Human
cagcuacugauuuuuguga

SEQ ID NO: 2866500 - RNA, 17 nt, Human
cagcuacuuaagagaaa

SEQ ID NO: 2866501 - RNA, 20 nt, Human
cagcuacuuaagagaaaugg

SEQ ID NO: 2866502 - RNA, 17 nt, Human
cagcuacuuccuccucc

SEQ ID NO: 2866503 - RNA, 21 nt, Human
cagcuacuuccuccuccccac

SEQ ID NO: 2866504 - RNA, 23 nt, Human
cagcuacucagaagccugaggcu

SEQ ID NO: 2866505 - RNA, 22 nt, Human
cagcuacucagaagccugaggc

SEQ ID NO: 2866506 - RNA, 16 nt, Human
cagcuacugauuuuug

SEQ ID NO: 2866507 - RNA, 19 nt, Human
cagcuacucgggaggcuga

SEQ ID NO: 2866508 - RNA, 12 nt, Human
cagcuacaacag

SEQ ID NO: 2866509 - RNA, 13 nt, Human
cagcuacaacagc

SEQ ID NO: 2866510 - RNA, 17 nt, Human
cagcuacaacagccuca

SEQ ID NO: 2866511 - RNA, 15 nt, Human
cagcuacagcuuucu

SEQ ID NO: 2866512 - RNA, 20 nt, Human
cagcuacagcuuucuugcuc

SEQ ID NO: 2866513 - RNA, 18 nt, Human
cagcuacccacuauccuu

SEQ ID NO: 2866514 - RNA, 21 nt, Human
cagcuaccucaaccaaugcca

SEQ ID NO: 2866515 - RNA, 17 nt, Human
cagcuacccuguguaua

SEQ ID NO: 2866516 - RNA, 21 nt, Human
cagcuacccuuuuucuccagc

SEQ ID NO: 2866517 - RNA, 24 nt, Human
cagcuacccuuuuucuccagcugg

SEQ ID NO: 2866518 - RNA, 21 nt, Human
cagcuacucagaagccugagg

SEQ ID NO: 2866519 - RNA, 20 nt, Human
cagcuacucagaagccugag

SEQ ID NO: 2866520 - RNA, 19 nt, Human
cagcuacucagaagccuga

SEQ ID NO: 2866521 - RNA, 16 nt, Human
cagcuacucagaagcc

SEQ ID NO: 2866522 - RNA, 15 nt, Human
cagcuacucagaagc

SEQ ID NO: 2866523 - RNA, 14 nt, Human
cagcuacucagaag

SEQ ID NO: 2866524 - RNA, 16 nt, Human
cagcuaaugggacacu

SEQ ID NO: 2866525 - RNA, 15 nt, Human
cagcuaaugggacac

SEQ ID NO: 2866526 - RNA, 21 nt, Human
cagcuaaggaggggaaaaaaa

SEQ ID NO: 2866527 - RNA, 22 nt, Human
cagcuaaggaggggaaaaaaau

SEQ ID NO: 2866528 - RNA, 18 nt, Human
cagcuaagggaagacauu

SEQ ID NO: 2866529 - RNA, 19 nt, Human
cagcuaagggaagacauuu

SEQ ID NO: 2866530 - RNA, 21 nt, Human
cagcuaagggaagacauuucu

SEQ ID NO: 2866531 - RNA, 23 nt, Human
cagcuaagggaagacauuucuuu

SEQ ID NO: 2866532 - RNA, 19 nt, Human
cagcuaaucagcauucuca

SEQ ID NO: 2866533 - RNA, 14 nt, Human
cagcgccagccugu

SEQ ID NO: 2866534 - RNA, 15 nt, Human
cagcuaagcuaggaa

SEQ ID NO: 2866535 - RNA, 18 nt, Human
cagcuaagcuaggaauga

SEQ ID NO: 2866536 - RNA, 20 nt, Human
cagcgagcccugguggcagu

SEQ ID NO: 2866537 - RNA, 19 nt, Human
cagcgagcccugguggcag

SEQ ID NO: 2866538 - RNA, 17 nt, Human
cagcgagcccugguggc

SEQ ID NO: 2866539 - RNA, 16 nt, Human
cagcgagcccuggugg

SEQ ID NO: 2866540 - RNA, 13 nt, Human
cagcgagcccugg

SEQ ID NO: 2866541 - RNA, 18 nt, Human
cagcgaccuuccucaucc

SEQ ID NO: 2866542 - RNA, 19 nt, Human
cagcgacauagcccauccc

SEQ ID NO: 2866543 - RNA, 16 nt, Human
cagcgaaguagcuugc

SEQ ID NO: 2866544 - RNA, 18 nt, Human
cagcgaaguagcuugcuc

SEQ ID NO: 2866545 - RNA, 19 nt, Human
cagcgaaguagcuugcucc

SEQ ID NO: 2866546 - RNA, 22 nt, Human
cagcgaaguagcuugcucccug

SEQ ID NO: 2866547 - RNA, 20 nt, Human
cagcgacauagcccaucccu

SEQ ID NO: 2866548 - RNA, 16 nt, Human
cagcgaccgcccccuc

SEQ ID NO: 2866549 - RNA, 17 nt, Human
cagcgaccgcccccucc

SEQ ID NO: 2866550 - RNA, 18 nt, Human
cagcgaccgcccccuccu

SEQ ID NO: 2866551 - RNA, 18 nt, Human
cagcgccaagugcgugcc

SEQ ID NO: 2866552 - RNA, 23 nt, Human
cagcgccaagugcgugccgugug

SEQ ID NO: 2866553 - RNA, 24 nt, Human
cagcgccaagugcgugccguguga

SEQ ID NO: 2866554 - RNA, 21 nt, Human
cagcgagcccugguggcagug

SEQ ID NO: 2866555 - RNA, 14 nt, Human
cagcgagggcagcu

SEQ ID NO: 2866556 - RNA, 17 nt, Human
cagcgagggcagcugcu

SEQ ID NO: 2866557 - RNA, 16 nt, Human
cagcgagggcagcugc

SEQ ID NO: 2866558 - RNA, 15 nt, Human
cagcgagggcagcug

SEQ ID NO: 2866559 - RNA, 18 nt, Human
cagcgagggcagcugcua

SEQ ID NO: 2866560 - RNA, 22 nt, Human
cagcgaguuguggaaagccucu

SEQ ID NO: 2866561 - RNA, 19 nt, Human
cagcucaccagccccagug

SEQ ID NO: 2866562 - RNA, 17 nt, Human
cagcucaccagccccag

SEQ ID NO: 2866563 - RNA, 16 nt, Human
cagcucaccagcccca

SEQ ID NO: 2866564 - RNA, 15 nt, Human
cagcucaccagcccc

SEQ ID NO: 2866565 - RNA, 13 nt, Human
cagcucaccagcc

SEQ ID NO: 2866566 - RNA, 16 nt, Human
cagcucaauggacugg

SEQ ID NO: 2866567 - RNA, 20 nt, Human
cagcucaaggaaaggccuga

SEQ ID NO: 2866568 - RNA, 19 nt, Human
cagcucaaggaaaggccug

SEQ ID NO: 2866569 - RNA, 13 nt, Human
cagcuaugcuggu

SEQ ID NO: 2866570 - RNA, 23 nt, Human
cagcuauaccugugccucggcuu

SEQ ID NO: 2866571 - RNA, 19 nt, Human
cagcuaucgaacuucacaa

SEQ ID NO: 2866572 - RNA, 24 nt, Human
cagcuaucgaacuucacaacuagg

SEQ ID NO: 2866573 - RNA, 22 nt, Human
cagcuauaccugugccucggcu

SEQ ID NO: 2866574 - RNA, 21 nt, Human
cagcuauaccugugccucggc

SEQ ID NO: 2866575 - RNA, 19 nt, Human
cagcuauaccugugccucg

SEQ ID NO: 2866576 - RNA, 17 nt, Human
cagcuauaccugugccu

SEQ ID NO: 2866577 - RNA, 23 nt, Human
cagcuaugggagccccagggucu

SEQ ID NO: 2866578 - RNA, 22 nt, Human
cagcuaugggagccccaggguc

SEQ ID NO: 2866579 - RNA, 21 nt, Human
cagcuaugggagccccagggu

SEQ ID NO: 2866580 - RNA, 20 nt, Human
cagcuaugggagccccaggg

SEQ ID NO: 2866581 - RNA, 18 nt, Human
cagcuaugggagccccag

SEQ ID NO: 2866582 - RNA, 17 nt, Human
cagcuaugggagcccca

SEQ ID NO: 2866583 - RNA, 15 nt, Human
cagcuaugggagccc

SEQ ID NO: 2866584 - RNA, 13 nt, Human
cagcuaugggagc

SEQ ID NO: 2866585 - RNA, 18 nt, Human
cagcuagaaaacauuuuu

SEQ ID NO: 2866586 - RNA, 17 nt, Human
cagcuacuugguuugug

SEQ ID NO: 2866587 - RNA, 19 nt, Human
cagcuacuugguuuguguu

SEQ ID NO: 2866588 - RNA, 20 nt, Human
cagcuaguccuagugaaccu

SEQ ID NO: 2866589 - RNA, 16 nt, Human
cagcuauaccugugcc

SEQ ID NO: 2866590 - RNA, 15 nt, Human
cagcuauaccugugc

SEQ ID NO: 2866591 - RNA, 21 nt, Human
cagcucaccagccccagugcc

SEQ ID NO: 2866592 - RNA, 20 nt, Human
cagcucaccagccccagugc

SEQ ID NO: 2866593 - RNA, 22 nt, Human
cagcucaccagccccagugccc

SEQ ID NO: 2866594 - RNA, 20 nt, Human
cagcucaauggacuggaagg

SEQ ID NO: 2866595 - RNA, 13 nt, Human
cagcucacagugc

SEQ ID NO: 2866596 - RNA, 20 nt, Human
cagcucacagugcugugugc

SEQ ID NO: 2866597 - RNA, 13 nt, Human
cagcucacgcuuc

SEQ ID NO: 2866598 - RNA, 17 nt, Human
cagcucacgcuucacag

SEQ ID NO: 2866599 - RNA, 19 nt, Human
cagcucacgcuucacagug

SEQ ID NO: 2866600 - RNA, 14 nt, Human
cagcucacugcaac

SEQ ID NO: 2866601 - RNA, 12 nt, Human
cagcucacugca

SEQ ID NO: 2866602 - RNA, 13 nt, Human
cagcucagaaccc

SEQ ID NO: 2866603 - RNA, 14 nt, Human
cagcucagaaccca

SEQ ID NO: 2866604 - RNA, 15 nt, Human
cagcucagaacccag

SEQ ID NO: 2866605 - RNA, 16 nt, Human
cagcucagaacccagg

SEQ ID NO: 2866606 - RNA, 17 nt, Human
cagcucagaacccaggg

SEQ ID NO: 2866607 - RNA, 18 nt, Human
cagcucagaacccagggc

SEQ ID NO: 2866608 - RNA, 19 nt, Human
cagcucagaacccagggcu

SEQ ID NO: 2866609 - RNA, 20 nt, Human
cagcucagaacccagggcuc

SEQ ID NO: 2866610 - RNA, 21 nt, Human
cagcucagaacccagggcucu

SEQ ID NO: 2866611 - RNA, 12 nt, Human
cagcucagaacc

SEQ ID NO: 2866612 - RNA, 21 nt, Human
cagcucacugcaaccuucgcc

SEQ ID NO: 2866613 - RNA, 15 nt, Human
cagcucacugcaacc

SEQ ID NO: 2866614 - RNA, 21 nt, Human
cagccuucccccucccagggc

SEQ ID NO: 2866615 - RNA, 20 nt, Human
cagccuucccccucccaggg

SEQ ID NO: 2866616 - RNA, 14 nt, Human
cagccuucccccuc

SEQ ID NO: 2866617 - RNA, 16 nt, Human
cagccuucuuccaucc

SEQ ID NO: 2866618 - RNA, 18 nt, Human
cagccuucuuccauccca

SEQ ID NO: 2866619 - RNA, 14 nt, Human
cagccuugaacucu

SEQ ID NO: 2866620 - RNA, 18 nt, Human
cagccuugaacucugggc

SEQ ID NO: 2866621 - RNA, 19 nt, Human
cagccuugaacucugggcu

SEQ ID NO: 2866622 - RNA, 21 nt, Human
cagccuucuuccaucccagga

SEQ ID NO: 2866623 - RNA, 23 nt, Human
cagccuucuuccaucccaggaca

SEQ ID NO: 2866624 - RNA, 17 nt, Human
cagccuuugccuccccg

SEQ ID NO: 2866625 - RNA, 18 nt, Human
cagccuuuggccuuggcu

SEQ ID NO: 2866626 - RNA, 14 nt, Human
cagccuuugggaaa

SEQ ID NO: 2866627 - RNA, 19 nt, Human
cagccugguccaugcaggg

SEQ ID NO: 2866628 - RNA, 23 nt, Human
cagccugguccaugcagggggcu

SEQ ID NO: 2866629 - RNA, 13 nt, Human
cagccuggggccu

SEQ ID NO: 2866630 - RNA, 15 nt, Human
cagccuggggccugg

SEQ ID NO: 2866631 - RNA, 16 nt, Human
cagccuggggccuggc

SEQ ID NO: 2866632 - RNA, 17 nt, Human
cagccuggggccuggca

SEQ ID NO: 2866633 - RNA, 18 nt, Human
cagccuggggccuggcag

SEQ ID NO: 2866634 - RNA, 19 nt, Human
cagccuggggccuggcagg

SEQ ID NO: 2866635 - RNA, 20 nt, Human
cagccuggggccuggcaggg

SEQ ID NO: 2866636 - RNA, 22 nt, Human
cagccuggggccuggcagggag

SEQ ID NO: 2866637 - RNA, 12 nt, Human
cagccuguggca

SEQ ID NO: 2866638 - RNA, 21 nt, Human
cagccuguggcaucuuugccu

SEQ ID NO: 2866639 - RNA, 19 nt, Human
cagccuguggcaucuuugc

SEQ ID NO: 2866640 - RNA, 15 nt, Human
cagccuguggcaucu

SEQ ID NO: 2866641 - RNA, 19 nt, Human
cagccugucccauggacac

SEQ ID NO: 2866642 - RNA, 21 nt, Human
cagccugucccauggacacuc

SEQ ID NO: 2866643 - RNA, 22 nt, Human
cagccugucccauggacacucc

SEQ ID NO: 2866644 - RNA, 21 nt, Human
cagccuggcuucuggagcccu

SEQ ID NO: 2866645 - RNA, 20 nt, Human
cagccuggcuucuggagccc

SEQ ID NO: 2866646 - RNA, 11 nt, Human
cagccugggac

SEQ ID NO: 2866647 - RNA, 23 nt, Human
cagccugggacaguuuaucauga

SEQ ID NO: 2866648 - RNA, 16 nt, Human
cagccugggaggcaca

SEQ ID NO: 2866649 - RNA, 17 nt, Human
cagccugggaggcacag

SEQ ID NO: 2866650 - RNA, 20 nt, Human
cagccugggaggcacagcaa

SEQ ID NO: 2866651 - RNA, 20 nt, Human
cagccugggcaacagagcaa

SEQ ID NO: 2866652 - RNA, 19 nt, Human
cagccugggcaacagagca

SEQ ID NO: 2866653 - RNA, 18 nt, Human
cagccugggcaacaaagu

SEQ ID NO: 2866654 - RNA, 16 nt, Human
cagccugggccccagc

SEQ ID NO: 2866655 - RNA, 15 nt, Human
cagccugggccccag

SEQ ID NO: 2866656 - RNA, 15 nt, Human
cagccugggcgacag

SEQ ID NO: 2866657 - RNA, 11 nt, Human
cagccugggcg

SEQ ID NO: 2866658 - RNA, 12 nt, Human
cagccugggccc

SEQ ID NO: 2866659 - RNA, 21 nt, Human
cagccugggcagccaggcugc

SEQ ID NO: 2866660 - RNA, 20 nt, Human
cagccugggcagccaggcug

SEQ ID NO: 2866661 - RNA, 19 nt, Human
cagccugggcagccaggcu

SEQ ID NO: 2866662 - RNA, 18 nt, Human
cagccugggcagccaggc

SEQ ID NO: 2866663 - RNA, 17 nt, Human
cagccugggcagccagg

SEQ ID NO: 2866664 - RNA, 20 nt, Human
cagccugggcagcauagcaa

SEQ ID NO: 2866665 - RNA, 14 nt, Human
cagccugcugccca

SEQ ID NO: 2866666 - RNA, 15 nt, Human
cagccugcugcccag

SEQ ID NO: 2866667 - RNA, 23 nt, Human
cagccugcuucccaccucccugc

SEQ ID NO: 2866668 - RNA, 21 nt, Human
cagccuggcacagggcagugg

SEQ ID NO: 2866669 - RNA, 13 nt, Human
cagccuggcacag

SEQ ID NO: 2866670 - RNA, 20 nt, Human
cagccuggcacagggcagug

SEQ ID NO: 2866671 - RNA, 16 nt, Human
cagccuggagaugaaa

SEQ ID NO: 2866672 - RNA, 17 nt, Human
cagccuggagacccacc

SEQ ID NO: 2866673 - RNA, 10 nt, Human
cagccuggca

SEQ ID NO: 2866674 - RNA, 19 nt, Human
cagccuggcuucuggagcc

SEQ ID NO: 2866675 - RNA, 17 nt, Human
cagccuggcuucuggag

SEQ ID NO: 2866676 - RNA, 16 nt, Human
cagccuggcuucugga

SEQ ID NO: 2866677 - RNA, 15 nt, Human
cagccuggcuucugg

SEQ ID NO: 2866678 - RNA, 14 nt, Human
cagccuggcuucug

SEQ ID NO: 2866679 - RNA, 23 nt, Human
cagccucccgaguagcugggacu

SEQ ID NO: 2866680 - RNA, 22 nt, Human
cagccucccgaguagcugggac

SEQ ID NO: 2866681 - RNA, 23 nt, Human
cagccucccucugaccugcaggc

SEQ ID NO: 2866682 - RNA, 22 nt, Human
cagccucccucugaccugcagg

SEQ ID NO: 2866683 - RNA, 21 nt, Human
cagccucccucugaccugcag

SEQ ID NO: 2866684 - RNA, 15 nt, Human
cagccucccucugac

SEQ ID NO: 2866685 - RNA, 14 nt, Human
cagccucccucuga

SEQ ID NO: 2866686 - RNA, 13 nt, Human
cagccucccucug

SEQ ID NO: 2866687 - RNA, 18 nt, Human
cagccucccgaguagcug

SEQ ID NO: 2866688 - RNA, 21 nt, Human
cagccucccgaguagcuggga

SEQ ID NO: 2866689 - RNA, 20 nt, Human
cagccucccgaguagcuggg

SEQ ID NO: 2866690 - RNA, 19 nt, Human
cagccucccgaguagcugg

SEQ ID NO: 2866691 - RNA, 23 nt, Human
cagccucccgaauagcugggacu

SEQ ID NO: 2866692 - RNA, 23 nt, Human
cagccucguuggaagaggaacag

SEQ ID NO: 2866693 - RNA, 22 nt, Human
cagccucguuggaagaggaaca

SEQ ID NO: 2866694 - RNA, 18 nt, Human
cagccucguuggaagagg

SEQ ID NO: 2866695 - RNA, 20 nt, Human
cagccuccugaguagcugga

SEQ ID NO: 2866696 - RNA, 15 nt, Human
cagccuccugaguag

SEQ ID NO: 2866697 - RNA, 23 nt, Human
cagccuccucugucugcccuuca

SEQ ID NO: 2866698 - RNA, 17 nt, Human
cagccuccucugucugc

SEQ ID NO: 2866699 - RNA, 12 nt, Human
cagccuccucug

SEQ ID NO: 2866700 - RNA, 18 nt, Human
cagcaacacagccugggc

SEQ ID NO: 2866701 - RNA, 16 nt, Human
cagcaacacagccugg

SEQ ID NO: 2866702 - RNA, 19 nt, Human
cagcaacacagccugggcc

SEQ ID NO: 2866703 - RNA, 14 nt, Human
cagcaacacagccu

SEQ ID NO: 2866704 - RNA, 14 nt, Human
cagcaacacagagc

SEQ ID NO: 2866705 - RNA, 20 nt, Human
cagcaacuucuucuccaucc

SEQ ID NO: 2866706 - RNA, 22 nt, Human
cagcaacuucuucuccaucccu

SEQ ID NO: 2866707 - RNA, 11 nt, Human
cagcaagaaaa

SEQ ID NO: 2866708 - RNA, 13 nt, Human
cagcaagaaaaaa

SEQ ID NO: 2866709 - RNA, 14 nt, Human
cagcaagaaaaaaa

SEQ ID NO: 2866710 - RNA, 17 nt, Human
cagcaagaaaaaaaaau

SEQ ID NO: 2866711 - RNA, 19 nt, Human
cagcaagaaaaaaaaaugc

SEQ ID NO: 2866712 - RNA, 21 nt, Human
cagcaagaaaaaaaaaugcca

SEQ ID NO: 2866713 - RNA, 22 nt, Human
cagcaagaaaaaaaaaugccau

SEQ ID NO: 2866714 - RNA, 14 nt, Human
cagcaaaccaagag

SEQ ID NO: 2866715 - RNA, 15 nt, Human
cagcaaaccaagaga

SEQ ID NO: 2866716 - RNA, 16 nt, Human
cagcaaaccaagagau

SEQ ID NO: 2866717 - RNA, 23 nt, Human
cagcaaaccaagagauugcuaau

SEQ ID NO: 2866718 - RNA, 11 nt, Human
cagcaaaccau

SEQ ID NO: 2866719 - RNA, 12 nt, Human
cagcaaaccauu

SEQ ID NO: 2866720 - RNA, 21 nt, Human
cagcaaaccauuuuuaaagua

SEQ ID NO: 2866721 - RNA, 24 nt, Human
cagcaaaccauuuuuaaaguagaa

SEQ ID NO: 2866722 - RNA, 20 nt, Human
cagcaaagaggacucgcuug

SEQ ID NO: 2866723 - RNA, 21 nt, Human
cagcaaagaggacucgcuugu

SEQ ID NO: 2866724 - RNA, 12 nt, Human
cagauuuugaua

SEQ ID NO: 2866725 - RNA, 13 nt, Human
cagauuuugauaa

SEQ ID NO: 2866726 - RNA, 15 nt, Human
cagauuuugauaacu

SEQ ID NO: 2866727 - RNA, 18 nt, Human
cagauuuugauaacuguu

SEQ ID NO: 2866728 - RNA, 20 nt, Human
cagauuuugauaacuguuua

SEQ ID NO: 2866729 - RNA, 14 nt, Human
cagcaaaaauauaa

SEQ ID NO: 2866730 - RNA, 15 nt, Human
cagcaaaaauauaaa

SEQ ID NO: 2866731 - RNA, 18 nt, Human
cagcaaaaauauaaaaua

SEQ ID NO: 2866732 - RNA, 18 nt, Human
cagcaaaaaaguccaauu

SEQ ID NO: 2866733 - RNA, 23 nt, Human
cagauuuuuugaaccauccacuu

SEQ ID NO: 2866734 - RNA, 22 nt, Human
cagauuuuuuacagcugccugc

SEQ ID NO: 2866735 - RNA, 21 nt, Human
cagauuuugggguuguguugu

SEQ ID NO: 2866736 - RNA, 23 nt, Human
cagauuuugggguuguguuguca

SEQ ID NO: 2866737 - RNA, 20 nt, Human
cagauuuugggguuguguug

SEQ ID NO: 2866738 - RNA, 19 nt, Human
cagauuuuuuacagcugcc

SEQ ID NO: 2866739 - RNA, 22 nt, Human
cagauuuuuauauuaguugcuu

SEQ ID NO: 2866740 - RNA, 23 nt, Human
cagauuuuuauauuaguugcuuu

SEQ ID NO: 2866741 - RNA, 17 nt, Human
cagauuuuucggaggcc

SEQ ID NO: 2866742 - RNA, 18 nt, Human
cagauuuuucggaggccc

SEQ ID NO: 2866743 - RNA, 15 nt, Human
cagauuuuaauuguc

SEQ ID NO: 2866744 - RNA, 16 nt, Human
cagauuuuaauuguca

SEQ ID NO: 2866745 - RNA, 18 nt, Human
cagauuuuaauugucaug

SEQ ID NO: 2866746 - RNA, 19 nt, Human
cagauuuuaauugucaugg

SEQ ID NO: 2866747 - RNA, 14 nt, Human
cagauucacacugu

SEQ ID NO: 2866748 - RNA, 19 nt, Human
cagauucacacugucuggu

SEQ ID NO: 2866749 - RNA, 13 nt, Human
cagauuauuuugg

SEQ ID NO: 2866750 - RNA, 16 nt, Human
cagauuauuuuggaaa

SEQ ID NO: 2866751 - RNA, 18 nt, Human
cagauuauuuuggaaagu

SEQ ID NO: 2866752 - RNA, 18 nt, Human
cagauguuuccagacuuc

SEQ ID NO: 2866753 - RNA, 23 nt, Human
cagauguuuccagacuuccuuga

SEQ ID NO: 2866754 - RNA, 23 nt, Human
cagauguuuuggucaaguaguuu

SEQ ID NO: 2866755 - RNA, 17 nt, Human
cagauucccagagcaaa

SEQ ID NO: 2866756 - RNA, 14 nt, Human
cagauucccagagc

SEQ ID NO: 2866757 - RNA, 14 nt, Human
cagauucagucuug

SEQ ID NO: 2866758 - RNA, 15 nt, Human
cagauucagucuugc

SEQ ID NO: 2866759 - RNA, 16 nt, Human
cagauucagucuugcc

SEQ ID NO: 2866760 - RNA, 17 nt, Human
cagauucagucuugccu

SEQ ID NO: 2866761 - RNA, 18 nt, Human
cagauucagucuugccuu

SEQ ID NO: 2866762 - RNA, 20 nt, Human
cagauucagucuugccuuac

SEQ ID NO: 2866763 - RNA, 21 nt, Human
cagauucccagagcaaaauaa

SEQ ID NO: 2866764 - RNA, 19 nt, Human
cagauucccagagcaaaau

SEQ ID NO: 2866765 - RNA, 18 nt, Human
cagauucccagagcaaaa

SEQ ID NO: 2866766 - RNA, 22 nt, Human
cagauuaucuauuugugugugu

SEQ ID NO: 2866767 - RNA, 14 nt, Human
cagaugggggaaag

SEQ ID NO: 2866768 - RNA, 19 nt, Human
cagaugggggaaagcacag

SEQ ID NO: 2866769 - RNA, 12 nt, Human
cagauguaaugu

SEQ ID NO: 2866770 - RNA, 13 nt, Human
cagauguaauguu

SEQ ID NO: 2866771 - RNA, 14 nt, Human
cagauguaauguuu

SEQ ID NO: 2866772 - RNA, 15 nt, Human
cagauguaauguuuu

SEQ ID NO: 2866773 - RNA, 16 nt, Human
cagauguaauguuuuc

SEQ ID NO: 2866774 - RNA, 22 nt, Human
cagauguaauguuuucuuugca

SEQ ID NO: 2866775 - RNA, 23 nt, Human
cagauguaauguuuucuuugcaa

SEQ ID NO: 2866776 - RNA, 16 nt, Human
cagauggugaagcauu

SEQ ID NO: 2866777 - RNA, 19 nt, Human
cagaugguuuccacauuua

SEQ ID NO: 2866778 - RNA, 22 nt, Human
cagaugguuuccacauuuagau

SEQ ID NO: 2866779 - RNA, 22 nt, Human
cagaugucccuugaugcacaga

SEQ ID NO: 2866780 - RNA, 23 nt, Human
cagaugucccuugaugcacagag

SEQ ID NO: 2866781 - RNA, 14 nt, Human
cagauguggagcca

SEQ ID NO: 2866782 - RNA, 15 nt, Human
cagauguggagccag

SEQ ID NO: 2866783 - RNA, 16 nt, Human
cagauguggagccagg

SEQ ID NO: 2866784 - RNA, 17 nt, Human
cagauguggagccaggc

SEQ ID NO: 2866785 - RNA, 18 nt, Human
cagauguggagccaggcg

SEQ ID NO: 2866786 - RNA, 16 nt, Human
cagaugugacuguaua

SEQ ID NO: 2866787 - RNA, 16 nt, Human
cagaugugaugcuuga

SEQ ID NO: 2866788 - RNA, 14 nt, Human
cagaugugcagcag

SEQ ID NO: 2866789 - RNA, 15 nt, Human
cagaugugcagcaga

SEQ ID NO: 2866790 - RNA, 16 nt, Human
cagaugugcagcagau

SEQ ID NO: 2866791 - RNA, 17 nt, Human
cagaugugcagcagauu

SEQ ID NO: 2866792 - RNA, 19 nt, Human
cagaugugcagcagauugg

SEQ ID NO: 2866793 - RNA, 20 nt, Human
cagaugugcagcagauugga

SEQ ID NO: 2866794 - RNA, 15 nt, Human
cagauguuuccagac

SEQ ID NO: 2866795 - RNA, 16 nt, Human
cagauguuuccagacu

SEQ ID NO: 2866796 - RNA, 14 nt, Human
cagauguuuccaga

SEQ ID NO: 2866797 - RNA, 20 nt, Human
cagaugugggcuuugauuuc

SEQ ID NO: 2866798 - RNA, 17 nt, Human
cagauguucccccaucu

SEQ ID NO: 2866799 - RNA, 22 nt, Human
cagauguucgguuuuuuuccug

SEQ ID NO: 2866800 - RNA, 17 nt, Human
cagauguugaauucuuu

SEQ ID NO: 2866801 - RNA, 19 nt, Human
cagauguugaauucuuuug

SEQ ID NO: 2866802 - RNA, 17 nt, Human
cagauggaaauauuuug

SEQ ID NO: 2866803 - RNA, 18 nt, Human
cagauggaaauauuuuga

SEQ ID NO: 2866804 - RNA, 21 nt, Human
cagauggaaugcuguguuaaa

SEQ ID NO: 2866805 - RNA, 19 nt, Human
cagauggaaugcuguguua

SEQ ID NO: 2866806 - RNA, 17 nt, Human
cagauggaaugcugugu

SEQ ID NO: 2866807 - RNA, 16 nt, Human
cagauggaaugcugug

SEQ ID NO: 2866808 - RNA, 13 nt, Human
cagauggcccgga

SEQ ID NO: 2866809 - RNA, 21 nt, Human
cagauggcccggaugcugcuu

SEQ ID NO: 2866810 - RNA, 22 nt, Human
cagauggcccggaugcugcuuc

SEQ ID NO: 2866811 - RNA, 20 nt, Human
cagaugggaggaaagagagc

SEQ ID NO: 2866812 - RNA, 22 nt, Human
cagaugggaggaaagagagcag

SEQ ID NO: 2866813 - RNA, 23 nt, Human
cagaugggaggaaagagagcagg

SEQ ID NO: 2866814 - RNA, 23 nt, Human
cagaugggcauaugugucagugg

SEQ ID NO: 2866815 - RNA, 22 nt, Human
cagauggauugauaauugcauu

SEQ ID NO: 2866816 - RNA, 23 nt, Human
cagauggauugauaauugcauuc

SEQ ID NO: 2866817 - RNA, 12 nt, Human
cagauggcacuu

SEQ ID NO: 2866818 - RNA, 22 nt, Human
cagaugcgucccaagauguuga

SEQ ID NO: 2866819 - RNA, 21 nt, Human
cagaugcuaaaaucccuggau

SEQ ID NO: 2866820 - RNA, 23 nt, Human
cagaugcuagcgcguugccuguc

SEQ ID NO: 2866821 - RNA, 11 nt, Human
cagaugcucaa

SEQ ID NO: 2866822 - RNA, 14 nt, Human
cagaugcuccaaga

SEQ ID NO: 2866823 - RNA, 15 nt, Human
cagaugcuccaagau

SEQ ID NO: 2866824 - RNA, 16 nt, Human
cagaugcuccaagauu

SEQ ID NO: 2866825 - RNA, 18 nt, Human
cagaugcuccaagauucu

SEQ ID NO: 2866826 - RNA, 19 nt, Human
cagaugcuccaagauucua

SEQ ID NO: 2866827 - RNA, 20 nt, Human
cagaugcuccaagauucuag

SEQ ID NO: 2866828 - RNA, 23 nt, Human
cagaugcuccaagauucuagaug

SEQ ID NO: 2866829 - RNA, 21 nt, Human
cagaugcuccaagauucuaga

SEQ ID NO: 2866830 - RNA, 22 nt, Human
cagaugcuccaagauucuagau

SEQ ID NO: 2866831 - RNA, 15 nt, Human
cagaugcugugcaaa

SEQ ID NO: 2866832 - RNA, 21 nt, Human
cagaugcgucccaagauguug

SEQ ID NO: 2866833 - RNA, 20 nt, Human
cagaugcgucccaagauguu

SEQ ID NO: 2866834 - RNA, 13 nt, Human
cagaugcguccca

SEQ ID NO: 2866835 - RNA, 15 nt, Human
cagaugccccagagc

SEQ ID NO: 2866836 - RNA, 18 nt, Human
cagaugccccagagcugu

SEQ ID NO: 2866837 - RNA, 20 nt, Human
cagaugccacccuagccaau

SEQ ID NO: 2866838 - RNA, 18 nt, Human
cagaugccacccuagcca

SEQ ID NO: 2866839 - RNA, 16 nt, Human
cagaugccacccuagc

SEQ ID NO: 2866840 - RNA, 19 nt, Human
cagaugcccagagggccca

SEQ ID NO: 2866841 - RNA, 15 nt, Human
cagaugcccagaggg

SEQ ID NO: 2866842 - RNA, 16 nt, Human
cagaugccccagagcu

SEQ ID NO: 2866843 - RNA, 13 nt, Human
cagaugccccaga

SEQ ID NO: 2866844 - RNA, 22 nt, Human
cagaugcccagagggcccaggc

SEQ ID NO: 2866845 - RNA, 20 nt, Human
cagaugcccagagggcccag

SEQ ID NO: 2866846 - RNA, 12 nt, Human
cagcaagugaga

SEQ ID NO: 2866847 - RNA, 17 nt, Human
cagcaagugagagcugg

SEQ ID NO: 2866848 - RNA, 16 nt, Human
cagcaagugagagcug

SEQ ID NO: 2866849 - RNA, 15 nt, Human
cagcaagugagagcu

SEQ ID NO: 2866850 - RNA, 14 nt, Human
cagcaagugagagc

SEQ ID NO: 2866851 - RNA, 12 nt, Human
cagcaaggcccu

SEQ ID NO: 2866852 - RNA, 16 nt, Human
cagcaaggcccugcug

SEQ ID NO: 2866853 - RNA, 18 nt, Human
cagcaaggcccugcugcc

SEQ ID NO: 2866854 - RNA, 19 nt, Human
cagcaaggcccugcugccc

SEQ ID NO: 2866855 - RNA, 22 nt, Human
cagcaagaagauccuaaaacaa

SEQ ID NO: 2866856 - RNA, 14 nt, Human
cagcaagaauaaaa

SEQ ID NO: 2866857 - RNA, 16 nt, Human
cagcaagaauaaaaaa

SEQ ID NO: 2866858 - RNA, 15 nt, Human
cagcaagaauauugu

SEQ ID NO: 2866859 - RNA, 12 nt, Human
cagcaagagaga

SEQ ID NO: 2866860 - RNA, 15 nt, Human
cagcaagagagaacc

SEQ ID NO: 2866861 - RNA, 17 nt, Human
cagcaagagagaaccua

SEQ ID NO: 2866862 - RNA, 19 nt, Human
cagcaagcccuacagagcu

SEQ ID NO: 2866863 - RNA, 21 nt, Human
cagcaagcccuacagagcugu

SEQ ID NO: 2866864 - RNA, 21 nt, Human
cagcaagugagagcugggugu

SEQ ID NO: 2866865 - RNA, 19 nt, Human
cagcaagugagagcugggu

SEQ ID NO: 2866866 - RNA, 19 nt, Human
cagcaauauauuaccagca

SEQ ID NO: 2866867 - RNA, 20 nt, Human
cagcaauauauuaccagcaa

SEQ ID NO: 2866868 - RNA, 22 nt, Human
cagcaauauauuaccagcaaga

SEQ ID NO: 2866869 - RNA, 23 nt, Human
cagcaauauauuaccagcaagaa

SEQ ID NO: 2866870 - RNA, 15 nt, Human
cagcaauauguaaau

SEQ ID NO: 2866871 - RNA, 18 nt, Human
cagcaaugacaucucagg

SEQ ID NO: 2866872 - RNA, 16 nt, Human
cagcaauauguaaaua

SEQ ID NO: 2866873 - RNA, 19 nt, Human
cagcaaugacaucucaggg

SEQ ID NO: 2866874 - RNA, 20 nt, Human
cagcaaugacaucucagggg

SEQ ID NO: 2866875 - RNA, 21 nt, Human
cagcaaugacaucucaggggc

SEQ ID NO: 2866876 - RNA, 16 nt, Human
cagcaauuuaaauguu

SEQ ID NO: 2866877 - RNA, 20 nt, Human
cagcaauucuccugccucag

SEQ ID NO: 2866878 - RNA, 19 nt, Human
cagcaauucuccugccuca

SEQ ID NO: 2866879 - RNA, 15 nt, Human
cagcaauuuaaaugu

SEQ ID NO: 2866880 - RNA, 14 nt, Human
cagcaauuuaaaug

SEQ ID NO: 2866881 - RNA, 12 nt, Human
cagcacaaaaug

SEQ ID NO: 2866882 - RNA, 11 nt, Human
cagcacaaaca

SEQ ID NO: 2866883 - RNA, 13 nt, Human
cagcacaaacaca

SEQ ID NO: 2866884 - RNA, 14 nt, Human
cagcacaaacacaa

SEQ ID NO: 2866885 - RNA, 15 nt, Human
cagcacaaacacaag

SEQ ID NO: 2866886 - RNA, 16 nt, Human
cagcacaaacacaagg

SEQ ID NO: 2866887 - RNA, 18 nt, Human
cagcaauucuccugccuc

SEQ ID NO: 2866888 - RNA, 17 nt, Human
cagcaauucuccugccu

SEQ ID NO: 2866889 - RNA, 16 nt, Human
cagcaauucuccugcc

SEQ ID NO: 2866890 - RNA, 15 nt, Human
cagcaauucuccugc

SEQ ID NO: 2866891 - RNA, 20 nt, Human
cagcacuuugggagaccaag

SEQ ID NO: 2866892 - RNA, 13 nt, Human
cagcagaggcggu

SEQ ID NO: 2866893 - RNA, 22 nt, Human
cagcagaggcggucuucaacau

SEQ ID NO: 2866894 - RNA, 20 nt, Human
cagcagauaacaaugcagca

SEQ ID NO: 2866895 - RNA, 24 nt, Human
cagcagauaacaaugcagcaaggc

SEQ ID NO: 2866896 - RNA, 12 nt, Human
cagcagcaggug

SEQ ID NO: 2866897 - RNA, 16 nt, Human
cagcagcagcagguga

SEQ ID NO: 2866898 - RNA, 13 nt, Human
cagcagcagguga

SEQ ID NO: 2866899 - RNA, 15 nt, Human
cagcagcagcaggug

SEQ ID NO: 2866900 - RNA, 14 nt, Human
cagcagcagcaggu

SEQ ID NO: 2866901 - RNA, 13 nt, Human
cagcagcagcagg

SEQ ID NO: 2866902 - RNA, 14 nt, Human
cagcagauuggaag

SEQ ID NO: 2866903 - RNA, 15 nt, Human
cagcagauuggaagg

SEQ ID NO: 2866904 - RNA, 16 nt, Human
cagcagauuggaagga

SEQ ID NO: 2866905 - RNA, 18 nt, Human
cagcagauuggaaggaga

SEQ ID NO: 2866906 - RNA, 20 nt, Human
cagcagauuggaaggagaca

SEQ ID NO: 2866907 - RNA, 23 nt, Human
cagcagauuggaaggagacacag

SEQ ID NO: 2866908 - RNA, 11 nt, Human
cagcagcaaga

SEQ ID NO: 2866909 - RNA, 13 nt, Human
cagcagcaagaaa

SEQ ID NO: 2866910 - RNA, 14 nt, Human
cagcagcaagaaaa

SEQ ID NO: 2866911 - RNA, 15 nt, Human
cagcagcaagaaaaa

SEQ ID NO: 2866912 - RNA, 17 nt, Human
cagcagcaagaaaaaaa

SEQ ID NO: 2866913 - RNA, 20 nt, Human
cagcagcaagaaaaaaaaau

SEQ ID NO: 2866914 - RNA, 22 nt, Human
cagcagcaagaaaaaaaaaugc

SEQ ID NO: 2866915 - RNA, 13 nt, Human
cagcagcauuuuu

SEQ ID NO: 2866916 - RNA, 21 nt, Human
cagcagcauuuuuauuucaga

SEQ ID NO: 2866917 - RNA, 21 nt, Human
cagcagccgccuuaagcugau

SEQ ID NO: 2866918 - RNA, 22 nt, Human
cagcagccgccuuaagcugauc

SEQ ID NO: 2866919 - RNA, 12 nt, Human
cagcagccugcu

SEQ ID NO: 2866920 - RNA, 15 nt, Human
cagcagccugcuucc

SEQ ID NO: 2866921 - RNA, 20 nt, Human
cagcagccugcuucccaccu

SEQ ID NO: 2866922 - RNA, 21 nt, Human
cagcagccugcuucccaccuc

SEQ ID NO: 2866923 - RNA, 22 nt, Human
cagcagccugcuucccaccucc

SEQ ID NO: 2866924 - RNA, 13 nt, Human
cagcagccccugc

SEQ ID NO: 2866925 - RNA, 16 nt, Human
cagcagccccugcaca

SEQ ID NO: 2866926 - RNA, 23 nt, Human
cagcagccccugcacaaagcccu

SEQ ID NO: 2866927 - RNA, 22 nt, Human
cagcagaaaacuugugugaaau

SEQ ID NO: 2866928 - RNA, 21 nt, Human
cagcagaauggugaucacucc

SEQ ID NO: 2866929 - RNA, 15 nt, Human
cagcagaagacaaaa

SEQ ID NO: 2866930 - RNA, 13 nt, Human
cagcagaaggauu

SEQ ID NO: 2866931 - RNA, 18 nt, Human
cagcacuuugggaggcug

SEQ ID NO: 2866932 - RNA, 23 nt, Human
cagcacuuugggaggcugaggcg

SEQ ID NO: 2866933 - RNA, 22 nt, Human
cagcacuuugggaggcugaggc

SEQ ID NO: 2866934 - RNA, 20 nt, Human
cagcacuuugggaggcugag

SEQ ID NO: 2866935 - RNA, 19 nt, Human
cagcacuuugggaggcuga

SEQ ID NO: 2866936 - RNA, 14 nt, Human
cagcacuugucuca

SEQ ID NO: 2866937 - RNA, 17 nt, Human
cagcacuugucucauuu

SEQ ID NO: 2866938 - RNA, 20 nt, Human
cagcacuugucucauuuuaa

SEQ ID NO: 2866939 - RNA, 21 nt, Human
cagcacuugucucauuuuaau

SEQ ID NO: 2866940 - RNA, 23 nt, Human
cagcacuugucucauuuuaaugu

SEQ ID NO: 2866941 - RNA, 13 nt, Human
cagcacuuauuua

SEQ ID NO: 2866942 - RNA, 13 nt, Human
cagcacuuguaua

SEQ ID NO: 2866943 - RNA, 12 nt, Human
cagcagcuucac

SEQ ID NO: 2866944 - RNA, 16 nt, Human
cagcagcuucaccaga

SEQ ID NO: 2866945 - RNA, 17 nt, Human
cagcagcuucaccagag

SEQ ID NO: 2866946 - RNA, 18 nt, Human
cagcagcuucaccagagc

SEQ ID NO: 2866947 - RNA, 18 nt, Human
cagcaggaggccaggccg

SEQ ID NO: 2866948 - RNA, 15 nt, Human
cagcaggaggccagg

SEQ ID NO: 2866949 - RNA, 14 nt, Human
cagcaggaggccag

SEQ ID NO: 2866950 - RNA, 16 nt, Human
cagcaggaguggugca

SEQ ID NO: 2866951 - RNA, 21 nt, Human
cagcaggaguggugcagacag

SEQ ID NO: 2866952 - RNA, 22 nt, Human
cagcaggaguggugcagacaga

SEQ ID NO: 2866953 - RNA, 13 nt, Human
cagcaggcagcgc

SEQ ID NO: 2866954 - RNA, 15 nt, Human
cagcaggcagcgcca

SEQ ID NO: 2866955 - RNA, 16 nt, Human
cagcaggcagcgccaa

SEQ ID NO: 2866956 - RNA, 17 nt, Human
cagcauccuggcacccg

SEQ ID NO: 2866957 - RNA, 16 nt, Human
cagcauccuggcaccc

SEQ ID NO: 2866958 - RNA, 15 nt, Human
cagcauccuggcacc

SEQ ID NO: 2866959 - RNA, 14 nt, Human
cagcauccuggcac

SEQ ID NO: 2866960 - RNA, 13 nt, Human
cagccaacucauu

SEQ ID NO: 2866961 - RNA, 13 nt, Human
cagccaacagcua

SEQ ID NO: 2866962 - RNA, 15 nt, Human
cagccaacagcuaca

SEQ ID NO: 2866963 - RNA, 18 nt, Human
cagccaacagcuacaaca

SEQ ID NO: 2866964 - RNA, 19 nt, Human
cagccaacagcuacaacag

SEQ ID NO: 2866965 - RNA, 20 nt, Human
cagccaacagcuacaacagc

SEQ ID NO: 2866966 - RNA, 23 nt, Human
cagccaacagcuacaacagccuc

SEQ ID NO: 2866967 - RNA, 17 nt, Human
cagccaaacccaugagg

SEQ ID NO: 2866968 - RNA, 16 nt, Human
cagccaaacccaugag

SEQ ID NO: 2866969 - RNA, 18 nt, Human
cagcauuuuuauuucaga

SEQ ID NO: 2866970 - RNA, 17 nt, Human
cagccaaacccugucug

SEQ ID NO: 2866971 - RNA, 16 nt, Human
cagccaaacccugucu

SEQ ID NO: 2866972 - RNA, 15 nt, Human
cagccaaacccuguc

SEQ ID NO: 2866973 - RNA, 19 nt, Human
cagccaaacccaugaggca

SEQ ID NO: 2866974 - RNA, 18 nt, Human
cagcauuuuacugauuca

SEQ ID NO: 2866975 - RNA, 16 nt, Human
cagcauuucuuuucug

SEQ ID NO: 2866976 - RNA, 11 nt, Human
cagcauuugau

SEQ ID NO: 2866977 - RNA, 12 nt, Human
cagcauuugaua

SEQ ID NO: 2866978 - RNA, 14 nt, Human
cagcauuugauaau

SEQ ID NO: 2866979 - RNA, 15 nt, Human
cagcauuugauaaug

SEQ ID NO: 2866980 - RNA, 17 nt, Human
cagcauuugauaaugau

SEQ ID NO: 2866981 - RNA, 22 nt, Human
cagcauuugauaaugauaaaac

SEQ ID NO: 2866982 - RNA, 20 nt, Human
cagcauccuggcacccggcc

SEQ ID NO: 2866983 - RNA, 19 nt, Human
cagcauccuggcacccggc

SEQ ID NO: 2866984 - RNA, 21 nt, Human
cagcauccuggcacccggccc

SEQ ID NO: 2866985 - RNA, 23 nt, Human
cagcauccuuuucugcagagggg

SEQ ID NO: 2866986 - RNA, 14 nt, Human
cagcaucuucuggu

SEQ ID NO: 2866987 - RNA, 15 nt, Human
cagcaucuucugguu

SEQ ID NO: 2866988 - RNA, 14 nt, Human
cagcauucucacuc

SEQ ID NO: 2866989 - RNA, 15 nt, Human
cagcauucucacucc

SEQ ID NO: 2866990 - RNA, 18 nt, Human
cagcauucucaggcacca

SEQ ID NO: 2866991 - RNA, 14 nt, Human
cagcauucccuccc

SEQ ID NO: 2866992 - RNA, 20 nt, Human
cagcauucucaggcaccagu

SEQ ID NO: 2866993 - RNA, 19 nt, Human
cagcauucucaggcaccag

SEQ ID NO: 2866994 - RNA, 15 nt, Human
cagcaugaggacaga

SEQ ID NO: 2866995 - RNA, 22 nt, Human
cagcaugaggacagaccacaga

SEQ ID NO: 2866996 - RNA, 17 nt, Human
cagcauggucccugccu

SEQ ID NO: 2866997 - RNA, 18 nt, Human
cagcauggucccugccuu

SEQ ID NO: 2866998 - RNA, 20 nt, Human
cagcauggucccugccuuag

SEQ ID NO: 2866999 - RNA, 23 nt, Human
cagcauggucccugccuuaggcc

SEQ ID NO: 2867000 - RNA, 20 nt, Human
cagcaugacauaacagugca

SEQ ID NO: 2867001 - RNA, 21 nt, Human
cagcaugacauaacagugcag

SEQ ID NO: 2867002 - RNA, 15 nt, Human
cagcauggcacuccc

SEQ ID NO: 2867003 - RNA, 18 nt, Human
cagcauggcacucccucc

SEQ ID NO: 2867004 - RNA, 19 nt, Human
cagcauggcacucccucca

SEQ ID NO: 2867005 - RNA, 20 nt, Human
cagcauggcacucccuccag

SEQ ID NO: 2867006 - RNA, 21 nt, Human
cagcauggcacucccuccagc

SEQ ID NO: 2867007 - RNA, 22 nt, Human
cagcauggcacucccuccagca

SEQ ID NO: 2867008 - RNA, 14 nt, Human
cagcaugugcccuc

SEQ ID NO: 2867009 - RNA, 16 nt, Human
cagcaugugcccuccu

SEQ ID NO: 2867010 - RNA, 13 nt, Human
cagcaugugccuu

SEQ ID NO: 2867011 - RNA, 18 nt, Human
cagcauguauaguugcuu

SEQ ID NO: 2867012 - RNA, 19 nt, Human
cagcauguauaguugcuuu

SEQ ID NO: 2867013 - RNA, 11 nt, Human
cagccaccccg

SEQ ID NO: 2867014 - RNA, 14 nt, Human
cagccacacuugaa

SEQ ID NO: 2867015 - RNA, 16 nt, Human
cagccaccuaaacggu

SEQ ID NO: 2867016 - RNA, 16 nt, Human
cagccaccucucuuuu

SEQ ID NO: 2867017 - RNA, 15 nt, Human
cagccaccucucuuu

SEQ ID NO: 2867018 - RNA, 21 nt, Human
cagccaccccgggcucucugc

SEQ ID NO: 2867019 - RNA, 20 nt, Human
cagccaccccgggcucucug

SEQ ID NO: 2867020 - RNA, 17 nt, Human
cagccaccccgggcucu

SEQ ID NO: 2867021 - RNA, 12 nt, Human
cagccaccagcg

SEQ ID NO: 2867022 - RNA, 22 nt, Human
cagccaccccgggcucucugcu

SEQ ID NO: 2867023 - RNA, 12 nt, Human
cagccacacugu

SEQ ID NO: 2867024 - RNA, 15 nt, Human
cagccacacccaggc

SEQ ID NO: 2867025 - RNA, 19 nt, Human
cagccacacccaggcacuu

SEQ ID NO: 2867026 - RNA, 20 nt, Human
cagccaagugccaaaugcuc

SEQ ID NO: 2867027 - RNA, 20 nt, Human
cagccaagggaugaaagaga

SEQ ID NO: 2867028 - RNA, 11 nt, Human
cagccaagcuu

SEQ ID NO: 2867029 - RNA, 13 nt, Human
cagccaagcuugu

SEQ ID NO: 2867030 - RNA, 22 nt, Human
cagccacggccaggccagaggg

SEQ ID NO: 2867031 - RNA, 21 nt, Human
cagccacggccaggccagagg

SEQ ID NO: 2867032 - RNA, 19 nt, Human
cagccacggccaggccaga

SEQ ID NO: 2867033 - RNA, 18 nt, Human
cagccacggccaggccag

SEQ ID NO: 2867034 - RNA, 17 nt, Human
cagccacggccaggcca

SEQ ID NO: 2867035 - RNA, 16 nt, Human
cagccacggccaggcc

SEQ ID NO: 2867036 - RNA, 15 nt, Human
cagccacggccaggc

SEQ ID NO: 2867037 - RNA, 14 nt, Human
cagccacggccagg

SEQ ID NO: 2867038 - RNA, 18 nt, Human
cagccagugagaugaggg

SEQ ID NO: 2867039 - RNA, 23 nt, Human
cagccauacuuaucucucugugc

SEQ ID NO: 2867040 - RNA, 20 nt, Human
cagccauacuuaucucucug

SEQ ID NO: 2867041 - RNA, 21 nt, Human
cagccauacuuaucucucugu

SEQ ID NO: 2867042 - RNA, 13 nt, Human
cagccaucaaaau

SEQ ID NO: 2867043 - RNA, 23 nt, Human
cagccacggccaggccagaggga

SEQ ID NO: 2867044 - RNA, 21 nt, Human
cagccacuccccuccacucuc

SEQ ID NO: 2867045 - RNA, 10 nt, Human
cagccacucu

SEQ ID NO: 2867046 - RNA, 21 nt, Human
cagccacuucggccaggucac

SEQ ID NO: 2867047 - RNA, 22 nt, Human
cagccacuucggccaggucaca

SEQ ID NO: 2867048 - RNA, 15 nt, Human
cagccccacaacuuu

SEQ ID NO: 2867049 - RNA, 14 nt, Human
cagccccacacagc

SEQ ID NO: 2867050 - RNA, 15 nt, Human
cagccccacacagcu

SEQ ID NO: 2867051 - RNA, 16 nt, Human
cagccccacacagcua

SEQ ID NO: 2867052 - RNA, 16 nt, Human
cagcccaucucggagc

SEQ ID NO: 2867053 - RNA, 17 nt, Human
cagcccaucucggagca

SEQ ID NO: 2867054 - RNA, 19 nt, Human
cagcccauccauaguaacu

SEQ ID NO: 2867055 - RNA, 23 nt, Human
cagcccauccauaguaacugaca

SEQ ID NO: 2867056 - RNA, 17 nt, Human
cagcccaugcccaccug

SEQ ID NO: 2867057 - RNA, 16 nt, Human
cagcccaugcccaccu

SEQ ID NO: 2867058 - RNA, 15 nt, Human
cagcccaugcccacc

SEQ ID NO: 2867059 - RNA, 12 nt, Human
cagcccauuucu

SEQ ID NO: 2867060 - RNA, 13 nt, Human
cagcccauuucuc

SEQ ID NO: 2867061 - RNA, 16 nt, Human
cagcccauuucuccag

SEQ ID NO: 2867062 - RNA, 17 nt, Human
cagcccauuucuccaga

SEQ ID NO: 2867063 - RNA, 18 nt, Human
cagcccauuucuccagaa

SEQ ID NO: 2867064 - RNA, 20 nt, Human
cagcccauuucuccagaacc

SEQ ID NO: 2867065 - RNA, 16 nt, Human
cagcccauggcccugu

SEQ ID NO: 2867066 - RNA, 17 nt, Human
cagcccauggcccugug

SEQ ID NO: 2867067 - RNA, 18 nt, Human
cagcccauggcccugugc

SEQ ID NO: 2867068 - RNA, 21 nt, Human
cagcccaugcccaccugccca

SEQ ID NO: 2867069 - RNA, 19 nt, Human
cagcccaugcccaccugcc

SEQ ID NO: 2867070 - RNA, 24 nt, Human
cagcccaugcccaccugcccauca

SEQ ID NO: 2867071 - RNA, 18 nt, Human
cagcccacuucugccaua

SEQ ID NO: 2867072 - RNA, 12 nt, Human
cagcccagagac

SEQ ID NO: 2867073 - RNA, 14 nt, Human
cagcccagagacuu

SEQ ID NO: 2867074 - RNA, 13 nt, Human
cagcccagagacu

SEQ ID NO: 2867075 - RNA, 21 nt, Human
cagcccagagacuuuguagau

SEQ ID NO: 2867076 - RNA, 17 nt, Human
cagcccagagacuuugu

SEQ ID NO: 2867077 - RNA, 20 nt, Human
cagcccagaggccaacacug

SEQ ID NO: 2867078 - RNA, 23 nt, Human
cagcccaggccgggguggagcau

SEQ ID NO: 2867079 - RNA, 23 nt, Human
cagcccagcuuggcccuuuccuu

SEQ ID NO: 2867080 - RNA, 13 nt, Human
cagcccaauccag

SEQ ID NO: 2867081 - RNA, 16 nt, Human
cagcccaauccaggua

SEQ ID NO: 2867082 - RNA, 17 nt, Human
cagcccaauccagguac

SEQ ID NO: 2867083 - RNA, 22 nt, Human
cagcccaauccagguacgcaca

SEQ ID NO: 2867084 - RNA, 23 nt, Human
cagcccaauccagguacgcacag

SEQ ID NO: 2867085 - RNA, 19 nt, Human
cagcccacauagugauggu

SEQ ID NO: 2867086 - RNA, 15 nt, Human
cagcccacuucugcc

SEQ ID NO: 2867087 - RNA, 24 nt, Human
cagcccacauuggauucaucagca

SEQ ID NO: 2867088 - RNA, 17 nt, Human
cagcccacgucacgugu

SEQ ID NO: 2867089 - RNA, 17 nt, Human
cagccaucaaaaugcuu

SEQ ID NO: 2867090 - RNA, 16 nt, Human
cagccaucaaaaugcu

SEQ ID NO: 2867091 - RNA, 21 nt, Human
cagccaugcccgcauuagcuc

SEQ ID NO: 2867092 - RNA, 14 nt, Human
cagccauguacaga

SEQ ID NO: 2867093 - RNA, 19 nt, Human
cagccauguacagacagag

SEQ ID NO: 2867094 - RNA, 16 nt, Human
cagccauuaccaugga

SEQ ID NO: 2867095 - RNA, 20 nt, Human
cagcccaaaggggacaggcc

SEQ ID NO: 2867096 - RNA, 21 nt, Human
cagcccaaaggggacaggccu

SEQ ID NO: 2867097 - RNA, 22 nt, Human
cagcccaaaggggacaggccuc

SEQ ID NO: 2867098 - RNA, 23 nt, Human
cagcccaaaggggacaggccuca

SEQ ID NO: 2867099 - RNA, 20 nt, Human
cagccauuaccauggagaca

SEQ ID NO: 2867100 - RNA, 20 nt, Human
cagccauuacccagcuaaau

SEQ ID NO: 2867101 - RNA, 23 nt, Human
cagccauuacccagcuaaauaau

SEQ ID NO: 2867102 - RNA, 15 nt, Human
cagccauugcaccca

SEQ ID NO: 2867103 - RNA, 17 nt, Human
cagccauugcacccagc

SEQ ID NO: 2867104 - RNA, 21 nt, Human
cagccauugcacccagcccag

SEQ ID NO: 2867105 - RNA, 22 nt, Human
cagccauugcacccagcccaga

SEQ ID NO: 2867106 - RNA, 14 nt, Human
cagcucaccagccc

SEQ ID NO: 2867107 - RNA, 18 nt, Human
caggccgcgcccuuuccc

SEQ ID NO: 2867108 - RNA, 13 nt, Human
caggccggccagc

SEQ ID NO: 2867109 - RNA, 14 nt, Human
caggccggccagcc

SEQ ID NO: 2867110 - RNA, 15 nt, Human
caggccggccagccu

SEQ ID NO: 2867111 - RNA, 16 nt, Human
caggccggccagccuc

SEQ ID NO: 2867112 - RNA, 21 nt, Human
caggccggccagccucacccu

SEQ ID NO: 2867113 - RNA, 19 nt, Human
caggccggcgagcccugug

SEQ ID NO: 2867114 - RNA, 17 nt, Human
caggcuagcuggagccu

SEQ ID NO: 2867115 - RNA, 18 nt, Human
caggcuagcuggagccug

SEQ ID NO: 2867116 - RNA, 18 nt, Human
caggcuaguccggaccca

SEQ ID NO: 2867117 - RNA, 23 nt, Human
caggcuaguccggacccaccuca

SEQ ID NO: 2867118 - RNA, 20 nt, Human
caggcuccuuuagcgcccag

SEQ ID NO: 2867119 - RNA, 19 nt, Human
caggcuccuuuagcgccca

SEQ ID NO: 2867120 - RNA, 14 nt, Human
caggcuccuuuagc

SEQ ID NO: 2867121 - RNA, 18 nt, Human
caggcuccugccaccacg

SEQ ID NO: 2867122 - RNA, 12 nt, Human
caggcuccgccc

SEQ ID NO: 2867123 - RNA, 16 nt, Human
caggcuccgcccuuag

SEQ ID NO: 2867124 - RNA, 17 nt, Human
caggcuccgcccuuagu

SEQ ID NO: 2867125 - RNA, 18 nt, Human
caggcuccgcccuuaguc

SEQ ID NO: 2867126 - RNA, 22 nt, Human
caggcuccgcccuuaguccccc

SEQ ID NO: 2867127 - RNA, 16 nt, Human
caggcuccugccacca

SEQ ID NO: 2867128 - RNA, 15 nt, Human
caggcuccugccacc

SEQ ID NO: 2867129 - RNA, 14 nt, Human
caggcuccugccac

SEQ ID NO: 2867130 - RNA, 13 nt, Human
caggcuccugcca

SEQ ID NO: 2867131 - RNA, 21 nt, Human
caggcuccuuuagcgcccagu

SEQ ID NO: 2867132 - RNA, 13 nt, Human
caggcucucaaca

SEQ ID NO: 2867133 - RNA, 13 nt, Human
caggcucuccauu

SEQ ID NO: 2867134 - RNA, 14 nt, Human
caggcucucaacag

SEQ ID NO: 2867135 - RNA, 19 nt, Human
caggcccggcuccaggcuc

SEQ ID NO: 2867136 - RNA, 18 nt, Human
caggcccggcuccaggcu

SEQ ID NO: 2867137 - RNA, 16 nt, Human
caggcccggcuccagg

SEQ ID NO: 2867138 - RNA, 17 nt, Human
caggcccggcuccaggc

SEQ ID NO: 2867139 - RNA, 21 nt, Human
caggcccggcuccaggcuccu

SEQ ID NO: 2867140 - RNA, 20 nt, Human
caggcccggcuccaggcucc

SEQ ID NO: 2867141 - RNA, 22 nt, Human
caggcccggcuccaggcuccuu

SEQ ID NO: 2867142 - RNA, 15 nt, Human
caggcccgucugucc

SEQ ID NO: 2867143 - RNA, 16 nt, Human
caggcccgucugucca

SEQ ID NO: 2867144 - RNA, 17 nt, Human
caggcccgucuguccau

SEQ ID NO: 2867145 - RNA, 19 nt, Human
caggcccgucuguccaucu

SEQ ID NO: 2867146 - RNA, 20 nt, Human
caggcccgucuguccaucug

SEQ ID NO: 2867147 - RNA, 21 nt, Human
caggcccgucuguccaucugc

SEQ ID NO: 2867148 - RNA, 22 nt, Human
caggcccgucuguccaucugcc

SEQ ID NO: 2867149 - RNA, 23 nt, Human
caggcccgucuguccaucugccc

SEQ ID NO: 2867150 - RNA, 12 nt, Human
caggcccugcag

SEQ ID NO: 2867151 - RNA, 13 nt, Human
caggcccugcagu

SEQ ID NO: 2867152 - RNA, 15 nt, Human
caggcccugcagugu

SEQ ID NO: 2867153 - RNA, 16 nt, Human
caggcccugcaguguu

SEQ ID NO: 2867154 - RNA, 17 nt, Human
caggcccugcaguguuc

SEQ ID NO: 2867155 - RNA, 13 nt, Human
caggcccugcucc

SEQ ID NO: 2867156 - RNA, 14 nt, Human
caggcccugcuccu

SEQ ID NO: 2867157 - RNA, 15 nt, Human
caggcccugcuccug

SEQ ID NO: 2867158 - RNA, 16 nt, Human
caggcccugcuccugc

SEQ ID NO: 2867159 - RNA, 17 nt, Human
caggcccugcuccugca

SEQ ID NO: 2867160 - RNA, 19 nt, Human
caggcccugcuccugcagc

SEQ ID NO: 2867161 - RNA, 20 nt, Human
caggcccugcuccugcagca

SEQ ID NO: 2867162 - RNA, 22 nt, Human
caggcccugcuccugcagcaug

SEQ ID NO: 2867163 - RNA, 10 nt, Human
caggcccugg

SEQ ID NO: 2867164 - RNA, 15 nt, Human
caggcccuggaacuc

SEQ ID NO: 2867165 - RNA, 11 nt, Human
caggcccuggc

SEQ ID NO: 2867166 - RNA, 20 nt, Human
caggcccuggcuaagaccca

SEQ ID NO: 2867167 - RNA, 22 nt, Human
caggcccuggcugagggcagcu

SEQ ID NO: 2867168 - RNA, 21 nt, Human
caggcccuuauuuucaagaaa

SEQ ID NO: 2867169 - RNA, 15 nt, Human
caggcccuuccucuc

SEQ ID NO: 2867170 - RNA, 16 nt, Human
caggcccuuccucucc

SEQ ID NO: 2867171 - RNA, 17 nt, Human
caggcccuuccucucca

SEQ ID NO: 2867172 - RNA, 19 nt, Human
caggcccuuugaagccuca

SEQ ID NO: 2867173 - RNA, 20 nt, Human
caggcccuuugaagccucag

SEQ ID NO: 2867174 - RNA, 21 nt, Human
caggcccuuugaagccucagc

SEQ ID NO: 2867175 - RNA, 22 nt, Human
caggcccuuugaagccucagcu

SEQ ID NO: 2867176 - RNA, 19 nt, Human
caggcccuuccucuccacu

SEQ ID NO: 2867177 - RNA, 20 nt, Human
caggcccuuccucuccacug

SEQ ID NO: 2867178 - RNA, 21 nt, Human
caggcccuuccucuccacugc

SEQ ID NO: 2867179 - RNA, 23 nt, Human
caggcccuuccucuccacugccu

SEQ ID NO: 2867180 - RNA, 23 nt, Human
caggcuguaucccaugagccuca

SEQ ID NO: 2867181 - RNA, 22 nt, Human
caggcuguaucccaugagccuc

SEQ ID NO: 2867182 - RNA, 16 nt, Human
caggcuuaauaaaaau

SEQ ID NO: 2867183 - RNA, 20 nt, Human
caggcuuaauaaaaaugaca

SEQ ID NO: 2867184 - RNA, 21 nt, Human
caggcuuaauaaaaaugacag

SEQ ID NO: 2867185 - RNA, 17 nt, Human
caggcuguucugcacug

SEQ ID NO: 2867186 - RNA, 18 nt, Human
caggcuguucugcacuga

SEQ ID NO: 2867187 - RNA, 19 nt, Human
caggcuguucugcacugaa

SEQ ID NO: 2867188 - RNA, 20 nt, Human
caggcuguucugcacugaaa

SEQ ID NO: 2867189 - RNA, 21 nt, Human
caggcuguucugcacugaaaa

SEQ ID NO: 2867190 - RNA, 22 nt, Human
caggcuguucugcacugaaaag

SEQ ID NO: 2867191 - RNA, 14 nt, Human
caggcugugaguuu

SEQ ID NO: 2867192 - RNA, 21 nt, Human
caggcuguaucccaugagccu

SEQ ID NO: 2867193 - RNA, 20 nt, Human
caggcuguaucccaugagcc

SEQ ID NO: 2867194 - RNA, 14 nt, Human
caggcuguauccca

SEQ ID NO: 2867195 - RNA, 23 nt, Human
caggcuggucucgaacuccugac

SEQ ID NO: 2867196 - RNA, 18 nt, Human
caggcuggugggaggggc

SEQ ID NO: 2867197 - RNA, 15 nt, Human
caggcuggugggagg

SEQ ID NO: 2867198 - RNA, 20 nt, Human
caggcuggucuugaaguccu

SEQ ID NO: 2867199 - RNA, 21 nt, Human
caggcuggucuugaaguccug

SEQ ID NO: 2867200 - RNA, 19 nt, Human
caggcuggucucaaacucu

SEQ ID NO: 2867201 - RNA, 22 nt, Human
caggcuggucucgaacuccuga

SEQ ID NO: 2867202 - RNA, 20 nt, Human
caggcuggucucgaacuccu

SEQ ID NO: 2867203 - RNA, 12 nt, Human
caggcuggucuc

SEQ ID NO: 2867204 - RNA, 23 nt, Human
caggcuggucucaaacuccugac

SEQ ID NO: 2867205 - RNA, 13 nt, Human
caggcuggucuca

SEQ ID NO: 2867206 - RNA, 14 nt, Human
caggcuggucucaa

SEQ ID NO: 2867207 - RNA, 17 nt, Human
caggcuggucuaaaacu

SEQ ID NO: 2867208 - RNA, 18 nt, Human
caggcuggucuaaaacuc

SEQ ID NO: 2867209 - RNA, 14 nt, Human
caggcuuccuuggc

SEQ ID NO: 2867210 - RNA, 20 nt, Human
caggcugagccacucucuuc

SEQ ID NO: 2867211 - RNA, 21 nt, Human
caggcuuaugaauauauuuaa

SEQ ID NO: 2867212 - RNA, 21 nt, Human
caggcuuccugcaauuuucua

SEQ ID NO: 2867213 - RNA, 22 nt, Human
caggcuuccugcaauuuucuaa

SEQ ID NO: 2867214 - RNA, 15 nt, Human
cagggaaaagcagcu

SEQ ID NO: 2867215 - RNA, 19 nt, Human
caggcuuuguacagagugc

SEQ ID NO: 2867216 - RNA, 15 nt, Human
caggcuugccugcag

SEQ ID NO: 2867217 - RNA, 16 nt, Human
caggcuugccugcagg

SEQ ID NO: 2867218 - RNA, 17 nt, Human
caggcuugccugcaggc

SEQ ID NO: 2867219 - RNA, 18 nt, Human
caggcuugccugcaggca

SEQ ID NO: 2867220 - RNA, 23 nt, Human
caggcugggcuucaguggcagcu

SEQ ID NO: 2867221 - RNA, 16 nt, Human
caggcuggucuaaaac

SEQ ID NO: 2867222 - RNA, 16 nt, Human
caggcugggugacaga

SEQ ID NO: 2867223 - RNA, 18 nt, Human
caggcugggugacagagc

SEQ ID NO: 2867224 - RNA, 23 nt, Human
caggcugggugacagagcgagac

SEQ ID NO: 2867225 - RNA, 15 nt, Human
caggcuggccagccg

SEQ ID NO: 2867226 - RNA, 17 nt, Human
caggcuggccagccgcu

SEQ ID NO: 2867227 - RNA, 19 nt, Human
caggcuggccagccgcucu

SEQ ID NO: 2867228 - RNA, 16 nt, Human
caggcuggcccugccc

SEQ ID NO: 2867229 - RNA, 15 nt, Human
caggcuggcccugcc

SEQ ID NO: 2867230 - RNA, 14 nt, Human
caggcuggcccugc

SEQ ID NO: 2867231 - RNA, 12 nt, Human
caggcuggcccu

SEQ ID NO: 2867232 - RNA, 14 nt, Human
caggcuggacgugg

SEQ ID NO: 2867233 - RNA, 15 nt, Human
caggcugcuugggau

SEQ ID NO: 2867234 - RNA, 12 nt, Human
caggcugcuugg

SEQ ID NO: 2867235 - RNA, 22 nt, Human
caggcuggacaugcugacuguc

SEQ ID NO: 2867236 - RNA, 12 nt, Human
caggcuggccag

SEQ ID NO: 2867237 - RNA, 13 nt, Human
caggcuggccagc

SEQ ID NO: 2867238 - RNA, 14 nt, Human
caggcuggccagcc

SEQ ID NO: 2867239 - RNA, 15 nt, Human
caggcuggaguacag

SEQ ID NO: 2867240 - RNA, 21 nt, Human
caggcugcuggggccucagac

SEQ ID NO: 2867241 - RNA, 23 nt, Human
caggcugcuggggccucagacga

SEQ ID NO: 2867242 - RNA, 22 nt, Human
caggcugcuucaaucccagccu

SEQ ID NO: 2867243 - RNA, 23 nt, Human
caggcugcucuugaacuccugac

SEQ ID NO: 2867244 - RNA, 20 nt, Human
caggcugcucuugaacuccu

SEQ ID NO: 2867245 - RNA, 12 nt, Human
caggcugcucuu

SEQ ID NO: 2867246 - RNA, 21 nt, Human
caggcugccaaggccagagug

SEQ ID NO: 2867247 - RNA, 22 nt, Human
caggcugccaaggccagagugg

SEQ ID NO: 2867248 - RNA, 14 nt, Human
caggcugcagcugg

SEQ ID NO: 2867249 - RNA, 17 nt, Human
caggcugcagcuggaca

SEQ ID NO: 2867250 - RNA, 18 nt, Human
caggcugcagcuggacag

SEQ ID NO: 2867251 - RNA, 19 nt, Human
caggcugcagcuggacaga

SEQ ID NO: 2867252 - RNA, 20 nt, Human
caggcugcagcuggacagag

SEQ ID NO: 2867253 - RNA, 21 nt, Human
caggcugagccucagucuccc

SEQ ID NO: 2867254 - RNA, 17 nt, Human
caggcugagccucaguc

SEQ ID NO: 2867255 - RNA, 16 nt, Human
caggcugagccucagu

SEQ ID NO: 2867256 - RNA, 15 nt, Human
caggcugagccucag

SEQ ID NO: 2867257 - RNA, 14 nt, Human
caggcugagccuca

SEQ ID NO: 2867258 - RNA, 13 nt, Human
caggcugagccuc

SEQ ID NO: 2867259 - RNA, 18 nt, Human
caggcucuucuccuuuca

SEQ ID NO: 2867260 - RNA, 22 nt, Human
caggcucuucuccuuucacaac

SEQ ID NO: 2867261 - RNA, 12 nt, Human
caggcugagccu

SEQ ID NO: 2867262 - RNA, 14 nt, Human
caggcucuucuccu

SEQ ID NO: 2867263 - RNA, 15 nt, Human
caggcucuucuccuu

SEQ ID NO: 2867264 - RNA, 12 nt, Human
caggcucuucuc

SEQ ID NO: 2867265 - RNA, 15 nt, Human
caggggacucagccc

SEQ ID NO: 2867266 - RNA, 21 nt, Human
caggggacucagcccugaggu

SEQ ID NO: 2867267 - RNA, 20 nt, Human
caggggacucagcccugagg

SEQ ID NO: 2867268 - RNA, 18 nt, Human
caggggacucagcccuga

SEQ ID NO: 2867269 - RNA, 17 nt, Human
caggggacucagcccug

SEQ ID NO: 2867270 - RNA, 23 nt, Human
caggggacucagcccugagguga

SEQ ID NO: 2867271 - RNA, 17 nt, Human
cagggccuggaagacag

SEQ ID NO: 2867272 - RNA, 18 nt, Human
cagggccuggaagacaga

SEQ ID NO: 2867273 - RNA, 19 nt, Human
cagggccuggaagacagag

SEQ ID NO: 2867274 - RNA, 12 nt, Human
cagggccugggg

SEQ ID NO: 2867275 - RNA, 13 nt, Human
cagggccuggggc

SEQ ID NO: 2867276 - RNA, 14 nt, Human
cagggccuggggcc

SEQ ID NO: 2867277 - RNA, 15 nt, Human
cagggccuggggccu

SEQ ID NO: 2867278 - RNA, 17 nt, Human
cagggccuggggccuga

SEQ ID NO: 2867279 - RNA, 18 nt, Human
cagggccuggggccugag

SEQ ID NO: 2867280 - RNA, 19 nt, Human
cagggccuggggccugaga

SEQ ID NO: 2867281 - RNA, 20 nt, Human
cagggccuggggccugagag

SEQ ID NO: 2867282 - RNA, 21 nt, Human
cagggccuggggccugagaga

SEQ ID NO: 2867283 - RNA, 22 nt, Human
cagggccuggggccugagagaa

SEQ ID NO: 2867284 - RNA, 23 nt, Human
cagggccuggggccugagagaau

SEQ ID NO: 2867285 - RNA, 11 nt, Human
cagggccuggu

SEQ ID NO: 2867286 - RNA, 12 nt, Human
cagggccugguu

SEQ ID NO: 2867287 - RNA, 13 nt, Human
cagggccugguug

SEQ ID NO: 2867288 - RNA, 18 nt, Human
cagggccugguugaagaa

SEQ ID NO: 2867289 - RNA, 19 nt, Human
cagggccugguugaagaag

SEQ ID NO: 2867290 - RNA, 19 nt, Human
caggggaggcggcacucca

SEQ ID NO: 2867291 - RNA, 16 nt, Human
caggggaggugauagc

SEQ ID NO: 2867292 - RNA, 14 nt, Human
caggggccagagga

SEQ ID NO: 2867293 - RNA, 15 nt, Human
caggggccagaggaa

SEQ ID NO: 2867294 - RNA, 20 nt, Human
caggggcccaaggcggcccc

SEQ ID NO: 2867295 - RNA, 21 nt, Human
caggggcccaaggcggccccu

SEQ ID NO: 2867296 - RNA, 12 nt, Human
caggggcagcuc

SEQ ID NO: 2867297 - RNA, 22 nt, Human
caggggcccaaggcggccccuc

SEQ ID NO: 2867298 - RNA, 17 nt, Human
caggggcuacaagaggg

SEQ ID NO: 2867299 - RNA, 18 nt, Human
caggggcuacaagaggga

SEQ ID NO: 2867300 - RNA, 19 nt, Human
caggggcuacaagagggaa

SEQ ID NO: 2867301 - RNA, 13 nt, Human
caggggcucugga

SEQ ID NO: 2867302 - RNA, 14 nt, Human
caggggcucuggag

SEQ ID NO: 2867303 - RNA, 15 nt, Human
caggggcucuggaga

SEQ ID NO: 2867304 - RNA, 16 nt, Human
caggggcucuggagag

SEQ ID NO: 2867305 - RNA, 17 nt, Human
caggggcucuggagaga

SEQ ID NO: 2867306 - RNA, 18 nt, Human
caggggcucuggagagaa

SEQ ID NO: 2867307 - RNA, 20 nt, Human
caggggcucuggagagaaac

SEQ ID NO: 2867308 - RNA, 19 nt, Human
caggggcugacacuucaag

SEQ ID NO: 2867309 - RNA, 13 nt, Human
caggggcugcagu

SEQ ID NO: 2867310 - RNA, 19 nt, Human
caggggcucuggagagaaa

SEQ ID NO: 2867311 - RNA, 22 nt, Human
caggggcgugaggucccaggaa

SEQ ID NO: 2867312 - RNA, 17 nt, Human
cagggggcaugaccaga

SEQ ID NO: 2867313 - RNA, 18 nt, Human
cagggggacuagccccug

SEQ ID NO: 2867314 - RNA, 16 nt, Human
cagggggagaaugggu

SEQ ID NO: 2867315 - RNA, 19 nt, Human
cagggggaagguggggucc

SEQ ID NO: 2867316 - RNA, 14 nt, Human
cagggggaagaagc

SEQ ID NO: 2867317 - RNA, 15 nt, Human
cagggggaagaagca

SEQ ID NO: 2867318 - RNA, 20 nt, Human
cagggggaagaagcagagag

SEQ ID NO: 2867319 - RNA, 21 nt, Human
cagggggaagaagcagagaga

SEQ ID NO: 2867320 - RNA, 11 nt, Human
cagggggaagg

SEQ ID NO: 2867321 - RNA, 23 nt, Human
cagggggaaggccaaggggaguc

SEQ ID NO: 2867322 - RNA, 22 nt, Human
cagggggaugccacuccucccu

SEQ ID NO: 2867323 - RNA, 22 nt, Human
cagggcaugccccggccaccuc

SEQ ID NO: 2867324 - RNA, 23 nt, Human
cagggcaugccccggccaccucu

SEQ ID NO: 2867325 - RNA, 20 nt, Human
cagggcauggccagguggcc

SEQ ID NO: 2867326 - RNA, 15 nt, Human
cagggcaugccacgu

SEQ ID NO: 2867327 - RNA, 18 nt, Human
cagggcaugccccggcca

SEQ ID NO: 2867328 - RNA, 21 nt, Human
cagggcaugccccggccaccu

SEQ ID NO: 2867329 - RNA, 22 nt, Human
cagggcagugcuagugagcugg

SEQ ID NO: 2867330 - RNA, 13 nt, Human
cagggcagguggg

SEQ ID NO: 2867331 - RNA, 16 nt, Human
cagggccaugccugcc

SEQ ID NO: 2867332 - RNA, 17 nt, Human
cagggccaugccugccc

SEQ ID NO: 2867333 - RNA, 15 nt, Human
cagggccaguggggc

SEQ ID NO: 2867334 - RNA, 16 nt, Human
cagggccaguggggcc

SEQ ID NO: 2867335 - RNA, 17 nt, Human
cagggccaguggggccu

SEQ ID NO: 2867336 - RNA, 18 nt, Human
cagggccaguggggccug

SEQ ID NO: 2867337 - RNA, 19 nt, Human
cagggccaguggggccugu

SEQ ID NO: 2867338 - RNA, 20 nt, Human
cagggccaguggggccugug

SEQ ID NO: 2867339 - RNA, 21 nt, Human
cagggccaguggggccugugg

SEQ ID NO: 2867340 - RNA, 22 nt, Human
cagggccaguggggccugugga

SEQ ID NO: 2867341 - RNA, 19 nt, Human
cagggccagggcccugcag

SEQ ID NO: 2867342 - RNA, 18 nt, Human
cagggccagggcccugca

SEQ ID NO: 2867343 - RNA, 16 nt, Human
cagggccagggcccug

SEQ ID NO: 2867344 - RNA, 15 nt, Human
cagggccagggcccu

SEQ ID NO: 2867345 - RNA, 13 nt, Human
cagggccagggcc

SEQ ID NO: 2867346 - RNA, 12 nt, Human
cagggccagggc

SEQ ID NO: 2867347 - RNA, 14 nt, Human
cagggccaggacug

SEQ ID NO: 2867348 - RNA, 15 nt, Human
cagggccaggacuga

SEQ ID NO: 2867349 - RNA, 18 nt, Human
cagggccaggacugagcc

SEQ ID NO: 2867350 - RNA, 20 nt, Human
cagggccaggacugagcccc

SEQ ID NO: 2867351 - RNA, 17 nt, Human
cagggccaacuugaggg

SEQ ID NO: 2867352 - RNA, 19 nt, Human
cagggccaacuugagggcc

SEQ ID NO: 2867353 - RNA, 22 nt, Human
cagggccaacuugagggcccag

SEQ ID NO: 2867354 - RNA, 16 nt, Human
cagggccaauccccag

SEQ ID NO: 2867355 - RNA, 12 nt, Human
cagggccaggac

SEQ ID NO: 2867356 - RNA, 13 nt, Human
cagggccaggacu

SEQ ID NO: 2867357 - RNA, 14 nt, Human
cagggcccugcaga

SEQ ID NO: 2867358 - RNA, 13 nt, Human
cagggcccugcag

SEQ ID NO: 2867359 - RNA, 23 nt, Human
cagggccgaccagaggagccuuu

SEQ ID NO: 2867360 - RNA, 14 nt, Human
cagggccgaggagg

SEQ ID NO: 2867361 - RNA, 22 nt, Human
cagggccgaggaggugccugga

SEQ ID NO: 2867362 - RNA, 14 nt, Human
cagggccgaccaga

SEQ ID NO: 2867363 - RNA, 18 nt, Human
cagggcccugcagagggg

SEQ ID NO: 2867364 - RNA, 15 nt, Human
cagggcccugcagag

SEQ ID NO: 2867365 - RNA, 12 nt, Human
cagggccuggaa

SEQ ID NO: 2867366 - RNA, 22 nt, Human
cagggccugcaggaccugccug

SEQ ID NO: 2867367 - RNA, 22 nt, Human
cagggccugagccuggccagcc

SEQ ID NO: 2867368 - RNA, 21 nt, Human
cagggccugagccuggccagc

SEQ ID NO: 2867369 - RNA, 20 nt, Human
cagggccugagccuggccag

SEQ ID NO: 2867370 - RNA, 19 nt, Human
cagggccugagccuggcca

SEQ ID NO: 2867371 - RNA, 18 nt, Human
cagggccugagccuggcc

SEQ ID NO: 2867372 - RNA, 17 nt, Human
cagggccugagccuggc

SEQ ID NO: 2867373 - RNA, 16 nt, Human
cagggccugagccugg

SEQ ID NO: 2867374 - RNA, 23 nt, Human
cagggccucccgcaucaagguca

SEQ ID NO: 2867375 - RNA, 16 nt, Human
cagggccucacacggu

SEQ ID NO: 2867376 - RNA, 12 nt, Human
cagggcccagag

SEQ ID NO: 2867377 - RNA, 13 nt, Human
cagggcccagagg

SEQ ID NO: 2867378 - RNA, 16 nt, Human
cagggcccagaggcug

SEQ ID NO: 2867379 - RNA, 17 nt, Human
cagggcccagaggcuga

SEQ ID NO: 2867380 - RNA, 17 nt, Human
cagggacagagccaugc

SEQ ID NO: 2867381 - RNA, 16 nt, Human
cagggaccacacccug

SEQ ID NO: 2867382 - RNA, 22 nt, Human
cagggaccacacccuguacugu

SEQ ID NO: 2867383 - RNA, 12 nt, Human
cagggacaggau

SEQ ID NO: 2867384 - RNA, 19 nt, Human
cagggacgaagaagagcca

SEQ ID NO: 2867385 - RNA, 22 nt, Human
cagggacgaagaagagccacag

SEQ ID NO: 2867386 - RNA, 23 nt, Human
cagggacgaagaagagccacagu

SEQ ID NO: 2867387 - RNA, 23 nt, Human
cagggacugaaaaccucuccuca

SEQ ID NO: 2867388 - RNA, 21 nt, Human
cagggacugaaaaccucuccu

SEQ ID NO: 2867389 - RNA, 20 nt, Human
cagggacugaaaaccucucc

SEQ ID NO: 2867390 - RNA, 14 nt, Human
cagggcacaccggg

SEQ ID NO: 2867391 - RNA, 17 nt, Human
cagggcaaucaauguuc

SEQ ID NO: 2867392 - RNA, 18 nt, Human
cagggcaaugaugaauga

SEQ ID NO: 2867393 - RNA, 14 nt, Human
cagggcaaaugaca

SEQ ID NO: 2867394 - RNA, 20 nt, Human
cagggcaaaugacaugcacu

SEQ ID NO: 2867395 - RNA, 21 nt, Human
cagggcaaaugacaugcacug

SEQ ID NO: 2867396 - RNA, 22 nt, Human
cagggcaaaugacaugcacuga

SEQ ID NO: 2867397 - RNA, 23 nt, Human
cagggcaaaugacaugcacugac

SEQ ID NO: 2867398 - RNA, 15 nt, Human
cagggcaaaauauuc

SEQ ID NO: 2867399 - RNA, 21 nt, Human
cagggcaaaauauucacuggg

SEQ ID NO: 2867400 - RNA, 23 nt, Human
cagggcaaaauauucacugggcc

SEQ ID NO: 2867401 - RNA, 16 nt, Human
cagggauugcugccac

SEQ ID NO: 2867402 - RNA, 18 nt, Human
cagggauguacaaggcga

SEQ ID NO: 2867403 - RNA, 21 nt, Human
cagggauguagauuaagguga

SEQ ID NO: 2867404 - RNA, 21 nt, Human
cagggcacaccgggcacucag

SEQ ID NO: 2867405 - RNA, 19 nt, Human
cagggcacaccgggcacuc

SEQ ID NO: 2867406 - RNA, 17 nt, Human
cagggcacaccgggcac

SEQ ID NO: 2867407 - RNA, 15 nt, Human
cagggcacaccgggc

SEQ ID NO: 2867408 - RNA, 23 nt, Human
cagggcacaccgggcacucagaa

SEQ ID NO: 2867409 - RNA, 22 nt, Human
cagggcacaccgggcacucaga

SEQ ID NO: 2867410 - RNA, 21 nt, Human
cagggcagccucccccggcuc

SEQ ID NO: 2867411 - RNA, 12 nt, Human
cagggcagcccc

SEQ ID NO: 2867412 - RNA, 21 nt, Human
cagggcacccuguggcccugg

SEQ ID NO: 2867413 - RNA, 22 nt, Human
cagggcacccuguggcccuggc

SEQ ID NO: 2867414 - RNA, 15 nt, Human
cagggcagagccggg

SEQ ID NO: 2867415 - RNA, 12 nt, Human
cagggcagagcc

SEQ ID NO: 2867416 - RNA, 16 nt, Human
cagggcagagccggga

SEQ ID NO: 2867417 - RNA, 15 nt, Human
cagggacagagccau

SEQ ID NO: 2867418 - RNA, 16 nt, Human
cagggacagagccaug

SEQ ID NO: 2867419 - RNA, 23 nt, Human
cagggaauuucaggaacuagaga

SEQ ID NO: 2867420 - RNA, 14 nt, Human
cagggaauuucuau

SEQ ID NO: 2867421 - RNA, 16 nt, Human
cagggaauuucuaucu

SEQ ID NO: 2867422 - RNA, 13 nt, Human
cagggacagagcc

SEQ ID NO: 2867423 - RNA, 14 nt, Human
cagggacagagcca

SEQ ID NO: 2867424 - RNA, 14 nt, Human
cagggaauccaagc

SEQ ID NO: 2867425 - RNA, 15 nt, Human
cagggaaguggggag

SEQ ID NO: 2867426 - RNA, 21 nt, Human
cagggaaguggggagaggugg

SEQ ID NO: 2867427 - RNA, 23 nt, Human
cagggaauccaagccuccacagc

SEQ ID NO: 2867428 - RNA, 23 nt, Human
cagggaaugccugagugccuggc

SEQ ID NO: 2867429 - RNA, 18 nt, Human
cagggaauccaagccucc

SEQ ID NO: 2867430 - RNA, 18 nt, Human
cagggaagggggagcugg

SEQ ID NO: 2867431 - RNA, 23 nt, Human
cagggaaggccugacuucugcug

SEQ ID NO: 2867432 - RNA, 21 nt, Human
cagggaagggacugggagggg

SEQ ID NO: 2867433 - RNA, 16 nt, Human
cagggaaggccugacu

SEQ ID NO: 2867434 - RNA, 17 nt, Human
cagggaaggggacaagg

SEQ ID NO: 2867435 - RNA, 15 nt, Human
cagggaaggggacaa

SEQ ID NO: 2867436 - RNA, 15 nt, Human
cagggaaggccugac

SEQ ID NO: 2867437 - RNA, 13 nt, Human
cagggaagcuggc

SEQ ID NO: 2867438 - RNA, 17 nt, Human
cagggaagcuggccgag

SEQ ID NO: 2867439 - RNA, 14 nt, Human
cagggaagcuggcc

SEQ ID NO: 2867440 - RNA, 22 nt, Human
cagggaaacagcuaaugggaca

SEQ ID NO: 2867441 - RNA, 16 nt, Human
cagggaaacagcuaau

SEQ ID NO: 2867442 - RNA, 21 nt, Human
cagggaaaagcagcucucccc

SEQ ID NO: 2867443 - RNA, 20 nt, Human
cagggaaaagcagcucuccc

SEQ ID NO: 2867444 - RNA, 19 nt, Human
cagggaaaagcagcucucc

SEQ ID NO: 2867445 - RNA, 17 nt, Human
cagggaaaagcagcucu

SEQ ID NO: 2867446 - RNA, 22 nt, Human
cagggaagagcagaacggagcc

SEQ ID NO: 2867447 - RNA, 15 nt, Human
cagggaagagcagaa

SEQ ID NO: 2867448 - RNA, 17 nt, Human
cagggaagagcagaacg

SEQ ID NO: 2867449 - RNA, 13 nt, Human
cagggaacaguau

SEQ ID NO: 2867450 - RNA, 15 nt, Human
caggcccccaccacu

SEQ ID NO: 2867451 - RNA, 13 nt, Human
caggcccccacca

SEQ ID NO: 2867452 - RNA, 16 nt, Human
caggcccccaccacac

SEQ ID NO: 2867453 - RNA, 17 nt, Human
caggcccccaccacaca

SEQ ID NO: 2867454 - RNA, 18 nt, Human
caggcccccaccacacau

SEQ ID NO: 2867455 - RNA, 19 nt, Human
caggcccccaccacacauc

SEQ ID NO: 2867456 - RNA, 20 nt, Human
caggcccccaccacacaucc

SEQ ID NO: 2867457 - RNA, 21 nt, Human
caggcccccaccacacauccc

SEQ ID NO: 2867458 - RNA, 22 nt, Human
caggcccccaccacacauccca

SEQ ID NO: 2867459 - RNA, 23 nt, Human
caggcccccaccacacaucccag

SEQ ID NO: 2867460 - RNA, 13 nt, Human
caggccccugcca

SEQ ID NO: 2867461 - RNA, 16 nt, Human
caggccauucugccgc

SEQ ID NO: 2867462 - RNA, 15 nt, Human
caggcccaacuguga

SEQ ID NO: 2867463 - RNA, 22 nt, Human
caggcccaacugugagcaagga

SEQ ID NO: 2867464 - RNA, 21 nt, Human
caggccauuccccgucucugg

SEQ ID NO: 2867465 - RNA, 13 nt, Human
caggcccacucag

SEQ ID NO: 2867466 - RNA, 14 nt, Human
caggcccacucagg

SEQ ID NO: 2867467 - RNA, 13 nt, Human
caggcaugugcca

SEQ ID NO: 2867468 - RNA, 16 nt, Human
caggccaggugcagug

SEQ ID NO: 2867469 - RNA, 15 nt, Human
caggccaggugcagu

SEQ ID NO: 2867470 - RNA, 23 nt, Human
caggccaccauauucagugcugu

SEQ ID NO: 2867471 - RNA, 21 nt, Human
caggccaucaucaguggagcc

SEQ ID NO: 2867472 - RNA, 18 nt, Human
caggccauuccccgucuc

SEQ ID NO: 2867473 - RNA, 23 nt, Human
caggccaagagcagaggcagcga

SEQ ID NO: 2867474 - RNA, 19 nt, Human
caggccaaggccuucuccu

SEQ ID NO: 2867475 - RNA, 15 nt, Human
caggccaaggucuga

SEQ ID NO: 2867476 - RNA, 19 nt, Human
caggccaaggucugagcca

SEQ ID NO: 2867477 - RNA, 20 nt, Human
caggccaaggucugagccac

SEQ ID NO: 2867478 - RNA, 18 nt, Human
caggccaaguuaaaggcu

SEQ ID NO: 2867479 - RNA, 21 nt, Human
caggccaagagcagaggcagc

SEQ ID NO: 2867480 - RNA, 19 nt, Human
caggccaagagcagaggca

SEQ ID NO: 2867481 - RNA, 21 nt, Human
caggcauuugacugaagaugc

SEQ ID NO: 2867482 - RNA, 23 nt, Human
caggcauuugacugaagaugcag

SEQ ID NO: 2867483 - RNA, 13 nt, Human
caggcauuuguuc

SEQ ID NO: 2867484 - RNA, 18 nt, Human
caggcauuugacugaaga

SEQ ID NO: 2867485 - RNA, 18 nt, Human
caggccaagagcagaggc

SEQ ID NO: 2867486 - RNA, 17 nt, Human
caggccaagaaacgucu

SEQ ID NO: 2867487 - RNA, 20 nt, Human
caggccccugccacccuggg

SEQ ID NO: 2867488 - RNA, 19 nt, Human
caggccccugccacccugg

SEQ ID NO: 2867489 - RNA, 17 nt, Human
caggccccugccacccu

SEQ ID NO: 2867490 - RNA, 15 nt, Human
caggccccugccacc

SEQ ID NO: 2867491 - RNA, 15 nt, Human
caggcccggcuccag

SEQ ID NO: 2867492 - RNA, 14 nt, Human
caggcccggcucca

SEQ ID NO: 2867493 - RNA, 13 nt, Human
caggcccggcucc

SEQ ID NO: 2867494 - RNA, 18 nt, Human
caggcaaaauccuugcuu

SEQ ID NO: 2867495 - RNA, 14 nt, Human
caggcaaaauccuu

SEQ ID NO: 2867496 - RNA, 16 nt, Human
caggcaaagcaaguga

SEQ ID NO: 2867497 - RNA, 22 nt, Human
caggauuugaacucagaucugu

SEQ ID NO: 2867498 - RNA, 14 nt, Human
caggauuugcacag

SEQ ID NO: 2867499 - RNA, 12 nt, Human
caggauuucuaa

SEQ ID NO: 2867500 - RNA, 21 nt, Human
caggauuugaacucagaucug

SEQ ID NO: 2867501 - RNA, 22 nt, Human
caggauuugcacagaagcacau

SEQ ID NO: 2867502 - RNA, 17 nt, Human
caggauuugcugggaga

SEQ ID NO: 2867503 - RNA, 19 nt, Human
caggauuuguucucugucc

SEQ ID NO: 2867504 - RNA, 20 nt, Human
caggauuuguucucugucca

SEQ ID NO: 2867505 - RNA, 16 nt, Human
caggauuugcacagaa

SEQ ID NO: 2867506 - RNA, 15 nt, Human
caggauuugcacaga

SEQ ID NO: 2867507 - RNA, 15 nt, Human
caggauuuaaaaacu

SEQ ID NO: 2867508 - RNA, 18 nt, Human
caggauuuaaaaacugga

SEQ ID NO: 2867509 - RNA, 19 nt, Human
caggauuuaaaaacuggaa

SEQ ID NO: 2867510 - RNA, 20 nt, Human
caggauuuaaaaacuggaac

SEQ ID NO: 2867511 - RNA, 17 nt, Human
caggcaacuucaguccu

SEQ ID NO: 2867512 - RNA, 19 nt, Human
caggcaacuucaguccugg

SEQ ID NO: 2867513 - RNA, 20 nt, Human
caggcaacuucaguccuggg

SEQ ID NO: 2867514 - RNA, 21 nt, Human
caggcaacuucaguccuggga

SEQ ID NO: 2867515 - RNA, 22 nt, Human
caggcaacuucaguccugggag

SEQ ID NO: 2867516 - RNA, 21 nt, Human
caggcaagcaccuccugccuc

SEQ ID NO: 2867517 - RNA, 16 nt, Human
caggcaagcaccuccu

SEQ ID NO: 2867518 - RNA, 15 nt, Human
caggcaagcaccucc

SEQ ID NO: 2867519 - RNA, 14 nt, Human
caggcaagcaccuc

SEQ ID NO: 2867520 - RNA, 13 nt, Human
caggcagguccag

SEQ ID NO: 2867521 - RNA, 19 nt, Human
caggcaggaagggcaggaa

SEQ ID NO: 2867522 - RNA, 20 nt, Human
caggcaggcuaaggcgugga

SEQ ID NO: 2867523 - RNA, 23 nt, Human
caggcaggcuaaggcguggagcu

SEQ ID NO: 2867524 - RNA, 21 nt, Human
caggcaggccaaggccuucuc

SEQ ID NO: 2867525 - RNA, 12 nt, Human
caggcagcccua

SEQ ID NO: 2867526 - RNA, 14 nt, Human
caggcagcuuucua

SEQ ID NO: 2867527 - RNA, 17 nt, Human
caggcagcuuucuagaa

SEQ ID NO: 2867528 - RNA, 18 nt, Human
caggcagcuuucuagaag

SEQ ID NO: 2867529 - RNA, 12 nt, Human
caggcagcgaug

SEQ ID NO: 2867530 - RNA, 21 nt, Human
caggcagcgauggucucagaa

SEQ ID NO: 2867531 - RNA, 13 nt, Human
caggcagcgccaa

SEQ ID NO: 2867532 - RNA, 18 nt, Human
caggcagcgauggucuca

SEQ ID NO: 2867533 - RNA, 19 nt, Human
caggcagcgccaagugcgu

SEQ ID NO: 2867534 - RNA, 20 nt, Human
caggcagcgccaagugcgug

SEQ ID NO: 2867535 - RNA, 17 nt, Human
caggcagcggggagggg

SEQ ID NO: 2867536 - RNA, 19 nt, Human
caggcagcuuuuucucucc

SEQ ID NO: 2867537 - RNA, 22 nt, Human
caggcagcuuuuucucucccac

SEQ ID NO: 2867538 - RNA, 18 nt, Human
caggcaggaagggcagga

SEQ ID NO: 2867539 - RNA, 20 nt, Human
caggcaggaaggcugagagg

SEQ ID NO: 2867540 - RNA, 20 nt, Human
caggcauguucucugaggac

SEQ ID NO: 2867541 - RNA, 19 nt, Human
caggcauguucucugagga

SEQ ID NO: 2867542 - RNA, 18 nt, Human
caggcauguucucugagg

SEQ ID NO: 2867543 - RNA, 15 nt, Human
caggcauguucucug

SEQ ID NO: 2867544 - RNA, 14 nt, Human
caggcauugaggaa

SEQ ID NO: 2867545 - RNA, 15 nt, Human
caggcauugaggaag

SEQ ID NO: 2867546 - RNA, 20 nt, Human
caggcauugaggaagagucu

SEQ ID NO: 2867547 - RNA, 12 nt, Human
caggcaggucuu

SEQ ID NO: 2867548 - RNA, 19 nt, Human
caggcagguccaggguuug

SEQ ID NO: 2867549 - RNA, 15 nt, Human
caggcagguccaggg

SEQ ID NO: 2867550 - RNA, 14 nt, Human
caggcagguccagg

SEQ ID NO: 2867551 - RNA, 22 nt, Human
caggcaggucuugaacuccugg

SEQ ID NO: 2867552 - RNA, 13 nt, Human
caggcaggucuug

SEQ ID NO: 2867553 - RNA, 23 nt, Human
caggcaggucuugaacuccuggc

SEQ ID NO: 2867554 - RNA, 14 nt, Human
caggcauggggggu

SEQ ID NO: 2867555 - RNA, 23 nt, Human
caggcaugggugcaaggaaaauu

SEQ ID NO: 2867556 - RNA, 15 nt, Human
caggcaucugauuug

SEQ ID NO: 2867557 - RNA, 12 nt, Human
caggcaugaagu

SEQ ID NO: 2867558 - RNA, 20 nt, Human
caggcauaaaauagaguaaa

SEQ ID NO: 2867559 - RNA, 14 nt, Human
caggcaucacagcu

SEQ ID NO: 2867560 - RNA, 15 nt, Human
caggcaucacagcua

SEQ ID NO: 2867561 - RNA, 13 nt, Human
caggcagucucuc

SEQ ID NO: 2867562 - RNA, 20 nt, Human
caggcagguagccaggggga

SEQ ID NO: 2867563 - RNA, 14 nt, Human
caggcaggugccug

SEQ ID NO: 2867564 - RNA, 16 nt, Human
caggcaggugccugga

SEQ ID NO: 2867565 - RNA, 19 nt, Human
caggaugggggcuggccuc

SEQ ID NO: 2867566 - RNA, 15 nt, Human
caggaugguguuacu

SEQ ID NO: 2867567 - RNA, 21 nt, Human
caggaugguguuacugcaguu

SEQ ID NO: 2867568 - RNA, 22 nt, Human
caggaugguguuacugcaguug

SEQ ID NO: 2867569 - RNA, 15 nt, Human
caggauggccuggcc

SEQ ID NO: 2867570 - RNA, 16 nt, Human
caggauggccuggcca

SEQ ID NO: 2867571 - RNA, 18 nt, Human
caggaugggggcuggccu

SEQ ID NO: 2867572 - RNA, 17 nt, Human
caggauggccuggccag

SEQ ID NO: 2867573 - RNA, 24 nt, Human
caggauggccuggccagggccugg

SEQ ID NO: 2867574 - RNA, 21 nt, Human
caggaugggggcuggccucug

SEQ ID NO: 2867575 - RNA, 19 nt, Human
caggauguacaaggacagc

SEQ ID NO: 2867576 - RNA, 15 nt, Human
caggauucagccgga

SEQ ID NO: 2867577 - RNA, 17 nt, Human
caggauucagccggagg

SEQ ID NO: 2867578 - RNA, 13 nt, Human
caggaugcuggcc

SEQ ID NO: 2867579 - RNA, 13 nt, Human
caggaugcugggu

SEQ ID NO: 2867580 - RNA, 15 nt, Human
caggaugcugggugg

SEQ ID NO: 2867581 - RNA, 16 nt, Human
caggaugcuggguggc

SEQ ID NO: 2867582 - RNA, 18 nt, Human
caggaucaagcaugaaag

SEQ ID NO: 2867583 - RNA, 15 nt, Human
caggaugacccugcg

SEQ ID NO: 2867584 - RNA, 16 nt, Human
caggaugaccuggaua

SEQ ID NO: 2867585 - RNA, 17 nt, Human
caggaugaccuggauaa

SEQ ID NO: 2867586 - RNA, 13 nt, Human
caggaucagucug

SEQ ID NO: 2867587 - RNA, 14 nt, Human
caggaucagucuga

SEQ ID NO: 2867588 - RNA, 20 nt, Human
caggauauccuuaucagagc

SEQ ID NO: 2867589 - RNA, 21 nt, Human
caggauauccuuaucagagcu

SEQ ID NO: 2867590 - RNA, 22 nt, Human
caggauauccuuaucagagcua

SEQ ID NO: 2867591 - RNA, 12 nt, Human
caggaucagcca

SEQ ID NO: 2867592 - RNA, 15 nt, Human
caggaucaguuaacu

SEQ ID NO: 2867593 - RNA, 16 nt, Human
caggaucccaggggcc

SEQ ID NO: 2867594 - RNA, 23 nt, Human
caggaucaugguguaauaagaca

SEQ ID NO: 2867595 - RNA, 21 nt, Human
caggaucccaggggcccaagg

SEQ ID NO: 2867596 - RNA, 17 nt, Human
caggauccaagcuaagc

SEQ ID NO: 2867597 - RNA, 13 nt, Human
caggauccagccu

SEQ ID NO: 2867598 - RNA, 14 nt, Human
caggauccagccuc

SEQ ID NO: 2867599 - RNA, 15 nt, Human
caggauccagccuca

SEQ ID NO: 2867600 - RNA, 15 nt, Human
caggaucauggugua

SEQ ID NO: 2867601 - RNA, 16 nt, Human
caggaucaugguguaa

SEQ ID NO: 2867602 - RNA, 17 nt, Human
caggaucaguuaacuau

SEQ ID NO: 2867603 - RNA, 18 nt, Human
caggaucaugguguaaua

SEQ ID NO: 2867604 - RNA, 19 nt, Human
caggaucaugguguaauaa

SEQ ID NO: 2867605 - RNA, 21 nt, Human
caggaucaugguguaauaaga

SEQ ID NO: 2867606 - RNA, 22 nt, Human
caggaucaugguguaauaagac

SEQ ID NO: 2867607 - RNA, 22 nt, Human
caggaucccaggggcccaaggc

SEQ ID NO: 2867608 - RNA, 23 nt, Human
caggaucgcaagagccauguaga

SEQ ID NO: 2867609 - RNA, 20 nt, Human
caggauccucuccuuugaaa

SEQ ID NO: 2867610 - RNA, 19 nt, Human
caggaucucagaucacugc

SEQ ID NO: 2867611 - RNA, 18 nt, Human
caggauaauaaaguguuu

SEQ ID NO: 2867612 - RNA, 21 nt, Human
caggaguuugagaccagccug

SEQ ID NO: 2867613 - RNA, 18 nt, Human
caggauaaacugaaaacu

SEQ ID NO: 2867614 - RNA, 13 nt, Human
caggauagacuuu

SEQ ID NO: 2867615 - RNA, 22 nt, Human
caggaguuugaggcugcagcga

SEQ ID NO: 2867616 - RNA, 21 nt, Human
caggaguuugaggcugcagcg

SEQ ID NO: 2867617 - RNA, 20 nt, Human
caggaguuugaggcugcagc

SEQ ID NO: 2867618 - RNA, 18 nt, Human
caggaguuugaggcugca

SEQ ID NO: 2867619 - RNA, 16 nt, Human
caggaguuggaagugu

SEQ ID NO: 2867620 - RNA, 19 nt, Human
caggaguucgaggcugcag

SEQ ID NO: 2867621 - RNA, 23 nt, Human
caggaguucgagaccagccuggc

SEQ ID NO: 2867622 - RNA, 23 nt, Human
caggaguucgagaccagccuggg

SEQ ID NO: 2867623 - RNA, 18 nt, Human
caggaguucgaggcugca

SEQ ID NO: 2867624 - RNA, 22 nt, Human
caggagugggaaaacacugcca

SEQ ID NO: 2867625 - RNA, 17 nt, Human
caggaguggugcagaca

SEQ ID NO: 2867626 - RNA, 20 nt, Human
caggaguggugcagacagaa

SEQ ID NO: 2867627 - RNA, 24 nt, Human
caggaguggugcagacagaagucu

SEQ ID NO: 2867628 - RNA, 21 nt, Human
caggaguucgagaccagccug

SEQ ID NO: 2867629 - RNA, 23 nt, Human
caggaguucaauaaaugucuguu

SEQ ID NO: 2867630 - RNA, 21 nt, Human
caggaguucaauaaaugucug

SEQ ID NO: 2867631 - RNA, 24 nt, Human
caggagucccaaggaaagccccag

SEQ ID NO: 2867632 - RNA, 12 nt, Human
caggagugagca

SEQ ID NO: 2867633 - RNA, 21 nt, Human
caggagucccaaggaaagccc

SEQ ID NO: 2867634 - RNA, 19 nt, Human
caggagucccaaggaaagc

SEQ ID NO: 2867635 - RNA, 19 nt, Human
caggaguccaagaccagac

SEQ ID NO: 2867636 - RNA, 20 nt, Human
caggaguccaagaccagacu

SEQ ID NO: 2867637 - RNA, 18 nt, Human
caggagucccaaggaaag

SEQ ID NO: 2867638 - RNA, 17 nt, Human
caggagucccaaggaaa

SEQ ID NO: 2867639 - RNA, 16 nt, Human
caggagucccaaggaa

SEQ ID NO: 2867640 - RNA, 15 nt, Human
caggagucccaagga

SEQ ID NO: 2867641 - RNA, 12 nt, Human
caggagccuggc

SEQ ID NO: 2867642 - RNA, 11 nt, Human
caggagccugg

SEQ ID NO: 2867643 - RNA, 15 nt, Human
caggagccugugccu

SEQ ID NO: 2867644 - RNA, 16 nt, Human
caggagccugugccuc

SEQ ID NO: 2867645 - RNA, 13 nt, Human
caggagcgcaaga

SEQ ID NO: 2867646 - RNA, 15 nt, Human
caggagcgcaagaua

SEQ ID NO: 2867647 - RNA, 16 nt, Human
caggagcgcaagauag

SEQ ID NO: 2867648 - RNA, 18 nt, Human
caggagccccgaggccuu

SEQ ID NO: 2867649 - RNA, 16 nt, Human
caggagccccgaggcc

SEQ ID NO: 2867650 - RNA, 15 nt, Human
caggagccccgaggc

SEQ ID NO: 2867651 - RNA, 15 nt, Human
caggagcagccucag

SEQ ID NO: 2867652 - RNA, 20 nt, Human
caggagcagccucagaacaa

SEQ ID NO: 2867653 - RNA, 23 nt, Human
caggagcagccucagaacaaagu

SEQ ID NO: 2867654 - RNA, 22 nt, Human
caggagccccgaggccuucucu

SEQ ID NO: 2867655 - RNA, 20 nt, Human
caggagccccgaggccuucu

SEQ ID NO: 2867656 - RNA, 23 nt, Human
caggagccccgaggccuucucug

SEQ ID NO: 2867657 - RNA, 12 nt, Human
caggagaguaga

SEQ ID NO: 2867658 - RNA, 23 nt, Human
caggagagagaaagccaggcagg

SEQ ID NO: 2867659 - RNA, 16 nt, Human
caggagauugagaagg

SEQ ID NO: 2867660 - RNA, 17 nt, Human
caggagauugagaagga

SEQ ID NO: 2867661 - RNA, 19 nt, Human
caggagauugagaaggaga

SEQ ID NO: 2867662 - RNA, 20 nt, Human
caggagauugagaaggagag

SEQ ID NO: 2867663 - RNA, 21 nt, Human
caggagauugagaaggagaga

SEQ ID NO: 2867664 - RNA, 22 nt, Human
caggagauugagaaggagagaa

SEQ ID NO: 2867665 - RNA, 23 nt, Human
caggagauugagaaggagagaaa

SEQ ID NO: 2867666 - RNA, 23 nt, Human
caggagacacugugcuauaaauc

SEQ ID NO: 2867667 - RNA, 12 nt, Human
caggagacaucc

SEQ ID NO: 2867668 - RNA, 14 nt, Human
caggagacaggaag

SEQ ID NO: 2867669 - RNA, 13 nt, Human
caggagacgacag

SEQ ID NO: 2867670 - RNA, 15 nt, Human
caggagacaggaagg

SEQ ID NO: 2867671 - RNA, 19 nt, Human
caggagagagaaagccagg

SEQ ID NO: 2867672 - RNA, 20 nt, Human
caggagagagaaagccaggc

SEQ ID NO: 2867673 - RNA, 12 nt, Human
caggagagagaa

SEQ ID NO: 2867674 - RNA, 13 nt, Human
caggagagagaaa

SEQ ID NO: 2867675 - RNA, 14 nt, Human
caggagagagaaag

SEQ ID NO: 2867676 - RNA, 18 nt, Human
caggagagagaaagccag

SEQ ID NO: 2867677 - RNA, 19 nt, Human
caggacuuugaggcaagug

SEQ ID NO: 2867678 - RNA, 11 nt, Human
caggagaacca

SEQ ID NO: 2867679 - RNA, 17 nt, Human
caggagaaccacuacau

SEQ ID NO: 2867680 - RNA, 13 nt, Human
caggacucacagg

SEQ ID NO: 2867681 - RNA, 22 nt, Human
caggacucacagguuggaagag

SEQ ID NO: 2867682 - RNA, 16 nt, Human
caggacucagaagccu

SEQ ID NO: 2867683 - RNA, 19 nt, Human
caggacucagaagccucug

SEQ ID NO: 2867684 - RNA, 18 nt, Human
caggacucagaagccucu

SEQ ID NO: 2867685 - RNA, 21 nt, Human
caggacucagaagccucuggg

SEQ ID NO: 2867686 - RNA, 20 nt, Human
caggacucagaagccucugg

SEQ ID NO: 2867687 - RNA, 14 nt, Human
caggacucagcucc

SEQ ID NO: 2867688 - RNA, 17 nt, Human
caggacucagcucccca

SEQ ID NO: 2867689 - RNA, 18 nt, Human
caggacucagcuccccag

SEQ ID NO: 2867690 - RNA, 21 nt, Human
caggacucccuccucaccucu

SEQ ID NO: 2867691 - RNA, 20 nt, Human
caggacucccuccucaccuc

SEQ ID NO: 2867692 - RNA, 19 nt, Human
caggacucccuccucaccu

SEQ ID NO: 2867693 - RNA, 17 nt, Human
caggacucccuccucac

SEQ ID NO: 2867694 - RNA, 16 nt, Human
caggacucccuccuca

SEQ ID NO: 2867695 - RNA, 15 nt, Human
caggacucccuccuc

SEQ ID NO: 2867696 - RNA, 14 nt, Human
caggacucccuccu

SEQ ID NO: 2867697 - RNA, 13 nt, Human
caggacucccucc

SEQ ID NO: 2867698 - RNA, 19 nt, Human
caggacucagcuccccaga

SEQ ID NO: 2867699 - RNA, 20 nt, Human
caggacucagcuccccagag

SEQ ID NO: 2867700 - RNA, 21 nt, Human
caggacucagcuccccagagu

SEQ ID NO: 2867701 - RNA, 14 nt, Human
caggacugagcccc

SEQ ID NO: 2867702 - RNA, 17 nt, Human
caggacugagccccgca

SEQ ID NO: 2867703 - RNA, 18 nt, Human
caggacugagccccgcag

SEQ ID NO: 2867704 - RNA, 20 nt, Human
caggacugagccccgcagac

SEQ ID NO: 2867705 - RNA, 19 nt, Human
caggacugcaacaggcuug

SEQ ID NO: 2867706 - RNA, 14 nt, Human
caggacugugacuc

SEQ ID NO: 2867707 - RNA, 23 nt, Human
caggacucccuccucaccucugg

SEQ ID NO: 2867708 - RNA, 16 nt, Human
caggacuccuccccac

SEQ ID NO: 2867709 - RNA, 22 nt, Human
caggacucccuccucaccucug

SEQ ID NO: 2867710 - RNA, 14 nt, Human
caggacucugaccc

SEQ ID NO: 2867711 - RNA, 12 nt, Human
caggacucugac

SEQ ID NO: 2867712 - RNA, 12 nt, Human
caggacucugcc

SEQ ID NO: 2867713 - RNA, 13 nt, Human
caggacucugccu

SEQ ID NO: 2867714 - RNA, 15 nt, Human
caggacucugccucc

SEQ ID NO: 2867715 - RNA, 16 nt, Human
caggacucugccuccu

SEQ ID NO: 2867716 - RNA, 23 nt, Human
cagugauguaccaugaaacaaag

SEQ ID NO: 2867717 - RNA, 17 nt, Human
cagugaugggagaguag

SEQ ID NO: 2867718 - RNA, 15 nt, Human
cagugcccuccagga

SEQ ID NO: 2867719 - RNA, 19 nt, Human
cagugcccucauuuuaugu

SEQ ID NO: 2867720 - RNA, 17 nt, Human
cagugcccucauuuuau

SEQ ID NO: 2867721 - RNA, 23 nt, Human
cagugagucgaggacagggaggu

SEQ ID NO: 2867722 - RNA, 22 nt, Human
cagugagucgaggacagggagg

SEQ ID NO: 2867723 - RNA, 20 nt, Human
cagugagucgaggacaggga

SEQ ID NO: 2867724 - RNA, 19 nt, Human
cagugagucgaggacaggg

SEQ ID NO: 2867725 - RNA, 14 nt, Human
cagugagugagccu

SEQ ID NO: 2867726 - RNA, 15 nt, Human
cagugagugagccug

SEQ ID NO: 2867727 - RNA, 16 nt, Human
cagugagugagccugg

SEQ ID NO: 2867728 - RNA, 17 nt, Human
cagugagugagccuggc

SEQ ID NO: 2867729 - RNA, 18 nt, Human
cagugagugagccuggcu

SEQ ID NO: 2867730 - RNA, 18 nt, Human
cagugagucucuggggca

SEQ ID NO: 2867731 - RNA, 20 nt, Human
cagugauauggcagaagaca

SEQ ID NO: 2867732 - RNA, 21 nt, Human
cagugauauggcagaagacac

SEQ ID NO: 2867733 - RNA, 22 nt, Human
cagugauauggcagaagacacc

SEQ ID NO: 2867734 - RNA, 23 nt, Human
cagugauauggcagaagacacca

SEQ ID NO: 2867735 - RNA, 19 nt, Human
cagugagugagccuggcuc

SEQ ID NO: 2867736 - RNA, 20 nt, Human
cagugagugagccuggcucu

SEQ ID NO: 2867737 - RNA, 21 nt, Human
cagugagugagccuggcucuu

SEQ ID NO: 2867738 - RNA, 15 nt, Human
cagugauauggcaga

SEQ ID NO: 2867739 - RNA, 18 nt, Human
cagugauauggcagaaga

SEQ ID NO: 2867740 - RNA, 21 nt, Human
cagugccuggauccccucugu

SEQ ID NO: 2867741 - RNA, 15 nt, Human
cagucuugcagcagg

SEQ ID NO: 2867742 - RNA, 19 nt, Human
cagucuugccuuacacaaa

SEQ ID NO: 2867743 - RNA, 16 nt, Human
cagucuuggcucacug

SEQ ID NO: 2867744 - RNA, 13 nt, Human
cagucuugugcuu

SEQ ID NO: 2867745 - RNA, 17 nt, Human
cagucuuuaaaggccca

SEQ ID NO: 2867746 - RNA, 18 nt, Human
cagucuuuaaaggcccag

SEQ ID NO: 2867747 - RNA, 19 nt, Human
cagucuuuaaaggcccagc

SEQ ID NO: 2867748 - RNA, 20 nt, Human
cagucuuuaaaggcccagcc

SEQ ID NO: 2867749 - RNA, 21 nt, Human
cagucuuuaaaggcccagccc

SEQ ID NO: 2867750 - RNA, 22 nt, Human
cagucuuuaaaggcccagcccc

SEQ ID NO: 2867751 - RNA, 23 nt, Human
cagucuuuaaaggcccagccccu

SEQ ID NO: 2867752 - RNA, 14 nt, Human
cagucuugcagcag

SEQ ID NO: 2867753 - RNA, 12 nt, Human
cagucuuuuucu

SEQ ID NO: 2867754 - RNA, 14 nt, Human
cagucuuuuucugu

SEQ ID NO: 2867755 - RNA, 16 nt, Human
cagucuuuuucuguug

SEQ ID NO: 2867756 - RNA, 18 nt, Human
cagucuuuuucuguugua

SEQ ID NO: 2867757 - RNA, 19 nt, Human
cagucuuuuucuguuguaa

SEQ ID NO: 2867758 - RNA, 20 nt, Human
cagucuuuuucuguuguaac

SEQ ID NO: 2867759 - RNA, 21 nt, Human
cagucuuuuucuguuguaacu

SEQ ID NO: 2867760 - RNA, 18 nt, Human
cagucuuucaugugugcc

SEQ ID NO: 2867761 - RNA, 19 nt, Human
cagucuggaaugcaguggu

SEQ ID NO: 2867762 - RNA, 12 nt, Human
caguccuuccac

SEQ ID NO: 2867763 - RNA, 15 nt, Human
caguccuuaaaaauc

SEQ ID NO: 2867764 - RNA, 16 nt, Human
caguccuuaaaaauca

SEQ ID NO: 2867765 - RNA, 11 nt, Human
cagucugucuu

SEQ ID NO: 2867766 - RNA, 14 nt, Human
cagucugucuucug

SEQ ID NO: 2867767 - RNA, 17 nt, Human
cagucugucuucuguau

SEQ ID NO: 2867768 - RNA, 21 nt, Human
cagucugucuucuguauauaa

SEQ ID NO: 2867769 - RNA, 22 nt, Human
cagucugucuucuguauauaaa

SEQ ID NO: 2867770 - RNA, 23 nt, Human
cagucugucuucuguauauaaau

SEQ ID NO: 2867771 - RNA, 23 nt, Human
cagucuugaauuucuaaaaaaca

SEQ ID NO: 2867772 - RNA, 22 nt, Human
cagucuugaauuucuaaaaaac

SEQ ID NO: 2867773 - RNA, 15 nt, Human
cagucuugaauuucu

SEQ ID NO: 2867774 - RNA, 21 nt, Human
caguccucucccaaguccaca

SEQ ID NO: 2867775 - RNA, 23 nt, Human
caguccuccccucacagccucug

SEQ ID NO: 2867776 - RNA, 20 nt, Human
caguccuccgguugcauacu

SEQ ID NO: 2867777 - RNA, 22 nt, Human
caguccuccccucacagccucu

SEQ ID NO: 2867778 - RNA, 12 nt, Human
caguccuccccu

SEQ ID NO: 2867779 - RNA, 13 nt, Human
caguccuccccuc

SEQ ID NO: 2867780 - RNA, 14 nt, Human
caguccuccccuca

SEQ ID NO: 2867781 - RNA, 15 nt, Human
caguccuccccucac

SEQ ID NO: 2867782 - RNA, 18 nt, Human
caguccuccccucacagc

SEQ ID NO: 2867783 - RNA, 19 nt, Human
caguccuccccucacagcc

SEQ ID NO: 2867784 - RNA, 20 nt, Human
caguccuccccucacagccu

SEQ ID NO: 2867785 - RNA, 21 nt, Human
caguccuccccucacagccuc

SEQ ID NO: 2867786 - RNA, 21 nt, Human
caguccugccuggccaggcag

SEQ ID NO: 2867787 - RNA, 13 nt, Human
caguccugcucca

SEQ ID NO: 2867788 - RNA, 14 nt, Human
caguccugcuccag

SEQ ID NO: 2867789 - RNA, 15 nt, Human
caguccugcuccaga

SEQ ID NO: 2867790 - RNA, 16 nt, Human
caguccugcuccagaa

SEQ ID NO: 2867791 - RNA, 17 nt, Human
caguccugccuggccag

SEQ ID NO: 2867792 - RNA, 16 nt, Human
caguccugccuggcca

SEQ ID NO: 2867793 - RNA, 18 nt, Human
caguccugccuggccagg

SEQ ID NO: 2867794 - RNA, 23 nt, Human
caguccuggagcaaucacagaug

SEQ ID NO: 2867795 - RNA, 15 nt, Human
caguccugccuggcc

SEQ ID NO: 2867796 - RNA, 14 nt, Human
caguccugccuggc

SEQ ID NO: 2867797 - RNA, 13 nt, Human
caguccugccugg

SEQ ID NO: 2867798 - RNA, 12 nt, Human
caguccugccug

SEQ ID NO: 2867799 - RNA, 19 nt, Human
caguccugccucagccucc

SEQ ID NO: 2867800 - RNA, 17 nt, Human
caguccugccucagccu

SEQ ID NO: 2867801 - RNA, 23 nt, Human
caguccugggagaaccucaggcu

SEQ ID NO: 2867802 - RNA, 14 nt, Human
caguccuguaguuu

SEQ ID NO: 2867803 - RNA, 16 nt, Human
caguccuguaguuuua

SEQ ID NO: 2867804 - RNA, 17 nt, Human
caguccuguaguuuuau

SEQ ID NO: 2867805 - RNA, 18 nt, Human
caguccuguaguuuuauu

SEQ ID NO: 2867806 - RNA, 22 nt, Human
caguccugggagaaccucaggc

SEQ ID NO: 2867807 - RNA, 21 nt, Human
caguccugggagaaccucagg

SEQ ID NO: 2867808 - RNA, 13 nt, Human
caguccugggaga

SEQ ID NO: 2867809 - RNA, 12 nt, Human
caguccugggag

SEQ ID NO: 2867810 - RNA, 18 nt, Human
cagucuggaaugcagugg

SEQ ID NO: 2867811 - RNA, 18 nt, Human
cagugagauuacagagga

SEQ ID NO: 2867812 - RNA, 19 nt, Human
cagugagauuacagaggaa

SEQ ID NO: 2867813 - RNA, 20 nt, Human
cagugagauuacagaggaag

SEQ ID NO: 2867814 - RNA, 14 nt, Human
cagugagaugaggg

SEQ ID NO: 2867815 - RNA, 20 nt, Human
cagugagaugagggaugggc

SEQ ID NO: 2867816 - RNA, 21 nt, Human
cagugagaaaaagcuccuguc

SEQ ID NO: 2867817 - RNA, 22 nt, Human
cagugagaaaaagcuccugucc

SEQ ID NO: 2867818 - RNA, 14 nt, Human
cagugagaaaaagc

SEQ ID NO: 2867819 - RNA, 19 nt, Human
cagugagaaaaagcuccug

SEQ ID NO: 2867820 - RNA, 20 nt, Human
cagugagaaaaagcuccugu

SEQ ID NO: 2867821 - RNA, 22 nt, Human
cagugacgugcaccuguacuca

SEQ ID NO: 2867822 - RNA, 18 nt, Human
cagugacgugcaccugua

SEQ ID NO: 2867823 - RNA, 17 nt, Human
cagugacgugcaccugu

SEQ ID NO: 2867824 - RNA, 24 nt, Human
cagugacccuucccaaucagcacu

SEQ ID NO: 2867825 - RNA, 19 nt, Human
cagugaccugcuggguaaa

SEQ ID NO: 2867826 - RNA, 16 nt, Human
cagugacgugcaccug

SEQ ID NO: 2867827 - RNA, 12 nt, Human
cagugaauucuu

SEQ ID NO: 2867828 - RNA, 14 nt, Human
cagugacaaaccau

SEQ ID NO: 2867829 - RNA, 18 nt, Human
cagugagucgaggacagg

SEQ ID NO: 2867830 - RNA, 17 nt, Human
cagugagucgaggacag

SEQ ID NO: 2867831 - RNA, 23 nt, Human
cagugagggguauaucugggcug

SEQ ID NO: 2867832 - RNA, 12 nt, Human
cagugagccuga

SEQ ID NO: 2867833 - RNA, 24 nt, Human
cagugcgcgugcacguggagagcu

SEQ ID NO: 2867834 - RNA, 16 nt, Human
cagugcuagugagcug

SEQ ID NO: 2867835 - RNA, 19 nt, Human
cagugcuagugagcugggc

SEQ ID NO: 2867836 - RNA, 21 nt, Human
cagugcuagugagcugggcau

SEQ ID NO: 2867837 - RNA, 15 nt, Human
caguaugauuuauaa

SEQ ID NO: 2867838 - RNA, 16 nt, Human
caguaugcugccccug

SEQ ID NO: 2867839 - RNA, 17 nt, Human
caguaugcuugcucuaa

SEQ ID NO: 2867840 - RNA, 23 nt, Human
caguaucuauauauguguaugua

SEQ ID NO: 2867841 - RNA, 18 nt, Human
caguaucuuugcacucca

SEQ ID NO: 2867842 - RNA, 18 nt, Human
caguaucuauauaugugu

SEQ ID NO: 2867843 - RNA, 16 nt, Human
caguaucuauauaugu

SEQ ID NO: 2867844 - RNA, 19 nt, Human
caguaucuauauaugugua

SEQ ID NO: 2867845 - RNA, 20 nt, Human
caguaucuauauauguguau

SEQ ID NO: 2867846 - RNA, 21 nt, Human
caguaucuauauauguguaug

SEQ ID NO: 2867847 - RNA, 22 nt, Human
caguaucuauauauguguaugu

SEQ ID NO: 2867848 - RNA, 15 nt, Human
caguaucccacaucc

SEQ ID NO: 2867849 - RNA, 14 nt, Human
caguaucccacauc

SEQ ID NO: 2867850 - RNA, 13 nt, Human
caguaucccacau

SEQ ID NO: 2867851 - RNA, 12 nt, Human
caguaucccaca

SEQ ID NO: 2867852 - RNA, 16 nt, Human
caguaucccacaucca

SEQ ID NO: 2867853 - RNA, 16 nt, Human
caguauccacuuugca

SEQ ID NO: 2867854 - RNA, 24 nt, Human
caguauccaugcucuugaccuugu

SEQ ID NO: 2867855 - RNA, 14 nt, Human
caguauauuuaaac

SEQ ID NO: 2867856 - RNA, 15 nt, Human
caguauauuuaaacu

SEQ ID NO: 2867857 - RNA, 16 nt, Human
caguauauuuaaacuc

SEQ ID NO: 2867858 - RNA, 23 nt, Human
caguagucuugaugaccaaaguc

SEQ ID NO: 2867859 - RNA, 22 nt, Human
caguaggggcuuauaauaaagg

SEQ ID NO: 2867860 - RNA, 22 nt, Human
caguaggugacacuauaguuua

SEQ ID NO: 2867861 - RNA, 17 nt, Human
caguaggauaagccacu

SEQ ID NO: 2867862 - RNA, 13 nt, Human
caguaggccggug

SEQ ID NO: 2867863 - RNA, 19 nt, Human
caguaggggcuuauaauaa

SEQ ID NO: 2867864 - RNA, 12 nt, Human
caguaggggagg

SEQ ID NO: 2867865 - RNA, 15 nt, Human
caguagagccagcuu

SEQ ID NO: 2867866 - RNA, 14 nt, Human
caguagagccagcu

SEQ ID NO: 2867867 - RNA, 13 nt, Human
caguagagccagc

SEQ ID NO: 2867868 - RNA, 12 nt, Human
caguagagccag

SEQ ID NO: 2867869 - RNA, 17 nt, Human
caguagagccagcuugg

SEQ ID NO: 2867870 - RNA, 16 nt, Human
caguagagccagcuug

SEQ ID NO: 2867871 - RNA, 23 nt, Human
caguagaggcuauggacagggca

SEQ ID NO: 2867872 - RNA, 18 nt, Human
caguagaaauaauaugca

SEQ ID NO: 2867873 - RNA, 19 nt, Human
caguagaaauaauaugcau

SEQ ID NO: 2867874 - RNA, 12 nt, Human
caguagacaagc

SEQ ID NO: 2867875 - RNA, 12 nt, Human
caguagacauuu

SEQ ID NO: 2867876 - RNA, 15 nt, Human
caguagacauuuuaa

SEQ ID NO: 2867877 - RNA, 16 nt, Human
caguagacauuuuaac

SEQ ID NO: 2867878 - RNA, 19 nt, Human
caguagacauuuuaacaag

SEQ ID NO: 2867879 - RNA, 20 nt, Human
caguagacauuuuaacaaga

SEQ ID NO: 2867880 - RNA, 21 nt, Human
caguagacauuuuaacaagaa

SEQ ID NO: 2867881 - RNA, 22 nt, Human
caguagacauuuuaacaagaag

SEQ ID NO: 2867882 - RNA, 15 nt, Human
cagucagcucuucau

SEQ ID NO: 2867883 - RNA, 18 nt, Human
cagucagcucuucaucug

SEQ ID NO: 2867884 - RNA, 22 nt, Human
cagucagcucuucaucugccca

SEQ ID NO: 2867885 - RNA, 13 nt, Human
cagucaucaucag

SEQ ID NO: 2867886 - RNA, 14 nt, Human
cagucaucaucagg

SEQ ID NO: 2867887 - RNA, 15 nt, Human
cagucaucaucaggg

SEQ ID NO: 2867888 - RNA, 16 nt, Human
cagucaucaucagggc

SEQ ID NO: 2867889 - RNA, 17 nt, Human
cagucaucaucagggcc

SEQ ID NO: 2867890 - RNA, 18 nt, Human
cagucaucaucagggccu

SEQ ID NO: 2867891 - RNA, 19 nt, Human
cagucaucaucagggccug

SEQ ID NO: 2867892 - RNA, 20 nt, Human
cagucaucaucagggccugg

SEQ ID NO: 2867893 - RNA, 22 nt, Human
cagucaucaucagggccugggg

SEQ ID NO: 2867894 - RNA, 23 nt, Human
cagucaucaucagggccuggggc

SEQ ID NO: 2867895 - RNA, 13 nt, Human
cagucaugcauaa

SEQ ID NO: 2867896 - RNA, 14 nt, Human
cagucaugcauaaa

SEQ ID NO: 2867897 - RNA, 16 nt, Human
cagucaugcauaaaua

SEQ ID NO: 2867898 - RNA, 17 nt, Human
cagucaugcauaaauau

SEQ ID NO: 2867899 - RNA, 18 nt, Human
cagucaugcauaaauaug

SEQ ID NO: 2867900 - RNA, 17 nt, Human
cagucagugcaaauguc

SEQ ID NO: 2867901 - RNA, 18 nt, Human
cagucagugcaaauguca

SEQ ID NO: 2867902 - RNA, 16 nt, Human
caguauuacuucugcu

SEQ ID NO: 2867903 - RNA, 16 nt, Human
caguaugucccauagg

SEQ ID NO: 2867904 - RNA, 15 nt, Human
caguauguuuuacac

SEQ ID NO: 2867905 - RNA, 16 nt, Human
caguauguuuuacacu

SEQ ID NO: 2867906 - RNA, 17 nt, Human
caguauguuuuacacug

SEQ ID NO: 2867907 - RNA, 18 nt, Human
caguauguuuuacacugu

SEQ ID NO: 2867908 - RNA, 20 nt, Human
caguauguuuuacacuguac

SEQ ID NO: 2867909 - RNA, 21 nt, Human
caguauggucuaacacuggca

SEQ ID NO: 2867910 - RNA, 15 nt, Human
caguauguauucuuu

SEQ ID NO: 2867911 - RNA, 17 nt, Human
caguauguauucuuuug

SEQ ID NO: 2867912 - RNA, 18 nt, Human
caguauuacuucugcuac

SEQ ID NO: 2867913 - RNA, 12 nt, Human
cagucacugcca

SEQ ID NO: 2867914 - RNA, 18 nt, Human
cagucacugccacuuugc

SEQ ID NO: 2867915 - RNA, 22 nt, Human
cagucacugccacuuugcacau

SEQ ID NO: 2867916 - RNA, 19 nt, Human
caguauuaauacuaaaaua

SEQ ID NO: 2867917 - RNA, 20 nt, Human
caguauuaauacuaaaauau

SEQ ID NO: 2867918 - RNA, 22 nt, Human
caguauuaauacuaaaauaugu

SEQ ID NO: 2867919 - RNA, 21 nt, Human
cagucacuucggccagagcug

SEQ ID NO: 2867920 - RNA, 22 nt, Human
cagucacuucggccagagcuga

SEQ ID NO: 2867921 - RNA, 23 nt, Human
cagucacuucggccagagcugaa

SEQ ID NO: 2867922 - RNA, 16 nt, Human
cagucagaaaacuuua

SEQ ID NO: 2867923 - RNA, 19 nt, Human
cagucagaaaacuuuaaaa

SEQ ID NO: 2867924 - RNA, 16 nt, Human
caguccauagcagaga

SEQ ID NO: 2867925 - RNA, 17 nt, Human
caguccagccuggagau

SEQ ID NO: 2867926 - RNA, 15 nt, Human
caguccaggaacaag

SEQ ID NO: 2867927 - RNA, 19 nt, Human
cagucccaucagagagcga

SEQ ID NO: 2867928 - RNA, 16 nt, Human
caguccagccuggaga

SEQ ID NO: 2867929 - RNA, 17 nt, Human
caguccauuuauauaug

SEQ ID NO: 2867930 - RNA, 18 nt, Human
caguccauuuauauauga

SEQ ID NO: 2867931 - RNA, 16 nt, Human
cagucccaaauccuuc

SEQ ID NO: 2867932 - RNA, 18 nt, Human
cagucccaaauccuuccc

SEQ ID NO: 2867933 - RNA, 19 nt, Human
cagucccaaauccuuccca

SEQ ID NO: 2867934 - RNA, 12 nt, Human
caguccaugcau

SEQ ID NO: 2867935 - RNA, 19 nt, Human
caguccaugcaugacagcc

SEQ ID NO: 2867936 - RNA, 23 nt, Human
caguccaugcaugacagccucua

SEQ ID NO: 2867937 - RNA, 16 nt, Human
cagucccaaugcacau

SEQ ID NO: 2867938 - RNA, 13 nt, Human
cagucccacugug

SEQ ID NO: 2867939 - RNA, 14 nt, Human
cagucccacugugc

SEQ ID NO: 2867940 - RNA, 15 nt, Human
cagucccacugugca

SEQ ID NO: 2867941 - RNA, 23 nt, Human
cagucccacugugcaggugcuau

SEQ ID NO: 2867942 - RNA, 22 nt, Human
cagucauuagacuccuccucca

SEQ ID NO: 2867943 - RNA, 24 nt, Human
cagucauggcaccaaagccaccag

SEQ ID NO: 2867944 - RNA, 18 nt, Human
cagucauuagacuccucc

SEQ ID NO: 2867945 - RNA, 22 nt, Human
cagucauguuuuaaauguacag

SEQ ID NO: 2867946 - RNA, 23 nt, Human
cagucauguuuuaaauguacagu

SEQ ID NO: 2867947 - RNA, 19 nt, Human
cagucaugcauaaauaugc

SEQ ID NO: 2867948 - RNA, 20 nt, Human
cagucaugcauaaauaugca

SEQ ID NO: 2867949 - RNA, 23 nt, Human
cagucaugcauaaauaugcagug

SEQ ID NO: 2867950 - RNA, 24 nt, Human
caguccaaggaaaccacagcugcu

SEQ ID NO: 2867951 - RNA, 13 nt, Human
caguccagccugg

SEQ ID NO: 2867952 - RNA, 14 nt, Human
caguccagccugga

SEQ ID NO: 2867953 - RNA, 15 nt, Human
caguccagccuggag

SEQ ID NO: 2867954 - RNA, 19 nt, Human
caguccaaggaaaccacag

SEQ ID NO: 2867955 - RNA, 22 nt, Human
caguccaaggaaaccacagcug

SEQ ID NO: 2867956 - RNA, 23 nt, Human
caguccaaggaaaccacagcugc

SEQ ID NO: 2867957 - RNA, 23 nt, Human
caguccaaauguccuccagaagc

SEQ ID NO: 2867958 - RNA, 22 nt, Human
caguccaaauguccuccagaag

SEQ ID NO: 2867959 - RNA, 17 nt, Human
caguccaaauguccucc

SEQ ID NO: 2867960 - RNA, 21 nt, Human
caguccaaauguccuccagaa

SEQ ID NO: 2867961 - RNA, 18 nt, Human
caguccaaauguccucca

SEQ ID NO: 2867962 - RNA, 14 nt, Human
cagucccuaaagaa

SEQ ID NO: 2867963 - RNA, 15 nt, Human
cagucccuauguauu

SEQ ID NO: 2867964 - RNA, 23 nt, Human
cagucccugagaccauuuaacau

SEQ ID NO: 2867965 - RNA, 19 nt, Human
caguccguguggauccaau

SEQ ID NO: 2867966 - RNA, 20 nt, Human
caguccguguggauccaaug

SEQ ID NO: 2867967 - RNA, 19 nt, Human
caguccccagcccuucaca

SEQ ID NO: 2867968 - RNA, 19 nt, Human
cagucccccuauccuuggc

SEQ ID NO: 2867969 - RNA, 21 nt, Human
cagucccccuauccuuggcac

SEQ ID NO: 2867970 - RNA, 22 nt, Human
cagucccccuauccuuggcacc

SEQ ID NO: 2867971 - RNA, 23 nt, Human
cagucccccuauccuuggcacca

SEQ ID NO: 2867972 - RNA, 23 nt, Human
caguccccgugaaggagagcccu

SEQ ID NO: 2867973 - RNA, 23 nt, Human
caguccccguggccaucccugug

SEQ ID NO: 2867974 - RNA, 16 nt, Human
cagucccccugcccca

SEQ ID NO: 2867975 - RNA, 17 nt, Human
cagucccccugccccag

SEQ ID NO: 2867976 - RNA, 15 nt, Human
cagggucucacucug

SEQ ID NO: 2867977 - RNA, 23 nt, Human
cagggucucacuauguugcccag

SEQ ID NO: 2867978 - RNA, 22 nt, Human
cagggucucacuauguugccca

SEQ ID NO: 2867979 - RNA, 21 nt, Human
cagggucucacuauguugccc

SEQ ID NO: 2867980 - RNA, 16 nt, Human
cagggucucacucugu

SEQ ID NO: 2867981 - RNA, 16 nt, Human
caggguuuugccaugu

SEQ ID NO: 2867982 - RNA, 13 nt, Human
caggguuuuuacc

SEQ ID NO: 2867983 - RNA, 19 nt, Human
caggguuuuuaccugucac

SEQ ID NO: 2867984 - RNA, 17 nt, Human
cagguaacaggcagaua

SEQ ID NO: 2867985 - RNA, 16 nt, Human
cagguaacaggcagau

SEQ ID NO: 2867986 - RNA, 15 nt, Human
cagguaacaggcaga

SEQ ID NO: 2867987 - RNA, 14 nt, Human
cagguaacaggcag

SEQ ID NO: 2867988 - RNA, 22 nt, Human
caggguccacaggaagugaaga

SEQ ID NO: 2867989 - RNA, 12 nt, Human
cagggucccugg

SEQ ID NO: 2867990 - RNA, 16 nt, Human
caggguauugcuugcc

SEQ ID NO: 2867991 - RNA, 18 nt, Human
caggguauugcuugccac

SEQ ID NO: 2867992 - RNA, 19 nt, Human
caggguauugcuugccacu

SEQ ID NO: 2867993 - RNA, 20 nt, Human
cagggguuauguggaagugu

SEQ ID NO: 2867994 - RNA, 21 nt, Human
caggguaacugugcugaaugc

SEQ ID NO: 2867995 - RNA, 21 nt, Human
caggggguggacaaacuggag

SEQ ID NO: 2867996 - RNA, 20 nt, Human
caggggucccagccaccccg

SEQ ID NO: 2867997 - RNA, 18 nt, Human
caggggucccagccaccc

SEQ ID NO: 2867998 - RNA, 16 nt, Human
cagggggugugucugc

SEQ ID NO: 2867999 - RNA, 16 nt, Human
caggggucacugaggc

SEQ ID NO: 2868000 - RNA, 17 nt, Human
caggggucacugaggcc

SEQ ID NO: 2868001 - RNA, 23 nt, Human
caggggucacugaggccugagac

SEQ ID NO: 2868002 - RNA, 13 nt, Human
caggggugacaca

SEQ ID NO: 2868003 - RNA, 15 nt, Human
caggggugacacaga

SEQ ID NO: 2868004 - RNA, 16 nt, Human
caggggugacacagac

SEQ ID NO: 2868005 - RNA, 17 nt, Human
caggggugacacagacu

SEQ ID NO: 2868006 - RNA, 18 nt, Human
caggggugacacagacuc

SEQ ID NO: 2868007 - RNA, 19 nt, Human
caggggugacacagacuca

SEQ ID NO: 2868008 - RNA, 23 nt, Human
caggucuugaacuccuggccuca

SEQ ID NO: 2868009 - RNA, 22 nt, Human
caggucuugaacuccuggccuc

SEQ ID NO: 2868010 - RNA, 21 nt, Human
caggucuugaacuccuggccu

SEQ ID NO: 2868011 - RNA, 20 nt, Human
caggucuugaacuccuggcc

SEQ ID NO: 2868012 - RNA, 19 nt, Human
caggucuugaacuccuggc

SEQ ID NO: 2868013 - RNA, 18 nt, Human
caggucuugaacuccugg

SEQ ID NO: 2868014 - RNA, 19 nt, Human
caggucucccacgugggag

SEQ ID NO: 2868015 - RNA, 20 nt, Human
caggucucccacgugggaga

SEQ ID NO: 2868016 - RNA, 12 nt, Human
caggucucccac

SEQ ID NO: 2868017 - RNA, 14 nt, Human
caggucucacgggc

SEQ ID NO: 2868018 - RNA, 13 nt, Human
caggucucccacg

SEQ ID NO: 2868019 - RNA, 22 nt, Human
caggucucccacgugggagaca

SEQ ID NO: 2868020 - RNA, 12 nt, Human
caggucuagacu

SEQ ID NO: 2868021 - RNA, 16 nt, Human
caggucgggcgcagga

SEQ ID NO: 2868022 - RNA, 20 nt, Human
cagguccucagagaauuucu

SEQ ID NO: 2868023 - RNA, 15 nt, Human
cagguccucagagaa

SEQ ID NO: 2868024 - RNA, 16 nt, Human
caggucccuccccuuc

SEQ ID NO: 2868025 - RNA, 17 nt, Human
caggucccaccuccagc

SEQ ID NO: 2868026 - RNA, 18 nt, Human
caggucccaccuccagcc

SEQ ID NO: 2868027 - RNA, 19 nt, Human
caggucccaccuccagccc

SEQ ID NO: 2868028 - RNA, 20 nt, Human
caggucccaccuccagcccg

SEQ ID NO: 2868029 - RNA, 23 nt, Human
caggucccaccuccagcccggga

SEQ ID NO: 2868030 - RNA, 14 nt, Human
caggucccccugca

SEQ ID NO: 2868031 - RNA, 15 nt, Human
caggucccccugcag

SEQ ID NO: 2868032 - RNA, 16 nt, Human
caggucccccugcagc

SEQ ID NO: 2868033 - RNA, 17 nt, Human
caggucccccugcagcu

SEQ ID NO: 2868034 - RNA, 18 nt, Human
caggucccccugcagcua

SEQ ID NO: 2868035 - RNA, 12 nt, Human
cagguccccuca

SEQ ID NO: 2868036 - RNA, 15 nt, Human
caggugagcccaugg

SEQ ID NO: 2868037 - RNA, 17 nt, Human
caggugagcccauggcc

SEQ ID NO: 2868038 - RNA, 14 nt, Human
caggugacauguga

SEQ ID NO: 2868039 - RNA, 16 nt, Human
caggugacaugugaaa

SEQ ID NO: 2868040 - RNA, 17 nt, Human
caggugacaugugaaac

SEQ ID NO: 2868041 - RNA, 18 nt, Human
caggugacaugugaaacc

SEQ ID NO: 2868042 - RNA, 21 nt, Human
caggugacaugugaaaccuuu

SEQ ID NO: 2868043 - RNA, 12 nt, Human
caggugacaugu

SEQ ID NO: 2868044 - RNA, 20 nt, Human
caggugaagcaccaagcuca

SEQ ID NO: 2868045 - RNA, 13 nt, Human
caggugaaaaugu

SEQ ID NO: 2868046 - RNA, 17 nt, Human
caggugaaaauguucau

SEQ ID NO: 2868047 - RNA, 20 nt, Human
caggucuucaucgaaucuac

SEQ ID NO: 2868048 - RNA, 16 nt, Human
cagguggaaggcagac

SEQ ID NO: 2868049 - RNA, 18 nt, Human
cagguggaaggcagacag

SEQ ID NO: 2868050 - RNA, 19 nt, Human
cagguggaaggcagacagc

SEQ ID NO: 2868051 - RNA, 20 nt, Human
caggugagcccauggcccuc

SEQ ID NO: 2868052 - RNA, 15 nt, Human
cagguggccacucca

SEQ ID NO: 2868053 - RNA, 22 nt, Human
cagguggcucugaggugccugu

SEQ ID NO: 2868054 - RNA, 16 nt, Human
cagguggccacuccag

SEQ ID NO: 2868055 - RNA, 19 nt, Human
cagguggccacuccagacc

SEQ ID NO: 2868056 - RNA, 21 nt, Human
cagguggccacuccagacccc

SEQ ID NO: 2868057 - RNA, 20 nt, Human
caggucaggaguucgagacc

SEQ ID NO: 2868058 - RNA, 17 nt, Human
caggucaggggugacac

SEQ ID NO: 2868059 - RNA, 18 nt, Human
caggucaggggugacaca

SEQ ID NO: 2868060 - RNA, 20 nt, Human
caggucaggggugacacaga

SEQ ID NO: 2868061 - RNA, 21 nt, Human
caggucaggggugacacagac

SEQ ID NO: 2868062 - RNA, 23 nt, Human
caggucaggggugacacagacuc

SEQ ID NO: 2868063 - RNA, 11 nt, Human
cagguauuuug

SEQ ID NO: 2868064 - RNA, 20 nt, Human
cagguauuuuguuucuuuua

SEQ ID NO: 2868065 - RNA, 12 nt, Human
caggucaacaga

SEQ ID NO: 2868066 - RNA, 13 nt, Human
caggucaacagaa

SEQ ID NO: 2868067 - RNA, 14 nt, Human
caggucaacagaau

SEQ ID NO: 2868068 - RNA, 15 nt, Human
caggucaacagaaug

SEQ ID NO: 2868069 - RNA, 16 nt, Human
caggucaacagaauga

SEQ ID NO: 2868070 - RNA, 17 nt, Human
caggucaacagaaugaa

SEQ ID NO: 2868071 - RNA, 18 nt, Human
caggucaacagaaugaaa

SEQ ID NO: 2868072 - RNA, 19 nt, Human
caggucaacagaaugaaaa

SEQ ID NO: 2868073 - RNA, 21 nt, Human
caggucaacagaaugaaaaau

SEQ ID NO: 2868074 - RNA, 22 nt, Human
caggucaacagaaugaaaaaug

SEQ ID NO: 2868075 - RNA, 23 nt, Human
caggucaacagaaugaaaaauga

SEQ ID NO: 2868076 - RNA, 16 nt, Human
cagguauguugccuuu

SEQ ID NO: 2868077 - RNA, 20 nt, Human
cagguauguugccuuuaugg

SEQ ID NO: 2868078 - RNA, 17 nt, Human
cagguauuaaucuugga

SEQ ID NO: 2868079 - RNA, 18 nt, Human
cagguauuauuaucuuua

SEQ ID NO: 2868080 - RNA, 23 nt, Human
cagguauggaaggguuuguggcu

SEQ ID NO: 2868081 - RNA, 14 nt, Human
cagguauggcucug

SEQ ID NO: 2868082 - RNA, 16 nt, Human
cagguauggcucugca

SEQ ID NO: 2868083 - RNA, 14 nt, Human
cagguauguugccu

SEQ ID NO: 2868084 - RNA, 15 nt, Human
cagguauguugccuu

SEQ ID NO: 2868085 - RNA, 21 nt, Human
cagguaacaggcagauacagg

SEQ ID NO: 2868086 - RNA, 20 nt, Human
cagguaacaggcagauacag

SEQ ID NO: 2868087 - RNA, 20 nt, Human
cagguaaucgaccugccucg

SEQ ID NO: 2868088 - RNA, 19 nt, Human
cagguaaucgaccugccuc

SEQ ID NO: 2868089 - RNA, 18 nt, Human
cagguaaucgaccugccu

SEQ ID NO: 2868090 - RNA, 17 nt, Human
cagguaaucgaccugcc

SEQ ID NO: 2868091 - RNA, 22 nt, Human
cagguaccuugaccuuuguaca

SEQ ID NO: 2868092 - RNA, 23 nt, Human
cagguaccuugaccuuuguacag

SEQ ID NO: 2868093 - RNA, 14 nt, Human
cagguacgcacaga

SEQ ID NO: 2868094 - RNA, 15 nt, Human
cagguacgcacagac

SEQ ID NO: 2868095 - RNA, 16 nt, Human
cagguacgcacagaca

SEQ ID NO: 2868096 - RNA, 17 nt, Human
cagguacgcacagacag

SEQ ID NO: 2868097 - RNA, 18 nt, Human
cagguacgcacagacagg

SEQ ID NO: 2868098 - RNA, 22 nt, Human
cagguacgcacagacagguuuu

SEQ ID NO: 2868099 - RNA, 17 nt, Human
cagguaaauuaagacau

SEQ ID NO: 2868100 - RNA, 22 nt, Human
cagguaguacuaagaguaugug

SEQ ID NO: 2868101 - RNA, 18 nt, Human
cagggucauguuugcagg

SEQ ID NO: 2868102 - RNA, 22 nt, Human
cagguagaagguugacacaguu

SEQ ID NO: 2868103 - RNA, 12 nt, Human
cagguagccagg

SEQ ID NO: 2868104 - RNA, 19 nt, Human
cagguagcugggauuacag

SEQ ID NO: 2868105 - RNA, 14 nt, Human
caguacccucucag

SEQ ID NO: 2868106 - RNA, 15 nt, Human
caguacccucucagc

SEQ ID NO: 2868107 - RNA, 16 nt, Human
caguacccucucagcu

SEQ ID NO: 2868108 - RNA, 19 nt, Human
caguacccucucagcucca

SEQ ID NO: 2868109 - RNA, 20 nt, Human
caguacccucucagcuccag

SEQ ID NO: 2868110 - RNA, 22 nt, Human
caguacccucucagcuccaggu

SEQ ID NO: 2868111 - RNA, 24 nt, Human
caguacccucucagcuccaggugg

SEQ ID NO: 2868112 - RNA, 14 nt, Human
caguacaugggaaa

SEQ ID NO: 2868113 - RNA, 15 nt, Human
caguacaugggaaag

SEQ ID NO: 2868114 - RNA, 20 nt, Human
caguaccuccugucucuggc

SEQ ID NO: 2868115 - RNA, 12 nt, Human
caguaccuccug

SEQ ID NO: 2868116 - RNA, 15 nt, Human
caguacuucagcaag

SEQ ID NO: 2868117 - RNA, 16 nt, Human
caguacuucagcaaga

SEQ ID NO: 2868118 - RNA, 18 nt, Human
caguacuucagcaagaga

SEQ ID NO: 2868119 - RNA, 19 nt, Human
caguacuucagcaagagag

SEQ ID NO: 2868120 - RNA, 20 nt, Human
caguacuucagcaagagaga

SEQ ID NO: 2868121 - RNA, 24 nt, Human
caguacuucagcaagagagaaccu

SEQ ID NO: 2868122 - RNA, 21 nt, Human
caguacuugugaaacacagcu

SEQ ID NO: 2868123 - RNA, 22 nt, Human
caguacuugugaaacacagcug

SEQ ID NO: 2868124 - RNA, 23 nt, Human
caguacuugugaaacacagcugu

SEQ ID NO: 2868125 - RNA, 13 nt, Human
caguaccuugcuu

SEQ ID NO: 2868126 - RNA, 15 nt, Human
caguacagcaugugc

SEQ ID NO: 2868127 - RNA, 17 nt, Human
caguaauuugaggacaa

SEQ ID NO: 2868128 - RNA, 12 nt, Human
caguaacacgcu

SEQ ID NO: 2868129 - RNA, 13 nt, Human
caguaauguuauu

SEQ ID NO: 2868130 - RNA, 20 nt, Human
caguaauauuuauauauuua

SEQ ID NO: 2868131 - RNA, 13 nt, Human
caguaauauuuau

SEQ ID NO: 2868132 - RNA, 23 nt, Human
caguaauaagaauggaaaagaga

SEQ ID NO: 2868133 - RNA, 17 nt, Human
caguaauagcacugcca

SEQ ID NO: 2868134 - RNA, 13 nt, Human
cagguucagcuug

SEQ ID NO: 2868135 - RNA, 16 nt, Human
cagguucaguauuaug

SEQ ID NO: 2868136 - RNA, 12 nt, Human
cagguucagcuu

SEQ ID NO: 2868137 - RNA, 24 nt, Human
cagguuaucgaaauaacaauguua

SEQ ID NO: 2868138 - RNA, 16 nt, Human
cagguucaacccacag

SEQ ID NO: 2868139 - RNA, 17 nt, Human
cagguucaacccacagc

SEQ ID NO: 2868140 - RNA, 19 nt, Human
cagguucaacccacagcua

SEQ ID NO: 2868141 - RNA, 22 nt, Human
cagguucaagcgauucuccugc

SEQ ID NO: 2868142 - RNA, 11 nt, Human
cagguuagaga

SEQ ID NO: 2868143 - RNA, 12 nt, Human
cagguuagagaa

SEQ ID NO: 2868144 - RNA, 19 nt, Human
cagguuaucgaaauaacaa

SEQ ID NO: 2868145 - RNA, 20 nt, Human
cagguuaucgaaauaacaau

SEQ ID NO: 2868146 - RNA, 23 nt, Human
cagguuaucgaaauaacaauguu

SEQ ID NO: 2868147 - RNA, 16 nt, Human
cagguuaucugggcau

SEQ ID NO: 2868148 - RNA, 14 nt, Human
caguaaauuugcua

SEQ ID NO: 2868149 - RNA, 15 nt, Human
caguaaauuugcuag

SEQ ID NO: 2868150 - RNA, 18 nt, Human
caguaacgcaggggaaac

SEQ ID NO: 2868151 - RNA, 21 nt, Human
caguaacgggucguaaugacu

SEQ ID NO: 2868152 - RNA, 22 nt, Human
caguaacgggucguaaugacuu

SEQ ID NO: 2868153 - RNA, 20 nt, Human
caguaacuuuauguguaaau

SEQ ID NO: 2868154 - RNA, 18 nt, Human
caguaacuuuauguguaa

SEQ ID NO: 2868155 - RNA, 19 nt, Human
caguaacuuuauguguaaa

SEQ ID NO: 2868156 - RNA, 16 nt, Human
caguaacuuuaugugu

SEQ ID NO: 2868157 - RNA, 17 nt, Human
caguaacuuuaugugua

SEQ ID NO: 2868158 - RNA, 14 nt, Human
caguaacuuuaugu

SEQ ID NO: 2868159 - RNA, 16 nt, Human
caggugugagucacca

SEQ ID NO: 2868160 - RNA, 13 nt, Human
caggugguuuuua

SEQ ID NO: 2868161 - RNA, 14 nt, Human
caggugucagccau

SEQ ID NO: 2868162 - RNA, 16 nt, Human
caggugucagccauug

SEQ ID NO: 2868163 - RNA, 17 nt, Human
caggugucagccauugc

SEQ ID NO: 2868164 - RNA, 18 nt, Human
caggugugagccaccacg

SEQ ID NO: 2868165 - RNA, 21 nt, Human
caggugugagucaccaagccc

SEQ ID NO: 2868166 - RNA, 20 nt, Human
caggugugagucaccaagcc

SEQ ID NO: 2868167 - RNA, 23 nt, Human
caggugugaaccaccacacccag

SEQ ID NO: 2868168 - RNA, 22 nt, Human
caggugugaaccaccacaccca

SEQ ID NO: 2868169 - RNA, 19 nt, Human
caggugugaaccaccacac

SEQ ID NO: 2868170 - RNA, 16 nt, Human
caggugugaaccacca

SEQ ID NO: 2868171 - RNA, 23 nt, Human
caggugugagucaccaagcccag

SEQ ID NO: 2868172 - RNA, 22 nt, Human
caggugugagucaccaagccca

SEQ ID NO: 2868173 - RNA, 21 nt, Human
caggugugagccaccacgccc

SEQ ID NO: 2868174 - RNA, 20 nt, Human
cagguguguccaccugggca

SEQ ID NO: 2868175 - RNA, 21 nt, Human
cagguguguccaccugggcau

SEQ ID NO: 2868176 - RNA, 17 nt, Human
cagguguuaacauucca

SEQ ID NO: 2868177 - RNA, 18 nt, Human
cagguguuaacauuccaa

SEQ ID NO: 2868178 - RNA, 18 nt, Human
caggugugccgacagaag

SEQ ID NO: 2868179 - RNA, 19 nt, Human
caggugugccgacagaagg

SEQ ID NO: 2868180 - RNA, 22 nt, Human
caggugugguggcucacaccug

SEQ ID NO: 2868181 - RNA, 20 nt, Human
caggugugguguaauuuaua

SEQ ID NO: 2868182 - RNA, 23 nt, Human
caggugugagccaccacaccugg

SEQ ID NO: 2868183 - RNA, 22 nt, Human
cagguguuacuguaauuccuca

SEQ ID NO: 2868184 - RNA, 19 nt, Human
cagguguuaacauuccaag

SEQ ID NO: 2868185 - RNA, 20 nt, Human
cagguguuaacauuccaaga

SEQ ID NO: 2868186 - RNA, 14 nt, Human
cagguguuuuucca

SEQ ID NO: 2868187 - RNA, 21 nt, Human
cagguguuuuuuaugaagugc

SEQ ID NO: 2868188 - RNA, 12 nt, Human
caggugugaacc

SEQ ID NO: 2868189 - RNA, 19 nt, Human
caggugucccugcacuugc

SEQ ID NO: 2868190 - RNA, 18 nt, Human
caggugucccugcacuug

SEQ ID NO: 2868191 - RNA, 16 nt, Human
caggugucccugcacu

SEQ ID NO: 2868192 - RNA, 15 nt, Human
caggugucccugcac

SEQ ID NO: 2868193 - RNA, 17 nt, Human
cagguggggcagcuuga

SEQ ID NO: 2868194 - RNA, 16 nt, Human
cagguggggcagcuug

SEQ ID NO: 2868195 - RNA, 15 nt, Human
cagguggggcagcuu

SEQ ID NO: 2868196 - RNA, 14 nt, Human
cagguggggcagcu

SEQ ID NO: 2868197 - RNA, 13 nt, Human
cagguggggcagc

SEQ ID NO: 2868198 - RNA, 16 nt, Human
caggugggcuucccag

SEQ ID NO: 2868199 - RNA, 19 nt, Human
caggugggcuucccagugg

SEQ ID NO: 2868200 - RNA, 22 nt, Human
caggugggcuucccaguggcug

SEQ ID NO: 2868201 - RNA, 23 nt, Human
caggugggcuucccaguggcugc

SEQ ID NO: 2868202 - RNA, 21 nt, Human
cagguggugagaaauuucugu

SEQ ID NO: 2868203 - RNA, 14 nt, Human
caggugucccugca

SEQ ID NO: 2868204 - RNA, 11 nt, Human
caggugucccu

SEQ ID NO: 2868205 - RNA, 16 nt, Human
cagguggugucacugu

SEQ ID NO: 2868206 - RNA, 18 nt, Human
cagguggugucacugucc

SEQ ID NO: 2868207 - RNA, 19 nt, Human
cagguggugucacuguccc

SEQ ID NO: 2868208 - RNA, 20 nt, Human
cagguggugucacugucccu

SEQ ID NO: 2868209 - RNA, 16 nt, Human
cauuccaacagugagu

SEQ ID NO: 2868210 - RNA, 21 nt, Human
cauuccaagaauagcaucugu

SEQ ID NO: 2868211 - RNA, 22 nt, Human
cauuccaccuucccaugcccug

SEQ ID NO: 2868212 - RNA, 17 nt, Human
cauuccaccuucccaug

SEQ ID NO: 2868213 - RNA, 14 nt, Human
cauuccaagacucu

SEQ ID NO: 2868214 - RNA, 17 nt, Human
cauuccaagacucuaga

SEQ ID NO: 2868215 - RNA, 16 nt, Human
cauuccaaagcuuuau

SEQ ID NO: 2868216 - RNA, 17 nt, Human
cauuccaaagcuuuauu

SEQ ID NO: 2868217 - RNA, 19 nt, Human
cauuccaaaggggaccccu

SEQ ID NO: 2868218 - RNA, 23 nt, Human
cauuccaaaggggaccccuauga

SEQ ID NO: 2868219 - RNA, 18 nt, Human
cauucaucuuguguuuua

SEQ ID NO: 2868220 - RNA, 16 nt, Human
cauucaugccuggcuu

SEQ ID NO: 2868221 - RNA, 17 nt, Human
cauucauggaccacugu

SEQ ID NO: 2868222 - RNA, 19 nt, Human
cauucauggaccacuguuu

SEQ ID NO: 2868223 - RNA, 22 nt, Human
cauucauggaccacuguuucuu

SEQ ID NO: 2868224 - RNA, 14 nt, Human
cauucaugccuggc

SEQ ID NO: 2868225 - RNA, 20 nt, Human
cauucauuuagcuaaacgga

SEQ ID NO: 2868226 - RNA, 14 nt, Human
cauucauuuuauau

SEQ ID NO: 2868227 - RNA, 15 nt, Human
cauucauuuuauauu

SEQ ID NO: 2868228 - RNA, 17 nt, Human
cauucauuuuauauuga

SEQ ID NO: 2868229 - RNA, 18 nt, Human
cauucauuuuauauugaa

SEQ ID NO: 2868230 - RNA, 20 nt, Human
cauucauuuuauauugaaaa

SEQ ID NO: 2868231 - RNA, 22 nt, Human
cauucauuuuauauugaaaaaa

SEQ ID NO: 2868232 - RNA, 23 nt, Human
cauucauuuuauauugaaaaaaa

SEQ ID NO: 2868233 - RNA, 15 nt, Human
cauucagagagcagc

SEQ ID NO: 2868234 - RNA, 16 nt, Human
cauucagaucacugaa

SEQ ID NO: 2868235 - RNA, 17 nt, Human
cauucagaucacugaau

SEQ ID NO: 2868236 - RNA, 21 nt, Human
cauucagaucacugaauuuau

SEQ ID NO: 2868237 - RNA, 23 nt, Human
cauucagaucacugaauuuauaa

SEQ ID NO: 2868238 - RNA, 21 nt, Human
cauucagcugagguucauuac

SEQ ID NO: 2868239 - RNA, 13 nt, Human
cauucaucucauu

SEQ ID NO: 2868240 - RNA, 18 nt, Human
cauucacuugcauuucuu

SEQ ID NO: 2868241 - RNA, 12 nt, Human
cauucagagagc

SEQ ID NO: 2868242 - RNA, 15 nt, Human
cauucacuugcauuu

SEQ ID NO: 2868243 - RNA, 13 nt, Human
cauucacuucucu

SEQ ID NO: 2868244 - RNA, 22 nt, Human
cauucacggagauaugaagagc

SEQ ID NO: 2868245 - RNA, 15 nt, Human
cauucacuagcuuug

SEQ ID NO: 2868246 - RNA, 13 nt, Human
cauuccccauggg

SEQ ID NO: 2868247 - RNA, 13 nt, Human
cauuccuauuucu

SEQ ID NO: 2868248 - RNA, 16 nt, Human
cauuccguugucugug

SEQ ID NO: 2868249 - RNA, 14 nt, Human
cauuccuaaaaugc

SEQ ID NO: 2868250 - RNA, 16 nt, Human
cauuccuaaaaugcuu

SEQ ID NO: 2868251 - RNA, 21 nt, Human
cauucccucucaucucaggua

SEQ ID NO: 2868252 - RNA, 13 nt, Human
cauucccucccau

SEQ ID NO: 2868253 - RNA, 17 nt, Human
cauuccccgucucuggu

SEQ ID NO: 2868254 - RNA, 13 nt, Human
cauuccauugccu

SEQ ID NO: 2868255 - RNA, 14 nt, Human
cauuccauugccua

SEQ ID NO: 2868256 - RNA, 16 nt, Human
cauuccauugccuagc

SEQ ID NO: 2868257 - RNA, 21 nt, Human
cauuccauugccuagcucuuu

SEQ ID NO: 2868258 - RNA, 18 nt, Human
cauuccaagacucuagag

SEQ ID NO: 2868259 - RNA, 22 nt, Human
cauuccaaggaguuggaaguga

SEQ ID NO: 2868260 - RNA, 13 nt, Human
cauuauucauuua

SEQ ID NO: 2868261 - RNA, 14 nt, Human
cauuauucauuuag

SEQ ID NO: 2868262 - RNA, 16 nt, Human
cauuauucauuuagug

SEQ ID NO: 2868263 - RNA, 20 nt, Human
cauuauucauuuagugaguu

SEQ ID NO: 2868264 - RNA, 12 nt, Human
cauuauucucuu

SEQ ID NO: 2868265 - RNA, 15 nt, Human
cauuauucucuuuua

SEQ ID NO: 2868266 - RNA, 18 nt, Human
cauuauucucuuuuaucu

SEQ ID NO: 2868267 - RNA, 14 nt, Human
cauuauugcuuauu

SEQ ID NO: 2868268 - RNA, 16 nt, Human
cauuauugcuuauugc

SEQ ID NO: 2868269 - RNA, 14 nt, Human
cauuagaaaaagag

SEQ ID NO: 2868270 - RNA, 19 nt, Human
cauuagaaaaauagcaacu

SEQ ID NO: 2868271 - RNA, 12 nt, Human
cauuagaacuuc

SEQ ID NO: 2868272 - RNA, 14 nt, Human
cauuagaauuauuu

SEQ ID NO: 2868273 - RNA, 19 nt, Human
cauuagaauuauuuaaaca

SEQ ID NO: 2868274 - RNA, 16 nt, Human
cauuaccacucaggca

SEQ ID NO: 2868275 - RNA, 16 nt, Human
cauuacucuuaaggaa

SEQ ID NO: 2868276 - RNA, 13 nt, Human
cauuacugggccu

SEQ ID NO: 2868277 - RNA, 14 nt, Human
cauuauuuauaugg

SEQ ID NO: 2868278 - RNA, 14 nt, Human
cauuauuuucuguc

SEQ ID NO: 2868279 - RNA, 15 nt, Human
cauuauuuucuguca

SEQ ID NO: 2868280 - RNA, 16 nt, Human
cauuauuuucugucag

SEQ ID NO: 2868281 - RNA, 17 nt, Human
cauuauuuucugucaga

SEQ ID NO: 2868282 - RNA, 18 nt, Human
cauuauuuucugucagau

SEQ ID NO: 2868283 - RNA, 23 nt, Human
cauuacuugauuaagauuuuaca

SEQ ID NO: 2868284 - RNA, 12 nt, Human
cauucaacaaga

SEQ ID NO: 2868285 - RNA, 23 nt, Human
cauucaaaugggugauauccuga

SEQ ID NO: 2868286 - RNA, 21 nt, Human
cauucaauauugacauuugua

SEQ ID NO: 2868287 - RNA, 13 nt, Human
cauucaauguuua

SEQ ID NO: 2868288 - RNA, 21 nt, Human
cauucaauuucaggcucccca

SEQ ID NO: 2868289 - RNA, 19 nt, Human
cauuacauuguuuaaagaa

SEQ ID NO: 2868290 - RNA, 12 nt, Human
cauuaccacuca

SEQ ID NO: 2868291 - RNA, 13 nt, Human
cauuaccacucag

SEQ ID NO: 2868292 - RNA, 14 nt, Human
cauuaccacucagg

SEQ ID NO: 2868293 - RNA, 15 nt, Human
cauuaccacucaggc

SEQ ID NO: 2868294 - RNA, 24 nt, Human
cauuacagggaaugccugagugcc

SEQ ID NO: 2868295 - RNA, 14 nt, Human
cauuaaguaaucaa

SEQ ID NO: 2868296 - RNA, 20 nt, Human
cauuaaguaaucaauaaaga

SEQ ID NO: 2868297 - RNA, 21 nt, Human
cauuaaguaaucaauaaagaa

SEQ ID NO: 2868298 - RNA, 16 nt, Human
cauuaauuuuuuuuca

SEQ ID NO: 2868299 - RNA, 12 nt, Human
cauuaauucuau

SEQ ID NO: 2868300 - RNA, 23 nt, Human
cauuacaaucgagacugcaaugu

SEQ ID NO: 2868301 - RNA, 13 nt, Human
cauuacaauggaa

SEQ ID NO: 2868302 - RNA, 21 nt, Human
cauuaagaauguugguuuacu

SEQ ID NO: 2868303 - RNA, 22 nt, Human
cauuaagaauguugguuuacuu

SEQ ID NO: 2868304 - RNA, 16 nt, Human
cauuaaccgaugcuuu

SEQ ID NO: 2868305 - RNA, 17 nt, Human
cauuaaccgaugcuuua

SEQ ID NO: 2868306 - RNA, 18 nt, Human
cauuaaccgaugcuuuac

SEQ ID NO: 2868307 - RNA, 20 nt, Human
cauuaaccgaugcuuuacca

SEQ ID NO: 2868308 - RNA, 22 nt, Human
cauuaaccgaugcuuuaccaaa

SEQ ID NO: 2868309 - RNA, 17 nt, Human
cauucuggcaguuuuga

SEQ ID NO: 2868310 - RNA, 19 nt, Human
cauucuggcaguuuugaca

SEQ ID NO: 2868311 - RNA, 20 nt, Human
cauucuggcaguuuugacau

SEQ ID NO: 2868312 - RNA, 12 nt, Human
cauucuuacuua

SEQ ID NO: 2868313 - RNA, 16 nt, Human
cauucugugaucauuu

SEQ ID NO: 2868314 - RNA, 17 nt, Human
cauucugugaucauuua

SEQ ID NO: 2868315 - RNA, 21 nt, Human
cauucuuacuuacuaaaauau

SEQ ID NO: 2868316 - RNA, 22 nt, Human
cauucuuacuuacuaaaauaua

SEQ ID NO: 2868317 - RNA, 23 nt, Human
cauucuuacuuacuaaaauauau

SEQ ID NO: 2868318 - RNA, 20 nt, Human
cauucugccugcccaggccc

SEQ ID NO: 2868319 - RNA, 19 nt, Human
cauucugccugcccaggcc

SEQ ID NO: 2868320 - RNA, 18 nt, Human
cauucugccugcccaggc

SEQ ID NO: 2868321 - RNA, 17 nt, Human
cauucugccugcccagg

SEQ ID NO: 2868322 - RNA, 16 nt, Human
cauucugccugcccag

SEQ ID NO: 2868323 - RNA, 15 nt, Human
cauucugccugccca

SEQ ID NO: 2868324 - RNA, 13 nt, Human
cauucugccugcc

SEQ ID NO: 2868325 - RNA, 12 nt, Human
cauucugccugc

SEQ ID NO: 2868326 - RNA, 21 nt, Human
cauuccugauaugauuuaaaa

SEQ ID NO: 2868327 - RNA, 15 nt, Human
cauucugagaccaaa

SEQ ID NO: 2868328 - RNA, 15 nt, Human
cauucugaugagcaa

SEQ ID NO: 2868329 - RNA, 20 nt, Human
cauucugauuuggaaaaaga

SEQ ID NO: 2868330 - RNA, 15 nt, Human
cauucugcauugcua

SEQ ID NO: 2868331 - RNA, 18 nt, Human
cauucugcauugcuagau

SEQ ID NO: 2868332 - RNA, 19 nt, Human
cauucugcauugcuagaua

SEQ ID NO: 2868333 - RNA, 20 nt, Human
cauucugcauugcuagauaa

SEQ ID NO: 2868334 - RNA, 21 nt, Human
cauucugcauugcuagauaaa

SEQ ID NO: 2868335 - RNA, 23 nt, Human
cauucugccgcccccuccugaac

SEQ ID NO: 2868336 - RNA, 22 nt, Human
cauucugccgcccccuccugaa

SEQ ID NO: 2868337 - RNA, 17 nt, Human
cauucugccucucuagg

SEQ ID NO: 2868338 - RNA, 18 nt, Human
cauucugccucucuagga

SEQ ID NO: 2868339 - RNA, 21 nt, Human
cauucugccgcccccuccuga

SEQ ID NO: 2868340 - RNA, 18 nt, Human
cauucugccgcccccucc

SEQ ID NO: 2868341 - RNA, 16 nt, Human
cauucugcccuguggg

SEQ ID NO: 2868342 - RNA, 17 nt, Human
cauucugcccuguggga

SEQ ID NO: 2868343 - RNA, 18 nt, Human
cauucugcccugugggac

SEQ ID NO: 2868344 - RNA, 20 nt, Human
cauucugcccugugggaccc

SEQ ID NO: 2868345 - RNA, 23 nt, Human
cauucuucuguacgucugacagg

SEQ ID NO: 2868346 - RNA, 21 nt, Human
cauucuuccuaguuuucuccu

SEQ ID NO: 2868347 - RNA, 18 nt, Human
cauucuuccuaguuuucu

SEQ ID NO: 2868348 - RNA, 13 nt, Human
cauucuuccuagu

SEQ ID NO: 2868349 - RNA, 17 nt, Human
cauucuuuuaacuucuu

SEQ ID NO: 2868350 - RNA, 18 nt, Human
cauucuuuuaacuucuuu

SEQ ID NO: 2868351 - RNA, 23 nt, Human
cauucuuguuuucuuucuuuaaa

SEQ ID NO: 2868352 - RNA, 13 nt, Human
cauucuuucccag

SEQ ID NO: 2868353 - RNA, 16 nt, Human
cauucuugguuggcug

SEQ ID NO: 2868354 - RNA, 17 nt, Human
cauucuugguuggcugg

SEQ ID NO: 2868355 - RNA, 21 nt, Human
cauucuugguuggcuggccuu

SEQ ID NO: 2868356 - RNA, 19 nt, Human
cauucuuguaaggcuuuga

SEQ ID NO: 2868357 - RNA, 21 nt, Human
cauucuuguaaggcuuugauu

SEQ ID NO: 2868358 - RNA, 22 nt, Human
cauucuuguaaggcuuugauua

SEQ ID NO: 2868359 - RNA, 14 nt, Human
cauugauuuccugu

SEQ ID NO: 2868360 - RNA, 15 nt, Human
cauugauucagccug

SEQ ID NO: 2868361 - RNA, 21 nt, Human
cauuguggugugagcuucaga

SEQ ID NO: 2868362 - RNA, 15 nt, Human
cauuguguugacauu

SEQ ID NO: 2868363 - RNA, 16 nt, Human
cauuguguugacauua

SEQ ID NO: 2868364 - RNA, 19 nt, Human
cauuguguugacauuaaga

SEQ ID NO: 2868365 - RNA, 15 nt, Human
cauuguuauuuauac

SEQ ID NO: 2868366 - RNA, 16 nt, Human
cauuguuauuuauaca

SEQ ID NO: 2868367 - RNA, 13 nt, Human
cauuguuauuuuc

SEQ ID NO: 2868368 - RNA, 14 nt, Human
cauuguuauuuuca

SEQ ID NO: 2868369 - RNA, 15 nt, Human
cauuguuauuuucag

SEQ ID NO: 2868370 - RNA, 19 nt, Human
cauuguuauuuucagugau

SEQ ID NO: 2868371 - RNA, 15 nt, Human
cauuguucaaaagga

SEQ ID NO: 2868372 - RNA, 16 nt, Human
cauuguucaaaaggaa

SEQ ID NO: 2868373 - RNA, 17 nt, Human
cauuguucaaaaggaac

SEQ ID NO: 2868374 - RNA, 12 nt, Human
cauuuaaaaaaa

SEQ ID NO: 2868375 - RNA, 17 nt, Human
cauuguuuuaaaaagaa

SEQ ID NO: 2868376 - RNA, 14 nt, Human
cauuguuagcacua

SEQ ID NO: 2868377 - RNA, 22 nt, Human
cauuguuagcacuaggcaccca

SEQ ID NO: 2868378 - RNA, 23 nt, Human
cauuguuuuaaaaagaaacaaga

SEQ ID NO: 2868379 - RNA, 12 nt, Human
cauuguuuugaa

SEQ ID NO: 2868380 - RNA, 14 nt, Human
cauuguuuugaaac

SEQ ID NO: 2868381 - RNA, 13 nt, Human
cauuguuuugaau

SEQ ID NO: 2868382 - RNA, 16 nt, Human
cauuguuuugaauauu

SEQ ID NO: 2868383 - RNA, 18 nt, Human
cauuguuuugaauauuac

SEQ ID NO: 2868384 - RNA, 19 nt, Human
cauuguuuugaauauuacu

SEQ ID NO: 2868385 - RNA, 22 nt, Human
cauuguuuugaauauuacuccu

SEQ ID NO: 2868386 - RNA, 12 nt, Human
cauuuaaguuuc

SEQ ID NO: 2868387 - RNA, 17 nt, Human
cauuuaagagacaguca

SEQ ID NO: 2868388 - RNA, 19 nt, Human
cauuuaagagacagucacc

SEQ ID NO: 2868389 - RNA, 23 nt, Human
cauuuaagagacagucaccccag

SEQ ID NO: 2868390 - RNA, 15 nt, Human
cauuuaaaaaaauca

SEQ ID NO: 2868391 - RNA, 16 nt, Human
cauuuaaauaucugaa

SEQ ID NO: 2868392 - RNA, 16 nt, Human
cauuuaaauguguaca

SEQ ID NO: 2868393 - RNA, 20 nt, Human
cauuuaaauguguacaaugu

SEQ ID NO: 2868394 - RNA, 21 nt, Human
cauuuaaauguguacaaugua

SEQ ID NO: 2868395 - RNA, 23 nt, Human
cauuuaaauuuuacccuuuagac

SEQ ID NO: 2868396 - RNA, 13 nt, Human
cauugacaaaucu

SEQ ID NO: 2868397 - RNA, 16 nt, Human
cauugacaaaucugug

SEQ ID NO: 2868398 - RNA, 18 nt, Human
cauugacaaaucugugua

SEQ ID NO: 2868399 - RNA, 21 nt, Human
cauugacaaaucuguguauau

SEQ ID NO: 2868400 - RNA, 15 nt, Human
cauugagcugugcaa

SEQ ID NO: 2868401 - RNA, 14 nt, Human
cauugagcugugca

SEQ ID NO: 2868402 - RNA, 16 nt, Human
cauugacaagaacuga

SEQ ID NO: 2868403 - RNA, 18 nt, Human
cauugaacacaaacugua

SEQ ID NO: 2868404 - RNA, 21 nt, Human
cauugagcugauauaaauucu

SEQ ID NO: 2868405 - RNA, 15 nt, Human
cauugaguaauauag

SEQ ID NO: 2868406 - RNA, 13 nt, Human
cauugaguagaca

SEQ ID NO: 2868407 - RNA, 21 nt, Human
cauugaguagacacauuuaag

SEQ ID NO: 2868408 - RNA, 23 nt, Human
cauugaguagacacauuuaagga

SEQ ID NO: 2868409 - RNA, 16 nt, Human
cauugaggaagagucu

SEQ ID NO: 2868410 - RNA, 17 nt, Human
cauugaggaagagucuu

SEQ ID NO: 2868411 - RNA, 17 nt, Human
cauugaucauaaacuga

SEQ ID NO: 2868412 - RNA, 14 nt, Human
cauugauauuguga

SEQ ID NO: 2868413 - RNA, 16 nt, Human
cauugauauugugaac

SEQ ID NO: 2868414 - RNA, 19 nt, Human
cauugauauugugaacauu

SEQ ID NO: 2868415 - RNA, 20 nt, Human
cauugauauugugaacauuu

SEQ ID NO: 2868416 - RNA, 14 nt, Human
cauugaaggccugg

SEQ ID NO: 2868417 - RNA, 22 nt, Human
cauugaacacaaacuguaaaua

SEQ ID NO: 2868418 - RNA, 16 nt, Human
cauucuuuuuuucuug

SEQ ID NO: 2868419 - RNA, 17 nt, Human
cauucuuuuuuucuugg

SEQ ID NO: 2868420 - RNA, 18 nt, Human
cauucuuuuuuucuuggc

SEQ ID NO: 2868421 - RNA, 19 nt, Human
cauucuuuuuuucuuggcc

SEQ ID NO: 2868422 - RNA, 13 nt, Human
cauuucuuuucug

SEQ ID NO: 2868423 - RNA, 15 nt, Human
cauuucuuuucuuuu

SEQ ID NO: 2868424 - RNA, 17 nt, Human
cauuucuuuucuuuuua

SEQ ID NO: 2868425 - RNA, 19 nt, Human
cauuucuuuucuuuuuaca

SEQ ID NO: 2868426 - RNA, 20 nt, Human
cauuucuuuucuuuuuacau

SEQ ID NO: 2868427 - RNA, 21 nt, Human
cauuucuuuucuuuuuacaua

SEQ ID NO: 2868428 - RNA, 20 nt, Human
cauuuaccagcaacuugaac

SEQ ID NO: 2868429 - RNA, 13 nt, Human
cauuuacuaaaca

SEQ ID NO: 2868430 - RNA, 15 nt, Human
cauuuacuaaacaua

SEQ ID NO: 2868431 - RNA, 17 nt, Human
cauuuacuaaacauaug

SEQ ID NO: 2868432 - RNA, 19 nt, Human
cauuuacuaaacauaugau

SEQ ID NO: 2868433 - RNA, 20 nt, Human
cauuuacuaaacauaugauu

SEQ ID NO: 2868434 - RNA, 21 nt, Human
cauuuacuaaacauaugauuu

SEQ ID NO: 2868435 - RNA, 12 nt, Human
cauuuacaugua

SEQ ID NO: 2868436 - RNA, 20 nt, Human
cauuuacauguauuauuuca

SEQ ID NO: 2868437 - RNA, 20 nt, Human
cauuuacaguccuucaaaau

SEQ ID NO: 2868438 - RNA, 22 nt, Human
cauuuaaggaugggguuaugaa

SEQ ID NO: 2868439 - RNA, 12 nt, Human
cauuuaauuuag

SEQ ID NO: 2868440 - RNA, 19 nt, Human
cauuuaauuuagugaucuu

SEQ ID NO: 2868441 - RNA, 16 nt, Human
cauuugcuuuuucacc

SEQ ID NO: 2868442 - RNA, 13 nt, Human
cauuugcuuuuug

SEQ ID NO: 2868443 - RNA, 16 nt, Human
cauuuucaccccaccc

SEQ ID NO: 2868444 - RNA, 20 nt, Human
cauuuuacccacacacagau

SEQ ID NO: 2868445 - RNA, 18 nt, Human
cauuuuacauuaaauuuu

SEQ ID NO: 2868446 - RNA, 17 nt, Human
cauuuuacuuuuuccug

SEQ ID NO: 2868447 - RNA, 20 nt, Human
cauuuuacuuuuuccuggcu

SEQ ID NO: 2868448 - RNA, 22 nt, Human
cauuuuacuuuuuccuggcuca

SEQ ID NO: 2868449 - RNA, 17 nt, Human
cauuugcacccuccgcc

SEQ ID NO: 2868450 - RNA, 15 nt, Human
cauuugcacccuccg

SEQ ID NO: 2868451 - RNA, 20 nt, Human
cauuugcacuggaguucuau

SEQ ID NO: 2868452 - RNA, 21 nt, Human
cauuugcacuggaguucuaug

SEQ ID NO: 2868453 - RNA, 14 nt, Human
cauuugauaaugau

SEQ ID NO: 2868454 - RNA, 16 nt, Human
cauuugauaaugauaa

SEQ ID NO: 2868455 - RNA, 17 nt, Human
cauuugauaaugauaaa

SEQ ID NO: 2868456 - RNA, 23 nt, Human
cauuugauaaugauaaaacaccu

SEQ ID NO: 2868457 - RNA, 11 nt, Human
cauuugauacc

SEQ ID NO: 2868458 - RNA, 16 nt, Human
cauuugauaccccugg

SEQ ID NO: 2868459 - RNA, 17 nt, Human
cauuugauaccccuggg

SEQ ID NO: 2868460 - RNA, 19 nt, Human
cauuugauaccccugggga

SEQ ID NO: 2868461 - RNA, 23 nt, Human
cauuucuugugauguuuugagag

SEQ ID NO: 2868462 - RNA, 19 nt, Human
cauuuuuaaucaugaaauu

SEQ ID NO: 2868463 - RNA, 16 nt, Human
cauuugauuuuucuaa

SEQ ID NO: 2868464 - RNA, 15 nt, Human
cauuuuccccccacu

SEQ ID NO: 2868465 - RNA, 14 nt, Human
cauuuuccccccac

SEQ ID NO: 2868466 - RNA, 17 nt, Human
cauuuucaccccacccu

SEQ ID NO: 2868467 - RNA, 22 nt, Human
cauuuuccccccacucucccca

SEQ ID NO: 2868468 - RNA, 17 nt, Human
cauuuuccuacaggcag

SEQ ID NO: 2868469 - RNA, 18 nt, Human
cauuuuccuacaggcagu

SEQ ID NO: 2868470 - RNA, 22 nt, Human
cauuuuccuacaggcagucucu

SEQ ID NO: 2868471 - RNA, 21 nt, Human
cauuuuccccccacucucccc

SEQ ID NO: 2868472 - RNA, 20 nt, Human
cauuuuccccccacucuccc

SEQ ID NO: 2868473 - RNA, 17 nt, Human
cauuuuccccccacucu

SEQ ID NO: 2868474 - RNA, 18 nt, Human
cauuuucuauaacagaua

SEQ ID NO: 2868475 - RNA, 19 nt, Human
cauuuucuauaacagauau

SEQ ID NO: 2868476 - RNA, 17 nt, Human
cauuuuuaguagagaca

SEQ ID NO: 2868477 - RNA, 15 nt, Human
cauuuuuaaucauga

SEQ ID NO: 2868478 - RNA, 16 nt, Human
ccaaaaucucaagaaa

SEQ ID NO: 2868479 - RNA, 15 nt, Human
ccaaaaugacaucuu

SEQ ID NO: 2868480 - RNA, 16 nt, Human
ccaaaaugacaucuuu

SEQ ID NO: 2868481 - RNA, 19 nt, Human
ccaaaaugacaucuuuuua

SEQ ID NO: 2868482 - RNA, 16 nt, Human
ccaaacaaauaugcaa

SEQ ID NO: 2868483 - RNA, 13 nt, Human
ccaaacaauuauu

SEQ ID NO: 2868484 - RNA, 19 nt, Human
ccaaacaccuuccagcucc

SEQ ID NO: 2868485 - RNA, 15 nt, Human
ccaaacaccuuccag

SEQ ID NO: 2868486 - RNA, 23 nt, Human
caugugucaacaccccugugugg

SEQ ID NO: 2868487 - RNA, 17 nt, Human
caugugucacuugugcu

SEQ ID NO: 2868488 - RNA, 18 nt, Human
caugugucacuugugcuu

SEQ ID NO: 2868489 - RNA, 22 nt, Human
caugugucacuugugcuuugcu

SEQ ID NO: 2868490 - RNA, 15 nt, Human
caugugucaugcaug

SEQ ID NO: 2868491 - RNA, 14 nt, Human
cauguguagccugu

SEQ ID NO: 2868492 - RNA, 15 nt, Human
cauguguagccuaug

SEQ ID NO: 2868493 - RNA, 16 nt, Human
cauguguagccuaugu

SEQ ID NO: 2868494 - RNA, 16 nt, Human
cauguguagccugugc

SEQ ID NO: 2868495 - RNA, 18 nt, Human
cauguguagccugugcau

SEQ ID NO: 2868496 - RNA, 14 nt, Human
caugugcacaugca

SEQ ID NO: 2868497 - RNA, 22 nt, Human
caugugccagguuuuuggucug

SEQ ID NO: 2868498 - RNA, 12 nt, Human
caugugcccucc

SEQ ID NO: 2868499 - RNA, 14 nt, Human
caugugcccuccug

SEQ ID NO: 2868500 - RNA, 18 nt, Human
caugugcccuccugaggg

SEQ ID NO: 2868501 - RNA, 16 nt, Human
caugugccucuuuguc

SEQ ID NO: 2868502 - RNA, 20 nt, Human
cauguguuuuaauuccaaua

SEQ ID NO: 2868503 - RNA, 18 nt, Human
cauguguuuuauaaaauc

SEQ ID NO: 2868504 - RNA, 18 nt, Human
cauguguuggcagccucu

SEQ ID NO: 2868505 - RNA, 13 nt, Human
cauguguucccuu

SEQ ID NO: 2868506 - RNA, 14 nt, Human
cauguguucccuuu

SEQ ID NO: 2868507 - RNA, 22 nt, Human
cauguguucccuuugucuuuca

SEQ ID NO: 2868508 - RNA, 21 nt, Human
cauguguccugguucccguuu

SEQ ID NO: 2868509 - RNA, 15 nt, Human
cauguguccugguuc

SEQ ID NO: 2868510 - RNA, 13 nt, Human
cauguuucauguu

SEQ ID NO: 2868511 - RNA, 22 nt, Human
cauguuucauguuuugugacua

SEQ ID NO: 2868512 - RNA, 16 nt, Human
cauguuucauguuuug

SEQ ID NO: 2868513 - RNA, 17 nt, Human
cauguuucauguuuugu

SEQ ID NO: 2868514 - RNA, 14 nt, Human
cauguuuccagcag

SEQ ID NO: 2868515 - RNA, 12 nt, Human
caugucuggcua

SEQ ID NO: 2868516 - RNA, 22 nt, Human
caugucuccuuuaagagcucug

SEQ ID NO: 2868517 - RNA, 14 nt, Human
caugucucgacuca

SEQ ID NO: 2868518 - RNA, 13 nt, Human
caugucuuguaca

SEQ ID NO: 2868519 - RNA, 14 nt, Human
caugucuuguacau

SEQ ID NO: 2868520 - RNA, 15 nt, Human
caugucuuguacaug

SEQ ID NO: 2868521 - RNA, 17 nt, Human
caugucuuguacaugug

SEQ ID NO: 2868522 - RNA, 16 nt, Human
caugugaucacgccug

SEQ ID NO: 2868523 - RNA, 17 nt, Human
caugugacucuggcuug

SEQ ID NO: 2868524 - RNA, 20 nt, Human
caugugacucuggcuuggcc

SEQ ID NO: 2868525 - RNA, 15 nt, Human
cauggucacacacug

SEQ ID NO: 2868526 - RNA, 14 nt, Human
cauggucacacacu

SEQ ID NO: 2868527 - RNA, 20 nt, Human
caugguagagaaucucuccc

SEQ ID NO: 2868528 - RNA, 11 nt, Human
cauggugaaaa

SEQ ID NO: 2868529 - RNA, 18 nt, Human
cauggugaaaauguacug

SEQ ID NO: 2868530 - RNA, 19 nt, Human
cauggugaaaauguacuga

SEQ ID NO: 2868531 - RNA, 18 nt, Human
caugguggcaugcaccug

SEQ ID NO: 2868532 - RNA, 20 nt, Human
caugguggcaugcaccugca

SEQ ID NO: 2868533 - RNA, 16 nt, Human
caugguggacccagcg

SEQ ID NO: 2868534 - RNA, 22 nt, Human
caugguggacccagcgggcagg

SEQ ID NO: 2868535 - RNA, 13 nt, Human
caugguguaauaa

SEQ ID NO: 2868536 - RNA, 14 nt, Human
caugguguaauaag

SEQ ID NO: 2868537 - RNA, 19 nt, Human
caugguggguucaggggac

SEQ ID NO: 2868538 - RNA, 22 nt, Human
caugucuauaaucccagcacuu

SEQ ID NO: 2868539 - RNA, 21 nt, Human
caugucgcuagccagugcucc

SEQ ID NO: 2868540 - RNA, 22 nt, Human
caugucgcuagccagugcucca

SEQ ID NO: 2868541 - RNA, 16 nt, Human
cauguaaaagcggaaa

SEQ ID NO: 2868542 - RNA, 16 nt, Human
cauguaaagaaauguc

SEQ ID NO: 2868543 - RNA, 17 nt, Human
cauguaaagaaaugucu

SEQ ID NO: 2868544 - RNA, 18 nt, Human
cauguaaagaaaugucuu

SEQ ID NO: 2868545 - RNA, 21 nt, Human
cauguaaagaaaugucuuaau

SEQ ID NO: 2868546 - RNA, 22 nt, Human
cauguaaacacgccugcaaacg

SEQ ID NO: 2868547 - RNA, 19 nt, Human
cauguaccauuugcauggc

SEQ ID NO: 2868548 - RNA, 13 nt, Human
cauguaccucccc

SEQ ID NO: 2868549 - RNA, 14 nt, Human
cauguaccuccccu

SEQ ID NO: 2868550 - RNA, 16 nt, Human
cauguaccuccccugc

SEQ ID NO: 2868551 - RNA, 17 nt, Human
cauguaccuccccugcc

SEQ ID NO: 2868552 - RNA, 18 nt, Human
cauguaccuccccugccu

SEQ ID NO: 2868553 - RNA, 19 nt, Human
cauguaccuccccugccuu

SEQ ID NO: 2868554 - RNA, 20 nt, Human
cauguaccuccccugccuug

SEQ ID NO: 2868555 - RNA, 21 nt, Human
cauguaccuccccugccuugc

SEQ ID NO: 2868556 - RNA, 22 nt, Human
cauguaccuccccugccuugcu

SEQ ID NO: 2868557 - RNA, 22 nt, Human
cauguacuaguuuuaguuuucu

SEQ ID NO: 2868558 - RNA, 18 nt, Human
cauguaaauaccagacug

SEQ ID NO: 2868559 - RNA, 21 nt, Human
cauguaaauaccagacugcag

SEQ ID NO: 2868560 - RNA, 22 nt, Human
cauguaaauaccagacugcagg

SEQ ID NO: 2868561 - RNA, 23 nt, Human
cauguaaauaccagacugcaggu

SEQ ID NO: 2868562 - RNA, 13 nt, Human
cauguacauuugg

SEQ ID NO: 2868563 - RNA, 14 nt, Human
cauguacauuugga

SEQ ID NO: 2868564 - RNA, 17 nt, Human
cauguacauuuggaacu

SEQ ID NO: 2868565 - RNA, 22 nt, Human
cauuaaaaaaaaaaaaaaaagu

SEQ ID NO: 2868566 - RNA, 13 nt, Human
cauguuuguaaaa

SEQ ID NO: 2868567 - RNA, 17 nt, Human
cauguuuuuguuuucuu

SEQ ID NO: 2868568 - RNA, 17 nt, Human
cauguuuggugcauaga

SEQ ID NO: 2868569 - RNA, 20 nt, Human
cauguuuggugcauagaacu

SEQ ID NO: 2868570 - RNA, 21 nt, Human
cauguuuggugcauagaacug

SEQ ID NO: 2868571 - RNA, 22 nt, Human
cauguuuggugcauagaacugg

SEQ ID NO: 2868572 - RNA, 14 nt, Human
cauguuugcuucau

SEQ ID NO: 2868573 - RNA, 14 nt, Human
cauguuuggaagac

SEQ ID NO: 2868574 - RNA, 12 nt, Human
cauuaaaccugu

SEQ ID NO: 2868575 - RNA, 23 nt, Human
cauguuuuuguuuucuuugaaug

SEQ ID NO: 2868576 - RNA, 13 nt, Human
cauuaaaaaugga

SEQ ID NO: 2868577 - RNA, 14 nt, Human
cauuaaaaauggaa

SEQ ID NO: 2868578 - RNA, 15 nt, Human
cauuaaaaauggaac

SEQ ID NO: 2868579 - RNA, 13 nt, Human
cauuaaaaaauga

SEQ ID NO: 2868580 - RNA, 21 nt, Human
cauuaaaaaaugaaauauuuu

SEQ ID NO: 2868581 - RNA, 22 nt, Human
cauuaaaaaaugaaauauuuuu

SEQ ID NO: 2868582 - RNA, 13 nt, Human
cauuaaaacugcu

SEQ ID NO: 2868583 - RNA, 14 nt, Human
cauuaaaacugcuu

SEQ ID NO: 2868584 - RNA, 15 nt, Human
cauuaaaacugcuuu

SEQ ID NO: 2868585 - RNA, 16 nt, Human
cauuaaaacugcuuuu

SEQ ID NO: 2868586 - RNA, 22 nt, Human
caugcuuugaaaaaucacuuga

SEQ ID NO: 2868587 - RNA, 18 nt, Human
cauggaaaccugaaaaaa

SEQ ID NO: 2868588 - RNA, 13 nt, Human
cauggaacacaaa

SEQ ID NO: 2868589 - RNA, 21 nt, Human
cauggaacacaaacacauugu

SEQ ID NO: 2868590 - RNA, 23 nt, Human
cauggaacacaaacacauuguua

SEQ ID NO: 2868591 - RNA, 14 nt, Human
caugcuucuuccuu

SEQ ID NO: 2868592 - RNA, 20 nt, Human
caugcuucucaucuugugaa

SEQ ID NO: 2868593 - RNA, 21 nt, Human
caugcuucucaucuugugaaa

SEQ ID NO: 2868594 - RNA, 22 nt, Human
caugcuucucaucuugugaaau

SEQ ID NO: 2868595 - RNA, 23 nt, Human
caugcuucucaucuugugaaaug

SEQ ID NO: 2868596 - RNA, 19 nt, Human
caugcuugugaaaaugugu

SEQ ID NO: 2868597 - RNA, 16 nt, Human
caugcuucuuccuuac

SEQ ID NO: 2868598 - RNA, 14 nt, Human
caugcuuuaaagug

SEQ ID NO: 2868599 - RNA, 15 nt, Human
caugcuuuaaagugu

SEQ ID NO: 2868600 - RNA, 18 nt, Human
caugcuuuaaaguguaau

SEQ ID NO: 2868601 - RNA, 19 nt, Human
caugcuuuaaaguguaaua

SEQ ID NO: 2868602 - RNA, 23 nt, Human
caugcuuuaaaguguaauaauau

SEQ ID NO: 2868603 - RNA, 17 nt, Human
cauggaaaccugaaaaa

SEQ ID NO: 2868604 - RNA, 13 nt, Human
cauggagcuggcc

SEQ ID NO: 2868605 - RNA, 14 nt, Human
cauggagcuggccg

SEQ ID NO: 2868606 - RNA, 17 nt, Human
cauggagccagcucccu

SEQ ID NO: 2868607 - RNA, 12 nt, Human
cauggagcuggc

SEQ ID NO: 2868608 - RNA, 14 nt, Human
cauggagccagcuc

SEQ ID NO: 2868609 - RNA, 19 nt, Human
cauggacguucggggcaug

SEQ ID NO: 2868610 - RNA, 14 nt, Human
cauggaccacuguu

SEQ ID NO: 2868611 - RNA, 16 nt, Human
cauggaccacuguuuc

SEQ ID NO: 2868612 - RNA, 18 nt, Human
cauggaccacuguuucuu

SEQ ID NO: 2868613 - RNA, 21 nt, Human
cauggaccacuguuucuugcu

SEQ ID NO: 2868614 - RNA, 22 nt, Human
cauggaccacuguuucuugcuu

SEQ ID NO: 2868615 - RNA, 23 nt, Human
cauggaccacuguuucuugcuug

SEQ ID NO: 2868616 - RNA, 14 nt, Human
caugcggagaacaa

SEQ ID NO: 2868617 - RNA, 16 nt, Human
caugcggagaacaaau

SEQ ID NO: 2868618 - RNA, 23 nt, Human
caugcggagaacaaaugugaagg

SEQ ID NO: 2868619 - RNA, 23 nt, Human
caugcagcccaugcccaccugcc

SEQ ID NO: 2868620 - RNA, 22 nt, Human
caugcagcccaugcccaccugc

SEQ ID NO: 2868621 - RNA, 14 nt, Human
caugcagcaucuaa

SEQ ID NO: 2868622 - RNA, 20 nt, Human
caugcagcccaugcccaccu

SEQ ID NO: 2868623 - RNA, 19 nt, Human
caugcagcccaugcccacc

SEQ ID NO: 2868624 - RNA, 16 nt, Human
caugcagcccaugccc

SEQ ID NO: 2868625 - RNA, 19 nt, Human
caugcagacaugagugcgu

SEQ ID NO: 2868626 - RNA, 15 nt, Human
caugggagcagucca

SEQ ID NO: 2868627 - RNA, 20 nt, Human
caugggagcaguccaugcau

SEQ ID NO: 2868628 - RNA, 18 nt, Human
cauggcaucaccuccacc

SEQ ID NO: 2868629 - RNA, 21 nt, Human
caugggagcugguuagaaaug

SEQ ID NO: 2868630 - RNA, 13 nt, Human
cauggaggcccuc

SEQ ID NO: 2868631 - RNA, 17 nt, Human
cauggaggcccuccugu

SEQ ID NO: 2868632 - RNA, 18 nt, Human
cauggaggcccuccugug

SEQ ID NO: 2868633 - RNA, 20 nt, Human
cauggaggcccuccugugcu

SEQ ID NO: 2868634 - RNA, 13 nt, Human
cauggagguucua

SEQ ID NO: 2868635 - RNA, 17 nt, Human
cauggcagaguuugugu

SEQ ID NO: 2868636 - RNA, 18 nt, Human
cauggcagaguuugugug

SEQ ID NO: 2868637 - RNA, 15 nt, Human
cauggagguucuaag

SEQ ID NO: 2868638 - RNA, 22 nt, Human
cauggcagaauaaucuuugggu

SEQ ID NO: 2868639 - RNA, 21 nt, Human
caugggcacaaagggcccaga

SEQ ID NO: 2868640 - RNA, 19 nt, Human
caugggcacaaagggccca

SEQ ID NO: 2868641 - RNA, 16 nt, Human
caugggauacaaccuc

SEQ ID NO: 2868642 - RNA, 18 nt, Human
caugggauacaaccuccc

SEQ ID NO: 2868643 - RNA, 21 nt, Human
caugggauacaaccucccucu

SEQ ID NO: 2868644 - RNA, 22 nt, Human
caugggauacaaccucccucuu

SEQ ID NO: 2868645 - RNA, 21 nt, Human
caugggaggugaaaggggcac

SEQ ID NO: 2868646 - RNA, 18 nt, Human
caugggccuccugugugu

SEQ ID NO: 2868647 - RNA, 20 nt, Human
caugggcaucuaugggagag

SEQ ID NO: 2868648 - RNA, 13 nt, Human
caugggccuggcc

SEQ ID NO: 2868649 - RNA, 23 nt, Human
caugggccuggccaccucucucc

SEQ ID NO: 2868650 - RNA, 14 nt, Human
caugggccagcccc

SEQ ID NO: 2868651 - RNA, 15 nt, Human
caugggccagccccu

SEQ ID NO: 2868652 - RNA, 16 nt, Human
caugggccagccccuc

SEQ ID NO: 2868653 - RNA, 17 nt, Human
caugggccagccccucc

SEQ ID NO: 2868654 - RNA, 21 nt, Human
caugggccagccccuccaucu

SEQ ID NO: 2868655 - RNA, 13 nt, Human
caugggcucugac

SEQ ID NO: 2868656 - RNA, 13 nt, Human
caugggcucuuca

SEQ ID NO: 2868657 - RNA, 24 nt, Human
caugggccuggccaccucucuccu

SEQ ID NO: 2868658 - RNA, 12 nt, Human
caugggcuucac

SEQ ID NO: 2868659 - RNA, 13 nt, Human
caugggcuucacu

SEQ ID NO: 2868660 - RNA, 14 nt, Human
caugggcuucacug

SEQ ID NO: 2868661 - RNA, 15 nt, Human
caugggcuucacugu

SEQ ID NO: 2868662 - RNA, 16 nt, Human
caugggcuucacugua

SEQ ID NO: 2868663 - RNA, 21 nt, Human
cauggggugggguagggcuga

SEQ ID NO: 2868664 - RNA, 21 nt, Human
caugggcuucacuguauaaau

SEQ ID NO: 2868665 - RNA, 17 nt, Human
caugggcuucacuguau

SEQ ID NO: 2868666 - RNA, 20 nt, Human
caugggcuucacuguauaaa

SEQ ID NO: 2868667 - RNA, 23 nt, Human
caugggcuucacuguauaaauag

SEQ ID NO: 2868668 - RNA, 15 nt, Human
cauggggaaaaaaau

SEQ ID NO: 2868669 - RNA, 18 nt, Human
cauggggaaaaaaaucau

SEQ ID NO: 2868670 - RNA, 20 nt, Human
cauggggaaaaaaaucaucu

SEQ ID NO: 2868671 - RNA, 21 nt, Human
cauggggaaaaaaaucaucua

SEQ ID NO: 2868672 - RNA, 16 nt, Human
cauggucaacccucag

SEQ ID NO: 2868673 - RNA, 17 nt, Human
cauggucaacccucagg

SEQ ID NO: 2868674 - RNA, 14 nt, Human
caugguaccagccc

SEQ ID NO: 2868675 - RNA, 15 nt, Human
caugguaccagcccu

SEQ ID NO: 2868676 - RNA, 16 nt, Human
caugguaccagcccug

SEQ ID NO: 2868677 - RNA, 17 nt, Human
caugguaccagcccugg

SEQ ID NO: 2868678 - RNA, 23 nt, Human
cauggguuauguguaugugccau

SEQ ID NO: 2868679 - RNA, 15 nt, Human
cauggguuaugugua

SEQ ID NO: 2868680 - RNA, 18 nt, Human
cauccauaguaguaugau

SEQ ID NO: 2868681 - RNA, 12 nt, Human
cauccauccagg

SEQ ID NO: 2868682 - RNA, 16 nt, Human
cauccauaguaguaug

SEQ ID NO: 2868683 - RNA, 19 nt, Human
cauccagugacaaaccauc

SEQ ID NO: 2868684 - RNA, 13 nt, Human
cauccaguucaug

SEQ ID NO: 2868685 - RNA, 17 nt, Human
cauccaguuaaccaagu

SEQ ID NO: 2868686 - RNA, 12 nt, Human
cauccauaaauc

SEQ ID NO: 2868687 - RNA, 17 nt, Human
cauccauaaauccaguu

SEQ ID NO: 2868688 - RNA, 17 nt, Human
cauccauaccagcucgc

SEQ ID NO: 2868689 - RNA, 18 nt, Human
cauccauaguaacugaca

SEQ ID NO: 2868690 - RNA, 19 nt, Human
cauccauaguaacugacau

SEQ ID NO: 2868691 - RNA, 17 nt, Human
cauccagguucagcuug

SEQ ID NO: 2868692 - RNA, 18 nt, Human
cauccacuuacauauauu

SEQ ID NO: 2868693 - RNA, 21 nt, Human
cauccacuuacauauauuuuu

SEQ ID NO: 2868694 - RNA, 16 nt, Human
cauccagacaucauga

SEQ ID NO: 2868695 - RNA, 22 nt, Human
cauccacucuacccucccaccc

SEQ ID NO: 2868696 - RNA, 19 nt, Human
cauccacucuacccuccca

SEQ ID NO: 2868697 - RNA, 18 nt, Human
cauccacucuacccuccc

SEQ ID NO: 2868698 - RNA, 10 nt, Human
caucauuaga

SEQ ID NO: 2868699 - RNA, 13 nt, Human
caucauuagaaca

SEQ ID NO: 2868700 - RNA, 17 nt, Human
caucauuacccuucccu

SEQ ID NO: 2868701 - RNA, 20 nt, Human
caucauuacccuucccugca

SEQ ID NO: 2868702 - RNA, 22 nt, Human
caucauuacccuucccugcacu

SEQ ID NO: 2868703 - RNA, 14 nt, Human
caucauuagaacaa

SEQ ID NO: 2868704 - RNA, 22 nt, Human
caucauuccuugagaaaaacaa

SEQ ID NO: 2868705 - RNA, 17 nt, Human
caucauuccuugagaaa

SEQ ID NO: 2868706 - RNA, 14 nt, Human
caucauucccucuc

SEQ ID NO: 2868707 - RNA, 16 nt, Human
caucauucccucucau

SEQ ID NO: 2868708 - RNA, 20 nt, Human
caucauucccucucaucuca

SEQ ID NO: 2868709 - RNA, 23 nt, Human
caucauucccucucaucucaggu

SEQ ID NO: 2868710 - RNA, 23 nt, Human
cauccacugugccaugugccagg

SEQ ID NO: 2868711 - RNA, 17 nt, Human
cauccacugugccaugu

SEQ ID NO: 2868712 - RNA, 14 nt, Human
cauccacugugcca

SEQ ID NO: 2868713 - RNA, 17 nt, Human
cauccacucuacccucc

SEQ ID NO: 2868714 - RNA, 19 nt, Human
caucccuugaccaggccug

SEQ ID NO: 2868715 - RNA, 12 nt, Human
caucccugugag

SEQ ID NO: 2868716 - RNA, 13 nt, Human
caucccugugagg

SEQ ID NO: 2868717 - RNA, 23 nt, Human
caucccuugaccaggccugggcc

SEQ ID NO: 2868718 - RNA, 13 nt, Human
caucccuuuccag

SEQ ID NO: 2868719 - RNA, 20 nt, Human
caucccuugaccaggccugg

SEQ ID NO: 2868720 - RNA, 24 nt, Human
caucccugagcaggaaaguuuacc

SEQ ID NO: 2868721 - RNA, 17 nt, Human
caucccugaggagccag

SEQ ID NO: 2868722 - RNA, 13 nt, Human
caucccugccugg

SEQ ID NO: 2868723 - RNA, 14 nt, Human
caucccugccuggu

SEQ ID NO: 2868724 - RNA, 15 nt, Human
caucccugccugguc

SEQ ID NO: 2868725 - RNA, 18 nt, Human
caucccugaggagccagg

SEQ ID NO: 2868726 - RNA, 16 nt, Human
caucccugccugguca

SEQ ID NO: 2868727 - RNA, 21 nt, Human
caucacccucuuccugugauc

SEQ ID NO: 2868728 - RNA, 14 nt, Human
caucacccucuucc

SEQ ID NO: 2868729 - RNA, 22 nt, Human
caucaccgacgcgucuccuguu

SEQ ID NO: 2868730 - RNA, 19 nt, Human
caucaccgacgcgucuccu

SEQ ID NO: 2868731 - RNA, 14 nt, Human
caucaccugccugu

SEQ ID NO: 2868732 - RNA, 17 nt, Human
caucacguguacuggcu

SEQ ID NO: 2868733 - RNA, 20 nt, Human
caucacguguacuggcuccu

SEQ ID NO: 2868734 - RNA, 18 nt, Human
caucaccucaggccaggu

SEQ ID NO: 2868735 - RNA, 15 nt, Human
caucaccucaggcca

SEQ ID NO: 2868736 - RNA, 13 nt, Human
caucaccuccacc

SEQ ID NO: 2868737 - RNA, 14 nt, Human
caucaccuccacca

SEQ ID NO: 2868738 - RNA, 13 nt, Human
caucaccucugua

SEQ ID NO: 2868739 - RNA, 13 nt, Human
caucaccucaggc

SEQ ID NO: 2868740 - RNA, 12 nt, Human
caucaccucagg

SEQ ID NO: 2868741 - RNA, 16 nt, Human
caucacuauccaugca

SEQ ID NO: 2868742 - RNA, 21 nt, Human
caucacuauccaugcaccaaa

SEQ ID NO: 2868743 - RNA, 22 nt, Human
caucacuauccaugcaccaaac

SEQ ID NO: 2868744 - RNA, 16 nt, Human
caucacucugcugcuu

SEQ ID NO: 2868745 - RNA, 14 nt, Human
caucagggacagga

SEQ ID NO: 2868746 - RNA, 12 nt, Human
caucagggacag

SEQ ID NO: 2868747 - RNA, 20 nt, Human
caucaguauuaauacuaaaa

SEQ ID NO: 2868748 - RNA, 18 nt, Human
caucagggacaggaugac

SEQ ID NO: 2868749 - RNA, 11 nt, Human
caucagggccu

SEQ ID NO: 2868750 - RNA, 12 nt, Human
caucagggccug

SEQ ID NO: 2868751 - RNA, 13 nt, Human
caucagggccugg

SEQ ID NO: 2868752 - RNA, 15 nt, Human
caucagggccugggg

SEQ ID NO: 2868753 - RNA, 16 nt, Human
caucagggccuggggc

SEQ ID NO: 2868754 - RNA, 18 nt, Human
caucagggccuggggccu

SEQ ID NO: 2868755 - RNA, 21 nt, Human
caucagggccuggggccugag

SEQ ID NO: 2868756 - RNA, 22 nt, Human
caucagggccuggggccugaga

SEQ ID NO: 2868757 - RNA, 23 nt, Human
caucagggccuggggccugagag

SEQ ID NO: 2868758 - RNA, 12 nt, Human
caucagggggaa

SEQ ID NO: 2868759 - RNA, 14 nt, Human
caucagggggaaga

SEQ ID NO: 2868760 - RNA, 17 nt, Human
caucagggggaagaagc

SEQ ID NO: 2868761 - RNA, 18 nt, Human
caucagggggaagaagca

SEQ ID NO: 2868762 - RNA, 19 nt, Human
caucagggggaagaagcag

SEQ ID NO: 2868763 - RNA, 21 nt, Human
caucagggggaagaagcagag

SEQ ID NO: 2868764 - RNA, 12 nt, Human
caucauaaaaua

SEQ ID NO: 2868765 - RNA, 20 nt, Human
caucaguuagagcugacaca

SEQ ID NO: 2868766 - RNA, 15 nt, Human
caucaguuauucauu

SEQ ID NO: 2868767 - RNA, 19 nt, Human
caucaguuccuuugugugu

SEQ ID NO: 2868768 - RNA, 15 nt, Human
caucaguuagagcug

SEQ ID NO: 2868769 - RNA, 16 nt, Human
caucaguuagagcuga

SEQ ID NO: 2868770 - RNA, 18 nt, Human
caucaguuagagcugaca

SEQ ID NO: 2868771 - RNA, 14 nt, Human
caucaguggagcca

SEQ ID NO: 2868772 - RNA, 15 nt, Human
caucagucccuaugu

SEQ ID NO: 2868773 - RNA, 17 nt, Human
caucagucccuauguau

SEQ ID NO: 2868774 - RNA, 20 nt, Human
caucaugaggaaagcaguug

SEQ ID NO: 2868775 - RNA, 16 nt, Human
caucaugaauuuuaca

SEQ ID NO: 2868776 - RNA, 21 nt, Human
caucaucaaggcacugccuga

SEQ ID NO: 2868777 - RNA, 17 nt, Human
caucaucaguggagcca

SEQ ID NO: 2868778 - RNA, 13 nt, Human
caucaucagggcc

SEQ ID NO: 2868779 - RNA, 14 nt, Human
caucaucagggccu

SEQ ID NO: 2868780 - RNA, 15 nt, Human
caucaucagggccug

SEQ ID NO: 2868781 - RNA, 16 nt, Human
caucaucagggccugg

SEQ ID NO: 2868782 - RNA, 20 nt, Human
caucauaguaaaagaaauga

SEQ ID NO: 2868783 - RNA, 13 nt, Human
caucaucaaggca

SEQ ID NO: 2868784 - RNA, 19 nt, Human
caucaucaaggcacugccu

SEQ ID NO: 2868785 - RNA, 20 nt, Human
caucaucaaggcacugccug

SEQ ID NO: 2868786 - RNA, 20 nt, Human
caucauaaaauaaaguauau

SEQ ID NO: 2868787 - RNA, 18 nt, Human
caucauaaaauaaaguau

SEQ ID NO: 2868788 - RNA, 14 nt, Human
caucauaaaauaaa

SEQ ID NO: 2868789 - RNA, 13 nt, Human
caucauaaaauaa

SEQ ID NO: 2868790 - RNA, 23 nt, Human
caucauaaaauaaaguauauaua

SEQ ID NO: 2868791 - RNA, 22 nt, Human
caucauaaaauaaaguauauau

SEQ ID NO: 2868792 - RNA, 15 nt, Human
caucaugucuggcua

SEQ ID NO: 2868793 - RNA, 14 nt, Human
caucaugucuggcu

SEQ ID NO: 2868794 - RNA, 10 nt, Human
caucauguca

SEQ ID NO: 2868795 - RNA, 13 nt, Human
caucaugucuggc

SEQ ID NO: 2868796 - RNA, 12 nt, Human
caucaugcaugu

SEQ ID NO: 2868797 - RNA, 12 nt, Human
caucaugcagcu

SEQ ID NO: 2868798 - RNA, 13 nt, Human
caucaugcagcuc

SEQ ID NO: 2868799 - RNA, 21 nt, Human
caucaugcuggaaccugcaaa

SEQ ID NO: 2868800 - RNA, 22 nt, Human
caucaugcuggaaccugcaaaa

SEQ ID NO: 2868801 - RNA, 23 nt, Human
cauauaccuauaauguguguaug

SEQ ID NO: 2868802 - RNA, 18 nt, Human
cauauacuguucuucauu

SEQ ID NO: 2868803 - RNA, 21 nt, Human
cauauacuguucuucauuuua

SEQ ID NO: 2868804 - RNA, 14 nt, Human
cauauagagaugaa

SEQ ID NO: 2868805 - RNA, 20 nt, Human
cauauagagaugaaguuugu

SEQ ID NO: 2868806 - RNA, 18 nt, Human
cauauagcaaaacuuuua

SEQ ID NO: 2868807 - RNA, 19 nt, Human
cauauagcaaaacuuuuaa

SEQ ID NO: 2868808 - RNA, 21 nt, Human
cauauagcaaaacuuuuaaac

SEQ ID NO: 2868809 - RNA, 22 nt, Human
cauauagcaaaacuuuuaaacu

SEQ ID NO: 2868810 - RNA, 19 nt, Human
cauauagccauugaucaua

SEQ ID NO: 2868811 - RNA, 18 nt, Human
cauauaggugauguuugc

SEQ ID NO: 2868812 - RNA, 19 nt, Human
cauauaggugauguuugcu

SEQ ID NO: 2868813 - RNA, 18 nt, Human
cauagugaugguuccccu

SEQ ID NO: 2868814 - RNA, 19 nt, Human
cauagugaugguuccccug

SEQ ID NO: 2868815 - RNA, 23 nt, Human
cauauauauguuuuaagaggcag

SEQ ID NO: 2868816 - RNA, 13 nt, Human
cauauauauuaca

SEQ ID NO: 2868817 - RNA, 12 nt, Human
cauauauauuac

SEQ ID NO: 2868818 - RNA, 16 nt, Human
cauauauauuacaagg

SEQ ID NO: 2868819 - RNA, 20 nt, Human
cauauauccuuuucuucuau

SEQ ID NO: 2868820 - RNA, 22 nt, Human
cauauauccuuuucuucuaugu

SEQ ID NO: 2868821 - RNA, 23 nt, Human
cauauauccuuuucuucuaugua

SEQ ID NO: 2868822 - RNA, 17 nt, Human
cauauaugaggacuugu

SEQ ID NO: 2868823 - RNA, 22 nt, Human
cauauauuuuuaaaaaaugaaa

SEQ ID NO: 2868824 - RNA, 14 nt, Human
cauaucuacagaua

SEQ ID NO: 2868825 - RNA, 17 nt, Human
cauaucgcugacuucau

SEQ ID NO: 2868826 - RNA, 18 nt, Human
cauaucgcugacuucaug

SEQ ID NO: 2868827 - RNA, 22 nt, Human
cauaucgcugacuucauggaau

SEQ ID NO: 2868828 - RNA, 18 nt, Human
cauaucggcucacaaaga

SEQ ID NO: 2868829 - RNA, 15 nt, Human
cagugcuguacuuga

SEQ ID NO: 2868830 - RNA, 19 nt, Human
cagugcuguccaugcuucu

SEQ ID NO: 2868831 - RNA, 22 nt, Human
cagugcuguccaugcuucucau

SEQ ID NO: 2868832 - RNA, 20 nt, Human
cagugcuguggccugggcaa

SEQ ID NO: 2868833 - RNA, 12 nt, Human
cagugcugugug

SEQ ID NO: 2868834 - RNA, 18 nt, Human
cagugcuguggccugggc

SEQ ID NO: 2868835 - RNA, 15 nt, Human
cagugcuguggccug

SEQ ID NO: 2868836 - RNA, 13 nt, Human
cagugcuguggcc

SEQ ID NO: 2868837 - RNA, 12 nt, Human
cagugcuguggc

SEQ ID NO: 2868838 - RNA, 15 nt, Human
cagugcuugccacag

SEQ ID NO: 2868839 - RNA, 17 nt, Human
cagugcuugccacagag

SEQ ID NO: 2868840 - RNA, 18 nt, Human
cagugcuugccacagagc

SEQ ID NO: 2868841 - RNA, 17 nt, Human
cagugcuguggccuggg

SEQ ID NO: 2868842 - RNA, 13 nt, Human
cauaguaaaagaa

SEQ ID NO: 2868843 - RNA, 14 nt, Human
cagugcuugccaca

SEQ ID NO: 2868844 - RNA, 20 nt, Human
cagugcuucagccugaggcu

SEQ ID NO: 2868845 - RNA, 19 nt, Human
cagugcuucagccugaggc

SEQ ID NO: 2868846 - RNA, 18 nt, Human
cagugcuucagccugagg

SEQ ID NO: 2868847 - RNA, 17 nt, Human
cagugcuucagccugag

SEQ ID NO: 2868848 - RNA, 16 nt, Human
cagugcuucagccuga

SEQ ID NO: 2868849 - RNA, 15 nt, Human
cagugcuucagccug

SEQ ID NO: 2868850 - RNA, 14 nt, Human
cagugcuucagccu

SEQ ID NO: 2868851 - RNA, 19 nt, Human
cagugcuguggccugggca

SEQ ID NO: 2868852 - RNA, 15 nt, Human
cauaguaugguggcu

SEQ ID NO: 2868853 - RNA, 20 nt, Human
cauaguaaguucagcacuug

SEQ ID NO: 2868854 - RNA, 21 nt, Human
cauaguaaguucagcacuugu

SEQ ID NO: 2868855 - RNA, 22 nt, Human
cauaguaacuucuuauggaauu

SEQ ID NO: 2868856 - RNA, 21 nt, Human
cauaguaacuucuuauggaau

SEQ ID NO: 2868857 - RNA, 15 nt, Human
cauaguaacugacau

SEQ ID NO: 2868858 - RNA, 20 nt, Human
cauaguaacugacaugauua

SEQ ID NO: 2868859 - RNA, 24 nt, Human
cauaguaacuucuuauggaauuga

SEQ ID NO: 2868860 - RNA, 23 nt, Human
cauaguaacuucuuauggaauug

SEQ ID NO: 2868861 - RNA, 16 nt, Human
cauaguaugguggcug

SEQ ID NO: 2868862 - RNA, 20 nt, Human
cauaguaguaugaugauaca

SEQ ID NO: 2868863 - RNA, 13 nt, Human
cauaguaguuuuu

SEQ ID NO: 2868864 - RNA, 17 nt, Human
cauaguaguuuuuacag

SEQ ID NO: 2868865 - RNA, 20 nt, Human
cauaguaguuuuuacagcug

SEQ ID NO: 2868866 - RNA, 13 nt, Human
cauagucacaugg

SEQ ID NO: 2868867 - RNA, 13 nt, Human
cauauugugccaa

SEQ ID NO: 2868868 - RNA, 20 nt, Human
cauauugugccaauauguau

SEQ ID NO: 2868869 - RNA, 14 nt, Human
cauauugguauuca

SEQ ID NO: 2868870 - RNA, 16 nt, Human
cauauugguauucacu

SEQ ID NO: 2868871 - RNA, 16 nt, Human
cauauuggaaaaauca

SEQ ID NO: 2868872 - RNA, 17 nt, Human
cauauuggcauggauuu

SEQ ID NO: 2868873 - RNA, 15 nt, Human
cauauucuugugcuu

SEQ ID NO: 2868874 - RNA, 17 nt, Human
cauauucuuucaauucu

SEQ ID NO: 2868875 - RNA, 20 nt, Human
cauauucuuuucugcaaaau

SEQ ID NO: 2868876 - RNA, 22 nt, Human
cauaugacauucaugccuggcu

SEQ ID NO: 2868877 - RNA, 16 nt, Human
cauauugaauguuucc

SEQ ID NO: 2868878 - RNA, 13 nt, Human
cauauugaugaaa

SEQ ID NO: 2868879 - RNA, 14 nt, Human
cauauugaugaaaa

SEQ ID NO: 2868880 - RNA, 15 nt, Human
cauauugaugaaaag

SEQ ID NO: 2868881 - RNA, 16 nt, Human
cauauugaugaaaaga

SEQ ID NO: 2868882 - RNA, 20 nt, Human
cauauugaugaaaagauuua

SEQ ID NO: 2868883 - RNA, 22 nt, Human
cauauucuguuggccaguguga

SEQ ID NO: 2868884 - RNA, 19 nt, Human
cauaugacauucaugccug

SEQ ID NO: 2868885 - RNA, 21 nt, Human
cauaugacauucaugccuggc

SEQ ID NO: 2868886 - RNA, 13 nt, Human
cauaucucuaauu

SEQ ID NO: 2868887 - RNA, 20 nt, Human
cauaucuugcgaauccaagc

SEQ ID NO: 2868888 - RNA, 21 nt, Human
cauaucuugcgaauccaagcu

SEQ ID NO: 2868889 - RNA, 22 nt, Human
cauaucuugcgaauccaagcuc

SEQ ID NO: 2868890 - RNA, 23 nt, Human
cauaucuugcgaauccaagcucc

SEQ ID NO: 2868891 - RNA, 18 nt, Human
cauaucuuaaagaaacag

SEQ ID NO: 2868892 - RNA, 20 nt, Human
cauaucuuaaagaaacagcu

SEQ ID NO: 2868893 - RNA, 23 nt, Human
cauaucuuaaagaaacagcuuuc

SEQ ID NO: 2868894 - RNA, 13 nt, Human
cauaugaaauccu

SEQ ID NO: 2868895 - RNA, 23 nt, Human
cauauugugcuucacaguagagc

SEQ ID NO: 2868896 - RNA, 21 nt, Human
cauauugugcuucacaguaga

SEQ ID NO: 2868897 - RNA, 21 nt, Human
cauauugugccaauauguauu

SEQ ID NO: 2868898 - RNA, 22 nt, Human
cauauugugccaauauguauug

SEQ ID NO: 2868899 - RNA, 14 nt, Human
cauauuuaaagaca

SEQ ID NO: 2868900 - RNA, 13 nt, Human
cauauuuaacugg

SEQ ID NO: 2868901 - RNA, 14 nt, Human
cauauuuaacuggu

SEQ ID NO: 2868902 - RNA, 10 nt, Human
cauauuuaau

SEQ ID NO: 2868903 - RNA, 13 nt, Human
cauauuuaauguu

SEQ ID NO: 2868904 - RNA, 14 nt, Human
cauauuuaauguuu

SEQ ID NO: 2868905 - RNA, 15 nt, Human
cauauuuaauguuuu

SEQ ID NO: 2868906 - RNA, 16 nt, Human
cauauuuaauguuuua

SEQ ID NO: 2868907 - RNA, 18 nt, Human
cauauuuaauguuuuaaa

SEQ ID NO: 2868908 - RNA, 20 nt, Human
cauauuuaauguuuuaaaug

SEQ ID NO: 2868909 - RNA, 21 nt, Human
cauauuuaauguuuuaaaugu

SEQ ID NO: 2868910 - RNA, 22 nt, Human
cauauuuaauguuuuaaaugua

SEQ ID NO: 2868911 - RNA, 23 nt, Human
cauauuuaauguuuuaaauguac

SEQ ID NO: 2868912 - RNA, 12 nt, Human
cauauuuggaag

SEQ ID NO: 2868913 - RNA, 13 nt, Human
cauauuuggaaga

SEQ ID NO: 2868914 - RNA, 15 nt, Human
cauauuuggaagaaa

SEQ ID NO: 2868915 - RNA, 14 nt, Human
cauauuuguggaau

SEQ ID NO: 2868916 - RNA, 16 nt, Human
caucaacaaagaaaua

SEQ ID NO: 2868917 - RNA, 16 nt, Human
caucaacaagauuucc

SEQ ID NO: 2868918 - RNA, 15 nt, Human
caucaaauggaagac

SEQ ID NO: 2868919 - RNA, 16 nt, Human
caucaaauggaagaca

SEQ ID NO: 2868920 - RNA, 17 nt, Human
caucaaauggaagacac

SEQ ID NO: 2868921 - RNA, 19 nt, Human
caucaaauggaagacacau

SEQ ID NO: 2868922 - RNA, 14 nt, Human
caugaagagcaaaa

SEQ ID NO: 2868923 - RNA, 15 nt, Human
caugaagagcaaaaa

SEQ ID NO: 2868924 - RNA, 17 nt, Human
caugaagagcaaaaaua

SEQ ID NO: 2868925 - RNA, 19 nt, Human
caugaagagcaaaaauauc

SEQ ID NO: 2868926 - RNA, 20 nt, Human
caugacucguauaugucuca

SEQ ID NO: 2868927 - RNA, 23 nt, Human
caugacucguauaugucucaggu

SEQ ID NO: 2868928 - RNA, 18 nt, Human
caugaccuuauccuuccu

SEQ ID NO: 2868929 - RNA, 20 nt, Human
caugaccuuauccuuccucu

SEQ ID NO: 2868930 - RNA, 14 nt, Human
caugaccuccaggg

SEQ ID NO: 2868931 - RNA, 22 nt, Human
caugaccugaucacuagccugu

SEQ ID NO: 2868932 - RNA, 23 nt, Human
caugaccugaucacuagccuguc

SEQ ID NO: 2868933 - RNA, 17 nt, Human
caugagauguguggacu

SEQ ID NO: 2868934 - RNA, 15 nt, Human
caugagaugugugga

SEQ ID NO: 2868935 - RNA, 23 nt, Human
caugagauguguggacuguggca

SEQ ID NO: 2868936 - RNA, 12 nt, Human
caugagaugugu

SEQ ID NO: 2868937 - RNA, 14 nt, Human
caugagaugugugg

SEQ ID NO: 2868938 - RNA, 22 nt, Human
caugagacccuggugccuggcu

SEQ ID NO: 2868939 - RNA, 23 nt, Human
caugagacccuggugccuggcuc

SEQ ID NO: 2868940 - RNA, 21 nt, Human
caugacuuguagcauauucuu

SEQ ID NO: 2868941 - RNA, 16 nt, Human
caugagaacaaacaga

SEQ ID NO: 2868942 - RNA, 20 nt, Human
caugagaauaagagaaagaa

SEQ ID NO: 2868943 - RNA, 19 nt, Human
caugagaaucuauauuuaa

SEQ ID NO: 2868944 - RNA, 12 nt, Human
caugagaaucua

SEQ ID NO: 2868945 - RNA, 22 nt, Human
caugagaaguugauauagaaca

SEQ ID NO: 2868946 - RNA, 21 nt, Human
caugagccucagcauccuggc

SEQ ID NO: 2868947 - RNA, 20 nt, Human
caugagccucagcauccugg

SEQ ID NO: 2868948 - RNA, 19 nt, Human
caugagccucagcauccug

SEQ ID NO: 2868949 - RNA, 18 nt, Human
caugagccucagcauccu

SEQ ID NO: 2868950 - RNA, 17 nt, Human
caugagccucagcaucc

SEQ ID NO: 2868951 - RNA, 15 nt, Human
caugagccucagcau

SEQ ID NO: 2868952 - RNA, 12 nt, Human
caugagccucag

SEQ ID NO: 2868953 - RNA, 17 nt, Human
caugagcauuggauaca

SEQ ID NO: 2868954 - RNA, 20 nt, Human
caugagcauuggauacagca

SEQ ID NO: 2868955 - RNA, 22 nt, Human
caugagcauuggauacagcagu

SEQ ID NO: 2868956 - RNA, 23 nt, Human
caugagcauuggauacagcagua

SEQ ID NO: 2868957 - RNA, 23 nt, Human
caugaggaggggccccccugccc

SEQ ID NO: 2868958 - RNA, 22 nt, Human
caugaggaggggccccccugcc

SEQ ID NO: 2868959 - RNA, 23 nt, Human
caugaggcaaugucaggaacaga

SEQ ID NO: 2868960 - RNA, 22 nt, Human
caugaggcaaugucaggaacag

SEQ ID NO: 2868961 - RNA, 24 nt, Human
caugaggcaaugucaggaacagaa

SEQ ID NO: 2868962 - RNA, 18 nt, Human
caugaggaacuguagaug

SEQ ID NO: 2868963 - RNA, 14 nt, Human
caugagcuuuuaua

SEQ ID NO: 2868964 - RNA, 21 nt, Human
caugaggaaagcaguugaaau

SEQ ID NO: 2868965 - RNA, 22 nt, Human
caugaggaaagcaguugaaaug

SEQ ID NO: 2868966 - RNA, 22 nt, Human
caugaggaacuguagaugaugu

SEQ ID NO: 2868967 - RNA, 15 nt, Human
caugaggaaggaaca

SEQ ID NO: 2868968 - RNA, 20 nt, Human
caugaggacaugauggagcg

SEQ ID NO: 2868969 - RNA, 22 nt, Human
caugaggacaugauggagcgca

SEQ ID NO: 2868970 - RNA, 21 nt, Human
caugaggacaugauggagcgc

SEQ ID NO: 2868971 - RNA, 21 nt, Human
caugaggaggggccccccugc

SEQ ID NO: 2868972 - RNA, 13 nt, Human
caugaggaggggc

SEQ ID NO: 2868973 - RNA, 19 nt, Human
caugaggagaaaaaaagca

SEQ ID NO: 2868974 - RNA, 23 nt, Human
caugagccucagcauccuggcac

SEQ ID NO: 2868975 - RNA, 22 nt, Human
caugagccucagcauccuggca

SEQ ID NO: 2868976 - RNA, 21 nt, Human
caugaguccuugaaaauauuu

SEQ ID NO: 2868977 - RNA, 14 nt, Human
caugagugcgugcu

SEQ ID NO: 2868978 - RNA, 17 nt, Human
caugaguccuugaaaau

SEQ ID NO: 2868979 - RNA, 18 nt, Human
caugaguccuugaaaaua

SEQ ID NO: 2868980 - RNA, 19 nt, Human
caugaguccuugaaaauau

SEQ ID NO: 2868981 - RNA, 20 nt, Human
caugaguccuugaaaauauu

SEQ ID NO: 2868982 - RNA, 13 nt, Human
caugauauuuugu

SEQ ID NO: 2868983 - RNA, 20 nt, Human
caugauauuuuguuuuuccc

SEQ ID NO: 2868984 - RNA, 21 nt, Human
caugauauuuuguuuuucccc

SEQ ID NO: 2868985 - RNA, 13 nt, Human
caugauaaaugau

SEQ ID NO: 2868986 - RNA, 22 nt, Human
caugaguuugcccugguuucac

SEQ ID NO: 2868987 - RNA, 16 nt, Human
caugaguuugcccugg

SEQ ID NO: 2868988 - RNA, 15 nt, Human
caugaguuugcccug

SEQ ID NO: 2868989 - RNA, 16 nt, Human
caugaguuuaaaucaa

SEQ ID NO: 2868990 - RNA, 18 nt, Human
caugagugcgugcucagu

SEQ ID NO: 2868991 - RNA, 18 nt, Human
caugaguuacugugcauu

SEQ ID NO: 2868992 - RNA, 16 nt, Human
caugcacucagcucuu

SEQ ID NO: 2868993 - RNA, 12 nt, Human
caugcacugacc

SEQ ID NO: 2868994 - RNA, 14 nt, Human
caugcacugacccu

SEQ ID NO: 2868995 - RNA, 17 nt, Human
caugcacugacccuucc

SEQ ID NO: 2868996 - RNA, 18 nt, Human
caugcacugacccuucca

SEQ ID NO: 2868997 - RNA, 19 nt, Human
caugcacugacccuuccag

SEQ ID NO: 2868998 - RNA, 20 nt, Human
caugcacugacccuuccaga

SEQ ID NO: 2868999 - RNA, 22 nt, Human
caugcacugacccuuccagaca

SEQ ID NO: 2869000 - RNA, 15 nt, Human
caugcacucagcucu

SEQ ID NO: 2869001 - RNA, 15 nt, Human
caugaugagcuccuc

SEQ ID NO: 2869002 - RNA, 19 nt, Human
caugaugagcuccucuucc

SEQ ID NO: 2869003 - RNA, 18 nt, Human
caugaugagcuccucuuc

SEQ ID NO: 2869004 - RNA, 22 nt, Human
caugaaauauagaucaguuaua

SEQ ID NO: 2869005 - RNA, 19 nt, Human
caugaaacagaaacaaaaa

SEQ ID NO: 2869006 - RNA, 14 nt, Human
caugaaacuccacc

SEQ ID NO: 2869007 - RNA, 15 nt, Human
caugaaacuccaccu

SEQ ID NO: 2869008 - RNA, 13 nt, Human
caugaaacaaagc

SEQ ID NO: 2869009 - RNA, 11 nt, Human
caugaaacacc

SEQ ID NO: 2869010 - RNA, 11 nt, Human
caugaaaauuu

SEQ ID NO: 2869011 - RNA, 13 nt, Human
caugaaaauuuua

SEQ ID NO: 2869012 - RNA, 14 nt, Human
caugaaaauuuuaa

SEQ ID NO: 2869013 - RNA, 17 nt, Human
caugaaaauuuuaaaaa

SEQ ID NO: 2869014 - RNA, 19 nt, Human
caugaaaauuuuaaaaaua

SEQ ID NO: 2869015 - RNA, 15 nt, Human
caugaaacagaaaca

SEQ ID NO: 2869016 - RNA, 13 nt, Human
caugaaacagaaa

SEQ ID NO: 2869017 - RNA, 22 nt, Human
caugaaaugauagauuugaccu

SEQ ID NO: 2869018 - RNA, 13 nt, Human
caugaaauaugca

SEQ ID NO: 2869019 - RNA, 14 nt, Human
caugaaauaugcau

SEQ ID NO: 2869020 - RNA, 15 nt, Human
caugaaauaugcauc

SEQ ID NO: 2869021 - RNA, 24 nt, Human
caugaaaguagacaguuuugagaa

SEQ ID NO: 2869022 - RNA, 22 nt, Human
caugaaaguagcagugugaagu

SEQ ID NO: 2869023 - RNA, 24 nt, Human
caugaaauugucuagcagagcagg

SEQ ID NO: 2869024 - RNA, 14 nt, Human
caugaaauuuuuaa

SEQ ID NO: 2869025 - RNA, 16 nt, Human
caugaaauuuuuguaa

SEQ ID NO: 2869026 - RNA, 17 nt, Human
caugaaauuuuuguaaa

SEQ ID NO: 2869027 - RNA, 18 nt, Human
caugaaauuuuuguaaau

SEQ ID NO: 2869028 - RNA, 14 nt, Human
caugaaauuacuua

SEQ ID NO: 2869029 - RNA, 18 nt, Human
caugaacacccuuagaaa

SEQ ID NO: 2869030 - RNA, 22 nt, Human
caugaacagaaaacauucugau

SEQ ID NO: 2869031 - RNA, 23 nt, Human
caugaacagaaaacauucugauu

SEQ ID NO: 2869032 - RNA, 17 nt, Human
caugaagacaggacagu

SEQ ID NO: 2869033 - RNA, 16 nt, Human
caugaagacaggacag

SEQ ID NO: 2869034 - RNA, 15 nt, Human
caugaagacaggaca

SEQ ID NO: 2869035 - RNA, 14 nt, Human
caugaagacaggac

SEQ ID NO: 2869036 - RNA, 14 nt, Human
caugaagacaggau

SEQ ID NO: 2869037 - RNA, 12 nt, Human
caugaagagaag

SEQ ID NO: 2869038 - RNA, 15 nt, Human
caugaagagaagcaa

SEQ ID NO: 2869039 - RNA, 16 nt, Human
caugaagagaagcaau

SEQ ID NO: 2869040 - RNA, 18 nt, Human
caugaagagaagcaauuu

SEQ ID NO: 2869041 - RNA, 21 nt, Human
caugaagagaagcaauuuugg

SEQ ID NO: 2869042 - RNA, 18 nt, Human
caucuuuuuuguuaacug

SEQ ID NO: 2869043 - RNA, 11 nt, Human
caucuuuuuaa

SEQ ID NO: 2869044 - RNA, 16 nt, Human
caucuuuuuaaagcuu

SEQ ID NO: 2869045 - RNA, 21 nt, Human
caucuuuuuaaagcuuaucca

SEQ ID NO: 2869046 - RNA, 22 nt, Human
caucuuuuuaaagcuuauccau

SEQ ID NO: 2869047 - RNA, 23 nt, Human
caucuuuuuaaagcuuauccaua

SEQ ID NO: 2869048 - RNA, 21 nt, Human
caucuuuuuaaccugcaaaau

SEQ ID NO: 2869049 - RNA, 13 nt, Human
caucuuuuacauu

SEQ ID NO: 2869050 - RNA, 13 nt, Human
caucuuuuaaaga

SEQ ID NO: 2869051 - RNA, 15 nt, Human
caucuuuuaaagaaa

SEQ ID NO: 2869052 - RNA, 14 nt, Human
caucuuuuaagaca

SEQ ID NO: 2869053 - RNA, 16 nt, Human
caucuuuuaagacaaa

SEQ ID NO: 2869054 - RNA, 21 nt, Human
caucuuuugaggcuucuguuc

SEQ ID NO: 2869055 - RNA, 14 nt, Human
caucuuugccucuc

SEQ ID NO: 2869056 - RNA, 17 nt, Human
caucuuugccuugggcu

SEQ ID NO: 2869057 - RNA, 15 nt, Human
caucuuugccuuggg

SEQ ID NO: 2869058 - RNA, 22 nt, Human
caucuuugccuugggcugcucc

SEQ ID NO: 2869059 - RNA, 23 nt, Human
caucuuugccuugggcugcuccu

SEQ ID NO: 2869060 - RNA, 11 nt, Human
caucuuugggg

SEQ ID NO: 2869061 - RNA, 12 nt, Human
caucuuugggga

SEQ ID NO: 2869062 - RNA, 15 nt, Human
caucuuuggggaggu

SEQ ID NO: 2869063 - RNA, 18 nt, Human
caucuuuggggagguguu

SEQ ID NO: 2869064 - RNA, 21 nt, Human
caucuuuggggagguguucac

SEQ ID NO: 2869065 - RNA, 19 nt, Human
caucuuugacacucugcag

SEQ ID NO: 2869066 - RNA, 21 nt, Human
caucuuuccugauggcaggau

SEQ ID NO: 2869067 - RNA, 21 nt, Human
caucuuucuucuauuuuauuc

SEQ ID NO: 2869068 - RNA, 16 nt, Human
caucuuucuucuauuu

SEQ ID NO: 2869069 - RNA, 17 nt, Human
caucuuuaucuguucuu

SEQ ID NO: 2869070 - RNA, 22 nt, Human
caucuuuacaaaacuacaugag

SEQ ID NO: 2869071 - RNA, 16 nt, Human
caucuuuaucuguucu

SEQ ID NO: 2869072 - RNA, 19 nt, Human
caucuuuccugauggcagg

SEQ ID NO: 2869073 - RNA, 13 nt, Human
caucuuuccuguc

SEQ ID NO: 2869074 - RNA, 11 nt, Human
caucuuucucu

SEQ ID NO: 2869075 - RNA, 20 nt, Human
caucuuucucuuuucuaaaa

SEQ ID NO: 2869076 - RNA, 22 nt, Human
caucucucuacuccuaccucag

SEQ ID NO: 2869077 - RNA, 21 nt, Human
caucucucuacuccuaccuca

SEQ ID NO: 2869078 - RNA, 23 nt, Human
caucucucccuccccugccauuu

SEQ ID NO: 2869079 - RNA, 20 nt, Human
caucucucccuccccugcca

SEQ ID NO: 2869080 - RNA, 16 nt, Human
caucucucccuccccu

SEQ ID NO: 2869081 - RNA, 15 nt, Human
caucucucccucccc

SEQ ID NO: 2869082 - RNA, 12 nt, Human
caucucucccuc

SEQ ID NO: 2869083 - RNA, 16 nt, Human
caucucucauccucca

SEQ ID NO: 2869084 - RNA, 17 nt, Human
caucucucauccuccag

SEQ ID NO: 2869085 - RNA, 12 nt, Human
caucucucccca

SEQ ID NO: 2869086 - RNA, 13 nt, Human
caucucuccccaa

SEQ ID NO: 2869087 - RNA, 23 nt, Human
caucucucuacuccuaccucagc

SEQ ID NO: 2869088 - RNA, 11 nt, Human
caucucugcac

SEQ ID NO: 2869089 - RNA, 13 nt, Human
caucucugcuugg

SEQ ID NO: 2869090 - RNA, 14 nt, Human
caucucuggaugcc

SEQ ID NO: 2869091 - RNA, 16 nt, Human
caucucuggaugccug

SEQ ID NO: 2869092 - RNA, 15 nt, Human
caucugaagagcaga

SEQ ID NO: 2869093 - RNA, 19 nt, Human
caucugaaggggcaaauuc

SEQ ID NO: 2869094 - RNA, 21 nt, Human
caucugaaggggcaaauucuu

SEQ ID NO: 2869095 - RNA, 22 nt, Human
caucugaaggggcaaauucuuu

SEQ ID NO: 2869096 - RNA, 18 nt, Human
caucugaauuugcccugg

SEQ ID NO: 2869097 - RNA, 19 nt, Human
caucugaauuugcccuggg

SEQ ID NO: 2869098 - RNA, 20 nt, Human
caucugaauuugcccuggga

SEQ ID NO: 2869099 - RNA, 23 nt, Human
caucugaauuugcccugggaaac

SEQ ID NO: 2869100 - RNA, 14 nt, Human
caucugaaaguaga

SEQ ID NO: 2869101 - RNA, 14 nt, Human
caucucuuuguaca

SEQ ID NO: 2869102 - RNA, 17 nt, Human
caucugccccuccccca

SEQ ID NO: 2869103 - RNA, 16 nt, Human
caucugccccuccccc

SEQ ID NO: 2869104 - RNA, 15 nt, Human
caucugccccucccc

SEQ ID NO: 2869105 - RNA, 14 nt, Human
caucugccccuccc

SEQ ID NO: 2869106 - RNA, 13 nt, Human
caucugccccucc

SEQ ID NO: 2869107 - RNA, 11 nt, Human
caucugccccu

SEQ ID NO: 2869108 - RNA, 20 nt, Human
caucugcauuuucaccccac

SEQ ID NO: 2869109 - RNA, 17 nt, Human
caucugcccaacugugu

SEQ ID NO: 2869110 - RNA, 19 nt, Human
caucugcccaacuguguag

SEQ ID NO: 2869111 - RNA, 22 nt, Human
caucugcccaacuguguagcau

SEQ ID NO: 2869112 - RNA, 19 nt, Human
caucugcauuuucacccca

SEQ ID NO: 2869113 - RNA, 13 nt, Human
caucugcacccuu

SEQ ID NO: 2869114 - RNA, 15 nt, Human
caucugcacccuucu

SEQ ID NO: 2869115 - RNA, 16 nt, Human
caucugcacccuucuu

SEQ ID NO: 2869116 - RNA, 17 nt, Human
caucugcacccuucuuu

SEQ ID NO: 2869117 - RNA, 18 nt, Human
caucugcacccuucuuuu

SEQ ID NO: 2869118 - RNA, 19 nt, Human
caucugcacccuucuuuuc

SEQ ID NO: 2869119 - RNA, 20 nt, Human
caucugcacccuucuuuucu

SEQ ID NO: 2869120 - RNA, 21 nt, Human
caucugcacccuucuuuucuc

SEQ ID NO: 2869121 - RNA, 22 nt, Human
caucugcacccuucuuuucuca

SEQ ID NO: 2869122 - RNA, 16 nt, Human
caucugcauugcccag

SEQ ID NO: 2869123 - RNA, 17 nt, Human
caucugcauugcccagu

SEQ ID NO: 2869124 - RNA, 18 nt, Human
caucugcauugcccaguc

SEQ ID NO: 2869125 - RNA, 21 nt, Human
caucucgcucccucccaggac

SEQ ID NO: 2869126 - RNA, 22 nt, Human
caucucgcucccucccaggacu

SEQ ID NO: 2869127 - RNA, 14 nt, Human
caucucggagcauc

SEQ ID NO: 2869128 - RNA, 15 nt, Human
caucucggagcaucc

SEQ ID NO: 2869129 - RNA, 20 nt, Human
caucucggagcaucccggag

SEQ ID NO: 2869130 - RNA, 21 nt, Human
caucucggagcaucccggagg

SEQ ID NO: 2869131 - RNA, 20 nt, Human
caucucgcucccucccagga

SEQ ID NO: 2869132 - RNA, 19 nt, Human
caucucgcucccucccagg

SEQ ID NO: 2869133 - RNA, 17 nt, Human
caucucgcucccuccca

SEQ ID NO: 2869134 - RNA, 14 nt, Human
caucucgcucccuc

SEQ ID NO: 2869135 - RNA, 18 nt, Human
caucuccuauaaucuguc

SEQ ID NO: 2869136 - RNA, 19 nt, Human
caucuccuauaaucuguca

SEQ ID NO: 2869137 - RNA, 20 nt, Human
caucuccuauaaucugucaa

SEQ ID NO: 2869138 - RNA, 21 nt, Human
caucuccuauaaucugucaaa

SEQ ID NO: 2869139 - RNA, 13 nt, Human
caucucccuuccu

SEQ ID NO: 2869140 - RNA, 22 nt, Human
caucucccuuccugugggagca

SEQ ID NO: 2869141 - RNA, 16 nt, Human
cauccgccuuuuguau

SEQ ID NO: 2869142 - RNA, 19 nt, Human
cauccgccuuuuguauaca

SEQ ID NO: 2869143 - RNA, 18 nt, Human
cauccuacaagacacagu

SEQ ID NO: 2869144 - RNA, 19 nt, Human
cauccuacaagacacagug

SEQ ID NO: 2869145 - RNA, 17 nt, Human
cauccuacaagacacag

SEQ ID NO: 2869146 - RNA, 17 nt, Human
caucuugcucugcugac

SEQ ID NO: 2869147 - RNA, 16 nt, Human
caucuugcucugcuga

SEQ ID NO: 2869148 - RNA, 19 nt, Human
caucuugcucugcugacag

SEQ ID NO: 2869149 - RNA, 15 nt, Human
caucuugcucugcug

SEQ ID NO: 2869150 - RNA, 15 nt, Human
caucuuguguuuuau

SEQ ID NO: 2869151 - RNA, 17 nt, Human
caucuuuaaacaguauu

SEQ ID NO: 2869152 - RNA, 19 nt, Human
caucuuuaaacaguauuuc

SEQ ID NO: 2869153 - RNA, 20 nt, Human
caucuugaagggcccaggag

SEQ ID NO: 2869154 - RNA, 20 nt, Human
caucuucuguugcucucugu

SEQ ID NO: 2869155 - RNA, 17 nt, Human
caucuucugccuuaguc

SEQ ID NO: 2869156 - RNA, 23 nt, Human
caucuuucuucuauuuuauuccc

SEQ ID NO: 2869157 - RNA, 13 nt, Human
ccaccucccucac

SEQ ID NO: 2869158 - RNA, 14 nt, Human
ccaccuccaguccc

SEQ ID NO: 2869159 - RNA, 24 nt, Human
ccaccuccagucccccuauccuug

SEQ ID NO: 2869160 - RNA, 12 nt, Human
ccaccuccccac

SEQ ID NO: 2869161 - RNA, 13 nt, Human
ccaccuccccacg

SEQ ID NO: 2869162 - RNA, 17 nt, Human
ccaccuccccacgcccu

SEQ ID NO: 2869163 - RNA, 18 nt, Human
ccaccuccccacgcccuc

SEQ ID NO: 2869164 - RNA, 23 nt, Human
ccaccuccccacgcccuccccuc

SEQ ID NO: 2869165 - RNA, 23 nt, Human
ccaccugcccaucacaggguugg

SEQ ID NO: 2869166 - RNA, 20 nt, Human
ccaccugcccaucacagggu

SEQ ID NO: 2869167 - RNA, 11 nt, Human
ccaccugccug

SEQ ID NO: 2869168 - RNA, 12 nt, Human
ccaccugccugc

SEQ ID NO: 2869169 - RNA, 13 nt, Human
ccaccugccugcg

SEQ ID NO: 2869170 - RNA, 16 nt, Human
ccaccugccugcgucu

SEQ ID NO: 2869171 - RNA, 20 nt, Human
ccaccugccugcgucuuccg

SEQ ID NO: 2869172 - RNA, 21 nt, Human
ccaccugccugcgucuuccgc

SEQ ID NO: 2869173 - RNA, 23 nt, Human
ccaccugccugcgucuuccgccc

SEQ ID NO: 2869174 - RNA, 12 nt, Human
ccaccugccugg

SEQ ID NO: 2869175 - RNA, 13 nt, Human
ccaccugccuggc

SEQ ID NO: 2869176 - RNA, 14 nt, Human
ccaccugccuggcc

SEQ ID NO: 2869177 - RNA, 15 nt, Human
ccaccugccuggccg

SEQ ID NO: 2869178 - RNA, 16 nt, Human
ccaccugccuggccgg

SEQ ID NO: 2869179 - RNA, 17 nt, Human
ccaccugccuggccggc

SEQ ID NO: 2869180 - RNA, 20 nt, Human
ccaccugccuggccggccag

SEQ ID NO: 2869181 - RNA, 22 nt, Human
ccaccugccuggccggccagcc

SEQ ID NO: 2869182 - RNA, 23 nt, Human
ccaccugccuggccggccagcca

SEQ ID NO: 2869183 - RNA, 15 nt, Human
ccaccucccucacca

SEQ ID NO: 2869184 - RNA, 16 nt, Human
ccaccugcccaucaca

SEQ ID NO: 2869185 - RNA, 15 nt, Human
ccaccugcccaucac

SEQ ID NO: 2869186 - RNA, 14 nt, Human
ccaccugcccauca

SEQ ID NO: 2869187 - RNA, 9 nt, Human
ccaccugcc

SEQ ID NO: 2869188 - RNA, 15 nt, Human
ccaccugcagggcug

SEQ ID NO: 2869189 - RNA, 17 nt, Human
ccaccugcagggcugcc

SEQ ID NO: 2869190 - RNA, 19 nt, Human
ccaccugcagggcugcccu

SEQ ID NO: 2869191 - RNA, 14 nt, Human
ccaccugcccaacc

SEQ ID NO: 2869192 - RNA, 14 nt, Human
ccacggccaggcca

SEQ ID NO: 2869193 - RNA, 13 nt, Human
ccacggccaggcc

SEQ ID NO: 2869194 - RNA, 12 nt, Human
ccacggccaggc

SEQ ID NO: 2869195 - RNA, 15 nt, Human
ccacggccaggccag

SEQ ID NO: 2869196 - RNA, 17 nt, Human
ccacgucugucuucaca

SEQ ID NO: 2869197 - RNA, 12 nt, Human
ccacgugucuuc

SEQ ID NO: 2869198 - RNA, 15 nt, Human
ccacgugucuuccac

SEQ ID NO: 2869199 - RNA, 16 nt, Human
ccacgugucuuccacu

SEQ ID NO: 2869200 - RNA, 18 nt, Human
ccacguggcugcgugccc

SEQ ID NO: 2869201 - RNA, 23 nt, Human
ccacguggcugcgugccccugcu

SEQ ID NO: 2869202 - RNA, 14 nt, Human
ccacccaggagccc

SEQ ID NO: 2869203 - RNA, 23 nt, Human
ccacccccuucucugcuccacca

SEQ ID NO: 2869204 - RNA, 20 nt, Human
ccacccccuucucugcucca

SEQ ID NO: 2869205 - RNA, 16 nt, Human
ccaccccgccugcccu

SEQ ID NO: 2869206 - RNA, 22 nt, Human
ccaccccgcaccccgcgugucc

SEQ ID NO: 2869207 - RNA, 12 nt, Human
ccacccaggagc

SEQ ID NO: 2869208 - RNA, 15 nt, Human
ccaccucagccuccc

SEQ ID NO: 2869209 - RNA, 19 nt, Human
ccacccccuucucugcucc

SEQ ID NO: 2869210 - RNA, 12 nt, Human
ccaccuccagcc

SEQ ID NO: 2869211 - RNA, 13 nt, Human
ccaccuccagccc

SEQ ID NO: 2869212 - RNA, 14 nt, Human
ccaccuccagcccg

SEQ ID NO: 2869213 - RNA, 18 nt, Human
ccaccuccagcccgggag

SEQ ID NO: 2869214 - RNA, 19 nt, Human
ccaccuccagcccgggagc

SEQ ID NO: 2869215 - RNA, 20 nt, Human
ccaccuccagcccgggagcc

SEQ ID NO: 2869216 - RNA, 22 nt, Human
ccaccuccagcccgggagccua

SEQ ID NO: 2869217 - RNA, 23 nt, Human
ccaccuccagcccgggagccuag

SEQ ID NO: 2869218 - RNA, 14 nt, Human
ccaccucagccucc

SEQ ID NO: 2869219 - RNA, 13 nt, Human
ccaccucagccuc

SEQ ID NO: 2869220 - RNA, 12 nt, Human
ccaccucagccu

SEQ ID NO: 2869221 - RNA, 13 nt, Human
ccaccccuacccc

SEQ ID NO: 2869222 - RNA, 16 nt, Human
ccaccccuaccccugg

SEQ ID NO: 2869223 - RNA, 19 nt, Human
ccaccccggcccccugccc

SEQ ID NO: 2869224 - RNA, 15 nt, Human
ccaccccggcccccu

SEQ ID NO: 2869225 - RNA, 17 nt, Human
ccaccccgggcucucug

SEQ ID NO: 2869226 - RNA, 14 nt, Human
ccaccccgggcucu

SEQ ID NO: 2869227 - RNA, 20 nt, Human
ccaccccgggcucucugcug

SEQ ID NO: 2869228 - RNA, 18 nt, Human
ccaccccgggcucucugc

SEQ ID NO: 2869229 - RNA, 21 nt, Human
ccacccuagccaaugucuccu

SEQ ID NO: 2869230 - RNA, 18 nt, Human
ccacccuagccaaugucu

SEQ ID NO: 2869231 - RNA, 13 nt, Human
ccacccucccugg

SEQ ID NO: 2869232 - RNA, 22 nt, Human
ccacuacggaauaguuggcuag

SEQ ID NO: 2869233 - RNA, 23 nt, Human
ccacuacggaauaguuggcuagg

SEQ ID NO: 2869234 - RNA, 21 nt, Human
ccacuaagaauucaaacuggg

SEQ ID NO: 2869235 - RNA, 18 nt, Human
ccacuaacuccugagaaa

SEQ ID NO: 2869236 - RNA, 22 nt, Human
ccacuccccuccacucucuacc

SEQ ID NO: 2869237 - RNA, 16 nt, Human
ccacuccccaccuuca

SEQ ID NO: 2869238 - RNA, 17 nt, Human
ccacuccagaccccugg

SEQ ID NO: 2869239 - RNA, 19 nt, Human
ccacuccagaccccuggcu

SEQ ID NO: 2869240 - RNA, 18 nt, Human
ccacucaguccauagcag

SEQ ID NO: 2869241 - RNA, 13 nt, Human
ccacucaccccgg

SEQ ID NO: 2869242 - RNA, 21 nt, Human
ccacucacaugacacccguga

SEQ ID NO: 2869243 - RNA, 16 nt, Human
ccacucaccagugucc

SEQ ID NO: 2869244 - RNA, 11 nt, Human
ccacucacccc

SEQ ID NO: 2869245 - RNA, 12 nt, Human
ccacucaccccg

SEQ ID NO: 2869246 - RNA, 11 nt, Human
ccacugccucu

SEQ ID NO: 2869247 - RNA, 16 nt, Human
ccacuggacuugagcu

SEQ ID NO: 2869248 - RNA, 20 nt, Human
ccacugcucccuaagccagc

SEQ ID NO: 2869249 - RNA, 24 nt, Human
ccacugcucccuaagccagccugg

SEQ ID NO: 2869250 - RNA, 21 nt, Human
ccacuggacuugagcuuggca

SEQ ID NO: 2869251 - RNA, 20 nt, Human
ccacuggacuugagcuuggc

SEQ ID NO: 2869252 - RNA, 22 nt, Human
ccacuggacuugagcuuggcag

SEQ ID NO: 2869253 - RNA, 19 nt, Human
ccacugcucuccagccugg

SEQ ID NO: 2869254 - RNA, 20 nt, Human
ccacugcacuccagccuggg

SEQ ID NO: 2869255 - RNA, 19 nt, Human
ccacugcacuccagccugg

SEQ ID NO: 2869256 - RNA, 18 nt, Human
ccacugcacuccagccug

SEQ ID NO: 2869257 - RNA, 19 nt, Human
ccacugccccuucauugau

SEQ ID NO: 2869258 - RNA, 21 nt, Human
ccacugcacuccagccugggc

SEQ ID NO: 2869259 - RNA, 16 nt, Human
ccacguuccacaguug

SEQ ID NO: 2869260 - RNA, 20 nt, Human
ccacguuccacaguugccac

SEQ ID NO: 2869261 - RNA, 13 nt, Human
ccacccaccucag

SEQ ID NO: 2869262 - RNA, 15 nt, Human
ccacccaccucagcc

SEQ ID NO: 2869263 - RNA, 14 nt, Human
ccacccaccucagc

SEQ ID NO: 2869264 - RNA, 16 nt, Human
ccacccaccucagccu

SEQ ID NO: 2869265 - RNA, 15 nt, Human
ccacccaaugcugau

SEQ ID NO: 2869266 - RNA, 14 nt, Human
ccaccacacauccc

SEQ ID NO: 2869267 - RNA, 15 nt, Human
ccaccacacauccca

SEQ ID NO: 2869268 - RNA, 17 nt, Human
ccaccacacaucccagc

SEQ ID NO: 2869269 - RNA, 20 nt, Human
ccaccacacaucccagccca

SEQ ID NO: 2869270 - RNA, 16 nt, Human
ccaccacacccagccc

SEQ ID NO: 2869271 - RNA, 14 nt, Human
ccaccacacccagc

SEQ ID NO: 2869272 - RNA, 14 nt, Human
ccacaucuugcucu

SEQ ID NO: 2869273 - RNA, 18 nt, Human
ccacaucuuccauuucca

SEQ ID NO: 2869274 - RNA, 16 nt, Human
ccacaucucugaaagc

SEQ ID NO: 2869275 - RNA, 19 nt, Human
ccacauccaacuccagcaa

SEQ ID NO: 2869276 - RNA, 18 nt, Human
ccacauccaacuccagca

SEQ ID NO: 2869277 - RNA, 23 nt, Human
ccacauagugaugguuccccugu

SEQ ID NO: 2869278 - RNA, 13 nt, Human
ccacacucuccau

SEQ ID NO: 2869279 - RNA, 16 nt, Human
ccacacucuccaucac

SEQ ID NO: 2869280 - RNA, 20 nt, Human
ccacacucuucuaugaccca

SEQ ID NO: 2869281 - RNA, 13 nt, Human
ccacacuggacuc

SEQ ID NO: 2869282 - RNA, 19 nt, Human
ccacauagugaugguuccc

SEQ ID NO: 2869283 - RNA, 21 nt, Human
ccacauagugaugguuccccu

SEQ ID NO: 2869284 - RNA, 22 nt, Human
ccacauagugaugguuccccug

SEQ ID NO: 2869285 - RNA, 23 nt, Human
ccacaucuugcucugcugacaga

SEQ ID NO: 2869286 - RNA, 22 nt, Human
ccacaucuugcucugcugacag

SEQ ID NO: 2869287 - RNA, 20 nt, Human
ccacaucuugcucugcugac

SEQ ID NO: 2869288 - RNA, 16 nt, Human
ccacaucuugcucugc

SEQ ID NO: 2869289 - RNA, 14 nt, Human
ccacaugaaaccua

SEQ ID NO: 2869290 - RNA, 19 nt, Human
ccacaugccaagcacugug

SEQ ID NO: 2869291 - RNA, 16 nt, Human
ccaccaaagcugccca

SEQ ID NO: 2869292 - RNA, 14 nt, Human
ccaccaaagcugcc

SEQ ID NO: 2869293 - RNA, 13 nt, Human
ccaccaaagcugc

SEQ ID NO: 2869294 - RNA, 12 nt, Human
ccaccaaagcug

SEQ ID NO: 2869295 - RNA, 19 nt, Human
ccaccaaagcugcccacug

SEQ ID NO: 2869296 - RNA, 18 nt, Human
ccaccaaagcugcccacu

SEQ ID NO: 2869297 - RNA, 21 nt, Human
ccaccaaagcugcccacuguu

SEQ ID NO: 2869298 - RNA, 12 nt, Human
ccacacccagcc

SEQ ID NO: 2869299 - RNA, 11 nt, Human
ccacacacagg

SEQ ID NO: 2869300 - RNA, 12 nt, Human
ccacacacaggu

SEQ ID NO: 2869301 - RNA, 16 nt, Human
ccaaacccaugaggca

SEQ ID NO: 2869302 - RNA, 14 nt, Human
ccaaacccugucug

SEQ ID NO: 2869303 - RNA, 12 nt, Human
ccaaacccuagg

SEQ ID NO: 2869304 - RNA, 13 nt, Human
ccaaacccuaggu

SEQ ID NO: 2869305 - RNA, 23 nt, Human
ccaaacccuagguucccgguccc

SEQ ID NO: 2869306 - RNA, 14 nt, Human
ccacacccagccca

SEQ ID NO: 2869307 - RNA, 13 nt, Human
ccacacccagccc

SEQ ID NO: 2869308 - RNA, 22 nt, Human
ccacacccaauuccacucugau

SEQ ID NO: 2869309 - RNA, 19 nt, Human
ccacacccuguacuguucu

SEQ ID NO: 2869310 - RNA, 23 nt, Human
ccacacccuguacuguucugugu

SEQ ID NO: 2869311 - RNA, 19 nt, Human
ccacaccucaguucccuug

SEQ ID NO: 2869312 - RNA, 18 nt, Human
ccacaccucaguucccuu

SEQ ID NO: 2869313 - RNA, 22 nt, Human
ccacaccucaguucccuuggcc

SEQ ID NO: 2869314 - RNA, 14 nt, Human
ccacaccucugcca

SEQ ID NO: 2869315 - RNA, 17 nt, Human
ccacacuccagcuggga

SEQ ID NO: 2869316 - RNA, 14 nt, Human
ccacacuccagcug

SEQ ID NO: 2869317 - RNA, 13 nt, Human
ccacacuccagcu

SEQ ID NO: 2869318 - RNA, 15 nt, Human
ccacaccucugccag

SEQ ID NO: 2869319 - RNA, 16 nt, Human
ccacaccucugccaga

SEQ ID NO: 2869320 - RNA, 15 nt, Human
ccagcaguacaauaa

SEQ ID NO: 2869321 - RNA, 17 nt, Human
ccagcaguacaauaaaa

SEQ ID NO: 2869322 - RNA, 21 nt, Human
ccagcaguacaauaaaaguaa

SEQ ID NO: 2869323 - RNA, 14 nt, Human
ccagcagucacuuc

SEQ ID NO: 2869324 - RNA, 17 nt, Human
ccagcagucacuucggc

SEQ ID NO: 2869325 - RNA, 16 nt, Human
ccagcagucucugccu

SEQ ID NO: 2869326 - RNA, 17 nt, Human
ccagcagucucugccuu

SEQ ID NO: 2869327 - RNA, 21 nt, Human
ccagcagucucugccuugccu

SEQ ID NO: 2869328 - RNA, 22 nt, Human
ccagcagucucugccuugccuu

SEQ ID NO: 2869329 - RNA, 23 nt, Human
ccagcagucucugccuugccuuu

SEQ ID NO: 2869330 - RNA, 12 nt, Human
ccagcacuaacg

SEQ ID NO: 2869331 - RNA, 22 nt, Human
ccagcaguugaaugacaacaga

SEQ ID NO: 2869332 - RNA, 13 nt, Human
ccagcaguucugu

SEQ ID NO: 2869333 - RNA, 14 nt, Human
ccagcaguucuguu

SEQ ID NO: 2869334 - RNA, 15 nt, Human
ccagcaguucuguua

SEQ ID NO: 2869335 - RNA, 18 nt, Human
ccagcaucaccugccugu

SEQ ID NO: 2869336 - RNA, 14 nt, Human
ccagcaucacuccc

SEQ ID NO: 2869337 - RNA, 16 nt, Human
ccagcaucacucccca

SEQ ID NO: 2869338 - RNA, 17 nt, Human
ccagcaucacuccccaa

SEQ ID NO: 2869339 - RNA, 21 nt, Human
ccagcaucacuccccaaggaa

SEQ ID NO: 2869340 - RNA, 17 nt, Human
ccagcaucaccugccug

SEQ ID NO: 2869341 - RNA, 16 nt, Human
ccagcaucaccugccu

SEQ ID NO: 2869342 - RNA, 15 nt, Human
ccagcaucaccugcc

SEQ ID NO: 2869343 - RNA, 14 nt, Human
ccagcaucaccugc

SEQ ID NO: 2869344 - RNA, 19 nt, Human
ccagcauccuuuucugcag

SEQ ID NO: 2869345 - RNA, 15 nt, Human
ccagcaucccuugac

SEQ ID NO: 2869346 - RNA, 18 nt, Human
ccagcaucccuugaccag

SEQ ID NO: 2869347 - RNA, 21 nt, Human
ccagcauccuuuucugcagag

SEQ ID NO: 2869348 - RNA, 21 nt, Human
ccagcaucccuugaccaggcc

SEQ ID NO: 2869349 - RNA, 15 nt, Human
ccagcauggguuagu

SEQ ID NO: 2869350 - RNA, 18 nt, Human
ccagcaugacauaacagu

SEQ ID NO: 2869351 - RNA, 20 nt, Human
ccagcaugacauaacagugc

SEQ ID NO: 2869352 - RNA, 21 nt, Human
ccagcaugacauaacagugca

SEQ ID NO: 2869353 - RNA, 11 nt, Human
ccagccagcca

SEQ ID NO: 2869354 - RNA, 13 nt, Human
ccagccagccacu

SEQ ID NO: 2869355 - RNA, 14 nt, Human
ccagccagccacuc

SEQ ID NO: 2869356 - RNA, 15 nt, Human
ccagccagccacucu

SEQ ID NO: 2869357 - RNA, 16 nt, Human
ccagccagccacucua

SEQ ID NO: 2869358 - RNA, 21 nt, Human
ccagccaggcagguccacaga

SEQ ID NO: 2869359 - RNA, 18 nt, Human
ccagccagauccucuugg

SEQ ID NO: 2869360 - RNA, 19 nt, Human
ccagccagauccucuuggu

SEQ ID NO: 2869361 - RNA, 13 nt, Human
ccagccagauccu

SEQ ID NO: 2869362 - RNA, 11 nt, Human
ccagccacucu

SEQ ID NO: 2869363 - RNA, 15 nt, Human
ccagccacucuacca

SEQ ID NO: 2869364 - RNA, 21 nt, Human
ccagccacucuaccagugcag

SEQ ID NO: 2869365 - RNA, 22 nt, Human
ccagccaccccgggcucucugc

SEQ ID NO: 2869366 - RNA, 21 nt, Human
ccagccaccccgggcucucug

SEQ ID NO: 2869367 - RNA, 22 nt, Human
ccagccaacuuuugcauguuuu

SEQ ID NO: 2869368 - RNA, 13 nt, Human
ccagccaccccgg

SEQ ID NO: 2869369 - RNA, 19 nt, Human
ccagccacacuugaaccua

SEQ ID NO: 2869370 - RNA, 19 nt, Human
ccagccaaacccugucuga

SEQ ID NO: 2869371 - RNA, 18 nt, Human
ccagccaaacccugucug

SEQ ID NO: 2869372 - RNA, 17 nt, Human
ccagccaaacccugucu

SEQ ID NO: 2869373 - RNA, 18 nt, Human
ccagcauuuuacugauuc

SEQ ID NO: 2869374 - RNA, 14 nt, Human
ccagcauucucagg

SEQ ID NO: 2869375 - RNA, 20 nt, Human
ccagcauucucaggcaccag

SEQ ID NO: 2869376 - RNA, 16 nt, Human
ccagcauucucaggca

SEQ ID NO: 2869377 - RNA, 21 nt, Human
ccagcccuuuuguugagccag

SEQ ID NO: 2869378 - RNA, 14 nt, Human
ccagcauuugggua

SEQ ID NO: 2869379 - RNA, 10 nt, Human
ccagccucag

SEQ ID NO: 2869380 - RNA, 14 nt, Human
ccagccucacccuu

SEQ ID NO: 2869381 - RNA, 17 nt, Human
ccagccucacccuugcg

SEQ ID NO: 2869382 - RNA, 11 nt, Human
ccagccucagu

SEQ ID NO: 2869383 - RNA, 19 nt, Human
ccagccgccaucagcccaa

SEQ ID NO: 2869384 - RNA, 19 nt, Human
ccagccuaugagcauccug

SEQ ID NO: 2869385 - RNA, 20 nt, Human
ccagccuaugagcauccuga

SEQ ID NO: 2869386 - RNA, 21 nt, Human
ccagccuaugagcauccugag

SEQ ID NO: 2869387 - RNA, 22 nt, Human
ccagccuaugagcauccugagc

SEQ ID NO: 2869388 - RNA, 23 nt, Human
ccagccuaugagcauccugagcc

SEQ ID NO: 2869389 - RNA, 12 nt, Human
ccagccucaguc

SEQ ID NO: 2869390 - RNA, 15 nt, Human
ccagccucaguccuc

SEQ ID NO: 2869391 - RNA, 19 nt, Human
ccagccucaguccuccccu

SEQ ID NO: 2869392 - RNA, 20 nt, Human
ccagccucaguccuccccuc

SEQ ID NO: 2869393 - RNA, 21 nt, Human
ccagccucaguccuccccuca

SEQ ID NO: 2869394 - RNA, 19 nt, Human
ccagccucaucucuuuguu

SEQ ID NO: 2869395 - RNA, 21 nt, Human
ccagccuccaagcuccaucuc

SEQ ID NO: 2869396 - RNA, 17 nt, Human
ccagcccuuagcaggga

SEQ ID NO: 2869397 - RNA, 13 nt, Human
ccagcccuguucu

SEQ ID NO: 2869398 - RNA, 16 nt, Human
ccagcccuuagcaggg

SEQ ID NO: 2869399 - RNA, 21 nt, Human
ccagcccuccuuaucaaagga

SEQ ID NO: 2869400 - RNA, 16 nt, Human
ccagccccagugccca

SEQ ID NO: 2869401 - RNA, 20 nt, Human
ccagcccgggagccuaggac

SEQ ID NO: 2869402 - RNA, 21 nt, Human
ccagcccgggagccuaggacc

SEQ ID NO: 2869403 - RNA, 22 nt, Human
ccagcccgggagccuaggacca

SEQ ID NO: 2869404 - RNA, 14 nt, Human
ccagcccuccccau

SEQ ID NO: 2869405 - RNA, 20 nt, Human
ccagcccuccccauggagcc

SEQ ID NO: 2869406 - RNA, 21 nt, Human
ccagcccuccccauggagcca

SEQ ID NO: 2869407 - RNA, 15 nt, Human
ccagccagggcugcu

SEQ ID NO: 2869408 - RNA, 13 nt, Human
ccagccagggcug

SEQ ID NO: 2869409 - RNA, 14 nt, Human
ccagccagggcugc

SEQ ID NO: 2869410 - RNA, 16 nt, Human
ccagccccacccagga

SEQ ID NO: 2869411 - RNA, 15 nt, Human
ccagccccacccagg

SEQ ID NO: 2869412 - RNA, 14 nt, Human
ccagccccacccag

SEQ ID NO: 2869413 - RNA, 14 nt, Human
ccagccccacacag

SEQ ID NO: 2869414 - RNA, 15 nt, Human
ccagccccacacagc

SEQ ID NO: 2869415 - RNA, 16 nt, Human
ccagccccacacagcu

SEQ ID NO: 2869416 - RNA, 21 nt, Human
ccagccccacacagcuacagc

SEQ ID NO: 2869417 - RNA, 15 nt, Human
ccagccccagugccc

SEQ ID NO: 2869418 - RNA, 13 nt, Human
ccagccccagugc

SEQ ID NO: 2869419 - RNA, 23 nt, Human
ccagccccacugccagcagcagc

SEQ ID NO: 2869420 - RNA, 21 nt, Human
ccagccccacugccagcagca

SEQ ID NO: 2869421 - RNA, 20 nt, Human
ccagccccacugccagcagc

SEQ ID NO: 2869422 - RNA, 19 nt, Human
ccagccccacugccagcag

SEQ ID NO: 2869423 - RNA, 18 nt, Human
ccagccccacugccagca

SEQ ID NO: 2869424 - RNA, 17 nt, Human
ccagccccacugccagc

SEQ ID NO: 2869425 - RNA, 16 nt, Human
ccagccccacugccag

SEQ ID NO: 2869426 - RNA, 13 nt, Human
ccagccccacugc

SEQ ID NO: 2869427 - RNA, 18 nt, Human
ccagccccacccaggagg

SEQ ID NO: 2869428 - RNA, 17 nt, Human
ccagccccacccaggag

SEQ ID NO: 2869429 - RNA, 21 nt, Human
ccagcaauucauaaaaacugc

SEQ ID NO: 2869430 - RNA, 20 nt, Human
ccagcaauucuccugccuca

SEQ ID NO: 2869431 - RNA, 19 nt, Human
ccagcaauucuccugccuc

SEQ ID NO: 2869432 - RNA, 18 nt, Human
ccagcaauucuccugccu

SEQ ID NO: 2869433 - RNA, 16 nt, Human
ccagcaauucuccugc

SEQ ID NO: 2869434 - RNA, 23 nt, Human
ccagcaaugacaucucaggggcc

SEQ ID NO: 2869435 - RNA, 17 nt, Human
ccagcaauauguaaaua

SEQ ID NO: 2869436 - RNA, 12 nt, Human
ccagcaaugaca

SEQ ID NO: 2869437 - RNA, 21 nt, Human
ccagcaaugacaucucagggg

SEQ ID NO: 2869438 - RNA, 22 nt, Human
ccagcaaugacaucucaggggc

SEQ ID NO: 2869439 - RNA, 22 nt, Human
ccagcaagugagagcugggugu

SEQ ID NO: 2869440 - RNA, 21 nt, Human
ccagcaagugagagcugggug

SEQ ID NO: 2869441 - RNA, 20 nt, Human
ccagcaagugagagcugggu

SEQ ID NO: 2869442 - RNA, 16 nt, Human
ccagcaagugagagcu

SEQ ID NO: 2869443 - RNA, 14 nt, Human
ccagcaacuucuuc

SEQ ID NO: 2869444 - RNA, 23 nt, Human
ccagauuaucuauuugugugugu

SEQ ID NO: 2869445 - RNA, 15 nt, Human
ccagcaagugagagc

SEQ ID NO: 2869446 - RNA, 23 nt, Human
ccagcaacuucuucuccaucccu

SEQ ID NO: 2869447 - RNA, 14 nt, Human
ccagcaacuugaac

SEQ ID NO: 2869448 - RNA, 19 nt, Human
ccagcaagaauaaaaaaga

SEQ ID NO: 2869449 - RNA, 21 nt, Human
ccagcaagaauaaaaaagaaa

SEQ ID NO: 2869450 - RNA, 17 nt, Human
ccagcaagagaaccccg

SEQ ID NO: 2869451 - RNA, 16 nt, Human
ccagaggagccuuuuu

SEQ ID NO: 2869452 - RNA, 15 nt, Human
ccagaggagccuuuu

SEQ ID NO: 2869453 - RNA, 13 nt, Human
ccagaggagccuu

SEQ ID NO: 2869454 - RNA, 17 nt, Human
ccagaggagccuuuuua

SEQ ID NO: 2869455 - RNA, 19 nt, Human
ccagaggccaacacugugg

SEQ ID NO: 2869456 - RNA, 23 nt, Human
ccagaggaauccuggcagcccag

SEQ ID NO: 2869457 - RNA, 22 nt, Human
ccagaggaauccuggcagccca

SEQ ID NO: 2869458 - RNA, 21 nt, Human
ccagaggaauccuggcagccc

SEQ ID NO: 2869459 - RNA, 20 nt, Human
ccagaggaauccuggcagcc

SEQ ID NO: 2869460 - RNA, 19 nt, Human
ccagaggaauccuggcagc

SEQ ID NO: 2869461 - RNA, 18 nt, Human
ccagaggaauccuggcag

SEQ ID NO: 2869462 - RNA, 17 nt, Human
ccagaggaauccuggca

SEQ ID NO: 2869463 - RNA, 21 nt, Human
ccagagggagugacagaggca

SEQ ID NO: 2869464 - RNA, 20 nt, Human
ccagagggagugacagaggc

SEQ ID NO: 2869465 - RNA, 19 nt, Human
ccagagggagugacagagg

SEQ ID NO: 2869466 - RNA, 18 nt, Human
ccagagggagugacagag

SEQ ID NO: 2869467 - RNA, 17 nt, Human
ccagagggagugacaga

SEQ ID NO: 2869468 - RNA, 16 nt, Human
ccagagggagugacag

SEQ ID NO: 2869469 - RNA, 17 nt, Human
ccagaggcgucccgcac

SEQ ID NO: 2869470 - RNA, 19 nt, Human
ccagaggcuauuauuuuca

SEQ ID NO: 2869471 - RNA, 13 nt, Human
ccagaggcugagu

SEQ ID NO: 2869472 - RNA, 24 nt, Human
ccagagcuguuuauggccucagcu

SEQ ID NO: 2869473 - RNA, 17 nt, Human
ccagaggaaccugaggc

SEQ ID NO: 2869474 - RNA, 14 nt, Human
ccagaggaacuguc

SEQ ID NO: 2869475 - RNA, 19 nt, Human
ccagaggaacuguccagag

SEQ ID NO: 2869476 - RNA, 23 nt, Human
ccagagcuguuuauggccucagc

SEQ ID NO: 2869477 - RNA, 22 nt, Human
ccagagcuguuuauggccucag

SEQ ID NO: 2869478 - RNA, 20 nt, Human
ccagaggaacuguccagaga

SEQ ID NO: 2869479 - RNA, 21 nt, Human
ccagaggaacuguccagagag

SEQ ID NO: 2869480 - RNA, 22 nt, Human
ccagaggaacuguccagagagc

SEQ ID NO: 2869481 - RNA, 23 nt, Human
ccagaggaacuguccagagagca

SEQ ID NO: 2869482 - RNA, 21 nt, Human
ccagagcuguuuauggccuca

SEQ ID NO: 2869483 - RNA, 20 nt, Human
ccagagcuguuuauggccuc

SEQ ID NO: 2869484 - RNA, 19 nt, Human
ccagagcuguuuauggccu

SEQ ID NO: 2869485 - RNA, 22 nt, Human
ccagagcugguggacccaggga

SEQ ID NO: 2869486 - RNA, 18 nt, Human
ccagagcugguggaccca

SEQ ID NO: 2869487 - RNA, 21 nt, Human
ccagagcugggaggcauggcc

SEQ ID NO: 2869488 - RNA, 14 nt, Human
ccagagcuggugga

SEQ ID NO: 2869489 - RNA, 14 nt, Human
ccagagcugggagg

SEQ ID NO: 2869490 - RNA, 23 nt, Human
ccagagcugaagaguugccccgu

SEQ ID NO: 2869491 - RNA, 15 nt, Human
ccagagcaaccucuc

SEQ ID NO: 2869492 - RNA, 16 nt, Human
ccagagcaaccucuca

SEQ ID NO: 2869493 - RNA, 19 nt, Human
ccagagcaaccucucacuc

SEQ ID NO: 2869494 - RNA, 21 nt, Human
ccagagcaaccucucacuccc

SEQ ID NO: 2869495 - RNA, 22 nt, Human
ccagagcaacgaccagggccga

SEQ ID NO: 2869496 - RNA, 12 nt, Human
ccagagauguca

SEQ ID NO: 2869497 - RNA, 13 nt, Human
ccagagcaaaaua

SEQ ID NO: 2869498 - RNA, 14 nt, Human
ccagagaggguggu

SEQ ID NO: 2869499 - RNA, 23 nt, Human
ccagagaggguggugaccucugc

SEQ ID NO: 2869500 - RNA, 21 nt, Human
ccagagaggguggugaccucu

SEQ ID NO: 2869501 - RNA, 20 nt, Human
ccagacaccuugacagggca

SEQ ID NO: 2869502 - RNA, 17 nt, Human
ccagaccccaggcugga

SEQ ID NO: 2869503 - RNA, 21 nt, Human
ccacuguaugauuuauaaaca

SEQ ID NO: 2869504 - RNA, 19 nt, Human
ccagacaccuugacagggc

SEQ ID NO: 2869505 - RNA, 17 nt, Human
ccagacaccuugacagg

SEQ ID NO: 2869506 - RNA, 14 nt, Human
ccacugucacccuc

SEQ ID NO: 2869507 - RNA, 21 nt, Human
ccagauugcaacaggcugggc

SEQ ID NO: 2869508 - RNA, 20 nt, Human
ccagauugcaacaggcuggg

SEQ ID NO: 2869509 - RNA, 19 nt, Human
ccagauugcaacaggcugg

SEQ ID NO: 2869510 - RNA, 23 nt, Human
ccagaugcaccagcccuuagcag

SEQ ID NO: 2869511 - RNA, 18 nt, Human
ccagagggcccaggcagg

SEQ ID NO: 2869512 - RNA, 17 nt, Human
ccagaugcgucccaaga

SEQ ID NO: 2869513 - RNA, 23 nt, Human
ccagagggagugacagaggcagc

SEQ ID NO: 2869514 - RNA, 22 nt, Human
ccagagggagugacagaggcag

SEQ ID NO: 2869515 - RNA, 13 nt, Human
ccagagggcccag

SEQ ID NO: 2869516 - RNA, 17 nt, Human
ccagagggcccaggcag

SEQ ID NO: 2869517 - RNA, 15 nt, Human
ccagagggcccaggc

SEQ ID NO: 2869518 - RNA, 14 nt, Human
ccagauggugggau

SEQ ID NO: 2869519 - RNA, 16 nt, Human
ccagauggugggaugu

SEQ ID NO: 2869520 - RNA, 21 nt, Human
ccagaugugaugcuugauauu

SEQ ID NO: 2869521 - RNA, 17 nt, Human
ccagauguuuccagacu

SEQ ID NO: 2869522 - RNA, 23 nt, Human
ccagauguuuccagacuuccuug

SEQ ID NO: 2869523 - RNA, 21 nt, Human
ccagaugcgucccaagauguu

SEQ ID NO: 2869524 - RNA, 14 nt, Human
ccagaugcugcaga

SEQ ID NO: 2869525 - RNA, 19 nt, Human
ccagaugcugcagagucac

SEQ ID NO: 2869526 - RNA, 22 nt, Human
ccagauggcuggaaggggucca

SEQ ID NO: 2869527 - RNA, 16 nt, Human
ccagaugggggaaagc

SEQ ID NO: 2869528 - RNA, 20 nt, Human
ccagaugggggaaagcacag

SEQ ID NO: 2869529 - RNA, 23 nt, Human
ccagauggcccggaugcugcuuc

SEQ ID NO: 2869530 - RNA, 22 nt, Human
ccaugggagcugguuagaaaug

SEQ ID NO: 2869531 - RNA, 16 nt, Human
ccauguuggccaggcu

SEQ ID NO: 2869532 - RNA, 17 nt, Human
ccauguuggccaggcug

SEQ ID NO: 2869533 - RNA, 21 nt, Human
ccauguuggccaggcugcucu

SEQ ID NO: 2869534 - RNA, 23 nt, Human
ccauguuggccaggcuggucuca

SEQ ID NO: 2869535 - RNA, 18 nt, Human
ccauguuggccaggcugc

SEQ ID NO: 2869536 - RNA, 18 nt, Human
ccauguuggucaggcugg

SEQ ID NO: 2869537 - RNA, 19 nt, Human
ccauguuggucaggcuggu

SEQ ID NO: 2869538 - RNA, 22 nt, Human
ccauguugguugcacuuuguag

SEQ ID NO: 2869539 - RNA, 16 nt, Human
ccauguuguaaugcug

SEQ ID NO: 2869540 - RNA, 17 nt, Human
ccauguuguaaugcugc

SEQ ID NO: 2869541 - RNA, 18 nt, Human
ccauguuguaaugcugca

SEQ ID NO: 2869542 - RNA, 20 nt, Human
ccauguuguaaugcugcacu

SEQ ID NO: 2869543 - RNA, 22 nt, Human
ccauguuguaaugcugcacuuc

SEQ ID NO: 2869544 - RNA, 13 nt, Human
ccauguuuguaaa

SEQ ID NO: 2869545 - RNA, 14 nt, Human
ccauguuuguaaaa

SEQ ID NO: 2869546 - RNA, 15 nt, Human
ccauguuuguaaaac

SEQ ID NO: 2869547 - RNA, 12 nt, Human
ccauuauuuucu

SEQ ID NO: 2869548 - RNA, 13 nt, Human
ccauuauuuucug

SEQ ID NO: 2869549 - RNA, 14 nt, Human
ccauuauuuucugu

SEQ ID NO: 2869550 - RNA, 16 nt, Human
ccauuauuuucuguca

SEQ ID NO: 2869551 - RNA, 17 nt, Human
ccauuauuuucugucag

SEQ ID NO: 2869552 - RNA, 18 nt, Human
ccauuauuuucugucaga

SEQ ID NO: 2869553 - RNA, 19 nt, Human
ccauuauuuucugucagau

SEQ ID NO: 2869554 - RNA, 19 nt, Human
ccauucacaauaaaagcuu

SEQ ID NO: 2869555 - RNA, 20 nt, Human
ccauucacaauaaaagcuua

SEQ ID NO: 2869556 - RNA, 19 nt, Human
ccauauucuguuggccagu

SEQ ID NO: 2869557 - RNA, 14 nt, Human
ccauaguaguauga

SEQ ID NO: 2869558 - RNA, 22 nt, Human
ccauauuggcauggauuucugu

SEQ ID NO: 2869559 - RNA, 21 nt, Human
ccauauugugcuucacaguag

SEQ ID NO: 2869560 - RNA, 14 nt, Human
ccaucuaaacugcc

SEQ ID NO: 2869561 - RNA, 18 nt, Human
ccauccucaaacacugca

SEQ ID NO: 2869562 - RNA, 19 nt, Human
ccauccucaagaucauuca

SEQ ID NO: 2869563 - RNA, 13 nt, Human
ccauccucaaaca

SEQ ID NO: 2869564 - RNA, 19 nt, Human
ccauccuauccacugggca

SEQ ID NO: 2869565 - RNA, 16 nt, Human
ccaucugauaucuaua

SEQ ID NO: 2869566 - RNA, 15 nt, Human
ccaucuaagcugcag

SEQ ID NO: 2869567 - RNA, 16 nt, Human
ccaucuaagcugcagc

SEQ ID NO: 2869568 - RNA, 17 nt, Human
ccaucuaagcugcagcu

SEQ ID NO: 2869569 - RNA, 20 nt, Human
ccaucuaagcugcagcuucc

SEQ ID NO: 2869570 - RNA, 21 nt, Human
ccaucuaagcugcagcuuccu

SEQ ID NO: 2869571 - RNA, 16 nt, Human
ccaucuaaacugcccc

SEQ ID NO: 2869572 - RNA, 15 nt, Human
ccaucuaaacugccc

SEQ ID NO: 2869573 - RNA, 14 nt, Human
ccaucugcccgccu

SEQ ID NO: 2869574 - RNA, 17 nt, Human
ccaucugcccgccugcc

SEQ ID NO: 2869575 - RNA, 18 nt, Human
ccaucugcccgccugccc

SEQ ID NO: 2869576 - RNA, 20 nt, Human
ccaucugcccgccugcccac

SEQ ID NO: 2869577 - RNA, 22 nt, Human
ccaucugcccgccugcccaccu

SEQ ID NO: 2869578 - RNA, 23 nt, Human
ccaucugcccgccugcccaccug

SEQ ID NO: 2869579 - RNA, 15 nt, Human
ccauggcccucccag

SEQ ID NO: 2869580 - RNA, 14 nt, Human
ccauggcccugugc

SEQ ID NO: 2869581 - RNA, 17 nt, Human
ccauggcugcacaguug

SEQ ID NO: 2869582 - RNA, 21 nt, Human
ccaugggaaaugucaacaagu

SEQ ID NO: 2869583 - RNA, 21 nt, Human
ccauggcgugucccucucgga

SEQ ID NO: 2869584 - RNA, 19 nt, Human
ccauggcgugucccucucg

SEQ ID NO: 2869585 - RNA, 16 nt, Human
cccaaagugcugggau

SEQ ID NO: 2869586 - RNA, 16 nt, Human
cccaaagucuguguga

SEQ ID NO: 2869587 - RNA, 15 nt, Human
cccaaagugcugaga

SEQ ID NO: 2869588 - RNA, 18 nt, Human
ccauuugucucuacuuuu

SEQ ID NO: 2869589 - RNA, 16 nt, Human
cccaaaucucuuccac

SEQ ID NO: 2869590 - RNA, 20 nt, Human
cccaaagugcugagauuaca

SEQ ID NO: 2869591 - RNA, 18 nt, Human
cccaaauaacuucagucc

SEQ ID NO: 2869592 - RNA, 21 nt, Human
cccaaauaacuucaguccugc

SEQ ID NO: 2869593 - RNA, 20 nt, Human
cccaacccuaucuccugaca

SEQ ID NO: 2869594 - RNA, 17 nt, Human
cccaaucccuuuauuac

SEQ ID NO: 2869595 - RNA, 21 nt, Human
cccaaucccuuuauuaccccc

SEQ ID NO: 2869596 - RNA, 22 nt, Human
cccaaugagacucuagggucca

SEQ ID NO: 2869597 - RNA, 17 nt, Human
cccaaugagacuugccu

SEQ ID NO: 2869598 - RNA, 18 nt, Human
cccaaugagacuugccuu

SEQ ID NO: 2869599 - RNA, 19 nt, Human
cccaaugagacuugccuuc

SEQ ID NO: 2869600 - RNA, 16 nt, Human
cccaaugcacauccau

SEQ ID NO: 2869601 - RNA, 20 nt, Human
cccaaugcacauccauuccc

SEQ ID NO: 2869602 - RNA, 14 nt, Human
cccaaucuccaucu

SEQ ID NO: 2869603 - RNA, 17 nt, Human
cccaagggaaagaaaag

SEQ ID NO: 2869604 - RNA, 23 nt, Human
cccaaucccagcuaccucaacca

SEQ ID NO: 2869605 - RNA, 17 nt, Human
cccaaggcucugagcaa

SEQ ID NO: 2869606 - RNA, 15 nt, Human
cccaaggcggccccu

SEQ ID NO: 2869607 - RNA, 15 nt, Human
cccaacccuggcacc

SEQ ID NO: 2869608 - RNA, 15 nt, Human
cccaaggacugaggg

SEQ ID NO: 2869609 - RNA, 16 nt, Human
cccaaggacugaggga

SEQ ID NO: 2869610 - RNA, 21 nt, Human
cccaaggacugagggacucug

SEQ ID NO: 2869611 - RNA, 14 nt, Human
cccaaggagcacag

SEQ ID NO: 2869612 - RNA, 15 nt, Human
cccaaggagcacagg

SEQ ID NO: 2869613 - RNA, 18 nt, Human
cccaaggagcacaggucc

SEQ ID NO: 2869614 - RNA, 20 nt, Human
cccaaggagcacagguccca

SEQ ID NO: 2869615 - RNA, 22 nt, Human
cccaaggagcacaggucccacc

SEQ ID NO: 2869616 - RNA, 22 nt, Human
cccaaggaaagccccagcacua

SEQ ID NO: 2869617 - RNA, 19 nt, Human
ccauuuggcagagcuucuu

SEQ ID NO: 2869618 - RNA, 16 nt, Human
ccauagucaaagagag

SEQ ID NO: 2869619 - RNA, 18 nt, Human
ccauuugugccagaggaa

SEQ ID NO: 2869620 - RNA, 16 nt, Human
ccauuugugccagagg

SEQ ID NO: 2869621 - RNA, 15 nt, Human
ccauuugugccagag

SEQ ID NO: 2869622 - RNA, 14 nt, Human
ccauuugugccaga

SEQ ID NO: 2869623 - RNA, 16 nt, Human
ccauuuguaauuaaau

SEQ ID NO: 2869624 - RNA, 20 nt, Human
ccauuuguaauuaaauuaug

SEQ ID NO: 2869625 - RNA, 13 nt, Human
ccauuuguaauuu

SEQ ID NO: 2869626 - RNA, 14 nt, Human
ccauuuguaauuug

SEQ ID NO: 2869627 - RNA, 12 nt, Human
ccauuuguaaaa

SEQ ID NO: 2869628 - RNA, 13 nt, Human
ccauuuguaaaac

SEQ ID NO: 2869629 - RNA, 20 nt, Human
ccauuuguaaaacuccggau

SEQ ID NO: 2869630 - RNA, 15 nt, Human
cccaaagugcuggga

SEQ ID NO: 2869631 - RNA, 13 nt, Human
cccaaagugcugg

SEQ ID NO: 2869632 - RNA, 18 nt, Human
cccaaaggggacaggccu

SEQ ID NO: 2869633 - RNA, 20 nt, Human
cccaaaggggacaggccuca

SEQ ID NO: 2869634 - RNA, 22 nt, Human
cccaaaggggacaggccucacc

SEQ ID NO: 2869635 - RNA, 21 nt, Human
ccaguuagacuaguccccggu

SEQ ID NO: 2869636 - RNA, 23 nt, Human
ccauauucuguuggccaguguga

SEQ ID NO: 2869637 - RNA, 15 nt, Human
ccauagucacauggc

SEQ ID NO: 2869638 - RNA, 21 nt, Human
ccauaguaugggacuggccuc

SEQ ID NO: 2869639 - RNA, 14 nt, Human
ccauaggcccacac

SEQ ID NO: 2869640 - RNA, 16 nt, Human
ccauaggcccacacac

SEQ ID NO: 2869641 - RNA, 17 nt, Human
ccauaggcccacacaca

SEQ ID NO: 2869642 - RNA, 18 nt, Human
ccauaggcccacacacag

SEQ ID NO: 2869643 - RNA, 19 nt, Human
ccauaggcccacacacagg

SEQ ID NO: 2869644 - RNA, 20 nt, Human
ccauaggcccacacacaggu

SEQ ID NO: 2869645 - RNA, 23 nt, Human
ccauaggcccacacacagguggu

SEQ ID NO: 2869646 - RNA, 13 nt, Human
ccauaggcccagu

SEQ ID NO: 2869647 - RNA, 12 nt, Human
ccauaggucacc

SEQ ID NO: 2869648 - RNA, 13 nt, Human
ccauaguaacuga

SEQ ID NO: 2869649 - RNA, 15 nt, Human
ccauaguaacugaca

SEQ ID NO: 2869650 - RNA, 16 nt, Human
ccauaguaacugacau

SEQ ID NO: 2869651 - RNA, 18 nt, Human
ccauaguaacugacauga

SEQ ID NO: 2869652 - RNA, 21 nt, Human
ccauaguaacugacaugauua

SEQ ID NO: 2869653 - RNA, 13 nt, Human
ccaguuaaggacc

SEQ ID NO: 2869654 - RNA, 21 nt, Human
ccaguuaaggaccguggcccu

SEQ ID NO: 2869655 - RNA, 22 nt, Human
ccaguuaaggaccguggcccug

SEQ ID NO: 2869656 - RNA, 19 nt, Human
ccaguguugccuaaguauu

SEQ ID NO: 2869657 - RNA, 18 nt, Human
ccaguguucuaugaacaa

SEQ ID NO: 2869658 - RNA, 17 nt, Human
ccaguguugccuaagua

SEQ ID NO: 2869659 - RNA, 22 nt, Human
ccagugugggguucugcuggga

SEQ ID NO: 2869660 - RNA, 15 nt, Human
ccaguguagccuugc

SEQ ID NO: 2869661 - RNA, 14 nt, Human
ccaguguagccuug

SEQ ID NO: 2869662 - RNA, 19 nt, Human
ccagugguuuccagucaug

SEQ ID NO: 2869663 - RNA, 16 nt, Human
ccaguguaauccccca

SEQ ID NO: 2869664 - RNA, 20 nt, Human
ccaguguaaucccccaggag

SEQ ID NO: 2869665 - RNA, 22 nt, Human
ccaguguaaucccccaggagaa

SEQ ID NO: 2869666 - RNA, 12 nt, Human
ccaguguacaua

SEQ ID NO: 2869667 - RNA, 14 nt, Human
ccaguguccccucc

SEQ ID NO: 2869668 - RNA, 16 nt, Human
ccaguguccccuccac

SEQ ID NO: 2869669 - RNA, 22 nt, Human
ccaguguccccuccacugucac

SEQ ID NO: 2869670 - RNA, 23 nt, Human
ccagugcccacaggaucagucug

SEQ ID NO: 2869671 - RNA, 19 nt, Human
ccaggcgccccuucccccu

SEQ ID NO: 2869672 - RNA, 18 nt, Human
ccaggcgccccuuccccc

SEQ ID NO: 2869673 - RNA, 22 nt, Human
ccaggccggugugggcuguguc

SEQ ID NO: 2869674 - RNA, 21 nt, Human
ccaggccgggguggagcaugg

SEQ ID NO: 2869675 - RNA, 17 nt, Human
ccaggccgggccuguac

SEQ ID NO: 2869676 - RNA, 18 nt, Human
ccaggccgggccuguaca

SEQ ID NO: 2869677 - RNA, 19 nt, Human
ccaggccgggccuguacag

SEQ ID NO: 2869678 - RNA, 23 nt, Human
ccaggccgggccuguacagucug

SEQ ID NO: 2869679 - RNA, 18 nt, Human
ccaggccggcgagcccug

SEQ ID NO: 2869680 - RNA, 24 nt, Human
ccaggcuguaucccaugagccuca

SEQ ID NO: 2869681 - RNA, 13 nt, Human
ccaggcuccgccc

SEQ ID NO: 2869682 - RNA, 14 nt, Human
ccaggcuccgcccu

SEQ ID NO: 2869683 - RNA, 17 nt, Human
ccaggcuccgcccuuag

SEQ ID NO: 2869684 - RNA, 18 nt, Human
ccaggcuccgcccuuagu

SEQ ID NO: 2869685 - RNA, 23 nt, Human
ccaggcuccgcccuuaguccccc

SEQ ID NO: 2869686 - RNA, 18 nt, Human
ccaggcuagcuggagccu

SEQ ID NO: 2869687 - RNA, 19 nt, Human
ccaggcuagcuggagccug

SEQ ID NO: 2869688 - RNA, 19 nt, Human
ccaggcuaguccggaccca

SEQ ID NO: 2869689 - RNA, 20 nt, Human
ccaggcuaguccggacccac

SEQ ID NO: 2869690 - RNA, 23 nt, Human
ccaggcuaguccggacccaccuc

SEQ ID NO: 2869691 - RNA, 21 nt, Human
ccaggcgggagcgguggcccu

SEQ ID NO: 2869692 - RNA, 22 nt, Human
ccaggcgggagcgguggcccug

SEQ ID NO: 2869693 - RNA, 17 nt, Human
ccaggccauucugccgc

SEQ ID NO: 2869694 - RNA, 15 nt, Human
ccaggccauucugcc

SEQ ID NO: 2869695 - RNA, 14 nt, Human
ccaggcccacucag

SEQ ID NO: 2869696 - RNA, 15 nt, Human
ccaggcccacucagg

SEQ ID NO: 2869697 - RNA, 16 nt, Human
ccaggcccacucaggg

SEQ ID NO: 2869698 - RNA, 19 nt, Human
ccaggccgcgcccuuuccc

SEQ ID NO: 2869699 - RNA, 14 nt, Human
ccaggccggccagc

SEQ ID NO: 2869700 - RNA, 15 nt, Human
ccaggccggccagcc

SEQ ID NO: 2869701 - RNA, 17 nt, Human
ccaggccggccagccuc

SEQ ID NO: 2869702 - RNA, 18 nt, Human
ccaggccggccagccuca

SEQ ID NO: 2869703 - RNA, 23 nt, Human
ccaggagcucuucaggccucccu

SEQ ID NO: 2869704 - RNA, 21 nt, Human
ccaggagcucuucaggccucc

SEQ ID NO: 2869705 - RNA, 18 nt, Human
ccaggagcucuucaggcc

SEQ ID NO: 2869706 - RNA, 13 nt, Human
ccaggagcucuuc

SEQ ID NO: 2869707 - RNA, 15 nt, Human
ccaggccagcugccu

SEQ ID NO: 2869708 - RNA, 19 nt, Human
ccaggagccccgaggccuu

SEQ ID NO: 2869709 - RNA, 16 nt, Human
ccaggagccccgaggc

SEQ ID NO: 2869710 - RNA, 12 nt, Human
ccaggagagaga

SEQ ID NO: 2869711 - RNA, 14 nt, Human
ccaggagagagaaa

SEQ ID NO: 2869712 - RNA, 15 nt, Human
ccaggagagagaaag

SEQ ID NO: 2869713 - RNA, 21 nt, Human
ccaggagagagaaagccaggc

SEQ ID NO: 2869714 - RNA, 16 nt, Human
ccaggagagagaaagc

SEQ ID NO: 2869715 - RNA, 17 nt, Human
ccaggagagagaaagcc

SEQ ID NO: 2869716 - RNA, 20 nt, Human
ccaggagccccgaggccuuc

SEQ ID NO: 2869717 - RNA, 17 nt, Human
ccaggagccugugccuc

SEQ ID NO: 2869718 - RNA, 16 nt, Human
ccaggagccugugccu

SEQ ID NO: 2869719 - RNA, 20 nt, Human
ccaggagaauaaaagaaauu

SEQ ID NO: 2869720 - RNA, 23 nt, Human
ccaggagaauaaaagaaauuccu

SEQ ID NO: 2869721 - RNA, 22 nt, Human
ccagccucaguccuccccucac

SEQ ID NO: 2869722 - RNA, 15 nt, Human
ccagccuccaugcug

SEQ ID NO: 2869723 - RNA, 16 nt, Human
ccagccuccaugcugc

SEQ ID NO: 2869724 - RNA, 14 nt, Human
ccagggagccuaga

SEQ ID NO: 2869725 - RNA, 16 nt, Human
ccagggagccuagaag

SEQ ID NO: 2869726 - RNA, 15 nt, Human
ccaggcugugcagcg

SEQ ID NO: 2869727 - RNA, 20 nt, Human
ccaggcugugcagcgcagcu

SEQ ID NO: 2869728 - RNA, 17 nt, Human
ccagguuuuuggucuga

SEQ ID NO: 2869729 - RNA, 15 nt, Human
ccagguucagcuugu

SEQ ID NO: 2869730 - RNA, 14 nt, Human
ccagguuccgaaga

SEQ ID NO: 2869731 - RNA, 21 nt, Human
ccagguuccccagccgcccac

SEQ ID NO: 2869732 - RNA, 18 nt, Human
ccagucuggaaugcagug

SEQ ID NO: 2869733 - RNA, 16 nt, Human
ccagucucucuuaaag

SEQ ID NO: 2869734 - RNA, 17 nt, Human
ccagucucucuuaaagu

SEQ ID NO: 2869735 - RNA, 23 nt, Human
ccagucucugcuccaccuuucag

SEQ ID NO: 2869736 - RNA, 18 nt, Human
ccagucguuagaauauag

SEQ ID NO: 2869737 - RNA, 12 nt, Human
ccaguaaacaga

SEQ ID NO: 2869738 - RNA, 17 nt, Human
ccaguaaacagaggagu

SEQ ID NO: 2869739 - RNA, 20 nt, Human
ccagucuggaaugcaguggu

SEQ ID NO: 2869740 - RNA, 19 nt, Human
ccagucuggaaugcagugg

SEQ ID NO: 2869741 - RNA, 18 nt, Human
ccagguaccuugaccuuu

SEQ ID NO: 2869742 - RNA, 14 nt, Human
ccagguacgcacag

SEQ ID NO: 2869743 - RNA, 15 nt, Human
ccagguacgcacaga

SEQ ID NO: 2869744 - RNA, 16 nt, Human
ccagguacgcacagac

SEQ ID NO: 2869745 - RNA, 17 nt, Human
ccagguacgcacagaca

SEQ ID NO: 2869746 - RNA, 18 nt, Human
ccagguacgcacagacag

SEQ ID NO: 2869747 - RNA, 23 nt, Human
ccagguaauggcaugagauagcu

SEQ ID NO: 2869748 - RNA, 20 nt, Human
ccagggcugcuagacggagg

SEQ ID NO: 2869749 - RNA, 21 nt, Human
ccagggcuggaaugauuucag

SEQ ID NO: 2869750 - RNA, 16 nt, Human
ccagggcucugaccag

SEQ ID NO: 2869751 - RNA, 14 nt, Human
ccagggcucugccc

SEQ ID NO: 2869752 - RNA, 16 nt, Human
ccagggcucugcccca

SEQ ID NO: 2869753 - RNA, 17 nt, Human
ccagggcucugccccag

SEQ ID NO: 2869754 - RNA, 18 nt, Human
ccagggcucugccccagu

SEQ ID NO: 2869755 - RNA, 19 nt, Human
ccagggcucugccccaguc

SEQ ID NO: 2869756 - RNA, 15 nt, Human
ccagggcugcccuga

SEQ ID NO: 2869757 - RNA, 16 nt, Human
ccagggcugcccugag

SEQ ID NO: 2869758 - RNA, 17 nt, Human
ccagggcugcccugaga

SEQ ID NO: 2869759 - RNA, 18 nt, Human
ccagggcugcccugagaa

SEQ ID NO: 2869760 - RNA, 19 nt, Human
ccagggcugcccugagaag

SEQ ID NO: 2869761 - RNA, 21 nt, Human
ccagggcugcccugagaagcu

SEQ ID NO: 2869762 - RNA, 23 nt, Human
ccagggcugcccugagaagcugc

SEQ ID NO: 2869763 - RNA, 14 nt, Human
ccagggagccuuug

SEQ ID NO: 2869764 - RNA, 15 nt, Human
ccagggagauuuuga

SEQ ID NO: 2869765 - RNA, 12 nt, Human
ccagggagccuu

SEQ ID NO: 2869766 - RNA, 13 nt, Human
ccagggagccuuu

SEQ ID NO: 2869767 - RNA, 16 nt, Human
ccagggccagggcccu

SEQ ID NO: 2869768 - RNA, 14 nt, Human
ccagggccagggcc

SEQ ID NO: 2869769 - RNA, 17 nt, Human
ccagggccagggcccug

SEQ ID NO: 2869770 - RNA, 19 nt, Human
ccuuggguagugagcagug

SEQ ID NO: 2869771 - RNA, 21 nt, Human
ccuuggguauuugcaauauuc

SEQ ID NO: 2869772 - RNA, 23 nt, Human
ccuuggggaggacaaaacuucuu

SEQ ID NO: 2869773 - RNA, 16 nt, Human
ccuuggucuuuguauc

SEQ ID NO: 2869774 - RNA, 17 nt, Human
ccuuggucuuuguaucu

SEQ ID NO: 2869775 - RNA, 21 nt, Human
ccuuggucuuuguaucuucca

SEQ ID NO: 2869776 - RNA, 14 nt, Human
ccuugagugggguu

SEQ ID NO: 2869777 - RNA, 22 nt, Human
ccuugagugggguuaucucugu

SEQ ID NO: 2869778 - RNA, 23 nt, Human
ccuugagugggguuaucucugug

SEQ ID NO: 2869779 - RNA, 15 nt, Human
ccuugaugauuuaau

SEQ ID NO: 2869780 - RNA, 14 nt, Human
ccuugaugcacaga

SEQ ID NO: 2869781 - RNA, 15 nt, Human
ccuugaugcacagag

SEQ ID NO: 2869782 - RNA, 18 nt, Human
ccuugaugcacagagaag

SEQ ID NO: 2869783 - RNA, 19 nt, Human
ccuugauuuaaacacacag

SEQ ID NO: 2869784 - RNA, 12 nt, Human
ccuugggacccc

SEQ ID NO: 2869785 - RNA, 12 nt, Human
ccuuucuccagg

SEQ ID NO: 2869786 - RNA, 14 nt, Human
ccuuguccuuuccc

SEQ ID NO: 2869787 - RNA, 16 nt, Human
ccuuguccacccaccu

SEQ ID NO: 2869788 - RNA, 15 nt, Human
ccuugguggcaagag

SEQ ID NO: 2869789 - RNA, 14 nt, Human
ccuuguccacccac

SEQ ID NO: 2869790 - RNA, 16 nt, Human
ccuugucacugguaga

SEQ ID NO: 2869791 - RNA, 14 nt, Human
ccuuguuucaaaca

SEQ ID NO: 2869792 - RNA, 20 nt, Human
ccuuguuucaaacacaaaug

SEQ ID NO: 2869793 - RNA, 22 nt, Human
ccuuguuucaaacacaaaugca

SEQ ID NO: 2869794 - RNA, 20 nt, Human
ccuuguuuaucagauacauc

SEQ ID NO: 2869795 - RNA, 22 nt, Human
ccuuguuuaucagauacaucac

SEQ ID NO: 2869796 - RNA, 23 nt, Human
ccuucuuucacucugucaucuuu

SEQ ID NO: 2869797 - RNA, 19 nt, Human
ccuucuugcauccuuccua

SEQ ID NO: 2869798 - RNA, 15 nt, Human
ccuugaaaauauuuu

SEQ ID NO: 2869799 - RNA, 21 nt, Human
ccuugaaaauaagaauagaaa

SEQ ID NO: 2869800 - RNA, 16 nt, Human
ccuugaacucugggcu

SEQ ID NO: 2869801 - RNA, 15 nt, Human
ccuugaaccugugag

SEQ ID NO: 2869802 - RNA, 16 nt, Human
ccuugaaccugugagu

SEQ ID NO: 2869803 - RNA, 17 nt, Human
ccuugaaccugugagua

SEQ ID NO: 2869804 - RNA, 18 nt, Human
ccuugaaccugugaguaa

SEQ ID NO: 2869805 - RNA, 21 nt, Human
ccuugaaccugugaguaaaua

SEQ ID NO: 2869806 - RNA, 22 nt, Human
ccuugaagccacugaagcuggg

SEQ ID NO: 2869807 - RNA, 19 nt, Human
ccuugaagccacugaagcu

SEQ ID NO: 2869808 - RNA, 14 nt, Human
ccuugaagccacug

SEQ ID NO: 2869809 - RNA, 13 nt, Human
ccuugaccuuccu

SEQ ID NO: 2869810 - RNA, 22 nt, Human
ccuugaccuuccucuggggcuc

SEQ ID NO: 2869811 - RNA, 14 nt, Human
ccuugaccuuugua

SEQ ID NO: 2869812 - RNA, 15 nt, Human
ccuugaccuuuguac

SEQ ID NO: 2869813 - RNA, 16 nt, Human
ccuugaccuuuguaca

SEQ ID NO: 2869814 - RNA, 17 nt, Human
ccuugaccuuuguacag

SEQ ID NO: 2869815 - RNA, 21 nt, Human
ccuugaccuuuguacagccca

SEQ ID NO: 2869816 - RNA, 13 nt, Human
ccuugaauaauaa

SEQ ID NO: 2869817 - RNA, 21 nt, Human
ccuugagggugcuuguucccu

SEQ ID NO: 2869818 - RNA, 11 nt, Human
ccuugagggag

SEQ ID NO: 2869819 - RNA, 21 nt, Human
ccuugacuggaccugguggcu

SEQ ID NO: 2869820 - RNA, 16 nt, Human
ccuugacuguugaugu

SEQ ID NO: 2869821 - RNA, 21 nt, Human
ccuugacuguugauguacuga

SEQ ID NO: 2869822 - RNA, 16 nt, Human
ccuugacuuagauucu

SEQ ID NO: 2869823 - RNA, 20 nt, Human
ccuugacuuugaacuaauga

SEQ ID NO: 2869824 - RNA, 21 nt, Human
ccuugaggaaacaacagcuuu

SEQ ID NO: 2869825 - RNA, 15 nt, Human
ccuucugugaaagua

SEQ ID NO: 2869826 - RNA, 14 nt, Human
ccuucuguggcuca

SEQ ID NO: 2869827 - RNA, 16 nt, Human
ccuucucuauaucaug

SEQ ID NO: 2869828 - RNA, 16 nt, Human
ccuucuuccaucccag

SEQ ID NO: 2869829 - RNA, 18 nt, Human
ccuucuuccaucccagga

SEQ ID NO: 2869830 - RNA, 19 nt, Human
ccuucuuccaucccaggac

SEQ ID NO: 2869831 - RNA, 17 nt, Human
ccuucuuauuauauaua

SEQ ID NO: 2869832 - RNA, 16 nt, Human
ccuucuuccccuuccc

SEQ ID NO: 2869833 - RNA, 14 nt, Human
ccuucuuccauccc

SEQ ID NO: 2869834 - RNA, 22 nt, Human
ccuucuuccaucccaggacacc

SEQ ID NO: 2869835 - RNA, 18 nt, Human
ccuucuucaggcugccua

SEQ ID NO: 2869836 - RNA, 13 nt, Human
ccuucuucagggc

SEQ ID NO: 2869837 - RNA, 16 nt, Human
ccuucuucagggccug

SEQ ID NO: 2869838 - RNA, 17 nt, Human
ccuucuucagggccugg

SEQ ID NO: 2869839 - RNA, 18 nt, Human
ccuucuucagggccuggu

SEQ ID NO: 2869840 - RNA, 21 nt, Human
ccuucuguggcucacagaacc

SEQ ID NO: 2869841 - RNA, 18 nt, Human
ccuucgggcgucugugug

SEQ ID NO: 2869842 - RNA, 15 nt, Human
ccuucuacugagccu

SEQ ID NO: 2869843 - RNA, 14 nt, Human
ccuucuacugagcc

SEQ ID NO: 2869844 - RNA, 22 nt, Human
ccuuccuuguuacccaugaaaa

SEQ ID NO: 2869845 - RNA, 12 nt, Human
ccuuccuuucuc

SEQ ID NO: 2869846 - RNA, 14 nt, Human
ccuuccuuucucca

SEQ ID NO: 2869847 - RNA, 16 nt, Human
ccuuccuuucuccagg

SEQ ID NO: 2869848 - RNA, 17 nt, Human
ccuuccuuucuccagga

SEQ ID NO: 2869849 - RNA, 19 nt, Human
ccuuccuuucuccaggacc

SEQ ID NO: 2869850 - RNA, 20 nt, Human
ccuuccuugcuguccuaggc

SEQ ID NO: 2869851 - RNA, 13 nt, Human
ccuuccuugaccu

SEQ ID NO: 2869852 - RNA, 14 nt, Human
ccuuccuugaccuu

SEQ ID NO: 2869853 - RNA, 13 nt, Human
ccuuccuuccugu

SEQ ID NO: 2869854 - RNA, 17 nt, Human
ccuuccaaaaauuauua

SEQ ID NO: 2869855 - RNA, 18 nt, Human
ccuuccaaaaauuauuau

SEQ ID NO: 2869856 - RNA, 17 nt, Human
ccuuccaaauaauaaag

SEQ ID NO: 2869857 - RNA, 20 nt, Human
ccuuccaaauaauaaagucu

SEQ ID NO: 2869858 - RNA, 21 nt, Human
ccuuccucuccuuccuuguua

SEQ ID NO: 2869859 - RNA, 13 nt, Human
ccuuccucugagg

SEQ ID NO: 2869860 - RNA, 20 nt, Human
ccuuccucugagccuuggga

SEQ ID NO: 2869861 - RNA, 15 nt, Human
ccuuccucucuccag

SEQ ID NO: 2869862 - RNA, 17 nt, Human
ccuuccucucuccagau

SEQ ID NO: 2869863 - RNA, 21 nt, Human
ccuuccucuccacugccuucg

SEQ ID NO: 2869864 - RNA, 16 nt, Human
ccuuccucugagccuu

SEQ ID NO: 2869865 - RNA, 15 nt, Human
ccuuccucugagccu

SEQ ID NO: 2869866 - RNA, 20 nt, Human
ccuucacuccggugugccug

SEQ ID NO: 2869867 - RNA, 14 nt, Human
ccuucacuccggug

SEQ ID NO: 2869868 - RNA, 21 nt, Human
ccuucacauuccccuggggac

SEQ ID NO: 2869869 - RNA, 16 nt, Human
ccuucacauuuuuuau

SEQ ID NO: 2869870 - RNA, 18 nt, Human
ccuucacauuuuuuaugg

SEQ ID NO: 2869871 - RNA, 17 nt, Human
ccuucaccccaguggcc

SEQ ID NO: 2869872 - RNA, 10 nt, Human
ccuucagaca

SEQ ID NO: 2869873 - RNA, 11 nt, Human
ccuucagacac

SEQ ID NO: 2869874 - RNA, 18 nt, Human
ccuucagaaccauccaua

SEQ ID NO: 2869875 - RNA, 23 nt, Human
ccuucacuccggugugccugcag

SEQ ID NO: 2869876 - RNA, 14 nt, Human
ccuucacuuaggaa

SEQ ID NO: 2869877 - RNA, 13 nt, Human
ccuucagccccca

SEQ ID NO: 2869878 - RNA, 17 nt, Human
ccuucagcccccagccc

SEQ ID NO: 2869879 - RNA, 18 nt, Human
ccuucagcccccagcccc

SEQ ID NO: 2869880 - RNA, 19 nt, Human
ccuucagcccccagccccu

SEQ ID NO: 2869881 - RNA, 17 nt, Human
ccuucagacacccucaa

SEQ ID NO: 2869882 - RNA, 20 nt, Human
ccuucagacacccucaaccu

SEQ ID NO: 2869883 - RNA, 21 nt, Human
ccugugugugaaaggaagcuc

SEQ ID NO: 2869884 - RNA, 20 nt, Human
ccuguuaauguauuuguuca

SEQ ID NO: 2869885 - RNA, 13 nt, Human
ccuguuuggauuu

SEQ ID NO: 2869886 - RNA, 16 nt, Human
ccuguuuggauuuuua

SEQ ID NO: 2869887 - RNA, 20 nt, Human
ccuguuuuagaagguucucu

SEQ ID NO: 2869888 - RNA, 13 nt, Human
ccuguuucucugc

SEQ ID NO: 2869889 - RNA, 13 nt, Human
ccuguuucugaaa

SEQ ID NO: 2869890 - RNA, 15 nt, Human
ccuguuucugaaaag

SEQ ID NO: 2869891 - RNA, 16 nt, Human
ccuguuucugaaaaga

SEQ ID NO: 2869892 - RNA, 17 nt, Human
ccuguuucugaaaagaa

SEQ ID NO: 2869893 - RNA, 19 nt, Human
ccuguuucugaaaagaaau

SEQ ID NO: 2869894 - RNA, 12 nt, Human
ccuguuucuucc

SEQ ID NO: 2869895 - RNA, 13 nt, Human
ccuguuucuuccu

SEQ ID NO: 2869896 - RNA, 16 nt, Human
ccuguuuaauauuuaa

SEQ ID NO: 2869897 - RNA, 21 nt, Human
ccuguuuaauauuuaaacagc

SEQ ID NO: 2869898 - RNA, 19 nt, Human
ccuguuuauucccaucuuu

SEQ ID NO: 2869899 - RNA, 16 nt, Human
ccuguuucaaucacug

SEQ ID NO: 2869900 - RNA, 17 nt, Human
ccuguuucaaucacugu

SEQ ID NO: 2869901 - RNA, 13 nt, Human
ccuguugugccac

SEQ ID NO: 2869902 - RNA, 14 nt, Human
ccuguugugccaca

SEQ ID NO: 2869903 - RNA, 15 nt, Human
ccuguugugccacag

SEQ ID NO: 2869904 - RNA, 14 nt, Human
ccuguuuaauauuu

SEQ ID NO: 2869905 - RNA, 15 nt, Human
ccuguuuaauauuua

SEQ ID NO: 2869906 - RNA, 21 nt, Human
ccugugugugcgccuacagga

SEQ ID NO: 2869907 - RNA, 20 nt, Human
ccugugugugcgccuacagg

SEQ ID NO: 2869908 - RNA, 12 nt, Human
ccuguguggcca

SEQ ID NO: 2869909 - RNA, 15 nt, Human
ccuguguggccacuu

SEQ ID NO: 2869910 - RNA, 20 nt, Human
ccuguguggccacuucuguc

SEQ ID NO: 2869911 - RNA, 23 nt, Human
ccuguguggccacuucuguccau

SEQ ID NO: 2869912 - RNA, 17 nt, Human
ccugugugguacucuga

SEQ ID NO: 2869913 - RNA, 19 nt, Human
ccugugugguacucugaaa

SEQ ID NO: 2869914 - RNA, 22 nt, Human
ccugugucuugcaauggcagcc

SEQ ID NO: 2869915 - RNA, 20 nt, Human
ccugugucugcgaaguccua

SEQ ID NO: 2869916 - RNA, 23 nt, Human
ccugugucugcgaaguccuaugg

SEQ ID NO: 2869917 - RNA, 23 nt, Human
ccugugucuucuccaccacgcug

SEQ ID NO: 2869918 - RNA, 21 nt, Human
ccugugucuugcaauggcagc

SEQ ID NO: 2869919 - RNA, 19 nt, Human
ccugugucuugcaauggca

SEQ ID NO: 2869920 - RNA, 17 nt, Human
ccugugucuugcaaugg

SEQ ID NO: 2869921 - RNA, 17 nt, Human
ccuguguccaccugugg

SEQ ID NO: 2869922 - RNA, 18 nt, Human
ccuguguccaccuguggg

SEQ ID NO: 2869923 - RNA, 19 nt, Human
ccuguguccaccugugggu

SEQ ID NO: 2869924 - RNA, 17 nt, Human
ccuguguauacagcccu

SEQ ID NO: 2869925 - RNA, 14 nt, Human
ccuguguauggaaa

SEQ ID NO: 2869926 - RNA, 20 nt, Human
ccuguguauggaaaaaccau

SEQ ID NO: 2869927 - RNA, 15 nt, Human
ccugugucaauccag

SEQ ID NO: 2869928 - RNA, 16 nt, Human
ccugugucaauccaga

SEQ ID NO: 2869929 - RNA, 21 nt, Human
ccugugucaauccagauggug

SEQ ID NO: 2869930 - RNA, 14 nt, Human
ccuguguacugugu

SEQ ID NO: 2869931 - RNA, 19 nt, Human
ccuuaauuuuuuuuucaua

SEQ ID NO: 2869932 - RNA, 23 nt, Human
ccuuaaucagguccucagagaau

SEQ ID NO: 2869933 - RNA, 22 nt, Human
ccuuaaugcuucauaugaggag

SEQ ID NO: 2869934 - RNA, 13 nt, Human
ccuuaauuacuua

SEQ ID NO: 2869935 - RNA, 15 nt, Human
ccuuaauuacuuaaa

SEQ ID NO: 2869936 - RNA, 16 nt, Human
ccuuaauuacuuaaaa

SEQ ID NO: 2869937 - RNA, 22 nt, Human
ccuuaagaccuacuguucuaaa

SEQ ID NO: 2869938 - RNA, 14 nt, Human
ccuuaagcccuggc

SEQ ID NO: 2869939 - RNA, 16 nt, Human
ccuuaagcccuggccc

SEQ ID NO: 2869940 - RNA, 18 nt, Human
ccuuaagcccuggccccc

SEQ ID NO: 2869941 - RNA, 23 nt, Human
ccuuaagaccuacuguucuaaag

SEQ ID NO: 2869942 - RNA, 13 nt, Human
ccuuaacccaagg

SEQ ID NO: 2869943 - RNA, 15 nt, Human
ccuuaacccaaggag

SEQ ID NO: 2869944 - RNA, 17 nt, Human
ccuuaacccaaggagca

SEQ ID NO: 2869945 - RNA, 18 nt, Human
ccuuaacccaaggagcac

SEQ ID NO: 2869946 - RNA, 20 nt, Human
ccuuaacccaaggagcacag

SEQ ID NO: 2869947 - RNA, 12 nt, Human
ccuuaacacuga

SEQ ID NO: 2869948 - RNA, 23 nt, Human
ccuuaaagaaagucgaauuaaua

SEQ ID NO: 2869949 - RNA, 22 nt, Human
ccuuaaaggcaccaucuaauag

SEQ ID NO: 2869950 - RNA, 12 nt, Human
ccuuaaaaugga

SEQ ID NO: 2869951 - RNA, 13 nt, Human
ccuuaaaauggaa

SEQ ID NO: 2869952 - RNA, 17 nt, Human
ccuguuuuucugggugg

SEQ ID NO: 2869953 - RNA, 16 nt, Human
ccuguuuuguacauag

SEQ ID NO: 2869954 - RNA, 16 nt, Human
ccuguuuuuuuuucau

SEQ ID NO: 2869955 - RNA, 13 nt, Human
ccuuaaaaaucac

SEQ ID NO: 2869956 - RNA, 15 nt, Human
ccuguuuuucugggu

SEQ ID NO: 2869957 - RNA, 16 nt, Human
ccuguuuuucugggug

SEQ ID NO: 2869958 - RNA, 17 nt, Human
ccuuaccacugcucuga

SEQ ID NO: 2869959 - RNA, 13 nt, Human
ccuuacauuugug

SEQ ID NO: 2869960 - RNA, 19 nt, Human
ccuuacauuugugagauuc

SEQ ID NO: 2869961 - RNA, 15 nt, Human
ccuuaccaacuuucu

SEQ ID NO: 2869962 - RNA, 17 nt, Human
ccuuaccaacuuucugu

SEQ ID NO: 2869963 - RNA, 20 nt, Human
ccuuaccacugcucugauga

SEQ ID NO: 2869964 - RNA, 18 nt, Human
ccuuaccaacuuucugua

SEQ ID NO: 2869965 - RNA, 19 nt, Human
ccuuaccaacuuucuguaa

SEQ ID NO: 2869966 - RNA, 16 nt, Human
ccuuaccccuuagccu

SEQ ID NO: 2869967 - RNA, 15 nt, Human
ccuuaccccuuagcc

SEQ ID NO: 2869968 - RNA, 23 nt, Human
ccuuaccccacaacgugcaacug

SEQ ID NO: 2869969 - RNA, 19 nt, Human
ccuuaccccaguuuuuuga

SEQ ID NO: 2869970 - RNA, 13 nt, Human
ccuuaccccugcc

SEQ ID NO: 2869971 - RNA, 20 nt, Human
ccuuaccccuggcuguuugg

SEQ ID NO: 2869972 - RNA, 17 nt, Human
ccuuacgaucaggcaca

SEQ ID NO: 2869973 - RNA, 18 nt, Human
ccuuacgaucaggcacag

SEQ ID NO: 2869974 - RNA, 21 nt, Human
ccuuacgaucaggcacagguc

SEQ ID NO: 2869975 - RNA, 23 nt, Human
ccuuacgaucaggcacaggucag

SEQ ID NO: 2869976 - RNA, 16 nt, Human
ccuuacgcuuugucac

SEQ ID NO: 2869977 - RNA, 18 nt, Human
ccuuagaagucacacagu

SEQ ID NO: 2869978 - RNA, 17 nt, Human
ccuuagaagucacacag

SEQ ID NO: 2869979 - RNA, 13 nt, Human
ccuuacuucuugc

SEQ ID NO: 2869980 - RNA, 16 nt, Human
ccuuacuucuugcccu

SEQ ID NO: 2869981 - RNA, 17 nt, Human
ccuuacuucuugcccug

SEQ ID NO: 2869982 - RNA, 23 nt, Human
cgagcaguccugccucagccucc

SEQ ID NO: 2869983 - RNA, 14 nt, Human
cgagcaucccccaa

SEQ ID NO: 2869984 - RNA, 21 nt, Human
cgagcaucccccaaaguucac

SEQ ID NO: 2869985 - RNA, 21 nt, Human
cgagcaguccugccucagccu

SEQ ID NO: 2869986 - RNA, 17 nt, Human
cgagcaguccugccuca

SEQ ID NO: 2869987 - RNA, 15 nt, Human
cgagcaguccugccu

SEQ ID NO: 2869988 - RNA, 20 nt, Human
cgagaucacgccacugcacu

SEQ ID NO: 2869989 - RNA, 18 nt, Human
cgagaucacgccacugca

SEQ ID NO: 2869990 - RNA, 16 nt, Human
cgagaucacgccacug

SEQ ID NO: 2869991 - RNA, 20 nt, Human
cgagcaauauuuauggaugc

SEQ ID NO: 2869992 - RNA, 14 nt, Human
cgagcaaagaucaa

SEQ ID NO: 2869993 - RNA, 15 nt, Human
cgagcaaagaucaaa

SEQ ID NO: 2869994 - RNA, 20 nt, Human
cgagcaaagaucaaaauaaa

SEQ ID NO: 2869995 - RNA, 23 nt, Human
cgagcaaagaucaaaauaaaaag

SEQ ID NO: 2869996 - RNA, 17 nt, Human
cgagaucacgccacugc

SEQ ID NO: 2869997 - RNA, 14 nt, Human
cgagagucugucuc

SEQ ID NO: 2869998 - RNA, 15 nt, Human
cgagagucugucuca

SEQ ID NO: 2869999 - RNA, 17 nt, Human
cgagaccagccuggcca

SEQ ID NO: 2870000 - RNA, 14 nt, Human
cgagaccagccugg

SEQ ID NO: 2870001 - RNA, 13 nt, Human
cgagaccagccug

SEQ ID NO: 2870002 - RNA, 16 nt, Human
cgagaccagccuggcc

SEQ ID NO: 2870003 - RNA, 15 nt, Human
cgagaccagccuggc

SEQ ID NO: 2870004 - RNA, 14 nt, Human
cgaauagcugggac

SEQ ID NO: 2870005 - RNA, 13 nt, Human
cgaauagcuggga

SEQ ID NO: 2870006 - RNA, 20 nt, Human
cgagaaauaaaguuugcuua

SEQ ID NO: 2870007 - RNA, 22 nt, Human
cgaaguggacuggccccugggu

SEQ ID NO: 2870008 - RNA, 13 nt, Human
cgaagacacagac

SEQ ID NO: 2870009 - RNA, 14 nt, Human
cgaagaagaugcuc

SEQ ID NO: 2870010 - RNA, 18 nt, Human
cgaagaagagccacagug

SEQ ID NO: 2870011 - RNA, 17 nt, Human
cgaagaauggagaggaa

SEQ ID NO: 2870012 - RNA, 16 nt, Human
cgaagaagagccacag

SEQ ID NO: 2870013 - RNA, 17 nt, Human
cgaagaagagccacagu

SEQ ID NO: 2870014 - RNA, 15 nt, Human
cgaagaagagccaca

SEQ ID NO: 2870015 - RNA, 14 nt, Human
cgaacuucacaacu

SEQ ID NO: 2870016 - RNA, 14 nt, Human
cgaacuggcugcaa

SEQ ID NO: 2870017 - RNA, 12 nt, Human
cgaacuggcugc

SEQ ID NO: 2870018 - RNA, 19 nt, Human
cgaacuccuaaccucaagu

SEQ ID NO: 2870019 - RNA, 14 nt, Human
cgaacuccugaccu

SEQ ID NO: 2870020 - RNA, 23 nt, Human
cgaaccgugagcaggaaggccug

SEQ ID NO: 2870021 - RNA, 22 nt, Human
cgaaagggacuuggaagcuccg

SEQ ID NO: 2870022 - RNA, 18 nt, Human
cgaaagcucuagaaucug

SEQ ID NO: 2870023 - RNA, 19 nt, Human
cgaaagggacuuggaagcu

SEQ ID NO: 2870024 - RNA, 11 nt, Human
cgaaagagaga

SEQ ID NO: 2870025 - RNA, 12 nt, Human
cgaaagagagag

SEQ ID NO: 2870026 - RNA, 13 nt, Human
cgaaagagagaga

SEQ ID NO: 2870027 - RNA, 22 nt, Human
cgaaagagagagaaacaaacuu

SEQ ID NO: 2870028 - RNA, 23 nt, Human
cgaaagagagagaaacaaacuuu

SEQ ID NO: 2870029 - RNA, 11 nt, Human
cgaaagcacac

SEQ ID NO: 2870030 - RNA, 12 nt, Human
cgaaagcacaca

SEQ ID NO: 2870031 - RNA, 13 nt, Human
cgaaagcucuaga

SEQ ID NO: 2870032 - RNA, 14 nt, Human
cgaaagcucuagaa

SEQ ID NO: 2870033 - RNA, 20 nt, Human
ccuuuuacuacagcuaugaa

SEQ ID NO: 2870034 - RNA, 22 nt, Human
ccuuuuauguaguaauugacau

SEQ ID NO: 2870035 - RNA, 11 nt, Human
ccuuuuauagc

SEQ ID NO: 2870036 - RNA, 16 nt, Human
ccuuuuauagcuauua

SEQ ID NO: 2870037 - RNA, 22 nt, Human
ccuuuuauaggugagaaaaaaa

SEQ ID NO: 2870038 - RNA, 15 nt, Human
ccuuuuauugacaca

SEQ ID NO: 2870039 - RNA, 18 nt, Human
ccuuuuuuuccaucuuua

SEQ ID NO: 2870040 - RNA, 14 nt, Human
ccuuuuuuuccuuu

SEQ ID NO: 2870041 - RNA, 16 nt, Human
ccuuuuuuuccuuuuu

SEQ ID NO: 2870042 - RNA, 22 nt, Human
cgaaaaccaggccuuaucucca

SEQ ID NO: 2870043 - RNA, 13 nt, Human
cgaaaaccaggcc

SEQ ID NO: 2870044 - RNA, 15 nt, Human
cgaaaagagucuucc

SEQ ID NO: 2870045 - RNA, 18 nt, Human
cgaaaccugggauucagg

SEQ ID NO: 2870046 - RNA, 15 nt, Human
cgaaacuuguuauug

SEQ ID NO: 2870047 - RNA, 17 nt, Human
cgaaacuuguuauugug

SEQ ID NO: 2870048 - RNA, 19 nt, Human
cgaaacuuguuauugugaa

SEQ ID NO: 2870049 - RNA, 21 nt, Human
cgaaacuuguuauugugaaug

SEQ ID NO: 2870050 - RNA, 23 nt, Human
cgaaacuuguuauugugaaugau

SEQ ID NO: 2870051 - RNA, 18 nt, Human
cgaaaauucauuucacau

SEQ ID NO: 2870052 - RNA, 23 nt, Human
cgaaacacaaaccacaacugaca

SEQ ID NO: 2870053 - RNA, 17 nt, Human
cgaaacacagaaaccuu

SEQ ID NO: 2870054 - RNA, 21 nt, Human
cgaaaccaauuccucauccuc

SEQ ID NO: 2870055 - RNA, 22 nt, Human
cgcagcccuagagccugccugg

SEQ ID NO: 2870056 - RNA, 19 nt, Human
cgcagcccuagagccugcc

SEQ ID NO: 2870057 - RNA, 20 nt, Human
cgcagcccuagagccugccu

SEQ ID NO: 2870058 - RNA, 12 nt, Human
cgcagaccuccc

SEQ ID NO: 2870059 - RNA, 17 nt, Human
cgcaccccccaagcugu

SEQ ID NO: 2870060 - RNA, 14 nt, Human
cgcaccccccuguu

SEQ ID NO: 2870061 - RNA, 18 nt, Human
cgcaccccccuguucuaa

SEQ ID NO: 2870062 - RNA, 21 nt, Human
cgcaccccccuguucuaaggg

SEQ ID NO: 2870063 - RNA, 22 nt, Human
cgcaccccgauguggaccucua

SEQ ID NO: 2870064 - RNA, 19 nt, Human
cgcagaccuccccagcccc

SEQ ID NO: 2870065 - RNA, 20 nt, Human
cgcagaccuccccagccccu

SEQ ID NO: 2870066 - RNA, 13 nt, Human
cgcagaccucugg

SEQ ID NO: 2870067 - RNA, 15 nt, Human
cgcagaccucuggau

SEQ ID NO: 2870068 - RNA, 19 nt, Human
cgcagaccucuggauuagg

SEQ ID NO: 2870069 - RNA, 15 nt, Human
cgcagaccuccccag

SEQ ID NO: 2870070 - RNA, 16 nt, Human
cgcagaccuccccagc

SEQ ID NO: 2870071 - RNA, 17 nt, Human
cgcagaccuccccagcc

SEQ ID NO: 2870072 - RNA, 18 nt, Human
cgcagaccuccccagccc

SEQ ID NO: 2870073 - RNA, 10 nt, Human
cgcagcccug

SEQ ID NO: 2870074 - RNA, 17 nt, Human
cgcagcccuagagccug

SEQ ID NO: 2870075 - RNA, 18 nt, Human
cgcagcccuagagccugc

SEQ ID NO: 2870076 - RNA, 12 nt, Human
cgcagccccauc

SEQ ID NO: 2870077 - RNA, 13 nt, Human
cgcagccccaucu

SEQ ID NO: 2870078 - RNA, 18 nt, Human
cgcagccccaucugugca

SEQ ID NO: 2870079 - RNA, 15 nt, Human
cgauucauauugaau

SEQ ID NO: 2870080 - RNA, 22 nt, Human
cgauucaccugagcaggaccuc

SEQ ID NO: 2870081 - RNA, 14 nt, Human
cgauuugucccagg

SEQ ID NO: 2870082 - RNA, 14 nt, Human
cgauuuuauuacug

SEQ ID NO: 2870083 - RNA, 16 nt, Human
cgauuuuauuacuggc

SEQ ID NO: 2870084 - RNA, 19 nt, Human
cgauuuuauuacuggcgug

SEQ ID NO: 2870085 - RNA, 17 nt, Human
cgauuuucuccagcuca

SEQ ID NO: 2870086 - RNA, 18 nt, Human
cgcaaaccacacuggacu

SEQ ID NO: 2870087 - RNA, 15 nt, Human
cgcaaaccacacugg

SEQ ID NO: 2870088 - RNA, 16 nt, Human
cgcaaaccacacugga

SEQ ID NO: 2870089 - RNA, 13 nt, Human
cgauuuugccugu

SEQ ID NO: 2870090 - RNA, 12 nt, Human
cgcacauauaca

SEQ ID NO: 2870091 - RNA, 16 nt, Human
cgcacauauacacaca

SEQ ID NO: 2870092 - RNA, 18 nt, Human
cgcacauauacacacaca

SEQ ID NO: 2870093 - RNA, 10 nt, Human
cgcacagcag

SEQ ID NO: 2870094 - RNA, 12 nt, Human
cgcacagcagcc

SEQ ID NO: 2870095 - RNA, 15 nt, Human
cgcacagcagccugc

SEQ ID NO: 2870096 - RNA, 20 nt, Human
cgcacagcagccugcuuccc

SEQ ID NO: 2870097 - RNA, 20 nt, Human
cgcacacccucacucugcca

SEQ ID NO: 2870098 - RNA, 22 nt, Human
cgcacacccucacucugccagg

SEQ ID NO: 2870099 - RNA, 12 nt, Human
cgcacagacagg

SEQ ID NO: 2870100 - RNA, 13 nt, Human
cgcacagacaggu

SEQ ID NO: 2870101 - RNA, 16 nt, Human
cgcacacacacacaua

SEQ ID NO: 2870102 - RNA, 22 nt, Human
cgcacacacacacacacacauc

SEQ ID NO: 2870103 - RNA, 18 nt, Human
cgcacacacacacauaca

SEQ ID NO: 2870104 - RNA, 22 nt, Human
cgcaagagccauguagaagcug

SEQ ID NO: 2870105 - RNA, 20 nt, Human
cgcaagauagauuuggaaua

SEQ ID NO: 2870106 - RNA, 16 nt, Human
cgagcccugguggcag

SEQ ID NO: 2870107 - RNA, 15 nt, Human
cgagcccugguggca

SEQ ID NO: 2870108 - RNA, 13 nt, Human
cgauguaaauuau

SEQ ID NO: 2870109 - RNA, 23 nt, Human
cgauguggaccucuacuuuccag

SEQ ID NO: 2870110 - RNA, 21 nt, Human
ccugcaagccugucugagacu

SEQ ID NO: 2870111 - RNA, 13 nt, Human
ccugcaaggccca

SEQ ID NO: 2870112 - RNA, 14 nt, Human
ccugcaaggcccac

SEQ ID NO: 2870113 - RNA, 15 nt, Human
ccugcaaggcccaca

SEQ ID NO: 2870114 - RNA, 16 nt, Human
ccugcaaggcccacag

SEQ ID NO: 2870115 - RNA, 19 nt, Human
ccugcaaggcccacaggag

SEQ ID NO: 2870116 - RNA, 21 nt, Human
ccugcaaggcccacaggaggc

SEQ ID NO: 2870117 - RNA, 22 nt, Human
ccugcaaaauuugaugccagga

SEQ ID NO: 2870118 - RNA, 19 nt, Human
ccugcaauuucauaugcug

SEQ ID NO: 2870119 - RNA, 19 nt, Human
ccugcaauguaucccuucu

SEQ ID NO: 2870120 - RNA, 16 nt, Human
ccugcaauauuugaau

SEQ ID NO: 2870121 - RNA, 13 nt, Human
ccugcaaucccag

SEQ ID NO: 2870122 - RNA, 14 nt, Human
ccugcaaugaaagg

SEQ ID NO: 2870123 - RNA, 22 nt, Human
ccugcaaugaaagguacuauau

SEQ ID NO: 2870124 - RNA, 13 nt, Human
ccugcaauauuug

SEQ ID NO: 2870125 - RNA, 13 nt, Human
ccugcagggcugc

SEQ ID NO: 2870126 - RNA, 16 nt, Human
ccugcaggccaggcca

SEQ ID NO: 2870127 - RNA, 15 nt, Human
ccugcagggccaagc

SEQ ID NO: 2870128 - RNA, 18 nt, Human
ccugcaguacuuuaccuc

SEQ ID NO: 2870129 - RNA, 20 nt, Human
ccugcaguacuuuaccuccu

SEQ ID NO: 2870130 - RNA, 23 nt, Human
ccugcacuccucagggcagccuc

SEQ ID NO: 2870131 - RNA, 12 nt, Human
ccugcacuccuc

SEQ ID NO: 2870132 - RNA, 21 nt, Human
ccugcacuaauuugauguuua

SEQ ID NO: 2870133 - RNA, 14 nt, Human
ccugcacuaaagcc

SEQ ID NO: 2870134 - RNA, 19 nt, Human
ccugcacuaaagccagccu

SEQ ID NO: 2870135 - RNA, 20 nt, Human
ccugcacuaaagccagccug

SEQ ID NO: 2870136 - RNA, 21 nt, Human
ccugcacuaaagccagccuga

SEQ ID NO: 2870137 - RNA, 18 nt, Human
ccugcaggccaggccagc

SEQ ID NO: 2870138 - RNA, 15 nt, Human
ccugcaggcugagcc

SEQ ID NO: 2870139 - RNA, 16 nt, Human
ccugcaggcugagcca

SEQ ID NO: 2870140 - RNA, 12 nt, Human
ccugcaggccag

SEQ ID NO: 2870141 - RNA, 22 nt, Human
ccugcaggccaagagcagaggc

SEQ ID NO: 2870142 - RNA, 21 nt, Human
ccugcaggccaagagcagagg

SEQ ID NO: 2870143 - RNA, 16 nt, Human
ccugcaggccaagagc

SEQ ID NO: 2870144 - RNA, 22 nt, Human
ccugcaaacgcugccugcccgu

SEQ ID NO: 2870145 - RNA, 21 nt, Human
ccugcaaacgcugccugcccg

SEQ ID NO: 2870146 - RNA, 22 nt, Human
ccugcaaacgcugccugcccac

SEQ ID NO: 2870147 - RNA, 19 nt, Human
ccugcaaacgcugccugcc

SEQ ID NO: 2870148 - RNA, 18 nt, Human
ccugcaaacgcugccugc

SEQ ID NO: 2870149 - RNA, 17 nt, Human
ccugcaaacgcugccug

SEQ ID NO: 2870150 - RNA, 16 nt, Human
ccugcaaacgcugccu

SEQ ID NO: 2870151 - RNA, 15 nt, Human
ccugcaaacgcugcc

SEQ ID NO: 2870152 - RNA, 17 nt, Human
ccugcaaacagaacagg

SEQ ID NO: 2870153 - RNA, 18 nt, Human
ccugcaaacagaacaggg

SEQ ID NO: 2870154 - RNA, 19 nt, Human
ccugcaaacagaacagggu

SEQ ID NO: 2870155 - RNA, 20 nt, Human
ccugcaaacagaacaggguc

SEQ ID NO: 2870156 - RNA, 21 nt, Human
ccugcaaacagaacaggguca

SEQ ID NO: 2870157 - RNA, 13 nt, Human
ccugauuguaaac

SEQ ID NO: 2870158 - RNA, 19 nt, Human
ccugcaaaaucuguucuaa

SEQ ID NO: 2870159 - RNA, 20 nt, Human
ccugauuguguauauucaua

SEQ ID NO: 2870160 - RNA, 14 nt, Human
ccugcaaaaaauac

SEQ ID NO: 2870161 - RNA, 15 nt, Human
ccugcaaaaaauacu

SEQ ID NO: 2870162 - RNA, 17 nt, Human
ccugauugccaagcuca

SEQ ID NO: 2870163 - RNA, 13 nt, Human
ccugauugaccug

SEQ ID NO: 2870164 - RNA, 16 nt, Human
ccugauugaccugcuc

SEQ ID NO: 2870165 - RNA, 17 nt, Human
ccugauugaccugcucc

SEQ ID NO: 2870166 - RNA, 17 nt, Human
ccugccagccuggcuuc

SEQ ID NO: 2870167 - RNA, 16 nt, Human
ccugccagccuggcuu

SEQ ID NO: 2870168 - RNA, 15 nt, Human
ccugccagccuggcu

SEQ ID NO: 2870169 - RNA, 14 nt, Human
ccugccagccuggc

SEQ ID NO: 2870170 - RNA, 14 nt, Human
ccugccagagggga

SEQ ID NO: 2870171 - RNA, 18 nt, Human
ccugccagaggggaagga

SEQ ID NO: 2870172 - RNA, 12 nt, Human
ccugccagcccc

SEQ ID NO: 2870173 - RNA, 15 nt, Human
ccugccagccccaca

SEQ ID NO: 2870174 - RNA, 18 nt, Human
ccugccagccccacacag

SEQ ID NO: 2870175 - RNA, 13 nt, Human
ccugccagccugg

SEQ ID NO: 2870176 - RNA, 21 nt, Human
ccugccagccuggcuucugga

SEQ ID NO: 2870177 - RNA, 14 nt, Human
ccugcaucuuuagu

SEQ ID NO: 2870178 - RNA, 18 nt, Human
ccugcaucuuuagugcuu

SEQ ID NO: 2870179 - RNA, 16 nt, Human
ccugcaucuaagccca

SEQ ID NO: 2870180 - RNA, 17 nt, Human
ccugcaucuaagcccau

SEQ ID NO: 2870181 - RNA, 18 nt, Human
ccugcaugggccagcccc

SEQ ID NO: 2870182 - RNA, 21 nt, Human
ccugcagugggguuucgcagc

SEQ ID NO: 2870183 - RNA, 12 nt, Human
ccugcaguguuc

SEQ ID NO: 2870184 - RNA, 19 nt, Human
ccugcaguguucgcuuggc

SEQ ID NO: 2870185 - RNA, 20 nt, Human
ccugcaguguucgcuuggcu

SEQ ID NO: 2870186 - RNA, 21 nt, Human
ccugcaguguucgcuuggcuc

SEQ ID NO: 2870187 - RNA, 20 nt, Human
ccugcaguuaauuagcauuc

SEQ ID NO: 2870188 - RNA, 18 nt, Human
ccugcauccccuuggcug

SEQ ID NO: 2870189 - RNA, 21 nt, Human
ccugcauccccuuggcuguga

SEQ ID NO: 2870190 - RNA, 23 nt, Human
ccugcauccccuuggcugugagg

SEQ ID NO: 2870191 - RNA, 24 nt, Human
ccugcauccccuuggcugugaggc

SEQ ID NO: 2870192 - RNA, 23 nt, Human
ccugcaucccaggaugcugggug

SEQ ID NO: 2870193 - RNA, 23 nt, Human
ccugccacuuugguacauggcca

SEQ ID NO: 2870194 - RNA, 23 nt, Human
ccugcauguaaacacgccugcaa

SEQ ID NO: 2870195 - RNA, 22 nt, Human
ccugcauguaaacacgccugca

SEQ ID NO: 2870196 - RNA, 21 nt, Human
ccugcauguaaacacgccugc

SEQ ID NO: 2870197 - RNA, 20 nt, Human
ccugcauguaaacacgccug

SEQ ID NO: 2870198 - RNA, 22 nt, Human
ccugcccccagaccuuuuaucc

SEQ ID NO: 2870199 - RNA, 13 nt, Human
ccugagccaagga

SEQ ID NO: 2870200 - RNA, 14 nt, Human
ccugagcuuuaugg

SEQ ID NO: 2870201 - RNA, 21 nt, Human
ccugaggaaggaggggaagcu

SEQ ID NO: 2870202 - RNA, 23 nt, Human
ccugaggaaggaggggaagcugc

SEQ ID NO: 2870203 - RNA, 17 nt, Human
ccugacagaaggugcca

SEQ ID NO: 2870204 - RNA, 16 nt, Human
ccugacagaaggugcc

SEQ ID NO: 2870205 - RNA, 15 nt, Human
ccugacagaaggugc

SEQ ID NO: 2870206 - RNA, 14 nt, Human
ccugacagaaggug

SEQ ID NO: 2870207 - RNA, 16 nt, Human
ccugacagaaggacuc

SEQ ID NO: 2870208 - RNA, 18 nt, Human
ccugacagucuugugcuu

SEQ ID NO: 2870209 - RNA, 13 nt, Human
ccugacaucacag

SEQ ID NO: 2870210 - RNA, 14 nt, Human
ccugacaucacagc

SEQ ID NO: 2870211 - RNA, 17 nt, Human
ccugacaucacagcagc

SEQ ID NO: 2870212 - RNA, 18 nt, Human
ccugacaucacagcagcc

SEQ ID NO: 2870213 - RNA, 19 nt, Human
ccugacaucacagcagccu

SEQ ID NO: 2870214 - RNA, 20 nt, Human
ccugacaucacagcagccuc

SEQ ID NO: 2870215 - RNA, 21 nt, Human
ccugacaucacagcagccucc

SEQ ID NO: 2870216 - RNA, 14 nt, Human
ccugagcaacucuu

SEQ ID NO: 2870217 - RNA, 13 nt, Human
ccugagcaacucu

SEQ ID NO: 2870218 - RNA, 23 nt, Human
ccugagcaacucuugauuaucca

SEQ ID NO: 2870219 - RNA, 18 nt, Human
ccugagcaacucuugauu

SEQ ID NO: 2870220 - RNA, 15 nt, Human
ccugagcaacucuug

SEQ ID NO: 2870221 - RNA, 23 nt, Human
ccuggaaaggcucagucucagga

SEQ ID NO: 2870222 - RNA, 22 nt, Human
ccuggaacaucaucaaggcacu

SEQ ID NO: 2870223 - RNA, 24 nt, Human
ccuggaacauccuuugcagggcag

SEQ ID NO: 2870224 - RNA, 15 nt, Human
ccuggaaccuugcug

SEQ ID NO: 2870225 - RNA, 16 nt, Human
ccuggaaccuugcugu

SEQ ID NO: 2870226 - RNA, 17 nt, Human
ccuggaaccuugcuguc

SEQ ID NO: 2870227 - RNA, 18 nt, Human
ccuggaaccuugcugucc

SEQ ID NO: 2870228 - RNA, 20 nt, Human
ccuggaaccuugcuguccug

SEQ ID NO: 2870229 - RNA, 21 nt, Human
ccuggaaccuugcuguccuga

SEQ ID NO: 2870230 - RNA, 20 nt, Human
ccuggaacucuaucugggcc

SEQ ID NO: 2870231 - RNA, 22 nt, Human
ccuggaacucuaucugggccug

SEQ ID NO: 2870232 - RNA, 12 nt, Human
ccuggaagacag

SEQ ID NO: 2870233 - RNA, 13 nt, Human
ccuggaagacaga

SEQ ID NO: 2870234 - RNA, 14 nt, Human
ccuggaagacagag

SEQ ID NO: 2870235 - RNA, 15 nt, Human
ccuggaagacagaga

SEQ ID NO: 2870236 - RNA, 22 nt, Human
ccuggaagacagagaccuccug

SEQ ID NO: 2870237 - RNA, 15 nt, Human
ccuggaagcuuuguc

SEQ ID NO: 2870238 - RNA, 23 nt, Human
ccuggaagcuuuguccccugcuu

SEQ ID NO: 2870239 - RNA, 19 nt, Human
ccugcuucagauguggagc

SEQ ID NO: 2870240 - RNA, 21 nt, Human
ccugcuucagauguggagcca

SEQ ID NO: 2870241 - RNA, 22 nt, Human
ccugcuucagauguggagccag

SEQ ID NO: 2870242 - RNA, 23 nt, Human
ccugcuucagauguggagccagg

SEQ ID NO: 2870243 - RNA, 23 nt, Human
ccugcuuugggcugcccuggugc

SEQ ID NO: 2870244 - RNA, 21 nt, Human
ccugcuuugggcugcccuggu

SEQ ID NO: 2870245 - RNA, 22 nt, Human
ccugcuuugggcugcccuggug

SEQ ID NO: 2870246 - RNA, 20 nt, Human
ccugcuuugggcugcccugg

SEQ ID NO: 2870247 - RNA, 19 nt, Human
ccugcuuugggcugcccug

SEQ ID NO: 2870248 - RNA, 22 nt, Human
ccugcucuccgaccagacaccu

SEQ ID NO: 2870249 - RNA, 22 nt, Human
ccugcucuccaagucucagugg

SEQ ID NO: 2870250 - RNA, 23 nt, Human
ccugcucuccaagucucaguggc

SEQ ID NO: 2870251 - RNA, 16 nt, Human
ccugcucuccucuugc

SEQ ID NO: 2870252 - RNA, 18 nt, Human
ccugcucuccucuugcca

SEQ ID NO: 2870253 - RNA, 19 nt, Human
ccugcucuccucuugccac

SEQ ID NO: 2870254 - RNA, 21 nt, Human
ccugcucuccucuugccacug

SEQ ID NO: 2870255 - RNA, 22 nt, Human
ccugcucuccucuugccacugc

SEQ ID NO: 2870256 - RNA, 21 nt, Human
ccugcucuccgaccagacacc

SEQ ID NO: 2870257 - RNA, 13 nt, Human
ccugcuccugcag

SEQ ID NO: 2870258 - RNA, 14 nt, Human
ccugcuccugcagc

SEQ ID NO: 2870259 - RNA, 15 nt, Human
ccugcuccugcagca

SEQ ID NO: 2870260 - RNA, 16 nt, Human
ccugcuccugcagcau

SEQ ID NO: 2870261 - RNA, 17 nt, Human
ccugcuccugcagcaug

SEQ ID NO: 2870262 - RNA, 21 nt, Human
ccugcuccagaauuuggaaau

SEQ ID NO: 2870263 - RNA, 22 nt, Human
ccugcuccagaauuuggaaauc

SEQ ID NO: 2870264 - RNA, 13 nt, Human
ccugccuggagcg

SEQ ID NO: 2870265 - RNA, 14 nt, Human
ccugccuggccagg

SEQ ID NO: 2870266 - RNA, 13 nt, Human
ccugccuggccag

SEQ ID NO: 2870267 - RNA, 12 nt, Human
ccugccuggcca

SEQ ID NO: 2870268 - RNA, 11 nt, Human
ccugccuggcc

SEQ ID NO: 2870269 - RNA, 14 nt, Human
ccugccuucaugga

SEQ ID NO: 2870270 - RNA, 17 nt, Human
ccugccuuaggccuacc

SEQ ID NO: 2870271 - RNA, 13 nt, Human
ccugccuggcccc

SEQ ID NO: 2870272 - RNA, 23 nt, Human
ccugccuggccaggcagaucugu

SEQ ID NO: 2870273 - RNA, 22 nt, Human
ccugccuggccaggcagaucug

SEQ ID NO: 2870274 - RNA, 18 nt, Human
ccugccuggccaggcaga

SEQ ID NO: 2870275 - RNA, 14 nt, Human
ccugccuggccccu

SEQ ID NO: 2870276 - RNA, 15 nt, Human
ccugccuggccccuc

SEQ ID NO: 2870277 - RNA, 12 nt, Human
ccugccuggccg

SEQ ID NO: 2870278 - RNA, 14 nt, Human
ccugccuggccggc

SEQ ID NO: 2870279 - RNA, 15 nt, Human
ccugccuggccggcc

SEQ ID NO: 2870280 - RNA, 16 nt, Human
ccugccuggccggcca

SEQ ID NO: 2870281 - RNA, 17 nt, Human
ccugccuggccggccag

SEQ ID NO: 2870282 - RNA, 18 nt, Human
ccugccuggccggccagc

SEQ ID NO: 2870283 - RNA, 19 nt, Human
ccugccuggccggccagcc

SEQ ID NO: 2870284 - RNA, 23 nt, Human
ccugccuggccggccagccagcc

SEQ ID NO: 2870285 - RNA, 16 nt, Human
ccugccggagaggaag

SEQ ID NO: 2870286 - RNA, 18 nt, Human
ccugccggagaggaagag

SEQ ID NO: 2870287 - RNA, 21 nt, Human
ccugccggagaggaagagaca

SEQ ID NO: 2870288 - RNA, 15 nt, Human
ccugccgguaaacac

SEQ ID NO: 2870289 - RNA, 20 nt, Human
ccugccgguaaacacgccug

SEQ ID NO: 2870290 - RNA, 22 nt, Human
ccugccgguaaacacgccugca

SEQ ID NO: 2870291 - RNA, 21 nt, Human
ccugccgguaaacacgccugc

SEQ ID NO: 2870292 - RNA, 23 nt, Human
ccugccgguaaacacgccugcaa

SEQ ID NO: 2870293 - RNA, 22 nt, Human
ccugccccgcccagcugcaccu

SEQ ID NO: 2870294 - RNA, 16 nt, Human
ccugccccgcccagcu

SEQ ID NO: 2870295 - RNA, 14 nt, Human
ccugcgccugugau

SEQ ID NO: 2870296 - RNA, 15 nt, Human
ccugcgccugugaug

SEQ ID NO: 2870297 - RNA, 22 nt, Human
ccugcgcccaguccuuccaccu

SEQ ID NO: 2870298 - RNA, 22 nt, Human
ccugcgggucacaggagggagg

SEQ ID NO: 2870299 - RNA, 18 nt, Human
ccugcgggucacaggagg

SEQ ID NO: 2870300 - RNA, 20 nt, Human
ccugcgaaggggcccugguc

SEQ ID NO: 2870301 - RNA, 19 nt, Human
ccugcgaaggggcccuggu

SEQ ID NO: 2870302 - RNA, 17 nt, Human
ccugcgaaggggcccug

SEQ ID NO: 2870303 - RNA, 15 nt, Human
ccugcgaaggggccc

SEQ ID NO: 2870304 - RNA, 11 nt, Human
ccugccuuugc

SEQ ID NO: 2870305 - RNA, 14 nt, Human
ccugccuuugccuc

SEQ ID NO: 2870306 - RNA, 18 nt, Human
ccugccuuugggagcagg

SEQ ID NO: 2870307 - RNA, 11 nt, Human
ccugccuuuua

SEQ ID NO: 2870308 - RNA, 18 nt, Human
ccugcgauuuugccugug

SEQ ID NO: 2870309 - RNA, 18 nt, Human
ccugcgcccaguccuucc

SEQ ID NO: 2870310 - RNA, 20 nt, Human
ccugcgcccaguccuuccac

SEQ ID NO: 2870311 - RNA, 13 nt, Human
ccugccuugaagc

SEQ ID NO: 2870312 - RNA, 21 nt, Human
ccugccuugaagccacugaag

SEQ ID NO: 2870313 - RNA, 19 nt, Human
ccugccuugaagccacuga

SEQ ID NO: 2870314 - RNA, 17 nt, Human
ccugccuugaagccacu

SEQ ID NO: 2870315 - RNA, 16 nt, Human
ccugccuugaagccac

SEQ ID NO: 2870316 - RNA, 23 nt, Human
ccugccuugaagccacugaagcu

SEQ ID NO: 2870317 - RNA, 22 nt, Human
ccugccuugaagccacugaagc

SEQ ID NO: 2870318 - RNA, 16 nt, Human
ccugccuuguuuggau

SEQ ID NO: 2870319 - RNA, 19 nt, Human
ccugccuuggccucccaag

SEQ ID NO: 2870320 - RNA, 23 nt, Human
ccuggcuuuucacugcuggcugc

SEQ ID NO: 2870321 - RNA, 24 nt, Human
ccuggcuuuucacugcuggcugcc

SEQ ID NO: 2870322 - RNA, 20 nt, Human
ccuggcuuuucacugcuggc

SEQ ID NO: 2870323 - RNA, 18 nt, Human
ccuggcuuuucacugcug

SEQ ID NO: 2870324 - RNA, 21 nt, Human
ccuggcuuuucacugcuggcu

SEQ ID NO: 2870325 - RNA, 22 nt, Human
ccuggcuuuucacugcuggcug

SEQ ID NO: 2870326 - RNA, 23 nt, Human
ccuggcuguuuggacuuuguaua

SEQ ID NO: 2870327 - RNA, 14 nt, Human
ccuggcuucaggca

SEQ ID NO: 2870328 - RNA, 22 nt, Human
ccuggcuucaggcaauucuccu

SEQ ID NO: 2870329 - RNA, 13 nt, Human
ccuggcuguacug

SEQ ID NO: 2870330 - RNA, 14 nt, Human
ccuggcuguacugc

SEQ ID NO: 2870331 - RNA, 19 nt, Human
ccuggcuguacugcucagg

SEQ ID NO: 2870332 - RNA, 16 nt, Human
ccuggcuucuggagcc

SEQ ID NO: 2870333 - RNA, 15 nt, Human
ccuggcuucuggagc

SEQ ID NO: 2870334 - RNA, 14 nt, Human
ccuggcuucuggag

SEQ ID NO: 2870335 - RNA, 13 nt, Human
ccuggcuucugga

SEQ ID NO: 2870336 - RNA, 23 nt, Human
ccugggcauauccaccaccuccc

SEQ ID NO: 2870337 - RNA, 14 nt, Human
ccugggccaggguc

SEQ ID NO: 2870338 - RNA, 15 nt, Human
ccugggccagggucu

SEQ ID NO: 2870339 - RNA, 16 nt, Human
ccugggccagggucug

SEQ ID NO: 2870340 - RNA, 23 nt, Human
ccugggaaaccccuucucuguga

SEQ ID NO: 2870341 - RNA, 22 nt, Human
ccugggcauauccaccaccucc

SEQ ID NO: 2870342 - RNA, 18 nt, Human
ccuggggguucuuucuuc

SEQ ID NO: 2870343 - RNA, 12 nt, Human
ccuggggguggg

SEQ ID NO: 2870344 - RNA, 18 nt, Human
ccuggguggaucggccuc

SEQ ID NO: 2870345 - RNA, 22 nt, Human
ccuggguggaucggccuccucu

SEQ ID NO: 2870346 - RNA, 21 nt, Human
ccuggggguucuuucuuccuc

SEQ ID NO: 2870347 - RNA, 22 nt, Human
ccuggggguucuuucuuccucu

SEQ ID NO: 2870348 - RNA, 23 nt, Human
ccuggggguucuuucuuccucug

SEQ ID NO: 2870349 - RNA, 22 nt, Human
ccugggguaccaagagacuccu

SEQ ID NO: 2870350 - RNA, 13 nt, Human
ccuggguucccuu

SEQ ID NO: 2870351 - RNA, 17 nt, Human
ccuggguucccuuuccu

SEQ ID NO: 2870352 - RNA, 16 nt, Human
ccuggguuuaagggga

SEQ ID NO: 2870353 - RNA, 15 nt, Human
ccugguacucaagcc

SEQ ID NO: 2870354 - RNA, 17 nt, Human
ccugguacccuccuggc

SEQ ID NO: 2870355 - RNA, 16 nt, Human
ccugguacucaagccc

SEQ ID NO: 2870356 - RNA, 19 nt, Human
ccugguacucaagcccgcg

SEQ ID NO: 2870357 - RNA, 13 nt, Human
ccugguacucccu

SEQ ID NO: 2870358 - RNA, 20 nt, Human
ccugguacucccucucagga

SEQ ID NO: 2870359 - RNA, 14 nt, Human
ccugguacccuccu

SEQ ID NO: 2870360 - RNA, 15 nt, Human
ccugguacccuccug

SEQ ID NO: 2870361 - RNA, 17 nt, Human
ccuggucaggcccuggu

SEQ ID NO: 2870362 - RNA, 19 nt, Human
ccuggucaggcccuggugc

SEQ ID NO: 2870363 - RNA, 20 nt, Human
ccuggucacagggcaugccc

SEQ ID NO: 2870364 - RNA, 22 nt, Human
ccuggucacaggacucugccuc

SEQ ID NO: 2870365 - RNA, 23 nt, Human
ccuggucacaggacucugccucc

SEQ ID NO: 2870366 - RNA, 21 nt, Human
ccuggucacaggacucugccu

SEQ ID NO: 2870367 - RNA, 15 nt, Human
ccugguauggcugca

SEQ ID NO: 2870368 - RNA, 16 nt, Human
ccugguauggcugcag

SEQ ID NO: 2870369 - RNA, 21 nt, Human
ccugguccagggaagcuggcc

SEQ ID NO: 2870370 - RNA, 14 nt, Human
ccugguccagggaa

SEQ ID NO: 2870371 - RNA, 22 nt, Human
ccugguccagggaagcuggccg

SEQ ID NO: 2870372 - RNA, 13 nt, Human
ccugguccaugca

SEQ ID NO: 2870373 - RNA, 16 nt, Human
ccugguccaugcaggg

SEQ ID NO: 2870374 - RNA, 19 nt, Human
ccugguccaugcagggggc

SEQ ID NO: 2870375 - RNA, 10 nt, Human
ccuggugccc

SEQ ID NO: 2870376 - RNA, 15 nt, Human
ccuggccagaugcac

SEQ ID NO: 2870377 - RNA, 18 nt, Human
ccuggcagcccagagacu

SEQ ID NO: 2870378 - RNA, 17 nt, Human
ccuggcagcccagagac

SEQ ID NO: 2870379 - RNA, 15 nt, Human
ccuggcagcccagag

SEQ ID NO: 2870380 - RNA, 21 nt, Human
ccuggcagccgugccuucagc

SEQ ID NO: 2870381 - RNA, 22 nt, Human
ccuggcagccgugccuucagcu

SEQ ID NO: 2870382 - RNA, 17 nt, Human
ccuggcaggaugacccu

SEQ ID NO: 2870383 - RNA, 21 nt, Human
ccuggcuggagaauguggaga

SEQ ID NO: 2870384 - RNA, 22 nt, Human
ccuggcuggagaauguggagaa

SEQ ID NO: 2870385 - RNA, 23 nt, Human
ccuggcucccacaggcccuuccu

SEQ ID NO: 2870386 - RNA, 17 nt, Human
ccuggcucccacaggcc

SEQ ID NO: 2870387 - RNA, 17 nt, Human
ccuggacacucagaccu

SEQ ID NO: 2870388 - RNA, 16 nt, Human
ccuggacacucagacc

SEQ ID NO: 2870389 - RNA, 22 nt, Human
ccuggaauuagcuuggggccag

SEQ ID NO: 2870390 - RNA, 23 nt, Human
ccuggaauuagcuuggggccagg

SEQ ID NO: 2870391 - RNA, 23 nt, Human
ccuggcacuaacguugagccccu

SEQ ID NO: 2870392 - RNA, 14 nt, Human
ccuggcagcccaga

SEQ ID NO: 2870393 - RNA, 13 nt, Human
ccuggcagcccag

SEQ ID NO: 2870394 - RNA, 11 nt, Human
ccuggcagccc

SEQ ID NO: 2870395 - RNA, 23 nt, Human
ccuggcacccggccccugcuggu

SEQ ID NO: 2870396 - RNA, 22 nt, Human
ccuggcacgguggcucaggccu

SEQ ID NO: 2870397 - RNA, 18 nt, Human
ccuggcacgguggcucag

SEQ ID NO: 2870398 - RNA, 22 nt, Human
ccuggcacccggccccugcugg

SEQ ID NO: 2870399 - RNA, 14 nt, Human
cccgugggcucccg

SEQ ID NO: 2870400 - RNA, 22 nt, Human
cccgucucugguuccuccccuc

SEQ ID NO: 2870401 - RNA, 11 nt, Human
cccgucugucc

SEQ ID NO: 2870402 - RNA, 17 nt, Human
cccgucuguccaucugc

SEQ ID NO: 2870403 - RNA, 18 nt, Human
cccgucuguccaucugcc

SEQ ID NO: 2870404 - RNA, 19 nt, Human
cccgucuguccaucugccc

SEQ ID NO: 2870405 - RNA, 23 nt, Human
cccgucugugugugaccccuccu

SEQ ID NO: 2870406 - RNA, 20 nt, Human
cccgucgaggggcucucagc

SEQ ID NO: 2870407 - RNA, 12 nt, Human
cccgucucagug

SEQ ID NO: 2870408 - RNA, 13 nt, Human
cccgucucagugu

SEQ ID NO: 2870409 - RNA, 17 nt, Human
cccgggcucucugcugu

SEQ ID NO: 2870410 - RNA, 16 nt, Human
cccgggcucucugcug

SEQ ID NO: 2870411 - RNA, 20 nt, Human
cccggucccaccccucccuc

SEQ ID NO: 2870412 - RNA, 17 nt, Human
cccggucccgaguacag

SEQ ID NO: 2870413 - RNA, 18 nt, Human
cccggugcccaagaauag

SEQ ID NO: 2870414 - RNA, 19 nt, Human
cccgguggcggccccagca

SEQ ID NO: 2870415 - RNA, 18 nt, Human
cccgguggcggccccagc

SEQ ID NO: 2870416 - RNA, 14 nt, Human
cccguaaugcuuag

SEQ ID NO: 2870417 - RNA, 13 nt, Human
cccggggcccagg

SEQ ID NO: 2870418 - RNA, 14 nt, Human
cccggggcccaggg

SEQ ID NO: 2870419 - RNA, 15 nt, Human
cccggggcccagggg

SEQ ID NO: 2870420 - RNA, 16 nt, Human
cccuaauucagccaug

SEQ ID NO: 2870421 - RNA, 21 nt, Human
cccuaauucagccauguacag

SEQ ID NO: 2870422 - RNA, 22 nt, Human
cccuaauucagccauguacaga

SEQ ID NO: 2870423 - RNA, 23 nt, Human
cccuaaugcgcaggcuggcccug

SEQ ID NO: 2870424 - RNA, 17 nt, Human
cccuacacccagacccc

SEQ ID NO: 2870425 - RNA, 18 nt, Human
cccuacacccagacccca

SEQ ID NO: 2870426 - RNA, 13 nt, Human
cccuacagagcug

SEQ ID NO: 2870427 - RNA, 13 nt, Human
cccuacagcauug

SEQ ID NO: 2870428 - RNA, 16 nt, Human
cccguuacagcucccc

SEQ ID NO: 2870429 - RNA, 12 nt, Human
cccguggucucu

SEQ ID NO: 2870430 - RNA, 17 nt, Human
cccuaaugcgcaggcug

SEQ ID NO: 2870431 - RNA, 22 nt, Human
cccuaaugcgcaggcuggcccu

SEQ ID NO: 2870432 - RNA, 21 nt, Human
cccuaaugcgcaggcuggccc

SEQ ID NO: 2870433 - RNA, 23 nt, Human
cccuacuauucaguggcgagaaa

SEQ ID NO: 2870434 - RNA, 22 nt, Human
cccuacucauugggguuccgca

SEQ ID NO: 2870435 - RNA, 13 nt, Human
cccuacggaccag

SEQ ID NO: 2870436 - RNA, 14 nt, Human
cccuacggaccagg

SEQ ID NO: 2870437 - RNA, 14 nt, Human
cccuaccugugccu

SEQ ID NO: 2870438 - RNA, 23 nt, Human
cccuaccugauuggugcaacccu

SEQ ID NO: 2870439 - RNA, 22 nt, Human
cccuaccugauuggugcaaccc

SEQ ID NO: 2870440 - RNA, 16 nt, Human
cccuaccucaggcagg

SEQ ID NO: 2870441 - RNA, 13 nt, Human
cccuaccucaggc

SEQ ID NO: 2870442 - RNA, 21 nt, Human
cccuaccgagucucuucucca

SEQ ID NO: 2870443 - RNA, 14 nt, Human
cccuaccccuggcu

SEQ ID NO: 2870444 - RNA, 16 nt, Human
cccuaccccuggcugu

SEQ ID NO: 2870445 - RNA, 23 nt, Human
cccuaccccuggcuguacugcuc

SEQ ID NO: 2870446 - RNA, 18 nt, Human
cccuaccgagucucuucu

SEQ ID NO: 2870447 - RNA, 18 nt, Human
cccuacucccugcagaug

SEQ ID NO: 2870448 - RNA, 16 nt, Human
cccuacucccugcaga

SEQ ID NO: 2870449 - RNA, 15 nt, Human
cccuacucccugcag

SEQ ID NO: 2870450 - RNA, 21 nt, Human
cccuacucccugcagaugcca

SEQ ID NO: 2870451 - RNA, 19 nt, Human
cccuacucccugcagaugc

SEQ ID NO: 2870452 - RNA, 18 nt, Human
cccuagcccaggagagag

SEQ ID NO: 2870453 - RNA, 20 nt, Human
cccuagcggcagaaaggaaa

SEQ ID NO: 2870454 - RNA, 14 nt, Human
cccuaggagaccaa

SEQ ID NO: 2870455 - RNA, 20 nt, Human
cccuaggaguauauuuccgc

SEQ ID NO: 2870456 - RNA, 21 nt, Human
cccuaggaguauauuuccgca

SEQ ID NO: 2870457 - RNA, 21 nt, Human
cccuagcuuuauauauggaca

SEQ ID NO: 2870458 - RNA, 22 nt, Human
cccuagcuuuauauauggacau

SEQ ID NO: 2870459 - RNA, 23 nt, Human
cccuagcuuuauauauggacaug

SEQ ID NO: 2870460 - RNA, 17 nt, Human
cccuaggaacucagucc

SEQ ID NO: 2870461 - RNA, 21 nt, Human
cccgaguagcugggacuacag

SEQ ID NO: 2870462 - RNA, 18 nt, Human
cccgaguagcugggacua

SEQ ID NO: 2870463 - RNA, 17 nt, Human
cccgaguagcugggacu

SEQ ID NO: 2870464 - RNA, 16 nt, Human
cccgaguagcugggac

SEQ ID NO: 2870465 - RNA, 15 nt, Human
cccgaguagcuggga

SEQ ID NO: 2870466 - RNA, 14 nt, Human
cccgaguagcuggg

SEQ ID NO: 2870467 - RNA, 13 nt, Human
cccgaguagcugg

SEQ ID NO: 2870468 - RNA, 23 nt, Human
cccagagggcccaggcaggccac

SEQ ID NO: 2870469 - RNA, 22 nt, Human
cccagagggcccaggcaggcca

SEQ ID NO: 2870470 - RNA, 21 nt, Human
cccgaggccuucucugaagga

SEQ ID NO: 2870471 - RNA, 18 nt, Human
cccagagggcccaggcag

SEQ ID NO: 2870472 - RNA, 16 nt, Human
cccagagggcccaggc

SEQ ID NO: 2870473 - RNA, 15 nt, Human
cccagagggcccagg

SEQ ID NO: 2870474 - RNA, 14 nt, Human
cccagagggcccag

SEQ ID NO: 2870475 - RNA, 17 nt, Human
cccagaaaggagacuag

SEQ ID NO: 2870476 - RNA, 15 nt, Human
cccagaaaggagacu

SEQ ID NO: 2870477 - RNA, 14 nt, Human
cccagaaaggagac

SEQ ID NO: 2870478 - RNA, 13 nt, Human
cccagagggccca

SEQ ID NO: 2870479 - RNA, 16 nt, Human
cccagaggcuggguga

SEQ ID NO: 2870480 - RNA, 15 nt, Human
cccagaacuucccug

SEQ ID NO: 2870481 - RNA, 16 nt, Human
cccagaacuucccuga

SEQ ID NO: 2870482 - RNA, 19 nt, Human
cccagaacuucccugauug

SEQ ID NO: 2870483 - RNA, 16 nt, Human
cccagaagaaaauucu

SEQ ID NO: 2870484 - RNA, 16 nt, Human
cccgcugcugcugcug

SEQ ID NO: 2870485 - RNA, 13 nt, Human
cccgccugcccac

SEQ ID NO: 2870486 - RNA, 15 nt, Human
cccgccugcccaccu

SEQ ID NO: 2870487 - RNA, 16 nt, Human
cccgccugcccaccug

SEQ ID NO: 2870488 - RNA, 17 nt, Human
cccgccugcccaccugc

SEQ ID NO: 2870489 - RNA, 18 nt, Human
cccgccugcccaccugcc

SEQ ID NO: 2870490 - RNA, 20 nt, Human
cccgccugcccaccugccug

SEQ ID NO: 2870491 - RNA, 22 nt, Human
cccgaguagcugggacuacagg

SEQ ID NO: 2870492 - RNA, 15 nt, Human
cccgaguacagucug

SEQ ID NO: 2870493 - RNA, 17 nt, Human
cccgaggguugauuaag

SEQ ID NO: 2870494 - RNA, 19 nt, Human
cccgaggguugauuaaggc

SEQ ID NO: 2870495 - RNA, 18 nt, Human
cccgccgccugguacuca

SEQ ID NO: 2870496 - RNA, 14 nt, Human
cccgcccucuuccu

SEQ ID NO: 2870497 - RNA, 15 nt, Human
cccgcccucuuccug

SEQ ID NO: 2870498 - RNA, 17 nt, Human
cccgcccccugcccucc

SEQ ID NO: 2870499 - RNA, 14 nt, Human
cccgccccugcagc

SEQ ID NO: 2870500 - RNA, 15 nt, Human
cccgccccugcagca

SEQ ID NO: 2870501 - RNA, 17 nt, Human
cccgccccugcagcacg

SEQ ID NO: 2870502 - RNA, 16 nt, Human
cccgcccccugcccuc

SEQ ID NO: 2870503 - RNA, 19 nt, Human
cccgggcgcggccagcccc

SEQ ID NO: 2870504 - RNA, 21 nt, Human
cccgggcgcggccagccccgg

SEQ ID NO: 2870505 - RNA, 21 nt, Human
cccucccccgccacuccugaa

SEQ ID NO: 2870506 - RNA, 14 nt, Human
cccucuccuuccuu

SEQ ID NO: 2870507 - RNA, 15 nt, Human
cccucuccuuccuua

SEQ ID NO: 2870508 - RNA, 17 nt, Human
cccucucucuucugcuc

SEQ ID NO: 2870509 - RNA, 15 nt, Human
cccucucucuucugc

SEQ ID NO: 2870510 - RNA, 14 nt, Human
cccucucucuucug

SEQ ID NO: 2870511 - RNA, 13 nt, Human
cccucucucuucu

SEQ ID NO: 2870512 - RNA, 23 nt, Human
cccucucucuucugcuccacccu

SEQ ID NO: 2870513 - RNA, 22 nt, Human
cccucucucuucugcuccaccc

SEQ ID NO: 2870514 - RNA, 19 nt, Human
cccucucucuucugcucca

SEQ ID NO: 2870515 - RNA, 18 nt, Human
cccucucucuucugcucc

SEQ ID NO: 2870516 - RNA, 13 nt, Human
cccucugcucagc

SEQ ID NO: 2870517 - RNA, 14 nt, Human
cccucugcucagcc

SEQ ID NO: 2870518 - RNA, 15 nt, Human
cccucugcucagcca

SEQ ID NO: 2870519 - RNA, 15 nt, Human
cccucugcugaagac

SEQ ID NO: 2870520 - RNA, 19 nt, Human
cccucugcugaagacuugc

SEQ ID NO: 2870521 - RNA, 21 nt, Human
cccucugcugaagacuugccc

SEQ ID NO: 2870522 - RNA, 14 nt, Human
cccucugcugcugu

SEQ ID NO: 2870523 - RNA, 15 nt, Human
cccucugcugcuguc

SEQ ID NO: 2870524 - RNA, 12 nt, Human
cccucuggaggg

SEQ ID NO: 2870525 - RNA, 21 nt, Human
cccucuggagggguguggcuc

SEQ ID NO: 2870526 - RNA, 22 nt, Human
cccucuggagggguguggcucc

SEQ ID NO: 2870527 - RNA, 14 nt, Human
cccucugaccugca

SEQ ID NO: 2870528 - RNA, 19 nt, Human
cccucugaaaguuguacau

SEQ ID NO: 2870529 - RNA, 20 nt, Human
cccucugaaaguuguacaug

SEQ ID NO: 2870530 - RNA, 11 nt, Human
cccucucugga

SEQ ID NO: 2870531 - RNA, 13 nt, Human
cccucucugggcc

SEQ ID NO: 2870532 - RNA, 14 nt, Human
cccucucugggccu

SEQ ID NO: 2870533 - RNA, 19 nt, Human
cccucucugggccucagag

SEQ ID NO: 2870534 - RNA, 9 nt, Human
cccucugcc

SEQ ID NO: 2870535 - RNA, 12 nt, Human
cccucugccacc

SEQ ID NO: 2870536 - RNA, 13 nt, Human
cccucugccacca

SEQ ID NO: 2870537 - RNA, 15 nt, Human
cccucugaccugcac

SEQ ID NO: 2870538 - RNA, 16 nt, Human
cccucugaccugcacu

SEQ ID NO: 2870539 - RNA, 17 nt, Human
cccucugaccugcacug

SEQ ID NO: 2870540 - RNA, 19 nt, Human
cccucugaccugcacuggg

SEQ ID NO: 2870541 - RNA, 18 nt, Human
cccuccagaaccaccccg

SEQ ID NO: 2870542 - RNA, 12 nt, Human
cccuccacucuc

SEQ ID NO: 2870543 - RNA, 12 nt, Human
cccuccacuguc

SEQ ID NO: 2870544 - RNA, 19 nt, Human
cccuccagaacacggcuca

SEQ ID NO: 2870545 - RNA, 14 nt, Human
cccucccaggacuc

SEQ ID NO: 2870546 - RNA, 14 nt, Human
cccuccccauggag

SEQ ID NO: 2870547 - RNA, 16 nt, Human
cccucccccaaccccc

SEQ ID NO: 2870548 - RNA, 16 nt, Human
cccuccccaucccaug

SEQ ID NO: 2870549 - RNA, 22 nt, Human
cccucccagggccagggcccug

SEQ ID NO: 2870550 - RNA, 20 nt, Human
cccucccaggacucugaccc

SEQ ID NO: 2870551 - RNA, 16 nt, Human
cccuccccaaaguccc

SEQ ID NO: 2870552 - RNA, 13 nt, Human
cccuccccaggaa

SEQ ID NO: 2870553 - RNA, 15 nt, Human
cccuaguaaaaauac

SEQ ID NO: 2870554 - RNA, 16 nt, Human
cccuagucccuucccc

SEQ ID NO: 2870555 - RNA, 12 nt, Human
cccuagguuccc

SEQ ID NO: 2870556 - RNA, 17 nt, Human
cccuagguucccggucc

SEQ ID NO: 2870557 - RNA, 15 nt, Human
cccuagguucccugu

SEQ ID NO: 2870558 - RNA, 18 nt, Human
cccuagguucccuguucu

SEQ ID NO: 2870559 - RNA, 19 nt, Human
cccuagguucccuguucuu

SEQ ID NO: 2870560 - RNA, 23 nt, Human
cccuagguucccuguucuuccuc

SEQ ID NO: 2870561 - RNA, 22 nt, Human
cccuagucccuuccccucccug

SEQ ID NO: 2870562 - RNA, 17 nt, Human
cccuagucccuuccccu

SEQ ID NO: 2870563 - RNA, 19 nt, Human
cccuaguucuaccucaggc

SEQ ID NO: 2870564 - RNA, 16 nt, Human
cccuaguucccucugc

SEQ ID NO: 2870565 - RNA, 18 nt, Human
cccuaguucccucugcuc

SEQ ID NO: 2870566 - RNA, 21 nt, Human
cccuaguucccucugcucagc

SEQ ID NO: 2870567 - RNA, 23 nt, Human
cccuaguucccucugcucagcca

SEQ ID NO: 2870568 - RNA, 23 nt, Human
cccuauauguaguauaaagaaaa

SEQ ID NO: 2870569 - RNA, 19 nt, Human
cccuauacuguaguauucu

SEQ ID NO: 2870570 - RNA, 13 nt, Human
cccucuguccacc

SEQ ID NO: 2870571 - RNA, 17 nt, Human
cccucuguccaccagcc

SEQ ID NO: 2870572 - RNA, 21 nt, Human
cccugaaaccuaguacugccc

SEQ ID NO: 2870573 - RNA, 24 nt, Human
cccugaaaauguuuuucugccagg

SEQ ID NO: 2870574 - RNA, 12 nt, Human
cccugaaacacg

SEQ ID NO: 2870575 - RNA, 13 nt, Human
cccugaaacacga

SEQ ID NO: 2870576 - RNA, 19 nt, Human
cccugaaacacgaaacuug

SEQ ID NO: 2870577 - RNA, 21 nt, Human
cccugaaacacgaaacuuguu

SEQ ID NO: 2870578 - RNA, 23 nt, Human
cccugaaaauguuuuucugccag

SEQ ID NO: 2870579 - RNA, 22 nt, Human
cccugaaaauguuuuucugcca

SEQ ID NO: 2870580 - RNA, 19 nt, Human
cccugcacuugcagacucu

SEQ ID NO: 2870581 - RNA, 12 nt, Human
cccugcacuugc

SEQ ID NO: 2870582 - RNA, 19 nt, Human
cccugcacuaaagccagcc

SEQ ID NO: 2870583 - RNA, 20 nt, Human
cccugcacuaaagccagccu

SEQ ID NO: 2870584 - RNA, 21 nt, Human
cccugcacuaaagccagccug

SEQ ID NO: 2870585 - RNA, 22 nt, Human
cccugcacuaaagccagccuga

SEQ ID NO: 2870586 - RNA, 15 nt, Human
cccugcaaagcccag

SEQ ID NO: 2870587 - RNA, 23 nt, Human
cccugcaaaauuugaugccagga

SEQ ID NO: 2870588 - RNA, 13 nt, Human
cccugcaaacaga

SEQ ID NO: 2870589 - RNA, 18 nt, Human
cccugcaaacagaacagg

SEQ ID NO: 2870590 - RNA, 22 nt, Human
cccugcaaacagaacaggguca

SEQ ID NO: 2870591 - RNA, 24 nt, Human
cccugcaaacagaacagggucaug

SEQ ID NO: 2870592 - RNA, 20 nt, Human
cccugaggugaaagggagcu

SEQ ID NO: 2870593 - RNA, 18 nt, Human
cccugaggugaaagggag

SEQ ID NO: 2870594 - RNA, 18 nt, Human
cccugaggucagggagug

SEQ ID NO: 2870595 - RNA, 21 nt, Human
cccugaggucagggagugcug

SEQ ID NO: 2870596 - RNA, 23 nt, Human
cccugcacaaagcccuuccaugu

SEQ ID NO: 2870597 - RNA, 20 nt, Human
cccugcaaagcccagcuuga

SEQ ID NO: 2870598 - RNA, 19 nt, Human
cccugcaaagcccagcuug

SEQ ID NO: 2870599 - RNA, 17 nt, Human
cccugcaaagcccagcu

SEQ ID NO: 2870600 - RNA, 16 nt, Human
cccugcaaagcccagc

SEQ ID NO: 2870601 - RNA, 13 nt, Human
cccugcuggcucu

SEQ ID NO: 2870602 - RNA, 14 nt, Human
cccugcuggcucuu

SEQ ID NO: 2870603 - RNA, 15 nt, Human
cccugcuggcucuuc

SEQ ID NO: 2870604 - RNA, 17 nt, Human
cccugcuuugggcugcc

SEQ ID NO: 2870605 - RNA, 18 nt, Human
cccugcuuugggcugccc

SEQ ID NO: 2870606 - RNA, 19 nt, Human
cccugcuuugggcugcccu

SEQ ID NO: 2870607 - RNA, 17 nt, Human
cccuggacaagcagagg

SEQ ID NO: 2870608 - RNA, 20 nt, Human
cccugcuggcucuucugccc

SEQ ID NO: 2870609 - RNA, 21 nt, Human
cccugcuggcucuucugccca

SEQ ID NO: 2870610 - RNA, 20 nt, Human
cccugcuuugggcugcccug

SEQ ID NO: 2870611 - RNA, 23 nt, Human
cccuggaccaguggucucacaug

SEQ ID NO: 2870612 - RNA, 21 nt, Human
cccuggaccaguggucucaca

SEQ ID NO: 2870613 - RNA, 17 nt, Human
cccuggaccaguggucu

SEQ ID NO: 2870614 - RNA, 16 nt, Human
cccuggaccagugguc

SEQ ID NO: 2870615 - RNA, 16 nt, Human
cccugccagaggggaa

SEQ ID NO: 2870616 - RNA, 15 nt, Human
cccugggcucugccc

SEQ ID NO: 2870617 - RNA, 13 nt, Human
cccugggcucugc

SEQ ID NO: 2870618 - RNA, 16 nt, Human
cccugggcucugcccc

SEQ ID NO: 2870619 - RNA, 13 nt, Human
cccugguccuucc

SEQ ID NO: 2870620 - RNA, 15 nt, Human
cccugguccugaggg

SEQ ID NO: 2870621 - RNA, 18 nt, Human
cccugguccagggaagcu

SEQ ID NO: 2870622 - RNA, 16 nt, Human
cccugguccagggaag

SEQ ID NO: 2870623 - RNA, 17 nt, Human
cccugguccuuccaggc

SEQ ID NO: 2870624 - RNA, 16 nt, Human
cccugguccuuccagg

SEQ ID NO: 2870625 - RNA, 17 nt, Human
cccugggcucggaggcu

SEQ ID NO: 2870626 - RNA, 16 nt, Human
cccugggaggccccuu

SEQ ID NO: 2870627 - RNA, 14 nt, Human
cccugggagacaga

SEQ ID NO: 2870628 - RNA, 18 nt, Human
cccuggcuuuucacugcu

SEQ ID NO: 2870629 - RNA, 17 nt, Human
cccuggcuuuucacugc

SEQ ID NO: 2870630 - RNA, 19 nt, Human
cccuggcuuuucacugcug

SEQ ID NO: 2870631 - RNA, 22 nt, Human
cccuggcuuuucacugcuggcu

SEQ ID NO: 2870632 - RNA, 13 nt, Human
cccuggacuggga

SEQ ID NO: 2870633 - RNA, 14 nt, Human
cccuggacugggag

SEQ ID NO: 2870634 - RNA, 15 nt, Human
cccugggaaggccuc

SEQ ID NO: 2870635 - RNA, 18 nt, Human
cccugggaaggccucuug

SEQ ID NO: 2870636 - RNA, 21 nt, Human
cccugggaaggccucuuggag

SEQ ID NO: 2870637 - RNA, 18 nt, Human
cccugggaggcagugaug

SEQ ID NO: 2870638 - RNA, 20 nt, Human
cccacaggaagccugcaguc

SEQ ID NO: 2870639 - RNA, 22 nt, Human
cccacaggaagccugcaguccu

SEQ ID NO: 2870640 - RNA, 23 nt, Human
cccacaggaagccugcaguccug

SEQ ID NO: 2870641 - RNA, 13 nt, Human
cccacacacagau

SEQ ID NO: 2870642 - RNA, 12 nt, Human
cccacacacagg

SEQ ID NO: 2870643 - RNA, 13 nt, Human
cccacacacaggu

SEQ ID NO: 2870644 - RNA, 14 nt, Human
cccacacacaggug

SEQ ID NO: 2870645 - RNA, 15 nt, Human
cccacacacaggugg

SEQ ID NO: 2870646 - RNA, 14 nt, Human
cccacauuggaccc

SEQ ID NO: 2870647 - RNA, 19 nt, Human
cccacauuuagucucuuua

SEQ ID NO: 2870648 - RNA, 21 nt, Human
cccacauuuagucucuuuauu

SEQ ID NO: 2870649 - RNA, 21 nt, Human
cccacauuugugccgacacug

SEQ ID NO: 2870650 - RNA, 22 nt, Human
cccacauuugugccgacacugu

SEQ ID NO: 2870651 - RNA, 23 nt, Human
cccacauuugugccgacacuguu

SEQ ID NO: 2870652 - RNA, 18 nt, Human
cccacauucugaugagca

SEQ ID NO: 2870653 - RNA, 11 nt, Human
cccacacacag

SEQ ID NO: 2870654 - RNA, 11 nt, Human
cccaccacaca

SEQ ID NO: 2870655 - RNA, 19 nt, Human
cccacaugugacacauaug

SEQ ID NO: 2870656 - RNA, 16 nt, Human
cccacaugugacacau

SEQ ID NO: 2870657 - RNA, 16 nt, Human
cccacaggaggcaagc

SEQ ID NO: 2870658 - RNA, 22 nt, Human
cccacaggaggcaagcaagcuc

SEQ ID NO: 2870659 - RNA, 20 nt, Human
cccaccucugugaccucagg

SEQ ID NO: 2870660 - RNA, 21 nt, Human
cccaccucugugaccucaggc

SEQ ID NO: 2870661 - RNA, 15 nt, Human
cccaccucugugacc

SEQ ID NO: 2870662 - RNA, 17 nt, Human
cccaccucugugaccuc

SEQ ID NO: 2870663 - RNA, 18 nt, Human
cccaccucugugaccuca

SEQ ID NO: 2870664 - RNA, 14 nt, Human
cccaccucccugcc

SEQ ID NO: 2870665 - RNA, 15 nt, Human
cccaccucccugccc

SEQ ID NO: 2870666 - RNA, 16 nt, Human
cccaccucccugccca

SEQ ID NO: 2870667 - RNA, 17 nt, Human
cccaccucccugcccag

SEQ ID NO: 2870668 - RNA, 18 nt, Human
cccaccucccugcccagg

SEQ ID NO: 2870669 - RNA, 19 nt, Human
cccaccucccugcccaggc

SEQ ID NO: 2870670 - RNA, 17 nt, Human
cccaccucagccucccg

SEQ ID NO: 2870671 - RNA, 23 nt, Human
cccaccgggcugggagcucugca

SEQ ID NO: 2870672 - RNA, 17 nt, Human
cccaccgguccagcugg

SEQ ID NO: 2870673 - RNA, 16 nt, Human
cccaccgguccagcug

SEQ ID NO: 2870674 - RNA, 12 nt, Human
cccaccuccagc

SEQ ID NO: 2870675 - RNA, 13 nt, Human
cccaccuccagcc

SEQ ID NO: 2870676 - RNA, 14 nt, Human
cccaccuccagccc

SEQ ID NO: 2870677 - RNA, 18 nt, Human
cccaccuccagcccggga

SEQ ID NO: 2870678 - RNA, 10 nt, Human
cccaccuccc

SEQ ID NO: 2870679 - RNA, 13 nt, Human
cccaccuccccac

SEQ ID NO: 2870680 - RNA, 13 nt, Human
cccaccucccugc

SEQ ID NO: 2870681 - RNA, 14 nt, Human
cccaccuccccacg

SEQ ID NO: 2870682 - RNA, 15 nt, Human
cccaccuccccacgc

SEQ ID NO: 2870683 - RNA, 16 nt, Human
cccaccuccccacgcc

SEQ ID NO: 2870684 - RNA, 17 nt, Human
cccaccuccccacgccc

SEQ ID NO: 2870685 - RNA, 23 nt, Human
cccaccacuaggacucugaggcu

SEQ ID NO: 2870686 - RNA, 13 nt, Human
cccaccacacauc

SEQ ID NO: 2870687 - RNA, 15 nt, Human
cccaccacacauccc

SEQ ID NO: 2870688 - RNA, 16 nt, Human
cccaccacacauccca

SEQ ID NO: 2870689 - RNA, 17 nt, Human
cccaccacacaucccag

SEQ ID NO: 2870690 - RNA, 18 nt, Human
cccaccacacaucccagc

SEQ ID NO: 2870691 - RNA, 22 nt, Human
cccaccacacaucccagcccaa

SEQ ID NO: 2870692 - RNA, 21 nt, Human
cccacgcuggagugcagugag

SEQ ID NO: 2870693 - RNA, 20 nt, Human
cccacgcuggagugcaguga

SEQ ID NO: 2870694 - RNA, 19 nt, Human
cccacgcuggagugcagug

SEQ ID NO: 2870695 - RNA, 14 nt, Human
cccacgcuggagug

SEQ ID NO: 2870696 - RNA, 17 nt, Human
cccacgagaccccggcu

SEQ ID NO: 2870697 - RNA, 12 nt, Human
cccacuucugcc

SEQ ID NO: 2870698 - RNA, 22 nt, Human
cccacuugucacugacacaaag

SEQ ID NO: 2870699 - RNA, 23 nt, Human
cccacuugucacugacacaaagg

SEQ ID NO: 2870700 - RNA, 20 nt, Human
cccagaaaaaaaaaaacuua

SEQ ID NO: 2870701 - RNA, 12 nt, Human
cccaccugcagg

SEQ ID NO: 2870702 - RNA, 14 nt, Human
cccaccugcagggc

SEQ ID NO: 2870703 - RNA, 20 nt, Human
cccaccugcagggcugcccu

SEQ ID NO: 2870704 - RNA, 12 nt, Human
cccaccugccug

SEQ ID NO: 2870705 - RNA, 13 nt, Human
cccaccugccugg

SEQ ID NO: 2870706 - RNA, 14 nt, Human
cccaccugccuggc

SEQ ID NO: 2870707 - RNA, 23 nt, Human
cccaccugcccaucacaggguug

SEQ ID NO: 2870708 - RNA, 20 nt, Human
cccaccugcccaucacaggg

SEQ ID NO: 2870709 - RNA, 13 nt, Human
cccaccugcccau

SEQ ID NO: 2870710 - RNA, 13 nt, Human
ccgggcucucugc

SEQ ID NO: 2870711 - RNA, 16 nt, Human
ccgggcucucugcugu

SEQ ID NO: 2870712 - RNA, 14 nt, Human
ccgggcucucugcu

SEQ ID NO: 2870713 - RNA, 13 nt, Human
ccgggcugggagc

SEQ ID NO: 2870714 - RNA, 18 nt, Human
ccgggcugggagcucugc

SEQ ID NO: 2870715 - RNA, 19 nt, Human
ccgggcugggagcucugca

SEQ ID NO: 2870716 - RNA, 16 nt, Human
ccgguagggaggcagc

SEQ ID NO: 2870717 - RNA, 17 nt, Human
ccgguagggaggcagcc

SEQ ID NO: 2870718 - RNA, 18 nt, Human
ccgguagggaggcagccu

SEQ ID NO: 2870719 - RNA, 19 nt, Human
ccggucaccuagcaagcug

SEQ ID NO: 2870720 - RNA, 14 nt, Human
ccgguccagcuggc

SEQ ID NO: 2870721 - RNA, 22 nt, Human
ccgguaaacacgccugcaaacg

SEQ ID NO: 2870722 - RNA, 13 nt, Human
ccgcuaaggaaga

SEQ ID NO: 2870723 - RNA, 19 nt, Human
ccgcuuucuacccagcgag

SEQ ID NO: 2870724 - RNA, 15 nt, Human
ccggcuuccuuuccc

SEQ ID NO: 2870725 - RNA, 17 nt, Human
ccggcugugcucagaga

SEQ ID NO: 2870726 - RNA, 16 nt, Human
ccgcuuguggggaccc

SEQ ID NO: 2870727 - RNA, 17 nt, Human
ccgcuuguggggaccca

SEQ ID NO: 2870728 - RNA, 19 nt, Human
ccgcuuguggggacccagg

SEQ ID NO: 2870729 - RNA, 20 nt, Human
ccgcuuguggggacccaggc

SEQ ID NO: 2870730 - RNA, 21 nt, Human
ccgcuuguggggacccaggcu

SEQ ID NO: 2870731 - RNA, 23 nt, Human
ccgcuuguggggacccaggcucc

SEQ ID NO: 2870732 - RNA, 23 nt, Human
ccggcuuccuuucccaagccuuc

SEQ ID NO: 2870733 - RNA, 19 nt, Human
ccggcuuccuuucccaagc

SEQ ID NO: 2870734 - RNA, 12 nt, Human
ccgcuuucuacc

SEQ ID NO: 2870735 - RNA, 22 nt, Human
ccgcugauucucagggucucug

SEQ ID NO: 2870736 - RNA, 13 nt, Human
ccgcugauucuca

SEQ ID NO: 2870737 - RNA, 15 nt, Human
ccgcugauucucagg

SEQ ID NO: 2870738 - RNA, 15 nt, Human
ccgcucagcccuccc

SEQ ID NO: 2870739 - RNA, 19 nt, Human
ccgcucagcccucccugcc

SEQ ID NO: 2870740 - RNA, 21 nt, Human
ccgcucagcccucccugcccc

SEQ ID NO: 2870741 - RNA, 22 nt, Human
ccgcucagcccucccugccccu

SEQ ID NO: 2870742 - RNA, 19 nt, Human
ccgcucucuuccugccccu

SEQ ID NO: 2870743 - RNA, 22 nt, Human
ccgcucucuuccugccccucuu

SEQ ID NO: 2870744 - RNA, 21 nt, Human
ccgcucucuuuucuguacuuc

SEQ ID NO: 2870745 - RNA, 15 nt, Human
ccgcucaccuagagc

SEQ ID NO: 2870746 - RNA, 16 nt, Human
ccgcucaccuagagcc

SEQ ID NO: 2870747 - RNA, 17 nt, Human
ccgcucaccuagagcca

SEQ ID NO: 2870748 - RNA, 18 nt, Human
ccgcucaccuagagccag

SEQ ID NO: 2870749 - RNA, 19 nt, Human
ccgcucaccuagagccaga

SEQ ID NO: 2870750 - RNA, 20 nt, Human
ccgcucaccuagagccagac

SEQ ID NO: 2870751 - RNA, 20 nt, Human
ccgcuccagguaccuugacc

SEQ ID NO: 2870752 - RNA, 23 nt, Human
ccgcuccagguaccuugaccuuu

SEQ ID NO: 2870753 - RNA, 14 nt, Human
ccgaggcaggcaga

SEQ ID NO: 2870754 - RNA, 15 nt, Human
ccgaggcaggcagau

SEQ ID NO: 2870755 - RNA, 11 nt, Human
ccgaggcccug

SEQ ID NO: 2870756 - RNA, 12 nt, Human
ccgaggcccugc

SEQ ID NO: 2870757 - RNA, 13 nt, Human
ccgaggcccugca

SEQ ID NO: 2870758 - RNA, 14 nt, Human
ccgaggcccugcau

SEQ ID NO: 2870759 - RNA, 16 nt, Human
ccgaggcccugcaugg

SEQ ID NO: 2870760 - RNA, 14 nt, Human
ccgaggccuucucu

SEQ ID NO: 2870761 - RNA, 19 nt, Human
cccugguuuccugcccugg

SEQ ID NO: 2870762 - RNA, 18 nt, Human
cccugguuuccugcccug

SEQ ID NO: 2870763 - RNA, 22 nt, Human
cccugguucugaugaugugccu

SEQ ID NO: 2870764 - RNA, 15 nt, Human
cccuggucucugguc

SEQ ID NO: 2870765 - RNA, 13 nt, Human
cccuggucucugg

SEQ ID NO: 2870766 - RNA, 14 nt, Human
cccuggucucuggu

SEQ ID NO: 2870767 - RNA, 20 nt, Human
cccugguuucacuggcccaa

SEQ ID NO: 2870768 - RNA, 15 nt, Human
cccugguuucacugg

SEQ ID NO: 2870769 - RNA, 23 nt, Human
cccugguucugaugaugugccug

SEQ ID NO: 2870770 - RNA, 20 nt, Human
cccugguuggguggcaauuc

SEQ ID NO: 2870771 - RNA, 17 nt, Human
cccugguuuccugcccu

SEQ ID NO: 2870772 - RNA, 16 nt, Human
cccugguuuccugccc

SEQ ID NO: 2870773 - RNA, 17 nt, Human
ccgaguagcugggacua

SEQ ID NO: 2870774 - RNA, 20 nt, Human
ccgaguagcugggacuacag

SEQ ID NO: 2870775 - RNA, 15 nt, Human
ccgaggaggugccug

SEQ ID NO: 2870776 - RNA, 16 nt, Human
ccgauucaccugagca

SEQ ID NO: 2870777 - RNA, 19 nt, Human
ccgaguagcugggauuaca

SEQ ID NO: 2870778 - RNA, 20 nt, Human
ccgaguagcugggauuacag

SEQ ID NO: 2870779 - RNA, 22 nt, Human
ccgaugcuuuaccaaacagcaa

SEQ ID NO: 2870780 - RNA, 20 nt, Human
ccgaugguggguggggcugc

SEQ ID NO: 2870781 - RNA, 21 nt, Human
ccgaugguggguggggcugca

SEQ ID NO: 2870782 - RNA, 21 nt, Human
ccgcaaaccacacuggacucc

SEQ ID NO: 2870783 - RNA, 13 nt, Human
ccgcacacccuca

SEQ ID NO: 2870784 - RNA, 14 nt, Human
ccgcacacccucac

SEQ ID NO: 2870785 - RNA, 19 nt, Human
ccgcacacccucacucugc

SEQ ID NO: 2870786 - RNA, 20 nt, Human
ccgcacacccucacucugcc

SEQ ID NO: 2870787 - RNA, 21 nt, Human
ccgcacacccucacucugcca

SEQ ID NO: 2870788 - RNA, 22 nt, Human
ccgcacacccucacucugccag

SEQ ID NO: 2870789 - RNA, 23 nt, Human
ccgcacacccucacucugccagg

SEQ ID NO: 2870790 - RNA, 12 nt, Human
ccgcacagcagc

SEQ ID NO: 2870791 - RNA, 13 nt, Human
ccgcacagcagcc

SEQ ID NO: 2870792 - RNA, 14 nt, Human
ccgcacagcagccu

SEQ ID NO: 2870793 - RNA, 15 nt, Human
ccgcacagcagccug

SEQ ID NO: 2870794 - RNA, 16 nt, Human
ccgcacagcagccugc

SEQ ID NO: 2870795 - RNA, 21 nt, Human
ccgcacagcagccugcuuccc

SEQ ID NO: 2870796 - RNA, 22 nt, Human
ccgcacagcagccugcuuccca

SEQ ID NO: 2870797 - RNA, 15 nt, Human
ccgcaaaccacacug

SEQ ID NO: 2870798 - RNA, 16 nt, Human
ccgcaaaccacacugg

SEQ ID NO: 2870799 - RNA, 16 nt, Human
ccgcuaccucccuccc

SEQ ID NO: 2870800 - RNA, 20 nt, Human
ccgcuagagcagcccaaauu

SEQ ID NO: 2870801 - RNA, 11 nt, Human
ccgcucagccc

SEQ ID NO: 2870802 - RNA, 12 nt, Human
ccgcucagcccu

SEQ ID NO: 2870803 - RNA, 13 nt, Human
ccgcucagcccuc

SEQ ID NO: 2870804 - RNA, 22 nt, Human
ccgcguguccccggggcccagg

SEQ ID NO: 2870805 - RNA, 16 nt, Human
ccgcguuuagaccaag

SEQ ID NO: 2870806 - RNA, 19 nt, Human
ccgcguuuagaccaaggaa

SEQ ID NO: 2870807 - RNA, 17 nt, Human
ccgcggguuccgcaggc

SEQ ID NO: 2870808 - RNA, 19 nt, Human
ccgcggguuccgcaggcag

SEQ ID NO: 2870809 - RNA, 17 nt, Human
ccgcgucgcccucccag

SEQ ID NO: 2870810 - RNA, 20 nt, Human
ccgcggggacauugggaagg

SEQ ID NO: 2870811 - RNA, 19 nt, Human
ccgcgucgcccucccaggc

SEQ ID NO: 2870812 - RNA, 22 nt, Human
ccgcgugaucaaagccacacuc

SEQ ID NO: 2870813 - RNA, 17 nt, Human
ccgcgucuggugacaac

SEQ ID NO: 2870814 - RNA, 14 nt, Human
ccgcaccuguacag

SEQ ID NO: 2870815 - RNA, 22 nt, Human
ccgcaccuguacaguggaaccg

SEQ ID NO: 2870816 - RNA, 18 nt, Human
ccgcacagcucaggaggc

SEQ ID NO: 2870817 - RNA, 16 nt, Human
ccgcacagcucaggag

SEQ ID NO: 2870818 - RNA, 14 nt, Human
ccgcacagcucagg

SEQ ID NO: 2870819 - RNA, 13 nt, Human
ccgcacagcucag

SEQ ID NO: 2870820 - RNA, 12 nt, Human
ccgcacagcuca

SEQ ID NO: 2870821 - RNA, 13 nt, Human
ccgcaccccccaa

SEQ ID NO: 2870822 - RNA, 20 nt, Human
ccgcaccccgauguggaccu

SEQ ID NO: 2870823 - RNA, 20 nt, Human
ccgcgcucgccccaccggcg

SEQ ID NO: 2870824 - RNA, 16 nt, Human
ccgcgccuccuuccuu

SEQ ID NO: 2870825 - RNA, 12 nt, Human
ccgccuuuugua

SEQ ID NO: 2870826 - RNA, 22 nt, Human
ccgccugguacucaagcccgcg

SEQ ID NO: 2870827 - RNA, 23 nt, Human
ccgccugucucuuuaagggcaug

SEQ ID NO: 2870828 - RNA, 14 nt, Human
ccgccugguacuca

SEQ ID NO: 2870829 - RNA, 16 nt, Human
ccgccuuaagcugauc

SEQ ID NO: 2870830 - RNA, 23 nt, Human
ccgccuucacuccggugugccug

SEQ ID NO: 2870831 - RNA, 23 nt, Human
ccgccuuccgccccuucccuucc

SEQ ID NO: 2870832 - RNA, 12 nt, Human
ccgccuuccuug

SEQ ID NO: 2870833 - RNA, 22 nt, Human
ccgccuuccuugaccuuccucu

SEQ ID NO: 2870834 - RNA, 23 nt, Human
ccgccuuccuugaccuuccucug

SEQ ID NO: 2870835 - RNA, 15 nt, Human
ccuaaaauucagugg

SEQ ID NO: 2870836 - RNA, 15 nt, Human
ccuacaagacacagu

SEQ ID NO: 2870837 - RNA, 21 nt, Human
ccuacaagagcagccuguggc

SEQ ID NO: 2870838 - RNA, 18 nt, Human
ccuacaagauuuagaaaa

SEQ ID NO: 2870839 - RNA, 19 nt, Human
ccuacaagauuuagaaaaa

SEQ ID NO: 2870840 - RNA, 20 nt, Human
ccuacaagauuuagaaaaaa

SEQ ID NO: 2870841 - RNA, 22 nt, Human
ccuacaagauuuagaaaaaagu

SEQ ID NO: 2870842 - RNA, 13 nt, Human
ccuacaaggccua

SEQ ID NO: 2870843 - RNA, 14 nt, Human
ccuacaaggccuau

SEQ ID NO: 2870844 - RNA, 16 nt, Human
ccuacaaguuuaagua

SEQ ID NO: 2870845 - RNA, 14 nt, Human
ccuacacacuguca

SEQ ID NO: 2870846 - RNA, 15 nt, Human
ccuacacacugucau

SEQ ID NO: 2870847 - RNA, 22 nt, Human
ccuacacacugucaugcuucau

SEQ ID NO: 2870848 - RNA, 18 nt, Human
ccuacaagagcagccugu

SEQ ID NO: 2870849 - RNA, 17 nt, Human
ccuacaagagcagccug

SEQ ID NO: 2870850 - RNA, 19 nt, Human
ccuacaagagcagccugug

SEQ ID NO: 2870851 - RNA, 18 nt, Human
ccgugugagugugacagg

SEQ ID NO: 2870852 - RNA, 20 nt, Human
ccgugugagugugacagggc

SEQ ID NO: 2870853 - RNA, 21 nt, Human
ccgugugagugugacagggcc

SEQ ID NO: 2870854 - RNA, 22 nt, Human
ccgugugagugugacagggcca

SEQ ID NO: 2870855 - RNA, 14 nt, Human
ccguggguugcuaa

SEQ ID NO: 2870856 - RNA, 15 nt, Human
ccguggguugcuaac

SEQ ID NO: 2870857 - RNA, 17 nt, Human
ccguggguugcuaacug

SEQ ID NO: 2870858 - RNA, 18 nt, Human
ccguggguugcuaacuga

SEQ ID NO: 2870859 - RNA, 20 nt, Human
ccguggguugcuaacugaac

SEQ ID NO: 2870860 - RNA, 23 nt, Human
ccgugguuugaacacgaaagaaa

SEQ ID NO: 2870861 - RNA, 19 nt, Human
ccguguacauagugcauug

SEQ ID NO: 2870862 - RNA, 23 nt, Human
ccuaaaaggaaaucucaccccau

SEQ ID NO: 2870863 - RNA, 22 nt, Human
ccuaaaagugggcuugauucug

SEQ ID NO: 2870864 - RNA, 15 nt, Human
ccuaaaauacauuua

SEQ ID NO: 2870865 - RNA, 12 nt, Human
ccuaaaaucuug

SEQ ID NO: 2870866 - RNA, 17 nt, Human
ccuaaaagcacacucau

SEQ ID NO: 2870867 - RNA, 18 nt, Human
ccuaaaagcacacucauc

SEQ ID NO: 2870868 - RNA, 22 nt, Human
ccuaaaaggaaaucucacccca

SEQ ID NO: 2870869 - RNA, 13 nt, Human
ccuaaaagcaaaa

SEQ ID NO: 2870870 - RNA, 14 nt, Human
ccuaaaagcaaaau

SEQ ID NO: 2870871 - RNA, 22 nt, Human
ccuaaaagcaaaauaaaaacua

SEQ ID NO: 2870872 - RNA, 23 nt, Human
ccuaaaagcaaaauaaaaacuau

SEQ ID NO: 2870873 - RNA, 17 nt, Human
ccuacacccagacccca

SEQ ID NO: 2870874 - RNA, 19 nt, Human
ccuacacccagaccccagg

SEQ ID NO: 2870875 - RNA, 14 nt, Human
ccuaccacaugcca

SEQ ID NO: 2870876 - RNA, 13 nt, Human
ccuacccacaccu

SEQ ID NO: 2870877 - RNA, 21 nt, Human
ccuaccgagucucuucuccac

SEQ ID NO: 2870878 - RNA, 12 nt, Human
ccuaccucagcc

SEQ ID NO: 2870879 - RNA, 13 nt, Human
ccuaccucagccu

SEQ ID NO: 2870880 - RNA, 16 nt, Human
ccuaccucagccuaga

SEQ ID NO: 2870881 - RNA, 14 nt, Human
ccuaccucagccua

SEQ ID NO: 2870882 - RNA, 22 nt, Human
ccuaccgagucucuucuccacu

SEQ ID NO: 2870883 - RNA, 23 nt, Human
ccuaccgagucucuucuccacug

SEQ ID NO: 2870884 - RNA, 16 nt, Human
ccuaccaucagggaca

SEQ ID NO: 2870885 - RNA, 22 nt, Human
ccuaccaucagggacaggauga

SEQ ID NO: 2870886 - RNA, 23 nt, Human
ccuagggaagggugguggagcca

SEQ ID NO: 2870887 - RNA, 22 nt, Human
ccuagggaagggugguggagcc

SEQ ID NO: 2870888 - RNA, 17 nt, Human
ccuagggccacugaaga

SEQ ID NO: 2870889 - RNA, 18 nt, Human
ccuaggcuccaccccauc

SEQ ID NO: 2870890 - RNA, 17 nt, Human
ccuaggcuccaccccau

SEQ ID NO: 2870891 - RNA, 23 nt, Human
ccuacuucuuugcuuugcccagc

SEQ ID NO: 2870892 - RNA, 15 nt, Human
ccuaggcuccacccc

SEQ ID NO: 2870893 - RNA, 13 nt, Human
ccuacuuccugug

SEQ ID NO: 2870894 - RNA, 21 nt, Human
ccuacuuccccuuccuaauuc

SEQ ID NO: 2870895 - RNA, 21 nt, Human
ccuaccucagccuagacccuc

SEQ ID NO: 2870896 - RNA, 18 nt, Human
ccuaccucagccuagacc

SEQ ID NO: 2870897 - RNA, 15 nt, Human
ccuaccucaggcagg

SEQ ID NO: 2870898 - RNA, 15 nt, Human
ccuacuuccugugac

SEQ ID NO: 2870899 - RNA, 22 nt, Human
ccuacuucuuuugcucuuagcu

SEQ ID NO: 2870900 - RNA, 16 nt, Human
ccuacuucuuuugcuc

SEQ ID NO: 2870901 - RNA, 14 nt, Human
ccuauagucccagc

SEQ ID NO: 2870902 - RNA, 12 nt, Human
ccuaugcaauaa

SEQ ID NO: 2870903 - RNA, 14 nt, Human
ccuaugcaauaaaa

SEQ ID NO: 2870904 - RNA, 18 nt, Human
ccuauaugauuuauaguu

SEQ ID NO: 2870905 - RNA, 16 nt, Human
ccuauauaguuuauug

SEQ ID NO: 2870906 - RNA, 16 nt, Human
ccuauauccugugacu

SEQ ID NO: 2870907 - RNA, 15 nt, Human
ccuauaugagaagaa

SEQ ID NO: 2870908 - RNA, 22 nt, Human
ccuauaugagaagaauagccua

SEQ ID NO: 2870909 - RNA, 14 nt, Human
ccuauauguaguau

SEQ ID NO: 2870910 - RNA, 14 nt, Human
ccuauaaucuguca

SEQ ID NO: 2870911 - RNA, 15 nt, Human
ccuauaaucugucaa

SEQ ID NO: 2870912 - RNA, 23 nt, Human
ccuauaaucugucaaaacacugu

SEQ ID NO: 2870913 - RNA, 14 nt, Human
ccuauaacuugaug

SEQ ID NO: 2870914 - RNA, 17 nt, Human
ccuauaacuugaugcau

SEQ ID NO: 2870915 - RNA, 18 nt, Human
ccuauaacuugaugcaug

SEQ ID NO: 2870916 - RNA, 19 nt, Human
ccuauaacuugaugcaugu

SEQ ID NO: 2870917 - RNA, 20 nt, Human
ccuaguuuucuccucccagg

SEQ ID NO: 2870918 - RNA, 14 nt, Human
ccuaggcucaugga

SEQ ID NO: 2870919 - RNA, 18 nt, Human
ccuauagucccagcuacu

SEQ ID NO: 2870920 - RNA, 13 nt, Human
ccuauagucccag

SEQ ID NO: 2870921 - RNA, 19 nt, Human
ccuauacuguaguauucuu

SEQ ID NO: 2870922 - RNA, 14 nt, Human
ccuauaaugugugu

SEQ ID NO: 2870923 - RNA, 15 nt, Human
ccuauaaugugugua

SEQ ID NO: 2870924 - RNA, 16 nt, Human
ccuauaauguguguau

SEQ ID NO: 2870925 - RNA, 17 nt, Human
ccuauaauguguguaug

SEQ ID NO: 2870926 - RNA, 19 nt, Human
ccuauaauguguguaugug

SEQ ID NO: 2870927 - RNA, 21 nt, Human
ccuauaauguguguaugugua

SEQ ID NO: 2870928 - RNA, 20 nt, Human
ccuaguuugggaggagcaga

SEQ ID NO: 2870929 - RNA, 19 nt, Human
ccuaguuuucuccucccag

SEQ ID NO: 2870930 - RNA, 18 nt, Human
ccuaguuuucuccuccca

SEQ ID NO: 2870931 - RNA, 16 nt, Human
ccuaguuuucuccucc

SEQ ID NO: 2870932 - RNA, 15 nt, Human
ccuaguuuucuccuc

SEQ ID NO: 2870933 - RNA, 16 nt, Human
ccuaguuggugagaaa

SEQ ID NO: 2870934 - RNA, 22 nt, Human
ccuaguuggugagaaaccugua

SEQ ID NO: 2870935 - RNA, 23 nt, Human
ccuaguuggugagaaaccuguau

SEQ ID NO: 2870936 - RNA, 14 nt, Human
ccuaguuucccuga

SEQ ID NO: 2870937 - RNA, 13 nt, Human
ccuaguuuccucu

SEQ ID NO: 2870938 - RNA, 14 nt, Human
ccuaguuuccucuc

SEQ ID NO: 2870939 - RNA, 15 nt, Human
ccuaguuuccucucc

SEQ ID NO: 2870940 - RNA, 16 nt, Human
ccuaguuuccucuccu

SEQ ID NO: 2870941 - RNA, 17 nt, Human
ccuaguuuccucuccuu

SEQ ID NO: 2870942 - RNA, 15 nt, Human
ccuaguuugaccuca

SEQ ID NO: 2870943 - RNA, 17 nt, Human
ccuaguuugaccucaca

SEQ ID NO: 2870944 - RNA, 17 nt, Human
ccuaguucccucugcuc

SEQ ID NO: 2870945 - RNA, 18 nt, Human
ccuaguucccucugcuca

SEQ ID NO: 2870946 - RNA, 20 nt, Human
ccuaguucccucugcucagc

SEQ ID NO: 2870947 - RNA, 21 nt, Human
ccuaguucccucugcucagcc

SEQ ID NO: 2870948 - RNA, 22 nt, Human
ccuaguucccucugcucagcca

SEQ ID NO: 2870949 - RNA, 14 nt, Human
ccuccaccucuuca

SEQ ID NO: 2870950 - RNA, 14 nt, Human
ccuccaccaccgcc

SEQ ID NO: 2870951 - RNA, 19 nt, Human
ccuccaccuaccacucaca

SEQ ID NO: 2870952 - RNA, 21 nt, Human
ccuccaggcccgucuguccau

SEQ ID NO: 2870953 - RNA, 12 nt, Human
ccuccagcacaa

SEQ ID NO: 2870954 - RNA, 17 nt, Human
ccuccagcacaaacaca

SEQ ID NO: 2870955 - RNA, 20 nt, Human
ccuccagcacaaacacaagg

SEQ ID NO: 2870956 - RNA, 12 nt, Human
ccuccagcccgg

SEQ ID NO: 2870957 - RNA, 14 nt, Human
ccuccagcccggga

SEQ ID NO: 2870958 - RNA, 15 nt, Human
ccuccagcccgggag

SEQ ID NO: 2870959 - RNA, 16 nt, Human
ccuccagcccgggagc

SEQ ID NO: 2870960 - RNA, 17 nt, Human
ccuccagcccgggagcc

SEQ ID NO: 2870961 - RNA, 18 nt, Human
ccuccagcccgggagccu

SEQ ID NO: 2870962 - RNA, 19 nt, Human
ccuccagcccgggagccua

SEQ ID NO: 2870963 - RNA, 20 nt, Human
ccuccagcccgggagccuag

SEQ ID NO: 2870964 - RNA, 22 nt, Human
ccuccagcccgggagccuagga

SEQ ID NO: 2870965 - RNA, 23 nt, Human
ccuccagcccgggagccuaggac

SEQ ID NO: 2870966 - RNA, 23 nt, Human
ccuccaccucuucaccccccacu

SEQ ID NO: 2870967 - RNA, 18 nt, Human
ccuccagaagccucuggc

SEQ ID NO: 2870968 - RNA, 17 nt, Human
ccuccagaagccucugg

SEQ ID NO: 2870969 - RNA, 22 nt, Human
ccuccagaagccucuggcuaga

SEQ ID NO: 2870970 - RNA, 21 nt, Human
ccuccagaagccucuggcuag

SEQ ID NO: 2870971 - RNA, 20 nt, Human
ccuccagaagccucuggcua

SEQ ID NO: 2870972 - RNA, 19 nt, Human
ccuccagaagccucuggcu

SEQ ID NO: 2870973 - RNA, 18 nt, Human
ccuccaucuaaacugccc

SEQ ID NO: 2870974 - RNA, 24 nt, Human
ccuccaucucauguaucaucugga

SEQ ID NO: 2870975 - RNA, 15 nt, Human
ccucccaaagugcug

SEQ ID NO: 2870976 - RNA, 15 nt, Human
ccuccaugcugccuc

SEQ ID NO: 2870977 - RNA, 21 nt, Human
ccuccauuaaagucugaauca

SEQ ID NO: 2870978 - RNA, 20 nt, Human
ccuccauucuauuuuagaau

SEQ ID NO: 2870979 - RNA, 23 nt, Human
ccuccaugugggcuaguugggcu

SEQ ID NO: 2870980 - RNA, 14 nt, Human
ccuccaugcugccu

SEQ ID NO: 2870981 - RNA, 21 nt, Human
ccuccaucuguacuuggucca

SEQ ID NO: 2870982 - RNA, 16 nt, Human
ccuccaugacagcgcu

SEQ ID NO: 2870983 - RNA, 16 nt, Human
ccucccaaagugcugg

SEQ ID NO: 2870984 - RNA, 16 nt, Human
ccuccccauggagcca

SEQ ID NO: 2870985 - RNA, 20 nt, Human
ccuccccauuagagucagcc

SEQ ID NO: 2870986 - RNA, 18 nt, Human
ccucccaaagugcugaga

SEQ ID NO: 2870987 - RNA, 21 nt, Human
ccuccccauuagagucagccu

SEQ ID NO: 2870988 - RNA, 22 nt, Human
ccucccccaacccccaccccac

SEQ ID NO: 2870989 - RNA, 19 nt, Human
ccucccccaacccccaccc

SEQ ID NO: 2870990 - RNA, 18 nt, Human
ccucccccaacccccacc

SEQ ID NO: 2870991 - RNA, 13 nt, Human
ccucccccaaccc

SEQ ID NO: 2870992 - RNA, 20 nt, Human
ccucaucccguguucuccuu

SEQ ID NO: 2870993 - RNA, 23 nt, Human
ccucauccagggcucugaccagu

SEQ ID NO: 2870994 - RNA, 13 nt, Human
ccucaucccauga

SEQ ID NO: 2870995 - RNA, 12 nt, Human
ccucauauuuaa

SEQ ID NO: 2870996 - RNA, 13 nt, Human
ccucauauuuaaa

SEQ ID NO: 2870997 - RNA, 22 nt, Human
ccucauccaccccaucccuccc

SEQ ID NO: 2870998 - RNA, 14 nt, Human
ccucauccagggcu

SEQ ID NO: 2870999 - RNA, 15 nt, Human
ccucauccagggcuc

SEQ ID NO: 2871000 - RNA, 16 nt, Human
ccucaucuaugaggaa

SEQ ID NO: 2871001 - RNA, 21 nt, Human
ccucaucuaugaggaaagguu

SEQ ID NO: 2871002 - RNA, 13 nt, Human
ccucaucucauuc

SEQ ID NO: 2871003 - RNA, 13 nt, Human
ccucauccucaga

SEQ ID NO: 2871004 - RNA, 17 nt, Human
ccucauccucagaugcu

SEQ ID NO: 2871005 - RNA, 13 nt, Human
ccuccacagcgag

SEQ ID NO: 2871006 - RNA, 17 nt, Human
ccuccacagccgcagcc

SEQ ID NO: 2871007 - RNA, 16 nt, Human
ccuccacagccgcagc

SEQ ID NO: 2871008 - RNA, 15 nt, Human
ccuccacagccgcag

SEQ ID NO: 2871009 - RNA, 21 nt, Human
ccuccacagcgagggcagcug

SEQ ID NO: 2871010 - RNA, 20 nt, Human
ccuccacagcgagggcagcu

SEQ ID NO: 2871011 - RNA, 15 nt, Human
ccuccacagcgaggg

SEQ ID NO: 2871012 - RNA, 14 nt, Human
ccuccacagcgagg

SEQ ID NO: 2871013 - RNA, 23 nt, Human
ccuccacagcgagggcagcugcu

SEQ ID NO: 2871014 - RNA, 22 nt, Human
ccuccacagcgagggcagcugc

SEQ ID NO: 2871015 - RNA, 16 nt, Human
ccucaucuugaagggc

SEQ ID NO: 2871016 - RNA, 20 nt, Human
ccucaucuugaagggcccag

SEQ ID NO: 2871017 - RNA, 21 nt, Human
ccucaucuugaagggcccagg

SEQ ID NO: 2871018 - RNA, 22 nt, Human
ccucaucuugaagggcccagga

SEQ ID NO: 2871019 - RNA, 23 nt, Human
ccuccaaucccaccaacccucag

SEQ ID NO: 2871020 - RNA, 22 nt, Human
ccuccaaucccaccaacccuca

SEQ ID NO: 2871021 - RNA, 16 nt, Human
ccuccacacaagggaa

SEQ ID NO: 2871022 - RNA, 21 nt, Human
ccuccacacaagggaaggaca

SEQ ID NO: 2871023 - RNA, 11 nt, Human
ccuauggaaac

SEQ ID NO: 2871024 - RNA, 12 nt, Human
ccuauggaaacc

SEQ ID NO: 2871025 - RNA, 22 nt, Human
ccuauggaaacccgaggguuga

SEQ ID NO: 2871026 - RNA, 14 nt, Human
ccuauggaauuuau

SEQ ID NO: 2871027 - RNA, 16 nt, Human
ccuauggaauuuauaa

SEQ ID NO: 2871028 - RNA, 19 nt, Human
ccuaugcagagguccacaa

SEQ ID NO: 2871029 - RNA, 14 nt, Human
ccuaugcacauaug

SEQ ID NO: 2871030 - RNA, 20 nt, Human
ccuaugcacauauggacucu

SEQ ID NO: 2871031 - RNA, 21 nt, Human
ccuaugcacauauggacucug

SEQ ID NO: 2871032 - RNA, 11 nt, Human
ccucagugcca

SEQ ID NO: 2871033 - RNA, 22 nt, Human
ccucauaguaugguggcugggu

SEQ ID NO: 2871034 - RNA, 21 nt, Human
ccucauaguaugguggcuggg

SEQ ID NO: 2871035 - RNA, 18 nt, Human
ccucauagcccucacccu

SEQ ID NO: 2871036 - RNA, 17 nt, Human
ccucauagcccucaccc

SEQ ID NO: 2871037 - RNA, 20 nt, Human
ccucauaguaugguggcugg

SEQ ID NO: 2871038 - RNA, 22 nt, Human
ccucauagcccucacccugggg

SEQ ID NO: 2871039 - RNA, 21 nt, Human
ccucauagcccucacccuggg

SEQ ID NO: 2871040 - RNA, 19 nt, Human
ccuccuccaaaggcccccu

SEQ ID NO: 2871041 - RNA, 14 nt, Human
ccuccuccaccacc

SEQ ID NO: 2871042 - RNA, 18 nt, Human
ccuccuccaccaccgccc

SEQ ID NO: 2871043 - RNA, 17 nt, Human
ccuccuccaccucaccu

SEQ ID NO: 2871044 - RNA, 13 nt, Human
ccuccucaucccg

SEQ ID NO: 2871045 - RNA, 20 nt, Human
ccuccucaucccguguucuc

SEQ ID NO: 2871046 - RNA, 23 nt, Human
ccuccucaucccguguucuccuu

SEQ ID NO: 2871047 - RNA, 12 nt, Human
ccuccucaugua

SEQ ID NO: 2871048 - RNA, 20 nt, Human
ccuccucauguacauacccu

SEQ ID NO: 2871049 - RNA, 21 nt, Human
ccuccucauguacauacccug

SEQ ID NO: 2871050 - RNA, 13 nt, Human
ccuccucugucug

SEQ ID NO: 2871051 - RNA, 17 nt, Human
ccuccucugucugcccu

SEQ ID NO: 2871052 - RNA, 14 nt, Human
ccuccucugucugc

SEQ ID NO: 2871053 - RNA, 16 nt, Human
ccuccucugucugccc

SEQ ID NO: 2871054 - RNA, 22 nt, Human
ccuccugaaccgcacagcucag

SEQ ID NO: 2871055 - RNA, 20 nt, Human
ccuccugaaccgcacagcuc

SEQ ID NO: 2871056 - RNA, 12 nt, Human
ccuccucuuucu

SEQ ID NO: 2871057 - RNA, 14 nt, Human
ccuccucuuucucu

SEQ ID NO: 2871058 - RNA, 15 nt, Human
ccuccucuuucucuc

SEQ ID NO: 2871059 - RNA, 18 nt, Human
ccuccucuuucucucccc

SEQ ID NO: 2871060 - RNA, 21 nt, Human
ccuccucuuucucuccccaac

SEQ ID NO: 2871061 - RNA, 14 nt, Human
ccuccucuucaccc

SEQ ID NO: 2871062 - RNA, 16 nt, Human
ccuccucuucaccccg

SEQ ID NO: 2871063 - RNA, 19 nt, Human
ccuccucuucaccccggca

SEQ ID NO: 2871064 - RNA, 20 nt, Human
ccuccucuucaccccggcag

SEQ ID NO: 2871065 - RNA, 22 nt, Human
ccuccucuucaccccggcaggc

SEQ ID NO: 2871066 - RNA, 14 nt, Human
ccuccugggcuaag

SEQ ID NO: 2871067 - RNA, 17 nt, Human
ccuccuggugucacccc

SEQ ID NO: 2871068 - RNA, 18 nt, Human
ccuccuggugucacccca

SEQ ID NO: 2871069 - RNA, 19 nt, Human
ccuccuggugucaccccag

SEQ ID NO: 2871070 - RNA, 21 nt, Human
ccuccuggugucaccccagag

SEQ ID NO: 2871071 - RNA, 22 nt, Human
ccuccuggugucaccccagagc

SEQ ID NO: 2871072 - RNA, 15 nt, Human
ccuccugucucuggc

SEQ ID NO: 2871073 - RNA, 17 nt, Human
ccuccuggaaccuugcu

SEQ ID NO: 2871074 - RNA, 18 nt, Human
ccuccuggaaccuugcug

SEQ ID NO: 2871075 - RNA, 19 nt, Human
ccuccuggaaccuugcugu

SEQ ID NO: 2871076 - RNA, 10 nt, Human
ccuccugggg

SEQ ID NO: 2871077 - RNA, 12 nt, Human
ccuccuggggcc

SEQ ID NO: 2871078 - RNA, 13 nt, Human
ccuccuggggcca

SEQ ID NO: 2871079 - RNA, 14 nt, Human
ccuccuggggccag

SEQ ID NO: 2871080 - RNA, 15 nt, Human
ccuccuggggccagg

SEQ ID NO: 2871081 - RNA, 16 nt, Human
ccuccuggggccaggc

SEQ ID NO: 2871082 - RNA, 17 nt, Human
ccuccuggggccaggcc

SEQ ID NO: 2871083 - RNA, 18 nt, Human
ccuccuggggccaggccg

SEQ ID NO: 2871084 - RNA, 21 nt, Human
ccuccuggggccaggccgggc

SEQ ID NO: 2871085 - RNA, 23 nt, Human
ccuccugccucgaacuggcugca

SEQ ID NO: 2871086 - RNA, 18 nt, Human
ccucccugccccucccuu

SEQ ID NO: 2871087 - RNA, 21 nt, Human
ccucccugccccucccuucaa

SEQ ID NO: 2871088 - RNA, 15 nt, Human
ccucccgcaccccga

SEQ ID NO: 2871089 - RNA, 13 nt, Human
ccucccugccccu

SEQ ID NO: 2871090 - RNA, 22 nt, Human
ccucccugccccucccuucaac

SEQ ID NO: 2871091 - RNA, 24 nt, Human
ccucccugccccucccuucaacca

SEQ ID NO: 2871092 - RNA, 21 nt, Human
ccucccgaguagcugggacua

SEQ ID NO: 2871093 - RNA, 20 nt, Human
ccucccgaguagcugggacu

SEQ ID NO: 2871094 - RNA, 19 nt, Human
ccucccgaguagcugggac

SEQ ID NO: 2871095 - RNA, 18 nt, Human
ccucccgccccuucccac

SEQ ID NO: 2871096 - RNA, 19 nt, Human
ccucccccaucucccaccc

SEQ ID NO: 2871097 - RNA, 15 nt, Human
ccucccccagagggg

SEQ ID NO: 2871098 - RNA, 20 nt, Human
ccuccccugcugcaggggcu

SEQ ID NO: 2871099 - RNA, 16 nt, Human
ccuccccugcugcagg

SEQ ID NO: 2871100 - RNA, 13 nt, Human
ccuccccugggga

SEQ ID NO: 2871101 - RNA, 13 nt, Human
ccuccccuugaau

SEQ ID NO: 2871102 - RNA, 23 nt, Human
ccuccccuggggacagcaagggc

SEQ ID NO: 2871103 - RNA, 14 nt, Human
ccuccccuggggac

SEQ ID NO: 2871104 - RNA, 20 nt, Human
ccuccccuggggacagcaag

SEQ ID NO: 2871105 - RNA, 19 nt, Human
ccucgugguccccaacagc

SEQ ID NO: 2871106 - RNA, 20 nt, Human
ccucguuggaagaggaacag

SEQ ID NO: 2871107 - RNA, 15 nt, Human
ccucguuggaagagg

SEQ ID NO: 2871108 - RNA, 15 nt, Human
ccucgugguccccaa

SEQ ID NO: 2871109 - RNA, 18 nt, Human
ccucgugguccccaacag

SEQ ID NO: 2871110 - RNA, 19 nt, Human
ccucguuccuuucuccugu

SEQ ID NO: 2871111 - RNA, 21 nt, Human
ccucguuccuuucuccuguuu

SEQ ID NO: 2871112 - RNA, 14 nt, Human
ccucuagaggcaag

SEQ ID NO: 2871113 - RNA, 17 nt, Human
ccuccuucucccuuuuu

SEQ ID NO: 2871114 - RNA, 16 nt, Human
ccuccuucucccuuuu

SEQ ID NO: 2871115 - RNA, 15 nt, Human
ccuccuucucccuuu

SEQ ID NO: 2871116 - RNA, 20 nt, Human
ccuccuuccuugcuguccua

SEQ ID NO: 2871117 - RNA, 13 nt, Human
ccuccuucagaca

SEQ ID NO: 2871118 - RNA, 14 nt, Human
ccuccuucagacac

SEQ ID NO: 2871119 - RNA, 11 nt, Human
ccuccugugga

SEQ ID NO: 2871120 - RNA, 19 nt, Human
ccuccuguggaacccagca

SEQ ID NO: 2871121 - RNA, 20 nt, Human
ccuccuguggaacccagcag

SEQ ID NO: 2871122 - RNA, 15 nt, Human
ccuccuucagacacc

SEQ ID NO: 2871123 - RNA, 22 nt, Human
ccuccuucagacacccucaacc

SEQ ID NO: 2871124 - RNA, 13 nt, Human
ccucuaggcucug

SEQ ID NO: 2871125 - RNA, 16 nt, Human
ccucuaggcucugccu

SEQ ID NO: 2871126 - RNA, 17 nt, Human
ccucuaggcucugccuu

SEQ ID NO: 2871127 - RNA, 19 nt, Human
ccucuaggcucugccuucg

SEQ ID NO: 2871128 - RNA, 22 nt, Human
ccucuagcugugggggugaggg

SEQ ID NO: 2871129 - RNA, 15 nt, Human
ccucuagugcccucc

SEQ ID NO: 2871130 - RNA, 14 nt, Human
ccucuagugcccuc

SEQ ID NO: 2871131 - RNA, 13 nt, Human
ccucuauacaucu

SEQ ID NO: 2871132 - RNA, 15 nt, Human
ccucuauacaucucu

SEQ ID NO: 2871133 - RNA, 16 nt, Human
ccucuauacaucucuc

SEQ ID NO: 2871134 - RNA, 17 nt, Human
ccucuauacaucucucc

SEQ ID NO: 2871135 - RNA, 18 nt, Human
ccucuauacaucucuccc

SEQ ID NO: 2871136 - RNA, 19 nt, Human
ccucuauacaucucucccc

SEQ ID NO: 2871137 - RNA, 20 nt, Human
ccucuauacaucucucccca

SEQ ID NO: 2871138 - RNA, 21 nt, Human
ccucuauacaucucuccccaa

SEQ ID NO: 2871139 - RNA, 13 nt, Human
ccucuagugcccu

SEQ ID NO: 2871140 - RNA, 16 nt, Human
ccucucaccucagccu

SEQ ID NO: 2871141 - RNA, 14 nt, Human
ccucucaccucugu

SEQ ID NO: 2871142 - RNA, 15 nt, Human
ccucucaucucaggu

SEQ ID NO: 2871143 - RNA, 13 nt, Human
ccucucaguguuu

SEQ ID NO: 2871144 - RNA, 23 nt, Human
ccucucauauauagacagcuuug

SEQ ID NO: 2871145 - RNA, 13 nt, Human
ccucucacacaca

SEQ ID NO: 2871146 - RNA, 14 nt, Human
ccucucacacacau

SEQ ID NO: 2871147 - RNA, 13 nt, Human
ccucucaccucag

SEQ ID NO: 2871148 - RNA, 17 nt, Human
ccucuauuuauguuugc

SEQ ID NO: 2871149 - RNA, 19 nt, Human
ccucuaugaacuauggacg

SEQ ID NO: 2871150 - RNA, 21 nt, Human
ccucuauuuauguuugcacuu

SEQ ID NO: 2871151 - RNA, 17 nt, Human
ccucccgaauagcuggg

SEQ ID NO: 2871152 - RNA, 14 nt, Human
cuucggaccgcuug

SEQ ID NO: 2871153 - RNA, 21 nt, Human
cuucggaccgcuuguggggac

SEQ ID NO: 2871154 - RNA, 19 nt, Human
cuucguaucccgagucugg

SEQ ID NO: 2871155 - RNA, 21 nt, Human
cuucguaucccgagucuggga

SEQ ID NO: 2871156 - RNA, 22 nt, Human
cuucguaucccgagucugggac

SEQ ID NO: 2871157 - RNA, 23 nt, Human
cuucguaucccgagucugggaca

SEQ ID NO: 2871158 - RNA, 23 nt, Human
cuucgugaacauccccucccauc

SEQ ID NO: 2871159 - RNA, 15 nt, Human
cuucgugcccccccu

SEQ ID NO: 2871160 - RNA, 17 nt, Human
cuucgugcccccccuuc

SEQ ID NO: 2871161 - RNA, 21 nt, Human
cuucgugcggaaucagcuucu

SEQ ID NO: 2871162 - RNA, 15 nt, Human
cuucgggaccaggau

SEQ ID NO: 2871163 - RNA, 14 nt, Human
cuucgggaccagga

SEQ ID NO: 2871164 - RNA, 12 nt, Human
cuucgggaccag

SEQ ID NO: 2871165 - RNA, 16 nt, Human
cuucgguggaagagcu

SEQ ID NO: 2871166 - RNA, 17 nt, Human
cuucgguggaagagcuc

SEQ ID NO: 2871167 - RNA, 17 nt, Human
cuucucaucacacacau

SEQ ID NO: 2871168 - RNA, 19 nt, Human
cuucucaucacacacaugg

SEQ ID NO: 2871169 - RNA, 13 nt, Human
cuucguucuuuuu

SEQ ID NO: 2871170 - RNA, 15 nt, Human
cuucguucuuuuuaa

SEQ ID NO: 2871171 - RNA, 18 nt, Human
cuucguucuuuuuaaguu

SEQ ID NO: 2871172 - RNA, 20 nt, Human
cuucucauuccaacagugag

SEQ ID NO: 2871173 - RNA, 21 nt, Human
cuucucauuccaacagugagu

SEQ ID NO: 2871174 - RNA, 13 nt, Human
cuucucacuuuuu

SEQ ID NO: 2871175 - RNA, 17 nt, Human
cuucucauccugcaggc

SEQ ID NO: 2871176 - RNA, 15 nt, Human
cuucucauccugcag

SEQ ID NO: 2871177 - RNA, 16 nt, Human
cuucucauccugcagg

SEQ ID NO: 2871178 - RNA, 19 nt, Human
cuuccuuucccaagccuuc

SEQ ID NO: 2871179 - RNA, 15 nt, Human
cuuccuuucuccagg

SEQ ID NO: 2871180 - RNA, 16 nt, Human
cuuccuuucuccagga

SEQ ID NO: 2871181 - RNA, 17 nt, Human
cuuccuuucuccaggac

SEQ ID NO: 2871182 - RNA, 19 nt, Human
cuuccuuucuccaggacca

SEQ ID NO: 2871183 - RNA, 20 nt, Human
cuuccuuucucuuucucucu

SEQ ID NO: 2871184 - RNA, 21 nt, Human
cuuccuuucucuuucucucuu

SEQ ID NO: 2871185 - RNA, 23 nt, Human
cuuccuuucucuuucucucuucc

SEQ ID NO: 2871186 - RNA, 21 nt, Human
cuuccuuguuacccaugaaaa

SEQ ID NO: 2871187 - RNA, 15 nt, Human
cuuccuuuaaaaaac

SEQ ID NO: 2871188 - RNA, 16 nt, Human
cuuccuuuaaaaaacu

SEQ ID NO: 2871189 - RNA, 15 nt, Human
cuuccuuuacuuucc

SEQ ID NO: 2871190 - RNA, 16 nt, Human
cuuccuuuacuuuccc

SEQ ID NO: 2871191 - RNA, 17 nt, Human
cuuccuuuacuuucccu

SEQ ID NO: 2871192 - RNA, 18 nt, Human
cuuccuuuacuuucccuu

SEQ ID NO: 2871193 - RNA, 20 nt, Human
cuuccuuuacuuucccuugc

SEQ ID NO: 2871194 - RNA, 21 nt, Human
cuuccuuuacuuucccuugcu

SEQ ID NO: 2871195 - RNA, 22 nt, Human
cuuccuuuacuuucccuugcuu

SEQ ID NO: 2871196 - RNA, 23 nt, Human
cuuccuuuacuuucccuugcuuu

SEQ ID NO: 2871197 - RNA, 19 nt, Human
cuuccuuggcaucacaggg

SEQ ID NO: 2871198 - RNA, 16 nt, Human
cuuccuuacccaaacu

SEQ ID NO: 2871199 - RNA, 17 nt, Human
cuuccuuauuuuaagca

SEQ ID NO: 2871200 - RNA, 17 nt, Human
cuucgcuccugugucuu

SEQ ID NO: 2871201 - RNA, 19 nt, Human
cuucgcgugcccucgcugc

SEQ ID NO: 2871202 - RNA, 22 nt, Human
cuucgcgcccgccccugcagca

SEQ ID NO: 2871203 - RNA, 15 nt, Human
cuucgccaccugggu

SEQ ID NO: 2871204 - RNA, 16 nt, Human
cuucgcuccugugucu

SEQ ID NO: 2871205 - RNA, 21 nt, Human
cuuccuuuuaaguaaggucca

SEQ ID NO: 2871206 - RNA, 16 nt, Human
cuucgcaggcaugucc

SEQ ID NO: 2871207 - RNA, 14 nt, Human
cuucgccaccuggg

SEQ ID NO: 2871208 - RNA, 21 nt, Human
cuucgauacaccgggccugga

SEQ ID NO: 2871209 - RNA, 16 nt, Human
cuucgauacaccgggc

SEQ ID NO: 2871210 - RNA, 18 nt, Human
cuucccugauugaccugc

SEQ ID NO: 2871211 - RNA, 19 nt, Human
cuucccugauugaccugcu

SEQ ID NO: 2871212 - RNA, 20 nt, Human
cuucccugauugaccugcuc

SEQ ID NO: 2871213 - RNA, 21 nt, Human
cuucccugauugaccugcucc

SEQ ID NO: 2871214 - RNA, 22 nt, Human
cuucccugauugaccugcuccg

SEQ ID NO: 2871215 - RNA, 13 nt, Human
cuucccugcacua

SEQ ID NO: 2871216 - RNA, 18 nt, Human
cuucccugcgccugugau

SEQ ID NO: 2871217 - RNA, 14 nt, Human
cuucccugcugccu

SEQ ID NO: 2871218 - RNA, 21 nt, Human
cuuccucacagucccacugug

SEQ ID NO: 2871219 - RNA, 13 nt, Human
cuuccucacugcc

SEQ ID NO: 2871220 - RNA, 15 nt, Human
cuuccucacccugau

SEQ ID NO: 2871221 - RNA, 16 nt, Human
cuuccuauuucuaggg

SEQ ID NO: 2871222 - RNA, 17 nt, Human
cuuccuauuucuagggc

SEQ ID NO: 2871223 - RNA, 18 nt, Human
cuuccuauuucuagggcu

SEQ ID NO: 2871224 - RNA, 23 nt, Human
cuuccuauuucuagggcugggaa

SEQ ID NO: 2871225 - RNA, 22 nt, Human
cuuccuaguuuucuccucccag

SEQ ID NO: 2871226 - RNA, 23 nt, Human
cuuccuaguuuucuccucccagg

SEQ ID NO: 2871227 - RNA, 14 nt, Human
cuuccuauaacuug

SEQ ID NO: 2871228 - RNA, 15 nt, Human
cuuccuauaacuuga

SEQ ID NO: 2871229 - RNA, 17 nt, Human
cuuccuauaacuugaug

SEQ ID NO: 2871230 - RNA, 19 nt, Human
cuuccuauaacuugaugca

SEQ ID NO: 2871231 - RNA, 20 nt, Human
cuuccuauaacuugaugcau

SEQ ID NO: 2871232 - RNA, 22 nt, Human
cuuccuauaacuugaugcaugu

SEQ ID NO: 2871233 - RNA, 17 nt, Human
cuuccuaguuuucuccu

SEQ ID NO: 2871234 - RNA, 15 nt, Human
cuuccuaguuuucuc

SEQ ID NO: 2871235 - RNA, 16 nt, Human
cuuccucacugcccaa

SEQ ID NO: 2871236 - RNA, 13 nt, Human
cuuccugccccuc

SEQ ID NO: 2871237 - RNA, 15 nt, Human
cuuccugccccucuu

SEQ ID NO: 2871238 - RNA, 16 nt, Human
cuuccugccccucuuu

SEQ ID NO: 2871239 - RNA, 19 nt, Human
cuuccugccccucuuucuc

SEQ ID NO: 2871240 - RNA, 20 nt, Human
cuuccugccccucuuucucu

SEQ ID NO: 2871241 - RNA, 22 nt, Human
cuuccugccccucuuucucuuu

SEQ ID NO: 2871242 - RNA, 18 nt, Human
cuuccugugauccaccca

SEQ ID NO: 2871243 - RNA, 15 nt, Human
cuuccugugggagca

SEQ ID NO: 2871244 - RNA, 16 nt, Human
cuuccugugggagcag

SEQ ID NO: 2871245 - RNA, 16 nt, Human
cuuccugugauccacc

SEQ ID NO: 2871246 - RNA, 16 nt, Human
cuuccugugacuucag

SEQ ID NO: 2871247 - RNA, 16 nt, Human
cuuccugucuagucuc

SEQ ID NO: 2871248 - RNA, 20 nt, Human
cuuccugucuagucucuccu

SEQ ID NO: 2871249 - RNA, 23 nt, Human
cuuccugucuagucucuccugua

SEQ ID NO: 2871250 - RNA, 13 nt, Human
cuuccugugacuu

SEQ ID NO: 2871251 - RNA, 14 nt, Human
cuuccuguccccau

SEQ ID NO: 2871252 - RNA, 18 nt, Human
cuuccuguccccaucugu

SEQ ID NO: 2871253 - RNA, 19 nt, Human
cuuccuguccccaucuguc

SEQ ID NO: 2871254 - RNA, 18 nt, Human
cuuccagaucacugccac

SEQ ID NO: 2871255 - RNA, 17 nt, Human
cuuccagaucacugcca

SEQ ID NO: 2871256 - RNA, 15 nt, Human
cuuccagaucacugc

SEQ ID NO: 2871257 - RNA, 13 nt, Human
cuuccagaucacu

SEQ ID NO: 2871258 - RNA, 12 nt, Human
cuuccagacaua

SEQ ID NO: 2871259 - RNA, 21 nt, Human
cuuccacuuuuuuuuguaugu

SEQ ID NO: 2871260 - RNA, 20 nt, Human
cuuccacuuuuuuuuguaug

SEQ ID NO: 2871261 - RNA, 13 nt, Human
cuuccacugccuc

SEQ ID NO: 2871262 - RNA, 14 nt, Human
cuuccacugccucu

SEQ ID NO: 2871263 - RNA, 16 nt, Human
cuuccacugccucugc

SEQ ID NO: 2871264 - RNA, 17 nt, Human
cuuccacugccucugcc

SEQ ID NO: 2871265 - RNA, 18 nt, Human
cuuccacugccucugccu

SEQ ID NO: 2871266 - RNA, 19 nt, Human
cuuccacugccucugccuu

SEQ ID NO: 2871267 - RNA, 16 nt, Human
cuuccaauuaaugcuu

SEQ ID NO: 2871268 - RNA, 17 nt, Human
cuuccaauuaaugcuuu

SEQ ID NO: 2871269 - RNA, 20 nt, Human
cuuccagaucacugccacac

SEQ ID NO: 2871270 - RNA, 12 nt, Human
cuuccagauccu

SEQ ID NO: 2871271 - RNA, 23 nt, Human
cuucccaugacccaggcugggca

SEQ ID NO: 2871272 - RNA, 22 nt, Human
cuucccaugacccaggcugggc

SEQ ID NO: 2871273 - RNA, 17 nt, Human
cuucccaugucuuucuc

SEQ ID NO: 2871274 - RNA, 21 nt, Human
cuucccaugucuuucuccaaa

SEQ ID NO: 2871275 - RNA, 19 nt, Human
cuuccccagaaaggagacu

SEQ ID NO: 2871276 - RNA, 20 nt, Human
cuucccuaccucaggcagga

SEQ ID NO: 2871277 - RNA, 17 nt, Human
cuucccuaccucaggca

SEQ ID NO: 2871278 - RNA, 13 nt, Human
cuucccuaccuca

SEQ ID NO: 2871279 - RNA, 16 nt, Human
cuucccuaccucaggc

SEQ ID NO: 2871280 - RNA, 15 nt, Human
cuucccuaccucagg

SEQ ID NO: 2871281 - RNA, 15 nt, Human
cuucccccuccaauc

SEQ ID NO: 2871282 - RNA, 14 nt, Human
cuuccccagcgucc

SEQ ID NO: 2871283 - RNA, 18 nt, Human
cuuccccaucuucuaaac

SEQ ID NO: 2871284 - RNA, 23 nt, Human
cuucccccaccgguccagcuggc

SEQ ID NO: 2871285 - RNA, 14 nt, Human
cuucccccauagcc

SEQ ID NO: 2871286 - RNA, 16 nt, Human
cuucccccauagccac

SEQ ID NO: 2871287 - RNA, 15 nt, Human
cuucccccauagcca

SEQ ID NO: 2871288 - RNA, 18 nt, Human
cuucccccauagccaccc

SEQ ID NO: 2871289 - RNA, 12 nt, Human
cuucccccucca

SEQ ID NO: 2871290 - RNA, 14 nt, Human
cuucagccugaggc

SEQ ID NO: 2871291 - RNA, 20 nt, Human
cuucagccucuuucuguccc

SEQ ID NO: 2871292 - RNA, 20 nt, Human
cuucagccuccccaccuucu

SEQ ID NO: 2871293 - RNA, 20 nt, Human
cuucagccucccgaguagcu

SEQ ID NO: 2871294 - RNA, 16 nt, Human
cuucagccucccgagu

SEQ ID NO: 2871295 - RNA, 14 nt, Human
cuucagcaagagag

SEQ ID NO: 2871296 - RNA, 15 nt, Human
cuucagcaagagaga

SEQ ID NO: 2871297 - RNA, 17 nt, Human
cuucagcaagagagaac

SEQ ID NO: 2871298 - RNA, 20 nt, Human
cuucagcaagagagaaccua

SEQ ID NO: 2871299 - RNA, 14 nt, Human
cuucagccucccga

SEQ ID NO: 2871300 - RNA, 10 nt, Human
cuucagcacc

SEQ ID NO: 2871301 - RNA, 13 nt, Human
cuucagcauuccc

SEQ ID NO: 2871302 - RNA, 15 nt, Human
cuucagcauucccuc

SEQ ID NO: 2871303 - RNA, 16 nt, Human
cuucagcauucccucc

SEQ ID NO: 2871304 - RNA, 17 nt, Human
cuucagcauucccuccc

SEQ ID NO: 2871305 - RNA, 18 nt, Human
cuucagcauucccuccca

SEQ ID NO: 2871306 - RNA, 16 nt, Human
cuucagccuaguggcu

SEQ ID NO: 2871307 - RNA, 17 nt, Human
cuucagccuaguggcuu

SEQ ID NO: 2871308 - RNA, 19 nt, Human
cuucagccuaguggcuugu

SEQ ID NO: 2871309 - RNA, 23 nt, Human
cuucagccuaguggcuuguccuc

SEQ ID NO: 2871310 - RNA, 20 nt, Human
cuucagguuaucgaaauaac

SEQ ID NO: 2871311 - RNA, 21 nt, Human
cuucagguuaucgaaauaaca

SEQ ID NO: 2871312 - RNA, 22 nt, Human
cuucagguuaucgaaauaacaa

SEQ ID NO: 2871313 - RNA, 18 nt, Human
cuucaggucaggaguucg

SEQ ID NO: 2871314 - RNA, 16 nt, Human
cuucaggcaauucucc

SEQ ID NO: 2871315 - RNA, 18 nt, Human
cuucaggcaauucuccug

SEQ ID NO: 2871316 - RNA, 22 nt, Human
cuucaggcaauucuccugccuu

SEQ ID NO: 2871317 - RNA, 23 nt, Human
cuucaggcaauucuccugccuuu

SEQ ID NO: 2871318 - RNA, 21 nt, Human
cuucaggcauggggggugggg

SEQ ID NO: 2871319 - RNA, 13 nt, Human
cuucagccucucc

SEQ ID NO: 2871320 - RNA, 19 nt, Human
cuucagcuguacuucgucu

SEQ ID NO: 2871321 - RNA, 22 nt, Human
cuucagccugaggcugagacug

SEQ ID NO: 2871322 - RNA, 20 nt, Human
cuucagccugaggcugagac

SEQ ID NO: 2871323 - RNA, 16 nt, Human
cuucagccugaggcug

SEQ ID NO: 2871324 - RNA, 15 nt, Human
cuucagccugaggcu

SEQ ID NO: 2871325 - RNA, 16 nt, Human
cuucagucagaaaacu

SEQ ID NO: 2871326 - RNA, 11 nt, Human
cuucaguccug

SEQ ID NO: 2871327 - RNA, 12 nt, Human
cuucaguccugc

SEQ ID NO: 2871328 - RNA, 15 nt, Human
cuucaguccugcucc

SEQ ID NO: 2871329 - RNA, 17 nt, Human
cuucaguccugcuccag

SEQ ID NO: 2871330 - RNA, 18 nt, Human
cuucaguccugcuccaga

SEQ ID NO: 2871331 - RNA, 19 nt, Human
cuucaguccugcuccagaa

SEQ ID NO: 2871332 - RNA, 23 nt, Human
cuucaguccugcuccagaauuug

SEQ ID NO: 2871333 - RNA, 13 nt, Human
cuucaguccuggg

SEQ ID NO: 2871334 - RNA, 15 nt, Human
cuucaguccugggag

SEQ ID NO: 2871335 - RNA, 18 nt, Human
cuucaguccugggagacc

SEQ ID NO: 2871336 - RNA, 23 nt, Human
cuucaggaacacccccaugacau

SEQ ID NO: 2871337 - RNA, 19 nt, Human
cuucagugcaucugggaag

SEQ ID NO: 2871338 - RNA, 19 nt, Human
cuucauggccauagcuuuu

SEQ ID NO: 2871339 - RNA, 18 nt, Human
cuucauuuugaggggagg

SEQ ID NO: 2871340 - RNA, 14 nt, Human
cuuccaaagaaugu

SEQ ID NO: 2871341 - RNA, 22 nt, Human
cuuccaaagaauguuagagcac

SEQ ID NO: 2871342 - RNA, 17 nt, Human
cuuccaaagaauucuua

SEQ ID NO: 2871343 - RNA, 20 nt, Human
cuucauuaccuuuuuugaua

SEQ ID NO: 2871344 - RNA, 15 nt, Human
cuucauuagagcagg

SEQ ID NO: 2871345 - RNA, 16 nt, Human
cuucauuagagcaggc

SEQ ID NO: 2871346 - RNA, 11 nt, Human
cuucauuugug

SEQ ID NO: 2871347 - RNA, 13 nt, Human
cuucauuuguguc

SEQ ID NO: 2871348 - RNA, 14 nt, Human
cuucauuuguguca

SEQ ID NO: 2871349 - RNA, 18 nt, Human
cuucauuugugucaaugg

SEQ ID NO: 2871350 - RNA, 21 nt, Human
cuucauuuuauuaauauuuuu

SEQ ID NO: 2871351 - RNA, 22 nt, Human
cuucauuuuauuaauauuuuuc

SEQ ID NO: 2871352 - RNA, 16 nt, Human
cuuccaaaaauuauua

SEQ ID NO: 2871353 - RNA, 17 nt, Human
cuuccaaaaauuauuau

SEQ ID NO: 2871354 - RNA, 19 nt, Human
cuuccaaaaauuauuauaa

SEQ ID NO: 2871355 - RNA, 15 nt, Human
cuuccaaaauucuua

SEQ ID NO: 2871356 - RNA, 17 nt, Human
cuuccaaaauucuuauu

SEQ ID NO: 2871357 - RNA, 13 nt, Human
cuuagaaaaugug

SEQ ID NO: 2871358 - RNA, 16 nt, Human
cuucaaauccuuccaa

SEQ ID NO: 2871359 - RNA, 18 nt, Human
cuucaaauccuuccaaaa

SEQ ID NO: 2871360 - RNA, 12 nt, Human
cuuaguccccca

SEQ ID NO: 2871361 - RNA, 17 nt, Human
cuuagucccccaacucu

SEQ ID NO: 2871362 - RNA, 22 nt, Human
cuuagucccccaacucugagcc

SEQ ID NO: 2871363 - RNA, 23 nt, Human
cuuagucccccaacucugagccc

SEQ ID NO: 2871364 - RNA, 17 nt, Human
cuucaaauugucuuuug

SEQ ID NO: 2871365 - RNA, 21 nt, Human
cuucaaauuuuuuaaaagaga

SEQ ID NO: 2871366 - RNA, 18 nt, Human
cuucaaauuaaaacagcu

SEQ ID NO: 2871367 - RNA, 20 nt, Human
cuucaacugaccagccucca

SEQ ID NO: 2871368 - RNA, 23 nt, Human
cuucaacugaccagccuccaugc

SEQ ID NO: 2871369 - RNA, 17 nt, Human
cuucaacugaccagccu

SEQ ID NO: 2871370 - RNA, 16 nt, Human
cuucaacucccugccc

SEQ ID NO: 2871371 - RNA, 18 nt, Human
cuucaagaacucugggcu

SEQ ID NO: 2871372 - RNA, 22 nt, Human
cuucaacuccucgacaucacug

SEQ ID NO: 2871373 - RNA, 20 nt, Human
cuucacaguagagccagcuu

SEQ ID NO: 2871374 - RNA, 19 nt, Human
cuucacaguagagccagcu

SEQ ID NO: 2871375 - RNA, 18 nt, Human
cuucaacuugugccuggg

SEQ ID NO: 2871376 - RNA, 18 nt, Human
cuucacaguagagccagc

SEQ ID NO: 2871377 - RNA, 22 nt, Human
cuucacaguagagccagcuugg

SEQ ID NO: 2871378 - RNA, 23 nt, Human
cuucacagugaucgaugauucag

SEQ ID NO: 2871379 - RNA, 21 nt, Human
cuucacaguagagccagcuug

SEQ ID NO: 2871380 - RNA, 13 nt, Human
cuucaaggcuuca

SEQ ID NO: 2871381 - RNA, 14 nt, Human
cuucaaggcuucag

SEQ ID NO: 2871382 - RNA, 15 nt, Human
cuucaaggcuucagu

SEQ ID NO: 2871383 - RNA, 17 nt, Human
cuucaaggcuucagucu

SEQ ID NO: 2871384 - RNA, 18 nt, Human
cuucagauauuauugcuu

SEQ ID NO: 2871385 - RNA, 19 nt, Human
cuucagauauuauugcuuu

SEQ ID NO: 2871386 - RNA, 21 nt, Human
cuucagaugggaggaaagaga

SEQ ID NO: 2871387 - RNA, 23 nt, Human
cuucagaugggaggaaagagagc

SEQ ID NO: 2871388 - RNA, 17 nt, Human
cuucagauguggagcca

SEQ ID NO: 2871389 - RNA, 18 nt, Human
cuucagauguggagccag

SEQ ID NO: 2871390 - RNA, 19 nt, Human
cuucagauguggagccagg

SEQ ID NO: 2871391 - RNA, 20 nt, Human
cuucagauguggagccaggc

SEQ ID NO: 2871392 - RNA, 21 nt, Human
cuucagauguggagccaggcg

SEQ ID NO: 2871393 - RNA, 22 nt, Human
cuucagauguggagccaggcgu

SEQ ID NO: 2871394 - RNA, 12 nt, Human
cuucagagcuga

SEQ ID NO: 2871395 - RNA, 14 nt, Human
cuucagagcugaca

SEQ ID NO: 2871396 - RNA, 18 nt, Human
cuucagagcugacacagg

SEQ ID NO: 2871397 - RNA, 20 nt, Human
cuucagagcugacacaggau

SEQ ID NO: 2871398 - RNA, 18 nt, Human
cuguuuuagguuaaaaaa

SEQ ID NO: 2871399 - RNA, 13 nt, Human
cuguuuguuauug

SEQ ID NO: 2871400 - RNA, 14 nt, Human
cuguuuguuucaag

SEQ ID NO: 2871401 - RNA, 15 nt, Human
cuguuuguuucaaga

SEQ ID NO: 2871402 - RNA, 20 nt, Human
cuguuuguuucaagaaccug

SEQ ID NO: 2871403 - RNA, 14 nt, Human
cuguuuguuucaua

SEQ ID NO: 2871404 - RNA, 22 nt, Human
cuguuuuacaaaaaagaaaaga

SEQ ID NO: 2871405 - RNA, 17 nt, Human
cuguuuguagugaaaua

SEQ ID NO: 2871406 - RNA, 15 nt, Human
cuguuuuuagacacc

SEQ ID NO: 2871407 - RNA, 18 nt, Human
cuguuuuuagacaccuuc

SEQ ID NO: 2871408 - RNA, 21 nt, Human
cuguuuuguuuggcaaggaaa

SEQ ID NO: 2871409 - RNA, 22 nt, Human
cuguuuuguuuggcaaggaaag

SEQ ID NO: 2871410 - RNA, 21 nt, Human
cuguuuucucucggcucccca

SEQ ID NO: 2871411 - RNA, 14 nt, Human
cuguuugcugaugg

SEQ ID NO: 2871412 - RNA, 16 nt, Human
cuguuugcugaugguc

SEQ ID NO: 2871413 - RNA, 19 nt, Human
cuguuugcugauggucugg

SEQ ID NO: 2871414 - RNA, 12 nt, Human
cuguuugauucu

SEQ ID NO: 2871415 - RNA, 13 nt, Human
cuguuugauucuu

SEQ ID NO: 2871416 - RNA, 14 nt, Human
cuguuugauucuuu

SEQ ID NO: 2871417 - RNA, 23 nt, Human
cuguuuggaggagcaaaggcuga

SEQ ID NO: 2871418 - RNA, 19 nt, Human
cuguuuggauuuuuaauua

SEQ ID NO: 2871419 - RNA, 21 nt, Human
cuguuuggauuuuuaauuaaa

SEQ ID NO: 2871420 - RNA, 23 nt, Human
cuguuuggauuuuuaauuaaaaa

SEQ ID NO: 2871421 - RNA, 12 nt, Human
cuguuuggacug

SEQ ID NO: 2871422 - RNA, 16 nt, Human
cuguuuggacuuugua

SEQ ID NO: 2871423 - RNA, 17 nt, Human
cuguuugcuucaccgug

SEQ ID NO: 2871424 - RNA, 18 nt, Human
cuguuugcuucaccgugg

SEQ ID NO: 2871425 - RNA, 21 nt, Human
cuguuugcuucaccguggauu

SEQ ID NO: 2871426 - RNA, 17 nt, Human
cuguuucugcuugcucu

SEQ ID NO: 2871427 - RNA, 12 nt, Human
cuguuucuuccu

SEQ ID NO: 2871428 - RNA, 19 nt, Human
cuguuucuuccuguuaaug

SEQ ID NO: 2871429 - RNA, 12 nt, Human
cuguuucuugcu

SEQ ID NO: 2871430 - RNA, 13 nt, Human
cuguuucuugcuu

SEQ ID NO: 2871431 - RNA, 14 nt, Human
cuguuucuugcuug

SEQ ID NO: 2871432 - RNA, 15 nt, Human
cuguuucuugcuugu

SEQ ID NO: 2871433 - RNA, 16 nt, Human
cuguuucuugcuugua

SEQ ID NO: 2871434 - RNA, 19 nt, Human
cuguuucuugcuuguaccu

SEQ ID NO: 2871435 - RNA, 17 nt, Human
cuguuucaacacagacc

SEQ ID NO: 2871436 - RNA, 16 nt, Human
cuguuuauuucuguuu

SEQ ID NO: 2871437 - RNA, 15 nt, Human
cuguuuauucccauc

SEQ ID NO: 2871438 - RNA, 15 nt, Human
cuguuucaaucacug

SEQ ID NO: 2871439 - RNA, 16 nt, Human
cuguuucaaucacugu

SEQ ID NO: 2871440 - RNA, 17 nt, Human
cuguuucaaucacuguc

SEQ ID NO: 2871441 - RNA, 11 nt, Human
cuguuucacaa

SEQ ID NO: 2871442 - RNA, 11 nt, Human
cuguuucaagg

SEQ ID NO: 2871443 - RNA, 21 nt, Human
cuguuucaaggcacucuagau

SEQ ID NO: 2871444 - RNA, 22 nt, Human
cuguuucaaggcacucuagauu

SEQ ID NO: 2871445 - RNA, 17 nt, Human
cuguugcccaggcuggc

SEQ ID NO: 2871446 - RNA, 11 nt, Human
cuguucuugcu

SEQ ID NO: 2871447 - RNA, 12 nt, Human
cuguucuugcug

SEQ ID NO: 2871448 - RNA, 13 nt, Human
cuguucuugcugc

SEQ ID NO: 2871449 - RNA, 14 nt, Human
cuguucuugcugcu

SEQ ID NO: 2871450 - RNA, 15 nt, Human
cuguucuugcugcua

SEQ ID NO: 2871451 - RNA, 16 nt, Human
cuguucuugcugcuag

SEQ ID NO: 2871452 - RNA, 17 nt, Human
cuguucuugcugcuaga

SEQ ID NO: 2871453 - RNA, 18 nt, Human
cuguucuugcugcuagaa

SEQ ID NO: 2871454 - RNA, 19 nt, Human
cuguucuugcugcuagaac

SEQ ID NO: 2871455 - RNA, 20 nt, Human
cuguucuugcugcuagaacu

SEQ ID NO: 2871456 - RNA, 21 nt, Human
cuguucuugcugcuagaacuu

SEQ ID NO: 2871457 - RNA, 22 nt, Human
cuguucuugcugcuagaacuuu

SEQ ID NO: 2871458 - RNA, 13 nt, Human
cuguucuuccucc

SEQ ID NO: 2871459 - RNA, 14 nt, Human
cuguucuuccucca

SEQ ID NO: 2871460 - RNA, 15 nt, Human
cuguucuuccuccag

SEQ ID NO: 2871461 - RNA, 20 nt, Human
cuguucuuccuccagcugca

SEQ ID NO: 2871462 - RNA, 21 nt, Human
cuguucuuccuccagcugcac

SEQ ID NO: 2871463 - RNA, 22 nt, Human
cuguucuuccuccagcugcacc

SEQ ID NO: 2871464 - RNA, 23 nt, Human
cuguucuuccuccagcugcacca

SEQ ID NO: 2871465 - RNA, 16 nt, Human
cuguuaauaguucagg

SEQ ID NO: 2871466 - RNA, 19 nt, Human
cuguuaauagaucuuaggg

SEQ ID NO: 2871467 - RNA, 13 nt, Human
cuguuaauguauu

SEQ ID NO: 2871468 - RNA, 14 nt, Human
cuguuaauguauuu

SEQ ID NO: 2871469 - RNA, 18 nt, Human
cuguuaauguauuuguuc

SEQ ID NO: 2871470 - RNA, 19 nt, Human
cuguuaauguauuuguuca

SEQ ID NO: 2871471 - RNA, 12 nt, Human
cuguuaaccauu

SEQ ID NO: 2871472 - RNA, 19 nt, Human
cuguuaagaaaucuguuuu

SEQ ID NO: 2871473 - RNA, 11 nt, Human
cuguucugugu

SEQ ID NO: 2871474 - RNA, 21 nt, Human
cuguucuguuucaaggcacuc

SEQ ID NO: 2871475 - RNA, 14 nt, Human
cuguucuguuucaa

SEQ ID NO: 2871476 - RNA, 15 nt, Human
cuguucuguuucaag

SEQ ID NO: 2871477 - RNA, 13 nt, Human
cuguucugugucu

SEQ ID NO: 2871478 - RNA, 14 nt, Human
cuguucugugucuu

SEQ ID NO: 2871479 - RNA, 12 nt, Human
cuguucuuccuc

SEQ ID NO: 2871480 - RNA, 16 nt, Human
cuguugcccaggcugg

SEQ ID NO: 2871481 - RNA, 15 nt, Human
cuguugcccaggcug

SEQ ID NO: 2871482 - RNA, 14 nt, Human
cuguugcccaggcu

SEQ ID NO: 2871483 - RNA, 13 nt, Human
cuguugcccaggc

SEQ ID NO: 2871484 - RNA, 12 nt, Human
cuguugcccagg

SEQ ID NO: 2871485 - RNA, 21 nt, Human
cuguugcaauuaggauuuuga

SEQ ID NO: 2871486 - RNA, 22 nt, Human
cuguugcaauuaggauuuugau

SEQ ID NO: 2871487 - RNA, 12 nt, Human
cuguugaaaauu

SEQ ID NO: 2871488 - RNA, 15 nt, Human
cuguugacauauuua

SEQ ID NO: 2871489 - RNA, 16 nt, Human
cuguugacauauuuaa

SEQ ID NO: 2871490 - RNA, 17 nt, Human
cuguugacauauuuaau

SEQ ID NO: 2871491 - RNA, 18 nt, Human
cuguugacauauuuaaug

SEQ ID NO: 2871492 - RNA, 19 nt, Human
cuguugacauauuuaaugu

SEQ ID NO: 2871493 - RNA, 20 nt, Human
cuguugacauauuuaauguu

SEQ ID NO: 2871494 - RNA, 21 nt, Human
cuguugacauauuuaauguuu

SEQ ID NO: 2871495 - RNA, 22 nt, Human
cuguugacauauuuaauguuuu

SEQ ID NO: 2871496 - RNA, 23 nt, Human
cuguugacauauuuaauguuuua

SEQ ID NO: 2871497 - RNA, 14 nt, Human
cuguugaaaauuau

SEQ ID NO: 2871498 - RNA, 21 nt, Human
cuguugaaaauuauuuuaaac

SEQ ID NO: 2871499 - RNA, 22 nt, Human
cuguugaaaauuauuuuaaaca

SEQ ID NO: 2871500 - RNA, 12 nt, Human
cuguugaaagca

SEQ ID NO: 2871501 - RNA, 14 nt, Human
cuguugaaagcaaa

SEQ ID NO: 2871502 - RNA, 15 nt, Human
cuguugaaagcaaaa

SEQ ID NO: 2871503 - RNA, 16 nt, Human
cuguugaaagcaaaaa

SEQ ID NO: 2871504 - RNA, 17 nt, Human
cuguugaaagcaaaaau

SEQ ID NO: 2871505 - RNA, 18 nt, Human
cuguugaaagcaaaaaug

SEQ ID NO: 2871506 - RNA, 19 nt, Human
cuguugaaagcaaaaaugc

SEQ ID NO: 2871507 - RNA, 20 nt, Human
cuguugaaagcaaaaaugcu

SEQ ID NO: 2871508 - RNA, 22 nt, Human
cuguugaaagcaaaaaugcuaa

SEQ ID NO: 2871509 - RNA, 18 nt, Human
cuguugaagucaccuugu

SEQ ID NO: 2871510 - RNA, 18 nt, Human
cuguugauaauucuuauu

SEQ ID NO: 2871511 - RNA, 21 nt, Human
cuguugauaauucuuauuuug

SEQ ID NO: 2871512 - RNA, 15 nt, Human
cuguugacuggcugu

SEQ ID NO: 2871513 - RNA, 22 nt, Human
cuguugacuggcugugugaccu

SEQ ID NO: 2871514 - RNA, 14 nt, Human
cuguugauguaucu

SEQ ID NO: 2871515 - RNA, 15 nt, Human
cuguugauguaucug

SEQ ID NO: 2871516 - RNA, 16 nt, Human
cuguugauguaucuga

SEQ ID NO: 2871517 - RNA, 22 nt, Human
cuguugauguaucugaguugcc

SEQ ID NO: 2871518 - RNA, 23 nt, Human
cuguugauguaucugaguugcca

SEQ ID NO: 2871519 - RNA, 21 nt, Human
cuuaaugaaugagucuguugu

SEQ ID NO: 2871520 - RNA, 20 nt, Human
cuuaaugugauuacugcucu

SEQ ID NO: 2871521 - RNA, 22 nt, Human
cuuaaugugauuacugcucuau

SEQ ID NO: 2871522 - RNA, 13 nt, Human
cuuaauguucuua

SEQ ID NO: 2871523 - RNA, 14 nt, Human
cuuaauguucuuau

SEQ ID NO: 2871524 - RNA, 14 nt, Human
cuuaauauauuuga

SEQ ID NO: 2871525 - RNA, 13 nt, Human
cuuaauuaauuug

SEQ ID NO: 2871526 - RNA, 14 nt, Human
cuuaauuaauuuga

SEQ ID NO: 2871527 - RNA, 15 nt, Human
cuuaauuaauuugau

SEQ ID NO: 2871528 - RNA, 17 nt, Human
cuuaauuaauuugauua

SEQ ID NO: 2871529 - RNA, 18 nt, Human
cuuaauuaauuugauuaa

SEQ ID NO: 2871530 - RNA, 12 nt, Human
cuuaauuacuua

SEQ ID NO: 2871531 - RNA, 14 nt, Human
cuuaauuacuuaaa

SEQ ID NO: 2871532 - RNA, 16 nt, Human
cuuaauuacuuaaaaa

SEQ ID NO: 2871533 - RNA, 17 nt, Human
cuuaauuacuuaaaaaa

SEQ ID NO: 2871534 - RNA, 11 nt, Human
cuuaauuauua

SEQ ID NO: 2871535 - RNA, 15 nt, Human
cuuaauuauuauuug

SEQ ID NO: 2871536 - RNA, 18 nt, Human
cuuaauuauuauuugugu

SEQ ID NO: 2871537 - RNA, 19 nt, Human
cuuaauuauuauuuguguu

SEQ ID NO: 2871538 - RNA, 12 nt, Human
cuuaauuucuaa

SEQ ID NO: 2871539 - RNA, 14 nt, Human
cuuaaccaguugug

SEQ ID NO: 2871540 - RNA, 18 nt, Human
cuuaaccaguuguggugu

SEQ ID NO: 2871541 - RNA, 23 nt, Human
cuuaaccaguuguggugugagua

SEQ ID NO: 2871542 - RNA, 18 nt, Human
cuuaagaauuuugagcag

SEQ ID NO: 2871543 - RNA, 13 nt, Human
cuuaacauauuua

SEQ ID NO: 2871544 - RNA, 15 nt, Human
cuuaacauauuuacu

SEQ ID NO: 2871545 - RNA, 13 nt, Human
cuuaacaugggcu

SEQ ID NO: 2871546 - RNA, 16 nt, Human
cuuaacauuccuaaaa

SEQ ID NO: 2871547 - RNA, 19 nt, Human
cuuaacauuccuaaaaugc

SEQ ID NO: 2871548 - RNA, 17 nt, Human
cuuaacauauuuacuaa

SEQ ID NO: 2871549 - RNA, 17 nt, Human
cuuaacaaccuggccgc

SEQ ID NO: 2871550 - RNA, 18 nt, Human
cuuaaauuuuaauuuauu

SEQ ID NO: 2871551 - RNA, 13 nt, Human
cuuaaaaaucaca

SEQ ID NO: 2871552 - RNA, 21 nt, Human
cuuaaaaaucacacuguaaau

SEQ ID NO: 2871553 - RNA, 22 nt, Human
cuuaaaaaucacacuguaaaua

SEQ ID NO: 2871554 - RNA, 17 nt, Human
cuuaaauuuuaauuuau

SEQ ID NO: 2871555 - RNA, 12 nt, Human
cuuaagcuuccg

SEQ ID NO: 2871556 - RNA, 13 nt, Human
cuuaagcuuugga

SEQ ID NO: 2871557 - RNA, 22 nt, Human
cuuaagcuuuggacccaaggaa

SEQ ID NO: 2871558 - RNA, 23 nt, Human
cuuaagcuuuggacccaaggaaa

SEQ ID NO: 2871559 - RNA, 11 nt, Human
cuuaagcugau

SEQ ID NO: 2871560 - RNA, 23 nt, Human
cuuaagaccuacuguucuaaagc

SEQ ID NO: 2871561 - RNA, 20 nt, Human
cuuaagaccuacuguucuaa

SEQ ID NO: 2871562 - RNA, 22 nt, Human
cuuaagaccuacuguucuaaag

SEQ ID NO: 2871563 - RNA, 15 nt, Human
cuuaaggugaggccu

SEQ ID NO: 2871564 - RNA, 17 nt, Human
cuuaaggugaggccugu

SEQ ID NO: 2871565 - RNA, 18 nt, Human
cuuaaggugaggccuguc

SEQ ID NO: 2871566 - RNA, 19 nt, Human
cuuaaggugaggccugucu

SEQ ID NO: 2871567 - RNA, 20 nt, Human
cuuaaggugaggccugucug

SEQ ID NO: 2871568 - RNA, 21 nt, Human
cuuaaggugaggccugucugu

SEQ ID NO: 2871569 - RNA, 22 nt, Human
cuuaaggugaggccugucugug

SEQ ID NO: 2871570 - RNA, 23 nt, Human
cuuaaggugaggccugucuguga

SEQ ID NO: 2871571 - RNA, 16 nt, Human
cuuaagggaguuuaau

SEQ ID NO: 2871572 - RNA, 16 nt, Human
cuuaaggcacucuguu

SEQ ID NO: 2871573 - RNA, 19 nt, Human
cuuaaguauaucauguaaa

SEQ ID NO: 2871574 - RNA, 20 nt, Human
cuuaaguauaucauguaaag

SEQ ID NO: 2871575 - RNA, 18 nt, Human
cuuaauacuaccuugaaa

SEQ ID NO: 2871576 - RNA, 16 nt, Human
cuuaauacuaccuuga

SEQ ID NO: 2871577 - RNA, 20 nt, Human
cuuaauagaaacauugaaga

SEQ ID NO: 2871578 - RNA, 18 nt, Human
cuuagaaguuuguuguga

SEQ ID NO: 2871579 - RNA, 16 nt, Human
cuuagaccuuccauaa

SEQ ID NO: 2871580 - RNA, 18 nt, Human
cuuagaccuuccauaaug

SEQ ID NO: 2871581 - RNA, 20 nt, Human
cuuagagaauguucuccuaa

SEQ ID NO: 2871582 - RNA, 11 nt, Human
cuuagagcagu

SEQ ID NO: 2871583 - RNA, 19 nt, Human
cuuagagcaguuucugucc

SEQ ID NO: 2871584 - RNA, 22 nt, Human
cuuagagcaguuucuguccugc

SEQ ID NO: 2871585 - RNA, 15 nt, Human
cuuaguaaaauuuau

SEQ ID NO: 2871586 - RNA, 19 nt, Human
cuuaguaaaauuuauuuca

SEQ ID NO: 2871587 - RNA, 20 nt, Human
cuuaguaaaauuuauuucau

SEQ ID NO: 2871588 - RNA, 13 nt, Human
cuuaguaucucau

SEQ ID NO: 2871589 - RNA, 17 nt, Human
cuuaguaucucaucaac

SEQ ID NO: 2871590 - RNA, 19 nt, Human
cuuaguaucucaucaacaa

SEQ ID NO: 2871591 - RNA, 22 nt, Human
cuuaguaucucaucaacaaaga

SEQ ID NO: 2871592 - RNA, 20 nt, Human
cuuagaagucacacaguauu

SEQ ID NO: 2871593 - RNA, 17 nt, Human
cuuagaagucacacagu

SEQ ID NO: 2871594 - RNA, 16 nt, Human
cuuagaaauugcauuu

SEQ ID NO: 2871595 - RNA, 18 nt, Human
cuuagaaauguaaacugc

SEQ ID NO: 2871596 - RNA, 20 nt, Human
cuuagaaauguaaacugcca

SEQ ID NO: 2871597 - RNA, 21 nt, Human
cuuagaaauguaaacugccau

SEQ ID NO: 2871598 - RNA, 22 nt, Human
cuuagaaauguaaacugccaua

SEQ ID NO: 2871599 - RNA, 16 nt, Human
cuuacuguaagacauu

SEQ ID NO: 2871600 - RNA, 17 nt, Human
cuuacuguaagacauua

SEQ ID NO: 2871601 - RNA, 17 nt, Human
cuuacugauuauuuucu

SEQ ID NO: 2871602 - RNA, 14 nt, Human
cuuagaaagcaggg

SEQ ID NO: 2871603 - RNA, 16 nt, Human
cuuagaaagcaggggc

SEQ ID NO: 2871604 - RNA, 18 nt, Human
cuuagaaagcaggggcua

SEQ ID NO: 2871605 - RNA, 17 nt, Human
cuuagaaagcaggggcu

SEQ ID NO: 2871606 - RNA, 20 nt, Human
cuuaccuguaugucuccagu

SEQ ID NO: 2871607 - RNA, 15 nt, Human
cuuaccuguacacug

SEQ ID NO: 2871608 - RNA, 17 nt, Human
cuuaccuguacacugac

SEQ ID NO: 2871609 - RNA, 16 nt, Human
cuuaccuuuaccccau

SEQ ID NO: 2871610 - RNA, 12 nt, Human
cuuacucuaaga

SEQ ID NO: 2871611 - RNA, 20 nt, Human
cuuacucuaagaucuuagau

SEQ ID NO: 2871612 - RNA, 16 nt, Human
cuuacucuguccauuu

SEQ ID NO: 2871613 - RNA, 17 nt, Human
cuuacucuguccauuua

SEQ ID NO: 2871614 - RNA, 13 nt, Human
cuuacucuaagau

SEQ ID NO: 2871615 - RNA, 21 nt, Human
cuguuaaacuguuagcacugu

SEQ ID NO: 2871616 - RNA, 23 nt, Human
cuguuaaacuguuagcacuguug

SEQ ID NO: 2871617 - RNA, 18 nt, Human
cuguguugcgugucgugg

SEQ ID NO: 2871618 - RNA, 14 nt, Human
cuguguugccaugu

SEQ ID NO: 2871619 - RNA, 13 nt, Human
cuguguuguauua

SEQ ID NO: 2871620 - RNA, 15 nt, Human
cuguguuguauuaac

SEQ ID NO: 2871621 - RNA, 18 nt, Human
cuguguuguauuaacaaa

SEQ ID NO: 2871622 - RNA, 19 nt, Human
cuguguuguauuaacaaaa

SEQ ID NO: 2871623 - RNA, 21 nt, Human
cuguguuguauuaacaaaagu

SEQ ID NO: 2871624 - RNA, 22 nt, Human
cuguguuguauuaacaaaaguu

SEQ ID NO: 2871625 - RNA, 20 nt, Human
cuguguugcgugucgugggu

SEQ ID NO: 2871626 - RNA, 23 nt, Human
cuguguugcauuauucauuuagu

SEQ ID NO: 2871627 - RNA, 23 nt, Human
cugugugugugaaugaacacucu

SEQ ID NO: 2871628 - RNA, 17 nt, Human
cuguguaaaaagagagc

SEQ ID NO: 2871629 - RNA, 15 nt, Human
cuguguaaaauguaa

SEQ ID NO: 2871630 - RNA, 19 nt, Human
cuguguaaaauguaaugca

SEQ ID NO: 2871631 - RNA, 16 nt, Human
cuguguaaaaagagag

SEQ ID NO: 2871632 - RNA, 20 nt, Human
cugugucuuuuuucacuaca

SEQ ID NO: 2871633 - RNA, 13 nt, Human
cugugugaaaaug

SEQ ID NO: 2871634 - RNA, 20 nt, Human
cugugucuuucacagcuccu

SEQ ID NO: 2871635 - RNA, 22 nt, Human
cuguggucuucaaauugucuuu

SEQ ID NO: 2871636 - RNA, 21 nt, Human
cugugugcaccuuaccaacuu

SEQ ID NO: 2871637 - RNA, 16 nt, Human
cugugugcacaaauau

SEQ ID NO: 2871638 - RNA, 15 nt, Human
cugugugcagugaag

SEQ ID NO: 2871639 - RNA, 17 nt, Human
cugugugcagugaaggu

SEQ ID NO: 2871640 - RNA, 16 nt, Human
cugugugccuggggga

SEQ ID NO: 2871641 - RNA, 18 nt, Human
cugugugccugggggagu

SEQ ID NO: 2871642 - RNA, 18 nt, Human
cugugugaugaacuuucu

SEQ ID NO: 2871643 - RNA, 19 nt, Human
cugugugaugaacuuucuc

SEQ ID NO: 2871644 - RNA, 13 nt, Human
cugugugaaugug

SEQ ID NO: 2871645 - RNA, 14 nt, Human
cugugugaaugugg

SEQ ID NO: 2871646 - RNA, 17 nt, Human
cugugugaaugugggca

SEQ ID NO: 2871647 - RNA, 15 nt, Human
cugugugaugaacuu

SEQ ID NO: 2871648 - RNA, 16 nt, Human
cugugugaugaacuuu

SEQ ID NO: 2871649 - RNA, 16 nt, Human
cugugugugaccccuc

SEQ ID NO: 2871650 - RNA, 17 nt, Human
cugugugugaccccucc

SEQ ID NO: 2871651 - RNA, 18 nt, Human
cugugugugaccccuccu

SEQ ID NO: 2871652 - RNA, 19 nt, Human
cugugugugaccccuccug

SEQ ID NO: 2871653 - RNA, 20 nt, Human
cugugugugaccccuccugg

SEQ ID NO: 2871654 - RNA, 21 nt, Human
cugugugugaccccuccuggg

SEQ ID NO: 2871655 - RNA, 14 nt, Human
cugugugugcccug

SEQ ID NO: 2871656 - RNA, 15 nt, Human
cugugugugcccugu

SEQ ID NO: 2871657 - RNA, 15 nt, Human
cugugugcgcucugu

SEQ ID NO: 2871658 - RNA, 13 nt, Human
cuguggugucugc

SEQ ID NO: 2871659 - RNA, 15 nt, Human
cugugguaaaugcca

SEQ ID NO: 2871660 - RNA, 16 nt, Human
cugugguaaaugccac

SEQ ID NO: 2871661 - RNA, 17 nt, Human
cugugguaaaugccaca

SEQ ID NO: 2871662 - RNA, 18 nt, Human
cugugguaaaugccacac

SEQ ID NO: 2871663 - RNA, 23 nt, Human
cugugguaaaugccacacaccuu

SEQ ID NO: 2871664 - RNA, 16 nt, Human
cugugggugugugacu

SEQ ID NO: 2871665 - RNA, 19 nt, Human
cuguggguccgauaauauc

SEQ ID NO: 2871666 - RNA, 22 nt, Human
cuguggggucaacccuucugga

SEQ ID NO: 2871667 - RNA, 20 nt, Human
cugugggggugugcccccuu

SEQ ID NO: 2871668 - RNA, 19 nt, Human
cugugggggugugcccccu

SEQ ID NO: 2871669 - RNA, 24 nt, Human
cugugggggugagggucccaugug

SEQ ID NO: 2871670 - RNA, 23 nt, Human
cugugggggugagggucccaugu

SEQ ID NO: 2871671 - RNA, 14 nt, Human
cugugggaccccag

SEQ ID NO: 2871672 - RNA, 15 nt, Human
cugugggaccccagg

SEQ ID NO: 2871673 - RNA, 16 nt, Human
cugugggaccccaggc

SEQ ID NO: 2871674 - RNA, 17 nt, Human
cugugggaccccaggcc

SEQ ID NO: 2871675 - RNA, 18 nt, Human
cugugggaccccaggccc

SEQ ID NO: 2871676 - RNA, 19 nt, Human
cugugggaccccaggccca

SEQ ID NO: 2871677 - RNA, 20 nt, Human
cugugggagggacuuugcug

SEQ ID NO: 2871678 - RNA, 14 nt, Human
cuguggcugucugg

SEQ ID NO: 2871679 - RNA, 15 nt, Human
cuguggcugucugga

SEQ ID NO: 2871680 - RNA, 13 nt, Human
cuguggcugugga

SEQ ID NO: 2871681 - RNA, 20 nt, Human
cuguggcuucccaugucuuu

SEQ ID NO: 2871682 - RNA, 21 nt, Human
cuguggccguuaucuggaagu

SEQ ID NO: 2871683 - RNA, 19 nt, Human
cuguggccguuaucuggaa

SEQ ID NO: 2871684 - RNA, 20 nt, Human
cuguggccguuaucuggaag

SEQ ID NO: 2871685 - RNA, 19 nt, Human
cuguggagacaaugucugc

SEQ ID NO: 2871686 - RNA, 19 nt, Human
cuguggaaugagugugcau

SEQ ID NO: 2871687 - RNA, 21 nt, Human
cuguggaaugagugugcaugg

SEQ ID NO: 2871688 - RNA, 12 nt, Human
cuguggaagcaa

SEQ ID NO: 2871689 - RNA, 11 nt, Human
cugugccucug

SEQ ID NO: 2871690 - RNA, 18 nt, Human
cuguggaacauaaaaagg

SEQ ID NO: 2871691 - RNA, 21 nt, Human
cuguggaacauaaaaaggaca

SEQ ID NO: 2871692 - RNA, 16 nt, Human
cuguggaacccagcag

SEQ ID NO: 2871693 - RNA, 22 nt, Human
cuguggaacccagcaguucugu

SEQ ID NO: 2871694 - RNA, 23 nt, Human
cuguggaacccagcaguucuguu

SEQ ID NO: 2871695 - RNA, 18 nt, Human
cuguggaacuaauaaaua

SEQ ID NO: 2871696 - RNA, 22 nt, Human
cuguggaacuaauaaauacaua

SEQ ID NO: 2871697 - RNA, 16 nt, Human
cugugccucugccugu

SEQ ID NO: 2871698 - RNA, 12 nt, Human
cugugccucugc

SEQ ID NO: 2871699 - RNA, 13 nt, Human
cugugccucugcc

SEQ ID NO: 2871700 - RNA, 14 nt, Human
cugugccucugccu

SEQ ID NO: 2871701 - RNA, 15 nt, Human
cugugccucugccug

SEQ ID NO: 2871702 - RNA, 13 nt, Human
cuguggcccuggc

SEQ ID NO: 2871703 - RNA, 16 nt, Human
cuguggcccuggcucu

SEQ ID NO: 2871704 - RNA, 19 nt, Human
cuguggcccuggcucugcu

SEQ ID NO: 2871705 - RNA, 13 nt, Human
cuguggcccuguc

SEQ ID NO: 2871706 - RNA, 14 nt, Human
cuguggcccugucc

SEQ ID NO: 2871707 - RNA, 15 nt, Human
cuguggcccuguccu

SEQ ID NO: 2871708 - RNA, 22 nt, Human
cuguggagguacacucuuauag

SEQ ID NO: 2871709 - RNA, 20 nt, Human
cuguggauacccuuacccuu

SEQ ID NO: 2871710 - RNA, 17 nt, Human
cuguggaugagcccuca

SEQ ID NO: 2871711 - RNA, 15 nt, Human
cuguggaugagcccu

SEQ ID NO: 2871712 - RNA, 21 nt, Human
cugucuuuucagguuugucau

SEQ ID NO: 2871713 - RNA, 15 nt, Human
cuguggagcucagcc

SEQ ID NO: 2871714 - RNA, 16 nt, Human
cuguggagcucagccc

SEQ ID NO: 2871715 - RNA, 17 nt, Human
cuguggagcucagcccc

SEQ ID NO: 2871716 - RNA, 14 nt, Human
cuguggaggaagga

SEQ ID NO: 2871717 - RNA, 15 nt, Human
cuguggaggaaggau

SEQ ID NO: 2871718 - RNA, 14 nt, Human
cuguggagacuggg

SEQ ID NO: 2871719 - RNA, 16 nt, Human
cuguggaggaaggauu

SEQ ID NO: 2871720 - RNA, 17 nt, Human
cuguggaggaaggauug

SEQ ID NO: 2871721 - RNA, 19 nt, Human
cuguggaggaaggauugua

SEQ ID NO: 2871722 - RNA, 20 nt, Human
cuguggaggaaggauuguaa

SEQ ID NO: 2871723 - RNA, 21 nt, Human
cuguggaggaaggauuguaaa

SEQ ID NO: 2871724 - RNA, 22 nt, Human
cuguggaggaaggauuguaaaa

SEQ ID NO: 2871725 - RNA, 23 nt, Human
cuguggaggaaggauuguaaaaa

SEQ ID NO: 2871726 - RNA, 17 nt, Human
cuguggaggauugcuau

SEQ ID NO: 2871727 - RNA, 19 nt, Human
cugucuucacagcucugug

SEQ ID NO: 2871728 - RNA, 23 nt, Human
cugucuucacagcucuguguugc

SEQ ID NO: 2871729 - RNA, 22 nt, Human
cugucugagacucacaggaagg

SEQ ID NO: 2871730 - RNA, 13 nt, Human
cugucuucuguau

SEQ ID NO: 2871731 - RNA, 19 nt, Human
cugucuucuguauauaaau

SEQ ID NO: 2871732 - RNA, 21 nt, Human
cugucuucuguauauaaaugg

SEQ ID NO: 2871733 - RNA, 16 nt, Human
cugucuuuaaggaaaa

SEQ ID NO: 2871734 - RNA, 20 nt, Human
cugucuuuacuccucacacu

SEQ ID NO: 2871735 - RNA, 16 nt, Human
cugucuuuaaaagaga

SEQ ID NO: 2871736 - RNA, 17 nt, Human
cugucuuuaaaagagag

SEQ ID NO: 2871737 - RNA, 18 nt, Human
cugucuuuaaaagagaga

SEQ ID NO: 2871738 - RNA, 12 nt, Human
cugucuuguaau

SEQ ID NO: 2871739 - RNA, 13 nt, Human
cugucuuguaaua

SEQ ID NO: 2871740 - RNA, 14 nt, Human
cugucuuguaauau

SEQ ID NO: 2871741 - RNA, 18 nt, Human
cugucuuguaauauuuug

SEQ ID NO: 2871742 - RNA, 19 nt, Human
cugucuuguaauauuuugu

SEQ ID NO: 2871743 - RNA, 20 nt, Human
cugucuuguaauauuuugua

SEQ ID NO: 2871744 - RNA, 22 nt, Human
cugucuuguaauauuuuguauu

SEQ ID NO: 2871745 - RNA, 19 nt, Human
cugucuuuccuaagaccug

SEQ ID NO: 2871746 - RNA, 20 nt, Human
cugucuuuccuaagaccugg

SEQ ID NO: 2871747 - RNA, 23 nt, Human
cugucuuucugagcacacuuuag

SEQ ID NO: 2871748 - RNA, 14 nt, Human
cugucuuuggaaaa

SEQ ID NO: 2871749 - RNA, 20 nt, Human
cugucuuuggaaaaauguuu

SEQ ID NO: 2871750 - RNA, 22 nt, Human
cugucuuuggaaaaauguuugu

SEQ ID NO: 2871751 - RNA, 14 nt, Human
cugucugauuggcu

SEQ ID NO: 2871752 - RNA, 12 nt, Human
cugucugcagcc

SEQ ID NO: 2871753 - RNA, 13 nt, Human
cugucugcagccu

SEQ ID NO: 2871754 - RNA, 15 nt, Human
cugucugcagccuug

SEQ ID NO: 2871755 - RNA, 23 nt, Human
cugucauuugagcagggcucagc

SEQ ID NO: 2871756 - RNA, 20 nt, Human
cugucauuugagcagggcuc

SEQ ID NO: 2871757 - RNA, 22 nt, Human
cugucauuugagcagggcucag

SEQ ID NO: 2871758 - RNA, 21 nt, Human
cugucauuugagcagggcuca

SEQ ID NO: 2871759 - RNA, 15 nt, Human
cugucugcucagaca

SEQ ID NO: 2871760 - RNA, 23 nt, Human
cugucugguuucaccgaggacau

SEQ ID NO: 2871761 - RNA, 16 nt, Human
cugucugguuuuaaca

SEQ ID NO: 2871762 - RNA, 17 nt, Human
cugucugguuuuaacaa

SEQ ID NO: 2871763 - RNA, 18 nt, Human
cugucugguuuuaacaau

SEQ ID NO: 2871764 - RNA, 14 nt, Human
cugucuguaccuaa

SEQ ID NO: 2871765 - RNA, 13 nt, Human
cugucugugaccu

SEQ ID NO: 2871766 - RNA, 14 nt, Human
cugucugugaccug

SEQ ID NO: 2871767 - RNA, 12 nt, Human
cugucuguggcu

SEQ ID NO: 2871768 - RNA, 14 nt, Human
cugugaugcugggc

SEQ ID NO: 2871769 - RNA, 22 nt, Human
cugugaugagcugaucugcgga

SEQ ID NO: 2871770 - RNA, 18 nt, Human
cugugaugagcugaucug

SEQ ID NO: 2871771 - RNA, 16 nt, Human
cugugaugagcugauc

SEQ ID NO: 2871772 - RNA, 15 nt, Human
cugugaugagcugau

SEQ ID NO: 2871773 - RNA, 14 nt, Human
cugugaugagcuga

SEQ ID NO: 2871774 - RNA, 13 nt, Human
cugugaugagcug

SEQ ID NO: 2871775 - RNA, 17 nt, Human
cugugaggccccuggac

SEQ ID NO: 2871776 - RNA, 18 nt, Human
cugugaggccccuggaca

SEQ ID NO: 2871777 - RNA, 16 nt, Human
cugugauugugccuac

SEQ ID NO: 2871778 - RNA, 18 nt, Human
cugugaaaguacauuugg

SEQ ID NO: 2871779 - RNA, 23 nt, Human
cugugaaacuggcacugaauuaa

SEQ ID NO: 2871780 - RNA, 16 nt, Human
cugugaaaugcuggca

SEQ ID NO: 2871781 - RNA, 15 nt, Human
cugugaaacuggcac

SEQ ID NO: 2871782 - RNA, 13 nt, Human
cugugaaaccugu

SEQ ID NO: 2871783 - RNA, 19 nt, Human
cugugaaaccugugaagcu

SEQ ID NO: 2871784 - RNA, 15 nt, Human
cugugaacaggcugg

SEQ ID NO: 2871785 - RNA, 21 nt, Human
cugugaacaggcugggcugcu

SEQ ID NO: 2871786 - RNA, 13 nt, Human
cugugagccccug

SEQ ID NO: 2871787 - RNA, 12 nt, Human
cugugagccuug

SEQ ID NO: 2871788 - RNA, 15 nt, Human
cugugagccuuggcu

SEQ ID NO: 2871789 - RNA, 14 nt, Human
cugugagccccugg

SEQ ID NO: 2871790 - RNA, 15 nt, Human
cugugagccccuggu

SEQ ID NO: 2871791 - RNA, 16 nt, Human
cugugagccccugguc

SEQ ID NO: 2871792 - RNA, 21 nt, Human
cugugagccccugguccugag

SEQ ID NO: 2871793 - RNA, 15 nt, Human
cugugaggccccugg

SEQ ID NO: 2871794 - RNA, 17 nt, Human
cugugagccuuggcugu

SEQ ID NO: 2871795 - RNA, 17 nt, Human
cugugaggaaagcacac

SEQ ID NO: 2871796 - RNA, 20 nt, Human
cugugaggaaagcacacagu

SEQ ID NO: 2871797 - RNA, 16 nt, Human
cugugaggagccccau

SEQ ID NO: 2871798 - RNA, 17 nt, Human
cugugaggagccccauc

SEQ ID NO: 2871799 - RNA, 18 nt, Human
cugugaggagccccaucu

SEQ ID NO: 2871800 - RNA, 19 nt, Human
cugugaggagccccaucug

SEQ ID NO: 2871801 - RNA, 14 nt, Human
cugugccaugugcc

SEQ ID NO: 2871802 - RNA, 22 nt, Human
cugugcagggaggagguggcag

SEQ ID NO: 2871803 - RNA, 15 nt, Human
cugugcagggaggag

SEQ ID NO: 2871804 - RNA, 15 nt, Human
cugugcaaaaaaauu

SEQ ID NO: 2871805 - RNA, 16 nt, Human
cugugcaaaaaaauua

SEQ ID NO: 2871806 - RNA, 16 nt, Human
cugugcaaauccuuga

SEQ ID NO: 2871807 - RNA, 18 nt, Human
cugugcacgcaguggccu

SEQ ID NO: 2871808 - RNA, 19 nt, Human
cugugcacccagaagaaga

SEQ ID NO: 2871809 - RNA, 12 nt, Human
cugugcacgcag

SEQ ID NO: 2871810 - RNA, 17 nt, Human
cugugcacgcaguggcc

SEQ ID NO: 2871811 - RNA, 13 nt, Human
cugugcagggagg

SEQ ID NO: 2871812 - RNA, 15 nt, Human
cugugcagcgcagcu

SEQ ID NO: 2871813 - RNA, 17 nt, Human
cugugcagcgcagcugg

SEQ ID NO: 2871814 - RNA, 21 nt, Human
cugugcagcgcagcuggacuc

SEQ ID NO: 2871815 - RNA, 17 nt, Human
cugugccccaugccugu

SEQ ID NO: 2871816 - RNA, 21 nt, Human
cugugccccaugccuguccag

SEQ ID NO: 2871817 - RNA, 15 nt, Human
cugugccaugugcca

SEQ ID NO: 2871818 - RNA, 20 nt, Human
cugggguggggauagggagc

SEQ ID NO: 2871819 - RNA, 21 nt, Human
cugggguaccaagagacuccu

SEQ ID NO: 2871820 - RNA, 19 nt, Human
cuggggguggggagguguc

SEQ ID NO: 2871821 - RNA, 16 nt, Human
cugggguaccaagaga

SEQ ID NO: 2871822 - RNA, 20 nt, Human
cuggggguucuuucuuccuc

SEQ ID NO: 2871823 - RNA, 23 nt, Human
cuggggguucuuucuuccucugc

SEQ ID NO: 2871824 - RNA, 21 nt, Human
cuggguccuaauuaccagucu

SEQ ID NO: 2871825 - RNA, 18 nt, Human
cuggguccuugcaccccu

SEQ ID NO: 2871826 - RNA, 23 nt, Human
cuggguccuugcaccccucacuc

SEQ ID NO: 2871827 - RNA, 15 nt, Human
cugggguugucagcu

SEQ ID NO: 2871828 - RNA, 18 nt, Human
cugggguugucagcucuc

SEQ ID NO: 2871829 - RNA, 16 nt, Human
cuggguaaaugcaaag

SEQ ID NO: 2871830 - RNA, 16 nt, Human
cuggguaaaugcagcg

SEQ ID NO: 2871831 - RNA, 18 nt, Human
cugguaacaguucauguu

SEQ ID NO: 2871832 - RNA, 16 nt, Human
cugguaaacuauuugu

SEQ ID NO: 2871833 - RNA, 19 nt, Human
cugguaaacuauuugucuu

SEQ ID NO: 2871834 - RNA, 15 nt, Human
cugggcuucaguggc

SEQ ID NO: 2871835 - RNA, 12 nt, Human
cugggcugugug

SEQ ID NO: 2871836 - RNA, 18 nt, Human
cugggcuggggaggaccu

SEQ ID NO: 2871837 - RNA, 19 nt, Human
cugggcugcuacccagaaa

SEQ ID NO: 2871838 - RNA, 15 nt, Human
cugggcugcuggagg

SEQ ID NO: 2871839 - RNA, 22 nt, Human
cugggcuggccaguuggaacca

SEQ ID NO: 2871840 - RNA, 15 nt, Human
cugggcuggccaguu

SEQ ID NO: 2871841 - RNA, 19 nt, Human
cuggggaaagacacugccu

SEQ ID NO: 2871842 - RNA, 18 nt, Human
cuggggaaagacacugcc

SEQ ID NO: 2871843 - RNA, 16 nt, Human
cuggggaaagacacug

SEQ ID NO: 2871844 - RNA, 20 nt, Human
cuggggaaaacuccaccuuc

SEQ ID NO: 2871845 - RNA, 21 nt, Human
cugggauuacaagcgugagcc

SEQ ID NO: 2871846 - RNA, 22 nt, Human
cugggauuacaggcaugugcca

SEQ ID NO: 2871847 - RNA, 18 nt, Human
cugggauuacaggcguga

SEQ ID NO: 2871848 - RNA, 21 nt, Human
cugcuccacccuuggccuguc

SEQ ID NO: 2871849 - RNA, 18 nt, Human
cugcuccaccuuucagcc

SEQ ID NO: 2871850 - RNA, 21 nt, Human
cugcuccaccuuucagcccac

SEQ ID NO: 2871851 - RNA, 24 nt, Human
cugcuccaccuuucagcccacguc

SEQ ID NO: 2871852 - RNA, 20 nt, Human
cugcuccacccuuggccugu

SEQ ID NO: 2871853 - RNA, 16 nt, Human
cugggauggugggcuu

SEQ ID NO: 2871854 - RNA, 17 nt, Human
cugggauggugggcuuc

SEQ ID NO: 2871855 - RNA, 18 nt, Human
cugggauggugggcuuca

SEQ ID NO: 2871856 - RNA, 19 nt, Human
cugggauggugggcuucag

SEQ ID NO: 2871857 - RNA, 20 nt, Human
cugggauggugggcuucagg

SEQ ID NO: 2871858 - RNA, 21 nt, Human
cugggauggugggcuucaggg

SEQ ID NO: 2871859 - RNA, 22 nt, Human
cugggauggugggcuucagggc

SEQ ID NO: 2871860 - RNA, 11 nt, Human
cugcuccaccc

SEQ ID NO: 2871861 - RNA, 16 nt, Human
cugcuccaccacaucc

SEQ ID NO: 2871862 - RNA, 13 nt, Human
cugcuccaccaca

SEQ ID NO: 2871863 - RNA, 11 nt, Human
cugcuccacca

SEQ ID NO: 2871864 - RNA, 19 nt, Human
cugcuccacccuuggccug

SEQ ID NO: 2871865 - RNA, 18 nt, Human
cugcuccacccuuggccu

SEQ ID NO: 2871866 - RNA, 17 nt, Human
cugcuccacccuuggcc

SEQ ID NO: 2871867 - RNA, 16 nt, Human
cugcuccacccuuggc

SEQ ID NO: 2871868 - RNA, 15 nt, Human
cugcuccacccuugg

SEQ ID NO: 2871869 - RNA, 14 nt, Human
cugcuccacccuug

SEQ ID NO: 2871870 - RNA, 13 nt, Human
cugcuccacccuu

SEQ ID NO: 2871871 - RNA, 12 nt, Human
cugcuccacccu

SEQ ID NO: 2871872 - RNA, 21 nt, Human
cugggcaaggaggccacguga

SEQ ID NO: 2871873 - RNA, 15 nt, Human
cugggcaaggaggcc

SEQ ID NO: 2871874 - RNA, 14 nt, Human
cugggauuccuccc

SEQ ID NO: 2871875 - RNA, 19 nt, Human
cugggauuacaggugugca

SEQ ID NO: 2871876 - RNA, 18 nt, Human
cugggcaacagagcaaga

SEQ ID NO: 2871877 - RNA, 15 nt, Human
cugggcaacagagca

SEQ ID NO: 2871878 - RNA, 14 nt, Human
cugggcaaggaaaa

SEQ ID NO: 2871879 - RNA, 15 nt, Human
cugggcaaggaaaaa

SEQ ID NO: 2871880 - RNA, 17 nt, Human
cugggcaaggaaaaaga

SEQ ID NO: 2871881 - RNA, 18 nt, Human
cugggcaaggaaaaagaa

SEQ ID NO: 2871882 - RNA, 19 nt, Human
cugggcaaggaaaaagaaa

SEQ ID NO: 2871883 - RNA, 22 nt, Human
cugggcaaggaaaaagaaaaua

SEQ ID NO: 2871884 - RNA, 17 nt, Human
cugggauuuacacuuga

SEQ ID NO: 2871885 - RNA, 21 nt, Human
cugggauuuaugcucaugaac

SEQ ID NO: 2871886 - RNA, 17 nt, Human
cugggauuuuaaacuag

SEQ ID NO: 2871887 - RNA, 21 nt, Human
cugggauuuuaaacuagauga

SEQ ID NO: 2871888 - RNA, 22 nt, Human
cugggauuuuaaacuagaugac

SEQ ID NO: 2871889 - RNA, 23 nt, Human
cugggauuuuaaacuagaugacc

SEQ ID NO: 2871890 - RNA, 20 nt, Human
cugggccuccucacaacaug

SEQ ID NO: 2871891 - RNA, 17 nt, Human
cugggccuguugcccuu

SEQ ID NO: 2871892 - RNA, 11 nt, Human
cugggccuggg

SEQ ID NO: 2871893 - RNA, 12 nt, Human
cugggccugggc

SEQ ID NO: 2871894 - RNA, 13 nt, Human
cugggccugggcu

SEQ ID NO: 2871895 - RNA, 16 nt, Human
cugggccugggcuagg

SEQ ID NO: 2871896 - RNA, 16 nt, Human
cugggcucggaggcug

SEQ ID NO: 2871897 - RNA, 17 nt, Human
cugggcucggaggcugc

SEQ ID NO: 2871898 - RNA, 18 nt, Human
cugggcucggaggcugcc

SEQ ID NO: 2871899 - RNA, 21 nt, Human
cugggcucggaggcugccccc

SEQ ID NO: 2871900 - RNA, 21 nt, Human
cugggcuccuaaccuuccugu

SEQ ID NO: 2871901 - RNA, 13 nt, Human
cugggcucggagg

SEQ ID NO: 2871902 - RNA, 15 nt, Human
cugggcucggaggcu

SEQ ID NO: 2871903 - RNA, 23 nt, Human
cugggcucugccccagcucuggc

SEQ ID NO: 2871904 - RNA, 14 nt, Human
cugggcucugguuu

SEQ ID NO: 2871905 - RNA, 12 nt, Human
cugggcucuguc

SEQ ID NO: 2871906 - RNA, 18 nt, Human
cugggcucugccccagcu

SEQ ID NO: 2871907 - RNA, 17 nt, Human
cugggcucugccccagc

SEQ ID NO: 2871908 - RNA, 13 nt, Human
cugggcucugccc

SEQ ID NO: 2871909 - RNA, 22 nt, Human
cugggcucugcaauuccccucu

SEQ ID NO: 2871910 - RNA, 23 nt, Human
cugggcucugcaauuccccucug

SEQ ID NO: 2871911 - RNA, 16 nt, Human
cuggugucaccccaga

SEQ ID NO: 2871912 - RNA, 17 nt, Human
cuggugucaccccagag

SEQ ID NO: 2871913 - RNA, 18 nt, Human
cuggugucaccccagagc

SEQ ID NO: 2871914 - RNA, 19 nt, Human
cuggugucaccccagagcc

SEQ ID NO: 2871915 - RNA, 20 nt, Human
cuggugucaccccagagcca

SEQ ID NO: 2871916 - RNA, 22 nt, Human
cuggugucaccccagagccaca

SEQ ID NO: 2871917 - RNA, 23 nt, Human
cuggugucaccccagagccacac

SEQ ID NO: 2871918 - RNA, 20 nt, Human
cugguauugguggcuuuccu

SEQ ID NO: 2871919 - RNA, 18 nt, Human
cugguggcagugggagcu

SEQ ID NO: 2871920 - RNA, 14 nt, Human
cugguggcaguggg

SEQ ID NO: 2871921 - RNA, 15 nt, Human
cugguggcagcugcg

SEQ ID NO: 2871922 - RNA, 14 nt, Human
cugguauuccugcc

SEQ ID NO: 2871923 - RNA, 15 nt, Human
cugguauuccugccu

SEQ ID NO: 2871924 - RNA, 17 nt, Human
cugguauuccugccucc

SEQ ID NO: 2871925 - RNA, 13 nt, Human
cugguauggcugc

SEQ ID NO: 2871926 - RNA, 15 nt, Human
cugguauggcugcag

SEQ ID NO: 2871927 - RNA, 16 nt, Human
cugguauggcugcagu

SEQ ID NO: 2871928 - RNA, 17 nt, Human
cugguauggcugcaguc

SEQ ID NO: 2871929 - RNA, 18 nt, Human
cugguauggcugcagucc

SEQ ID NO: 2871930 - RNA, 23 nt, Human
cugguuaauauuuauaggucacu

SEQ ID NO: 2871931 - RNA, 13 nt, Human
cugguuagcagag

SEQ ID NO: 2871932 - RNA, 23 nt, Human
cugguuagaaaugcagaauccua

SEQ ID NO: 2871933 - RNA, 14 nt, Human
cugguuagaaaugc

SEQ ID NO: 2871934 - RNA, 14 nt, Human
cuguaaucccagcu

SEQ ID NO: 2871935 - RNA, 13 nt, Human
cuguaaucccagc

SEQ ID NO: 2871936 - RNA, 17 nt, Human
cuguaaucccagcacuu

SEQ ID NO: 2871937 - RNA, 18 nt, Human
cuguaaucccagcacacu

SEQ ID NO: 2871938 - RNA, 22 nt, Human
cuguaaucccagcuacucggga

SEQ ID NO: 2871939 - RNA, 19 nt, Human
cuguaaucccagcuacucg

SEQ ID NO: 2871940 - RNA, 14 nt, Human
cuguaauucagugu

SEQ ID NO: 2871941 - RNA, 23 nt, Human
cuguaauucaguguauuucaguu

SEQ ID NO: 2871942 - RNA, 18 nt, Human
cuguacgucugacaggca

SEQ ID NO: 2871943 - RNA, 16 nt, Human
cuguacgucugacagg

SEQ ID NO: 2871944 - RNA, 15 nt, Human
cuguacgucugacag

SEQ ID NO: 2871945 - RNA, 14 nt, Human
cuguacgucugaca

SEQ ID NO: 2871946 - RNA, 13 nt, Human
cuguaauuuaguu

SEQ ID NO: 2871947 - RNA, 16 nt, Human
cuguaauuuaguuauu

SEQ ID NO: 2871948 - RNA, 19 nt, Human
cuguaauuuaguuauugau

SEQ ID NO: 2871949 - RNA, 15 nt, Human
cuguacauauguaaa

SEQ ID NO: 2871950 - RNA, 16 nt, Human
cuguacauauguaaac

SEQ ID NO: 2871951 - RNA, 20 nt, Human
cuguacgucugacaggcaau

SEQ ID NO: 2871952 - RNA, 19 nt, Human
cuguacgucugacaggcaa

SEQ ID NO: 2871953 - RNA, 22 nt, Human
cuguacuaaaguaacgcaauaa

SEQ ID NO: 2871954 - RNA, 17 nt, Human
cuguacuaauucuuaca

SEQ ID NO: 2871955 - RNA, 23 nt, Human
cuguaccuuuugaggagccccag

SEQ ID NO: 2871956 - RNA, 20 nt, Human
cuguacauauuugagacuag

SEQ ID NO: 2871957 - RNA, 14 nt, Human
cuguacaucuauuu

SEQ ID NO: 2871958 - RNA, 13 nt, Human
cuguacucaggag

SEQ ID NO: 2871959 - RNA, 14 nt, Human
cuguacuccuccca

SEQ ID NO: 2871960 - RNA, 22 nt, Human
cuguaguuaggaaauaaaaccu

SEQ ID NO: 2871961 - RNA, 21 nt, Human
cuguaguuaggaaauaaaacc

SEQ ID NO: 2871962 - RNA, 20 nt, Human
cuguacucaggaggcugagg

SEQ ID NO: 2871963 - RNA, 20 nt, Human
cuguaguugcguggacucug

SEQ ID NO: 2871964 - RNA, 19 nt, Human
cuguaguucuaagacucaa

SEQ ID NO: 2871965 - RNA, 13 nt, Human
cuguaguucuaag

SEQ ID NO: 2871966 - RNA, 14 nt, Human
cuguaguucuaaga

SEQ ID NO: 2871967 - RNA, 16 nt, Human
cuguaguucuaagacu

SEQ ID NO: 2871968 - RNA, 15 nt, Human
cuguacuccucccag

SEQ ID NO: 2871969 - RNA, 16 nt, Human
cuguacuccucccagg

SEQ ID NO: 2871970 - RNA, 19 nt, Human
cuguacuccucccaggcgc

SEQ ID NO: 2871971 - RNA, 21 nt, Human
cuguacuccucccaggcgccc

SEQ ID NO: 2871972 - RNA, 19 nt, Human
cuguaucccaugagccuca

SEQ ID NO: 2871973 - RNA, 14 nt, Human
cuguauaaauagga

SEQ ID NO: 2871974 - RNA, 15 nt, Human
cuguauaaauaggag

SEQ ID NO: 2871975 - RNA, 16 nt, Human
cuguauaaauaggaga

SEQ ID NO: 2871976 - RNA, 19 nt, Human
cuguauaaauaggagagga

SEQ ID NO: 2871977 - RNA, 20 nt, Human
cuguaucccaugagccucag

SEQ ID NO: 2871978 - RNA, 13 nt, Human
cuguauaaauagg

SEQ ID NO: 2871979 - RNA, 18 nt, Human
cuguauaaacauuaaaug

SEQ ID NO: 2871980 - RNA, 19 nt, Human
cuguauaaacauuaaaugu

SEQ ID NO: 2871981 - RNA, 20 nt, Human
cuguauaaacauuaaauguc

SEQ ID NO: 2871982 - RNA, 21 nt, Human
cuguauaaacauuaaaugucu

SEQ ID NO: 2871983 - RNA, 17 nt, Human
cuguaguuuuauuuuau

SEQ ID NO: 2871984 - RNA, 18 nt, Human
cuguaguuuuauuuuaug

SEQ ID NO: 2871985 - RNA, 20 nt, Human
cuguaguuuuauuuuauguu

SEQ ID NO: 2871986 - RNA, 22 nt, Human
cuguaguuuuauuuuauguuua

SEQ ID NO: 2871987 - RNA, 24 nt, Human
cuguaguuuuauuuuauguuuaga

SEQ ID NO: 2871988 - RNA, 22 nt, Human
cuguaucccaugagccucagca

SEQ ID NO: 2871989 - RNA, 21 nt, Human
cuguaucccaugagccucagc

SEQ ID NO: 2871990 - RNA, 17 nt, Human
cuguauuagucacagag

SEQ ID NO: 2871991 - RNA, 19 nt, Human
cuguauuagucacagagau

SEQ ID NO: 2871992 - RNA, 18 nt, Human
cuguauuuuuaaagcaug

SEQ ID NO: 2871993 - RNA, 20 nt, Human
cuguauuuuuucuugcauug

SEQ ID NO: 2871994 - RNA, 21 nt, Human
cuguauuuuuucuugcauuga

SEQ ID NO: 2871995 - RNA, 22 nt, Human
cuguauuuuuucuugcauugac

SEQ ID NO: 2871996 - RNA, 23 nt, Human
cuguauuuuuucuugcauugaca

SEQ ID NO: 2871997 - RNA, 14 nt, Human
cuguauuuaagcaa

SEQ ID NO: 2871998 - RNA, 15 nt, Human
cuguauuuaagcaaa

SEQ ID NO: 2871999 - RNA, 16 nt, Human
cuguauuuaagcaaau

SEQ ID NO: 2872000 - RNA, 17 nt, Human
cuguauuuaagcaaaua

SEQ ID NO: 2872001 - RNA, 21 nt, Human
cuguauugugcugauugugga

SEQ ID NO: 2872002 - RNA, 19 nt, Human
cugucaaaacaaguuuuuc

SEQ ID NO: 2872003 - RNA, 21 nt, Human
cugucaaaacaaguuuuucug

SEQ ID NO: 2872004 - RNA, 14 nt, Human
cugucaaaacacug

SEQ ID NO: 2872005 - RNA, 15 nt, Human
cugucaaaacacugu

SEQ ID NO: 2872006 - RNA, 16 nt, Human
cugucaaaacacugug

SEQ ID NO: 2872007 - RNA, 17 nt, Human
cugucaaaacacugugg

SEQ ID NO: 2872008 - RNA, 18 nt, Human
cugucaaaacacugugga

SEQ ID NO: 2872009 - RNA, 19 nt, Human
cugucaaaacacuguggaa

SEQ ID NO: 2872010 - RNA, 20 nt, Human
cugucaaaacacuguggaac

SEQ ID NO: 2872011 - RNA, 21 nt, Human
cugucaaaaguuggacuaaau

SEQ ID NO: 2872012 - RNA, 18 nt, Human
gaacggugaaggugacag

SEQ ID NO: 2872013 - RNA, 13 nt, Human
gaacguaaagaac

SEQ ID NO: 2872014 - RNA, 16 nt, Human
gaacgggguccuucaa

SEQ ID NO: 2872015 - RNA, 22 nt, Human
gaacuauuggagggugggagag

SEQ ID NO: 2872016 - RNA, 15 nt, Human
gaacuauuggagggu

SEQ ID NO: 2872017 - RNA, 21 nt, Human
gaacuauggacggugcuccag

SEQ ID NO: 2872018 - RNA, 17 nt, Human
gaacuauggacggugcu

SEQ ID NO: 2872019 - RNA, 18 nt, Human
gaacuagcauauagccau

SEQ ID NO: 2872020 - RNA, 21 nt, Human
gaacuagcauauagccauuga

SEQ ID NO: 2872021 - RNA, 15 nt, Human
gaacuauaaagaagu

SEQ ID NO: 2872022 - RNA, 19 nt, Human
gaacuauaacaccugccac

SEQ ID NO: 2872023 - RNA, 16 nt, Human
gaacuagggaagcuca

SEQ ID NO: 2872024 - RNA, 23 nt, Human
gaacggagccccaggccucugug

SEQ ID NO: 2872025 - RNA, 22 nt, Human
gaacggagccccaggccucugu

SEQ ID NO: 2872026 - RNA, 21 nt, Human
gaaccuucuggccucccacag

SEQ ID NO: 2872027 - RNA, 13 nt, Human
gaaccuugcuguc

SEQ ID NO: 2872028 - RNA, 14 nt, Human
gaaccuugcugucc

SEQ ID NO: 2872029 - RNA, 15 nt, Human
gaaccuugcuguccu

SEQ ID NO: 2872030 - RNA, 16 nt, Human
gaaccuugcuguccug

SEQ ID NO: 2872031 - RNA, 17 nt, Human
gaaccuugcuguccuga

SEQ ID NO: 2872032 - RNA, 18 nt, Human
gaaccuucuggccuccca

SEQ ID NO: 2872033 - RNA, 19 nt, Human
gaaccuuccuuccugcuug

SEQ ID NO: 2872034 - RNA, 15 nt, Human
gaaccuuccuuccug

SEQ ID NO: 2872035 - RNA, 12 nt, Human
gaaccugugagu

SEQ ID NO: 2872036 - RNA, 17 nt, Human
gaaccugugaguaaaua

SEQ ID NO: 2872037 - RNA, 22 nt, Human
gaaccugugaguaaauauugag

SEQ ID NO: 2872038 - RNA, 16 nt, Human
gaaccuguccuaagga

SEQ ID NO: 2872039 - RNA, 12 nt, Human
gaacagaaggau

SEQ ID NO: 2872040 - RNA, 22 nt, Human
gaacacuuauaagugaagugau

SEQ ID NO: 2872041 - RNA, 12 nt, Human
gaacagaauguu

SEQ ID NO: 2872042 - RNA, 14 nt, Human
gaacagaauguuuu

SEQ ID NO: 2872043 - RNA, 15 nt, Human
gaacagaauguuuua

SEQ ID NO: 2872044 - RNA, 19 nt, Human
gaacagaaggaugaaugag

SEQ ID NO: 2872045 - RNA, 14 nt, Human
gaacagaaggauga

SEQ ID NO: 2872046 - RNA, 19 nt, Human
gaacagacaacagaaguca

SEQ ID NO: 2872047 - RNA, 18 nt, Human
gaacagacaacagaaguc

SEQ ID NO: 2872048 - RNA, 17 nt, Human
gaacagacaacagaagu

SEQ ID NO: 2872049 - RNA, 21 nt, Human
gaaccacaucuugcucugcug

SEQ ID NO: 2872050 - RNA, 20 nt, Human
gaaccacaucuugcucugcu

SEQ ID NO: 2872051 - RNA, 16 nt, Human
gaacagacuggaagca

SEQ ID NO: 2872052 - RNA, 15 nt, Human
gaacagacuggaagc

SEQ ID NO: 2872053 - RNA, 17 nt, Human
gaaccaccacacccagc

SEQ ID NO: 2872054 - RNA, 16 nt, Human
gaaccaccacacccag

SEQ ID NO: 2872055 - RNA, 12 nt, Human
gaaccguugcca

SEQ ID NO: 2872056 - RNA, 16 nt, Human
gaaccgcucaccuaga

SEQ ID NO: 2872057 - RNA, 17 nt, Human
gaaccgcucaccuagag

SEQ ID NO: 2872058 - RNA, 18 nt, Human
gaaccgcucaccuagagc

SEQ ID NO: 2872059 - RNA, 20 nt, Human
gaaccgcucaccuagagcca

SEQ ID NO: 2872060 - RNA, 22 nt, Human
gaaccgcucaccuagagccaga

SEQ ID NO: 2872061 - RNA, 19 nt, Human
gaacagaccggagaggaca

SEQ ID NO: 2872062 - RNA, 12 nt, Human
gaaccuaacugu

SEQ ID NO: 2872063 - RNA, 14 nt, Human
gaaccuaacuguau

SEQ ID NO: 2872064 - RNA, 16 nt, Human
gaaccuaacuguaucu

SEQ ID NO: 2872065 - RNA, 17 nt, Human
gaaccuaacuguaucuu

SEQ ID NO: 2872066 - RNA, 20 nt, Human
gaaccuaacuguaucuugag

SEQ ID NO: 2872067 - RNA, 14 nt, Human
gaaccuaauacccu

SEQ ID NO: 2872068 - RNA, 18 nt, Human
gaaccguuuugaagcuac

SEQ ID NO: 2872069 - RNA, 17 nt, Human
gaaccguuuugaagcua

SEQ ID NO: 2872070 - RNA, 19 nt, Human
gaaccguuuugaagcuacu

SEQ ID NO: 2872071 - RNA, 11 nt, Human
gaaccugaccc

SEQ ID NO: 2872072 - RNA, 17 nt, Human
gaaccucuuccccagaa

SEQ ID NO: 2872073 - RNA, 12 nt, Human
gaaccugacccc

SEQ ID NO: 2872074 - RNA, 16 nt, Human
gaaccugcaaaaaaua

SEQ ID NO: 2872075 - RNA, 19 nt, Human
gaacucaaacuucuggcuc

SEQ ID NO: 2872076 - RNA, 22 nt, Human
gaacuggguacuuguggacaca

SEQ ID NO: 2872077 - RNA, 17 nt, Human
gaacugggccuguugcc

SEQ ID NO: 2872078 - RNA, 12 nt, Human
gaacuggguaaa

SEQ ID NO: 2872079 - RNA, 16 nt, Human
gaacuggguaaaugca

SEQ ID NO: 2872080 - RNA, 19 nt, Human
gaacuggguaaaugcaaag

SEQ ID NO: 2872081 - RNA, 18 nt, Human
gaacuguagaugauguau

SEQ ID NO: 2872082 - RNA, 13 nt, Human
gaacuguccagag

SEQ ID NO: 2872083 - RNA, 22 nt, Human
gaacuguccagagagcaacucu

SEQ ID NO: 2872084 - RNA, 18 nt, Human
gaacugucggaggaaaga

SEQ ID NO: 2872085 - RNA, 20 nt, Human
gaacugucggaggaaagaca

SEQ ID NO: 2872086 - RNA, 14 nt, Human
gaacuguccagaga

SEQ ID NO: 2872087 - RNA, 15 nt, Human
gaacuguccagagag

SEQ ID NO: 2872088 - RNA, 16 nt, Human
gaacuguccagagagc

SEQ ID NO: 2872089 - RNA, 17 nt, Human
gaacuguccagagagca

SEQ ID NO: 2872090 - RNA, 15 nt, Human
gaacuuauucuguag

SEQ ID NO: 2872091 - RNA, 15 nt, Human
gaacuucaccugcaa

SEQ ID NO: 2872092 - RNA, 17 nt, Human
gaacuucaccugcaaag

SEQ ID NO: 2872093 - RNA, 19 nt, Human
gaacuucaccugcaaagcu

SEQ ID NO: 2872094 - RNA, 20 nt, Human
gaacuucaccugcaaagcuc

SEQ ID NO: 2872095 - RNA, 18 nt, Human
gaacugugcauagugcug

SEQ ID NO: 2872096 - RNA, 19 nt, Human
gaacugugcauagugcugg

SEQ ID NO: 2872097 - RNA, 22 nt, Human
gaacugugcauagugcugggau

SEQ ID NO: 2872098 - RNA, 15 nt, Human
gaacuuacuauucau

SEQ ID NO: 2872099 - RNA, 21 nt, Human
gaacuuacuauucauuaaaug

SEQ ID NO: 2872100 - RNA, 18 nt, Human
gaacuguccagagagcaa

SEQ ID NO: 2872101 - RNA, 20 nt, Human
gaacuuauccuaaaacaaau

SEQ ID NO: 2872102 - RNA, 17 nt, Human
gaacuugaaugugucag

SEQ ID NO: 2872103 - RNA, 23 nt, Human
gaacuuccagguguuacuguaau

SEQ ID NO: 2872104 - RNA, 12 nt, Human
gaacuugcaugg

SEQ ID NO: 2872105 - RNA, 21 nt, Human
gaacuugcagcugauguugga

SEQ ID NO: 2872106 - RNA, 19 nt, Human
gaacuuggaaagaaaugcc

SEQ ID NO: 2872107 - RNA, 13 nt, Human
gaagaagaugcuc

SEQ ID NO: 2872108 - RNA, 15 nt, Human
gaagaagagccacag

SEQ ID NO: 2872109 - RNA, 14 nt, Human
gaagaagagccaca

SEQ ID NO: 2872110 - RNA, 16 nt, Human
gaagaacuugcaugga

SEQ ID NO: 2872111 - RNA, 9 nt, Human
gaagaagaa

SEQ ID NO: 2872112 - RNA, 13 nt, Human
gaagaagaaaaaa

SEQ ID NO: 2872113 - RNA, 14 nt, Human
gaagaagaaaaaaa

SEQ ID NO: 2872114 - RNA, 16 nt, Human
gaagaagaaaaaaacg

SEQ ID NO: 2872115 - RNA, 12 nt, Human
gaagaagaaaag

SEQ ID NO: 2872116 - RNA, 14 nt, Human
gaagaagaaaagag

SEQ ID NO: 2872117 - RNA, 15 nt, Human
gaagaagaaaagaga

SEQ ID NO: 2872118 - RNA, 13 nt, Human
gaagaagaagaaa

SEQ ID NO: 2872119 - RNA, 14 nt, Human
gaagaagaagaaaa

SEQ ID NO: 2872120 - RNA, 15 nt, Human
gaagaagaagaaaag

SEQ ID NO: 2872121 - RNA, 15 nt, Human
gaagaagaagaagaa

SEQ ID NO: 2872122 - RNA, 16 nt, Human
gaagaagagaagcugc

SEQ ID NO: 2872123 - RNA, 17 nt, Human
gaagaagagaagcugcu

SEQ ID NO: 2872124 - RNA, 19 nt, Human
gaagaagagaagcugcuga

SEQ ID NO: 2872125 - RNA, 17 nt, Human
gaagaaacacuuucucu

SEQ ID NO: 2872126 - RNA, 18 nt, Human
gaagaaacacuuucucuu

SEQ ID NO: 2872127 - RNA, 14 nt, Human
gaagaaacagaaga

SEQ ID NO: 2872128 - RNA, 15 nt, Human
gaacuuggaggcacc

SEQ ID NO: 2872129 - RNA, 17 nt, Human
gaacuuggaggcaccau

SEQ ID NO: 2872130 - RNA, 9 nt, Human
gaagaaaag

SEQ ID NO: 2872131 - RNA, 11 nt, Human
gaagaaaagag

SEQ ID NO: 2872132 - RNA, 17 nt, Human
gaagaaaagagaagaag

SEQ ID NO: 2872133 - RNA, 19 nt, Human
gaagaaaagagaagaagaa

SEQ ID NO: 2872134 - RNA, 16 nt, Human
gaagaaaaugguuuau

SEQ ID NO: 2872135 - RNA, 16 nt, Human
gaaauauugcuggggu

SEQ ID NO: 2872136 - RNA, 14 nt, Human
gaaauauugcugua

SEQ ID NO: 2872137 - RNA, 18 nt, Human
gaaauauugcuguauagc

SEQ ID NO: 2872138 - RNA, 16 nt, Human
gaaauggauacuacau

SEQ ID NO: 2872139 - RNA, 21 nt, Human
gaaauggauacuacaucuuua

SEQ ID NO: 2872140 - RNA, 17 nt, Human
gaaauggaugcaaagua

SEQ ID NO: 2872141 - RNA, 20 nt, Human
gaaauggacugguuugagau

SEQ ID NO: 2872142 - RNA, 21 nt, Human
gaaauguuaaagguucacagg

SEQ ID NO: 2872143 - RNA, 14 nt, Human
gaaauguaaacugc

SEQ ID NO: 2872144 - RNA, 16 nt, Human
gaaauguaaacugcca

SEQ ID NO: 2872145 - RNA, 16 nt, Human
gaaauucuaaagagca

SEQ ID NO: 2872146 - RNA, 17 nt, Human
gaaauuacacccaaaga

SEQ ID NO: 2872147 - RNA, 20 nt, Human
gaaauuaaaacuauucaugc

SEQ ID NO: 2872148 - RNA, 13 nt, Human
gaaauuaaaguuu

SEQ ID NO: 2872149 - RNA, 22 nt, Human
gaaauuaagaaggcaaaaaugu

SEQ ID NO: 2872150 - RNA, 18 nt, Human
gaaauuaagaaggcaaaa

SEQ ID NO: 2872151 - RNA, 17 nt, Human
gaaauuaagaaggcaaa

SEQ ID NO: 2872152 - RNA, 14 nt, Human
gaaauuggcuggau

SEQ ID NO: 2872153 - RNA, 15 nt, Human
gaaauuggcuggaug

SEQ ID NO: 2872154 - RNA, 17 nt, Human
gaaauuggaacagaaug

SEQ ID NO: 2872155 - RNA, 22 nt, Human
gaaauuggaacagaauguuuua

SEQ ID NO: 2872156 - RNA, 20 nt, Human
gaaauugccuauccugcugu

SEQ ID NO: 2872157 - RNA, 21 nt, Human
gaaauugccuauccugcuguu

SEQ ID NO: 2872158 - RNA, 19 nt, Human
gaaauugcauuuccugaca

SEQ ID NO: 2872159 - RNA, 21 nt, Human
gaaauugacacaaguggaccu

SEQ ID NO: 2872160 - RNA, 11 nt, Human
gaaauucuguu

SEQ ID NO: 2872161 - RNA, 15 nt, Human
gaaauucuguuaaaa

SEQ ID NO: 2872162 - RNA, 18 nt, Human
gaaauucuguuaaaaucu

SEQ ID NO: 2872163 - RNA, 24 nt, Human
gaaauucuguuaaaaucuauucug

SEQ ID NO: 2872164 - RNA, 16 nt, Human
gaaauucuuucagcua

SEQ ID NO: 2872165 - RNA, 18 nt, Human
gaaauuuucuagacuuuc

SEQ ID NO: 2872166 - RNA, 20 nt, Human
gaaauuuucuagacuuucug

SEQ ID NO: 2872167 - RNA, 21 nt, Human
gaaauuugauuucuauucaag

SEQ ID NO: 2872168 - RNA, 21 nt, Human
gaaauuuucuagacuuucugu

SEQ ID NO: 2872169 - RNA, 16 nt, Human
gaaauuuucuugauuu

SEQ ID NO: 2872170 - RNA, 20 nt, Human
gaaauuuucuugauuugagu

SEQ ID NO: 2872171 - RNA, 13 nt, Human
gaaauuuugcaaa

SEQ ID NO: 2872172 - RNA, 15 nt, Human
gaaauuuugcaaaua

SEQ ID NO: 2872173 - RNA, 16 nt, Human
gaaauuuugcaaauau

SEQ ID NO: 2872174 - RNA, 17 nt, Human
gaaauuuugcaaauaua

SEQ ID NO: 2872175 - RNA, 19 nt, Human
gaaauuuugcaaauauaaa

SEQ ID NO: 2872176 - RNA, 21 nt, Human
gaaauuuugcaaauauaaaca

SEQ ID NO: 2872177 - RNA, 22 nt, Human
gaaauuuugcaaauauaaacau

SEQ ID NO: 2872178 - RNA, 21 nt, Human
gaacacugcccucgcacggcc

SEQ ID NO: 2872179 - RNA, 19 nt, Human
gaacacuggcagacugugu

SEQ ID NO: 2872180 - RNA, 22 nt, Human
gaacacuggcagacuguguaaa

SEQ ID NO: 2872181 - RNA, 13 nt, Human
gaaauuuacuaua

SEQ ID NO: 2872182 - RNA, 15 nt, Human
gaaauuugauuucua

SEQ ID NO: 2872183 - RNA, 14 nt, Human
gaaauuugauuucu

SEQ ID NO: 2872184 - RNA, 21 nt, Human
gaaauugucuagcagagcagg

SEQ ID NO: 2872185 - RNA, 13 nt, Human
gaaauugugaacu

SEQ ID NO: 2872186 - RNA, 18 nt, Human
gaaauugugaacucauug

SEQ ID NO: 2872187 - RNA, 20 nt, Human
gaaauugucuagcagagcag

SEQ ID NO: 2872188 - RNA, 15 nt, Human
gaaauuuaaacauua

SEQ ID NO: 2872189 - RNA, 14 nt, Human
gaaacauuuauauu

SEQ ID NO: 2872190 - RNA, 19 nt, Human
gaaacauuuauauuuuuau

SEQ ID NO: 2872191 - RNA, 12 nt, Human
gaaacauuuaua

SEQ ID NO: 2872192 - RNA, 19 nt, Human
gaaauaaaguuaaguuugu

SEQ ID NO: 2872193 - RNA, 17 nt, Human
gaaauaaaguuugcuua

SEQ ID NO: 2872194 - RNA, 13 nt, Human
gaaacaugacacu

SEQ ID NO: 2872195 - RNA, 16 nt, Human
gaaacaugacacugac

SEQ ID NO: 2872196 - RNA, 17 nt, Human
gaaacaugacacugacc

SEQ ID NO: 2872197 - RNA, 20 nt, Human
gaaacaugacucguauaugu

SEQ ID NO: 2872198 - RNA, 15 nt, Human
gaaauaauaugcauu

SEQ ID NO: 2872199 - RNA, 18 nt, Human
gaaauaauagaaugagca

SEQ ID NO: 2872200 - RNA, 19 nt, Human
gaaauaauguacaucuggc

SEQ ID NO: 2872201 - RNA, 13 nt, Human
gaaauaauaauau

SEQ ID NO: 2872202 - RNA, 16 nt, Human
gaaauaauaauaucca

SEQ ID NO: 2872203 - RNA, 13 nt, Human
gaaauaauaugca

SEQ ID NO: 2872204 - RNA, 14 nt, Human
gaaauaauaugcau

SEQ ID NO: 2872205 - RNA, 15 nt, Human
gaaauaacaauguua

SEQ ID NO: 2872206 - RNA, 16 nt, Human
gaaauaacaauguuaa

SEQ ID NO: 2872207 - RNA, 17 nt, Human
gaaauaacaauguuaag

SEQ ID NO: 2872208 - RNA, 18 nt, Human
gaaauaacaauguuaagg

SEQ ID NO: 2872209 - RNA, 20 nt, Human
gaaauaacaauguuaaggaa

SEQ ID NO: 2872210 - RNA, 21 nt, Human
gaaauaaauguaucauagaaa

SEQ ID NO: 2872211 - RNA, 15 nt, Human
gaaauaacaaaaugg

SEQ ID NO: 2872212 - RNA, 16 nt, Human
gaaauaacaaaaugga

SEQ ID NO: 2872213 - RNA, 17 nt, Human
gaaauaacaaaauggac

SEQ ID NO: 2872214 - RNA, 18 nt, Human
gaaauaacaaaauggaca

SEQ ID NO: 2872215 - RNA, 19 nt, Human
gaaauaacaaaauggacau

SEQ ID NO: 2872216 - RNA, 13 nt, Human
gaaauaugcaucu

SEQ ID NO: 2872217 - RNA, 14 nt, Human
gaaauaugcucuuu

SEQ ID NO: 2872218 - RNA, 18 nt, Human
gaaauaugcucuuuuguu

SEQ ID NO: 2872219 - RNA, 13 nt, Human
gaaauaugugaga

SEQ ID NO: 2872220 - RNA, 14 nt, Human
gaaauaugugagau

SEQ ID NO: 2872221 - RNA, 15 nt, Human
gaaauaugugagauu

SEQ ID NO: 2872222 - RNA, 21 nt, Human
gaaauaugugagauuuuuuau

SEQ ID NO: 2872223 - RNA, 15 nt, Human
gaaauagucugugug

SEQ ID NO: 2872224 - RNA, 17 nt, Human
gaaauagucugugugaa

SEQ ID NO: 2872225 - RNA, 14 nt, Human
gaaauauaauaaaa

SEQ ID NO: 2872226 - RNA, 15 nt, Human
gaaauauaauaaaau

SEQ ID NO: 2872227 - RNA, 20 nt, Human
gaaauauaauaaaauguguu

SEQ ID NO: 2872228 - RNA, 14 nt, Human
gaaauaggaaacaa

SEQ ID NO: 2872229 - RNA, 15 nt, Human
gaaauaggaaacaag

SEQ ID NO: 2872230 - RNA, 18 nt, Human
gaaauaggaaacaaguga

SEQ ID NO: 2872231 - RNA, 15 nt, Human
gaaauagguuagagu

SEQ ID NO: 2872232 - RNA, 14 nt, Human
gaaauacuauuuaa

SEQ ID NO: 2872233 - RNA, 15 nt, Human
gaaauacuauuuaaa

SEQ ID NO: 2872234 - RNA, 21 nt, Human
gaaauacaauucuacauuguc

SEQ ID NO: 2872235 - RNA, 14 nt, Human
gaaauacccuucuu

SEQ ID NO: 2872236 - RNA, 21 nt, Human
gaaauacccuucuuuuaugag

SEQ ID NO: 2872237 - RNA, 22 nt, Human
gaaauacccuucuuuuaugagc

SEQ ID NO: 2872238 - RNA, 11 nt, Human
gaaauaccuca

SEQ ID NO: 2872239 - RNA, 12 nt, Human
gaaauaccucau

SEQ ID NO: 2872240 - RNA, 16 nt, Human
gaaauaccucauguuu

SEQ ID NO: 2872241 - RNA, 17 nt, Human
gaaauaccucauguuua

SEQ ID NO: 2872242 - RNA, 21 nt, Human
gaaauaccucauguuuaugaa

SEQ ID NO: 2872243 - RNA, 23 nt, Human
gaaauaccucauguuuaugaaaa

SEQ ID NO: 2872244 - RNA, 14 nt, Human
gaagccucuggcua

SEQ ID NO: 2872245 - RNA, 13 nt, Human
gaagccucuggcu

SEQ ID NO: 2872246 - RNA, 17 nt, Human
gaagccucuggcuagag

SEQ ID NO: 2872247 - RNA, 22 nt, Human
gaagccuugccuaaauuuaaug

SEQ ID NO: 2872248 - RNA, 11 nt, Human
gaagccuuugu

SEQ ID NO: 2872249 - RNA, 10 nt, Human
gaagccuuug

SEQ ID NO: 2872250 - RNA, 19 nt, Human
gaagcuuuguccccugcuu

SEQ ID NO: 2872251 - RNA, 20 nt, Human
gaagcuuuguccccugcuuc

SEQ ID NO: 2872252 - RNA, 21 nt, Human
gaagcuuuguccccugcuuca

SEQ ID NO: 2872253 - RNA, 14 nt, Human
gaagcuuucugucu

SEQ ID NO: 2872254 - RNA, 22 nt, Human
gaagcgcgccacucgcuucccc

SEQ ID NO: 2872255 - RNA, 14 nt, Human
gaagcggauuucca

SEQ ID NO: 2872256 - RNA, 16 nt, Human
gaagcggauuuccagg

SEQ ID NO: 2872257 - RNA, 15 nt, Human
gaagcuugacuccca

SEQ ID NO: 2872258 - RNA, 20 nt, Human
gaagcggcccuaagggagug

SEQ ID NO: 2872259 - RNA, 16 nt, Human
gaagccgggaacagac

SEQ ID NO: 2872260 - RNA, 12 nt, Human
gaagccucuggc

SEQ ID NO: 2872261 - RNA, 17 nt, Human
gaagccucagcuaccca

SEQ ID NO: 2872262 - RNA, 20 nt, Human
gaagccagccuucuuccauc

SEQ ID NO: 2872263 - RNA, 10 nt, Human
gaagccagcu

SEQ ID NO: 2872264 - RNA, 12 nt, Human
gaagccagccuu

SEQ ID NO: 2872265 - RNA, 16 nt, Human
gaagcccaagugaaau

SEQ ID NO: 2872266 - RNA, 15 nt, Human
gaagcccaagugaaa

SEQ ID NO: 2872267 - RNA, 18 nt, Human
gaagccacugaagcuggg

SEQ ID NO: 2872268 - RNA, 15 nt, Human
gaagccacugaagcu

SEQ ID NO: 2872269 - RNA, 21 nt, Human
gaagacucauucuucuguacg

SEQ ID NO: 2872270 - RNA, 19 nt, Human
gaagacucauucuucugua

SEQ ID NO: 2872271 - RNA, 13 nt, Human
gaagaagcagaga

SEQ ID NO: 2872272 - RNA, 14 nt, Human
gaagaagcagagag

SEQ ID NO: 2872273 - RNA, 15 nt, Human
gaagaagcagagaga

SEQ ID NO: 2872274 - RNA, 16 nt, Human
gaaggagagccugcug

SEQ ID NO: 2872275 - RNA, 15 nt, Human
gaaggagagccugcu

SEQ ID NO: 2872276 - RNA, 13 nt, Human
gaaggagagccug

SEQ ID NO: 2872277 - RNA, 20 nt, Human
gaaggagagaaaguggguga

SEQ ID NO: 2872278 - RNA, 21 nt, Human
gaaggagagaaagugggugag

SEQ ID NO: 2872279 - RNA, 12 nt, Human
gaaggagagaaa

SEQ ID NO: 2872280 - RNA, 13 nt, Human
gaaggagagaaag

SEQ ID NO: 2872281 - RNA, 16 nt, Human
gaaggagagaaagugg

SEQ ID NO: 2872282 - RNA, 14 nt, Human
gaaggaaaaugaua

SEQ ID NO: 2872283 - RNA, 23 nt, Human
gaaggacccggaggggccuggca

SEQ ID NO: 2872284 - RNA, 13 nt, Human
gaaggagacacag

SEQ ID NO: 2872285 - RNA, 14 nt, Human
gaaggagacacaga

SEQ ID NO: 2872286 - RNA, 15 nt, Human
gaaggagacacagau

SEQ ID NO: 2872287 - RNA, 16 nt, Human
gaaggagacacagaug

SEQ ID NO: 2872288 - RNA, 17 nt, Human
gaaggagacacagaugu

SEQ ID NO: 2872289 - RNA, 19 nt, Human
gaagccuuuacugacccug

SEQ ID NO: 2872290 - RNA, 20 nt, Human
gaaggacggguuggggccgg

SEQ ID NO: 2872291 - RNA, 17 nt, Human
gaagggguuggauugca

SEQ ID NO: 2872292 - RNA, 20 nt, Human
gaaggguuuuccacccugga

SEQ ID NO: 2872293 - RNA, 21 nt, Human
gaaggguuuguggcugggggc

SEQ ID NO: 2872294 - RNA, 15 nt, Human
gaaggguuuguggcu

SEQ ID NO: 2872295 - RNA, 17 nt, Human
gaagggugguggagcca

SEQ ID NO: 2872296 - RNA, 19 nt, Human
gaagguucauguagagaaa

SEQ ID NO: 2872297 - RNA, 20 nt, Human
gaagguacugucaugggcua

SEQ ID NO: 2872298 - RNA, 13 nt, Human
gaaggcaaugcca

SEQ ID NO: 2872299 - RNA, 16 nt, Human
gaaggcagccaccagc

SEQ ID NO: 2872300 - RNA, 15 nt, Human
gaaggcagagaaagg

SEQ ID NO: 2872301 - RNA, 17 nt, Human
gaaggcagagaaaggga

SEQ ID NO: 2872302 - RNA, 22 nt, Human
gaaggcagagaaagggacaaug

SEQ ID NO: 2872303 - RNA, 13 nt, Human
gaaggcagacagc

SEQ ID NO: 2872304 - RNA, 14 nt, Human
gaaggcagacagca

SEQ ID NO: 2872305 - RNA, 15 nt, Human
gaaggcagacagcag

SEQ ID NO: 2872306 - RNA, 16 nt, Human
gaaggcagacagcagg

SEQ ID NO: 2872307 - RNA, 19 nt, Human
gaaggcagacagcaggcag

SEQ ID NO: 2872308 - RNA, 20 nt, Human
gaaggcagacagcaggcagc

SEQ ID NO: 2872309 - RNA, 21 nt, Human
gaaggcagacagcaggcagcg

SEQ ID NO: 2872310 - RNA, 13 nt, Human
gaaggcagggagg

SEQ ID NO: 2872311 - RNA, 14 nt, Human
gaaggcagggaggg

SEQ ID NO: 2872312 - RNA, 22 nt, Human
gaauaaucuuuggguaacuuca

SEQ ID NO: 2872313 - RNA, 13 nt, Human
gaauaaugggcuu

SEQ ID NO: 2872314 - RNA, 14 nt, Human
gaaguaaacugcag

SEQ ID NO: 2872315 - RNA, 20 nt, Human
gaauaauuauuuauuuaaua

SEQ ID NO: 2872316 - RNA, 21 nt, Human
gaauaauugcuuuuucacagu

SEQ ID NO: 2872317 - RNA, 13 nt, Human
gaauaauuauuua

SEQ ID NO: 2872318 - RNA, 18 nt, Human
gaauaauuauuuauuuaa

SEQ ID NO: 2872319 - RNA, 14 nt, Human
gaauaauguaaaau

SEQ ID NO: 2872320 - RNA, 22 nt, Human
gaauaauguaaaauguugaaua

SEQ ID NO: 2872321 - RNA, 23 nt, Human
gaauagaaauaaaggaugugauu

SEQ ID NO: 2872322 - RNA, 16 nt, Human
gaauagaagcaaauua

SEQ ID NO: 2872323 - RNA, 20 nt, Human
gaauacuuuuuacaauuaaa

SEQ ID NO: 2872324 - RNA, 12 nt, Human
gaauagaaagaa

SEQ ID NO: 2872325 - RNA, 13 nt, Human
gaauagaaagaaa

SEQ ID NO: 2872326 - RNA, 15 nt, Human
gaauagaaagaaagu

SEQ ID NO: 2872327 - RNA, 16 nt, Human
gaauagaaagaaaguc

SEQ ID NO: 2872328 - RNA, 14 nt, Human
gaauacuuuuuaca

SEQ ID NO: 2872329 - RNA, 15 nt, Human
gaauacuuuuuaaaa

SEQ ID NO: 2872330 - RNA, 15 nt, Human
gaauaaucuuugggu

SEQ ID NO: 2872331 - RNA, 23 nt, Human
gaauaagcucuaguucuuaacaa

SEQ ID NO: 2872332 - RNA, 20 nt, Human
gaauaaauucccaacuucuc

SEQ ID NO: 2872333 - RNA, 15 nt, Human
gaauaaauugcuccu

SEQ ID NO: 2872334 - RNA, 17 nt, Human
gaauaaagccugcuuuu

SEQ ID NO: 2872335 - RNA, 11 nt, Human
gaauaaacuuc

SEQ ID NO: 2872336 - RNA, 12 nt, Human
gaauaaacuuca

SEQ ID NO: 2872337 - RNA, 13 nt, Human
gaauaaacuucag

SEQ ID NO: 2872338 - RNA, 14 nt, Human
gaauaaacuucagc

SEQ ID NO: 2872339 - RNA, 15 nt, Human
gaauaaacuucagca

SEQ ID NO: 2872340 - RNA, 16 nt, Human
gaauaaacuucagcac

SEQ ID NO: 2872341 - RNA, 17 nt, Human
gaauaaacuucagcacc

SEQ ID NO: 2872342 - RNA, 18 nt, Human
gaauaaacuucagcacca

SEQ ID NO: 2872343 - RNA, 14 nt, Human
gaauaaagacaccu

SEQ ID NO: 2872344 - RNA, 13 nt, Human
gaaguuuacauuu

SEQ ID NO: 2872345 - RNA, 14 nt, Human
gaaguuuacauuuu

SEQ ID NO: 2872346 - RNA, 21 nt, Human
gaaguuuacauuuuuauuuau

SEQ ID NO: 2872347 - RNA, 22 nt, Human
gaaguuuacauuuuuauuuaug

SEQ ID NO: 2872348 - RNA, 17 nt, Human
gaaguuuauucucauuu

SEQ ID NO: 2872349 - RNA, 21 nt, Human
gaaguuuccuuggcuggugca

SEQ ID NO: 2872350 - RNA, 17 nt, Human
gaaguuuacauuguaaa

SEQ ID NO: 2872351 - RNA, 16 nt, Human
gaaguuuacauuguaa

SEQ ID NO: 2872352 - RNA, 13 nt, Human
gaagguuuuaagu

SEQ ID NO: 2872353 - RNA, 15 nt, Human
gaaguaaagaacugc

SEQ ID NO: 2872354 - RNA, 15 nt, Human
gaaguaaagccauua

SEQ ID NO: 2872355 - RNA, 19 nt, Human
gaaguaaagccauuaaaug

SEQ ID NO: 2872356 - RNA, 22 nt, Human
gaagguuuguguuuucucugga

SEQ ID NO: 2872357 - RNA, 14 nt, Human
gaauagcugggacu

SEQ ID NO: 2872358 - RNA, 23 nt, Human
gaauagccacauuuggaauacuu

SEQ ID NO: 2872359 - RNA, 18 nt, Human
gaauagccacauuuggaa

SEQ ID NO: 2872360 - RNA, 15 nt, Human
gaauagccacauuug

SEQ ID NO: 2872361 - RNA, 13 nt, Human
gaauagcaucugu

SEQ ID NO: 2872362 - RNA, 16 nt, Human
gaauagcaucuguaca

SEQ ID NO: 2872363 - RNA, 18 nt, Human
gaauagcaucuguacaaa

SEQ ID NO: 2872364 - RNA, 20 nt, Human
gaauagcaucuguacaaagg

SEQ ID NO: 2872365 - RNA, 15 nt, Human
gaauagaugcugacu

SEQ ID NO: 2872366 - RNA, 15 nt, Human
gaauagcugggacua

SEQ ID NO: 2872367 - RNA, 17 nt, Human
gaauagccuagauauga

SEQ ID NO: 2872368 - RNA, 22 nt, Human
gaauagccuagauaugaauaua

SEQ ID NO: 2872369 - RNA, 15 nt, Human
gaauagccuguggcc

SEQ ID NO: 2872370 - RNA, 11 nt, Human
gaaucacuguu

SEQ ID NO: 2872371 - RNA, 14 nt, Human
gaaucacuguuuuu

SEQ ID NO: 2872372 - RNA, 15 nt, Human
gaaucacuguuuuua

SEQ ID NO: 2872373 - RNA, 16 nt, Human
gaaucacuguuuuuag

SEQ ID NO: 2872374 - RNA, 17 nt, Human
gaaucacuguuuuuaga

SEQ ID NO: 2872375 - RNA, 23 nt, Human
gaaucacuguuuuuagacaccuu

SEQ ID NO: 2872376 - RNA, 16 nt, Human
gaauccccucccuguc

SEQ ID NO: 2872377 - RNA, 23 nt, Human
gaaucccccuugccaccccaccc

SEQ ID NO: 2872378 - RNA, 16 nt, Human
gaauccccgaaggugc

SEQ ID NO: 2872379 - RNA, 17 nt, Human
gaauccccucccuguca

SEQ ID NO: 2872380 - RNA, 20 nt, Human
gaaucccuagacuuuaggcu

SEQ ID NO: 2872381 - RNA, 14 nt, Human
gaaucccccuugcc

SEQ ID NO: 2872382 - RNA, 17 nt, Human
gaaucccccuugccacc

SEQ ID NO: 2872383 - RNA, 18 nt, Human
gaaucccccuugccaccc

SEQ ID NO: 2872384 - RNA, 17 nt, Human
gaauccacucccaggca

SEQ ID NO: 2872385 - RNA, 13 nt, Human
gaaucccagccgg

SEQ ID NO: 2872386 - RNA, 15 nt, Human
gaaucccagccggcc

SEQ ID NO: 2872387 - RNA, 20 nt, Human
gaauccaagccuccacagcg

SEQ ID NO: 2872388 - RNA, 17 nt, Human
gaauccaagccuccaca

SEQ ID NO: 2872389 - RNA, 16 nt, Human
gaauccacauuucuaa

SEQ ID NO: 2872390 - RNA, 15 nt, Human
gaauccaagcucccu

SEQ ID NO: 2872391 - RNA, 16 nt, Human
gaauccaagcucccug

SEQ ID NO: 2872392 - RNA, 17 nt, Human
gaauccaagcucccugc

SEQ ID NO: 2872393 - RNA, 18 nt, Human
gaauccaagcucccugcc

SEQ ID NO: 2872394 - RNA, 20 nt, Human
gaauccaagcucccugcccc

SEQ ID NO: 2872395 - RNA, 23 nt, Human
gaauccacguauuccccuuccca

SEQ ID NO: 2872396 - RNA, 17 nt, Human
gaauccacauuucuaaa

SEQ ID NO: 2872397 - RNA, 18 nt, Human
gaauccacauuucuaaaa

SEQ ID NO: 2872398 - RNA, 16 nt, Human
gaaucccacuguauga

SEQ ID NO: 2872399 - RNA, 17 nt, Human
gaaucccacuguaugau

SEQ ID NO: 2872400 - RNA, 15 nt, Human
gaauccaagccucca

SEQ ID NO: 2872401 - RNA, 14 nt, Human
gaauccaagccucc

SEQ ID NO: 2872402 - RNA, 16 nt, Human
gaaucagaguagaaau

SEQ ID NO: 2872403 - RNA, 17 nt, Human
gaaucagaguagaaaua

SEQ ID NO: 2872404 - RNA, 13 nt, Human
gaaucagcacaga

SEQ ID NO: 2872405 - RNA, 12 nt, Human
gaaucuggagac

SEQ ID NO: 2872406 - RNA, 22 nt, Human
gaaucuggagaccagggagccu

SEQ ID NO: 2872407 - RNA, 16 nt, Human
gaaucuggagaccagg

SEQ ID NO: 2872408 - RNA, 18 nt, Human
gaaucuggagaccaggga

SEQ ID NO: 2872409 - RNA, 20 nt, Human
gaauccuaggcuccacccca

SEQ ID NO: 2872410 - RNA, 12 nt, Human
gaauccuggcag

SEQ ID NO: 2872411 - RNA, 22 nt, Human
gaauccuauauagaaugcugca

SEQ ID NO: 2872412 - RNA, 10 nt, Human
gaauccuccu

SEQ ID NO: 2872413 - RNA, 17 nt, Human
gaauccuggcagcccag

SEQ ID NO: 2872414 - RNA, 16 nt, Human
gaauccuggcagccca

SEQ ID NO: 2872415 - RNA, 14 nt, Human
gaauccuggcagcc

SEQ ID NO: 2872416 - RNA, 13 nt, Human
gaauccuggcagc

SEQ ID NO: 2872417 - RNA, 17 nt, Human
gaaucuauauuuaacaa

SEQ ID NO: 2872418 - RNA, 13 nt, Human
gaaucuauuuaag

SEQ ID NO: 2872419 - RNA, 15 nt, Human
gaaucuauuuaagua

SEQ ID NO: 2872420 - RNA, 16 nt, Human
gaaucuauuuaaguaa

SEQ ID NO: 2872421 - RNA, 12 nt, Human
gaaucuauuuuc

SEQ ID NO: 2872422 - RNA, 15 nt, Human
gaaucuauuuucuau

SEQ ID NO: 2872423 - RNA, 16 nt, Human
gaaucuauuuucuaug

SEQ ID NO: 2872424 - RNA, 17 nt, Human
gaaucuauuuucuaugu

SEQ ID NO: 2872425 - RNA, 18 nt, Human
gaaucuauuuucuaugua

SEQ ID NO: 2872426 - RNA, 19 nt, Human
gaaucuauuuucuauguac

SEQ ID NO: 2872427 - RNA, 21 nt, Human
gaaucuauuuucuauguacua

SEQ ID NO: 2872428 - RNA, 23 nt, Human
gaaucuauuuucuauguacuagu

SEQ ID NO: 2872429 - RNA, 14 nt, Human
gaaugaaagggccc

SEQ ID NO: 2872430 - RNA, 19 nt, Human
gaaugaaagggcccagaga

SEQ ID NO: 2872431 - RNA, 19 nt, Human
gaaugccugagugccuggc

SEQ ID NO: 2872432 - RNA, 16 nt, Human
gaaugccugagugccu

SEQ ID NO: 2872433 - RNA, 18 nt, Human
gaaugccugagugccugg

SEQ ID NO: 2872434 - RNA, 14 nt, Human
gaaugccuccugug

SEQ ID NO: 2872435 - RNA, 16 nt, Human
gaaugccuccuguggg

SEQ ID NO: 2872436 - RNA, 17 nt, Human
gaaugccuccugugggg

SEQ ID NO: 2872437 - RNA, 18 nt, Human
gaaugccuccugugggga

SEQ ID NO: 2872438 - RNA, 19 nt, Human
gaaaaucaaauacauacuu

SEQ ID NO: 2872439 - RNA, 17 nt, Human
gaaaaucacuuugucua

SEQ ID NO: 2872440 - RNA, 18 nt, Human
gaaaaucacuuugucuaa

SEQ ID NO: 2872441 - RNA, 18 nt, Human
gaaaauauuuuuuauaua

SEQ ID NO: 2872442 - RNA, 14 nt, Human
gaaaaucaaauaca

SEQ ID NO: 2872443 - RNA, 15 nt, Human
gaaaaucaaauacau

SEQ ID NO: 2872444 - RNA, 14 nt, Human
gaaacacagaaacc

SEQ ID NO: 2872445 - RNA, 15 nt, Human
gaaacacagagaagc

SEQ ID NO: 2872446 - RNA, 12 nt, Human
gaaacacagcug

SEQ ID NO: 2872447 - RNA, 13 nt, Human
gaaacacagcugu

SEQ ID NO: 2872448 - RNA, 14 nt, Human
gaaacacagcuguu

SEQ ID NO: 2872449 - RNA, 15 nt, Human
gaaacacagcuguuc

SEQ ID NO: 2872450 - RNA, 23 nt, Human
gaaacacagcuguucuucuguuc

SEQ ID NO: 2872451 - RNA, 22 nt, Human
gaaacacagcuuacaaucgcaa

SEQ ID NO: 2872452 - RNA, 17 nt, Human
gaaacacugccuuuuua

SEQ ID NO: 2872453 - RNA, 16 nt, Human
gaaacacugccuuuuu

SEQ ID NO: 2872454 - RNA, 14 nt, Human
gaaacacugccuuu

SEQ ID NO: 2872455 - RNA, 13 nt, Human
gaaacacugccuu

SEQ ID NO: 2872456 - RNA, 12 nt, Human
gaaacacugccu

SEQ ID NO: 2872457 - RNA, 11 nt, Human
gaaacacugcc

SEQ ID NO: 2872458 - RNA, 14 nt, Human
gaaacacuccuugc

SEQ ID NO: 2872459 - RNA, 15 nt, Human
gaaacacuccuugca

SEQ ID NO: 2872460 - RNA, 16 nt, Human
gaaacacuccuugcau

SEQ ID NO: 2872461 - RNA, 17 nt, Human
gaaacacuccuugcauc

SEQ ID NO: 2872462 - RNA, 22 nt, Human
gaaacacugggcuucuagaacc

SEQ ID NO: 2872463 - RNA, 15 nt, Human
gaaacacgaaacuug

SEQ ID NO: 2872464 - RNA, 16 nt, Human
gaaacacgaaacuugu

SEQ ID NO: 2872465 - RNA, 17 nt, Human
gaaacacgaaacuuguu

SEQ ID NO: 2872466 - RNA, 18 nt, Human
gaaacacgaaacuuguua

SEQ ID NO: 2872467 - RNA, 22 nt, Human
gaaacacgaaacuuguuauugu

SEQ ID NO: 2872468 - RNA, 18 nt, Human
gaaacagcuaaugggaca

SEQ ID NO: 2872469 - RNA, 16 nt, Human
gaaacagauuucauac

SEQ ID NO: 2872470 - RNA, 20 nt, Human
gaaacagcucgacuuuaaaa

SEQ ID NO: 2872471 - RNA, 15 nt, Human
gaaacagcuuucaag

SEQ ID NO: 2872472 - RNA, 16 nt, Human
gaaacagcuuucaagu

SEQ ID NO: 2872473 - RNA, 18 nt, Human
gaaacagcuuucaagugc

SEQ ID NO: 2872474 - RNA, 20 nt, Human
gaaacagcuuucaagugccu

SEQ ID NO: 2872475 - RNA, 21 nt, Human
gaaacagcuuucaagugccuu

SEQ ID NO: 2872476 - RNA, 15 nt, Human
gaaacagcucgacuu

SEQ ID NO: 2872477 - RNA, 12 nt, Human
gaaacagaggcu

SEQ ID NO: 2872478 - RNA, 14 nt, Human
gaaacagauaccau

SEQ ID NO: 2872479 - RNA, 15 nt, Human
gaaacagauaccaua

SEQ ID NO: 2872480 - RNA, 21 nt, Human
gaaacagauaccauacucauu

SEQ ID NO: 2872481 - RNA, 22 nt, Human
gaaacagaaacaaaaacacuaa

SEQ ID NO: 2872482 - RNA, 14 nt, Human
gaaacagaaacaaa

SEQ ID NO: 2872483 - RNA, 14 nt, Human
gaaacacuuucucu

SEQ ID NO: 2872484 - RNA, 18 nt, Human
gaaacacuuugccuccug

SEQ ID NO: 2872485 - RNA, 19 nt, Human
gaaacacuuugccuccugu

SEQ ID NO: 2872486 - RNA, 20 nt, Human
gaaacacuuugccuccugug

SEQ ID NO: 2872487 - RNA, 22 nt, Human
gaaacacuuugccuccugugua

SEQ ID NO: 2872488 - RNA, 13 nt, Human
gaaacacuuuuuu

SEQ ID NO: 2872489 - RNA, 17 nt, Human
gaaaagcugcugacagu

SEQ ID NO: 2872490 - RNA, 13 nt, Human
gaaaagcugcuga

SEQ ID NO: 2872491 - RNA, 18 nt, Human
gaaaauaauguaauugua

SEQ ID NO: 2872492 - RNA, 19 nt, Human
gaaaauaauguaauuguaa

SEQ ID NO: 2872493 - RNA, 19 nt, Human
gaaaauaagugaauaauaa

SEQ ID NO: 2872494 - RNA, 18 nt, Human
gaaaauaagaauagaaau

SEQ ID NO: 2872495 - RNA, 20 nt, Human
gaaaagcuauuagccaggau

SEQ ID NO: 2872496 - RNA, 22 nt, Human
gaaaagcuauuagccaggauca

SEQ ID NO: 2872497 - RNA, 11 nt, Human
gaaaagcuauu

SEQ ID NO: 2872498 - RNA, 14 nt, Human
gaaaagcuauuagc

SEQ ID NO: 2872499 - RNA, 17 nt, Human
gaaaagcuauuagccag

SEQ ID NO: 2872500 - RNA, 19 nt, Human
gaaaagcuauuagccagga

SEQ ID NO: 2872501 - RNA, 16 nt, Human
gaaaauauaugauggc

SEQ ID NO: 2872502 - RNA, 15 nt, Human
gaaaauauauguauu

SEQ ID NO: 2872503 - RNA, 16 nt, Human
gaaaauauauguauuu

SEQ ID NO: 2872504 - RNA, 17 nt, Human
gaaaauauauguauuuu

SEQ ID NO: 2872505 - RNA, 20 nt, Human
gaaaauauauguauuuuuau

SEQ ID NO: 2872506 - RNA, 22 nt, Human
gaaaauauauguauuuuuauau

SEQ ID NO: 2872507 - RNA, 17 nt, Human
gaaaauauuauguguuu

SEQ ID NO: 2872508 - RNA, 22 nt, Human
gaaaauaucugcucaaaacuuu

SEQ ID NO: 2872509 - RNA, 18 nt, Human
gaaaaauaaaucuguucu

SEQ ID NO: 2872510 - RNA, 19 nt, Human
gaaaacaucacugaaaugc

SEQ ID NO: 2872511 - RNA, 19 nt, Human
gaaaacaaugcaaaaccuu

SEQ ID NO: 2872512 - RNA, 22 nt, Human
gaaaagcuaguguaccuccucu

SEQ ID NO: 2872513 - RNA, 24 nt, Human
gaaaagcuaguguaccuccucuca

SEQ ID NO: 2872514 - RNA, 16 nt, Human
gaaaaccaucuggccu

SEQ ID NO: 2872515 - RNA, 18 nt, Human
gaaaaccaucuggccugg

SEQ ID NO: 2872516 - RNA, 19 nt, Human
gaaaaccaucuggccuggc

SEQ ID NO: 2872517 - RNA, 20 nt, Human
gaaaaccaucuggccuggcc

SEQ ID NO: 2872518 - RNA, 21 nt, Human
gaaaaccaucuggccuggccu

SEQ ID NO: 2872519 - RNA, 22 nt, Human
gaaaaccagcuugcgaauaaca

SEQ ID NO: 2872520 - RNA, 18 nt, Human
gaaaaccaccccuuagau

SEQ ID NO: 2872521 - RNA, 21 nt, Human
gaaaaccaagccguggcuucc

SEQ ID NO: 2872522 - RNA, 18 nt, Human
gaaaaccaagccguggcu

SEQ ID NO: 2872523 - RNA, 19 nt, Human
gaaaaccaagccguggcuu

SEQ ID NO: 2872524 - RNA, 20 nt, Human
gaaaacauucugauuuggaa

SEQ ID NO: 2872525 - RNA, 11 nt, Human
gaaaaccaaaa

SEQ ID NO: 2872526 - RNA, 17 nt, Human
gaaaaccaaaaugacau

SEQ ID NO: 2872527 - RNA, 18 nt, Human
gaaaaccaaaaugacauc

SEQ ID NO: 2872528 - RNA, 21 nt, Human
gaaaaccaaaaugacaucuuu

SEQ ID NO: 2872529 - RNA, 14 nt, Human
cuuuucuuuaaaga

SEQ ID NO: 2872530 - RNA, 17 nt, Human
cuuuucuuuaaagaagu

SEQ ID NO: 2872531 - RNA, 18 nt, Human
cuuuucuuuaaagaaguu

SEQ ID NO: 2872532 - RNA, 14 nt, Human
cuuuucuuuaacuu

SEQ ID NO: 2872533 - RNA, 15 nt, Human
cuuuucuuuaacuuu

SEQ ID NO: 2872534 - RNA, 17 nt, Human
cuuuucuuuagagaacu

SEQ ID NO: 2872535 - RNA, 20 nt, Human
cuuuucuuuagagaacugaa

SEQ ID NO: 2872536 - RNA, 21 nt, Human
cuuuucuuuagagaacugaaa

SEQ ID NO: 2872537 - RNA, 22 nt, Human
cuuuucuuuagagaacugaaaa

SEQ ID NO: 2872538 - RNA, 13 nt, Human
cuuuuuuccuaau

SEQ ID NO: 2872539 - RNA, 15 nt, Human
cuuuuuucacuacau

SEQ ID NO: 2872540 - RNA, 17 nt, Human
cuuuugaggcuucuguu

SEQ ID NO: 2872541 - RNA, 15 nt, Human
cuuuugagugugugu

SEQ ID NO: 2872542 - RNA, 20 nt, Human
cuuuugagugugugugugca

SEQ ID NO: 2872543 - RNA, 23 nt, Human
cuuuugagugugugugugcaugu

SEQ ID NO: 2872544 - RNA, 17 nt, Human
cuuuuuugauaaaguuu

SEQ ID NO: 2872545 - RNA, 18 nt, Human
cuuuuuugauaaaguuuc

SEQ ID NO: 2872546 - RNA, 19 nt, Human
cuuuuuugauaaaguuucu

SEQ ID NO: 2872547 - RNA, 18 nt, Human
gaaaaaguuaaugcuuaa

SEQ ID NO: 2872548 - RNA, 20 nt, Human
gaaaaaguuaaugcuuaaga

SEQ ID NO: 2872549 - RNA, 16 nt, Human
gaaaaaggcugugcug

SEQ ID NO: 2872550 - RNA, 12 nt, Human
gaaaaaggguca

SEQ ID NO: 2872551 - RNA, 15 nt, Human
gaaaaaggcugugcu

SEQ ID NO: 2872552 - RNA, 21 nt, Human
cuuuuuugauaaaguuucuca

SEQ ID NO: 2872553 - RNA, 16 nt, Human
cuuuucucuuuuuagu

SEQ ID NO: 2872554 - RNA, 14 nt, Human
cuuuucucccauau

SEQ ID NO: 2872555 - RNA, 18 nt, Human
cuuuucccuguacuuuuc

SEQ ID NO: 2872556 - RNA, 12 nt, Human
cuuuucuaguuu

SEQ ID NO: 2872557 - RNA, 21 nt, Human
cuuuucuauuccuucuggccu

SEQ ID NO: 2872558 - RNA, 18 nt, Human
cuuuucucauguguuugc

SEQ ID NO: 2872559 - RNA, 13 nt, Human
cuuuucucagcug

SEQ ID NO: 2872560 - RNA, 12 nt, Human
cuuuucccucuu

SEQ ID NO: 2872561 - RNA, 13 nt, Human
cuuuucccucuuu

SEQ ID NO: 2872562 - RNA, 20 nt, Human
cuuuucccucuuuggcuccc

SEQ ID NO: 2872563 - RNA, 22 nt, Human
cuuuucccucuuuggcuccccu

SEQ ID NO: 2872564 - RNA, 15 nt, Human
cuuuucccucuuuuc

SEQ ID NO: 2872565 - RNA, 16 nt, Human
cuuuucccucuuuucu

SEQ ID NO: 2872566 - RNA, 19 nt, Human
cuuuucccucuuuucuuac

SEQ ID NO: 2872567 - RNA, 17 nt, Human
cuuuucccauuuguaau

SEQ ID NO: 2872568 - RNA, 19 nt, Human
cuuuucccauuuguaauuu

SEQ ID NO: 2872569 - RNA, 11 nt, Human
cuuuucugcug

SEQ ID NO: 2872570 - RNA, 23 nt, Human
cuuuucuggggaaagacacugcc

SEQ ID NO: 2872571 - RNA, 21 nt, Human
cuuuucuggggaaagacacug

SEQ ID NO: 2872572 - RNA, 19 nt, Human
cuuuucuggccaaaagcag

SEQ ID NO: 2872573 - RNA, 13 nt, Human
cuuuucuguacuu

SEQ ID NO: 2872574 - RNA, 11 nt, Human
cuuuucuuggc

SEQ ID NO: 2872575 - RNA, 12 nt, Human
cuuuucuuggca

SEQ ID NO: 2872576 - RNA, 21 nt, Human
cuuuucuuggcaaaagccuug

SEQ ID NO: 2872577 - RNA, 22 nt, Human
cuuuucuuggcaaaagccuugu

SEQ ID NO: 2872578 - RNA, 23 nt, Human
cuuuucuuggcaaaagccuugug

SEQ ID NO: 2872579 - RNA, 20 nt, Human
cuuuucauaaccuagccuua

SEQ ID NO: 2872580 - RNA, 22 nt, Human
cuuuucacuucgggcuguguaa

SEQ ID NO: 2872581 - RNA, 18 nt, Human
cuuuuacuacagcuauga

SEQ ID NO: 2872582 - RNA, 23 nt, Human
cuuuuacuacagcuaugaagaaa

SEQ ID NO: 2872583 - RNA, 16 nt, Human
cuuuucacugcuggcu

SEQ ID NO: 2872584 - RNA, 17 nt, Human
cuuuucacugcuggcug

SEQ ID NO: 2872585 - RNA, 18 nt, Human
cuuuucacugcuggcugc

SEQ ID NO: 2872586 - RNA, 20 nt, Human
cuuuucacugcuggcugccu

SEQ ID NO: 2872587 - RNA, 22 nt, Human
cuuuucauaaccuagccuuaga

SEQ ID NO: 2872588 - RNA, 21 nt, Human
cuuuucagguuugucaucaga

SEQ ID NO: 2872589 - RNA, 20 nt, Human
cuuuggacccaaggaaaacu

SEQ ID NO: 2872590 - RNA, 18 nt, Human
cuuuucaugcgugugugu

SEQ ID NO: 2872591 - RNA, 15 nt, Human
cuuuucauucucauu

SEQ ID NO: 2872592 - RNA, 17 nt, Human
cuuuguuucaaccaagu

SEQ ID NO: 2872593 - RNA, 13 nt, Human
cuuuguuucuugu

SEQ ID NO: 2872594 - RNA, 15 nt, Human
cuuuguuucuuguuu

SEQ ID NO: 2872595 - RNA, 17 nt, Human
cuuuguuucuuguuuau

SEQ ID NO: 2872596 - RNA, 20 nt, Human
cuuuguuuggauguaauuua

SEQ ID NO: 2872597 - RNA, 21 nt, Human
cuuuguuuggauguaauuuag

SEQ ID NO: 2872598 - RNA, 15 nt, Human
cuuuuacgagugcua

SEQ ID NO: 2872599 - RNA, 15 nt, Human
cuuuuaccagcuuuu

SEQ ID NO: 2872600 - RNA, 18 nt, Human
cuuuuaccagcuuuuaac

SEQ ID NO: 2872601 - RNA, 21 nt, Human
cuuuuaccagcuuuuaaccau

SEQ ID NO: 2872602 - RNA, 15 nt, Human
cuuugucccggggcu

SEQ ID NO: 2872603 - RNA, 13 nt, Human
cuuugggagacca

SEQ ID NO: 2872604 - RNA, 14 nt, Human
cuuuguccccugcu

SEQ ID NO: 2872605 - RNA, 15 nt, Human
cuuuguccccugcuu

SEQ ID NO: 2872606 - RNA, 16 nt, Human
cuuuguccccugcuuc

SEQ ID NO: 2872607 - RNA, 14 nt, Human
cuuugggaagccuu

SEQ ID NO: 2872608 - RNA, 19 nt, Human
cuuugggaagccuuuacug

SEQ ID NO: 2872609 - RNA, 20 nt, Human
cuuugucuaacucagaauua

SEQ ID NO: 2872610 - RNA, 18 nt, Human
cuuuguucuaaagaugga

SEQ ID NO: 2872611 - RNA, 15 nt, Human
cuuucccaagccuuc

SEQ ID NO: 2872612 - RNA, 20 nt, Human
cuuucccagugagucucugg

SEQ ID NO: 2872613 - RNA, 22 nt, Human
cuuucccaccccacgccuuauc

SEQ ID NO: 2872614 - RNA, 16 nt, Human
cuuucccacccuguuc

SEQ ID NO: 2872615 - RNA, 22 nt, Human
cuuucccacccuguucccaguc

SEQ ID NO: 2872616 - RNA, 19 nt, Human
cuuucccaccgcccucccu

SEQ ID NO: 2872617 - RNA, 14 nt, Human
cuuugcucuuucuu

SEQ ID NO: 2872618 - RNA, 16 nt, Human
cuuugcucuuguccca

SEQ ID NO: 2872619 - RNA, 11 nt, Human
cuuugcugcca

SEQ ID NO: 2872620 - RNA, 19 nt, Human
cuuugcugauuuccccucu

SEQ ID NO: 2872621 - RNA, 13 nt, Human
cuuugcuguaaga

SEQ ID NO: 2872622 - RNA, 17 nt, Human
cuuugcuguaagauguc

SEQ ID NO: 2872623 - RNA, 18 nt, Human
cuuugcuguaagaugucu

SEQ ID NO: 2872624 - RNA, 19 nt, Human
cuuugcuguaagaugucug

SEQ ID NO: 2872625 - RNA, 20 nt, Human
cuuugcuguaagaugucugu

SEQ ID NO: 2872626 - RNA, 22 nt, Human
cuuugcuguaagaugucuguuu

SEQ ID NO: 2872627 - RNA, 17 nt, Human
cuuuccaacguuuggaa

SEQ ID NO: 2872628 - RNA, 10 nt, Human
cuuuaaagaa

SEQ ID NO: 2872629 - RNA, 20 nt, Human
cuuuaaagaugaacucugaa

SEQ ID NO: 2872630 - RNA, 14 nt, Human
cuuuaaaggcccag

SEQ ID NO: 2872631 - RNA, 15 nt, Human
cuuuaaaggcccagc

SEQ ID NO: 2872632 - RNA, 16 nt, Human
cuuuaaaggcccagcc

SEQ ID NO: 2872633 - RNA, 18 nt, Human
cuuuaaaggcccagcccc

SEQ ID NO: 2872634 - RNA, 19 nt, Human
cuuuaaaggcccagccccu

SEQ ID NO: 2872635 - RNA, 20 nt, Human
cuuuaaaggcccagccccua

SEQ ID NO: 2872636 - RNA, 17 nt, Human
cuuuagaagugcauuuc

SEQ ID NO: 2872637 - RNA, 19 nt, Human
cuuuagaagugcauuucug

SEQ ID NO: 2872638 - RNA, 20 nt, Human
cuuuagaagugcauuucuga

SEQ ID NO: 2872639 - RNA, 20 nt, Human
cuuuagugaucacagcagcu

SEQ ID NO: 2872640 - RNA, 14 nt, Human
cuuuaguggcuuca

SEQ ID NO: 2872641 - RNA, 15 nt, Human
cuuuaguguauuuau

SEQ ID NO: 2872642 - RNA, 14 nt, Human
cuuuacuuuuaaac

SEQ ID NO: 2872643 - RNA, 17 nt, Human
cuuuacuuuagaagcac

SEQ ID NO: 2872644 - RNA, 18 nt, Human
cuuuacuuuagaagcaca

SEQ ID NO: 2872645 - RNA, 13 nt, Human
cuuuacuuucccu

SEQ ID NO: 2872646 - RNA, 14 nt, Human
cuuuacuuucccuu

SEQ ID NO: 2872647 - RNA, 16 nt, Human
cuuuacuuucccuugc

SEQ ID NO: 2872648 - RNA, 17 nt, Human
cuuuacuuucccuugcu

SEQ ID NO: 2872649 - RNA, 18 nt, Human
cuuuacuuucccuugcuu

SEQ ID NO: 2872650 - RNA, 19 nt, Human
cuuuacuuucccuugcuuu

SEQ ID NO: 2872651 - RNA, 22 nt, Human
cuuuacuuucccuugcuuuucc

SEQ ID NO: 2872652 - RNA, 23 nt, Human
cuuuacuuucccuugcuuuuccc

SEQ ID NO: 2872653 - RNA, 19 nt, Human
cuuuagaaagcugacauug

SEQ ID NO: 2872654 - RNA, 13 nt, Human
cuuguuuuguuug

SEQ ID NO: 2872655 - RNA, 15 nt, Human
cuuguuuuguuuguc

SEQ ID NO: 2872656 - RNA, 16 nt, Human
cuuguuuuguuugucu

SEQ ID NO: 2872657 - RNA, 18 nt, Human
cuuguuuuguuugucucu

SEQ ID NO: 2872658 - RNA, 22 nt, Human
cuuguuuuguuugucucuccuu

SEQ ID NO: 2872659 - RNA, 23 nt, Human
cuuguuuuguuugucucuccuuu

SEQ ID NO: 2872660 - RNA, 15 nt, Human
cuuguuuuuauaaua

SEQ ID NO: 2872661 - RNA, 23 nt, Human
cuuguuuuuauaauaaaaagcuu

SEQ ID NO: 2872662 - RNA, 18 nt, Human
cuuguuuuuauuaauuua

SEQ ID NO: 2872663 - RNA, 20 nt, Human
cuuguuuuuauuaauuuaua

SEQ ID NO: 2872664 - RNA, 20 nt, Human
cuuguuuucuuucuuuaaau

SEQ ID NO: 2872665 - RNA, 21 nt, Human
cuuguuuucuuucuuuaaaug

SEQ ID NO: 2872666 - RNA, 22 nt, Human
cuuguuuucuuucuuuaaaugu

SEQ ID NO: 2872667 - RNA, 23 nt, Human
cuuguuuucuuucuuuaaauguu

SEQ ID NO: 2872668 - RNA, 14 nt, Human
cuuguuuucuggga

SEQ ID NO: 2872669 - RNA, 19 nt, Human
cuuguuuuuuuuuuccacu

SEQ ID NO: 2872670 - RNA, 20 nt, Human
cuuguuuuuuuuuuccacuu

SEQ ID NO: 2872671 - RNA, 21 nt, Human
cuuguuuuuuuuuuccacuua

SEQ ID NO: 2872672 - RNA, 22 nt, Human
cuuuaaaccuguuuuuuuuuca

SEQ ID NO: 2872673 - RNA, 23 nt, Human
cuuuaaaccuguuuuuuuuucau

SEQ ID NO: 2872674 - RNA, 13 nt, Human
cuuuaaacucagg

SEQ ID NO: 2872675 - RNA, 20 nt, Human
cuuuaaaaaaaaaaguuaca

SEQ ID NO: 2872676 - RNA, 15 nt, Human
cuuuaaacucaggga

SEQ ID NO: 2872677 - RNA, 16 nt, Human
cuuuaaacucagggac

SEQ ID NO: 2872678 - RNA, 19 nt, Human
cuuuaaacucagggacaga

SEQ ID NO: 2872679 - RNA, 22 nt, Human
cuuuaaacucagggacagagcc

SEQ ID NO: 2872680 - RNA, 16 nt, Human
cuuguggggacccagg

SEQ ID NO: 2872681 - RNA, 17 nt, Human
cuuguggggacccaggc

SEQ ID NO: 2872682 - RNA, 18 nt, Human
cuuguggggacccaggcu

SEQ ID NO: 2872683 - RNA, 20 nt, Human
cuuguggggacccaggcucc

SEQ ID NO: 2872684 - RNA, 21 nt, Human
cuuguggggacccaggcuccg

SEQ ID NO: 2872685 - RNA, 18 nt, Human
cuuguggcccucucccuu

SEQ ID NO: 2872686 - RNA, 22 nt, Human
cuuguggcccucucccuuaccc

SEQ ID NO: 2872687 - RNA, 13 nt, Human
cuuguggcagagg

SEQ ID NO: 2872688 - RNA, 17 nt, Human
cuuguggcagaggaugu

SEQ ID NO: 2872689 - RNA, 12 nt, Human
cuuguaaauacc

SEQ ID NO: 2872690 - RNA, 14 nt, Human
cuuguaaauaccag

SEQ ID NO: 2872691 - RNA, 19 nt, Human
cuuguaaauaccaggauuu

SEQ ID NO: 2872692 - RNA, 19 nt, Human
cuuguguuaaguaugugua

SEQ ID NO: 2872693 - RNA, 20 nt, Human
cuuguguuguccuuuugucu

SEQ ID NO: 2872694 - RNA, 16 nt, Human
cuuguuguaaagcaau

SEQ ID NO: 2872695 - RNA, 17 nt, Human
cuuguuguaaagcaaua

SEQ ID NO: 2872696 - RNA, 20 nt, Human
cuuguuguugguuguuuuuu

SEQ ID NO: 2872697 - RNA, 14 nt, Human
cuuguuuucaguuu

SEQ ID NO: 2872698 - RNA, 11 nt, Human
cuuguuuucca

SEQ ID NO: 2872699 - RNA, 22 nt, Human
cuuguuuuccagucucuuguac

SEQ ID NO: 2872700 - RNA, 15 nt, Human
cuuguuugucuucca

SEQ ID NO: 2872701 - RNA, 13 nt, Human
cuuguuuuauaaa

SEQ ID NO: 2872702 - RNA, 22 nt, Human
cuuguuuuauaaaauuuugcuu

SEQ ID NO: 2872703 - RNA, 21 nt, Human
cuuuauuuuccccuaucauuu

SEQ ID NO: 2872704 - RNA, 13 nt, Human
cuuuauuuguuuu

SEQ ID NO: 2872705 - RNA, 16 nt, Human
cuuuauuuguuuuuuu

SEQ ID NO: 2872706 - RNA, 17 nt, Human
cuuucagggccaugguu

SEQ ID NO: 2872707 - RNA, 12 nt, Human
cuuucagguacu

SEQ ID NO: 2872708 - RNA, 11 nt, Human
cuuuauuuucu

SEQ ID NO: 2872709 - RNA, 14 nt, Human
cuuuauuucuguca

SEQ ID NO: 2872710 - RNA, 20 nt, Human
cuuuauuggguaucaagaca

SEQ ID NO: 2872711 - RNA, 23 nt, Human
cuuuauuccagaaugcuguacau

SEQ ID NO: 2872712 - RNA, 12 nt, Human
cuuuauuccuag

SEQ ID NO: 2872713 - RNA, 18 nt, Human
cuuuauucuugaaagaag

SEQ ID NO: 2872714 - RNA, 20 nt, Human
cuuuauucuugaaagaagaa

SEQ ID NO: 2872715 - RNA, 13 nt, Human
cuuuauucuuuuc

SEQ ID NO: 2872716 - RNA, 14 nt, Human
cuuuauugcuuuuu

SEQ ID NO: 2872717 - RNA, 18 nt, Human
cuuuauugcuuuuuugua

SEQ ID NO: 2872718 - RNA, 19 nt, Human
cuuuauugcuuuuuuguau

SEQ ID NO: 2872719 - RNA, 12 nt, Human
cuuuauuggaaa

SEQ ID NO: 2872720 - RNA, 18 nt, Human
cuuuauguggaaaacaga

SEQ ID NO: 2872721 - RNA, 23 nt, Human
cuuuauguggaaaacagaacauc

SEQ ID NO: 2872722 - RNA, 20 nt, Human
cuuuauaagucauuguaugu

SEQ ID NO: 2872723 - RNA, 12 nt, Human
cuuuauguguaa

SEQ ID NO: 2872724 - RNA, 14 nt, Human
cuuuauguguaaau

SEQ ID NO: 2872725 - RNA, 20 nt, Human
cuuuauguucauuuguuugu

SEQ ID NO: 2872726 - RNA, 13 nt, Human
cuuuauuaccagu

SEQ ID NO: 2872727 - RNA, 14 nt, Human
cuuuauuacccccu

SEQ ID NO: 2872728 - RNA, 20 nt, Human
cuuuauuacccccuccuuca

SEQ ID NO: 2872729 - RNA, 22 nt, Human
cuuuauuacccccuccuucaga

SEQ ID NO: 2872730 - RNA, 12 nt, Human
cuuuauuauuau

SEQ ID NO: 2872731 - RNA, 20 nt, Human
cuuuauuccagaaugcugua

SEQ ID NO: 2872732 - RNA, 20 nt, Human
cuuuauucuggcagaggagg

SEQ ID NO: 2872733 - RNA, 15 nt, Human
cuuuccaaggcuucu

SEQ ID NO: 2872734 - RNA, 11 nt, Human
cuuucccaagc

SEQ ID NO: 2872735 - RNA, 17 nt, Human
cuuuccaaaauuuuuca

SEQ ID NO: 2872736 - RNA, 18 nt, Human
cuuuccaaaauuuuucaa

SEQ ID NO: 2872737 - RNA, 14 nt, Human
cuuucaguuagccu

SEQ ID NO: 2872738 - RNA, 19 nt, Human
cuuggggaggacaaaacuu

SEQ ID NO: 2872739 - RNA, 23 nt, Human
cuuggggaggacaaaacuucuug

SEQ ID NO: 2872740 - RNA, 17 nt, Human
cuugggccaccccuccu

SEQ ID NO: 2872741 - RNA, 13 nt, Human
cuugggccacccc

SEQ ID NO: 2872742 - RNA, 19 nt, Human
cuugggccaaauccgcucu

SEQ ID NO: 2872743 - RNA, 20 nt, Human
cuugggccaaauccgcucuc

SEQ ID NO: 2872744 - RNA, 14 nt, Human
cuugggcugcuccu

SEQ ID NO: 2872745 - RNA, 17 nt, Human
cuuggcugcagggaguc

SEQ ID NO: 2872746 - RNA, 14 nt, Human
cuuggcugcaggga

SEQ ID NO: 2872747 - RNA, 16 nt, Human
cuuggcuuuucuagcc

SEQ ID NO: 2872748 - RNA, 22 nt, Human
cuuggcuuucauuauuaguacu

SEQ ID NO: 2872749 - RNA, 16 nt, Human
cuugggagagccccug

SEQ ID NO: 2872750 - RNA, 17 nt, Human
cuugggagagccccugg

SEQ ID NO: 2872751 - RNA, 18 nt, Human
cuugggagagccccuggg

SEQ ID NO: 2872752 - RNA, 22 nt, Human
cuugggagagccccuggggccu

SEQ ID NO: 2872753 - RNA, 18 nt, Human
cuugggaauggauccugg

SEQ ID NO: 2872754 - RNA, 10 nt, Human
cuugggaaug

SEQ ID NO: 2872755 - RNA, 16 nt, Human
cuuggcugcagggagu

SEQ ID NO: 2872756 - RNA, 18 nt, Human
cuuggaguauuggggucu

SEQ ID NO: 2872757 - RNA, 14 nt, Human
cuuggagggaccaa

SEQ ID NO: 2872758 - RNA, 21 nt, Human
cuuggagcuuacauaguuuua

SEQ ID NO: 2872759 - RNA, 20 nt, Human
cuuggagggcccacuuguau

SEQ ID NO: 2872760 - RNA, 19 nt, Human
cuuggagggcccacuugua

SEQ ID NO: 2872761 - RNA, 15 nt, Human
cuuggagggauaagc

SEQ ID NO: 2872762 - RNA, 15 nt, Human
cuugccaugugacuc

SEQ ID NO: 2872763 - RNA, 21 nt, Human
cuugccaugugacucuggcuu

SEQ ID NO: 2872764 - RNA, 23 nt, Human
cuugcccccugcccguguacaua

SEQ ID NO: 2872765 - RNA, 14 nt, Human
cuugcucugcugac

SEQ ID NO: 2872766 - RNA, 13 nt, Human
cuugcucugcuga

SEQ ID NO: 2872767 - RNA, 15 nt, Human
cuugcccuagaugag

SEQ ID NO: 2872768 - RNA, 19 nt, Human
cuugcccuagauaguuuau

SEQ ID NO: 2872769 - RNA, 20 nt, Human
cuugcccggauucugggagg

SEQ ID NO: 2872770 - RNA, 18 nt, Human
cuugcccggauucuggga

SEQ ID NO: 2872771 - RNA, 17 nt, Human
cuugcccggauucuggg

SEQ ID NO: 2872772 - RNA, 20 nt, Human
cuugccagagccgggcacau

SEQ ID NO: 2872773 - RNA, 14 nt, Human
cuugccagaugcug

SEQ ID NO: 2872774 - RNA, 17 nt, Human
cuugccagaugcugcag

SEQ ID NO: 2872775 - RNA, 13 nt, Human
cuugccagagccg

SEQ ID NO: 2872776 - RNA, 20 nt, Human
cuugccagaaguuguggauu

SEQ ID NO: 2872777 - RNA, 15 nt, Human
cuugccacuuugcac

SEQ ID NO: 2872778 - RNA, 17 nt, Human
cuugccacuuugcacga

SEQ ID NO: 2872779 - RNA, 14 nt, Human
cuugccacugccuc

SEQ ID NO: 2872780 - RNA, 15 nt, Human
cuugccacugccucu

SEQ ID NO: 2872781 - RNA, 21 nt, Human
cuucuccacccugcucuccga

SEQ ID NO: 2872782 - RNA, 13 nt, Human
cuugccacugccu

SEQ ID NO: 2872783 - RNA, 16 nt, Human
cuucuccacccugcuc

SEQ ID NO: 2872784 - RNA, 18 nt, Human
cuucuccacccugcucuc

SEQ ID NO: 2872785 - RNA, 17 nt, Human
cuucuccacccugcucu

SEQ ID NO: 2872786 - RNA, 23 nt, Human
cuuggaaagcaucaccucaggcc

SEQ ID NO: 2872787 - RNA, 20 nt, Human
cuuggaaagcaucaccucag

SEQ ID NO: 2872788 - RNA, 22 nt, Human
cuuggaaagcaucaccucaggc

SEQ ID NO: 2872789 - RNA, 21 nt, Human
cuuggaaagcaucaccucagg

SEQ ID NO: 2872790 - RNA, 13 nt, Human
cuuggaagcuccg

SEQ ID NO: 2872791 - RNA, 17 nt, Human
cuugcucugcugacaga

SEQ ID NO: 2872792 - RNA, 16 nt, Human
cuugcucugcugacag

SEQ ID NO: 2872793 - RNA, 16 nt, Human
cuugcuguccuaggcc

SEQ ID NO: 2872794 - RNA, 11 nt, Human
cuugcccugcu

SEQ ID NO: 2872795 - RNA, 12 nt, Human
cuugcccugcuc

SEQ ID NO: 2872796 - RNA, 13 nt, Human
cuugcccugcucc

SEQ ID NO: 2872797 - RNA, 15 nt, Human
cuugcccugcucccu

SEQ ID NO: 2872798 - RNA, 16 nt, Human
cuugcccugcucccuc

SEQ ID NO: 2872799 - RNA, 20 nt, Human
cuugcuguccuaggccacac

SEQ ID NO: 2872800 - RNA, 13 nt, Human
cuugcuguccuga

SEQ ID NO: 2872801 - RNA, 16 nt, Human
cuugcuguccugaucu

SEQ ID NO: 2872802 - RNA, 17 nt, Human
cuugcuguccugaucug

SEQ ID NO: 2872803 - RNA, 18 nt, Human
cuugcuguccugaucugu

SEQ ID NO: 2872804 - RNA, 12 nt, Human
cuugcugucucu

SEQ ID NO: 2872805 - RNA, 13 nt, Human
cuugcugucucug

SEQ ID NO: 2872806 - RNA, 14 nt, Human
cuugcugucucugc

SEQ ID NO: 2872807 - RNA, 15 nt, Human
cuugcugucucugcu

SEQ ID NO: 2872808 - RNA, 16 nt, Human
cuugcugucucugcuc

SEQ ID NO: 2872809 - RNA, 17 nt, Human
cuugcugucucugcucg

SEQ ID NO: 2872810 - RNA, 21 nt, Human
cuugcugucucugcucgcccu

SEQ ID NO: 2872811 - RNA, 17 nt, Human
cuugcuguccuaggcca

SEQ ID NO: 2872812 - RNA, 15 nt, Human
cuugcuuuucccucu

SEQ ID NO: 2872813 - RNA, 16 nt, Human
cuugcuuuucccucuu

SEQ ID NO: 2872814 - RNA, 17 nt, Human
cuugcuuuucccucuuu

SEQ ID NO: 2872815 - RNA, 18 nt, Human
cuugcuuuucccucuuuu

SEQ ID NO: 2872816 - RNA, 20 nt, Human
cuugcuuuucccucuuuucu

SEQ ID NO: 2872817 - RNA, 21 nt, Human
cuugcuuuucccucuuuucuu

SEQ ID NO: 2872818 - RNA, 22 nt, Human
cuugcuuuucccucuuuucuua

SEQ ID NO: 2872819 - RNA, 22 nt, Human
cuugcuuaccuugacuguugau

SEQ ID NO: 2872820 - RNA, 24 nt, Human
cuugcuuaccuugacuguugaugu

SEQ ID NO: 2872821 - RNA, 16 nt, Human
cuucucaucuugugaa

SEQ ID NO: 2872822 - RNA, 15 nt, Human
cuugcuguccuaggc

SEQ ID NO: 2872823 - RNA, 19 nt, Human
cuugcuguugacauauuua

SEQ ID NO: 2872824 - RNA, 20 nt, Human
cuugcuguugacauauuuaa

SEQ ID NO: 2872825 - RNA, 21 nt, Human
cuugcuguugacauauuuaau

SEQ ID NO: 2872826 - RNA, 23 nt, Human
cuugcuguugacauauuuaaugu

SEQ ID NO: 2872827 - RNA, 16 nt, Human
cuugcuguuggucaug

SEQ ID NO: 2872828 - RNA, 20 nt, Human
cuugcuguuggucauguggg

SEQ ID NO: 2872829 - RNA, 14 nt, Human
cuccccugccauuu

SEQ ID NO: 2872830 - RNA, 13 nt, Human
cuccccugcccug

SEQ ID NO: 2872831 - RNA, 12 nt, Human
cuccccugcccu

SEQ ID NO: 2872832 - RNA, 14 nt, Human
cuccccugcccugc

SEQ ID NO: 2872833 - RNA, 19 nt, Human
cuccccuuccucacugccc

SEQ ID NO: 2872834 - RNA, 21 nt, Human
cuccccuguuucaaucacugu

SEQ ID NO: 2872835 - RNA, 22 nt, Human
cuccccuugauuuaaacacaca

SEQ ID NO: 2872836 - RNA, 23 nt, Human
cuccccuugauuuaaacacacag

SEQ ID NO: 2872837 - RNA, 12 nt, Human
cuccccuucucu

SEQ ID NO: 2872838 - RNA, 23 nt, Human
cuccccagcaagugagagcuggg

SEQ ID NO: 2872839 - RNA, 22 nt, Human
cuccccagcaagugagagcugg

SEQ ID NO: 2872840 - RNA, 21 nt, Human
cuccccagcaagugagagcug

SEQ ID NO: 2872841 - RNA, 20 nt, Human
cuccccuccuccuggacucc

SEQ ID NO: 2872842 - RNA, 12 nt, Human
cuccccuccucc

SEQ ID NO: 2872843 - RNA, 20 nt, Human
cucccgaguagcugggacua

SEQ ID NO: 2872844 - RNA, 19 nt, Human
cucccgaguagcugggacu

SEQ ID NO: 2872845 - RNA, 18 nt, Human
cucccgaguagcugggac

SEQ ID NO: 2872846 - RNA, 15 nt, Human
cucccggugcccaag

SEQ ID NO: 2872847 - RNA, 21 nt, Human
cucccggugcccaagaauaga

SEQ ID NO: 2872848 - RNA, 16 nt, Human
cucccgccccuuccca

SEQ ID NO: 2872849 - RNA, 21 nt, Human
cucccgccagacuguuagaaa

SEQ ID NO: 2872850 - RNA, 22 nt, Human
cuccccuuucccucgcuaugug

SEQ ID NO: 2872851 - RNA, 22 nt, Human
cucccgaguagcugggauuaca

SEQ ID NO: 2872852 - RNA, 20 nt, Human
cucccgaguagggaggacca

SEQ ID NO: 2872853 - RNA, 17 nt, Human
cucccgauucccaacug

SEQ ID NO: 2872854 - RNA, 14 nt, Human
cucccugcccaggc

SEQ ID NO: 2872855 - RNA, 15 nt, Human
cucccugccccaaau

SEQ ID NO: 2872856 - RNA, 17 nt, Human
cucccugccccucccuu

SEQ ID NO: 2872857 - RNA, 18 nt, Human
cucccugccccucccuuc

SEQ ID NO: 2872858 - RNA, 20 nt, Human
cucccugccccucccuucaa

SEQ ID NO: 2872859 - RNA, 21 nt, Human
cucccugccccucccuucaac

SEQ ID NO: 2872860 - RNA, 13 nt, Human
cucccugccagag

SEQ ID NO: 2872861 - RNA, 14 nt, Human
cucccugccagagg

SEQ ID NO: 2872862 - RNA, 19 nt, Human
cucccugccagaggggaag

SEQ ID NO: 2872863 - RNA, 14 nt, Human
cucccuaaacugua

SEQ ID NO: 2872864 - RNA, 16 nt, Human
cucccuaagccagccu

SEQ ID NO: 2872865 - RNA, 17 nt, Human
cucccuaagccagccug

SEQ ID NO: 2872866 - RNA, 18 nt, Human
cucccuaagccagccugg

SEQ ID NO: 2872867 - RNA, 21 nt, Human
cucccuaaggcaugugugaaa

SEQ ID NO: 2872868 - RNA, 13 nt, Human
cucccugccccuc

SEQ ID NO: 2872869 - RNA, 14 nt, Human
cucccugccccucc

SEQ ID NO: 2872870 - RNA, 23 nt, Human
cucccugccccccagcccuccuu

SEQ ID NO: 2872871 - RNA, 17 nt, Human
cucccugccccccagcc

SEQ ID NO: 2872872 - RNA, 18 nt, Human
cuccucagggcagccucc

SEQ ID NO: 2872873 - RNA, 16 nt, Human
cuccucauccagggcu

SEQ ID NO: 2872874 - RNA, 20 nt, Human
cuccucauccagggcucuga

SEQ ID NO: 2872875 - RNA, 14 nt, Human
cuccucacccccag

SEQ ID NO: 2872876 - RNA, 21 nt, Human
cuccucacaacauggugucug

SEQ ID NO: 2872877 - RNA, 15 nt, Human
cuccucacacacccu

SEQ ID NO: 2872878 - RNA, 17 nt, Human
cuccucacacacccuga

SEQ ID NO: 2872879 - RNA, 19 nt, Human
cuccucacacacccugagg

SEQ ID NO: 2872880 - RNA, 16 nt, Human
cuccucacacuuacug

SEQ ID NO: 2872881 - RNA, 17 nt, Human
cuccucccaggcgcccc

SEQ ID NO: 2872882 - RNA, 12 nt, Human
cuccucccagcu

SEQ ID NO: 2872883 - RNA, 14 nt, Human
cuccucccagcuug

SEQ ID NO: 2872884 - RNA, 23 nt, Human
cuccucccagcuuguaggagcug

SEQ ID NO: 2872885 - RNA, 22 nt, Human
cuccucccaggcgccccuuccc

SEQ ID NO: 2872886 - RNA, 23 nt, Human
cuccucccaggcgccccuucccc

SEQ ID NO: 2872887 - RNA, 12 nt, Human
cuccucccagga

SEQ ID NO: 2872888 - RNA, 22 nt, Human
cuccuccgaggugguuuuaaag

SEQ ID NO: 2872889 - RNA, 19 nt, Human
cuccuccuggacuccugca

SEQ ID NO: 2872890 - RNA, 15 nt, Human
cuccuccucccccag

SEQ ID NO: 2872891 - RNA, 14 nt, Human
cuccuccuccccca

SEQ ID NO: 2872892 - RNA, 12 nt, Human
cuccuccucgga

SEQ ID NO: 2872893 - RNA, 13 nt, Human
cuccuccucggaa

SEQ ID NO: 2872894 - RNA, 12 nt, Human
cuccuccucuuu

SEQ ID NO: 2872895 - RNA, 13 nt, Human
cuccuccucuuuc

SEQ ID NO: 2872896 - RNA, 14 nt, Human
cuccuccucuuucu

SEQ ID NO: 2872897 - RNA, 15 nt, Human
cuccuccucuuucuc

SEQ ID NO: 2872898 - RNA, 16 nt, Human
cuccuccucuuucucu

SEQ ID NO: 2872899 - RNA, 17 nt, Human
cuccuccucuuucucuc

SEQ ID NO: 2872900 - RNA, 19 nt, Human
cuccuccucuuucucuccc

SEQ ID NO: 2872901 - RNA, 15 nt, Human
cuccuccuggacucc

SEQ ID NO: 2872902 - RNA, 14 nt, Human
cuccuccuggacuc

SEQ ID NO: 2872903 - RNA, 16 nt, Human
cuccuauuuuuguaaa

SEQ ID NO: 2872904 - RNA, 19 nt, Human
cuccuauuuuuguaaacug

SEQ ID NO: 2872905 - RNA, 20 nt, Human
cuccucaauuuuugucucag

SEQ ID NO: 2872906 - RNA, 21 nt, Human
cuccucaauuuuugucucaga

SEQ ID NO: 2872907 - RNA, 18 nt, Human
cuccgaggugguuuuaaa

SEQ ID NO: 2872908 - RNA, 22 nt, Human
cuccuaucagaaguuucucagc

SEQ ID NO: 2872909 - RNA, 13 nt, Human
cucccugugucca

SEQ ID NO: 2872910 - RNA, 21 nt, Human
cucccuguguccaccuguggg

SEQ ID NO: 2872911 - RNA, 13 nt, Human
cucccuguuauuu

SEQ ID NO: 2872912 - RNA, 24 nt, Human
cucccuguuauuuucaaguagcug

SEQ ID NO: 2872913 - RNA, 18 nt, Human
cucccugguucugaugau

SEQ ID NO: 2872914 - RNA, 19 nt, Human
cucccuuggggccuaugca

SEQ ID NO: 2872915 - RNA, 20 nt, Human
cucccuugguggcaagagcc

SEQ ID NO: 2872916 - RNA, 21 nt, Human
cucccuugguggcaagagccc

SEQ ID NO: 2872917 - RNA, 14 nt, Human
cuccuuggugccug

SEQ ID NO: 2872918 - RNA, 14 nt, Human
cuccuuccuuaccc

SEQ ID NO: 2872919 - RNA, 19 nt, Human
cuccuuccuuacccaaacu

SEQ ID NO: 2872920 - RNA, 23 nt, Human
cuccuuccuuacccaaacuguuc

SEQ ID NO: 2872921 - RNA, 22 nt, Human
cuccuuccuugcuguccuaggc

SEQ ID NO: 2872922 - RNA, 13 nt, Human
cuccuuccuuguu

SEQ ID NO: 2872923 - RNA, 22 nt, Human
cuccuuggugccuggccuggca

SEQ ID NO: 2872924 - RNA, 15 nt, Human
cuccuuggugccugg

SEQ ID NO: 2872925 - RNA, 19 nt, Human
cuccuuggugccuggccug

SEQ ID NO: 2872926 - RNA, 23 nt, Human
cucgacguuuacaagcccccccu

SEQ ID NO: 2872927 - RNA, 17 nt, Human
cucgagcaguccugccu

SEQ ID NO: 2872928 - RNA, 23 nt, Human
cucgagcaguccugccucagccu

SEQ ID NO: 2872929 - RNA, 15 nt, Human
cucgagcuuggggca

SEQ ID NO: 2872930 - RNA, 18 nt, Human
cucgagggcagggaccac

SEQ ID NO: 2872931 - RNA, 23 nt, Human
cucgagggcagggaccacacccu

SEQ ID NO: 2872932 - RNA, 14 nt, Human
cucgcaccuuucca

SEQ ID NO: 2872933 - RNA, 15 nt, Human
cucgcaccuuuccaa

SEQ ID NO: 2872934 - RNA, 17 nt, Human
cucgcacggccccgaag

SEQ ID NO: 2872935 - RNA, 16 nt, Human
cucgcaccccccuguu

SEQ ID NO: 2872936 - RNA, 17 nt, Human
cucgcaccccccuguuc

SEQ ID NO: 2872937 - RNA, 19 nt, Human
cucgcaccccccuguucua

SEQ ID NO: 2872938 - RNA, 20 nt, Human
cucgcaccccccuguucuaa

SEQ ID NO: 2872939 - RNA, 21 nt, Human
cucgcaccccccuguucuaag

SEQ ID NO: 2872940 - RNA, 23 nt, Human
cucgcaccccccuguucuaaggg

SEQ ID NO: 2872941 - RNA, 17 nt, Human
cucgauucauauugaau

SEQ ID NO: 2872942 - RNA, 19 nt, Human
cucgauguguacucuaacu

SEQ ID NO: 2872943 - RNA, 23 nt, Human
cucgcaaaaacguaucuccuaau

SEQ ID NO: 2872944 - RNA, 16 nt, Human
cucgcucuguuaccca

SEQ ID NO: 2872945 - RNA, 23 nt, Human
cucgcucugucgcccaggcugga

SEQ ID NO: 2872946 - RNA, 18 nt, Human
cucgcucccucccaggac

SEQ ID NO: 2872947 - RNA, 22 nt, Human
cucgcuauugucaccagggcug

SEQ ID NO: 2872948 - RNA, 15 nt, Human
cucgcucccucccag

SEQ ID NO: 2872949 - RNA, 15 nt, Human
cucgccgucugugaa

SEQ ID NO: 2872950 - RNA, 16 nt, Human
cucgccgucugugaau

SEQ ID NO: 2872951 - RNA, 13 nt, Human
cucgccucuccca

SEQ ID NO: 2872952 - RNA, 14 nt, Human
cucgccucucccac

SEQ ID NO: 2872953 - RNA, 15 nt, Human
cucgccuucaucucc

SEQ ID NO: 2872954 - RNA, 15 nt, Human
cucgcccuccuuucu

SEQ ID NO: 2872955 - RNA, 17 nt, Human
cucgcccuccuuucugu

SEQ ID NO: 2872956 - RNA, 19 nt, Human
cucgcccuccuuucugugc

SEQ ID NO: 2872957 - RNA, 24 nt, Human
cuccugugugugcgccuacaggag

SEQ ID NO: 2872958 - RNA, 23 nt, Human
cuccugugugugcgccuacagga

SEQ ID NO: 2872959 - RNA, 21 nt, Human
cuccugugugugcgccuacag

SEQ ID NO: 2872960 - RNA, 11 nt, Human
cuccuggacuc

SEQ ID NO: 2872961 - RNA, 22 nt, Human
cuccuggaacagaagacagcug

SEQ ID NO: 2872962 - RNA, 17 nt, Human
cuccuggaaccuugcug

SEQ ID NO: 2872963 - RNA, 18 nt, Human
cuccuggaaccuugcugu

SEQ ID NO: 2872964 - RNA, 19 nt, Human
cuccuggaaccuugcuguc

SEQ ID NO: 2872965 - RNA, 20 nt, Human
cuccuggaaccuugcugucc

SEQ ID NO: 2872966 - RNA, 21 nt, Human
cuccuggaaccuugcuguccu

SEQ ID NO: 2872967 - RNA, 22 nt, Human
cuccuggaaccuugcuguccug

SEQ ID NO: 2872968 - RNA, 23 nt, Human
cuccuggaaccuugcuguccuga

SEQ ID NO: 2872969 - RNA, 17 nt, Human
cuccuggaaaggcucag

SEQ ID NO: 2872970 - RNA, 19 nt, Human
cuccuggaaaggcucaguc

SEQ ID NO: 2872971 - RNA, 18 nt, Human
cuccuggaaaggcucagu

SEQ ID NO: 2872972 - RNA, 24 nt, Human
cuccuggaaaggcucagucucagg

SEQ ID NO: 2872973 - RNA, 23 nt, Human
cuccuggaaaggcucagucucag

SEQ ID NO: 2872974 - RNA, 22 nt, Human
cuccuggaaaggcucagucuca

SEQ ID NO: 2872975 - RNA, 20 nt, Human
cuccuggaaaggcucagucu

SEQ ID NO: 2872976 - RNA, 22 nt, Human
cuccuuaucaaaggacaccauu

SEQ ID NO: 2872977 - RNA, 17 nt, Human
cuccuuaucaaaggaca

SEQ ID NO: 2872978 - RNA, 16 nt, Human
cuccuucccaucgcug

SEQ ID NO: 2872979 - RNA, 17 nt, Human
cuccuucccaucgcugu

SEQ ID NO: 2872980 - RNA, 15 nt, Human
cuccucuccccagca

SEQ ID NO: 2872981 - RNA, 13 nt, Human
cuccucuccccag

SEQ ID NO: 2872982 - RNA, 23 nt, Human
cuccugccuagcugccuagcaag

SEQ ID NO: 2872983 - RNA, 11 nt, Human
cuccugccuca

SEQ ID NO: 2872984 - RNA, 12 nt, Human
cuccugccucag

SEQ ID NO: 2872985 - RNA, 16 nt, Human
cuccugccucagccuc

SEQ ID NO: 2872986 - RNA, 17 nt, Human
cuccugccucagccucc

SEQ ID NO: 2872987 - RNA, 21 nt, Human
cuccugccucgaacuggcugc

SEQ ID NO: 2872988 - RNA, 20 nt, Human
cuccugccucgaacuggcug

SEQ ID NO: 2872989 - RNA, 18 nt, Human
cuccugccucgaacuggc

SEQ ID NO: 2872990 - RNA, 21 nt, Human
cuccugccucagccuccugag

SEQ ID NO: 2872991 - RNA, 19 nt, Human
cuccugccucagccucccg

SEQ ID NO: 2872992 - RNA, 22 nt, Human
cuccugccucgaacuggcugca

SEQ ID NO: 2872993 - RNA, 11 nt, Human
cuccucccagc

SEQ ID NO: 2872994 - RNA, 22 nt, Human
cuccaucccucuaaugagacug

SEQ ID NO: 2872995 - RNA, 15 nt, Human
cuccaucccucuaau

SEQ ID NO: 2872996 - RNA, 13 nt, Human
cuccaucccucua

SEQ ID NO: 2872997 - RNA, 12 nt, Human
cuccaucccucu

SEQ ID NO: 2872998 - RNA, 17 nt, Human
cuccaucccaacagcca

SEQ ID NO: 2872999 - RNA, 22 nt, Human
cuccaucccaacagccaugccc

SEQ ID NO: 2873000 - RNA, 22 nt, Human
cuccaucacccucuuccuguga

SEQ ID NO: 2873001 - RNA, 18 nt, Human
cuccaucaguuagagcug

SEQ ID NO: 2873002 - RNA, 19 nt, Human
cuccaucaguuagagcuga

SEQ ID NO: 2873003 - RNA, 11 nt, Human
cuccaggcagg

SEQ ID NO: 2873004 - RNA, 15 nt, Human
cuccaucacccucuu

SEQ ID NO: 2873005 - RNA, 16 nt, Human
cuccaggcaccaucuc

SEQ ID NO: 2873006 - RNA, 17 nt, Human
cuccaggcaccaucucc

SEQ ID NO: 2873007 - RNA, 11 nt, Human
cuccaggacca

SEQ ID NO: 2873008 - RNA, 15 nt, Human
cuccaccuugcgggg

SEQ ID NO: 2873009 - RNA, 18 nt, Human
cuccacgauccugccacc

SEQ ID NO: 2873010 - RNA, 20 nt, Human
cuccacgauccugccacccu

SEQ ID NO: 2873011 - RNA, 23 nt, Human
cuccacgauccugccacccugua

SEQ ID NO: 2873012 - RNA, 15 nt, Human
cuccacgcgcuucga

SEQ ID NO: 2873013 - RNA, 12 nt, Human
cuccaccuuccc

SEQ ID NO: 2873014 - RNA, 14 nt, Human
cuccaccuucccac

SEQ ID NO: 2873015 - RNA, 22 nt, Human
cuccaccucuucaccccccacu

SEQ ID NO: 2873016 - RNA, 12 nt, Human
cuccagccuggg

SEQ ID NO: 2873017 - RNA, 21 nt, Human
cuccagccuuuggccuuggcu

SEQ ID NO: 2873018 - RNA, 13 nt, Human
cuccagcgcugag

SEQ ID NO: 2873019 - RNA, 20 nt, Human
cuccagccugggaggcacag

SEQ ID NO: 2873020 - RNA, 14 nt, Human
cuccagccugggca

SEQ ID NO: 2873021 - RNA, 13 nt, Human
cuccagccugggc

SEQ ID NO: 2873022 - RNA, 20 nt, Human
cuccagcgucaucggacucu

SEQ ID NO: 2873023 - RNA, 12 nt, Human
cuccacccuugg

SEQ ID NO: 2873024 - RNA, 15 nt, Human
cuccacccugcucuc

SEQ ID NO: 2873025 - RNA, 13 nt, Human
cuccaccacaucc

SEQ ID NO: 2873026 - RNA, 13 nt, Human
cuccacccugcuc

SEQ ID NO: 2873027 - RNA, 15 nt, Human
cuccacacaagggaa

SEQ ID NO: 2873028 - RNA, 20 nt, Human
cuccacacaagggaaggaca

SEQ ID NO: 2873029 - RNA, 21 nt, Human
cuccacacaagggaaggacag

SEQ ID NO: 2873030 - RNA, 17 nt, Human
cuccaaugucugcugag

SEQ ID NO: 2873031 - RNA, 19 nt, Human
cuccaaugucugcugagga

SEQ ID NO: 2873032 - RNA, 20 nt, Human
cuccaaugucugcugaggag

SEQ ID NO: 2873033 - RNA, 15 nt, Human
cuccaagucucagug

SEQ ID NO: 2873034 - RNA, 14 nt, Human
cuccaaaggccccc

SEQ ID NO: 2873035 - RNA, 16 nt, Human
cuccaagucucagugg

SEQ ID NO: 2873036 - RNA, 17 nt, Human
cuccaagucucaguggc

SEQ ID NO: 2873037 - RNA, 21 nt, Human
cuccaagucucaguggcuuca

SEQ ID NO: 2873038 - RNA, 22 nt, Human
cuccaaucccaccaacccucag

SEQ ID NO: 2873039 - RNA, 16 nt, Human
cucauuucuaaaagaa

SEQ ID NO: 2873040 - RNA, 22 nt, Human
cucauuugguuugauuuucccu

SEQ ID NO: 2873041 - RNA, 18 nt, Human
cucauuuuuuuaauuuau

SEQ ID NO: 2873042 - RNA, 20 nt, Human
cucauuuuuuuaauuuauua

SEQ ID NO: 2873043 - RNA, 22 nt, Human
cucauuuuuuuuuuuguuucug

SEQ ID NO: 2873044 - RNA, 23 nt, Human
cucauuuuuuuuuuuguuucuga

SEQ ID NO: 2873045 - RNA, 17 nt, Human
cuccaaaacccaugugg

SEQ ID NO: 2873046 - RNA, 20 nt, Human
cuccaaaacccaugugggaa

SEQ ID NO: 2873047 - RNA, 19 nt, Human
cucauuaaccgaugcuuua

SEQ ID NO: 2873048 - RNA, 23 nt, Human
cucauuaaccgaugcuuuaccaa

SEQ ID NO: 2873049 - RNA, 15 nt, Human
cucauuacugggccu

SEQ ID NO: 2873050 - RNA, 16 nt, Human
cucauuacugggccuu

SEQ ID NO: 2873051 - RNA, 18 nt, Human
cucauuacugggccuuag

SEQ ID NO: 2873052 - RNA, 17 nt, Human
cucauuugucacacacu

SEQ ID NO: 2873053 - RNA, 15 nt, Human
cucaucucuguccca

SEQ ID NO: 2873054 - RNA, 14 nt, Human
cucaucugcacccu

SEQ ID NO: 2873055 - RNA, 15 nt, Human
cucaucugcacccuu

SEQ ID NO: 2873056 - RNA, 18 nt, Human
cucaucugcacccuucuu

SEQ ID NO: 2873057 - RNA, 19 nt, Human
cucaucugcacccuucuuu

SEQ ID NO: 2873058 - RNA, 20 nt, Human
cucaucugcacccuucuuuu

SEQ ID NO: 2873059 - RNA, 21 nt, Human
cucaucugcacccuucuuuuc

SEQ ID NO: 2873060 - RNA, 13 nt, Human
cucaucugaggca

SEQ ID NO: 2873061 - RNA, 13 nt, Human
cucauuaaaaaaa

SEQ ID NO: 2873062 - RNA, 13 nt, Human
cucauguuuauga

SEQ ID NO: 2873063 - RNA, 15 nt, Human
cucauguuuaugaaa

SEQ ID NO: 2873064 - RNA, 17 nt, Human
cucauguuuaugaaaau

SEQ ID NO: 2873065 - RNA, 18 nt, Human
cucauguuuaugaaaaua

SEQ ID NO: 2873066 - RNA, 21 nt, Human
cucauguuuaugaaaauaaau

SEQ ID NO: 2873067 - RNA, 19 nt, Human
cucaucccguguucuccuu

SEQ ID NO: 2873068 - RNA, 18 nt, Human
cucaucccuaaugcugca

SEQ ID NO: 2873069 - RNA, 16 nt, Human
cucaucccguguucuc

SEQ ID NO: 2873070 - RNA, 23 nt, Human
cucauccccaggggucccagcca

SEQ ID NO: 2873071 - RNA, 16 nt, Human
cucauccccaguccca

SEQ ID NO: 2873072 - RNA, 19 nt, Human
cucauccccagucccaaug

SEQ ID NO: 2873073 - RNA, 16 nt, Human
cucaucauaaaauaaa

SEQ ID NO: 2873074 - RNA, 21 nt, Human
cucaucccuaaugcugcagau

SEQ ID NO: 2873075 - RNA, 16 nt, Human
cucauccucagaugcu

SEQ ID NO: 2873076 - RNA, 22 nt, Human
cucauccucagaugcucaaagu

SEQ ID NO: 2873077 - RNA, 13 nt, Human
cucauccuccagu

SEQ ID NO: 2873078 - RNA, 22 nt, Human
cucauccuccaguaccuugcuu

SEQ ID NO: 2873079 - RNA, 23 nt, Human
cucauccuccaguaccuugcuuc

SEQ ID NO: 2873080 - RNA, 13 nt, Human
cucauccuccugg

SEQ ID NO: 2873081 - RNA, 15 nt, Human
cucauccuccuggaa

SEQ ID NO: 2873082 - RNA, 23 nt, Human
cucauccuccuggaaccuugcug

SEQ ID NO: 2873083 - RNA, 14 nt, Human
cucauccugaacag

SEQ ID NO: 2873084 - RNA, 16 nt, Human
cucauccugaacagca

SEQ ID NO: 2873085 - RNA, 17 nt, Human
cucaucaaucaaauaag

SEQ ID NO: 2873086 - RNA, 23 nt, Human
cucauaguaugguggcuggguug

SEQ ID NO: 2873087 - RNA, 21 nt, Human
cucaucaaucaaauaaguauu

SEQ ID NO: 2873088 - RNA, 13 nt, Human
cucaucacacaca

SEQ ID NO: 2873089 - RNA, 14 nt, Human
cucaucacacacau

SEQ ID NO: 2873090 - RNA, 15 nt, Human
cucaucacacacaug

SEQ ID NO: 2873091 - RNA, 16 nt, Human
cucaucacacacaugg

SEQ ID NO: 2873092 - RNA, 17 nt, Human
cucaucacacacaugga

SEQ ID NO: 2873093 - RNA, 15 nt, Human
cucaucauaaaauaa

SEQ ID NO: 2873094 - RNA, 14 nt, Human
cucaucauaaaaua

SEQ ID NO: 2873095 - RNA, 12 nt, Human
cucaucauaaaa

SEQ ID NO: 2873096 - RNA, 12 nt, Human
cucaucacugug

SEQ ID NO: 2873097 - RNA, 13 nt, Human
cucaucacugugg

SEQ ID NO: 2873098 - RNA, 15 nt, Human
cucaucacuguggcu

SEQ ID NO: 2873099 - RNA, 16 nt, Human
cucaucacuguggcug

SEQ ID NO: 2873100 - RNA, 21 nt, Human
cucaucacuguggcugucugg

SEQ ID NO: 2873101 - RNA, 19 nt, Human
cucaggugauccacccacc

SEQ ID NO: 2873102 - RNA, 18 nt, Human
cucaggugauccacccac

SEQ ID NO: 2873103 - RNA, 20 nt, Human
cucaggugauccacccaccu

SEQ ID NO: 2873104 - RNA, 18 nt, Human
cucaggggaaaacuguua

SEQ ID NO: 2873105 - RNA, 21 nt, Human
cucauaguaugguggcugggu

SEQ ID NO: 2873106 - RNA, 21 nt, Human
cucauagcccucacccugggg

SEQ ID NO: 2873107 - RNA, 20 nt, Human
cucauagcccucacccuggg

SEQ ID NO: 2873108 - RNA, 17 nt, Human
cucauagcccucacccu

SEQ ID NO: 2873109 - RNA, 13 nt, Human
cucauagcccuca

SEQ ID NO: 2873110 - RNA, 21 nt, Human
cucauacuacauugaguagac

SEQ ID NO: 2873111 - RNA, 14 nt, Human
cucauaccucugac

SEQ ID NO: 2873112 - RNA, 15 nt, Human
cucauaccucugacc

SEQ ID NO: 2873113 - RNA, 21 nt, Human
cucauaccucugaccaacagg

SEQ ID NO: 2873114 - RNA, 18 nt, Human
cucagcauccuggcaccc

SEQ ID NO: 2873115 - RNA, 15 nt, Human
cucagcauccuggca

SEQ ID NO: 2873116 - RNA, 12 nt, Human
cucagccaagcu

SEQ ID NO: 2873117 - RNA, 13 nt, Human
cucagccaagcuu

SEQ ID NO: 2873118 - RNA, 14 nt, Human
cucagccaagcuug

SEQ ID NO: 2873119 - RNA, 17 nt, Human
cucagccacacccaggc

SEQ ID NO: 2873120 - RNA, 19 nt, Human
cucagccacacccaggcac

SEQ ID NO: 2873121 - RNA, 22 nt, Human
cucaggaggcugaggcaggagg

SEQ ID NO: 2873122 - RNA, 20 nt, Human
cucaggaggcugaggcagga

SEQ ID NO: 2873123 - RNA, 19 nt, Human
cucagcccacauagugaug

SEQ ID NO: 2873124 - RNA, 19 nt, Human
cucaggauuuaaaaacugg

SEQ ID NO: 2873125 - RNA, 20 nt, Human
cucaggauuuaaaaacugga

SEQ ID NO: 2873126 - RNA, 14 nt, Human
cucaggcacuagcc

SEQ ID NO: 2873127 - RNA, 15 nt, Human
cucaggcacuagccu

SEQ ID NO: 2873128 - RNA, 18 nt, Human
cucaggcacuagccuuug

SEQ ID NO: 2873129 - RNA, 19 nt, Human
cucaggcacuagccuuugg

SEQ ID NO: 2873130 - RNA, 14 nt, Human
cucaggcaccaguc

SEQ ID NO: 2873131 - RNA, 16 nt, Human
cucaggaggcugaggg

SEQ ID NO: 2873132 - RNA, 23 nt, Human
cucaggaggcugaggcaggagga

SEQ ID NO: 2873133 - RNA, 20 nt, Human
cucaggauauccuuaucaga

SEQ ID NO: 2873134 - RNA, 22 nt, Human
cucaggauauccuuaucagagc

SEQ ID NO: 2873135 - RNA, 12 nt, Human
cucaggauccaa

SEQ ID NO: 2873136 - RNA, 18 nt, Human
cucaggauccaagcuaag

SEQ ID NO: 2873137 - RNA, 20 nt, Human
cucaggauccaagcuaagca

SEQ ID NO: 2873138 - RNA, 14 nt, Human
cucagggacagagc

SEQ ID NO: 2873139 - RNA, 15 nt, Human
cucagggacagagcc

SEQ ID NO: 2873140 - RNA, 16 nt, Human
cucagggacagagcca

SEQ ID NO: 2873141 - RNA, 18 nt, Human
cucagggacagagccaug

SEQ ID NO: 2873142 - RNA, 19 nt, Human
cucagggacagagccaugc

SEQ ID NO: 2873143 - RNA, 23 nt, Human
cucaggcacuagccuuuggcucu

SEQ ID NO: 2873144 - RNA, 14 nt, Human
cucaggcagcucaa

SEQ ID NO: 2873145 - RNA, 15 nt, Human
cucaggcagcucaag

SEQ ID NO: 2873146 - RNA, 23 nt, Human
cucagggagcagggaaggccuga

SEQ ID NO: 2873147 - RNA, 22 nt, Human
cucagggagcagggaaggccug

SEQ ID NO: 2873148 - RNA, 21 nt, Human
cucagggagcagggaaggccu

SEQ ID NO: 2873149 - RNA, 19 nt, Human
cucagggagcagggaaggc

SEQ ID NO: 2873150 - RNA, 18 nt, Human
cucagggagcagggaagg

SEQ ID NO: 2873151 - RNA, 15 nt, Human
cucagggcuccuccc

SEQ ID NO: 2873152 - RNA, 16 nt, Human
cucagggcuccuccca

SEQ ID NO: 2873153 - RNA, 17 nt, Human
cucagggcuccucccag

SEQ ID NO: 2873154 - RNA, 18 nt, Human
cucagggcuccucccagc

SEQ ID NO: 2873155 - RNA, 19 nt, Human
cucagggcuccucccagcu

SEQ ID NO: 2873156 - RNA, 21 nt, Human
cucagggcuccucccagcuug

SEQ ID NO: 2873157 - RNA, 22 nt, Human
cucagggcuaaacgggcauugc

SEQ ID NO: 2873158 - RNA, 21 nt, Human
cucagggcagccucccccggc

SEQ ID NO: 2873159 - RNA, 14 nt, Human
cucagggcagccuc

SEQ ID NO: 2873160 - RNA, 19 nt, Human
cuauaugauuuauaguuug

SEQ ID NO: 2873161 - RNA, 13 nt, Human
cuauauggcaaga

SEQ ID NO: 2873162 - RNA, 19 nt, Human
cuauauggcaagaaagcug

SEQ ID NO: 2873163 - RNA, 21 nt, Human
cuauauguaguauaaagaaaa

SEQ ID NO: 2873164 - RNA, 12 nt, Human
cuauaugugaau

SEQ ID NO: 2873165 - RNA, 20 nt, Human
cuauauucuggccagacucg

SEQ ID NO: 2873166 - RNA, 18 nt, Human
cuauauugauuguccuuu

SEQ ID NO: 2873167 - RNA, 19 nt, Human
cuauauugcccaggcuggu

SEQ ID NO: 2873168 - RNA, 18 nt, Human
cuauaugugaauccucuu

SEQ ID NO: 2873169 - RNA, 17 nt, Human
cuauagccuaggugaca

SEQ ID NO: 2873170 - RNA, 15 nt, Human
cuaucugggccuggg

SEQ ID NO: 2873171 - RNA, 16 nt, Human
cuaucugggccugggc

SEQ ID NO: 2873172 - RNA, 17 nt, Human
cuaucugggccugggcu

SEQ ID NO: 2873173 - RNA, 21 nt, Human
cuaucugggccugggcuaggg

SEQ ID NO: 2873174 - RNA, 23 nt, Human
cuauauuuagauuguuaaaauaa

SEQ ID NO: 2873175 - RNA, 12 nt, Human
cuauauuugcua

SEQ ID NO: 2873176 - RNA, 22 nt, Human
cuauauuugcuagacucuagac

SEQ ID NO: 2873177 - RNA, 23 nt, Human
cuauauuugcuagacucuagaca

SEQ ID NO: 2873178 - RNA, 22 nt, Human
cuauauuuagauuguuaaaaua

SEQ ID NO: 2873179 - RNA, 16 nt, Human
cuauauuuaacaagau

SEQ ID NO: 2873180 - RNA, 13 nt, Human
cuauauuuagauu

SEQ ID NO: 2873181 - RNA, 13 nt, Human
cuauacaaauaua

SEQ ID NO: 2873182 - RNA, 14 nt, Human
cuauacaaauauaa

SEQ ID NO: 2873183 - RNA, 15 nt, Human
cuauacaaauauaaa

SEQ ID NO: 2873184 - RNA, 20 nt, Human
cuauagacuggaaaaaauga

SEQ ID NO: 2873185 - RNA, 21 nt, Human
cuauagacuggaaaaaaugag

SEQ ID NO: 2873186 - RNA, 15 nt, Human
cuauacaacuggaca

SEQ ID NO: 2873187 - RNA, 14 nt, Human
cuauacaucucucc

SEQ ID NO: 2873188 - RNA, 16 nt, Human
cuauacaucucucccc

SEQ ID NO: 2873189 - RNA, 18 nt, Human
cuauacaucucuccccaa

SEQ ID NO: 2873190 - RNA, 14 nt, Human
cuaguggcuugucc

SEQ ID NO: 2873191 - RNA, 15 nt, Human
cuaguggcuuguccu

SEQ ID NO: 2873192 - RNA, 19 nt, Human
cuauaaucccagcacuuug

SEQ ID NO: 2873193 - RNA, 12 nt, Human
cuauaaucuguc

SEQ ID NO: 2873194 - RNA, 13 nt, Human
cuauaaucuguca

SEQ ID NO: 2873195 - RNA, 14 nt, Human
cuauaaucugucaa

SEQ ID NO: 2873196 - RNA, 15 nt, Human
cuauaaucugucaaa

SEQ ID NO: 2873197 - RNA, 18 nt, Human
cuauaaucugucaaaaca

SEQ ID NO: 2873198 - RNA, 19 nt, Human
cuauaaucugucaaaacac

SEQ ID NO: 2873199 - RNA, 21 nt, Human
cuauaaucugucaaaacacug

SEQ ID NO: 2873200 - RNA, 22 nt, Human
cuauaaucugucaaaacacugu

SEQ ID NO: 2873201 - RNA, 21 nt, Human
cuaguggcucucaguuaaaau

SEQ ID NO: 2873202 - RNA, 14 nt, Human
cuagugagcugggc

SEQ ID NO: 2873203 - RNA, 16 nt, Human
cuagugagcugggcau

SEQ ID NO: 2873204 - RNA, 17 nt, Human
cuagugagcugggcaug

SEQ ID NO: 2873205 - RNA, 18 nt, Human
cuagugagcugggcaugg

SEQ ID NO: 2873206 - RNA, 19 nt, Human
cuagugauguuuuuaugau

SEQ ID NO: 2873207 - RNA, 19 nt, Human
cuauucaguggcgagaaau

SEQ ID NO: 2873208 - RNA, 23 nt, Human
cuauucaagguggccaaauuauu

SEQ ID NO: 2873209 - RNA, 22 nt, Human
cuauucaagguggccaaauuau

SEQ ID NO: 2873210 - RNA, 17 nt, Human
cuauggcugaguucugg

SEQ ID NO: 2873211 - RNA, 12 nt, Human
cuauuacaaaua

SEQ ID NO: 2873212 - RNA, 14 nt, Human
cuaugguuaugaaa

SEQ ID NO: 2873213 - RNA, 15 nt, Human
cuaugguuaugaaag

SEQ ID NO: 2873214 - RNA, 16 nt, Human
cuaugguuaugaaaga

SEQ ID NO: 2873215 - RNA, 21 nt, Human
cuauuaggugcaauuucaagg

SEQ ID NO: 2873216 - RNA, 16 nt, Human
cuauuagccaggauca

SEQ ID NO: 2873217 - RNA, 22 nt, Human
cuauuagccaggaucauggugu

SEQ ID NO: 2873218 - RNA, 23 nt, Human
cuauuacugucugguuuuaacaa

SEQ ID NO: 2873219 - RNA, 23 nt, Human
cuaugggacucaaugcacugaca

SEQ ID NO: 2873220 - RNA, 15 nt, Human
cuaugggagccccag

SEQ ID NO: 2873221 - RNA, 14 nt, Human
cuaugggagcccca

SEQ ID NO: 2873222 - RNA, 13 nt, Human
cuaugggagcccc

SEQ ID NO: 2873223 - RNA, 19 nt, Human
cuaugggagagugucaacc

SEQ ID NO: 2873224 - RNA, 21 nt, Human
cuaugggagagugucaaccag

SEQ ID NO: 2873225 - RNA, 22 nt, Human
cuaugggagagugucaaccaga

SEQ ID NO: 2873226 - RNA, 23 nt, Human
cuaugggagagugucaaccagac

SEQ ID NO: 2873227 - RNA, 22 nt, Human
cuaugggacucaaugcacugac

SEQ ID NO: 2873228 - RNA, 18 nt, Human
cuaugggacucaaugcac

SEQ ID NO: 2873229 - RNA, 19 nt, Human
cuaugggggcacugaggac

SEQ ID NO: 2873230 - RNA, 16 nt, Human
cuaugggagccccagg

SEQ ID NO: 2873231 - RNA, 13 nt, Human
cuauguaaacuac

SEQ ID NO: 2873232 - RNA, 13 nt, Human
cuaugcugcuuuu

SEQ ID NO: 2873233 - RNA, 15 nt, Human
cuaugcugcuuuuau

SEQ ID NO: 2873234 - RNA, 16 nt, Human
cuaugcugcuuuuaua

SEQ ID NO: 2873235 - RNA, 19 nt, Human
cuaugcugcuuuuauaucu

SEQ ID NO: 2873236 - RNA, 20 nt, Human
cuaugcugcuuuuauaucug

SEQ ID NO: 2873237 - RNA, 13 nt, Human
cuaugcuguuugu

SEQ ID NO: 2873238 - RNA, 18 nt, Human
cuaugcuguuuguaguga

SEQ ID NO: 2873239 - RNA, 21 nt, Human
cuaugcugguaggcuccugcc

SEQ ID NO: 2873240 - RNA, 14 nt, Human
cuauggaauuuaua

SEQ ID NO: 2873241 - RNA, 22 nt, Human
cuauggaauuuauaauucagua

SEQ ID NO: 2873242 - RNA, 12 nt, Human
cuauggacacag

SEQ ID NO: 2873243 - RNA, 14 nt, Human
cuauggacacaggg

SEQ ID NO: 2873244 - RNA, 15 nt, Human
cuauggacacagggu

SEQ ID NO: 2873245 - RNA, 19 nt, Human
cuauggacggugcuccagg

SEQ ID NO: 2873246 - RNA, 16 nt, Human
cuauggaaaaucagcu

SEQ ID NO: 2873247 - RNA, 22 nt, Human
cuauggacggugcuccaggcag

SEQ ID NO: 2873248 - RNA, 23 nt, Human
cuauggacggugcuccaggcagg

SEQ ID NO: 2873249 - RNA, 22 nt, Human
cuauggcagaaaaaaugucugu

SEQ ID NO: 2873250 - RNA, 16 nt, Human
cuauggcagaaaaaau

SEQ ID NO: 2873251 - RNA, 23 nt, Human
cuauggcagaaaaaaugucugua

SEQ ID NO: 2873252 - RNA, 14 nt, Human
cuauggcagaaaaa

SEQ ID NO: 2873253 - RNA, 19 nt, Human
cuauggagccuggcacagg

SEQ ID NO: 2873254 - RNA, 23 nt, Human
cuauggagccuggcacaggacug

SEQ ID NO: 2873255 - RNA, 22 nt, Human
cuaugcacauauggacucugca

SEQ ID NO: 2873256 - RNA, 21 nt, Human
cuaugaucccagcacuuuggg

SEQ ID NO: 2873257 - RNA, 13 nt, Human
cuaugcacauaug

SEQ ID NO: 2873258 - RNA, 18 nt, Human
cuaugcacauauggacuc

SEQ ID NO: 2873259 - RNA, 20 nt, Human
cuaugcagagguccacaaca

SEQ ID NO: 2873260 - RNA, 20 nt, Human
cuaugcacauauggacucug

SEQ ID NO: 2873261 - RNA, 21 nt, Human
cuaugcacauauggacucugc

SEQ ID NO: 2873262 - RNA, 22 nt, Human
cuaugaggaauaauuauuuauu

SEQ ID NO: 2873263 - RNA, 23 nt, Human
cuaugaggaauaauuauuuauuu

SEQ ID NO: 2873264 - RNA, 12 nt, Human
cuaugaggaaag

SEQ ID NO: 2873265 - RNA, 13 nt, Human
cuaugaggaaagg

SEQ ID NO: 2873266 - RNA, 14 nt, Human
cuaugaggaaaggu

SEQ ID NO: 2873267 - RNA, 14 nt, Human
cuaugagcauccug

SEQ ID NO: 2873268 - RNA, 18 nt, Human
cuaugagcauccugagcc

SEQ ID NO: 2873269 - RNA, 19 nt, Human
cuaugagcauccugagccc

SEQ ID NO: 2873270 - RNA, 21 nt, Human
cuaugagcauccugagccccg

SEQ ID NO: 2873271 - RNA, 22 nt, Human
cuaugagcauccugagccccgc

SEQ ID NO: 2873272 - RNA, 17 nt, Human
cuaugagucuagauguu

SEQ ID NO: 2873273 - RNA, 19 nt, Human
cuaugagucuagauguuua

SEQ ID NO: 2873274 - RNA, 15 nt, Human
cuaugaguggaaaaa

SEQ ID NO: 2873275 - RNA, 16 nt, Human
cuaugaguggaaaaag

SEQ ID NO: 2873276 - RNA, 20 nt, Human
cuaugaguggaaaaagccaa

SEQ ID NO: 2873277 - RNA, 13 nt, Human
cuaugagucuaga

SEQ ID NO: 2873278 - RNA, 14 nt, Human
cuaugagucuagau

SEQ ID NO: 2873279 - RNA, 15 nt, Human
cuaugagucuagaug

SEQ ID NO: 2873280 - RNA, 16 nt, Human
cuaugagucuagaugu

SEQ ID NO: 2873281 - RNA, 19 nt, Human
cuagugaccccuucccugu

SEQ ID NO: 2873282 - RNA, 20 nt, Human
cuagugaccccuucccuguc

SEQ ID NO: 2873283 - RNA, 15 nt, Human
cuagguaauuuuuac

SEQ ID NO: 2873284 - RNA, 16 nt, Human
cuagugacagcuugug

SEQ ID NO: 2873285 - RNA, 17 nt, Human
cuagucccuuccccucc

SEQ ID NO: 2873286 - RNA, 15 nt, Human
cuagucccuuccccu

SEQ ID NO: 2873287 - RNA, 14 nt, Human
cuagucccuucccc

SEQ ID NO: 2873288 - RNA, 14 nt, Human
cuaguccagugacc

SEQ ID NO: 2873289 - RNA, 12 nt, Human
cuaguacaaauu

SEQ ID NO: 2873290 - RNA, 13 nt, Human
cuaguacacuuuu

SEQ ID NO: 2873291 - RNA, 15 nt, Human
cuaguacacuuuuau

SEQ ID NO: 2873292 - RNA, 19 nt, Human
cuaguacacuuuuaugagc

SEQ ID NO: 2873293 - RNA, 17 nt, Human
cuagucaccccaaguag

SEQ ID NO: 2873294 - RNA, 21 nt, Human
cuaguaaguaauuaugcacua

SEQ ID NO: 2873295 - RNA, 22 nt, Human
cuaguaaguaauuaugcacuaa

SEQ ID NO: 2873296 - RNA, 16 nt, Human
cuaguaaaaauacaaa

SEQ ID NO: 2873297 - RNA, 13 nt, Human
cuagguuucaaag

SEQ ID NO: 2873298 - RNA, 14 nt, Human
cuagguuuuuuccu

SEQ ID NO: 2873299 - RNA, 15 nt, Human
cuagguucaauuccc

SEQ ID NO: 2873300 - RNA, 19 nt, Human
cuagguucccggucccgag

SEQ ID NO: 2873301 - RNA, 20 nt, Human
cuagguucccggucccgagu

SEQ ID NO: 2873302 - RNA, 13 nt, Human
cuagguucccugu

SEQ ID NO: 2873303 - RNA, 16 nt, Human
cuagguucccuguucu

SEQ ID NO: 2873304 - RNA, 21 nt, Human
cuagguucccuguucuuccuc

SEQ ID NO: 2873305 - RNA, 18 nt, Human
cuaggugacagagugaga

SEQ ID NO: 2873306 - RNA, 14 nt, Human
cuaggugacagagu

SEQ ID NO: 2873307 - RNA, 14 nt, Human
cuagguacuucagg

SEQ ID NO: 2873308 - RNA, 15 nt, Human
cuagguagaaaaagg

SEQ ID NO: 2873309 - RNA, 17 nt, Human
cuagguagaaaaagggu

SEQ ID NO: 2873310 - RNA, 18 nt, Human
cuagguagaaaaaggguc

SEQ ID NO: 2873311 - RNA, 19 nt, Human
cuagguagaaaaaggguca

SEQ ID NO: 2873312 - RNA, 24 nt, Human
cuaggugacagagugagacucugu

SEQ ID NO: 2873313 - RNA, 14 nt, Human
cuaggucauaaaga

SEQ ID NO: 2873314 - RNA, 23 nt, Human
cuaggucucggacuaagccuacc

SEQ ID NO: 2873315 - RNA, 23 nt, Human
cuagguggcaaggcugugcuccc

SEQ ID NO: 2873316 - RNA, 17 nt, Human
cuagguggcaaggcugu

SEQ ID NO: 2873317 - RNA, 19 nt, Human
cuagguggcaaggcugugc

SEQ ID NO: 2873318 - RNA, 22 nt, Human
cgcccaguuggguggaugccug

SEQ ID NO: 2873319 - RNA, 23 nt, Human
cgcccaguuggguggaugccugg

SEQ ID NO: 2873320 - RNA, 18 nt, Human
cgcccaugcacuggggac

SEQ ID NO: 2873321 - RNA, 12 nt, Human
cgccccacccag

SEQ ID NO: 2873322 - RNA, 21 nt, Human
cgccccaaaguaaaagaaacc

SEQ ID NO: 2873323 - RNA, 13 nt, Human
cgccccacccaga

SEQ ID NO: 2873324 - RNA, 15 nt, Human
cuaggguugcuggag

SEQ ID NO: 2873325 - RNA, 18 nt, Human
cuaggguugcuggagccu

SEQ ID NO: 2873326 - RNA, 19 nt, Human
cuaggguugcuggagccug

SEQ ID NO: 2873327 - RNA, 12 nt, Human
cuauaguauuug

SEQ ID NO: 2873328 - RNA, 15 nt, Human
cuauaguauuugauu

SEQ ID NO: 2873329 - RNA, 18 nt, Human
cuauaguauuugauucaa

SEQ ID NO: 2873330 - RNA, 22 nt, Human
cuauaguauuugauucaaaaua

SEQ ID NO: 2873331 - RNA, 13 nt, Human
cucagcaagcccu

SEQ ID NO: 2873332 - RNA, 17 nt, Human
cucagauccuuguuuca

SEQ ID NO: 2873333 - RNA, 19 nt, Human
cucagauccuuguuucaaa

SEQ ID NO: 2873334 - RNA, 15 nt, Human
cucagaucugucuga

SEQ ID NO: 2873335 - RNA, 18 nt, Human
cucagaucugucugauag

SEQ ID NO: 2873336 - RNA, 17 nt, Human
cucagcauccuggcacc

SEQ ID NO: 2873337 - RNA, 16 nt, Human
cucagcauccuggcac

SEQ ID NO: 2873338 - RNA, 22 nt, Human
cucagcagccgccuuaagcuga

SEQ ID NO: 2873339 - RNA, 23 nt, Human
cucagcagccgccuuaagcugau

SEQ ID NO: 2873340 - RNA, 13 nt, Human
cucagagagggca

SEQ ID NO: 2873341 - RNA, 15 nt, Human
cucagagagggcagg

SEQ ID NO: 2873342 - RNA, 23 nt, Human
cucagagagggcaggcaugaagu

SEQ ID NO: 2873343 - RNA, 21 nt, Human
cucagagaccugaagugugca

SEQ ID NO: 2873344 - RNA, 18 nt, Human
cucagaguucuauacugu

SEQ ID NO: 2873345 - RNA, 13 nt, Human
cucagagugcaag

SEQ ID NO: 2873346 - RNA, 17 nt, Human
cucagaucaguguacca

SEQ ID NO: 2873347 - RNA, 13 nt, Human
cucagaucacugc

SEQ ID NO: 2873348 - RNA, 17 nt, Human
cucagaucacugcaacc

SEQ ID NO: 2873349 - RNA, 21 nt, Human
cucagaucaguguaccauuug

SEQ ID NO: 2873350 - RNA, 15 nt, Human
cucagauccuuguuu

SEQ ID NO: 2873351 - RNA, 22 nt, Human
cucacuguugcccaggcuggcg

SEQ ID NO: 2873352 - RNA, 21 nt, Human
cucacuguugcccaggcuggc

SEQ ID NO: 2873353 - RNA, 17 nt, Human
cucagagaaaagagauu

SEQ ID NO: 2873354 - RNA, 23 nt, Human
cucagagaaaagagauugagaug

SEQ ID NO: 2873355 - RNA, 16 nt, Human
cucagacuuuuguaca

SEQ ID NO: 2873356 - RNA, 17 nt, Human
cucagacuuuuguacau

SEQ ID NO: 2873357 - RNA, 23 nt, Human
cucagagaauuucuaccauuuca

SEQ ID NO: 2873358 - RNA, 20 nt, Human
cucacuguugcccaggcugg

SEQ ID NO: 2873359 - RNA, 12 nt, Human
cucacugcccgc

SEQ ID NO: 2873360 - RNA, 18 nt, Human
cucacugcccgcacaccc

SEQ ID NO: 2873361 - RNA, 19 nt, Human
cucacugcccgcacacccu

SEQ ID NO: 2873362 - RNA, 20 nt, Human
cucacugcccgcacacccuc

SEQ ID NO: 2873363 - RNA, 21 nt, Human
cucacucugucgcccagucug

SEQ ID NO: 2873364 - RNA, 13 nt, Human
cucacucugucgc

SEQ ID NO: 2873365 - RNA, 22 nt, Human
cucacucugucgcccagucugg

SEQ ID NO: 2873366 - RNA, 15 nt, Human
cucacucuggccuca

SEQ ID NO: 2873367 - RNA, 12 nt, Human
cucacugcagcc

SEQ ID NO: 2873368 - RNA, 12 nt, Human
cucacugaagcc

SEQ ID NO: 2873369 - RNA, 15 nt, Human
cucacugaagccugc

SEQ ID NO: 2873370 - RNA, 16 nt, Human
cucacugaagccugcg

SEQ ID NO: 2873371 - RNA, 23 nt, Human
cucacugaagccugcguuggucc

SEQ ID NO: 2873372 - RNA, 15 nt, Human
cucacugauauauuu

SEQ ID NO: 2873373 - RNA, 22 nt, Human
cucacugauauauuuuccaggg

SEQ ID NO: 2873374 - RNA, 13 nt, Human
cucacugcagccu

SEQ ID NO: 2873375 - RNA, 18 nt, Human
cucacugcaaccuucacc

SEQ ID NO: 2873376 - RNA, 16 nt, Human
cucacuccuaccuggu

SEQ ID NO: 2873377 - RNA, 17 nt, Human
cucacuccuaccuggua

SEQ ID NO: 2873378 - RNA, 19 nt, Human
cucacuccuaccugguaau

SEQ ID NO: 2873379 - RNA, 12 nt, Human
cucacucugucg

SEQ ID NO: 2873380 - RNA, 11 nt, Human
cucacucuguc

SEQ ID NO: 2873381 - RNA, 14 nt, Human
cucacucuggccuc

SEQ ID NO: 2873382 - RNA, 11 nt, Human
cucacucugcc

SEQ ID NO: 2873383 - RNA, 12 nt, Human
cucacucugcca

SEQ ID NO: 2873384 - RNA, 13 nt, Human
cucacucugccag

SEQ ID NO: 2873385 - RNA, 14 nt, Human
cucacucugccagg

SEQ ID NO: 2873386 - RNA, 15 nt, Human
cucacucugccaggg

SEQ ID NO: 2873387 - RNA, 18 nt, Human
cucacucugccagggcag

SEQ ID NO: 2873388 - RNA, 20 nt, Human
cucacuauguugcccaggca

SEQ ID NO: 2873389 - RNA, 19 nt, Human
cucacuauguugcccaggc

SEQ ID NO: 2873390 - RNA, 22 nt, Human
cucaccccaucccacacccugg

SEQ ID NO: 2873391 - RNA, 21 nt, Human
cucaccccaucccacacccug

SEQ ID NO: 2873392 - RNA, 19 nt, Human
cucaccccaucccacaccc

SEQ ID NO: 2873393 - RNA, 14 nt, Human
cucacccccagcuu

SEQ ID NO: 2873394 - RNA, 18 nt, Human
cucacccccagcuuugcu

SEQ ID NO: 2873395 - RNA, 17 nt, Human
cucacccccagcuuugc

SEQ ID NO: 2873396 - RNA, 13 nt, Human
cucaccccauccc

SEQ ID NO: 2873397 - RNA, 12 nt, Human
cucaccccaucc

SEQ ID NO: 2873398 - RNA, 14 nt, Human
cucaccaucugugc

SEQ ID NO: 2873399 - RNA, 20 nt, Human
cucaccaguguccccuccac

SEQ ID NO: 2873400 - RNA, 23 nt, Human
cucaccaguguccccuccacugu

SEQ ID NO: 2873401 - RNA, 24 nt, Human
cucaccaguguccccuccacuguc

SEQ ID NO: 2873402 - RNA, 22 nt, Human
cucacuauguugcccaggcagg

SEQ ID NO: 2873403 - RNA, 21 nt, Human
cucacuauguugcccaggcag

SEQ ID NO: 2873404 - RNA, 23 nt, Human
cucacuauguugcccaggcaggu

SEQ ID NO: 2873405 - RNA, 19 nt, Human
cucacccccagcuuugcua

SEQ ID NO: 2873406 - RNA, 12 nt, Human
cucacuccccau

SEQ ID NO: 2873407 - RNA, 19 nt, Human
cucacuccccaugccacgu

SEQ ID NO: 2873408 - RNA, 15 nt, Human
cucacucccagucca

SEQ ID NO: 2873409 - RNA, 13 nt, Human
cucacuccuaccu

SEQ ID NO: 2873410 - RNA, 15 nt, Human
cucacuccuaccugg

SEQ ID NO: 2873411 - RNA, 22 nt, Human
cucacauuuauucugcucacau

SEQ ID NO: 2873412 - RNA, 12 nt, Human
cucacauuuaug

SEQ ID NO: 2873413 - RNA, 19 nt, Human
cucacauuuauucugcuca

SEQ ID NO: 2873414 - RNA, 15 nt, Human
cucacauuuauucug

SEQ ID NO: 2873415 - RNA, 18 nt, Human
cucaccagccccagugcc

SEQ ID NO: 2873416 - RNA, 17 nt, Human
cucaccagccccagugc

SEQ ID NO: 2873417 - RNA, 22 nt, Human
cucaccagccccacugccagca

SEQ ID NO: 2873418 - RNA, 21 nt, Human
cucaccagccccacugccagc

SEQ ID NO: 2873419 - RNA, 23 nt, Human
cucaccagccccacugccagcag

SEQ ID NO: 2873420 - RNA, 19 nt, Human
cucaccagcugcugcucug

SEQ ID NO: 2873421 - RNA, 15 nt, Human
cucaccagccccagu

SEQ ID NO: 2873422 - RNA, 14 nt, Human
cucaccagccccag

SEQ ID NO: 2873423 - RNA, 13 nt, Human
cucaccagcccca

SEQ ID NO: 2873424 - RNA, 20 nt, Human
cucaccagccccacugccag

SEQ ID NO: 2873425 - RNA, 19 nt, Human
cucaccagccccacugcca

SEQ ID NO: 2873426 - RNA, 18 nt, Human
cucaccagccccacugcc

SEQ ID NO: 2873427 - RNA, 17 nt, Human
cucaccagccccacugc

SEQ ID NO: 2873428 - RNA, 16 nt, Human
cucaccagccccacug

SEQ ID NO: 2873429 - RNA, 20 nt, Human
cucaccagaauugugcaaau

SEQ ID NO: 2873430 - RNA, 13 nt, Human
cucacaccaaauu

SEQ ID NO: 2873431 - RNA, 17 nt, Human
cucaagugauccuccca

SEQ ID NO: 2873432 - RNA, 18 nt, Human
cucaagugauccucccac

SEQ ID NO: 2873433 - RNA, 23 nt, Human
cucacaccaggcuugccugcagg

SEQ ID NO: 2873434 - RNA, 14 nt, Human
cucacagucccacu

SEQ ID NO: 2873435 - RNA, 17 nt, Human
cucacagucccacugug

SEQ ID NO: 2873436 - RNA, 18 nt, Human
cucacagucccacugugc

SEQ ID NO: 2873437 - RNA, 18 nt, Human
cucacagguuggaagaga

SEQ ID NO: 2873438 - RNA, 19 nt, Human
cucacagguuggaagagaa

SEQ ID NO: 2873439 - RNA, 22 nt, Human
cucacagguuggaagagaauca

SEQ ID NO: 2873440 - RNA, 23 nt, Human
cucacagguuggaagagaaucac

SEQ ID NO: 2873441 - RNA, 16 nt, Human
cucacaguaacccaaa

SEQ ID NO: 2873442 - RNA, 19 nt, Human
cucacaguaacccaaaccu

SEQ ID NO: 2873443 - RNA, 20 nt, Human
cucacaguaacccaaaccuc

SEQ ID NO: 2873444 - RNA, 23 nt, Human
cucacaguaacccaaaccucaag

SEQ ID NO: 2873445 - RNA, 13 nt, Human
cucacaguacagc

SEQ ID NO: 2873446 - RNA, 20 nt, Human
cucacaguacagcaugugcc

SEQ ID NO: 2873447 - RNA, 22 nt, Human
cucacaguacagcaugugccuu

SEQ ID NO: 2873448 - RNA, 16 nt, Human
cucacagccucugacc

SEQ ID NO: 2873449 - RNA, 19 nt, Human
cucacagccucugaccccu

SEQ ID NO: 2873450 - RNA, 21 nt, Human
cucacagccucugaccccucc

SEQ ID NO: 2873451 - RNA, 22 nt, Human
cucacagccucugaccccuccu

SEQ ID NO: 2873452 - RNA, 19 nt, Human
cucacaccgcgucugguga

SEQ ID NO: 2873453 - RNA, 11 nt, Human
cucacagccuc

SEQ ID NO: 2873454 - RNA, 12 nt, Human
cucacagccucu

SEQ ID NO: 2873455 - RNA, 13 nt, Human
cucacagccucug

SEQ ID NO: 2873456 - RNA, 14 nt, Human
cucacagccucuga

SEQ ID NO: 2873457 - RNA, 15 nt, Human
cucacagccucugac

SEQ ID NO: 2873458 - RNA, 17 nt, Human
cucaagugauucuccug

SEQ ID NO: 2873459 - RNA, 14 nt, Human
cucaaguccucuuu

SEQ ID NO: 2873460 - RNA, 21 nt, Human
cucaaguccucuuuucugaga

SEQ ID NO: 2873461 - RNA, 15 nt, Human
cucaagaaauuccca

SEQ ID NO: 2873462 - RNA, 15 nt, Human
cucaagaagcaggcu

SEQ ID NO: 2873463 - RNA, 16 nt, Human
cucaacuuucuguugg

SEQ ID NO: 2873464 - RNA, 17 nt, Human
cucaacuuucuguugga

SEQ ID NO: 2873465 - RNA, 13 nt, Human
cucaagaagcagg

SEQ ID NO: 2873466 - RNA, 14 nt, Human
cucaagaagcaggc

SEQ ID NO: 2873467 - RNA, 23 nt, Human
cucaagaagcaggcuacacugac

SEQ ID NO: 2873468 - RNA, 11 nt, Human
cucaagacaau

SEQ ID NO: 2873469 - RNA, 14 nt, Human
cuauuucaguacuu

SEQ ID NO: 2873470 - RNA, 19 nt, Human
cuauuucaguacuucagca

SEQ ID NO: 2873471 - RNA, 13 nt, Human
cuauuucauuuuu

SEQ ID NO: 2873472 - RNA, 13 nt, Human
cuauuucggccuu

SEQ ID NO: 2873473 - RNA, 22 nt, Human
cuauuucuacacagugggaacu

SEQ ID NO: 2873474 - RNA, 20 nt, Human
cuauuucuagggcugggaaa

SEQ ID NO: 2873475 - RNA, 19 nt, Human
cucaaaucguccagcgacc

SEQ ID NO: 2873476 - RNA, 16 nt, Human
cucaaaugcucagacc

SEQ ID NO: 2873477 - RNA, 13 nt, Human
cucaaaucuguua

SEQ ID NO: 2873478 - RNA, 17 nt, Human
cucaaccuccugggcua

SEQ ID NO: 2873479 - RNA, 15 nt, Human
cucaaccuccugggc

SEQ ID NO: 2873480 - RNA, 13 nt, Human
cucaaccuccugg

SEQ ID NO: 2873481 - RNA, 12 nt, Human
cucaacaauaaa

SEQ ID NO: 2873482 - RNA, 14 nt, Human
cucaacaauaaaac

SEQ ID NO: 2873483 - RNA, 19 nt, Human
cucaacaaagcacaguguu

SEQ ID NO: 2873484 - RNA, 15 nt, Human
cucaacaaagcacag

SEQ ID NO: 2873485 - RNA, 19 nt, Human
cucaaaugcucagaccagc

SEQ ID NO: 2873486 - RNA, 23 nt, Human
cuauuuaccugcaggcugagcca

SEQ ID NO: 2873487 - RNA, 12 nt, Human
cuauuccagcuc

SEQ ID NO: 2873488 - RNA, 13 nt, Human
cuauuccagcuca

SEQ ID NO: 2873489 - RNA, 17 nt, Human
cuauuccagcucauuca

SEQ ID NO: 2873490 - RNA, 23 nt, Human
cuauuccagcucauucauuuuau

SEQ ID NO: 2873491 - RNA, 11 nt, Human
cuauucaguug

SEQ ID NO: 2873492 - RNA, 14 nt, Human
cuauucaguugugu

SEQ ID NO: 2873493 - RNA, 15 nt, Human
cuauucaguuguguu

SEQ ID NO: 2873494 - RNA, 17 nt, Human
cuauucauuaaauguuu

SEQ ID NO: 2873495 - RNA, 18 nt, Human
cuauucauuaaauguuug

SEQ ID NO: 2873496 - RNA, 15 nt, Human
cuauuccaaaaaggu

SEQ ID NO: 2873497 - RNA, 14 nt, Human
cuauuccugaacua

SEQ ID NO: 2873498 - RNA, 19 nt, Human
cuauucucaaaguuuccua

SEQ ID NO: 2873499 - RNA, 21 nt, Human
cuauucucaaaguuuccuaau

SEQ ID NO: 2873500 - RNA, 16 nt, Human
cuauuccuucuggccu

SEQ ID NO: 2873501 - RNA, 17 nt, Human
cuauuccuucuggccuu

SEQ ID NO: 2873502 - RNA, 23 nt, Human
cuauuccuucuggccuuuccucu

SEQ ID NO: 2873503 - RNA, 12 nt, Human
cuauuccuuucc

SEQ ID NO: 2873504 - RNA, 14 nt, Human
cuauuccuuucccu

SEQ ID NO: 2873505 - RNA, 15 nt, Human
cuauuccuuucccuu

SEQ ID NO: 2873506 - RNA, 16 nt, Human
cuauuccuuucccuuc

SEQ ID NO: 2873507 - RNA, 17 nt, Human
cuauuccuuucccuucc

SEQ ID NO: 2873508 - RNA, 18 nt, Human
cuauuccuuucccuuccu

SEQ ID NO: 2873509 - RNA, 19 nt, Human
cuauuccuuucccuuccuc

SEQ ID NO: 2873510 - RNA, 20 nt, Human
cuauuccuuucccuuccucu

SEQ ID NO: 2873511 - RNA, 22 nt, Human
cuauuccuuucccuuccucuuc

SEQ ID NO: 2873512 - RNA, 15 nt, Human
cuauucgaaugaaaa

SEQ ID NO: 2873513 - RNA, 17 nt, Human
cuauucgaaugaaaaga

SEQ ID NO: 2873514 - RNA, 17 nt, Human
cuauuuauauguacaug

SEQ ID NO: 2873515 - RNA, 14 nt, Human
cuauuuaugccuug

SEQ ID NO: 2873516 - RNA, 20 nt, Human
cuauuuaugccuugaugauu

SEQ ID NO: 2873517 - RNA, 21 nt, Human
cuauuuaugccuugaugauuu

SEQ ID NO: 2873518 - RNA, 23 nt, Human
cuauuuaguuuuuguaauuuauu

SEQ ID NO: 2873519 - RNA, 22 nt, Human
cuauuuaguuuuuguaauuuau

SEQ ID NO: 2873520 - RNA, 20 nt, Human
cuauuuaguuuuuguaauuu

SEQ ID NO: 2873521 - RNA, 17 nt, Human
cuauuuaguuuuuguaa

SEQ ID NO: 2873522 - RNA, 18 nt, Human
cuauuuaauuaggaaaaa

SEQ ID NO: 2873523 - RNA, 21 nt, Human
cuauuuaauuaggaaaaaaac

SEQ ID NO: 2873524 - RNA, 21 nt, Human
cuauugugggacuuauuacaa

SEQ ID NO: 2873525 - RNA, 19 nt, Human
cuauugucaccagggcugg

SEQ ID NO: 2873526 - RNA, 15 nt, Human
cugcaaguccuuuug

SEQ ID NO: 2873527 - RNA, 18 nt, Human
cugcaaguccuuuuguaa

SEQ ID NO: 2873528 - RNA, 19 nt, Human
cugcaaguccuuuuguaaa

SEQ ID NO: 2873529 - RNA, 20 nt, Human
cugcaaguccuuuuguaaag

SEQ ID NO: 2873530 - RNA, 21 nt, Human
cugcaaguccuuuuguaaagu

SEQ ID NO: 2873531 - RNA, 19 nt, Human
cugcaagugacaucucuuu

SEQ ID NO: 2873532 - RNA, 14 nt, Human
cugcaauaacuucu

SEQ ID NO: 2873533 - RNA, 15 nt, Human
cugcaauaacuucug

SEQ ID NO: 2873534 - RNA, 16 nt, Human
cugcaauaacuucuga

SEQ ID NO: 2873535 - RNA, 17 nt, Human
cugcaauaacuucugac

SEQ ID NO: 2873536 - RNA, 18 nt, Human
cugcaauaacuucugacc

SEQ ID NO: 2873537 - RNA, 19 nt, Human
cugcaauaacuucugaccu

SEQ ID NO: 2873538 - RNA, 13 nt, Human
cugcacacagcac

SEQ ID NO: 2873539 - RNA, 11 nt, Human
cugcacacaag

SEQ ID NO: 2873540 - RNA, 17 nt, Human
cugcacacaagcccaca

SEQ ID NO: 2873541 - RNA, 22 nt, Human
cugcacacaagcccacagcaca

SEQ ID NO: 2873542 - RNA, 23 nt, Human
cugcacacaagcccacagcacag

SEQ ID NO: 2873543 - RNA, 22 nt, Human
cugcacaugaaucccacccaca

SEQ ID NO: 2873544 - RNA, 23 nt, Human
cugcacaugaaucccacccacau

SEQ ID NO: 2873545 - RNA, 13 nt, Human
cugcacaugaaga

SEQ ID NO: 2873546 - RNA, 14 nt, Human
cugcacaugaagaa

SEQ ID NO: 2873547 - RNA, 14 nt, Human
cugcacaugucuug

SEQ ID NO: 2873548 - RNA, 16 nt, Human
cugcacaugucuugua

SEQ ID NO: 2873549 - RNA, 21 nt, Human
cugcacaugucuuguacaugu

SEQ ID NO: 2873550 - RNA, 23 nt, Human
cugcacaugucuuguacaugugu

SEQ ID NO: 2873551 - RNA, 22 nt, Human
cugcacagugcaucucagccca

SEQ ID NO: 2873552 - RNA, 22 nt, Human
cugcacacgcuccuuccucuga

SEQ ID NO: 2873553 - RNA, 20 nt, Human
cugcacacgcuccuuccucu

SEQ ID NO: 2873554 - RNA, 14 nt, Human
cugcacacagcacg

SEQ ID NO: 2873555 - RNA, 15 nt, Human
cugcacuccucaggg

SEQ ID NO: 2873556 - RNA, 14 nt, Human
cugcacuccucagg

SEQ ID NO: 2873557 - RNA, 22 nt, Human
cugcacuccucagggcagccuc

SEQ ID NO: 2873558 - RNA, 18 nt, Human
cugcacuugcagacucua

SEQ ID NO: 2873559 - RNA, 19 nt, Human
cugcacucuuaagcuuccg

SEQ ID NO: 2873560 - RNA, 11 nt, Human
cugcacugaaa

SEQ ID NO: 2873561 - RNA, 12 nt, Human
cugcacugaaaa

SEQ ID NO: 2873562 - RNA, 14 nt, Human
cugcacugaaaagg

SEQ ID NO: 2873563 - RNA, 18 nt, Human
cugcacugaaaagguucu

SEQ ID NO: 2873564 - RNA, 12 nt, Human
cugcaccgggcc

SEQ ID NO: 2873565 - RNA, 13 nt, Human
cugauuucuucag

SEQ ID NO: 2873566 - RNA, 14 nt, Human
cugauuucuugcuu

SEQ ID NO: 2873567 - RNA, 13 nt, Human
cugauuucuugcu

SEQ ID NO: 2873568 - RNA, 13 nt, Human
cugauuuccccuc

SEQ ID NO: 2873569 - RNA, 22 nt, Human
cugauuugcaauaaaaaugaua

SEQ ID NO: 2873570 - RNA, 17 nt, Human
cugauuugcauauucau

SEQ ID NO: 2873571 - RNA, 17 nt, Human
cugauuugccacugaua

SEQ ID NO: 2873572 - RNA, 22 nt, Human
cugauuugccacugauauucag

SEQ ID NO: 2873573 - RNA, 21 nt, Human
cugauuguggaucuuuucauu

SEQ ID NO: 2873574 - RNA, 23 nt, Human
cugauuguggaucuuuucauucu

SEQ ID NO: 2873575 - RNA, 18 nt, Human
cugauuggcuuguagaau

SEQ ID NO: 2873576 - RNA, 20 nt, Human
cugauuggcuuguagaauug

SEQ ID NO: 2873577 - RNA, 22 nt, Human
cugauuggcuuguagaauuguu

SEQ ID NO: 2873578 - RNA, 23 nt, Human
cugauuggcuuguagaauuguua

SEQ ID NO: 2873579 - RNA, 16 nt, Human
cugaugguacaggaaa

SEQ ID NO: 2873580 - RNA, 17 nt, Human
cugauuggugcaacccu

SEQ ID NO: 2873581 - RNA, 12 nt, Human
cugauuguaaac

SEQ ID NO: 2873582 - RNA, 16 nt, Human
cugauuguaaacuuca

SEQ ID NO: 2873583 - RNA, 12 nt, Human
cugauuuuaaug

SEQ ID NO: 2873584 - RNA, 13 nt, Human
cugauuuuaaugg

SEQ ID NO: 2873585 - RNA, 14 nt, Human
cugauuuuaaugga

SEQ ID NO: 2873586 - RNA, 22 nt, Human
cugauuuuaauggauuguuaau

SEQ ID NO: 2873587 - RNA, 23 nt, Human
cugauuuuaauggauuguuaauu

SEQ ID NO: 2873588 - RNA, 21 nt, Human
cugauuuuaggagcuaaggcu

SEQ ID NO: 2873589 - RNA, 22 nt, Human
cugauuuuaggagcuaaggcuc

SEQ ID NO: 2873590 - RNA, 14 nt, Human
cugauuuggaaaaa

SEQ ID NO: 2873591 - RNA, 14 nt, Human
cugauuugguacuu

SEQ ID NO: 2873592 - RNA, 23 nt, Human
cugauuugguacuuuugagugug

SEQ ID NO: 2873593 - RNA, 18 nt, Human
cugauuuucaaagcuuuu

SEQ ID NO: 2873594 - RNA, 23 nt, Human
cugauuuuaggagcuaaggcucu

SEQ ID NO: 2873595 - RNA, 21 nt, Human
cugauuuucaaagcuuuuucc

SEQ ID NO: 2873596 - RNA, 21 nt, Human
cugauuuuuaugaugaugaaa

SEQ ID NO: 2873597 - RNA, 13 nt, Human
cugcaaaaaauac

SEQ ID NO: 2873598 - RNA, 23 nt, Human
cugcaaaaaauacuuuuucuaau

SEQ ID NO: 2873599 - RNA, 13 nt, Human
cugcaaaaaugga

SEQ ID NO: 2873600 - RNA, 21 nt, Human
cugcaaaaauggauauuauua

SEQ ID NO: 2873601 - RNA, 18 nt, Human
cugcaaacgcugccugcc

SEQ ID NO: 2873602 - RNA, 20 nt, Human
cugcaaacgcugccugccca

SEQ ID NO: 2873603 - RNA, 19 nt, Human
cugcaaacgcugccugccc

SEQ ID NO: 2873604 - RNA, 19 nt, Human
cugcaaacgcugccugccg

SEQ ID NO: 2873605 - RNA, 15 nt, Human
cugcaaagcccagcu

SEQ ID NO: 2873606 - RNA, 13 nt, Human
cugcaaagcccag

SEQ ID NO: 2873607 - RNA, 12 nt, Human
cugcaaagaaag

SEQ ID NO: 2873608 - RNA, 16 nt, Human
cugaggcucuuucugg

SEQ ID NO: 2873609 - RNA, 15 nt, Human
cugaggcucuuucug

SEQ ID NO: 2873610 - RNA, 22 nt, Human
cugaggcucugacccagugaga

SEQ ID NO: 2873611 - RNA, 23 nt, Human
cugaggcucugacccagugagau

SEQ ID NO: 2873612 - RNA, 18 nt, Human
cugaggcggguggaucac

SEQ ID NO: 2873613 - RNA, 15 nt, Human
cugaggccuccagcu

SEQ ID NO: 2873614 - RNA, 14 nt, Human
cugaggccugagac

SEQ ID NO: 2873615 - RNA, 15 nt, Human
cugaggccugagacc

SEQ ID NO: 2873616 - RNA, 18 nt, Human
cugaggccugagacccag

SEQ ID NO: 2873617 - RNA, 19 nt, Human
cugaggccugagacccagg

SEQ ID NO: 2873618 - RNA, 20 nt, Human
cugaggccugagacccagga

SEQ ID NO: 2873619 - RNA, 21 nt, Human
cugaggccugagacccaggac

SEQ ID NO: 2873620 - RNA, 23 nt, Human
cugagccccgcagaccuccccag

SEQ ID NO: 2873621 - RNA, 18 nt, Human
cugagccccgcccucuuc

SEQ ID NO: 2873622 - RNA, 19 nt, Human
cugagccccgcccucuucc

SEQ ID NO: 2873623 - RNA, 20 nt, Human
cugagccccgcccucuuccu

SEQ ID NO: 2873624 - RNA, 21 nt, Human
cugagccccgcccucuuccug

SEQ ID NO: 2873625 - RNA, 22 nt, Human
cugagccccgcccucuuccuga

SEQ ID NO: 2873626 - RNA, 23 nt, Human
cugagccccgcccucuuccugac

SEQ ID NO: 2873627 - RNA, 21 nt, Human
cugagccccgcagaccucccc

SEQ ID NO: 2873628 - RNA, 22 nt, Human
cugagccccgcagaccucccca

SEQ ID NO: 2873629 - RNA, 17 nt, Human
cugagccccgcagaccu

SEQ ID NO: 2873630 - RNA, 18 nt, Human
cugagccccgcagaccuc

SEQ ID NO: 2873631 - RNA, 19 nt, Human
cugagccccagggugccca

SEQ ID NO: 2873632 - RNA, 20 nt, Human
cugagccccagggugcccag

SEQ ID NO: 2873633 - RNA, 21 nt, Human
cugagccccagggugcccaga

SEQ ID NO: 2873634 - RNA, 22 nt, Human
cugagccccagggugcccagaa

SEQ ID NO: 2873635 - RNA, 15 nt, Human
cugaggcugagacug

SEQ ID NO: 2873636 - RNA, 20 nt, Human
cugaggcucuuucugggcca

SEQ ID NO: 2873637 - RNA, 18 nt, Human
cugaggcucuuucugggc

SEQ ID NO: 2873638 - RNA, 15 nt, Human
cugagggaggaccug

SEQ ID NO: 2873639 - RNA, 16 nt, Human
cugagggaggaccugg

SEQ ID NO: 2873640 - RNA, 17 nt, Human
cugagggaggaccuggg

SEQ ID NO: 2873641 - RNA, 19 nt, Human
cugagggaggaccuggggc

SEQ ID NO: 2873642 - RNA, 22 nt, Human
cugagggaggaccuggggcaca

SEQ ID NO: 2873643 - RNA, 14 nt, Human
cugagggacucuga

SEQ ID NO: 2873644 - RNA, 16 nt, Human
cugagggacucugaag

SEQ ID NO: 2873645 - RNA, 20 nt, Human
cugagggacucugaagccuc

SEQ ID NO: 2873646 - RNA, 21 nt, Human
cugagggacucugaagccucu

SEQ ID NO: 2873647 - RNA, 22 nt, Human
cugagggacucugaagccucug

SEQ ID NO: 2873648 - RNA, 16 nt, Human
cugagucagggcccag

SEQ ID NO: 2873649 - RNA, 17 nt, Human
cugagucagggcccaga

SEQ ID NO: 2873650 - RNA, 19 nt, Human
cugagucagggcccagagg

SEQ ID NO: 2873651 - RNA, 20 nt, Human
cugagucagggcccagaggc

SEQ ID NO: 2873652 - RNA, 22 nt, Human
cugagucagggcccagaggcug

SEQ ID NO: 2873653 - RNA, 23 nt, Human
cugagucagggcccagaggcuga

SEQ ID NO: 2873654 - RNA, 23 nt, Human
cugagucacccuaccugugccug

SEQ ID NO: 2873655 - RNA, 22 nt, Human
cugagucacccuaccugugccu

SEQ ID NO: 2873656 - RNA, 20 nt, Human
cugagucacccaugaagaca

SEQ ID NO: 2873657 - RNA, 22 nt, Human
cugagucacccaugaagacagg

SEQ ID NO: 2873658 - RNA, 23 nt, Human
cugagggacucugaagccucugg

SEQ ID NO: 2873659 - RNA, 16 nt, Human
cugauaaagcacagcu

SEQ ID NO: 2873660 - RNA, 18 nt, Human
cugauaaagcacagcugu

SEQ ID NO: 2873661 - RNA, 18 nt, Human
cugaguuucauucuccug

SEQ ID NO: 2873662 - RNA, 21 nt, Human
cugaguuucauucuccugccu

SEQ ID NO: 2873663 - RNA, 19 nt, Human
cugaguuucauucuccugc

SEQ ID NO: 2873664 - RNA, 20 nt, Human
cugaguuucauucuccugcc

SEQ ID NO: 2873665 - RNA, 17 nt, Human
cugaguuucauucuccu

SEQ ID NO: 2873666 - RNA, 11 nt, Human
cugaguugcca

SEQ ID NO: 2873667 - RNA, 14 nt, Human
cugaguugccaaga

SEQ ID NO: 2873668 - RNA, 16 nt, Human
cugaguugccaagaca

SEQ ID NO: 2873669 - RNA, 18 nt, Human
cugaguugccaagacaaa

SEQ ID NO: 2873670 - RNA, 20 nt, Human
cugaguugccaagacaaauc

SEQ ID NO: 2873671 - RNA, 19 nt, Human
cugaguucuggucaaagaa

SEQ ID NO: 2873672 - RNA, 13 nt, Human
cugaguuaugaug

SEQ ID NO: 2873673 - RNA, 15 nt, Human
cugaguuaugaugua

SEQ ID NO: 2873674 - RNA, 21 nt, Human
cugaguccaagaggguccuuu

SEQ ID NO: 2873675 - RNA, 16 nt, Human
cugauacauaacuaaa

SEQ ID NO: 2873676 - RNA, 17 nt, Human
cugauacauaacuaaau

SEQ ID NO: 2873677 - RNA, 18 nt, Human
cugauacauaacuaaauu

SEQ ID NO: 2873678 - RNA, 19 nt, Human
cugauacauaacuaaauuu

SEQ ID NO: 2873679 - RNA, 16 nt, Human
cugauauauuuuccag

SEQ ID NO: 2873680 - RNA, 23 nt, Human
cugauaucuggccuaaaaucuug

SEQ ID NO: 2873681 - RNA, 16 nt, Human
cugauaugauuuaaaa

SEQ ID NO: 2873682 - RNA, 18 nt, Human
cugauaugauuuaaaaca

SEQ ID NO: 2873683 - RNA, 19 nt, Human
cugauaugauuuaaaacau

SEQ ID NO: 2873684 - RNA, 21 nt, Human
cugauaugauuuaaaacaugu

SEQ ID NO: 2873685 - RNA, 23 nt, Human
cugauaugauuuaaaacauguaa

SEQ ID NO: 2873686 - RNA, 22 nt, Human
cugauaugauuuaaaacaugua

SEQ ID NO: 2873687 - RNA, 13 nt, Human
cugauaugggacu

SEQ ID NO: 2873688 - RNA, 15 nt, Human
cugauaugggacuga

SEQ ID NO: 2873689 - RNA, 16 nt, Human
cugauaugggacugag

SEQ ID NO: 2873690 - RNA, 16 nt, Human
cugaucaacaauuugg

SEQ ID NO: 2873691 - RNA, 22 nt, Human
cugaucacuagccugucauccu

SEQ ID NO: 2873692 - RNA, 15 nt, Human
cugaucaccugcccu

SEQ ID NO: 2873693 - RNA, 17 nt, Human
cugauauucagaauuau

SEQ ID NO: 2873694 - RNA, 20 nt, Human
cugauauucagaauuaugau

SEQ ID NO: 2873695 - RNA, 22 nt, Human
cugauauuucccuccccugggg

SEQ ID NO: 2873696 - RNA, 17 nt, Human
cugauauuuuaccucuu

SEQ ID NO: 2873697 - RNA, 23 nt, Human
cugauauuuuaccucuuauugca

SEQ ID NO: 2873698 - RNA, 21 nt, Human
cugauccuaacugaagagaca

SEQ ID NO: 2873699 - RNA, 15 nt, Human
cugcaucccagcacc

SEQ ID NO: 2873700 - RNA, 16 nt, Human
cugcaucccagcaccu

SEQ ID NO: 2873701 - RNA, 17 nt, Human
cugcaucccagcaccug

SEQ ID NO: 2873702 - RNA, 18 nt, Human
cugcaucccagcaccugc

SEQ ID NO: 2873703 - RNA, 20 nt, Human
cugcaucccagcaccugccu

SEQ ID NO: 2873704 - RNA, 21 nt, Human
cugcaucccagcaccugccuc

SEQ ID NO: 2873705 - RNA, 23 nt, Human
cugcaucccagcaccugccuccu

SEQ ID NO: 2873706 - RNA, 22 nt, Human
cugcaucccaggaugcugggug

SEQ ID NO: 2873707 - RNA, 23 nt, Human
cugcaucccaggaugcugggugg

SEQ ID NO: 2873708 - RNA, 14 nt, Human
cugcacuuugaugu

SEQ ID NO: 2873709 - RNA, 17 nt, Human
cugcacuuugaugucau

SEQ ID NO: 2873710 - RNA, 18 nt, Human
cugcacuuugaugucaug

SEQ ID NO: 2873711 - RNA, 19 nt, Human
cugcacuuugaugucaugu

SEQ ID NO: 2873712 - RNA, 20 nt, Human
cugcacuuugaugucaugug

SEQ ID NO: 2873713 - RNA, 21 nt, Human
cugcacuuugaugucaugugu

SEQ ID NO: 2873714 - RNA, 22 nt, Human
cugcacuuugaugucauguguu

SEQ ID NO: 2873715 - RNA, 23 nt, Human
cugcacuuugaugucauguguuc

SEQ ID NO: 2873716 - RNA, 23 nt, Human
cugcacuugcagacucuacagag

SEQ ID NO: 2873717 - RNA, 20 nt, Human
cugcauccuccgccucccgg

SEQ ID NO: 2873718 - RNA, 12 nt, Human
cugcauccccuu

SEQ ID NO: 2873719 - RNA, 22 nt, Human
cugcauccccuuggcugugagg

SEQ ID NO: 2873720 - RNA, 15 nt, Human
cugcauccccuuggc

SEQ ID NO: 2873721 - RNA, 16 nt, Human
cugcauccccuuggcu

SEQ ID NO: 2873722 - RNA, 19 nt, Human
cugcauccuccgccucccg

SEQ ID NO: 2873723 - RNA, 17 nt, Human
cugcaucuaagcccaug

SEQ ID NO: 2873724 - RNA, 18 nt, Human
cugcaucuaagcccaugg

SEQ ID NO: 2873725 - RNA, 21 nt, Human
cugcaucuuauagcacuuuga

SEQ ID NO: 2873726 - RNA, 22 nt, Human
cugcaucuuauagcacuuugaa

SEQ ID NO: 2873727 - RNA, 23 nt, Human
cugcaucuuauagcacuuugaaa

SEQ ID NO: 2873728 - RNA, 21 nt, Human
cugcauguaaacacgccugca

SEQ ID NO: 2873729 - RNA, 16 nt, Human
cugcaugggccagccc

SEQ ID NO: 2873730 - RNA, 17 nt, Human
cugcaugggccagcccc

SEQ ID NO: 2873731 - RNA, 19 nt, Human
cugcaugggccagccccuc

SEQ ID NO: 2873732 - RNA, 18 nt, Human
cugccaccucccugaccc

SEQ ID NO: 2873733 - RNA, 16 nt, Human
cugccaccucuccauc

SEQ ID NO: 2873734 - RNA, 17 nt, Human
cugccaccucuccaucc

SEQ ID NO: 2873735 - RNA, 12 nt, Human
cugccacacagg

SEQ ID NO: 2873736 - RNA, 21 nt, Human
cugccacaccagucacaugac

SEQ ID NO: 2873737 - RNA, 18 nt, Human
cugcauggagacgcauuu

SEQ ID NO: 2873738 - RNA, 20 nt, Human
cugcaugccuggucuuuccu

SEQ ID NO: 2873739 - RNA, 22 nt, Human
cugcaugccuggucuuuccucu

SEQ ID NO: 2873740 - RNA, 23 nt, Human
cugcaugccuggucuuuccucug

SEQ ID NO: 2873741 - RNA, 17 nt, Human
cugcaucuuuagugcuu

SEQ ID NO: 2873742 - RNA, 18 nt, Human
cugcaucuuuagugcuuu

SEQ ID NO: 2873743 - RNA, 15 nt, Human
cugcaugaauaucau

SEQ ID NO: 2873744 - RNA, 16 nt, Human
cugcaugaauaucaua

SEQ ID NO: 2873745 - RNA, 23 nt, Human
cugcccacuguuucucuugagcu

SEQ ID NO: 2873746 - RNA, 22 nt, Human
cugcccacuguuucucuugagc

SEQ ID NO: 2873747 - RNA, 13 nt, Human
cugcccacuguuu

SEQ ID NO: 2873748 - RNA, 17 nt, Human
cugccaugcagggccuc

SEQ ID NO: 2873749 - RNA, 20 nt, Human
cugccacaaccagccaggca

SEQ ID NO: 2873750 - RNA, 16 nt, Human
cugcccacugcugcag

SEQ ID NO: 2873751 - RNA, 17 nt, Human
cugcccagccuccaagc

SEQ ID NO: 2873752 - RNA, 22 nt, Human
cugcccaucacaggguugggcc

SEQ ID NO: 2873753 - RNA, 18 nt, Human
cugcccaucacaggguug

SEQ ID NO: 2873754 - RNA, 15 nt, Human
cugcccaucacaggg

SEQ ID NO: 2873755 - RNA, 15 nt, Human
cugccccaaacaaau

SEQ ID NO: 2873756 - RNA, 19 nt, Human
cugcccauucugcccugug

SEQ ID NO: 2873757 - RNA, 23 nt, Human
cugcccauucugcccugugggac

SEQ ID NO: 2873758 - RNA, 18 nt, Human
cugcccauuucauauucu

SEQ ID NO: 2873759 - RNA, 22 nt, Human
cugcccauuucgugagccccau

SEQ ID NO: 2873760 - RNA, 21 nt, Human
cugcccauucaccaaaauuau

SEQ ID NO: 2873761 - RNA, 15 nt, Human
cugccaugcagggcc

SEQ ID NO: 2873762 - RNA, 16 nt, Human
cugccaugcagggccu

SEQ ID NO: 2873763 - RNA, 22 nt, Human
cugccaucuuaguuuggauucu

SEQ ID NO: 2873764 - RNA, 23 nt, Human
cugccaucuuaguuuggauucuu

SEQ ID NO: 2873765 - RNA, 19 nt, Human
cugccaucuuaguuuggau

SEQ ID NO: 2873766 - RNA, 19 nt, Human
cugccacuuugguacaugg

SEQ ID NO: 2873767 - RNA, 16 nt, Human
cugccacuugaacaaa

SEQ ID NO: 2873768 - RNA, 12 nt, Human
cugccacuuugc

SEQ ID NO: 2873769 - RNA, 14 nt, Human
cugccacuuugcac

SEQ ID NO: 2873770 - RNA, 17 nt, Human
cugccacuuugcacauu

SEQ ID NO: 2873771 - RNA, 20 nt, Human
cugccacuuugcacauuuug

SEQ ID NO: 2873772 - RNA, 22 nt, Human
cugccacuuugcacauuuugau

SEQ ID NO: 2873773 - RNA, 17 nt, Human
cugccuagcaagcuggc

SEQ ID NO: 2873774 - RNA, 18 nt, Human
cugccuagcaagcuggcc

SEQ ID NO: 2873775 - RNA, 19 nt, Human
cugccuagcaagcuggccu

SEQ ID NO: 2873776 - RNA, 20 nt, Human
cugccuagcaagcuggccuc

SEQ ID NO: 2873777 - RNA, 17 nt, Human
cugccuagcugccuagc

SEQ ID NO: 2873778 - RNA, 18 nt, Human
cugccuagcugccuagca

SEQ ID NO: 2873779 - RNA, 21 nt, Human
cugccuagcugccuagcaagc

SEQ ID NO: 2873780 - RNA, 15 nt, Human
cugccuaauuacgau

SEQ ID NO: 2873781 - RNA, 23 nt, Human
cugccuaauuacgauaaggaaga

SEQ ID NO: 2873782 - RNA, 15 nt, Human
cugccucagccuccc

SEQ ID NO: 2873783 - RNA, 19 nt, Human
cugccucagccucccaaag

SEQ ID NO: 2873784 - RNA, 17 nt, Human
cugccucagccucccga

SEQ ID NO: 2873785 - RNA, 18 nt, Human
cugccucagccucccaag

SEQ ID NO: 2873786 - RNA, 22 nt, Human
cugccuccagaauggucuuucu

SEQ ID NO: 2873787 - RNA, 14 nt, Human
cugccuccagaaug

SEQ ID NO: 2873788 - RNA, 18 nt, Human
cugccgcccccuccugaa

SEQ ID NO: 2873789 - RNA, 16 nt, Human
cugccgccccacccag

SEQ ID NO: 2873790 - RNA, 19 nt, Human
cugccgcccccuccugaac

SEQ ID NO: 2873791 - RNA, 14 nt, Human
cugccgccucccag

SEQ ID NO: 2873792 - RNA, 16 nt, Human
cugccgccucccagcc

SEQ ID NO: 2873793 - RNA, 15 nt, Human
cugccgccucccagc

SEQ ID NO: 2873794 - RNA, 15 nt, Human
cugccggagaggaag

SEQ ID NO: 2873795 - RNA, 16 nt, Human
cugccggagaggaaga

SEQ ID NO: 2873796 - RNA, 17 nt, Human
cugccggagaggaagag

SEQ ID NO: 2873797 - RNA, 23 nt, Human
cugccggagaggaagagacacuc

SEQ ID NO: 2873798 - RNA, 13 nt, Human
cugccgcuaccuc

SEQ ID NO: 2873799 - RNA, 14 nt, Human
cugccgcuaccucc

SEQ ID NO: 2873800 - RNA, 17 nt, Human
cugccgcuaccucccuc

SEQ ID NO: 2873801 - RNA, 18 nt, Human
cugccgcuaccucccucc

SEQ ID NO: 2873802 - RNA, 19 nt, Human
cugccgccucccagccugg

SEQ ID NO: 2873803 - RNA, 18 nt, Human
cugccgccucccagccug

SEQ ID NO: 2873804 - RNA, 17 nt, Human
cugccccucucaccaaa

SEQ ID NO: 2873805 - RNA, 12 nt, Human
cugccccucucu

SEQ ID NO: 2873806 - RNA, 13 nt, Human
cugccccucucug

SEQ ID NO: 2873807 - RNA, 14 nt, Human
cugccccucucugg

SEQ ID NO: 2873808 - RNA, 15 nt, Human
cugccccucucuggg

SEQ ID NO: 2873809 - RNA, 16 nt, Human
cugccccucucugggc

SEQ ID NO: 2873810 - RNA, 17 nt, Human
cugccccucucugggcc

SEQ ID NO: 2873811 - RNA, 18 nt, Human
cugccccucucugggccu

SEQ ID NO: 2873812 - RNA, 22 nt, Human
cugccccucucugggccucaga

SEQ ID NO: 2873813 - RNA, 23 nt, Human
cugccccucucugggccucagag

SEQ ID NO: 2873814 - RNA, 12 nt, Human
cugccccucuuu

SEQ ID NO: 2873815 - RNA, 13 nt, Human
cugccccucuuuc

SEQ ID NO: 2873816 - RNA, 14 nt, Human
cugccccucuuucu

SEQ ID NO: 2873817 - RNA, 15 nt, Human
cugccccucuuucuc

SEQ ID NO: 2873818 - RNA, 16 nt, Human
cugccccucuuucucu

SEQ ID NO: 2873819 - RNA, 17 nt, Human
cugccccucuuucucuu

SEQ ID NO: 2873820 - RNA, 13 nt, Human
cugccccucucac

SEQ ID NO: 2873821 - RNA, 17 nt, Human
cugccccaaccugcuga

SEQ ID NO: 2873822 - RNA, 21 nt, Human
cugccccuccucucugcccua

SEQ ID NO: 2873823 - RNA, 21 nt, Human
cugccccaaacaaauaugcaa

SEQ ID NO: 2873824 - RNA, 21 nt, Human
cugccccaaauaacuucaguc

SEQ ID NO: 2873825 - RNA, 22 nt, Human
cugccccaaauaacuucagucc

SEQ ID NO: 2873826 - RNA, 23 nt, Human
cugccccaaauaacuucaguccu

SEQ ID NO: 2873827 - RNA, 20 nt, Human
cugccccuccucucugcccu

SEQ ID NO: 2873828 - RNA, 21 nt, Human
cugccucugacacacagcucu

SEQ ID NO: 2873829 - RNA, 18 nt, Human
cugccucugacacacagc

SEQ ID NO: 2873830 - RNA, 17 nt, Human
cugccucugacacacag

SEQ ID NO: 2873831 - RNA, 22 nt, Human
cugccugcccaggccccugcca

SEQ ID NO: 2873832 - RNA, 21 nt, Human
cugccugcccaggccccugcc

SEQ ID NO: 2873833 - RNA, 17 nt, Human
cugccugcccgcacagc

SEQ ID NO: 2873834 - RNA, 18 nt, Human
cugccugcccgcacagca

SEQ ID NO: 2873835 - RNA, 19 nt, Human
cugccugcccgcacagcag

SEQ ID NO: 2873836 - RNA, 20 nt, Human
cugccugcccgcacagcagc

SEQ ID NO: 2873837 - RNA, 23 nt, Human
cugccugcccgcacagcagccug

SEQ ID NO: 2873838 - RNA, 18 nt, Human
cugccuucugacggcccu

SEQ ID NO: 2873839 - RNA, 19 nt, Human
cugccuucugacggcccug

SEQ ID NO: 2873840 - RNA, 20 nt, Human
cugccuucugacggcccugc

SEQ ID NO: 2873841 - RNA, 21 nt, Human
cugccuucugacggcccugca

SEQ ID NO: 2873842 - RNA, 22 nt, Human
cugccuucugacggcccugcaa

SEQ ID NO: 2873843 - RNA, 23 nt, Human
cugccuucugacggcccugcaau

SEQ ID NO: 2873844 - RNA, 21 nt, Human
cugccuugaagccacugaagc

SEQ ID NO: 2873845 - RNA, 20 nt, Human
cugccuugaagccacugaag

SEQ ID NO: 2873846 - RNA, 16 nt, Human
cugccuugaagccacu

SEQ ID NO: 2873847 - RNA, 17 nt, Human
cugccuugaaccuguga

SEQ ID NO: 2873848 - RNA, 19 nt, Human
cugccuugaaccugugagu

SEQ ID NO: 2873849 - RNA, 14 nt, Human
cugccuggccacug

SEQ ID NO: 2873850 - RNA, 16 nt, Human
cugccuggccacugcu

SEQ ID NO: 2873851 - RNA, 18 nt, Human
cugccuggccacugcucc

SEQ ID NO: 2873852 - RNA, 11 nt, Human
cugccuggagc

SEQ ID NO: 2873853 - RNA, 18 nt, Human
cugccuggacuagaggga

SEQ ID NO: 2873854 - RNA, 18 nt, Human
cugcgguccacccaggag

SEQ ID NO: 2873855 - RNA, 17 nt, Human
cugcgguccacccagga

SEQ ID NO: 2873856 - RNA, 22 nt, Human
cugcgggaugguccuggggcuc

SEQ ID NO: 2873857 - RNA, 20 nt, Human
cugcgggaugguccuggggc

SEQ ID NO: 2873858 - RNA, 20 nt, Human
cugcgguccacccaggagcc

SEQ ID NO: 2873859 - RNA, 19 nt, Human
cugcgguccacccaggagc

SEQ ID NO: 2873860 - RNA, 20 nt, Human
cugcgugccagucaagaaga

SEQ ID NO: 2873861 - RNA, 22 nt, Human
cugcgugccagucaagaagaaa

SEQ ID NO: 2873862 - RNA, 16 nt, Human
cugcgugccccugcug

SEQ ID NO: 2873863 - RNA, 13 nt, Human
cugcgucuguguu

SEQ ID NO: 2873864 - RNA, 17 nt, Human
cugcgucuuccgccccu

SEQ ID NO: 2873865 - RNA, 23 nt, Human
cugcgucuuccgccccugccugc

SEQ ID NO: 2873866 - RNA, 19 nt, Human
cugcgggaugguccugggg

SEQ ID NO: 2873867 - RNA, 18 nt, Human
cugcgggaugguccuggg

SEQ ID NO: 2873868 - RNA, 17 nt, Human
cugcgggaugguccugg

SEQ ID NO: 2873869 - RNA, 15 nt, Human
cugcggaucucagcu

SEQ ID NO: 2873870 - RNA, 18 nt, Human
cugccucagccucccgag

SEQ ID NO: 2873871 - RNA, 19 nt, Human
cugcgaaggggcccugguc

SEQ ID NO: 2873872 - RNA, 18 nt, Human
cugcgaaggggcccuggu

SEQ ID NO: 2873873 - RNA, 17 nt, Human
cugccuuugacauuuaa

SEQ ID NO: 2873874 - RNA, 21 nt, Human
cugccuuugacauuuaauuua

SEQ ID NO: 2873875 - RNA, 18 nt, Human
cugccuuugauguuacag

SEQ ID NO: 2873876 - RNA, 17 nt, Human
cugcgaaggggcccugg

SEQ ID NO: 2873877 - RNA, 17 nt, Human
cugccuuugggagcagg

SEQ ID NO: 2873878 - RNA, 14 nt, Human
cugccuuugccucc

SEQ ID NO: 2873879 - RNA, 16 nt, Human
cugccuuugccuccag

SEQ ID NO: 2873880 - RNA, 20 nt, Human
cugccuuugccuccagaagc

SEQ ID NO: 2873881 - RNA, 21 nt, Human
cugccuuugccuccagaagca

SEQ ID NO: 2873882 - RNA, 20 nt, Human
cucuuuguucuaaagaugga

SEQ ID NO: 2873883 - RNA, 18 nt, Human
cucuuuguggggcuuggc

SEQ ID NO: 2873884 - RNA, 20 nt, Human
cucuuuguggggcuuggcgu

SEQ ID NO: 2873885 - RNA, 15 nt, Human
cucuuuuauauuugu

SEQ ID NO: 2873886 - RNA, 16 nt, Human
cucuuuuauauuugua

SEQ ID NO: 2873887 - RNA, 22 nt, Human
cucuuuuauauuuguaggagaa

SEQ ID NO: 2873888 - RNA, 23 nt, Human
cucuuuuauauuuguaggagaaa

SEQ ID NO: 2873889 - RNA, 14 nt, Human
cucuuuucaaaaca

SEQ ID NO: 2873890 - RNA, 23 nt, Human
cugaaagugaaaguccagaaacu

SEQ ID NO: 2873891 - RNA, 13 nt, Human
cugaaaguuaccc

SEQ ID NO: 2873892 - RNA, 15 nt, Human
cugaaaguuacccac

SEQ ID NO: 2873893 - RNA, 17 nt, Human
cugaaaguuacccacug

SEQ ID NO: 2873894 - RNA, 18 nt, Human
cugaaaguuacccacuga

SEQ ID NO: 2873895 - RNA, 22 nt, Human
cugaaaguuacccacugaagcc

SEQ ID NO: 2873896 - RNA, 12 nt, Human
cugaaaguucuu

SEQ ID NO: 2873897 - RNA, 14 nt, Human
cugaaaguuguaca

SEQ ID NO: 2873898 - RNA, 15 nt, Human
cugaaaguuguacau

SEQ ID NO: 2873899 - RNA, 16 nt, Human
cugaaaguuguacaug

SEQ ID NO: 2873900 - RNA, 20 nt, Human
cugaaaguuguacaugaaau

SEQ ID NO: 2873901 - RNA, 14 nt, Human
cucuguuguaagaa

SEQ ID NO: 2873902 - RNA, 19 nt, Human
cugaaagugaaaguccaga

SEQ ID NO: 2873903 - RNA, 12 nt, Human
cucuucugcucc

SEQ ID NO: 2873904 - RNA, 16 nt, Human
cucuucuccaggcugu

SEQ ID NO: 2873905 - RNA, 13 nt, Human
cucuucuccccag

SEQ ID NO: 2873906 - RNA, 14 nt, Human
cucuucuccccaga

SEQ ID NO: 2873907 - RNA, 12 nt, Human
cucuucucccag

SEQ ID NO: 2873908 - RNA, 13 nt, Human
cucuucucccaga

SEQ ID NO: 2873909 - RNA, 14 nt, Human
cucuucucccagaa

SEQ ID NO: 2873910 - RNA, 15 nt, Human
cucuucucccagaau

SEQ ID NO: 2873911 - RNA, 16 nt, Human
cucuucucccagaauc

SEQ ID NO: 2873912 - RNA, 17 nt, Human
cucuucucccagaaucc

SEQ ID NO: 2873913 - RNA, 21 nt, Human
cucuucucccagaaucccagc

SEQ ID NO: 2873914 - RNA, 22 nt, Human
cucuucucccagaaucccagcc

SEQ ID NO: 2873915 - RNA, 12 nt, Human
cugaaauuccaa

SEQ ID NO: 2873916 - RNA, 13 nt, Human
cugaaauuccaaa

SEQ ID NO: 2873917 - RNA, 14 nt, Human
cugaaauuccaaag

SEQ ID NO: 2873918 - RNA, 15 nt, Human
cugaaauuccaaagu

SEQ ID NO: 2873919 - RNA, 16 nt, Human
cugaaauuccaaaguc

SEQ ID NO: 2873920 - RNA, 17 nt, Human
cugaaauuccaaagucu

SEQ ID NO: 2873921 - RNA, 20 nt, Human
cugaaauuccaaagucucua

SEQ ID NO: 2873922 - RNA, 14 nt, Human
cugaaauucuaaag

SEQ ID NO: 2873923 - RNA, 18 nt, Human
cugaaauuccaaagucuc

SEQ ID NO: 2873924 - RNA, 16 nt, Human
cugaacaaaaaauaaa

SEQ ID NO: 2873925 - RNA, 21 nt, Human
cugaacaaacuaaaggugcac

SEQ ID NO: 2873926 - RNA, 16 nt, Human
cugaacaagaauugga

SEQ ID NO: 2873927 - RNA, 14 nt, Human
cugaacaagaauug

SEQ ID NO: 2873928 - RNA, 13 nt, Human
cugaacaagaauu

SEQ ID NO: 2873929 - RNA, 12 nt, Human
cugaacaagaau

SEQ ID NO: 2873930 - RNA, 19 nt, Human
cugaacaauaggcuguucc

SEQ ID NO: 2873931 - RNA, 21 nt, Human
cugaacaauaggcuguuccca

SEQ ID NO: 2873932 - RNA, 13 nt, Human
cugaacacaggca

SEQ ID NO: 2873933 - RNA, 14 nt, Human
cugaacacaggcag

SEQ ID NO: 2873934 - RNA, 15 nt, Human
cugaacacaggcagc

SEQ ID NO: 2873935 - RNA, 16 nt, Human
cugaacacaggcagcu

SEQ ID NO: 2873936 - RNA, 17 nt, Human
cugaacacaggcagcuu

SEQ ID NO: 2873937 - RNA, 18 nt, Human
cugaacacaggcagcuuu

SEQ ID NO: 2873938 - RNA, 19 nt, Human
cugaacacaggcagcuuuc

SEQ ID NO: 2873939 - RNA, 22 nt, Human
cugaacacaggcagcuuucuag

SEQ ID NO: 2873940 - RNA, 21 nt, Human
cugaacauuuacuacaguuuu

SEQ ID NO: 2873941 - RNA, 16 nt, Human
cugaaccccucccucc

SEQ ID NO: 2873942 - RNA, 21 nt, Human
cugaaccccgucgaggggcuc

SEQ ID NO: 2873943 - RNA, 13 nt, Human
cugaagaacagua

SEQ ID NO: 2873944 - RNA, 13 nt, Human
cugaacuuuggag

SEQ ID NO: 2873945 - RNA, 14 nt, Human
cugaacuuuggaga

SEQ ID NO: 2873946 - RNA, 16 nt, Human
cugaacuuuggagagu

SEQ ID NO: 2873947 - RNA, 14 nt, Human
cugaacuuugggaa

SEQ ID NO: 2873948 - RNA, 16 nt, Human
cugaacuuugggaagc

SEQ ID NO: 2873949 - RNA, 21 nt, Human
cugaacuuugggaagccuuua

SEQ ID NO: 2873950 - RNA, 17 nt, Human
cugaagucacacaguga

SEQ ID NO: 2873951 - RNA, 19 nt, Human
cugaagucacacagugagu

SEQ ID NO: 2873952 - RNA, 18 nt, Human
cugaagucacacagugag

SEQ ID NO: 2873953 - RNA, 21 nt, Human
cugaagucacacagugagucg

SEQ ID NO: 2873954 - RNA, 16 nt, Human
cugaagucacacagug

SEQ ID NO: 2873955 - RNA, 19 nt, Human
cugaagucacaucacagga

SEQ ID NO: 2873956 - RNA, 22 nt, Human
cugaagucacaucacaggacac

SEQ ID NO: 2873957 - RNA, 21 nt, Human
cugaagucacaucacaggaca

SEQ ID NO: 2873958 - RNA, 13 nt, Human
cugaagucacugc

SEQ ID NO: 2873959 - RNA, 14 nt, Human
cugaagucacugca

SEQ ID NO: 2873960 - RNA, 15 nt, Human
cugaagucacugcac

SEQ ID NO: 2873961 - RNA, 22 nt, Human
cugaauguuuaaagaucaugac

SEQ ID NO: 2873962 - RNA, 19 nt, Human
cugaauguuuauuccuuga

SEQ ID NO: 2873963 - RNA, 16 nt, Human
cugaauguuuauuccu

SEQ ID NO: 2873964 - RNA, 18 nt, Human
cugaauguuuauuccuug

SEQ ID NO: 2873965 - RNA, 17 nt, Human
cugaauuaaucaucuau

SEQ ID NO: 2873966 - RNA, 11 nt, Human
cugaauguauu

SEQ ID NO: 2873967 - RNA, 17 nt, Human
cugaaugugcugaucau

SEQ ID NO: 2873968 - RNA, 23 nt, Human
cugaaugugguuucaaucuaauu

SEQ ID NO: 2873969 - RNA, 14 nt, Human
cugaaugcugccac

SEQ ID NO: 2873970 - RNA, 15 nt, Human
cugaaugccuccugu

SEQ ID NO: 2873971 - RNA, 17 nt, Human
cugaaugccuccugugg

SEQ ID NO: 2873972 - RNA, 18 nt, Human
cugaaugccuccuguggg

SEQ ID NO: 2873973 - RNA, 19 nt, Human
cugaaugccuccugugggg

SEQ ID NO: 2873974 - RNA, 20 nt, Human
cugaaugccuccugugggga

SEQ ID NO: 2873975 - RNA, 22 nt, Human
cugaaugaaccuucuggccucc

SEQ ID NO: 2873976 - RNA, 19 nt, Human
cugaaugcuuauagguggc

SEQ ID NO: 2873977 - RNA, 21 nt, Human
cugaaugcuuauagguggccu

SEQ ID NO: 2873978 - RNA, 22 nt, Human
cugaaugcuuauagguggccuc

SEQ ID NO: 2873979 - RNA, 20 nt, Human
cugacugguuaacagcaguc

SEQ ID NO: 2873980 - RNA, 19 nt, Human
cugacuguaacauauucug

SEQ ID NO: 2873981 - RNA, 13 nt, Human
cugacuguccucu

SEQ ID NO: 2873982 - RNA, 14 nt, Human
cugacuguccucuc

SEQ ID NO: 2873983 - RNA, 16 nt, Human
cugacuguccucuccc

SEQ ID NO: 2873984 - RNA, 21 nt, Human
cugacuguccucuccccucca

SEQ ID NO: 2873985 - RNA, 22 nt, Human
cugacuguccucuccccuccag

SEQ ID NO: 2873986 - RNA, 17 nt, Human
cugacuguacuccuccc

SEQ ID NO: 2873987 - RNA, 12 nt, Human
cugagaaaacaa

SEQ ID NO: 2873988 - RNA, 21 nt, Human
cugacuuuuaaugucauuugu

SEQ ID NO: 2873989 - RNA, 10 nt, Human
cugagaaaag

SEQ ID NO: 2873990 - RNA, 13 nt, Human
cugagaaaagaac

SEQ ID NO: 2873991 - RNA, 14 nt, Human
cugagaaaacaagc

SEQ ID NO: 2873992 - RNA, 23 nt, Human
cugagaaaaugagugacuagacg

SEQ ID NO: 2873993 - RNA, 18 nt, Human
cugacuuugcucuuucuu

SEQ ID NO: 2873994 - RNA, 16 nt, Human
cugacuuugcucuuuc

SEQ ID NO: 2873995 - RNA, 19 nt, Human
cugaaugggaucaugaaag

SEQ ID NO: 2873996 - RNA, 12 nt, Human
cugacuaaauuu

SEQ ID NO: 2873997 - RNA, 13 nt, Human
cugacuaaauuug

SEQ ID NO: 2873998 - RNA, 18 nt, Human
cugacuaaauuuggggac

SEQ ID NO: 2873999 - RNA, 17 nt, Human
cugacuacuggcucuca

SEQ ID NO: 2874000 - RNA, 20 nt, Human
cugacuccacgauccugcca

SEQ ID NO: 2874001 - RNA, 18 nt, Human
cugacuccuaccugcccu

SEQ ID NO: 2874002 - RNA, 20 nt, Human
cugacuccuaccugcccugg

SEQ ID NO: 2874003 - RNA, 21 nt, Human
cugacuccuaccugcccugga

SEQ ID NO: 2874004 - RNA, 22 nt, Human
cugacuccuaccugcccuggaa

SEQ ID NO: 2874005 - RNA, 16 nt, Human
cugacucaucauuugu

SEQ ID NO: 2874006 - RNA, 16 nt, Human
cugacuacauuuuuuc

SEQ ID NO: 2874007 - RNA, 20 nt, Human
cugacuggauucauucucau

SEQ ID NO: 2874008 - RNA, 21 nt, Human
cugacuggauucauucucaua

SEQ ID NO: 2874009 - RNA, 14 nt, Human
cugacugcccagca

SEQ ID NO: 2874010 - RNA, 15 nt, Human
cugacugcccagcau

SEQ ID NO: 2874011 - RNA, 18 nt, Human
cugacugcccagcauuug

SEQ ID NO: 2874012 - RNA, 21 nt, Human
cugacgcaaaaccacuuuccu

SEQ ID NO: 2874013 - RNA, 21 nt, Human
cugaccuuugucaucuuucuu

SEQ ID NO: 2874014 - RNA, 23 nt, Human
cugaccuuugucaucuuucuucu

SEQ ID NO: 2874015 - RNA, 17 nt, Human
cugacgaaacuggcccc

SEQ ID NO: 2874016 - RNA, 20 nt, Human
cugacgaaacuggccccgga

SEQ ID NO: 2874017 - RNA, 21 nt, Human
cugacgaaacuggccccggau

SEQ ID NO: 2874018 - RNA, 18 nt, Human
cugaccuuugucaucuuu

SEQ ID NO: 2874019 - RNA, 21 nt, Human
cugaccagccuccaugcugcc

SEQ ID NO: 2874020 - RNA, 23 nt, Human
cugaccagccuccaugcugccuc

SEQ ID NO: 2874021 - RNA, 21 nt, Human
cugacgucugaagcuugacuc

SEQ ID NO: 2874022 - RNA, 22 nt, Human
cugacgucugaagcuugacucc

SEQ ID NO: 2874023 - RNA, 23 nt, Human
cugacgucugaagcuugacuccc

SEQ ID NO: 2874024 - RNA, 13 nt, Human
cugacggcccugc

SEQ ID NO: 2874025 - RNA, 14 nt, Human
cugacggcccugca

SEQ ID NO: 2874026 - RNA, 15 nt, Human
cugacggcccugcaa

SEQ ID NO: 2874027 - RNA, 16 nt, Human
cugacggcccugcaau

SEQ ID NO: 2874028 - RNA, 17 nt, Human
cugacggcccugcaaug

SEQ ID NO: 2874029 - RNA, 18 nt, Human
cugacgcaaugaaaaguc

SEQ ID NO: 2874030 - RNA, 18 nt, Human
cugacagacacaggcccg

SEQ ID NO: 2874031 - RNA, 17 nt, Human
cugacagacacaggccc

SEQ ID NO: 2874032 - RNA, 17 nt, Human
cugaccagccuccaugc

SEQ ID NO: 2874033 - RNA, 15 nt, Human
cugaauuugcccugg

SEQ ID NO: 2874034 - RNA, 16 nt, Human
cugaauuugcccuggg

SEQ ID NO: 2874035 - RNA, 18 nt, Human
cugaauuugcccugggaa

SEQ ID NO: 2874036 - RNA, 19 nt, Human
cugaauuugcccugggaaa

SEQ ID NO: 2874037 - RNA, 16 nt, Human
cugacagacacaggcc

SEQ ID NO: 2874038 - RNA, 21 nt, Human
cugaauuuggccugcacuaau

SEQ ID NO: 2874039 - RNA, 16 nt, Human
cugaauuuuggaggca

SEQ ID NO: 2874040 - RNA, 13 nt, Human
cugagauucuuca

SEQ ID NO: 2874041 - RNA, 23 nt, Human
cugagauuauaggcaccuaccac

SEQ ID NO: 2874042 - RNA, 24 nt, Human
cugagcaacagagugagacccugu

SEQ ID NO: 2874043 - RNA, 23 nt, Human
cugagcaacagagugagacccug

SEQ ID NO: 2874044 - RNA, 16 nt, Human
cugagcaacagaguga

SEQ ID NO: 2874045 - RNA, 20 nt, Human
cugagcaacucuugauuauc

SEQ ID NO: 2874046 - RNA, 15 nt, Human
cugagcaaauguggc

SEQ ID NO: 2874047 - RNA, 17 nt, Human
cugagcaaauguggcuc

SEQ ID NO: 2874048 - RNA, 20 nt, Human
cugagcaaauguggcuccug

SEQ ID NO: 2874049 - RNA, 21 nt, Human
cugagcaaauguggcuccugg

SEQ ID NO: 2874050 - RNA, 16 nt, Human
cugagcaggaccucug

SEQ ID NO: 2874051 - RNA, 14 nt, Human
cugagcacuggagu

SEQ ID NO: 2874052 - RNA, 16 nt, Human
cugagcacuggagugg

SEQ ID NO: 2874053 - RNA, 13 nt, Human
cugagcacagaug

SEQ ID NO: 2874054 - RNA, 11 nt, Human
cugagcacaga

SEQ ID NO: 2874055 - RNA, 17 nt, Human
cugagcacacuuuagug

SEQ ID NO: 2874056 - RNA, 16 nt, Human
cugagcccauguucug

SEQ ID NO: 2874057 - RNA, 19 nt, Human
cugagcccauguucugccc

SEQ ID NO: 2874058 - RNA, 20 nt, Human
cugagcccauguucugcccc

SEQ ID NO: 2874059 - RNA, 23 nt, Human
cugagcccauguucugcccccag

SEQ ID NO: 2874060 - RNA, 20 nt, Human
cugagcauacucaacaaaac

SEQ ID NO: 2874061 - RNA, 14 nt, Human
cugagccacagcag

SEQ ID NO: 2874062 - RNA, 18 nt, Human
cugagccacagcagcauu

SEQ ID NO: 2874063 - RNA, 19 nt, Human
cugagccacagcagcauuu

SEQ ID NO: 2874064 - RNA, 20 nt, Human
cugagccacagcagcauuuu

SEQ ID NO: 2874065 - RNA, 15 nt, Human
cugagccacucucuu

SEQ ID NO: 2874066 - RNA, 18 nt, Human
cugagcaggaccucugaa

SEQ ID NO: 2874067 - RNA, 20 nt, Human
cucuggcauuagaauuauuu

SEQ ID NO: 2874068 - RNA, 23 nt, Human
cucuggcauuagaauuauuuaaa

SEQ ID NO: 2874069 - RNA, 14 nt, Human
cucuggccacaaca

SEQ ID NO: 2874070 - RNA, 19 nt, Human
cucuggcaguucuggaaug

SEQ ID NO: 2874071 - RNA, 18 nt, Human
cucuggcauuagaauuau

SEQ ID NO: 2874072 - RNA, 19 nt, Human
cucuggcauuagaauuauu

SEQ ID NO: 2874073 - RNA, 22 nt, Human
cucuggauuggagauagggaaa

SEQ ID NO: 2874074 - RNA, 10 nt, Human
cucugccuga

SEQ ID NO: 2874075 - RNA, 23 nt, Human
cucuggaugccugauugccaagc

SEQ ID NO: 2874076 - RNA, 19 nt, Human
cucugccucaccgcuuccc

SEQ ID NO: 2874077 - RNA, 17 nt, Human
cucuggauuaggucucu

SEQ ID NO: 2874078 - RNA, 20 nt, Human
cucugccucugacacacagc

SEQ ID NO: 2874079 - RNA, 19 nt, Human
cucugccucugacacacag

SEQ ID NO: 2874080 - RNA, 16 nt, Human
cucugccucugacaca

SEQ ID NO: 2874081 - RNA, 18 nt, Human
cucugccgucucuggagc

SEQ ID NO: 2874082 - RNA, 17 nt, Human
cucugccgucucuggag

SEQ ID NO: 2874083 - RNA, 16 nt, Human
cucugccgucucugga

SEQ ID NO: 2874084 - RNA, 13 nt, Human
cucugucgcccag

SEQ ID NO: 2874085 - RNA, 15 nt, Human
cucugucgcccaggc

SEQ ID NO: 2874086 - RNA, 21 nt, Human
cucuggggcuguugaagucac

SEQ ID NO: 2874087 - RNA, 22 nt, Human
cucuggggcuguugaagucacc

SEQ ID NO: 2874088 - RNA, 14 nt, Human
cucuggggcucuag

SEQ ID NO: 2874089 - RNA, 16 nt, Human
cucuggggcucuaggg

SEQ ID NO: 2874090 - RNA, 22 nt, Human
cucuggggcucuaggguugcug

SEQ ID NO: 2874091 - RNA, 17 nt, Human
cucugucgcccagucug

SEQ ID NO: 2874092 - RNA, 22 nt, Human
cucugucgcccaggcuggagug

SEQ ID NO: 2874093 - RNA, 18 nt, Human
cucugucgcccaggcugg

SEQ ID NO: 2874094 - RNA, 19 nt, Human
cucugucgcccagucugga

SEQ ID NO: 2874095 - RNA, 18 nt, Human
cucugucgcccagucugg

SEQ ID NO: 2874096 - RNA, 15 nt, Human
cucugucuagcaugc

SEQ ID NO: 2874097 - RNA, 18 nt, Human
cucugucuagcaugccaa

SEQ ID NO: 2874098 - RNA, 15 nt, Human
cucugucuacaaaua

SEQ ID NO: 2874099 - RNA, 22 nt, Human
cucuguccugggagugagcugg

SEQ ID NO: 2874100 - RNA, 15 nt, Human
cucuguccugggagu

SEQ ID NO: 2874101 - RNA, 13 nt, Human
cucuguccuggga

SEQ ID NO: 2874102 - RNA, 14 nt, Human
cucuguccugggag

SEQ ID NO: 2874103 - RNA, 18 nt, Human
cucugggauuuaugcuca

SEQ ID NO: 2874104 - RNA, 19 nt, Human
cucugggauuuaugcucau

SEQ ID NO: 2874105 - RNA, 22 nt, Human
cucugggauuuaugcucaugaa

SEQ ID NO: 2874106 - RNA, 19 nt, Human
cucugggcacacucugcca

SEQ ID NO: 2874107 - RNA, 14 nt, Human
cucuggcuagaggc

SEQ ID NO: 2874108 - RNA, 23 nt, Human
cucugggaaccucccagaggucc

SEQ ID NO: 2874109 - RNA, 16 nt, Human
cucugggcuauggaca

SEQ ID NO: 2874110 - RNA, 17 nt, Human
cucugggcuauggacac

SEQ ID NO: 2874111 - RNA, 18 nt, Human
cucugggcuauggacaca

SEQ ID NO: 2874112 - RNA, 20 nt, Human
cucugggcuauggacacagg

SEQ ID NO: 2874113 - RNA, 21 nt, Human
cucugggcuauggacacaggg

SEQ ID NO: 2874114 - RNA, 20 nt, Human
cucuggggcaggcugcuuca

SEQ ID NO: 2874115 - RNA, 16 nt, Human
cucuguuucuccuucu

SEQ ID NO: 2874116 - RNA, 17 nt, Human
cucugugugcacaaaua

SEQ ID NO: 2874117 - RNA, 15 nt, Human
cucugugugcacaaa

SEQ ID NO: 2874118 - RNA, 23 nt, Human
cucugugucuaagauucuagauc

SEQ ID NO: 2874119 - RNA, 14 nt, Human
cucugugucugaga

SEQ ID NO: 2874120 - RNA, 17 nt, Human
cucuguguccuucccug

SEQ ID NO: 2874121 - RNA, 15 nt, Human
cucugugucuaagau

SEQ ID NO: 2874122 - RNA, 14 nt, Human
cucuguguccuucc

SEQ ID NO: 2874123 - RNA, 16 nt, Human
cucuguguccuucccu

SEQ ID NO: 2874124 - RNA, 18 nt, Human
cucugugucuaagauucu

SEQ ID NO: 2874125 - RNA, 19 nt, Human
cucugugucuaagauucua

SEQ ID NO: 2874126 - RNA, 21 nt, Human
cucugugucuaagauucuaga

SEQ ID NO: 2874127 - RNA, 22 nt, Human
cucugugucuaagauucuagau

SEQ ID NO: 2874128 - RNA, 20 nt, Human
cucuguugcccaggcuggag

SEQ ID NO: 2874129 - RNA, 22 nt, Human
cucuguugcccaggcuggagug

SEQ ID NO: 2874130 - RNA, 23 nt, Human
cucugugucagguggggcagcuu

SEQ ID NO: 2874131 - RNA, 22 nt, Human
cucugugucagguggggcagcu

SEQ ID NO: 2874132 - RNA, 21 nt, Human
cucugugucagguggggcagc

SEQ ID NO: 2874133 - RNA, 20 nt, Human
cucugugucagguggggcag

SEQ ID NO: 2874134 - RNA, 19 nt, Human
cucugugucagguggggca

SEQ ID NO: 2874135 - RNA, 23 nt, Human
cucugugaccugccccgcccagc

SEQ ID NO: 2874136 - RNA, 15 nt, Human
cucugugaccugccc

SEQ ID NO: 2874137 - RNA, 12 nt, Human
cucugugaccca

SEQ ID NO: 2874138 - RNA, 23 nt, Human
cucugugacccacuucucaucac

SEQ ID NO: 2874139 - RNA, 24 nt, Human
cucugugacccacuucucaucaca

SEQ ID NO: 2874140 - RNA, 14 nt, Human
cucugugaccucag

SEQ ID NO: 2874141 - RNA, 16 nt, Human
cucugugaccucaggc

SEQ ID NO: 2874142 - RNA, 19 nt, Human
cucugugaccucaggcacu

SEQ ID NO: 2874143 - RNA, 24 nt, Human
cucugugaccucaggcacuagccu

SEQ ID NO: 2874144 - RNA, 13 nt, Human
cucuucuccaggc

SEQ ID NO: 2874145 - RNA, 15 nt, Human
cucuucuccaggcug

SEQ ID NO: 2874146 - RNA, 12 nt, Human
cucuucuccacu

SEQ ID NO: 2874147 - RNA, 13 nt, Human
cucuucuccacug

SEQ ID NO: 2874148 - RNA, 16 nt, Human
cucuucgaagccuugc

SEQ ID NO: 2874149 - RNA, 18 nt, Human
cucuucgaagccuugccu

SEQ ID NO: 2874150 - RNA, 21 nt, Human
cucuucgcgcccgccccugca

SEQ ID NO: 2874151 - RNA, 23 nt, Human
cucuucgcgcccgccccugcagc

SEQ ID NO: 2874152 - RNA, 13 nt, Human
cucuucggcccuc

SEQ ID NO: 2874153 - RNA, 14 nt, Human
cucuucggcccuca

SEQ ID NO: 2874154 - RNA, 16 nt, Human
cucuucggcccucaga

SEQ ID NO: 2874155 - RNA, 17 nt, Human
cucuuccugugauccac

SEQ ID NO: 2874156 - RNA, 13 nt, Human
cucuuccugugau

SEQ ID NO: 2874157 - RNA, 19 nt, Human
cucuucuauuuuguaaacu

SEQ ID NO: 2874158 - RNA, 17 nt, Human
cucuucuauuuuguaaa

SEQ ID NO: 2874159 - RNA, 21 nt, Human
cucuuccccagaaaggagacu

SEQ ID NO: 2874160 - RNA, 12 nt, Human
cucuuccccaga

SEQ ID NO: 2874161 - RNA, 22 nt, Human
cucuuaagcuuccgccgucuca

SEQ ID NO: 2874162 - RNA, 15 nt, Human
cucuucccccuucca

SEQ ID NO: 2874163 - RNA, 16 nt, Human
cucuucccccuuccaa

SEQ ID NO: 2874164 - RNA, 15 nt, Human
cucuucccucagucc

SEQ ID NO: 2874165 - RNA, 17 nt, Human
cucuucccucaguccca

SEQ ID NO: 2874166 - RNA, 12 nt, Human
cucuuccugccc

SEQ ID NO: 2874167 - RNA, 13 nt, Human
cucuuccugcccc

SEQ ID NO: 2874168 - RNA, 14 nt, Human
cucuuccugccccu

SEQ ID NO: 2874169 - RNA, 16 nt, Human
cucuuccugccccucu

SEQ ID NO: 2874170 - RNA, 17 nt, Human
cucuuccugccccucuu

SEQ ID NO: 2874171 - RNA, 18 nt, Human
cucuuccugccccucuuu

SEQ ID NO: 2874172 - RNA, 19 nt, Human
cucuuccugccccucuuuc

SEQ ID NO: 2874173 - RNA, 20 nt, Human
cucuuccugccccucuuucu

SEQ ID NO: 2874174 - RNA, 21 nt, Human
cucuuccugccccucuuucuc

SEQ ID NO: 2874175 - RNA, 22 nt, Human
cucuuccugccccucuuucucu

SEQ ID NO: 2874176 - RNA, 23 nt, Human
cucuuccugccccucuuucucuu

SEQ ID NO: 2874177 - RNA, 19 nt, Human
cucugacacacagcucugu

SEQ ID NO: 2874178 - RNA, 18 nt, Human
cucugacacacagcucug

SEQ ID NO: 2874179 - RNA, 17 nt, Human
cucugacacacagcucu

SEQ ID NO: 2874180 - RNA, 16 nt, Human
cucugacacacagcuc

SEQ ID NO: 2874181 - RNA, 15 nt, Human
cucugacacacagcu

SEQ ID NO: 2874182 - RNA, 14 nt, Human
cucugacacacagc

SEQ ID NO: 2874183 - RNA, 22 nt, Human
cucugacaacagacuucugaaa

SEQ ID NO: 2874184 - RNA, 21 nt, Human
cucugacaacagacuucugaa

SEQ ID NO: 2874185 - RNA, 22 nt, Human
cucugaaggacauugcggacag

SEQ ID NO: 2874186 - RNA, 18 nt, Human
cucgcugcacaaauacuc

SEQ ID NO: 2874187 - RNA, 13 nt, Human
cucugaagucaca

SEQ ID NO: 2874188 - RNA, 23 nt, Human
cucugaagucacaucacaggaca

SEQ ID NO: 2874189 - RNA, 16 nt, Human
cucugacaacagacuu

SEQ ID NO: 2874190 - RNA, 14 nt, Human
cucugaggacacua

SEQ ID NO: 2874191 - RNA, 12 nt, Human
cucugaggacac

SEQ ID NO: 2874192 - RNA, 16 nt, Human
cucugaggacacuaac

SEQ ID NO: 2874193 - RNA, 22 nt, Human
cucugaggugccugucccaccc

SEQ ID NO: 2874194 - RNA, 15 nt, Human
cucugaggugccugu

SEQ ID NO: 2874195 - RNA, 19 nt, Human
cucugaggugccuguccca

SEQ ID NO: 2874196 - RNA, 17 nt, Human
cucugagagucuagauu

SEQ ID NO: 2874197 - RNA, 13 nt, Human
cucugagagucua

SEQ ID NO: 2874198 - RNA, 15 nt, Human
cucugagagucuaga

SEQ ID NO: 2874199 - RNA, 16 nt, Human
cucugagagucuagau

SEQ ID NO: 2874200 - RNA, 15 nt, Human
cucugaccugcaggc

SEQ ID NO: 2874201 - RNA, 14 nt, Human
cucugaccugcagg

SEQ ID NO: 2874202 - RNA, 13 nt, Human
cucugaccugcag

SEQ ID NO: 2874203 - RNA, 15 nt, Human
cucugaccugcacug

SEQ ID NO: 2874204 - RNA, 16 nt, Human
cucugaccugcaggcc

SEQ ID NO: 2874205 - RNA, 16 nt, Human
cucugacccagugaga

SEQ ID NO: 2874206 - RNA, 12 nt, Human
cucugaccccuc

SEQ ID NO: 2874207 - RNA, 20 nt, Human
cucugaccccagcauucuca

SEQ ID NO: 2874208 - RNA, 23 nt, Human
cucugacauuaugugguuuuaga

SEQ ID NO: 2874209 - RNA, 16 nt, Human
cucugaccaacaggcu

SEQ ID NO: 2874210 - RNA, 14 nt, Human
cucugacaagggcu

SEQ ID NO: 2874211 - RNA, 16 nt, Human
cucugacaagggcuga

SEQ ID NO: 2874212 - RNA, 17 nt, Human
cucugacaagggcugac

SEQ ID NO: 2874213 - RNA, 18 nt, Human
cucugacaagggcugacc

SEQ ID NO: 2874214 - RNA, 19 nt, Human
cucugacaagggcugaccu

SEQ ID NO: 2874215 - RNA, 20 nt, Human
cucugacaagggcugaccug

SEQ ID NO: 2874216 - RNA, 12 nt, Human
cucugaccugca

SEQ ID NO: 2874217 - RNA, 14 nt, Human
cucugaccugcacu

SEQ ID NO: 2874218 - RNA, 21 nt, Human
cucugaccccuccucacuggc

SEQ ID NO: 2874219 - RNA, 13 nt, Human
cucugaccccucc

SEQ ID NO: 2874220 - RNA, 14 nt, Human
cucugaccccuccu

SEQ ID NO: 2874221 - RNA, 16 nt, Human
cucugaccccuccuca

SEQ ID NO: 2874222 - RNA, 18 nt, Human
cucugaccccuccucacu

SEQ ID NO: 2874223 - RNA, 12 nt, Human
cucugccccagu

SEQ ID NO: 2874224 - RNA, 13 nt, Human
cucugccccaguc

SEQ ID NO: 2874225 - RNA, 17 nt, Human
cucugccccagucguua

SEQ ID NO: 2874226 - RNA, 20 nt, Human
cucugcccuaaugcgcaggc

SEQ ID NO: 2874227 - RNA, 12 nt, Human
cucugcccccug

SEQ ID NO: 2874228 - RNA, 17 nt, Human
cucugcccccugcuggc

SEQ ID NO: 2874229 - RNA, 14 nt, Human
cucugccgcuaccu

SEQ ID NO: 2874230 - RNA, 15 nt, Human
cucugccgcuaccuc

SEQ ID NO: 2874231 - RNA, 19 nt, Human
cucugccgcuaccucccuc

SEQ ID NO: 2874232 - RNA, 20 nt, Human
cucugccgcuaccucccucc

SEQ ID NO: 2874233 - RNA, 21 nt, Human
cucugccgcuaccucccuccc

SEQ ID NO: 2874234 - RNA, 15 nt, Human
cucugccgucucugg

SEQ ID NO: 2874235 - RNA, 23 nt, Human
cucugauaaaagggcaaaucugc

SEQ ID NO: 2874236 - RNA, 15 nt, Human
cucugaguccuggcc

SEQ ID NO: 2874237 - RNA, 16 nt, Human
cucugaguccuggccc

SEQ ID NO: 2874238 - RNA, 17 nt, Human
cucugaguccuggccca

SEQ ID NO: 2874239 - RNA, 18 nt, Human
cucugaguccuggcccaa

SEQ ID NO: 2874240 - RNA, 16 nt, Human
cucugcauuuuucugc

SEQ ID NO: 2874241 - RNA, 19 nt, Human
cucugcauuuuucugcaga

SEQ ID NO: 2874242 - RNA, 17 nt, Human
cucugcaucccagcacc

SEQ ID NO: 2874243 - RNA, 18 nt, Human
cucugcaucccagcaccu

SEQ ID NO: 2874244 - RNA, 19 nt, Human
cucugcaucccagcaccug

SEQ ID NO: 2874245 - RNA, 20 nt, Human
cucugcaucccagcaccugc

SEQ ID NO: 2874246 - RNA, 22 nt, Human
cucugcaucccagcaccugccu

SEQ ID NO: 2874247 - RNA, 23 nt, Human
cucugcaucccagcaccugccuc

SEQ ID NO: 2874248 - RNA, 11 nt, Human
gagcugcccuc

SEQ ID NO: 2874249 - RNA, 15 nt, Human
gagcugccccucucu

SEQ ID NO: 2874250 - RNA, 18 nt, Human
gagcugccccucucuggg

SEQ ID NO: 2874251 - RNA, 19 nt, Human
gagcugccccucucugggc

SEQ ID NO: 2874252 - RNA, 22 nt, Human
gagcucuucaggccucccucuc

SEQ ID NO: 2874253 - RNA, 19 nt, Human
gagcucuucaggccucccu

SEQ ID NO: 2874254 - RNA, 17 nt, Human
gagcucuucaggccucc

SEQ ID NO: 2874255 - RNA, 16 nt, Human
gagcucuucaggccuc

SEQ ID NO: 2874256 - RNA, 20 nt, Human
gagcucuggugauaaggaca

SEQ ID NO: 2874257 - RNA, 16 nt, Human
gagcucugcagagcag

SEQ ID NO: 2874258 - RNA, 15 nt, Human
gagcugcccuccuug

SEQ ID NO: 2874259 - RNA, 21 nt, Human
gagcugcccuccuuguccacc

SEQ ID NO: 2874260 - RNA, 23 nt, Human
gagcugcccuccuuguccaccca

SEQ ID NO: 2874261 - RNA, 19 nt, Human
gagcuguuuauggccucag

SEQ ID NO: 2874262 - RNA, 22 nt, Human
gagcuguuuauggccucagcug

SEQ ID NO: 2874263 - RNA, 15 nt, Human
gagcuguuuauguuu

SEQ ID NO: 2874264 - RNA, 16 nt, Human
gagcuguuuauguuuu

SEQ ID NO: 2874265 - RNA, 17 nt, Human
gagcuguuuauguuuuu

SEQ ID NO: 2874266 - RNA, 20 nt, Human
gagcuguuuauggccucagc

SEQ ID NO: 2874267 - RNA, 15 nt, Human
gagcuuaacagugug

SEQ ID NO: 2874268 - RNA, 22 nt, Human
gagcuuccaaggggcaaauuuu

SEQ ID NO: 2874269 - RNA, 14 nt, Human
gagcuucuggcacu

SEQ ID NO: 2874270 - RNA, 18 nt, Human
gagcuucuguugcugccu

SEQ ID NO: 2874271 - RNA, 11 nt, Human
gagcuaaggcu

SEQ ID NO: 2874272 - RNA, 21 nt, Human
gagccugggauuucuaugcag

SEQ ID NO: 2874273 - RNA, 13 nt, Human
gagcuaaggcucu

SEQ ID NO: 2874274 - RNA, 14 nt, Human
gagcuaaggcucua

SEQ ID NO: 2874275 - RNA, 15 nt, Human
gagcuaagggugggu

SEQ ID NO: 2874276 - RNA, 18 nt, Human
gagcuaagggugggugcu

SEQ ID NO: 2874277 - RNA, 20 nt, Human
gagcuaagggugggugcuca

SEQ ID NO: 2874278 - RNA, 22 nt, Human
gagcuaagggugggugcucaga

SEQ ID NO: 2874279 - RNA, 23 nt, Human
gagcuaagggugggugcucagaa

SEQ ID NO: 2874280 - RNA, 16 nt, Human
gagcuccucuccugga

SEQ ID NO: 2874281 - RNA, 17 nt, Human
gagcuccucuccuggag

SEQ ID NO: 2874282 - RNA, 18 nt, Human
gagcuccucuccuggagg

SEQ ID NO: 2874283 - RNA, 19 nt, Human
gagcuccucuccuggagga

SEQ ID NO: 2874284 - RNA, 19 nt, Human
gagcuccucuguccugcuu

SEQ ID NO: 2874285 - RNA, 21 nt, Human
gagcuccucuguccugcuucu

SEQ ID NO: 2874286 - RNA, 22 nt, Human
gagcuccucuguccugcuucug

SEQ ID NO: 2874287 - RNA, 19 nt, Human
gagcuccccuacggaccag

SEQ ID NO: 2874288 - RNA, 20 nt, Human
gagcuccccuacggaccagg

SEQ ID NO: 2874289 - RNA, 15 nt, Human
gagcuccucuccugg

SEQ ID NO: 2874290 - RNA, 17 nt, Human
gagcggucucaggcugg

SEQ ID NO: 2874291 - RNA, 22 nt, Human
gagcggucucaggcugguggga

SEQ ID NO: 2874292 - RNA, 23 nt, Human
gagcggucucaggcuggugggag

SEQ ID NO: 2874293 - RNA, 14 nt, Human
gagcgguggcccug

SEQ ID NO: 2874294 - RNA, 23 nt, Human
gagcgguggcccugucccuccca

SEQ ID NO: 2874295 - RNA, 13 nt, Human
gagcgguggggga

SEQ ID NO: 2874296 - RNA, 23 nt, Human
gagcgucaggguuggugugcuga

SEQ ID NO: 2874297 - RNA, 17 nt, Human
gagcgguggcccugucc

SEQ ID NO: 2874298 - RNA, 16 nt, Human
gagcgugaaucuguau

SEQ ID NO: 2874299 - RNA, 20 nt, Human
gagcguuagacugacuuguu

SEQ ID NO: 2874300 - RNA, 14 nt, Human
gagccuggugcccu

SEQ ID NO: 2874301 - RNA, 12 nt, Human
gagccuggugcc

SEQ ID NO: 2874302 - RNA, 12 nt, Human
gagccugcuggu

SEQ ID NO: 2874303 - RNA, 21 nt, Human
gagccugcuggucacagccuc

SEQ ID NO: 2874304 - RNA, 23 nt, Human
gagccugcuggucacagccuccu

SEQ ID NO: 2874305 - RNA, 15 nt, Human
gagccuggccagccu

SEQ ID NO: 2874306 - RNA, 17 nt, Human
gagccuggcccauagaa

SEQ ID NO: 2874307 - RNA, 18 nt, Human
gagccuggcccauagaaa

SEQ ID NO: 2874308 - RNA, 23 nt, Human
gagccuggcuccguccaggagcc

SEQ ID NO: 2874309 - RNA, 12 nt, Human
gagccuggcucu

SEQ ID NO: 2874310 - RNA, 17 nt, Human
gagccuggcacaggacu

SEQ ID NO: 2874311 - RNA, 18 nt, Human
gagccuggcacaggacug

SEQ ID NO: 2874312 - RNA, 19 nt, Human
gagccuggcacaggacuga

SEQ ID NO: 2874313 - RNA, 21 nt, Human
gagccuggcucuugugcugga

SEQ ID NO: 2874314 - RNA, 23 nt, Human
gagccuggcucuugugcuggaug

SEQ ID NO: 2874315 - RNA, 17 nt, Human
gagccugagucagggcc

SEQ ID NO: 2874316 - RNA, 21 nt, Human
gagccugagucagggcccaga

SEQ ID NO: 2874317 - RNA, 22 nt, Human
gagccugagucagggcccagag

SEQ ID NO: 2874318 - RNA, 15 nt, Human
gagccugaucucuuc

SEQ ID NO: 2874319 - RNA, 16 nt, Human
gagccugaucucuucc

SEQ ID NO: 2874320 - RNA, 17 nt, Human
gagccugaucucuuccu

SEQ ID NO: 2874321 - RNA, 18 nt, Human
gagccugaucucuuccug

SEQ ID NO: 2874322 - RNA, 19 nt, Human
gagccugaucucuuccugu

SEQ ID NO: 2874323 - RNA, 16 nt, Human
gagccugccuggagcg

SEQ ID NO: 2874324 - RNA, 17 nt, Human
gagcccugguggcagug

SEQ ID NO: 2874325 - RNA, 19 nt, Human
gagccucagcauccuggca

SEQ ID NO: 2874326 - RNA, 16 nt, Human
gagcccugguggcagu

SEQ ID NO: 2874327 - RNA, 15 nt, Human
gagcccugguggcag

SEQ ID NO: 2874328 - RNA, 21 nt, Human
gagccucagcauccuggcacc

SEQ ID NO: 2874329 - RNA, 20 nt, Human
gagccucagcauccuggcac

SEQ ID NO: 2874330 - RNA, 20 nt, Human
gagcaggagauugagaagga

SEQ ID NO: 2874331 - RNA, 22 nt, Human
gagcaggagauugagaaggaga

SEQ ID NO: 2874332 - RNA, 23 nt, Human
gagcaggagauugagaaggagag

SEQ ID NO: 2874333 - RNA, 19 nt, Human
gagcaggacucuauuuuaa

SEQ ID NO: 2874334 - RNA, 18 nt, Human
gagcaggagauugagaag

SEQ ID NO: 2874335 - RNA, 22 nt, Human
gagcagaaauuuaucuuucaaa

SEQ ID NO: 2874336 - RNA, 18 nt, Human
gagcaggcggugggcacc

SEQ ID NO: 2874337 - RNA, 22 nt, Human
gagcaggcggugggcacccacc

SEQ ID NO: 2874338 - RNA, 18 nt, Human
gagcaggcgguggggaga

SEQ ID NO: 2874339 - RNA, 18 nt, Human
gagccaccgcgcccagcc

SEQ ID NO: 2874340 - RNA, 14 nt, Human
gagccaccgugccu

SEQ ID NO: 2874341 - RNA, 20 nt, Human
gagccaccgugccuggccac

SEQ ID NO: 2874342 - RNA, 19 nt, Human
gagcagaugcagagagcca

SEQ ID NO: 2874343 - RNA, 21 nt, Human
gagcagaugcagagagccauu

SEQ ID NO: 2874344 - RNA, 14 nt, Human
gagcagaugcagag

SEQ ID NO: 2874345 - RNA, 16 nt, Human
gagcagaugcagagag

SEQ ID NO: 2874346 - RNA, 18 nt, Human
gagcagaugcagagagcc

SEQ ID NO: 2874347 - RNA, 22 nt, Human
gagcagaccaccccgccugccc

SEQ ID NO: 2874348 - RNA, 15 nt, Human
gagcagacaggagga

SEQ ID NO: 2874349 - RNA, 21 nt, Human
gagcagacaggaggaaucaug

SEQ ID NO: 2874350 - RNA, 17 nt, Human
gagcacuggguugacuu

SEQ ID NO: 2874351 - RNA, 13 nt, Human
gagcacuggguug

SEQ ID NO: 2874352 - RNA, 22 nt, Human
gagcacuggaguggcucgccag

SEQ ID NO: 2874353 - RNA, 14 nt, Human
gagcagacaggagg

SEQ ID NO: 2874354 - RNA, 17 nt, Human
gagcagaaguggagcug

SEQ ID NO: 2874355 - RNA, 23 nt, Human
gagcagaacggagccccaggccu

SEQ ID NO: 2874356 - RNA, 15 nt, Human
gagcacuuacuguaa

SEQ ID NO: 2874357 - RNA, 16 nt, Human
gagccauuuugugaau

SEQ ID NO: 2874358 - RNA, 21 nt, Human
gagccauuuugugaauggauu

SEQ ID NO: 2874359 - RNA, 13 nt, Human
gagcccaggcggg

SEQ ID NO: 2874360 - RNA, 15 nt, Human
gagcccaggcgggag

SEQ ID NO: 2874361 - RNA, 14 nt, Human
gagccauuuuguga

SEQ ID NO: 2874362 - RNA, 14 nt, Human
gagccaugcuggga

SEQ ID NO: 2874363 - RNA, 17 nt, Human
gagccaugggcacaaag

SEQ ID NO: 2874364 - RNA, 18 nt, Human
gagccaugggcacaaagg

SEQ ID NO: 2874365 - RNA, 21 nt, Human
gagccauguagaagcugcauc

SEQ ID NO: 2874366 - RNA, 22 nt, Human
gagccacugcaccgggccacag

SEQ ID NO: 2874367 - RNA, 14 nt, Human
gagccagacagacc

SEQ ID NO: 2874368 - RNA, 18 nt, Human
gagccacucucuucccuu

SEQ ID NO: 2874369 - RNA, 23 nt, Human
gagccauauaaguuugaaggaaa

SEQ ID NO: 2874370 - RNA, 18 nt, Human
gagcacacuuggcccaag

SEQ ID NO: 2874371 - RNA, 20 nt, Human
gagcacacuuuaguggccga

SEQ ID NO: 2874372 - RNA, 13 nt, Human
gagcacagguccc

SEQ ID NO: 2874373 - RNA, 14 nt, Human
gagcacagguccca

SEQ ID NO: 2874374 - RNA, 16 nt, Human
gagcacaggucccacc

SEQ ID NO: 2874375 - RNA, 18 nt, Human
gagcacaggucccaccuc

SEQ ID NO: 2874376 - RNA, 22 nt, Human
gagcacaggucccaccuccagc

SEQ ID NO: 2874377 - RNA, 23 nt, Human
gagcacaggucccaccuccagcc

SEQ ID NO: 2874378 - RNA, 16 nt, Human
gagcacccauuccaaa

SEQ ID NO: 2874379 - RNA, 19 nt, Human
gagcacccauuccaaagcu

SEQ ID NO: 2874380 - RNA, 13 nt, Human
gagcaaagcugau

SEQ ID NO: 2874381 - RNA, 22 nt, Human
gagcaaagaucaaaauaaaaag

SEQ ID NO: 2874382 - RNA, 14 nt, Human
gagcaaagaucaaa

SEQ ID NO: 2874383 - RNA, 18 nt, Human
gagcaaagaucaaaauaa

SEQ ID NO: 2874384 - RNA, 13 nt, Human
gagcaaagaucaa

SEQ ID NO: 2874385 - RNA, 22 nt, Human
gagaucuccuugcccuagauga

SEQ ID NO: 2874386 - RNA, 16 nt, Human
gagauuuuuuauugcu

SEQ ID NO: 2874387 - RNA, 17 nt, Human
gagauuuuuuauugcua

SEQ ID NO: 2874388 - RNA, 20 nt, Human
gagcaaaaauaucccuuccg

SEQ ID NO: 2874389 - RNA, 21 nt, Human
gagaugaaaucuuacagcugg

SEQ ID NO: 2874390 - RNA, 12 nt, Human
gagcaaaauaau

SEQ ID NO: 2874391 - RNA, 20 nt, Human
gagaucaaccccuucgcucc

SEQ ID NO: 2874392 - RNA, 16 nt, Human
gagauauugugaggac

SEQ ID NO: 2874393 - RNA, 20 nt, Human
gaaugcuguacaucuauuuu

SEQ ID NO: 2874394 - RNA, 17 nt, Human
gaaugcuguacaucuau

SEQ ID NO: 2874395 - RNA, 15 nt, Human
gaaugcuguacaucu

SEQ ID NO: 2874396 - RNA, 14 nt, Human
gaaugcuguacauc

SEQ ID NO: 2874397 - RNA, 13 nt, Human
gaaugcuguacau

SEQ ID NO: 2874398 - RNA, 21 nt, Human
gaaugcugcaggacuugagaa

SEQ ID NO: 2874399 - RNA, 10 nt, Human
gaaugcugcc

SEQ ID NO: 2874400 - RNA, 11 nt, Human
gaaugcugcca

SEQ ID NO: 2874401 - RNA, 12 nt, Human
gaaugcugccag

SEQ ID NO: 2874402 - RNA, 13 nt, Human
gaaugcugccagu

SEQ ID NO: 2874403 - RNA, 15 nt, Human
gaaugcugccagugu

SEQ ID NO: 2874404 - RNA, 23 nt, Human
gaaucugucucccaguuaugaau

SEQ ID NO: 2874405 - RNA, 12 nt, Human
gagaucagaaaa

SEQ ID NO: 2874406 - RNA, 23 nt, Human
gagaucuaaggaugucacagggc

SEQ ID NO: 2874407 - RNA, 20 nt, Human
gagaucgcgccacugcacuc

SEQ ID NO: 2874408 - RNA, 15 nt, Human
gagaucgugccacug

SEQ ID NO: 2874409 - RNA, 17 nt, Human
gagaucgugccacugca

SEQ ID NO: 2874410 - RNA, 20 nt, Human
gagaucgugccacugcacuc

SEQ ID NO: 2874411 - RNA, 18 nt, Human
gagaucgugccauugcac

SEQ ID NO: 2874412 - RNA, 21 nt, Human
gagaucgugccauugcacucc

SEQ ID NO: 2874413 - RNA, 12 nt, Human
gaggcagaguuu

SEQ ID NO: 2874414 - RNA, 13 nt, Human
gaggcagccccau

SEQ ID NO: 2874415 - RNA, 17 nt, Human
gaggcagccacuucggc

SEQ ID NO: 2874416 - RNA, 12 nt, Human
gaggcagccagg

SEQ ID NO: 2874417 - RNA, 23 nt, Human
gaggcaaugucaggaacagaagg

SEQ ID NO: 2874418 - RNA, 21 nt, Human
gaggcaaugucaggaacagaa

SEQ ID NO: 2874419 - RNA, 22 nt, Human
gaggauugcuugagcccaggag

SEQ ID NO: 2874420 - RNA, 19 nt, Human
gaggauugcuugagcccag

SEQ ID NO: 2874421 - RNA, 18 nt, Human
gaggauugcuugagccca

SEQ ID NO: 2874422 - RNA, 14 nt, Human
gaggauuauugaua

SEQ ID NO: 2874423 - RNA, 13 nt, Human
gaggcacaagaau

SEQ ID NO: 2874424 - RNA, 11 nt, Human
gaggcacagca

SEQ ID NO: 2874425 - RNA, 14 nt, Human
gaggcacagcaaac

SEQ ID NO: 2874426 - RNA, 18 nt, Human
gaggcacugaagugcuua

SEQ ID NO: 2874427 - RNA, 16 nt, Human
gaggcagaaaauugca

SEQ ID NO: 2874428 - RNA, 20 nt, Human
gaggcagaaaauugcacaau

SEQ ID NO: 2874429 - RNA, 22 nt, Human
gaggcagccccauucugccugc

SEQ ID NO: 2874430 - RNA, 21 nt, Human
gaggcagccccauucugccug

SEQ ID NO: 2874431 - RNA, 23 nt, Human
gaggcagccccauucugccugcc

SEQ ID NO: 2874432 - RNA, 22 nt, Human
gaggccaggaguuugagaccag

SEQ ID NO: 2874433 - RNA, 12 nt, Human
gaggccaggagu

SEQ ID NO: 2874434 - RNA, 22 nt, Human
gaggcaggccgacuguacuaaa

SEQ ID NO: 2874435 - RNA, 23 nt, Human
gaggcaggaggauugcuugagcc

SEQ ID NO: 2874436 - RNA, 20 nt, Human
gaggcagagguugcagugag

SEQ ID NO: 2874437 - RNA, 15 nt, Human
gaggaguacagguga

SEQ ID NO: 2874438 - RNA, 20 nt, Human
gaggaguaaccgcuccaggu

SEQ ID NO: 2874439 - RNA, 15 nt, Human
gaggaggugccugga

SEQ ID NO: 2874440 - RNA, 18 nt, Human
gaggagguggcagcccug

SEQ ID NO: 2874441 - RNA, 15 nt, Human
gaggagguggcagcc

SEQ ID NO: 2874442 - RNA, 19 nt, Human
gaggaggggccccccugcc

SEQ ID NO: 2874443 - RNA, 22 nt, Human
gaggaggggccccccugcccug

SEQ ID NO: 2874444 - RNA, 21 nt, Human
gaggaggggccccccugcccu

SEQ ID NO: 2874445 - RNA, 22 nt, Human
gaggagguggcagcccuguagg

SEQ ID NO: 2874446 - RNA, 20 nt, Human
gaggagguggcagcccugua

SEQ ID NO: 2874447 - RNA, 15 nt, Human
gaggaggugugagga

SEQ ID NO: 2874448 - RNA, 21 nt, Human
gaggaggugugaggaggaggc

SEQ ID NO: 2874449 - RNA, 12 nt, Human
gaggauguucug

SEQ ID NO: 2874450 - RNA, 13 nt, Human
gaggaugucccug

SEQ ID NO: 2874451 - RNA, 18 nt, Human
gaggaugucccugggcca

SEQ ID NO: 2874452 - RNA, 19 nt, Human
gaggaugucccugggccag

SEQ ID NO: 2874453 - RNA, 20 nt, Human
gaggaugucccugggccagg

SEQ ID NO: 2874454 - RNA, 18 nt, Human
gaggaugucucaaacuuc

SEQ ID NO: 2874455 - RNA, 16 nt, Human
gaggaucacuggagcc

SEQ ID NO: 2874456 - RNA, 17 nt, Human
gaggaucacuggagccc

SEQ ID NO: 2874457 - RNA, 20 nt, Human
gaggauguucugggacacag

SEQ ID NO: 2874458 - RNA, 17 nt, Human
gaggauguucugggaca

SEQ ID NO: 2874459 - RNA, 15 nt, Human
gaggauugcuaucug

SEQ ID NO: 2874460 - RNA, 15 nt, Human
gaggacaaccauucc

SEQ ID NO: 2874461 - RNA, 22 nt, Human
gaggaauuuucuuuguguagcu

SEQ ID NO: 2874462 - RNA, 13 nt, Human
gaggacaaaacuu

SEQ ID NO: 2874463 - RNA, 14 nt, Human
gaggacaaaacuuc

SEQ ID NO: 2874464 - RNA, 15 nt, Human
gaggacaaaacuucu

SEQ ID NO: 2874465 - RNA, 17 nt, Human
gaggacaaaacuucuug

SEQ ID NO: 2874466 - RNA, 22 nt, Human
gaggacaaaacuucuugucaga

SEQ ID NO: 2874467 - RNA, 23 nt, Human
gaggacaaaacuucuugucagac

SEQ ID NO: 2874468 - RNA, 22 nt, Human
gaggaauuuauaccucaaacua

SEQ ID NO: 2874469 - RNA, 14 nt, Human
gaggaauggacaga

SEQ ID NO: 2874470 - RNA, 15 nt, Human
gaggaauccagaccc

SEQ ID NO: 2874471 - RNA, 19 nt, Human
gaggaauccuggcagccca

SEQ ID NO: 2874472 - RNA, 17 nt, Human
gaggaauccuggcagcc

SEQ ID NO: 2874473 - RNA, 16 nt, Human
gaggaauccuggcagc

SEQ ID NO: 2874474 - RNA, 15 nt, Human
gaggaauccuggcag

SEQ ID NO: 2874475 - RNA, 20 nt, Human
gaggaauccuggcagcccag

SEQ ID NO: 2874476 - RNA, 22 nt, Human
gagcuucuuccaggugcccagc

SEQ ID NO: 2874477 - RNA, 18 nt, Human
gagcuucuggggucccca

SEQ ID NO: 2874478 - RNA, 19 nt, Human
gagcuucugggguccccag

SEQ ID NO: 2874479 - RNA, 20 nt, Human
gagcuucugggguccccagg

SEQ ID NO: 2874480 - RNA, 21 nt, Human
gagcuucugggguccccaggg

SEQ ID NO: 2874481 - RNA, 23 nt, Human
gagcuucugggguccccagggcu

SEQ ID NO: 2874482 - RNA, 21 nt, Human
gagcuucuguugcugccucau

SEQ ID NO: 2874483 - RNA, 11 nt, Human
gagcuucuggg

SEQ ID NO: 2874484 - RNA, 19 nt, Human
gaggaaggaacagcaaugg

SEQ ID NO: 2874485 - RNA, 14 nt, Human
gaggaauccagacc

SEQ ID NO: 2874486 - RNA, 21 nt, Human
gaggaauaauuauuuauuuaa

SEQ ID NO: 2874487 - RNA, 20 nt, Human
gaggaaucaugucaggccug

SEQ ID NO: 2874488 - RNA, 21 nt, Human
gaggaaucaugucaggccugu

SEQ ID NO: 2874489 - RNA, 22 nt, Human
gaggaaucaugucaggccugug

SEQ ID NO: 2874490 - RNA, 16 nt, Human
gaggaaggauuguaaa

SEQ ID NO: 2874491 - RNA, 14 nt, Human
gaggaaggauugua

SEQ ID NO: 2874492 - RNA, 15 nt, Human
gaggaaggauuguaa

SEQ ID NO: 2874493 - RNA, 18 nt, Human
gaggaauaauuauuuauu

SEQ ID NO: 2874494 - RNA, 16 nt, Human
gaggaaguacaaacua

SEQ ID NO: 2874495 - RNA, 17 nt, Human
gaggaauaauuauuuau

SEQ ID NO: 2874496 - RNA, 22 nt, Human
gaggaauaagaauggagcagua

SEQ ID NO: 2874497 - RNA, 15 nt, Human
gaggagcagugcagg

SEQ ID NO: 2874498 - RNA, 14 nt, Human
gaggagccagacag

SEQ ID NO: 2874499 - RNA, 16 nt, Human
gaggagccagacagac

SEQ ID NO: 2874500 - RNA, 13 nt, Human
gaggagccaggca

SEQ ID NO: 2874501 - RNA, 17 nt, Human
gaggagcagugcaggca

SEQ ID NO: 2874502 - RNA, 14 nt, Human
gaggagcauguuuu

SEQ ID NO: 2874503 - RNA, 21 nt, Human
gaggagcauguuuuguauaca

SEQ ID NO: 2874504 - RNA, 14 nt, Human
gaggacaggcggga

SEQ ID NO: 2874505 - RNA, 20 nt, Human
gaggacaggcgggaggaggu

SEQ ID NO: 2874506 - RNA, 14 nt, Human
gaggagccccagcu

SEQ ID NO: 2874507 - RNA, 21 nt, Human
gaggagcccauacucagccug

SEQ ID NO: 2874508 - RNA, 15 nt, Human
gaggagccccagcua

SEQ ID NO: 2874509 - RNA, 13 nt, Human
gaggagccccauc

SEQ ID NO: 2874510 - RNA, 17 nt, Human
gaggagccccaucuguc

SEQ ID NO: 2874511 - RNA, 18 nt, Human
gaggagccccaucugucu

SEQ ID NO: 2874512 - RNA, 23 nt, Human
gaggacagggaggugaccccagg

SEQ ID NO: 2874513 - RNA, 22 nt, Human
gaggacagggaggugaccccag

SEQ ID NO: 2874514 - RNA, 13 nt, Human
gaggacagggagg

SEQ ID NO: 2874515 - RNA, 13 nt, Human
gaggaggccucca

SEQ ID NO: 2874516 - RNA, 19 nt, Human
gaggagggaugcugccuga

SEQ ID NO: 2874517 - RNA, 13 nt, Human
gaggagcuucugg

SEQ ID NO: 2874518 - RNA, 14 nt, Human
gaggagcuucuggg

SEQ ID NO: 2874519 - RNA, 19 nt, Human
gaggaggaugucccugggc

SEQ ID NO: 2874520 - RNA, 21 nt, Human
gaggaggaugucccugggcca

SEQ ID NO: 2874521 - RNA, 22 nt, Human
gaggaggaugucccugggccag

SEQ ID NO: 2874522 - RNA, 23 nt, Human
gaggaggaugucccugggccagg

SEQ ID NO: 2874523 - RNA, 11 nt, Human
gaggagccuuu

SEQ ID NO: 2874524 - RNA, 13 nt, Human
gaggagccuuuuu

SEQ ID NO: 2874525 - RNA, 15 nt, Human
gaggagcugcuggcu

SEQ ID NO: 2874526 - RNA, 13 nt, Human
gaggagcugcugg

SEQ ID NO: 2874527 - RNA, 12 nt, Human
gaggagcugcug

SEQ ID NO: 2874528 - RNA, 11 nt, Human
gaggagcugcu

SEQ ID NO: 2874529 - RNA, 14 nt, Human
gaggccgaggcagg

SEQ ID NO: 2874530 - RNA, 12 nt, Human
gaggccugcccg

SEQ ID NO: 2874531 - RNA, 13 nt, Human
gaggccugcccgg

SEQ ID NO: 2874532 - RNA, 16 nt, Human
gaggccugcccgggcg

SEQ ID NO: 2874533 - RNA, 13 nt, Human
gaggccugagacc

SEQ ID NO: 2874534 - RNA, 14 nt, Human
gaggccugagaccc

SEQ ID NO: 2874535 - RNA, 17 nt, Human
gaggccugagacccagg

SEQ ID NO: 2874536 - RNA, 18 nt, Human
gaggccugagacccagga

SEQ ID NO: 2874537 - RNA, 13 nt, Human
gaggccccuggac

SEQ ID NO: 2874538 - RNA, 19 nt, Human
gaggccccuucuagguggc

SEQ ID NO: 2874539 - RNA, 20 nt, Human
gaggccccuucuagguggca

SEQ ID NO: 2874540 - RNA, 17 nt, Human
gaggccccuucucuccc

SEQ ID NO: 2874541 - RNA, 23 nt, Human
gaggccccuucucucccugccag

SEQ ID NO: 2874542 - RNA, 13 nt, Human
gaggcccggccuc

SEQ ID NO: 2874543 - RNA, 14 nt, Human
gaggcccuccugug

SEQ ID NO: 2874544 - RNA, 16 nt, Human
gaggcccuccugugcu

SEQ ID NO: 2874545 - RNA, 17 nt, Human
gaggcccuccugugcug

SEQ ID NO: 2874546 - RNA, 19 nt, Human
gaggcccuccugugcuggg

SEQ ID NO: 2874547 - RNA, 21 nt, Human
gaggcccuccugugcuggggg

SEQ ID NO: 2874548 - RNA, 18 nt, Human
gaggcccugcccaaugag

SEQ ID NO: 2874549 - RNA, 11 nt, Human
gaggcccugca

SEQ ID NO: 2874550 - RNA, 12 nt, Human
gaggcccugcau

SEQ ID NO: 2874551 - RNA, 13 nt, Human
gaggcccugcaug

SEQ ID NO: 2874552 - RNA, 14 nt, Human
gaggcccugcaugg

SEQ ID NO: 2874553 - RNA, 19 nt, Human
gaggcccugcaugggccag

SEQ ID NO: 2874554 - RNA, 14 nt, Human
gaggccuucucuga

SEQ ID NO: 2874555 - RNA, 20 nt, Human
gaggcggagcuugcagugag

SEQ ID NO: 2874556 - RNA, 21 nt, Human
gaggccuuaugaggguccucu

SEQ ID NO: 2874557 - RNA, 19 nt, Human
gaggcggguggaucaccug

SEQ ID NO: 2874558 - RNA, 12 nt, Human
gaggcgggugga

SEQ ID NO: 2874559 - RNA, 12 nt, Human
gaggccugucug

SEQ ID NO: 2874560 - RNA, 15 nt, Human
gaggccugucuguga

SEQ ID NO: 2874561 - RNA, 19 nt, Human
gaggccugucugugaccug

SEQ ID NO: 2874562 - RNA, 11 nt, Human
gaggccuucca

SEQ ID NO: 2874563 - RNA, 14 nt, Human
gaggccuuccagcu

SEQ ID NO: 2874564 - RNA, 15 nt, Human
gaggccuuccagcug

SEQ ID NO: 2874565 - RNA, 16 nt, Human
gaggccuuccagcugc

SEQ ID NO: 2874566 - RNA, 17 nt, Human
gaggccuuccagcugcu

SEQ ID NO: 2874567 - RNA, 18 nt, Human
gaggccuuccagcugcug

SEQ ID NO: 2874568 - RNA, 19 nt, Human
gaggccuuccagcugcugu

SEQ ID NO: 2874569 - RNA, 20 nt, Human
gaggccuuccagcugcuguc

SEQ ID NO: 2874570 - RNA, 21 nt, Human
gaggcugugugccugggggag

SEQ ID NO: 2874571 - RNA, 22 nt, Human
gaggcugugugccugggggagu

SEQ ID NO: 2874572 - RNA, 22 nt, Human
gaggcuuagcuuugcucugcca

SEQ ID NO: 2874573 - RNA, 21 nt, Human
gagggacuuugcugauuuccc

SEQ ID NO: 2874574 - RNA, 22 nt, Human
gagggacgucagacuuggcuca

SEQ ID NO: 2874575 - RNA, 14 nt, Human
gagggacucugaag

SEQ ID NO: 2874576 - RNA, 22 nt, Human
gagggacucugaagccucuggg

SEQ ID NO: 2874577 - RNA, 23 nt, Human
gagggacucugaagccucuggga

SEQ ID NO: 2874578 - RNA, 15 nt, Human
gagggacugccucug

SEQ ID NO: 2874579 - RNA, 16 nt, Human
gagggacugccucugc

SEQ ID NO: 2874580 - RNA, 18 nt, Human
gagggacugccucugcca

SEQ ID NO: 2874581 - RNA, 18 nt, Human
gagggacucugaagccuc

SEQ ID NO: 2874582 - RNA, 19 nt, Human
gagggacucugaagccucu

SEQ ID NO: 2874583 - RNA, 20 nt, Human
gagggacucugaagccucug

SEQ ID NO: 2874584 - RNA, 21 nt, Human
gagggacucugaagccucugg

SEQ ID NO: 2874585 - RNA, 18 nt, Human
gagggaccucucccaggg

SEQ ID NO: 2874586 - RNA, 17 nt, Human
gagggaccucucccagg

SEQ ID NO: 2874587 - RNA, 15 nt, Human
gagggaccucuccca

SEQ ID NO: 2874588 - RNA, 14 nt, Human
gagggaccucuccc

SEQ ID NO: 2874589 - RNA, 13 nt, Human
gagggaccucucc

SEQ ID NO: 2874590 - RNA, 15 nt, Human
gagggaccauguguc

SEQ ID NO: 2874591 - RNA, 16 nt, Human
gagggaccauguguca

SEQ ID NO: 2874592 - RNA, 21 nt, Human
gagggaccaugugucacuugu

SEQ ID NO: 2874593 - RNA, 23 nt, Human
gaggcuuuaugauaauagauucu

SEQ ID NO: 2874594 - RNA, 16 nt, Human
gaggcuuuggauuuga

SEQ ID NO: 2874595 - RNA, 14 nt, Human
gaggcuuuggauuu

SEQ ID NO: 2874596 - RNA, 15 nt, Human
gagggaaagugcaua

SEQ ID NO: 2874597 - RNA, 20 nt, Human
gaggcuuuggauuugacauu

SEQ ID NO: 2874598 - RNA, 11 nt, Human
gaggcuuugug

SEQ ID NO: 2874599 - RNA, 14 nt, Human
gaggcuuuguguug

SEQ ID NO: 2874600 - RNA, 16 nt, Human
gaggcuuuguguugua

SEQ ID NO: 2874601 - RNA, 10 nt, Human
gagggaaaag

SEQ ID NO: 2874602 - RNA, 15 nt, Human
gagggaaaagggaag

SEQ ID NO: 2874603 - RNA, 16 nt, Human
gagggaaaagggaagu

SEQ ID NO: 2874604 - RNA, 15 nt, Human
gaggcuuggaaagca

SEQ ID NO: 2874605 - RNA, 21 nt, Human
gagggaauccccgaaggugcu

SEQ ID NO: 2874606 - RNA, 17 nt, Human
gagggaaggauuuagga

SEQ ID NO: 2874607 - RNA, 14 nt, Human
gagggaagggacgg

SEQ ID NO: 2874608 - RNA, 19 nt, Human
gagggaccaacugggccca

SEQ ID NO: 2874609 - RNA, 18 nt, Human
gagggaccaacugggccc

SEQ ID NO: 2874610 - RNA, 17 nt, Human
gagggaccaacugggcc

SEQ ID NO: 2874611 - RNA, 14 nt, Human
gagggagugacaga

SEQ ID NO: 2874612 - RNA, 13 nt, Human
gagggagugacag

SEQ ID NO: 2874613 - RNA, 12 nt, Human
gagggcacuggu

SEQ ID NO: 2874614 - RNA, 20 nt, Human
gagggcacauuccuugccug

SEQ ID NO: 2874615 - RNA, 13 nt, Human
gaggggccuggca

SEQ ID NO: 2874616 - RNA, 14 nt, Human
gaggggccuggcag

SEQ ID NO: 2874617 - RNA, 18 nt, Human
gaggggccuggcagccgu

SEQ ID NO: 2874618 - RNA, 20 nt, Human
gaggggccuggcagccgugc

SEQ ID NO: 2874619 - RNA, 23 nt, Human
gagggcagaaagguucugcccgg

SEQ ID NO: 2874620 - RNA, 21 nt, Human
gagggcagaaagguucugccc

SEQ ID NO: 2874621 - RNA, 22 nt, Human
gagggcagaaagguucugcccg

SEQ ID NO: 2874622 - RNA, 23 nt, Human
gagggcacauuccuugccugcac

SEQ ID NO: 2874623 - RNA, 17 nt, Human
gagggcagaaagguucu

SEQ ID NO: 2874624 - RNA, 20 nt, Human
gagggcagaaagguucugcc

SEQ ID NO: 2874625 - RNA, 16 nt, Human
gagggcacugguggcc

SEQ ID NO: 2874626 - RNA, 18 nt, Human
gagggcacugguggcccg

SEQ ID NO: 2874627 - RNA, 16 nt, Human
gaucuuugcagacagg

SEQ ID NO: 2874628 - RNA, 13 nt, Human
gauagaguuccau

SEQ ID NO: 2874629 - RNA, 14 nt, Human
gaugaaaacauagc

SEQ ID NO: 2874630 - RNA, 21 nt, Human
gaugaaaaccuacauauucca

SEQ ID NO: 2874631 - RNA, 13 nt, Human
gaugaaaagauuu

SEQ ID NO: 2874632 - RNA, 13 nt, Human
gaucuuagauucu

SEQ ID NO: 2874633 - RNA, 14 nt, Human
gaucuuagauucuc

SEQ ID NO: 2874634 - RNA, 19 nt, Human
gaucuuagggugaaccacu

SEQ ID NO: 2874635 - RNA, 14 nt, Human
gaucuuauuuuucu

SEQ ID NO: 2874636 - RNA, 16 nt, Human
gaucuuauuuuucuaa

SEQ ID NO: 2874637 - RNA, 19 nt, Human
gaucuuauuuuucuaaacg

SEQ ID NO: 2874638 - RNA, 21 nt, Human
gaucuuauuuuucuaaacgua

SEQ ID NO: 2874639 - RNA, 19 nt, Human
gaucuucaaaaguaaugcc

SEQ ID NO: 2874640 - RNA, 24 nt, Human
gaucuucaaaaguaaugccucugu

SEQ ID NO: 2874641 - RNA, 19 nt, Human
gaucuuaagaggcugacag

SEQ ID NO: 2874642 - RNA, 20 nt, Human
gaucuguuuugaaggcaaaa

SEQ ID NO: 2874643 - RNA, 19 nt, Human
gaucuguuuugaaggcaaa

SEQ ID NO: 2874644 - RNA, 18 nt, Human
gauccucccaccucagcc

SEQ ID NO: 2874645 - RNA, 22 nt, Human
gauccuuagagguccucuggag

SEQ ID NO: 2874646 - RNA, 21 nt, Human
gauccuuagagguccucugga

SEQ ID NO: 2874647 - RNA, 17 nt, Human
gaucgaaccguuuugaa

SEQ ID NO: 2874648 - RNA, 20 nt, Human
gaucgcaagagccauguaga

SEQ ID NO: 2874649 - RNA, 17 nt, Human
gauccuuuuggagucag

SEQ ID NO: 2874650 - RNA, 15 nt, Human
gauccuuuuggaguc

SEQ ID NO: 2874651 - RNA, 21 nt, Human
gauccucccaccucagccucc

SEQ ID NO: 2874652 - RNA, 20 nt, Human
gauccucccaccucagccuc

SEQ ID NO: 2874653 - RNA, 19 nt, Human
gauccucccaccucagccu

SEQ ID NO: 2874654 - RNA, 18 nt, Human
gaucacgauguaaauuau

SEQ ID NO: 2874655 - RNA, 15 nt, Human
gaucacgccacugca

SEQ ID NO: 2874656 - RNA, 14 nt, Human
gaucacgccacugc

SEQ ID NO: 2874657 - RNA, 13 nt, Human
gaucacgccacug

SEQ ID NO: 2874658 - RNA, 23 nt, Human
gaucaaccccuucgcuccugugu

SEQ ID NO: 2874659 - RNA, 20 nt, Human
gaucaagcaugaaaggcuuu

SEQ ID NO: 2874660 - RNA, 14 nt, Human
gaucaccugagguu

SEQ ID NO: 2874661 - RNA, 17 nt, Human
gaucacgacgcugcaga

SEQ ID NO: 2874662 - RNA, 13 nt, Human
gauggcaggaugg

SEQ ID NO: 2874663 - RNA, 21 nt, Human
gauggcacuuagcuaucagaa

SEQ ID NO: 2874664 - RNA, 22 nt, Human
gaugggcaacccccagccugcu

SEQ ID NO: 2874665 - RNA, 20 nt, Human
gaugggagcuccucuccugg

SEQ ID NO: 2874666 - RNA, 21 nt, Human
gaugggagcuccucuccugga

SEQ ID NO: 2874667 - RNA, 21 nt, Human
gaugggaacgcagaugaucca

SEQ ID NO: 2874668 - RNA, 18 nt, Human
gauggcaggauggccugg

SEQ ID NO: 2874669 - RNA, 15 nt, Human
gauggcaggauggcc

SEQ ID NO: 2874670 - RNA, 17 nt, Human
gauggcaggauggccug

SEQ ID NO: 2874671 - RNA, 21 nt, Human
gaugccccgucccccucuggc

SEQ ID NO: 2874672 - RNA, 21 nt, Human
gaugcauucuugguuggcugg

SEQ ID NO: 2874673 - RNA, 15 nt, Human
gaugccugauugcca

SEQ ID NO: 2874674 - RNA, 22 nt, Human
gaugccugauugccaagcucag

SEQ ID NO: 2874675 - RNA, 21 nt, Human
gaugcuagcgcguugccuguc

SEQ ID NO: 2874676 - RNA, 16 nt, Human
gaugcuccaagauucu

SEQ ID NO: 2874677 - RNA, 19 nt, Human
gaugcucaguugcuaaaca

SEQ ID NO: 2874678 - RNA, 22 nt, Human
gaugcucaguugcuaaacacug

SEQ ID NO: 2874679 - RNA, 17 nt, Human
gaugcuccaagauucua

SEQ ID NO: 2874680 - RNA, 19 nt, Human
gaugcuccaagauucuaga

SEQ ID NO: 2874681 - RNA, 20 nt, Human
gaugcuccaagauucuagau

SEQ ID NO: 2874682 - RNA, 22 nt, Human
gaugcuccaagauucuagauga

SEQ ID NO: 2874683 - RNA, 21 nt, Human
gaugcucccuccccugcccug

SEQ ID NO: 2874684 - RNA, 20 nt, Human
gaugcucccuccccugcccu

SEQ ID NO: 2874685 - RNA, 15 nt, Human
gaugcucccuccccu

SEQ ID NO: 2874686 - RNA, 13 nt, Human
gaugcucccuccc

SEQ ID NO: 2874687 - RNA, 22 nt, Human
gaugcaugugguuugguuccuc

SEQ ID NO: 2874688 - RNA, 23 nt, Human
gaugcaugugguuugguuccucu

SEQ ID NO: 2874689 - RNA, 20 nt, Human
gaugcauguugauuaaacuc

SEQ ID NO: 2874690 - RNA, 20 nt, Human
gaugcauguuuuccagcucc

SEQ ID NO: 2874691 - RNA, 21 nt, Human
gaugcauguuuuccagcuccu

SEQ ID NO: 2874692 - RNA, 17 nt, Human
gaugcaaggaccaggac

SEQ ID NO: 2874693 - RNA, 14 nt, Human
gaugcaaggaccag

SEQ ID NO: 2874694 - RNA, 18 nt, Human
gaugcaaaguacaaugug

SEQ ID NO: 2874695 - RNA, 21 nt, Human
gaugcaaaguacaauguguuu

SEQ ID NO: 2874696 - RNA, 23 nt, Human
gaugcaaaguacaauguguuuuu

SEQ ID NO: 2874697 - RNA, 19 nt, Human
gaugcaaauagcaaaacua

SEQ ID NO: 2874698 - RNA, 20 nt, Human
gaugcaacacgcauggucaa

SEQ ID NO: 2874699 - RNA, 21 nt, Human
gaugacucccuuaaaauagaa

SEQ ID NO: 2874700 - RNA, 14 nt, Human
gaugcaaagaaaau

SEQ ID NO: 2874701 - RNA, 13 nt, Human
gaugcacagagaa

SEQ ID NO: 2874702 - RNA, 14 nt, Human
gaugcacagagaag

SEQ ID NO: 2874703 - RNA, 15 nt, Human
gaugcacagagaagc

SEQ ID NO: 2874704 - RNA, 17 nt, Human
gaugcacagagaagcug

SEQ ID NO: 2874705 - RNA, 18 nt, Human
gaugcacagagaagcugg

SEQ ID NO: 2874706 - RNA, 19 nt, Human
gaugcacagagaagcuggg

SEQ ID NO: 2874707 - RNA, 21 nt, Human
gaugcacagagaagcugggga

SEQ ID NO: 2874708 - RNA, 19 nt, Human
gaugcaaggaccaggacuc

SEQ ID NO: 2874709 - RNA, 18 nt, Human
gaugcaaggaccaggacu

SEQ ID NO: 2874710 - RNA, 11 nt, Human
gaugagaaagg

SEQ ID NO: 2874711 - RNA, 14 nt, Human
gaugacugaguccu

SEQ ID NO: 2874712 - RNA, 12 nt, Human
gaugacugaguc

SEQ ID NO: 2874713 - RNA, 14 nt, Human
gaugacuggcauuu

SEQ ID NO: 2874714 - RNA, 17 nt, Human
gaugacuggcauuuuau

SEQ ID NO: 2874715 - RNA, 18 nt, Human
gaugacuggcauuuuaua

SEQ ID NO: 2874716 - RNA, 20 nt, Human
gaugacuggcauuuuauaga

SEQ ID NO: 2874717 - RNA, 19 nt, Human
gaugacuggggugggaggu

SEQ ID NO: 2874718 - RNA, 22 nt, Human
gaugagaaagguugaagcacca

SEQ ID NO: 2874719 - RNA, 17 nt, Human
gaugacugaguccucgu

SEQ ID NO: 2874720 - RNA, 14 nt, Human
gaugauuuuuguca

SEQ ID NO: 2874721 - RNA, 18 nt, Human
gaugacuaaaauauuuau

SEQ ID NO: 2874722 - RNA, 15 nt, Human
gaugacuaaaauauu

SEQ ID NO: 2874723 - RNA, 12 nt, Human
gaugacuaaaau

SEQ ID NO: 2874724 - RNA, 18 nt, Human
gaugacucccuuaaaaua

SEQ ID NO: 2874725 - RNA, 19 nt, Human
gauuguccucauuucucca

SEQ ID NO: 2874726 - RNA, 20 nt, Human
gauuguccuuuaaaaaagaa

SEQ ID NO: 2874727 - RNA, 13 nt, Human
gauuguauugcug

SEQ ID NO: 2874728 - RNA, 15 nt, Human
gauuguauugcuguc

SEQ ID NO: 2874729 - RNA, 22 nt, Human
gauuggauuauuuaauaacauu

SEQ ID NO: 2874730 - RNA, 20 nt, Human
gauuguaggugcaagaugga

SEQ ID NO: 2874731 - RNA, 15 nt, Human
gauuggaccaggcca

SEQ ID NO: 2874732 - RNA, 22 nt, Human
gauuggagauagggaaagaaag

SEQ ID NO: 2874733 - RNA, 23 nt, Human
gauuggacggccugaugcucccu

SEQ ID NO: 2874734 - RNA, 16 nt, Human
gauuggacggccugau

SEQ ID NO: 2874735 - RNA, 13 nt, Human
gauuggauuauuu

SEQ ID NO: 2874736 - RNA, 20 nt, Human
gauuggauuauuuaauaaca

SEQ ID NO: 2874737 - RNA, 21 nt, Human
gauuggauuauuuaauaacau

SEQ ID NO: 2874738 - RNA, 12 nt, Human
gauugaccugcu

SEQ ID NO: 2874739 - RNA, 14 nt, Human
gauugaccugcucc

SEQ ID NO: 2874740 - RNA, 15 nt, Human
gauugaccugcuccg

SEQ ID NO: 2874741 - RNA, 18 nt, Human
gauugaccugcuccgcug

SEQ ID NO: 2874742 - RNA, 23 nt, Human
gauugaccugcuccgcugcuccu

SEQ ID NO: 2874743 - RNA, 16 nt, Human
gauugagaagaggaca

SEQ ID NO: 2874744 - RNA, 14 nt, Human
gauuggaccaggcc

SEQ ID NO: 2874745 - RNA, 18 nt, Human
gauuggaaggagacacag

SEQ ID NO: 2874746 - RNA, 19 nt, Human
gauuggaaggagacacaga

SEQ ID NO: 2874747 - RNA, 20 nt, Human
gauuggaaggagacacagau

SEQ ID NO: 2874748 - RNA, 21 nt, Human
gauuggaaggagacacagaug

SEQ ID NO: 2874749 - RNA, 22 nt, Human
gauuggaaggagacacagaugu

SEQ ID NO: 2874750 - RNA, 15 nt, Human
gauugaaaauucgcc

SEQ ID NO: 2874751 - RNA, 15 nt, Human
gauugaacuccaaga

SEQ ID NO: 2874752 - RNA, 21 nt, Human
gauugaaaacuuuucucagau

SEQ ID NO: 2874753 - RNA, 19 nt, Human
gauugaaaacuuuucucag

SEQ ID NO: 2874754 - RNA, 20 nt, Human
gauugaaaacuuuucucaga

SEQ ID NO: 2874755 - RNA, 18 nt, Human
gauucuagaucagaugcu

SEQ ID NO: 2874756 - RNA, 19 nt, Human
gauucuagaucagaugcuc

SEQ ID NO: 2874757 - RNA, 21 nt, Human
gauucuagaucagaugcucca

SEQ ID NO: 2874758 - RNA, 15 nt, Human
gauucuaaugucuuc

SEQ ID NO: 2874759 - RNA, 18 nt, Human
gauucuauaguucuagac

SEQ ID NO: 2874760 - RNA, 19 nt, Human
gauucuauaguucuagaca

SEQ ID NO: 2874761 - RNA, 23 nt, Human
gauucuagaucagaugcuccaag

SEQ ID NO: 2874762 - RNA, 15 nt, Human
gauucuauaguucua

SEQ ID NO: 2874763 - RNA, 17 nt, Human
gauucuauaguucuaga

SEQ ID NO: 2874764 - RNA, 14 nt, Human
gauucaccugagca

SEQ ID NO: 2874765 - RNA, 22 nt, Human
gauucccaagcucugcuccucu

SEQ ID NO: 2874766 - RNA, 12 nt, Human
gauucagaaauu

SEQ ID NO: 2874767 - RNA, 14 nt, Human
gauucacaucugca

SEQ ID NO: 2874768 - RNA, 12 nt, Human
gauucacacugu

SEQ ID NO: 2874769 - RNA, 19 nt, Human
gauucaaagguucuagguu

SEQ ID NO: 2874770 - RNA, 13 nt, Human
gauucaaagguuc

SEQ ID NO: 2874771 - RNA, 15 nt, Human
gauucaaagguucua

SEQ ID NO: 2874772 - RNA, 18 nt, Human
gauucaaagguucuaggu

SEQ ID NO: 2874773 - RNA, 15 nt, Human
gauuccggauccuaa

SEQ ID NO: 2874774 - RNA, 18 nt, Human
gauuccggauccuaagca

SEQ ID NO: 2874775 - RNA, 22 nt, Human
gauuccggauccuaagcaucua

SEQ ID NO: 2874776 - RNA, 22 nt, Human
gauuccuaagccacuugaaaug

SEQ ID NO: 2874777 - RNA, 23 nt, Human
gauuccucuguauugugcugauu

SEQ ID NO: 2874778 - RNA, 15 nt, Human
gauucuaaugaugau

SEQ ID NO: 2874779 - RNA, 20 nt, Human
gauucuaaagauucuauagu

SEQ ID NO: 2874780 - RNA, 15 nt, Human
gauucuaaaggucca

SEQ ID NO: 2874781 - RNA, 23 nt, Human
gauucuaccacacagcagcaguu

SEQ ID NO: 2874782 - RNA, 19 nt, Human
gauucuaauuuuuaagcaa

SEQ ID NO: 2874783 - RNA, 15 nt, Human
gauuccugagccagu

SEQ ID NO: 2874784 - RNA, 15 nt, Human
gauucuaaagauucu

SEQ ID NO: 2874785 - RNA, 16 nt, Human
gauucuaaagauucua

SEQ ID NO: 2874786 - RNA, 17 nt, Human
gauucuaaagauucuau

SEQ ID NO: 2874787 - RNA, 19 nt, Human
gauucccagagcaaaauaa

SEQ ID NO: 2874788 - RNA, 17 nt, Human
gauucccaggaugagca

SEQ ID NO: 2874789 - RNA, 13 nt, Human
gauucccagagca

SEQ ID NO: 2874790 - RNA, 19 nt, Human
gauuaaauauagauuagaa

SEQ ID NO: 2874791 - RNA, 20 nt, Human
gauuaaauauagauuagaaa

SEQ ID NO: 2874792 - RNA, 23 nt, Human
gauuaaauauagauuagaaaaau

SEQ ID NO: 2874793 - RNA, 14 nt, Human
gauguuuuauuauu

SEQ ID NO: 2874794 - RNA, 13 nt, Human
gauuaacaaauau

SEQ ID NO: 2874795 - RNA, 14 nt, Human
gauuaacaaauaug

SEQ ID NO: 2874796 - RNA, 16 nt, Human
gauuaacaaauaugcu

SEQ ID NO: 2874797 - RNA, 21 nt, Human
gauuaacaaauaugcuaauuu

SEQ ID NO: 2874798 - RNA, 13 nt, Human
gauucaaaauauu

SEQ ID NO: 2874799 - RNA, 14 nt, Human
gauucaaaauauuu

SEQ ID NO: 2874800 - RNA, 15 nt, Human
gauucaaaauauuua

SEQ ID NO: 2874801 - RNA, 16 nt, Human
gauucaaaauauuuaa

SEQ ID NO: 2874802 - RNA, 18 nt, Human
gauucaaaauauuuaaaa

SEQ ID NO: 2874803 - RNA, 22 nt, Human
gauucaaaauauuuaaaaaugu

SEQ ID NO: 2874804 - RNA, 23 nt, Human
gauucaaaauauuuaaaaauguc

SEQ ID NO: 2874805 - RNA, 13 nt, Human
gauuaagagccau

SEQ ID NO: 2874806 - RNA, 12 nt, Human
gauuaagauuuu

SEQ ID NO: 2874807 - RNA, 17 nt, Human
gauuaacuuauuuagag

SEQ ID NO: 2874808 - RNA, 19 nt, Human
gauuaacuuauuuagagau

SEQ ID NO: 2874809 - RNA, 13 nt, Human
gaugugccugggu

SEQ ID NO: 2874810 - RNA, 13 nt, Human
gauggugggaugu

SEQ ID NO: 2874811 - RNA, 17 nt, Human
gauggugggaugugguu

SEQ ID NO: 2874812 - RNA, 13 nt, Human
gauggugggcuuc

SEQ ID NO: 2874813 - RNA, 15 nt, Human
gauggugggcuucag

SEQ ID NO: 2874814 - RNA, 19 nt, Human
gauggugggcuucagggca

SEQ ID NO: 2874815 - RNA, 20 nt, Human
gaugguggguggggcugcag

SEQ ID NO: 2874816 - RNA, 15 nt, Human
gaugugccugggugg

SEQ ID NO: 2874817 - RNA, 19 nt, Human
gaugugcuuguuaacugag

SEQ ID NO: 2874818 - RNA, 14 nt, Human
gaugggcuuucucu

SEQ ID NO: 2874819 - RNA, 14 nt, Human
gaugggccuggcau

SEQ ID NO: 2874820 - RNA, 22 nt, Human
gaugggagcuccucuccuggag

SEQ ID NO: 2874821 - RNA, 15 nt, Human
gaugggcacuugaga

SEQ ID NO: 2874822 - RNA, 20 nt, Human
gaugggcauaugugucagug

SEQ ID NO: 2874823 - RNA, 23 nt, Human
gaugggcauaugugucagugggg

SEQ ID NO: 2874824 - RNA, 16 nt, Human
gauguucugggacaca

SEQ ID NO: 2874825 - RNA, 14 nt, Human
gauguucugggaca

SEQ ID NO: 2874826 - RNA, 12 nt, Human
gauguguuguga

SEQ ID NO: 2874827 - RNA, 14 nt, Human
gauguguugugaua

SEQ ID NO: 2874828 - RNA, 13 nt, Human
gaugugucuguau

SEQ ID NO: 2874829 - RNA, 18 nt, Human
gauguguggacuguggca

SEQ ID NO: 2874830 - RNA, 20 nt, Human
gaugugcuuguuaacugagu

SEQ ID NO: 2874831 - RNA, 13 nt, Human
gauguguccucag

SEQ ID NO: 2874832 - RNA, 18 nt, Human
gauguguccucagggagc

SEQ ID NO: 2874833 - RNA, 14 nt, Human
gaguuuucuuccuu

SEQ ID NO: 2874834 - RNA, 22 nt, Human
gaguuuuccucuauacaucucu

SEQ ID NO: 2874835 - RNA, 23 nt, Human
gaguuuuccucuauacaucucuc

SEQ ID NO: 2874836 - RNA, 21 nt, Human
gaguuuucucuuuguggggcu

SEQ ID NO: 2874837 - RNA, 21 nt, Human
gaguuccuugaucuguauaua

SEQ ID NO: 2874838 - RNA, 15 nt, Human
gaguucuugugccau

SEQ ID NO: 2874839 - RNA, 16 nt, Human
gaguuccacagauugu

SEQ ID NO: 2874840 - RNA, 19 nt, Human
gaguuccaguuccucuuug

SEQ ID NO: 2874841 - RNA, 18 nt, Human
gaguuccccaugcagaca

SEQ ID NO: 2874842 - RNA, 13 nt, Human
gagugugcaugga

SEQ ID NO: 2874843 - RNA, 15 nt, Human
gagugugcauggagg

SEQ ID NO: 2874844 - RNA, 20 nt, Human
gagugugcauggaggcccuc

SEQ ID NO: 2874845 - RNA, 11 nt, Human
gagugugaagg

SEQ ID NO: 2874846 - RNA, 11 nt, Human
gagugugacag

SEQ ID NO: 2874847 - RNA, 12 nt, Human
gagugugacagg

SEQ ID NO: 2874848 - RNA, 14 nt, Human
gagugugacagggc

SEQ ID NO: 2874849 - RNA, 15 nt, Human
gagugugacagggcc

SEQ ID NO: 2874850 - RNA, 16 nt, Human
gagugugacagggcca

SEQ ID NO: 2874851 - RNA, 17 nt, Human
gagugugacagggccag

SEQ ID NO: 2874852 - RNA, 22 nt, Human
gaguuaucuaagaauacagcuu

SEQ ID NO: 2874853 - RNA, 17 nt, Human
gaguuaugauguaaucu

SEQ ID NO: 2874854 - RNA, 22 nt, Human
gaguuaugauguaaucucucug

SEQ ID NO: 2874855 - RNA, 18 nt, Human
gaguuaguuucuuuggga

SEQ ID NO: 2874856 - RNA, 16 nt, Human
gaguggcucgccaggc

SEQ ID NO: 2874857 - RNA, 17 nt, Human
gaguuaggaaugagaag

SEQ ID NO: 2874858 - RNA, 13 nt, Human
gaguuagccaucc

SEQ ID NO: 2874859 - RNA, 12 nt, Human
gagucugaugau

SEQ ID NO: 2874860 - RNA, 14 nt, Human
gagucuggaguggg

SEQ ID NO: 2874861 - RNA, 17 nt, Human
gagucuggagugggcag

SEQ ID NO: 2874862 - RNA, 12 nt, Human
gaguggccuggc

SEQ ID NO: 2874863 - RNA, 10 nt, Human
gaguggccug

SEQ ID NO: 2874864 - RNA, 19 nt, Human
gagugggagaaggcaguga

SEQ ID NO: 2874865 - RNA, 13 nt, Human
gagugggcagagc

SEQ ID NO: 2874866 - RNA, 23 nt, Human
gagugggcagagcccccaggaag

SEQ ID NO: 2874867 - RNA, 15 nt, Human
gaguggcuccucccg

SEQ ID NO: 2874868 - RNA, 18 nt, Human
gaguggccuggccaggag

SEQ ID NO: 2874869 - RNA, 15 nt, Human
gaguggccuggccag

SEQ ID NO: 2874870 - RNA, 14 nt, Human
gaguggccuggcca

SEQ ID NO: 2874871 - RNA, 13 nt, Human
gaguggccuggcc

SEQ ID NO: 2874872 - RNA, 20 nt, Human
gaguggccuggccaggagcu

SEQ ID NO: 2874873 - RNA, 19 nt, Human
gaguggccuggccaggagc

SEQ ID NO: 2874874 - RNA, 13 nt, Human
gaguggcuccucc

SEQ ID NO: 2874875 - RNA, 13 nt, Human
gauagcauugcuu

SEQ ID NO: 2874876 - RNA, 17 nt, Human
gauagcauuuuugauuu

SEQ ID NO: 2874877 - RNA, 22 nt, Human
gauagcauuuuugauuuaugca

SEQ ID NO: 2874878 - RNA, 22 nt, Human
gaucaaccccuucgcuccugug

SEQ ID NO: 2874879 - RNA, 21 nt, Human
gaucaaccccuucgcuccugu

SEQ ID NO: 2874880 - RNA, 22 nt, Human
gauauauguauuaauaaauaga

SEQ ID NO: 2874881 - RNA, 16 nt, Human
gauauagaacagugcu

SEQ ID NO: 2874882 - RNA, 14 nt, Human
gauauacagaugaa

SEQ ID NO: 2874883 - RNA, 16 nt, Human
gauauacagaugaaaa

SEQ ID NO: 2874884 - RNA, 17 nt, Human
gauauacagaugaaaau

SEQ ID NO: 2874885 - RNA, 19 nt, Human
gauauacagaugaaaauuu

SEQ ID NO: 2874886 - RNA, 21 nt, Human
gauauacagaugaaaauuuga

SEQ ID NO: 2874887 - RNA, 14 nt, Human
gauauacaugaaaa

SEQ ID NO: 2874888 - RNA, 17 nt, Human
gauauacaugaaaauuu

SEQ ID NO: 2874889 - RNA, 23 nt, Human
gauagcauuuuugauuuaugcau

SEQ ID NO: 2874890 - RNA, 17 nt, Human
gauauacucuagaugaa

SEQ ID NO: 2874891 - RNA, 15 nt, Human
gauauacugugugcu

SEQ ID NO: 2874892 - RNA, 12 nt, Human
gauauagaacag

SEQ ID NO: 2874893 - RNA, 20 nt, Human
gauauagacaguccuuaaaa

SEQ ID NO: 2874894 - RNA, 14 nt, Human
gauauacuuugugg

SEQ ID NO: 2874895 - RNA, 16 nt, Human
gauauacuuuguggac

SEQ ID NO: 2874896 - RNA, 22 nt, Human
gauauacuuuguggaccaauua

SEQ ID NO: 2874897 - RNA, 22 nt, Human
gauacaauguauuuauuuaaaa

SEQ ID NO: 2874898 - RNA, 13 nt, Human
gauacacacacac

SEQ ID NO: 2874899 - RNA, 16 nt, Human
gauacaagauuagaag

SEQ ID NO: 2874900 - RNA, 12 nt, Human
gauaauguuaaa

SEQ ID NO: 2874901 - RNA, 13 nt, Human
gauaauguuaaau

SEQ ID NO: 2874902 - RNA, 14 nt, Human
gauaauguuaaauu

SEQ ID NO: 2874903 - RNA, 19 nt, Human
gauaauguuaaauuuguaa

SEQ ID NO: 2874904 - RNA, 21 nt, Human
gauaauguuaaauuuguaagu

SEQ ID NO: 2874905 - RNA, 19 nt, Human
gauacaaacacuacagaca

SEQ ID NO: 2874906 - RNA, 16 nt, Human
gauacaaaugucuauc

SEQ ID NO: 2874907 - RNA, 17 nt, Human
gauacaaaugucuauca

SEQ ID NO: 2874908 - RNA, 14 nt, Human
gauacaaccucccu

SEQ ID NO: 2874909 - RNA, 16 nt, Human
gauacaaccucccucu

SEQ ID NO: 2874910 - RNA, 19 nt, Human
gauacaaccucccucuugu

SEQ ID NO: 2874911 - RNA, 21 nt, Human
gauaaucagugugucuaaauu

SEQ ID NO: 2874912 - RNA, 15 nt, Human
gauaaugauaaaaca

SEQ ID NO: 2874913 - RNA, 22 nt, Human
gauaaaacugggccuguagcuc

SEQ ID NO: 2874914 - RNA, 21 nt, Human
gauaauguccaacuaaaaaca

SEQ ID NO: 2874915 - RNA, 11 nt, Human
gauaauguuaa

SEQ ID NO: 2874916 - RNA, 16 nt, Human
gauaaucagccucuua

SEQ ID NO: 2874917 - RNA, 15 nt, Human
gauaaucagccucuu

SEQ ID NO: 2874918 - RNA, 14 nt, Human
gauaaucagccucu

SEQ ID NO: 2874919 - RNA, 13 nt, Human
gauaaucagccuc

SEQ ID NO: 2874920 - RNA, 19 nt, Human
gaguuuuuguuuggagagc

SEQ ID NO: 2874921 - RNA, 16 nt, Human
gaguuuuuaauagaac

SEQ ID NO: 2874922 - RNA, 20 nt, Human
gauaaaaauaucaucauagu

SEQ ID NO: 2874923 - RNA, 22 nt, Human
gagguuaggaguucgagaccag

SEQ ID NO: 2874924 - RNA, 10 nt, Human
gaguaaagcu

SEQ ID NO: 2874925 - RNA, 16 nt, Human
gaguaaauacagguag

SEQ ID NO: 2874926 - RNA, 15 nt, Human
gaguaaauauugagg

SEQ ID NO: 2874927 - RNA, 19 nt, Human
gaguaaauauugaggcuuu

SEQ ID NO: 2874928 - RNA, 16 nt, Human
gaguaaaucagauguu

SEQ ID NO: 2874929 - RNA, 20 nt, Human
gaguaaaucagauguugaau

SEQ ID NO: 2874930 - RNA, 23 nt, Human
gagguuuuuuugucaacauugug

SEQ ID NO: 2874931 - RNA, 21 nt, Human
gaguaaaaaaaaaaacaauua

SEQ ID NO: 2874932 - RNA, 23 nt, Human
gagguuugucgggcaccagccag

SEQ ID NO: 2874933 - RNA, 17 nt, Human
gaguaaagcuccuaucu

SEQ ID NO: 2874934 - RNA, 13 nt, Human
gaguacaaaugcc

SEQ ID NO: 2874935 - RNA, 14 nt, Human
gaguacaaaugccu

SEQ ID NO: 2874936 - RNA, 23 nt, Human
gaguacaaaugccuuaaaaugga

SEQ ID NO: 2874937 - RNA, 16 nt, Human
gaguacaggugaagca

SEQ ID NO: 2874938 - RNA, 18 nt, Human
gaguacauugaaggccug

SEQ ID NO: 2874939 - RNA, 12 nt, Human
gaguagcuggau

SEQ ID NO: 2874940 - RNA, 20 nt, Human
gagguccucuggagcccuaa

SEQ ID NO: 2874941 - RNA, 12 nt, Human
gagguccagccc

SEQ ID NO: 2874942 - RNA, 13 nt, Human
gagguccagccca

SEQ ID NO: 2874943 - RNA, 14 nt, Human
gagguccagcccau

SEQ ID NO: 2874944 - RNA, 16 nt, Human
gagguccucuggagcc

SEQ ID NO: 2874945 - RNA, 14 nt, Human
gagguccucuggag

SEQ ID NO: 2874946 - RNA, 14 nt, Human
gaggucccaggcag

SEQ ID NO: 2874947 - RNA, 12 nt, Human
gaggucccaggc

SEQ ID NO: 2874948 - RNA, 22 nt, Human
gaggucaggaaacuuuuaacug

SEQ ID NO: 2874949 - RNA, 13 nt, Human
gaggucccaggaa

SEQ ID NO: 2874950 - RNA, 15 nt, Human
gaggggcuccuggaa

SEQ ID NO: 2874951 - RNA, 14 nt, Human
gaggggcuccugga

SEQ ID NO: 2874952 - RNA, 11 nt, Human
gaggggcucuc

SEQ ID NO: 2874953 - RNA, 12 nt, Human
gaggggcucuca

SEQ ID NO: 2874954 - RNA, 16 nt, Human
gaggggcucucagcuc

SEQ ID NO: 2874955 - RNA, 13 nt, Human
gaggggcuccugg

SEQ ID NO: 2874956 - RNA, 12 nt, Human
gaggggcuccug

SEQ ID NO: 2874957 - RNA, 16 nt, Human
gaggggcgcccaccuc

SEQ ID NO: 2874958 - RNA, 14 nt, Human
gaggucaggcccug

SEQ ID NO: 2874959 - RNA, 15 nt, Human
gaggucaggcccugg

SEQ ID NO: 2874960 - RNA, 11 nt, Human
gaggucaggga

SEQ ID NO: 2874961 - RNA, 14 nt, Human
gaggucagggagug

SEQ ID NO: 2874962 - RNA, 22 nt, Human
gaggucagggagugcuggcuca

SEQ ID NO: 2874963 - RNA, 23 nt, Human
gaggucagggagugcuggcucac

SEQ ID NO: 2874964 - RNA, 18 nt, Human
gagguccacaacacacag

SEQ ID NO: 2874965 - RNA, 19 nt, Human
gaggggcucucagcucagc

SEQ ID NO: 2874966 - RNA, 19 nt, Human
gaggggggauuuccagcca

SEQ ID NO: 2874967 - RNA, 23 nt, Human
gagucucacuguugcccaggcug

SEQ ID NO: 2874968 - RNA, 22 nt, Human
gagucucacuguugcccaggcu

SEQ ID NO: 2874969 - RNA, 12 nt, Human
gagucucuucuc

SEQ ID NO: 2874970 - RNA, 23 nt, Human
gagucucgcuauugucaccaggg

SEQ ID NO: 2874971 - RNA, 23 nt, Human
gagucgucaucacuuuucaguga

SEQ ID NO: 2874972 - RNA, 18 nt, Human
gagucucuucuccacugg

SEQ ID NO: 2874973 - RNA, 14 nt, Human
gagucucuucucca

SEQ ID NO: 2874974 - RNA, 15 nt, Human
gagucucuucuccac

SEQ ID NO: 2874975 - RNA, 16 nt, Human
gagucucuucuccacu

SEQ ID NO: 2874976 - RNA, 17 nt, Human
gagucucuucuccacug

SEQ ID NO: 2874977 - RNA, 21 nt, Human
gagucucacuguugcccaggc

SEQ ID NO: 2874978 - RNA, 20 nt, Human
gagucucacuguugcccagg

SEQ ID NO: 2874979 - RNA, 19 nt, Human
gagucucacuguugcccag

SEQ ID NO: 2874980 - RNA, 17 nt, Human
gagucgaggacagggag

SEQ ID NO: 2874981 - RNA, 19 nt, Human
gagucgucaucacuuuuca

SEQ ID NO: 2874982 - RNA, 20 nt, Human
gaguccccccucccaccucc

SEQ ID NO: 2874983 - RNA, 22 nt, Human
gaguccccccucccaccuccag

SEQ ID NO: 2874984 - RNA, 20 nt, Human
gaguccccgggcaucuuugg

SEQ ID NO: 2874985 - RNA, 16 nt, Human
gagucccccagagaug

SEQ ID NO: 2874986 - RNA, 11 nt, Human
gaguccccuca

SEQ ID NO: 2874987 - RNA, 16 nt, Human
gaguccccucaccucc

SEQ ID NO: 2874988 - RNA, 17 nt, Human
gaguccccucaccuccu

SEQ ID NO: 2874989 - RNA, 19 nt, Human
gagucccaggcugagccuc

SEQ ID NO: 2874990 - RNA, 18 nt, Human
gagucccaggcugagccu

SEQ ID NO: 2874991 - RNA, 18 nt, Human
gaguccccucaccuccuc

SEQ ID NO: 2874992 - RNA, 19 nt, Human
gaguccccucaccuccucu

SEQ ID NO: 2874993 - RNA, 19 nt, Human
gagucaaaugguaggcauu

SEQ ID NO: 2874994 - RNA, 19 nt, Human
gagucaaaacuacaaauca

SEQ ID NO: 2874995 - RNA, 14 nt, Human
gaguagcugggacu

SEQ ID NO: 2874996 - RNA, 12 nt, Human
gaguagcuggga

SEQ ID NO: 2874997 - RNA, 16 nt, Human
gccaugcugggaagac

SEQ ID NO: 2874998 - RNA, 21 nt, Human
gccaugggcacaaagggccca

SEQ ID NO: 2874999 - RNA, 13 nt, Human
gccauuuugugaa

SEQ ID NO: 2875000 - RNA, 14 nt, Human
gccauuuugugaau

SEQ ID NO: 2875001 - RNA, 18 nt, Human
gccauuuugugaauggau

SEQ ID NO: 2875002 - RNA, 19 nt, Human
gccauuuugugaauggauu

SEQ ID NO: 2875003 - RNA, 18 nt, Human
gcccaaaaauaugguuga

SEQ ID NO: 2875004 - RNA, 14 nt, Human
gcccaaauuuuucu

SEQ ID NO: 2875005 - RNA, 21 nt, Human
gcccaaagagcacaaacauuu

SEQ ID NO: 2875006 - RNA, 22 nt, Human
gcccaaagagcacaaacauuuu

SEQ ID NO: 2875007 - RNA, 15 nt, Human
gccaugccaggaacc

SEQ ID NO: 2875008 - RNA, 21 nt, Human
gccauccuugacuuugaacua

SEQ ID NO: 2875009 - RNA, 12 nt, Human
gccaucucugga

SEQ ID NO: 2875010 - RNA, 15 nt, Human
gccaucucuggaugc

SEQ ID NO: 2875011 - RNA, 16 nt, Human
gccaucucuggaugcc

SEQ ID NO: 2875012 - RNA, 19 nt, Human
gccaucucuggaugccuga

SEQ ID NO: 2875013 - RNA, 17 nt, Human
gccagugaugugcggug

SEQ ID NO: 2875014 - RNA, 17 nt, Human
gccagucaagaagaaaa

SEQ ID NO: 2875015 - RNA, 18 nt, Human
gccagucaagaagaaaaa

SEQ ID NO: 2875016 - RNA, 17 nt, Human
gccagguuuuuggucug

SEQ ID NO: 2875017 - RNA, 22 nt, Human
gccagguuucugcccacauugg

SEQ ID NO: 2875018 - RNA, 18 nt, Human
gccagguggccacuccag

SEQ ID NO: 2875019 - RNA, 11 nt, Human
gccagggagcu

SEQ ID NO: 2875020 - RNA, 20 nt, Human
gccagggcaaugaugaauga

SEQ ID NO: 2875021 - RNA, 15 nt, Human
gccagggcagugcua

SEQ ID NO: 2875022 - RNA, 18 nt, Human
gccagggcagugcuagug

SEQ ID NO: 2875023 - RNA, 19 nt, Human
gccagggggacuagccccu

SEQ ID NO: 2875024 - RNA, 20 nt, Human
gccagggggacuagccccug

SEQ ID NO: 2875025 - RNA, 15 nt, Human
gccagggggaugcca

SEQ ID NO: 2875026 - RNA, 16 nt, Human
gccagggucucucccu

SEQ ID NO: 2875027 - RNA, 17 nt, Human
gccagggucucucccuc

SEQ ID NO: 2875028 - RNA, 18 nt, Human
gccagggucucucccuca

SEQ ID NO: 2875029 - RNA, 19 nt, Human
gccagggucucucccucag

SEQ ID NO: 2875030 - RNA, 20 nt, Human
gccagggucucucccucagg

SEQ ID NO: 2875031 - RNA, 22 nt, Human
gccagggucucucccucaggug

SEQ ID NO: 2875032 - RNA, 23 nt, Human
gccagggucucucccucaggugu

SEQ ID NO: 2875033 - RNA, 16 nt, Human
gccagggucuguguga

SEQ ID NO: 2875034 - RNA, 18 nt, Human
gccagggucugugugaau

SEQ ID NO: 2875035 - RNA, 19 nt, Human
gccagggucugugugaaug

SEQ ID NO: 2875036 - RNA, 20 nt, Human
gccagggucugugugaaugu

SEQ ID NO: 2875037 - RNA, 21 nt, Human
gccagggucugugugaaugug

SEQ ID NO: 2875038 - RNA, 22 nt, Human
gccagggucugugugaaugugg

SEQ ID NO: 2875039 - RNA, 21 nt, Human
gccagggggacuagccccugu

SEQ ID NO: 2875040 - RNA, 22 nt, Human
gccaggcuggucucgaacuccu

SEQ ID NO: 2875041 - RNA, 15 nt, Human
gccaggcugaucucg

SEQ ID NO: 2875042 - RNA, 14 nt, Human
gccaggcugcucuu

SEQ ID NO: 2875043 - RNA, 13 nt, Human
gccaggcugcucu

SEQ ID NO: 2875044 - RNA, 14 nt, Human
gccaggcugccaag

SEQ ID NO: 2875045 - RNA, 22 nt, Human
gccaggcugcucuugaacuccu

SEQ ID NO: 2875046 - RNA, 21 nt, Human
gcccagagggcccaggcaggc

SEQ ID NO: 2875047 - RNA, 12 nt, Human
gcccagagguaa

SEQ ID NO: 2875048 - RNA, 16 nt, Human
gcccagagguaacaga

SEQ ID NO: 2875049 - RNA, 18 nt, Human
gcccagauugugccacug

SEQ ID NO: 2875050 - RNA, 17 nt, Human
gcccagccaaacccugu

SEQ ID NO: 2875051 - RNA, 22 nt, Human
gcccagauuaaagucuuuaucc

SEQ ID NO: 2875052 - RNA, 22 nt, Human
gcccagagguaacagaacagcu

SEQ ID NO: 2875053 - RNA, 18 nt, Human
gcccagagguaacagaac

SEQ ID NO: 2875054 - RNA, 20 nt, Human
gcccagagguaacagaacag

SEQ ID NO: 2875055 - RNA, 12 nt, Human
gcccagccccua

SEQ ID NO: 2875056 - RNA, 14 nt, Human
gcccagccccuaga

SEQ ID NO: 2875057 - RNA, 15 nt, Human
gcccagccccuagaa

SEQ ID NO: 2875058 - RNA, 23 nt, Human
gcccagccauuaccauggagaca

SEQ ID NO: 2875059 - RNA, 22 nt, Human
gcccagccauuaccauggagac

SEQ ID NO: 2875060 - RNA, 21 nt, Human
gcccagccauuaccauggaga

SEQ ID NO: 2875061 - RNA, 20 nt, Human
gcccagccauuaccauggag

SEQ ID NO: 2875062 - RNA, 21 nt, Human
gcccagccaaacccugucuga

SEQ ID NO: 2875063 - RNA, 20 nt, Human
gcccagccaaacccugucug

SEQ ID NO: 2875064 - RNA, 20 nt, Human
gcccagagggcccaggcagg

SEQ ID NO: 2875065 - RNA, 16 nt, Human
gcccagagggcccagg

SEQ ID NO: 2875066 - RNA, 15 nt, Human
gcccagagggcccag

SEQ ID NO: 2875067 - RNA, 13 nt, Human
gcccagagggccc

SEQ ID NO: 2875068 - RNA, 21 nt, Human
gcccagaggccaacacugugg

SEQ ID NO: 2875069 - RNA, 23 nt, Human
gcccagaggccaacacugugggu

SEQ ID NO: 2875070 - RNA, 13 nt, Human
gcccagaggcuga

SEQ ID NO: 2875071 - RNA, 22 nt, Human
gcccaauccagguacgcacaga

SEQ ID NO: 2875072 - RNA, 20 nt, Human
gcccaaguggcagagcuugg

SEQ ID NO: 2875073 - RNA, 14 nt, Human
gcccaauuggagga

SEQ ID NO: 2875074 - RNA, 20 nt, Human
gcccaaugagacucuagggu

SEQ ID NO: 2875075 - RNA, 15 nt, Human
gcccaauuggaggaa

SEQ ID NO: 2875076 - RNA, 20 nt, Human
gcccaauuggaggaaagcaa

SEQ ID NO: 2875077 - RNA, 13 nt, Human
gcccagagaacag

SEQ ID NO: 2875078 - RNA, 14 nt, Human
gcccagagaacagc

SEQ ID NO: 2875079 - RNA, 12 nt, Human
gcccagagacuu

SEQ ID NO: 2875080 - RNA, 20 nt, Human
gcccaggcuggcgugcagug

SEQ ID NO: 2875081 - RNA, 19 nt, Human
gcccaggcuggcgugcagu

SEQ ID NO: 2875082 - RNA, 22 nt, Human
gcccaggcuggcgugcaguggu

SEQ ID NO: 2875083 - RNA, 16 nt, Human
gcccaggcugguuucg

SEQ ID NO: 2875084 - RNA, 22 nt, Human
gcccaggcugugcagcgcagcu

SEQ ID NO: 2875085 - RNA, 12 nt, Human
gcccaggcuggu

SEQ ID NO: 2875086 - RNA, 24 nt, Human
gcccaggcuggucuugaaguccug

SEQ ID NO: 2875087 - RNA, 18 nt, Human
gcccaguccucucccaag

SEQ ID NO: 2875088 - RNA, 23 nt, Human
gcccaguccucucccaaguccac

SEQ ID NO: 2875089 - RNA, 19 nt, Human
gcccagucuggaaugcagu

SEQ ID NO: 2875090 - RNA, 14 nt, Human
gcccaguccuucca

SEQ ID NO: 2875091 - RNA, 15 nt, Human
gcccaguccuuccac

SEQ ID NO: 2875092 - RNA, 17 nt, Human
gcccaguccuuccaccu

SEQ ID NO: 2875093 - RNA, 15 nt, Human
gcccaguugggugga

SEQ ID NO: 2875094 - RNA, 18 nt, Human
gcccaguccuuccaccuc

SEQ ID NO: 2875095 - RNA, 19 nt, Human
gcccaguccuuccaccucg

SEQ ID NO: 2875096 - RNA, 12 nt, Human
gcccagcccucc

SEQ ID NO: 2875097 - RNA, 16 nt, Human
gcccagcccuccccau

SEQ ID NO: 2875098 - RNA, 18 nt, Human
gcccagcccggaccuugg

SEQ ID NO: 2875099 - RNA, 15 nt, Human
gcccagcgcucugcc

SEQ ID NO: 2875100 - RNA, 16 nt, Human
gcccagcgcucugccu

SEQ ID NO: 2875101 - RNA, 16 nt, Human
gcccagcccuguucug

SEQ ID NO: 2875102 - RNA, 15 nt, Human
gcccagcccuguucu

SEQ ID NO: 2875103 - RNA, 18 nt, Human
gcccagcuauaccugugc

SEQ ID NO: 2875104 - RNA, 21 nt, Human
gcccagcuugaaaccuucacu

SEQ ID NO: 2875105 - RNA, 15 nt, Human
gccacugaagcuggg

SEQ ID NO: 2875106 - RNA, 14 nt, Human
gccacugaagcugg

SEQ ID NO: 2875107 - RNA, 15 nt, Human
gccacugaaaucugu

SEQ ID NO: 2875108 - RNA, 20 nt, Human
gccacucuaccagugcaggc

SEQ ID NO: 2875109 - RNA, 22 nt, Human
gccacucuaccagugcaggcug

SEQ ID NO: 2875110 - RNA, 23 nt, Human
gccacucuaccagugcaggcugg

SEQ ID NO: 2875111 - RNA, 18 nt, Human
gccacucucuucccuuuc

SEQ ID NO: 2875112 - RNA, 19 nt, Human
gccacucucuucccuuucc

SEQ ID NO: 2875113 - RNA, 18 nt, Human
gccacucgcuucccccau

SEQ ID NO: 2875114 - RNA, 14 nt, Human
gccacucgcuuccc

SEQ ID NO: 2875115 - RNA, 15 nt, Human
gccacuccugaaccc

SEQ ID NO: 2875116 - RNA, 21 nt, Human
gccacuagacucuucacuguu

SEQ ID NO: 2875117 - RNA, 23 nt, Human
gccacuacacuccagccugagca

SEQ ID NO: 2875118 - RNA, 22 nt, Human
gccacuacacuccagccugagc

SEQ ID NO: 2875119 - RNA, 21 nt, Human
gccacuacacuccagccugag

SEQ ID NO: 2875120 - RNA, 20 nt, Human
gccacuacacuccagccuga

SEQ ID NO: 2875121 - RNA, 16 nt, Human
gccacuaguaaguaau

SEQ ID NO: 2875122 - RNA, 24 nt, Human
gccagaggaacuguccagagagca

SEQ ID NO: 2875123 - RNA, 24 nt, Human
gccagaggaauccuggcagcccag

SEQ ID NO: 2875124 - RNA, 23 nt, Human
gccagaggaauccuggcagccca

SEQ ID NO: 2875125 - RNA, 22 nt, Human
gccagaggaauccuggcagccc

SEQ ID NO: 2875126 - RNA, 21 nt, Human
gccagaggaauccuggcagcc

SEQ ID NO: 2875127 - RNA, 20 nt, Human
gccagaggaauccuggcagc

SEQ ID NO: 2875128 - RNA, 19 nt, Human
gccagaggaauccuggcag

SEQ ID NO: 2875129 - RNA, 18 nt, Human
gccagaggaauccuggca

SEQ ID NO: 2875130 - RNA, 17 nt, Human
gccagaggaauccuggc

SEQ ID NO: 2875131 - RNA, 18 nt, Human
gccagaugcaccagcccu

SEQ ID NO: 2875132 - RNA, 17 nt, Human
gccagaugcaccagccc

SEQ ID NO: 2875133 - RNA, 16 nt, Human
gccagaugcaccagcc

SEQ ID NO: 2875134 - RNA, 24 nt, Human
gccagaguggccuggccaggagcu

SEQ ID NO: 2875135 - RNA, 23 nt, Human
gccagaguggccuggccaggagc

SEQ ID NO: 2875136 - RNA, 23 nt, Human
gccagagggagugacagaggcag

SEQ ID NO: 2875137 - RNA, 15 nt, Human
gccagagggcuugug

SEQ ID NO: 2875138 - RNA, 19 nt, Human
gccagagggcuugugaaca

SEQ ID NO: 2875139 - RNA, 14 nt, Human
gccagaggggaagg

SEQ ID NO: 2875140 - RNA, 13 nt, Human
gccagaggugcuu

SEQ ID NO: 2875141 - RNA, 15 nt, Human
gccagaggugcuuca

SEQ ID NO: 2875142 - RNA, 16 nt, Human
gccagaggugcuucac

SEQ ID NO: 2875143 - RNA, 19 nt, Human
gccagaggugcuucacccu

SEQ ID NO: 2875144 - RNA, 22 nt, Human
gccagaguggccuggccaggag

SEQ ID NO: 2875145 - RNA, 19 nt, Human
gccagaguggccuggccag

SEQ ID NO: 2875146 - RNA, 18 nt, Human
gccagaguggccuggcca

SEQ ID NO: 2875147 - RNA, 17 nt, Human
gccagaguggccuggcc

SEQ ID NO: 2875148 - RNA, 15 nt, Human
gccagaguggccugg

SEQ ID NO: 2875149 - RNA, 14 nt, Human
gccagaguggccug

SEQ ID NO: 2875150 - RNA, 13 nt, Human
gccagaguggccu

SEQ ID NO: 2875151 - RNA, 17 nt, Human
gccagaguccuuuccaa

SEQ ID NO: 2875152 - RNA, 22 nt, Human
gccagagggagugacagaggca

SEQ ID NO: 2875153 - RNA, 21 nt, Human
gccagagggagugacagaggc

SEQ ID NO: 2875154 - RNA, 10 nt, Human
gccaccugcc

SEQ ID NO: 2875155 - RNA, 22 nt, Human
gccaccucugcggaccccagcu

SEQ ID NO: 2875156 - RNA, 20 nt, Human
gccaccucccugacccgucu

SEQ ID NO: 2875157 - RNA, 13 nt, Human
gccaccucucucc

SEQ ID NO: 2875158 - RNA, 16 nt, Human
gccaccucucuccuuu

SEQ ID NO: 2875159 - RNA, 11 nt, Human
gccaccucugc

SEQ ID NO: 2875160 - RNA, 14 nt, Human
gccaccucugcgga

SEQ ID NO: 2875161 - RNA, 20 nt, Human
gccaccucugcggaccccag

SEQ ID NO: 2875162 - RNA, 21 nt, Human
gccaccucugcggaccccagc

SEQ ID NO: 2875163 - RNA, 23 nt, Human
gccaccucugcggaccccagcug

SEQ ID NO: 2875164 - RNA, 16 nt, Human
gccaccucugucauuu

SEQ ID NO: 2875165 - RNA, 16 nt, Human
gccacauacuugcagc

SEQ ID NO: 2875166 - RNA, 17 nt, Human
gccacauacuugcagcu

SEQ ID NO: 2875167 - RNA, 18 nt, Human
gccacaguagucuugaug

SEQ ID NO: 2875168 - RNA, 18 nt, Human
gccacaguauggaugggu

SEQ ID NO: 2875169 - RNA, 22 nt, Human
gccacaguauggauggguggau

SEQ ID NO: 2875170 - RNA, 17 nt, Human
gccaccgcgcccagccu

SEQ ID NO: 2875171 - RNA, 12 nt, Human
gccacacaccuu

SEQ ID NO: 2875172 - RNA, 16 nt, Human
gccacaucuuaaacuu

SEQ ID NO: 2875173 - RNA, 22 nt, Human
gccaccgugccuggccacgccc

SEQ ID NO: 2875174 - RNA, 17 nt, Human
gccaccgugccuggcca

SEQ ID NO: 2875175 - RNA, 17 nt, Human
gccaccgcgccuggccg

SEQ ID NO: 2875176 - RNA, 11 nt, Human
gccaccugccu

SEQ ID NO: 2875177 - RNA, 12 nt, Human
gccaccugccug

SEQ ID NO: 2875178 - RNA, 13 nt, Human
gccaccugccugc

SEQ ID NO: 2875179 - RNA, 14 nt, Human
gccaccugccugcg

SEQ ID NO: 2875180 - RNA, 21 nt, Human
gccaccugccugcgucuuccg

SEQ ID NO: 2875181 - RNA, 22 nt, Human
gccaccugccugcgucuuccgc

SEQ ID NO: 2875182 - RNA, 23 nt, Human
gccaccugccugcgucuuccgcc

SEQ ID NO: 2875183 - RNA, 11 nt, Human
gccaccugggu

SEQ ID NO: 2875184 - RNA, 19 nt, Human
gccacggccaggccagagg

SEQ ID NO: 2875185 - RNA, 19 nt, Human
gccacuacacuccagccug

SEQ ID NO: 2875186 - RNA, 18 nt, Human
gccacuacacuccagccu

SEQ ID NO: 2875187 - RNA, 17 nt, Human
gccacuacacuccagcc

SEQ ID NO: 2875188 - RNA, 18 nt, Human
gccacuaauuuuaguauu

SEQ ID NO: 2875189 - RNA, 23 nt, Human
gccacuaauuuuaguauucauuc

SEQ ID NO: 2875190 - RNA, 17 nt, Human
gccacggccaggccaga

SEQ ID NO: 2875191 - RNA, 18 nt, Human
gccacggccaggccagag

SEQ ID NO: 2875192 - RNA, 20 nt, Human
gccacgcccaacuaauuuuu

SEQ ID NO: 2875193 - RNA, 13 nt, Human
gccaauauguauu

SEQ ID NO: 2875194 - RNA, 17 nt, Human
gccaauauguauuguaa

SEQ ID NO: 2875195 - RNA, 23 nt, Human
gccaauauguauuguaaacaugu

SEQ ID NO: 2875196 - RNA, 18 nt, Human
gccaauauuaaaucugcu

SEQ ID NO: 2875197 - RNA, 15 nt, Human
gccaaucaagggcaa

SEQ ID NO: 2875198 - RNA, 16 nt, Human
gccaaugcacggccuc

SEQ ID NO: 2875199 - RNA, 13 nt, Human
gccaauggaaacc

SEQ ID NO: 2875200 - RNA, 19 nt, Human
gccaauggaaaccucacgc

SEQ ID NO: 2875201 - RNA, 21 nt, Human
gccaaucccucaccuucugag

SEQ ID NO: 2875202 - RNA, 22 nt, Human
gccaaucccucaccuucugagu

SEQ ID NO: 2875203 - RNA, 16 nt, Human
gccaauggagacuguc

SEQ ID NO: 2875204 - RNA, 19 nt, Human
gccaauggagacugucuca

SEQ ID NO: 2875205 - RNA, 21 nt, Human
gccaauggagacugucucaag

SEQ ID NO: 2875206 - RNA, 22 nt, Human
gccaauguauugauaagagggc

SEQ ID NO: 2875207 - RNA, 20 nt, Human
gccaauaauaauaccucccu

SEQ ID NO: 2875208 - RNA, 21 nt, Human
gccaaguuccucuagugcccu

SEQ ID NO: 2875209 - RNA, 15 nt, Human
gccaaguuccucuag

SEQ ID NO: 2875210 - RNA, 17 nt, Human
gccaagugccaaaugcu

SEQ ID NO: 2875211 - RNA, 18 nt, Human
gccaagugccaaaugcuc

SEQ ID NO: 2875212 - RNA, 18 nt, Human
gccaagugcgugccgugu

SEQ ID NO: 2875213 - RNA, 19 nt, Human
gccaagugcgugccgugug

SEQ ID NO: 2875214 - RNA, 23 nt, Human
gccaagugcgugccgugugagug

SEQ ID NO: 2875215 - RNA, 21 nt, Human
gccaaguccgcagaagcccug

SEQ ID NO: 2875216 - RNA, 12 nt, Human
gcauuuguauuu

SEQ ID NO: 2875217 - RNA, 16 nt, Human
gcauuuguauuuugug

SEQ ID NO: 2875218 - RNA, 19 nt, Human
gcauuuguauuuuguguga

SEQ ID NO: 2875219 - RNA, 21 nt, Human
gcauuuguauuuugugugacc

SEQ ID NO: 2875220 - RNA, 21 nt, Human
gccaaggugggcugagcccug

SEQ ID NO: 2875221 - RNA, 19 nt, Human
gccaaggugggcugagccc

SEQ ID NO: 2875222 - RNA, 18 nt, Human
gccaaggugggcugagcc

SEQ ID NO: 2875223 - RNA, 16 nt, Human
gccaaggugggcugag

SEQ ID NO: 2875224 - RNA, 23 nt, Human
gccaaggugggcugagcccuggc

SEQ ID NO: 2875225 - RNA, 22 nt, Human
gccaaggugggcugagcccugg

SEQ ID NO: 2875226 - RNA, 16 nt, Human
gccaaguauaauuuuu

SEQ ID NO: 2875227 - RNA, 22 nt, Human
gccaaguauaauuuuuuguaau

SEQ ID NO: 2875228 - RNA, 21 nt, Human
gccaagggaugaaagagaagg

SEQ ID NO: 2875229 - RNA, 20 nt, Human
gccaagggaauuauagcugc

SEQ ID NO: 2875230 - RNA, 21 nt, Human
gccaaggggagucaccuuccc

SEQ ID NO: 2875231 - RNA, 22 nt, Human
gccaaggggagucaccuucccu

SEQ ID NO: 2875232 - RNA, 15 nt, Human
gccaaggucugagcc

SEQ ID NO: 2875233 - RNA, 16 nt, Human
gccaaggucugagcca

SEQ ID NO: 2875234 - RNA, 22 nt, Human
gccaaggucugagccacagcag

SEQ ID NO: 2875235 - RNA, 20 nt, Human
gccacagagaaaguacuucu

SEQ ID NO: 2875236 - RNA, 14 nt, Human
gccacagagaaagu

SEQ ID NO: 2875237 - RNA, 13 nt, Human
gccacagagaaag

SEQ ID NO: 2875238 - RNA, 23 nt, Human
gccacacuucaggcucuucuccu

SEQ ID NO: 2875239 - RNA, 18 nt, Human
gccacacucuccaucacc

SEQ ID NO: 2875240 - RNA, 17 nt, Human
gccacacucuccaucac

SEQ ID NO: 2875241 - RNA, 22 nt, Human
gccacacucugggcuccagagu

SEQ ID NO: 2875242 - RNA, 12 nt, Human
gccacacuguga

SEQ ID NO: 2875243 - RNA, 15 nt, Human
gccacacugugacac

SEQ ID NO: 2875244 - RNA, 16 nt, Human
gccacacugugacaca

SEQ ID NO: 2875245 - RNA, 17 nt, Human
gccacacugugacacac

SEQ ID NO: 2875246 - RNA, 18 nt, Human
gccacacugugacacacu

SEQ ID NO: 2875247 - RNA, 20 nt, Human
gccacacuucaggcucuucu

SEQ ID NO: 2875248 - RNA, 22 nt, Human
gccacacuucaggcucuucucc

SEQ ID NO: 2875249 - RNA, 22 nt, Human
gccacacccucccccgccacuc

SEQ ID NO: 2875250 - RNA, 13 nt, Human
gccacacccuccc

SEQ ID NO: 2875251 - RNA, 16 nt, Human
gccacacccucccccg

SEQ ID NO: 2875252 - RNA, 23 nt, Human
gccacagagaaaguacuucucca

SEQ ID NO: 2875253 - RNA, 18 nt, Human
gccacacuugaaccuaau

SEQ ID NO: 2875254 - RNA, 22 nt, Human
gccacagaguguagccaggucc

SEQ ID NO: 2875255 - RNA, 23 nt, Human
gccacagaguguagccagguccc

SEQ ID NO: 2875256 - RNA, 14 nt, Human
gccacagcagcauu

SEQ ID NO: 2875257 - RNA, 15 nt, Human
gccacagcagcauuu

SEQ ID NO: 2875258 - RNA, 16 nt, Human
gccacagcagcauuuu

SEQ ID NO: 2875259 - RNA, 19 nt, Human
gccacagcagcauuuuuau

SEQ ID NO: 2875260 - RNA, 21 nt, Human
gccacagcccauccauaguaa

SEQ ID NO: 2875261 - RNA, 15 nt, Human
gccacaaauaaaaug

SEQ ID NO: 2875262 - RNA, 22 nt, Human
gccacaaauucuuugacacuca

SEQ ID NO: 2875263 - RNA, 23 nt, Human
gccaauuuuugccuucauuaccu

SEQ ID NO: 2875264 - RNA, 20 nt, Human
gccacaacuccuacaugaug

SEQ ID NO: 2875265 - RNA, 14 nt, Human
gccacaagaaauuu

SEQ ID NO: 2875266 - RNA, 16 nt, Human
gccacaagaaauuuga

SEQ ID NO: 2875267 - RNA, 23 nt, Human
gccacaagaaauuugauuucuau

SEQ ID NO: 2875268 - RNA, 16 nt, Human
gccaaugucuccuccc

SEQ ID NO: 2875269 - RNA, 19 nt, Human
gccaauguuuuccacccau

SEQ ID NO: 2875270 - RNA, 22 nt, Human
gccaauuaggggguaaggcccc

SEQ ID NO: 2875271 - RNA, 19 nt, Human
gccaauuauuguuacacau

SEQ ID NO: 2875272 - RNA, 19 nt, Human
gccacaccaucuccuuuca

SEQ ID NO: 2875273 - RNA, 12 nt, Human
gccacacccagg

SEQ ID NO: 2875274 - RNA, 15 nt, Human
gccacacccaggcac

SEQ ID NO: 2875275 - RNA, 14 nt, Human
gccacacaugggca

SEQ ID NO: 2875276 - RNA, 18 nt, Human
gccacacaugggcaucua

SEQ ID NO: 2875277 - RNA, 14 nt, Human
gccacacagaccac

SEQ ID NO: 2875278 - RNA, 15 nt, Human
gccacacagaccacc

SEQ ID NO: 2875279 - RNA, 20 nt, Human
gccacacagaccaccaucca

SEQ ID NO: 2875280 - RNA, 15 nt, Human
gccacaagucuucca

SEQ ID NO: 2875281 - RNA, 16 nt, Human
gccacaagucuuccag

SEQ ID NO: 2875282 - RNA, 14 nt, Human
gcagaggucagacu

SEQ ID NO: 2875283 - RNA, 21 nt, Human
gcagagguccacaacacacag

SEQ ID NO: 2875284 - RNA, 21 nt, Human
gcagaggggcuuucuggagag

SEQ ID NO: 2875285 - RNA, 19 nt, Human
gcagagggguaagagagga

SEQ ID NO: 2875286 - RNA, 20 nt, Human
gcagaggggcuuucuggaga

SEQ ID NO: 2875287 - RNA, 19 nt, Human
gcagaggggcuuucuggag

SEQ ID NO: 2875288 - RNA, 18 nt, Human
gcagaggggcuuucugga

SEQ ID NO: 2875289 - RNA, 16 nt, Human
gcagaggggcuuucug

SEQ ID NO: 2875290 - RNA, 12 nt, Human
gcagaggggcuu

SEQ ID NO: 2875291 - RNA, 14 nt, Human
gcagagguggccag

SEQ ID NO: 2875292 - RNA, 15 nt, Human
gcagagguggccaga

SEQ ID NO: 2875293 - RNA, 22 nt, Human
gcagaucugugccccaugccug

SEQ ID NO: 2875294 - RNA, 20 nt, Human
gcagaucugugccccaugcc

SEQ ID NO: 2875295 - RNA, 14 nt, Human
gcagaucugugccc

SEQ ID NO: 2875296 - RNA, 13 nt, Human
gcagaucugugcc

SEQ ID NO: 2875297 - RNA, 23 nt, Human
gcagagguggccagagcugggag

SEQ ID NO: 2875298 - RNA, 18 nt, Human
gcagauguccuugaugcu

SEQ ID NO: 2875299 - RNA, 13 nt, Human
gcagauuagcagg

SEQ ID NO: 2875300 - RNA, 16 nt, Human
gcagauuagcaggcca

SEQ ID NO: 2875301 - RNA, 16 nt, Human
gcagaugugcagcaga

SEQ ID NO: 2875302 - RNA, 17 nt, Human
gcagaugugcagcagau

SEQ ID NO: 2875303 - RNA, 22 nt, Human
gcagaugugcagcagauuggaa

SEQ ID NO: 2875304 - RNA, 19 nt, Human
gcagcagauuggaaggaga

SEQ ID NO: 2875305 - RNA, 20 nt, Human
gcagcagauuggaaggagac

SEQ ID NO: 2875306 - RNA, 21 nt, Human
gcagcagauuggaaggagaca

SEQ ID NO: 2875307 - RNA, 23 nt, Human
gcagcagauuggaaggagacaca

SEQ ID NO: 2875308 - RNA, 16 nt, Human
gcagaucuuggacuca

SEQ ID NO: 2875309 - RNA, 12 nt, Human
gcagaugacaag

SEQ ID NO: 2875310 - RNA, 14 nt, Human
gcagaugacaagau

SEQ ID NO: 2875311 - RNA, 21 nt, Human
gcagaugacaagaugguacaa

SEQ ID NO: 2875312 - RNA, 14 nt, Human
gcagaugauccaug

SEQ ID NO: 2875313 - RNA, 13 nt, Human
gcagaugauccau

SEQ ID NO: 2875314 - RNA, 14 nt, Human
gcagaugagguugc

SEQ ID NO: 2875315 - RNA, 19 nt, Human
gcagaugagguugcuagag

SEQ ID NO: 2875316 - RNA, 22 nt, Human
gcagagaagggcauaaaacagc

SEQ ID NO: 2875317 - RNA, 20 nt, Human
gcagagaaagggacaaugau

SEQ ID NO: 2875318 - RNA, 23 nt, Human
gcagacuguguaaaauguaaugc

SEQ ID NO: 2875319 - RNA, 22 nt, Human
gcagacucuacagaggccaugg

SEQ ID NO: 2875320 - RNA, 19 nt, Human
gcagacucuacagaggcca

SEQ ID NO: 2875321 - RNA, 18 nt, Human
gcagacucuacagaggcc

SEQ ID NO: 2875322 - RNA, 17 nt, Human
gcagacucuacagaggc

SEQ ID NO: 2875323 - RNA, 16 nt, Human
gcacuugcagacucua

SEQ ID NO: 2875324 - RNA, 14 nt, Human
gcacuugcagacuc

SEQ ID NO: 2875325 - RNA, 21 nt, Human
gcacuuccuuuuaccugccca

SEQ ID NO: 2875326 - RNA, 14 nt, Human
gcacuguuuuucca

SEQ ID NO: 2875327 - RNA, 13 nt, Human
gcaggaaggagag

SEQ ID NO: 2875328 - RNA, 12 nt, Human
gcaggaaggaga

SEQ ID NO: 2875329 - RNA, 20 nt, Human
gcaggaagcauucagagagc

SEQ ID NO: 2875330 - RNA, 21 nt, Human
gcaggaagcauucagagagca

SEQ ID NO: 2875331 - RNA, 23 nt, Human
gcaggacucacagguuggaagag

SEQ ID NO: 2875332 - RNA, 19 nt, Human
gcaggacucagcuccccag

SEQ ID NO: 2875333 - RNA, 17 nt, Human
gcaggaacaaugacuac

SEQ ID NO: 2875334 - RNA, 16 nt, Human
gcagcucacuacccua

SEQ ID NO: 2875335 - RNA, 19 nt, Human
gcagcucagguuguagugg

SEQ ID NO: 2875336 - RNA, 23 nt, Human
gcagccucccucugaccugcagg

SEQ ID NO: 2875337 - RNA, 14 nt, Human
gcagcccugcuuug

SEQ ID NO: 2875338 - RNA, 24 nt, Human
gcagcccugcuuugggcugcccug

SEQ ID NO: 2875339 - RNA, 15 nt, Human
gcagcagcaggugau

SEQ ID NO: 2875340 - RNA, 16 nt, Human
gcagcaggaggccagg

SEQ ID NO: 2875341 - RNA, 22 nt, Human
gcagccucccucugaccugcag

SEQ ID NO: 2875342 - RNA, 16 nt, Human
gcagccucccucugac

SEQ ID NO: 2875343 - RNA, 14 nt, Human
gcagccucccucug

SEQ ID NO: 2875344 - RNA, 17 nt, Human
gcagccuccaacacaag

SEQ ID NO: 2875345 - RNA, 18 nt, Human
gcagccuccaacacaagg

SEQ ID NO: 2875346 - RNA, 19 nt, Human
gcagcccuggcagggggca

SEQ ID NO: 2875347 - RNA, 16 nt, Human
gcagcccuucccccag

SEQ ID NO: 2875348 - RNA, 20 nt, Human
gcagccgccuuaagcugauc

SEQ ID NO: 2875349 - RNA, 14 nt, Human
gcagccgccuuccu

SEQ ID NO: 2875350 - RNA, 16 nt, Human
gcagccgccuuccuug

SEQ ID NO: 2875351 - RNA, 18 nt, Human
gcagccgccuuccuugac

SEQ ID NO: 2875352 - RNA, 20 nt, Human
gcagccgccuuccuugaccu

SEQ ID NO: 2875353 - RNA, 14 nt, Human
gauuguuaaaauaa

SEQ ID NO: 2875354 - RNA, 12 nt, Human
gcacagcagccu

SEQ ID NO: 2875355 - RNA, 13 nt, Human
gcacagcagccug

SEQ ID NO: 2875356 - RNA, 14 nt, Human
gcacagcagccugc

SEQ ID NO: 2875357 - RNA, 17 nt, Human
gcacagcagccugcuuc

SEQ ID NO: 2875358 - RNA, 20 nt, Human
gcacagcagccugcuuccca

SEQ ID NO: 2875359 - RNA, 13 nt, Human
gcacagauuuuaa

SEQ ID NO: 2875360 - RNA, 14 nt, Human
gcacagauuuuaau

SEQ ID NO: 2875361 - RNA, 17 nt, Human
gcacagauuuuaauugu

SEQ ID NO: 2875362 - RNA, 21 nt, Human
gcacagauuuuaauugucaug

SEQ ID NO: 2875363 - RNA, 13 nt, Human
gcacagcaaacug

SEQ ID NO: 2875364 - RNA, 21 nt, Human
gcacagcuucauuuccugugu

SEQ ID NO: 2875365 - RNA, 23 nt, Human
gcacagcuucauuuccugugucu

SEQ ID NO: 2875366 - RNA, 15 nt, Human
gcacaggaaaaggua

SEQ ID NO: 2875367 - RNA, 18 nt, Human
gcacaggaaaagguagcu

SEQ ID NO: 2875368 - RNA, 16 nt, Human
gcacagggcaguggga

SEQ ID NO: 2875369 - RNA, 15 nt, Human
gcaccccucugcccu

SEQ ID NO: 2875370 - RNA, 18 nt, Human
gcaccccgauguggaccu

SEQ ID NO: 2875371 - RNA, 23 nt, Human
gcaccccgauguggaccucuacu

SEQ ID NO: 2875372 - RNA, 14 nt, Human
gcaccccgcugcgg

SEQ ID NO: 2875373 - RNA, 12 nt, Human
gcacagggagaa

SEQ ID NO: 2875374 - RNA, 18 nt, Human
gcaccagagcaaccucuc

SEQ ID NO: 2875375 - RNA, 19 nt, Human
gcaccagagcaaccucuca

SEQ ID NO: 2875376 - RNA, 19 nt, Human
gcaccaaagaugcagccgc

SEQ ID NO: 2875377 - RNA, 21 nt, Human
gcaccaaagaugcagccgccu

SEQ ID NO: 2875378 - RNA, 23 nt, Human
gcaccaaagaugcagccgccuuc

SEQ ID NO: 2875379 - RNA, 15 nt, Human
gcacaggucaggggu

SEQ ID NO: 2875380 - RNA, 21 nt, Human
gcacaggucaggggugacaca

SEQ ID NO: 2875381 - RNA, 22 nt, Human
gcacaggucaggggugacacag

SEQ ID NO: 2875382 - RNA, 23 nt, Human
gcacaggucaggggugacacaga

SEQ ID NO: 2875383 - RNA, 13 nt, Human
gcacaggucccac

SEQ ID NO: 2875384 - RNA, 14 nt, Human
gcacaggucccacc

SEQ ID NO: 2875385 - RNA, 17 nt, Human
gcacuguugauguaucu

SEQ ID NO: 2875386 - RNA, 18 nt, Human
gcacuguugauguaucug

SEQ ID NO: 2875387 - RNA, 19 nt, Human
gcacuguugauguaucuga

SEQ ID NO: 2875388 - RNA, 20 nt, Human
gcacuguugcaaacucagug

SEQ ID NO: 2875389 - RNA, 23 nt, Human
gcacugggaugagccgcugugag

SEQ ID NO: 2875390 - RNA, 15 nt, Human
gcacugggaucacag

SEQ ID NO: 2875391 - RNA, 21 nt, Human
gcacuacaugugguuuauaga

SEQ ID NO: 2875392 - RNA, 16 nt, Human
gcacuacauucauuua

SEQ ID NO: 2875393 - RNA, 12 nt, Human
gcacuacauuca

SEQ ID NO: 2875394 - RNA, 23 nt, Human
gcacgcggauuaauuugcaucug

SEQ ID NO: 2875395 - RNA, 13 nt, Human
gcacgccugcccc

SEQ ID NO: 2875396 - RNA, 18 nt, Human
gcacgcgcccuuucuacc

SEQ ID NO: 2875397 - RNA, 20 nt, Human
gcacgcgcccuuucuaccau

SEQ ID NO: 2875398 - RNA, 12 nt, Human
gcacgcaguggc

SEQ ID NO: 2875399 - RNA, 16 nt, Human
gcacgcacacacacaa

SEQ ID NO: 2875400 - RNA, 15 nt, Human
gcacuaaagccagcc

SEQ ID NO: 2875401 - RNA, 17 nt, Human
gcacuaaagccagccug

SEQ ID NO: 2875402 - RNA, 18 nt, Human
gcacuaaagccagccuga

SEQ ID NO: 2875403 - RNA, 19 nt, Human
gcacuaaagccagccugac

SEQ ID NO: 2875404 - RNA, 21 nt, Human
gcacuaaagccagccugaccu

SEQ ID NO: 2875405 - RNA, 23 nt, Human
gcacuaaagccagccugaccuuc

SEQ ID NO: 2875406 - RNA, 15 nt, Human
gcacguugcuucagg

SEQ ID NO: 2875407 - RNA, 14 nt, Human
gcacgugugugcac

SEQ ID NO: 2875408 - RNA, 12 nt, Human
gcacggacaaua

SEQ ID NO: 2875409 - RNA, 15 nt, Human
gcacggacaauaaac

SEQ ID NO: 2875410 - RNA, 16 nt, Human
gcacggacaauaaacc

SEQ ID NO: 2875411 - RNA, 17 nt, Human
gcacggacaauaaaccu

SEQ ID NO: 2875412 - RNA, 18 nt, Human
gcacggacaauaaaccuc

SEQ ID NO: 2875413 - RNA, 20 nt, Human
gcacuaaggugugcucugau

SEQ ID NO: 2875414 - RNA, 19 nt, Human
gcacuaaaguauguaaagu

SEQ ID NO: 2875415 - RNA, 20 nt, Human
gcacuaaaguauguaaagua

SEQ ID NO: 2875416 - RNA, 22 nt, Human
gcacuaaaguauguaaaguaug

SEQ ID NO: 2875417 - RNA, 14 nt, Human
gcacuaaauaugaa

SEQ ID NO: 2875418 - RNA, 15 nt, Human
gcacuaaauaugaac

SEQ ID NO: 2875419 - RNA, 19 nt, Human
gcacuaaggugugcucuga

SEQ ID NO: 2875420 - RNA, 19 nt, Human
gcacuaauuugauguuuac

SEQ ID NO: 2875421 - RNA, 13 nt, Human
gcacuacaugugg

SEQ ID NO: 2875422 - RNA, 22 nt, Human
gcauacugagccaaguauaauu

SEQ ID NO: 2875423 - RNA, 23 nt, Human
gcauacugagccaaguauaauuu

SEQ ID NO: 2875424 - RNA, 17 nt, Human
gcaucagcuggcgucau

SEQ ID NO: 2875425 - RNA, 21 nt, Human
gcaucagcuggcgucaugcaa

SEQ ID NO: 2875426 - RNA, 13 nt, Human
gcaucagggggaa

SEQ ID NO: 2875427 - RNA, 18 nt, Human
gcaucagggggaagaagc

SEQ ID NO: 2875428 - RNA, 20 nt, Human
gcaucagggggaagaagcag

SEQ ID NO: 2875429 - RNA, 21 nt, Human
gcaucagggggaagaagcaga

SEQ ID NO: 2875430 - RNA, 24 nt, Human
gcaucagggggaagaagcagagag

SEQ ID NO: 2875431 - RNA, 15 nt, Human
gcaucagugcccucc

SEQ ID NO: 2875432 - RNA, 15 nt, Human
gcauccaaucucaag

SEQ ID NO: 2875433 - RNA, 18 nt, Human
gcauccaaucucaaggaa

SEQ ID NO: 2875434 - RNA, 19 nt, Human
gcauccaaucucaaggaau

SEQ ID NO: 2875435 - RNA, 23 nt, Human
gcaucuaugggagagugucaacc

SEQ ID NO: 2875436 - RNA, 16 nt, Human
gcaucuagguaauuuu

SEQ ID NO: 2875437 - RNA, 12 nt, Human
gcaucucagccc

SEQ ID NO: 2875438 - RNA, 13 nt, Human
gcaucucagccca

SEQ ID NO: 2875439 - RNA, 14 nt, Human
gcaucucagcccac

SEQ ID NO: 2875440 - RNA, 11 nt, Human
gcaucauugca

SEQ ID NO: 2875441 - RNA, 14 nt, Human
gcaucauugcagau

SEQ ID NO: 2875442 - RNA, 15 nt, Human
gcaucauugcagaug

SEQ ID NO: 2875443 - RNA, 13 nt, Human
gcaucaugcaugu

SEQ ID NO: 2875444 - RNA, 19 nt, Human
gcaucagucccuauguauu

SEQ ID NO: 2875445 - RNA, 15 nt, Human
gcaucaguucuacgg

SEQ ID NO: 2875446 - RNA, 17 nt, Human
gcaucauaguaguuuuu

SEQ ID NO: 2875447 - RNA, 23 nt, Human
gcaucagugcccuccaggauaga

SEQ ID NO: 2875448 - RNA, 14 nt, Human
gcaucugugauggg

SEQ ID NO: 2875449 - RNA, 15 nt, Human
gcaucugugauggga

SEQ ID NO: 2875450 - RNA, 18 nt, Human
gcaucugugaugggagcg

SEQ ID NO: 2875451 - RNA, 12 nt, Human
gcaucuguacaa

SEQ ID NO: 2875452 - RNA, 15 nt, Human
gcaucuguacaaagg

SEQ ID NO: 2875453 - RNA, 15 nt, Human
gcaucucagcccaca

SEQ ID NO: 2875454 - RNA, 17 nt, Human
gcaucugccccuccccc

SEQ ID NO: 2875455 - RNA, 15 nt, Human
gcaucugccccuccc

SEQ ID NO: 2875456 - RNA, 14 nt, Human
gcaucugccccucc

SEQ ID NO: 2875457 - RNA, 12 nt, Human
gcaucugccccu

SEQ ID NO: 2875458 - RNA, 14 nt, Human
gcaucucuguacuu

SEQ ID NO: 2875459 - RNA, 17 nt, Human
gcaucucuguacuuugc

SEQ ID NO: 2875460 - RNA, 18 nt, Human
gcaucugccccuccccca

SEQ ID NO: 2875461 - RNA, 21 nt, Human
gcauuauguccacuguguaua

SEQ ID NO: 2875462 - RNA, 22 nt, Human
gcauuauguccacuguguauag

SEQ ID NO: 2875463 - RNA, 21 nt, Human
gcauugaacacaaacuguaaa

SEQ ID NO: 2875464 - RNA, 14 nt, Human
gcauuccuucuuug

SEQ ID NO: 2875465 - RNA, 15 nt, Human
gcauuccuucuuuga

SEQ ID NO: 2875466 - RNA, 19 nt, Human
gcauuccugauaugauuua

SEQ ID NO: 2875467 - RNA, 21 nt, Human
gcauuccugauaugauuuaaa

SEQ ID NO: 2875468 - RNA, 22 nt, Human
gcauuccugauaugauuuaaaa

SEQ ID NO: 2875469 - RNA, 13 nt, Human
gcauuccuucuuu

SEQ ID NO: 2875470 - RNA, 23 nt, Human
gcauugaacacaaacuguaaaua

SEQ ID NO: 2875471 - RNA, 22 nt, Human
gcauugaacacaaacuguaaau

SEQ ID NO: 2875472 - RNA, 15 nt, Human
gcauugacaaaucug

SEQ ID NO: 2875473 - RNA, 16 nt, Human
gcauugacaaaucugu

SEQ ID NO: 2875474 - RNA, 19 nt, Human
gcauugacaaaucugugua

SEQ ID NO: 2875475 - RNA, 20 nt, Human
gcauugacaaaucuguguau

SEQ ID NO: 2875476 - RNA, 13 nt, Human
gcauugacauuau

SEQ ID NO: 2875477 - RNA, 15 nt, Human
gcauugauauuguga

SEQ ID NO: 2875478 - RNA, 16 nt, Human
gcauugauauugugaa

SEQ ID NO: 2875479 - RNA, 15 nt, Human
gcauugagcugagau

SEQ ID NO: 2875480 - RNA, 18 nt, Human
gcauugaggaagagucuu

SEQ ID NO: 2875481 - RNA, 21 nt, Human
gcauugacuuucaguaaacau

SEQ ID NO: 2875482 - RNA, 22 nt, Human
gcauugacuuucaguaaacaua

SEQ ID NO: 2875483 - RNA, 19 nt, Human
gcauuccuucuuugauaau

SEQ ID NO: 2875484 - RNA, 22 nt, Human
gcauugaccgcgacuaauuuca

SEQ ID NO: 2875485 - RNA, 23 nt, Human
gcauugaccgcgacuaauuucaa

SEQ ID NO: 2875486 - RNA, 22 nt, Human
gcauugacugguuuacaggccc

SEQ ID NO: 2875487 - RNA, 23 nt, Human
gcauugacugguuuacaggcccu

SEQ ID NO: 2875488 - RNA, 14 nt, Human
gcauuaugcaauua

SEQ ID NO: 2875489 - RNA, 19 nt, Human
gcauuauguccacugugua

SEQ ID NO: 2875490 - RNA, 12 nt, Human
gcauuaaaccug

SEQ ID NO: 2875491 - RNA, 13 nt, Human
gcauuaaaccugu

SEQ ID NO: 2875492 - RNA, 14 nt, Human
gcauuaaaccuguc

SEQ ID NO: 2875493 - RNA, 15 nt, Human
gcauuaaaccugucu

SEQ ID NO: 2875494 - RNA, 22 nt, Human
gcauuaaaccugucuccacugu

SEQ ID NO: 2875495 - RNA, 22 nt, Human
gcauuaaauucacaaacuuuua

SEQ ID NO: 2875496 - RNA, 19 nt, Human
gcauuaaauuuuaagguag

SEQ ID NO: 2875497 - RNA, 20 nt, Human
gcauuaaauuuuaagguaga

SEQ ID NO: 2875498 - RNA, 18 nt, Human
gcauuaaauucacaaacu

SEQ ID NO: 2875499 - RNA, 13 nt, Human
gcauuaacacaaa

SEQ ID NO: 2875500 - RNA, 12 nt, Human
gcauuaauguuu

SEQ ID NO: 2875501 - RNA, 13 nt, Human
gcauuaauguuuc

SEQ ID NO: 2875502 - RNA, 14 nt, Human
gcauuaauguuucu

SEQ ID NO: 2875503 - RNA, 15 nt, Human
gcauuacccccaacc

SEQ ID NO: 2875504 - RNA, 21 nt, Human
gcauuacccccaaccucauuu

SEQ ID NO: 2875505 - RNA, 15 nt, Human
gcaugugucaugcau

SEQ ID NO: 2875506 - RNA, 18 nt, Human
gcaugugucaugcaugaa

SEQ ID NO: 2875507 - RNA, 13 nt, Human
gcaugugugugug

SEQ ID NO: 2875508 - RNA, 14 nt, Human
gcaugugugugugu

SEQ ID NO: 2875509 - RNA, 11 nt, Human
gcaugugugug

SEQ ID NO: 2875510 - RNA, 11 nt, Human
gcaugugugua

SEQ ID NO: 2875511 - RNA, 12 nt, Human
gcauguguguau

SEQ ID NO: 2875512 - RNA, 13 nt, Human
gcauguguguaua

SEQ ID NO: 2875513 - RNA, 15 nt, Human
gcauguguguauaag

SEQ ID NO: 2875514 - RNA, 11 nt, Human
gcaugccucug

SEQ ID NO: 2875515 - RNA, 19 nt, Human
gcaugccucugauauggga

SEQ ID NO: 2875516 - RNA, 21 nt, Human
gcaugccucugauaugggacu

SEQ ID NO: 2875517 - RNA, 13 nt, Human
gcaugccugagag

SEQ ID NO: 2875518 - RNA, 22 nt, Human
gcaugccugagagacauggcuu

SEQ ID NO: 2875519 - RNA, 22 nt, Human
gcaugccccggccaccucugcg

SEQ ID NO: 2875520 - RNA, 23 nt, Human
gcaugccccggccaccucugcgg

SEQ ID NO: 2875521 - RNA, 18 nt, Human
gcaugccccggccaccuc

SEQ ID NO: 2875522 - RNA, 19 nt, Human
gcaugccccggccaccucu

SEQ ID NO: 2875523 - RNA, 20 nt, Human
gcaugccccggccaccucug

SEQ ID NO: 2875524 - RNA, 21 nt, Human
gcaugccccggccaccucugc

SEQ ID NO: 2875525 - RNA, 15 nt, Human
gcaugaccagaugcg

SEQ ID NO: 2875526 - RNA, 20 nt, Human
gcaugacauaacagugcagg

SEQ ID NO: 2875527 - RNA, 13 nt, Human
gcaugacagccuc

SEQ ID NO: 2875528 - RNA, 14 nt, Human
gcaugacagccucu

SEQ ID NO: 2875529 - RNA, 15 nt, Human
gcaugacagccucua

SEQ ID NO: 2875530 - RNA, 14 nt, Human
gcaugccccggcca

SEQ ID NO: 2875531 - RNA, 16 nt, Human
gcaugccccggccacc

SEQ ID NO: 2875532 - RNA, 17 nt, Human
gcaugccccggccaccu

SEQ ID NO: 2875533 - RNA, 19 nt, Human
gcaguucagcaccacccua

SEQ ID NO: 2875534 - RNA, 17 nt, Human
gcaguucagcaccaccc

SEQ ID NO: 2875535 - RNA, 21 nt, Human
gcaguggugcgaucuggguuc

SEQ ID NO: 2875536 - RNA, 20 nt, Human
gcaguggugcgaucuggguu

SEQ ID NO: 2875537 - RNA, 22 nt, Human
gcaguggugcgaucuggguuca

SEQ ID NO: 2875538 - RNA, 16 nt, Human
gcaguggcucacgccu

SEQ ID NO: 2875539 - RNA, 19 nt, Human
gcaguggugcgaucugggu

SEQ ID NO: 2875540 - RNA, 18 nt, Human
gcaguggugcgaucuggg

SEQ ID NO: 2875541 - RNA, 14 nt, Human
gcaguggugcgauc

SEQ ID NO: 2875542 - RNA, 16 nt, Human
gcaguggugcgaucuc

SEQ ID NO: 2875543 - RNA, 21 nt, Human
gcagugggguuucgcagccug

SEQ ID NO: 2875544 - RNA, 16 nt, Human
gcagugggcuccuggc

SEQ ID NO: 2875545 - RNA, 18 nt, Human
gcagugggcuccuggcag

SEQ ID NO: 2875546 - RNA, 11 nt, Human
gcagugggagc

SEQ ID NO: 2875547 - RNA, 21 nt, Human
gcagugggacagggcauggcc

SEQ ID NO: 2875548 - RNA, 13 nt, Human
gcagggcuggccc

SEQ ID NO: 2875549 - RNA, 21 nt, Human
gcagggcuggccccagggcac

SEQ ID NO: 2875550 - RNA, 14 nt, Human
gcagggcugugcac

SEQ ID NO: 2875551 - RNA, 16 nt, Human
gcagggucucacucug

SEQ ID NO: 2875552 - RNA, 14 nt, Human
gcaggcggugggca

SEQ ID NO: 2875553 - RNA, 15 nt, Human
gcaggcggugggcac

SEQ ID NO: 2875554 - RNA, 16 nt, Human
gcaggcggugggcacc

SEQ ID NO: 2875555 - RNA, 23 nt, Human
gcaggcggugggcacccacccug

SEQ ID NO: 2875556 - RNA, 15 nt, Human
gcagggaggucaggc

SEQ ID NO: 2875557 - RNA, 16 nt, Human
gcagggaggucaggcc

SEQ ID NO: 2875558 - RNA, 18 nt, Human
gcagggaggucaggcccu

SEQ ID NO: 2875559 - RNA, 20 nt, Human
gcagggaggucaggcccugg

SEQ ID NO: 2875560 - RNA, 15 nt, Human
gcagggauugcugcc

SEQ ID NO: 2875561 - RNA, 19 nt, Human
gcagggauugcugccacuu

SEQ ID NO: 2875562 - RNA, 22 nt, Human
gcagggauugcugccacuuuuu

SEQ ID NO: 2875563 - RNA, 22 nt, Human
gcagggcaaaugacaugcacug

SEQ ID NO: 2875564 - RNA, 23 nt, Human
gcagggcaaaugacaugcacuga

SEQ ID NO: 2875565 - RNA, 12 nt, Human
gcagggcagccc

SEQ ID NO: 2875566 - RNA, 13 nt, Human
gcagggcagcccc

SEQ ID NO: 2875567 - RNA, 15 nt, Human
gcagggcagccccac

SEQ ID NO: 2875568 - RNA, 19 nt, Human
gcaggacuuugaggcaagu

SEQ ID NO: 2875569 - RNA, 13 nt, Human
gcaggcagcgcca

SEQ ID NO: 2875570 - RNA, 24 nt, Human
gcaggccaagagcagaggcagcga

SEQ ID NO: 2875571 - RNA, 22 nt, Human
gcaggccaagagcagaggcagc

SEQ ID NO: 2875572 - RNA, 20 nt, Human
gcaggccaagagcagaggca

SEQ ID NO: 2875573 - RNA, 16 nt, Human
gcaggcauguccugga

SEQ ID NO: 2875574 - RNA, 15 nt, Human
gcaggcauugaggaa

SEQ ID NO: 2875575 - RNA, 16 nt, Human
gcaggcauugaggaag

SEQ ID NO: 2875576 - RNA, 18 nt, Human
gcaggcauugaggaagag

SEQ ID NO: 2875577 - RNA, 20 nt, Human
gcaggccaagucaggcccuu

SEQ ID NO: 2875578 - RNA, 23 nt, Human
gcaggccaaggccuucuccuccc

SEQ ID NO: 2875579 - RNA, 15 nt, Human
gcaggccaaggucug

SEQ ID NO: 2875580 - RNA, 16 nt, Human
gcaggccaaggucuga

SEQ ID NO: 2875581 - RNA, 22 nt, Human
gcaggccaaggucugagccaca

SEQ ID NO: 2875582 - RNA, 19 nt, Human
gcaggccaaggccuucucc

SEQ ID NO: 2875583 - RNA, 14 nt, Human
gcaggcaucugauu

SEQ ID NO: 2875584 - RNA, 20 nt, Human
gcaggccaaggccuucuccu

SEQ ID NO: 2875585 - RNA, 21 nt, Human
gcaggccaaggccuucuccuc

SEQ ID NO: 2875586 - RNA, 19 nt, Human
gcaggcccuuugaagccuc

SEQ ID NO: 2875587 - RNA, 12 nt, Human
gcaggcccugca

SEQ ID NO: 2875588 - RNA, 11 nt, Human
gcaggcccugc

SEQ ID NO: 2875589 - RNA, 13 nt, Human
gcaggcccugcag

SEQ ID NO: 2875590 - RNA, 14 nt, Human
gcaggcccugcagu

SEQ ID NO: 2875591 - RNA, 16 nt, Human
gcaggccaggccagcu

SEQ ID NO: 2875592 - RNA, 15 nt, Human
gcaggccaggccagc

SEQ ID NO: 2875593 - RNA, 17 nt, Human
gcaggccaggccagcug

SEQ ID NO: 2875594 - RNA, 13 nt, Human
gcuugccugcagg

SEQ ID NO: 2875595 - RNA, 14 nt, Human
gcuugccugcaggc

SEQ ID NO: 2875596 - RNA, 14 nt, Human
gcuugccuggagac

SEQ ID NO: 2875597 - RNA, 16 nt, Human
gcuugcgaacuagaga

SEQ ID NO: 2875598 - RNA, 21 nt, Human
gcuugcgaacuagagaugugc

SEQ ID NO: 2875599 - RNA, 14 nt, Human
gcuugcucauuuuu

SEQ ID NO: 2875600 - RNA, 13 nt, Human
gcuugcucccugu

SEQ ID NO: 2875601 - RNA, 22 nt, Human
gcuugcuagcuaugugaccuug

SEQ ID NO: 2875602 - RNA, 16 nt, Human
gcuugcuagcuaugug

SEQ ID NO: 2875603 - RNA, 21 nt, Human
gcuuggaaagcaucaccucag

SEQ ID NO: 2875604 - RNA, 19 nt, Human
gcuuggaaagcaucaccuc

SEQ ID NO: 2875605 - RNA, 12 nt, Human
gcuuguguuaag

SEQ ID NO: 2875606 - RNA, 17 nt, Human
gcuuguuauauuaagca

SEQ ID NO: 2875607 - RNA, 17 nt, Human
gcuuguuaucagcuuuc

SEQ ID NO: 2875608 - RNA, 18 nt, Human
gcuuguuccaaugccaca

SEQ ID NO: 2875609 - RNA, 19 nt, Human
gcuuguuccaaugccacau

SEQ ID NO: 2875610 - RNA, 18 nt, Human
gcuuguucccucucccug

SEQ ID NO: 2875611 - RNA, 16 nt, Human
gcuuggacggcugggc

SEQ ID NO: 2875612 - RNA, 12 nt, Human
gcuuggacugga

SEQ ID NO: 2875613 - RNA, 12 nt, Human
gcuugugaacag

SEQ ID NO: 2875614 - RNA, 13 nt, Human
gcuugugaacaga

SEQ ID NO: 2875615 - RNA, 20 nt, Human
gcuugugaauguauuuuucu

SEQ ID NO: 2875616 - RNA, 15 nt, Human
gcuugugcaacaaua

SEQ ID NO: 2875617 - RNA, 14 nt, Human
gcuugugcacaauu

SEQ ID NO: 2875618 - RNA, 17 nt, Human
gcuuguggggacccagg

SEQ ID NO: 2875619 - RNA, 18 nt, Human
gcuuguggggacccaggc

SEQ ID NO: 2875620 - RNA, 19 nt, Human
gcuuguggggacccaggcu

SEQ ID NO: 2875621 - RNA, 21 nt, Human
gcuuguggggacccaggcucc

SEQ ID NO: 2875622 - RNA, 18 nt, Human
gcuuuggggugucuuuuu

SEQ ID NO: 2875623 - RNA, 15 nt, Human
gcuuugguuuauauu

SEQ ID NO: 2875624 - RNA, 18 nt, Human
gcuuugggcugcccuggu

SEQ ID NO: 2875625 - RNA, 19 nt, Human
gcuuugggcugcccuggug

SEQ ID NO: 2875626 - RNA, 20 nt, Human
gcuuguuuuauaaaauuuug

SEQ ID NO: 2875627 - RNA, 23 nt, Human
gcuuguuuuauaaaauuuugcuu

SEQ ID NO: 2875628 - RNA, 14 nt, Human
gcuuguuuuccagu

SEQ ID NO: 2875629 - RNA, 13 nt, Human
gcuuuaaacaaau

SEQ ID NO: 2875630 - RNA, 17 nt, Human
gcuuuaaacaaauucau

SEQ ID NO: 2875631 - RNA, 16 nt, Human
gcuuuaaacucaggga

SEQ ID NO: 2875632 - RNA, 14 nt, Human
gcuuguuguaaagc

SEQ ID NO: 2875633 - RNA, 22 nt, Human
gcuuucaucacaaauccaaagg

SEQ ID NO: 2875634 - RNA, 21 nt, Human
gcuuucagggccaugguucac

SEQ ID NO: 2875635 - RNA, 18 nt, Human
gcuuuaaacucagggaca

SEQ ID NO: 2875636 - RNA, 21 nt, Human
gcuuuaaacucagggacagag

SEQ ID NO: 2875637 - RNA, 22 nt, Human
gcuuuaaacucagggacagagc

SEQ ID NO: 2875638 - RNA, 18 nt, Human
gcuuuaaagggccugccu

SEQ ID NO: 2875639 - RNA, 15 nt, Human
gcuuuaaaguguaau

SEQ ID NO: 2875640 - RNA, 16 nt, Human
gcuuuaaaguguaaua

SEQ ID NO: 2875641 - RNA, 19 nt, Human
gcuucuguugcugccucau

SEQ ID NO: 2875642 - RNA, 18 nt, Human
gcuucuggagcccuuggg

SEQ ID NO: 2875643 - RNA, 17 nt, Human
gcuucuggagcccuugg

SEQ ID NO: 2875644 - RNA, 14 nt, Human
gcuucuggagcccu

SEQ ID NO: 2875645 - RNA, 13 nt, Human
gcuucuggagccc

SEQ ID NO: 2875646 - RNA, 18 nt, Human
gcuucuguugcugccuca

SEQ ID NO: 2875647 - RNA, 17 nt, Human
gcuucuguugcugccuc

SEQ ID NO: 2875648 - RNA, 17 nt, Human
gcuucuggaauuuguuc

SEQ ID NO: 2875649 - RNA, 20 nt, Human
gcuucuggaauuuguucaag

SEQ ID NO: 2875650 - RNA, 23 nt, Human
gcuucuggaauuuguucaaguuu

SEQ ID NO: 2875651 - RNA, 12 nt, Human
gcuucuggagcc

SEQ ID NO: 2875652 - RNA, 17 nt, Human
gcuucucauccugcagg

SEQ ID NO: 2875653 - RNA, 18 nt, Human
gcuucauuuccugugucu

SEQ ID NO: 2875654 - RNA, 15 nt, Human
gcuucauuagagcag

SEQ ID NO: 2875655 - RNA, 16 nt, Human
gcuucauuagagcagg

SEQ ID NO: 2875656 - RNA, 17 nt, Human
gcuucauuagagcaggc

SEQ ID NO: 2875657 - RNA, 18 nt, Human
gcuucauuagagcaggcg

SEQ ID NO: 2875658 - RNA, 17 nt, Human
gcuucauucaauauuga

SEQ ID NO: 2875659 - RNA, 18 nt, Human
gcuucauucaauauugac

SEQ ID NO: 2875660 - RNA, 22 nt, Human
gcuucauucaauauugacauuu

SEQ ID NO: 2875661 - RNA, 15 nt, Human
gcuucauucuccuug

SEQ ID NO: 2875662 - RNA, 15 nt, Human
gcuuccaaauauugu

SEQ ID NO: 2875663 - RNA, 22 nt, Human
gcuuccaaggggcaaauuuuua

SEQ ID NO: 2875664 - RNA, 12 nt, Human
gcuuccaauuuu

SEQ ID NO: 2875665 - RNA, 19 nt, Human
gcuuccagaaaaccccagc

SEQ ID NO: 2875666 - RNA, 12 nt, Human
gcuucucauccc

SEQ ID NO: 2875667 - RNA, 14 nt, Human
gcuucucaucccca

SEQ ID NO: 2875668 - RNA, 16 nt, Human
gcuucucauccugcag

SEQ ID NO: 2875669 - RNA, 11 nt, Human
gcuuacucugu

SEQ ID NO: 2875670 - RNA, 19 nt, Human
gcuuaccuugacuguugau

SEQ ID NO: 2875671 - RNA, 15 nt, Human
gcuuagacauaacaa

SEQ ID NO: 2875672 - RNA, 13 nt, Human
gcuuauauucaac

SEQ ID NO: 2875673 - RNA, 20 nt, Human
gcuuauauucaaccauggac

SEQ ID NO: 2875674 - RNA, 22 nt, Human
gcuuauauucaaccauggacuu

SEQ ID NO: 2875675 - RNA, 17 nt, Human
gcuuauagguggccucu

SEQ ID NO: 2875676 - RNA, 15 nt, Human
gcuuauagguggccu

SEQ ID NO: 2875677 - RNA, 20 nt, Human
gcuucaguggcagcugcuuu

SEQ ID NO: 2875678 - RNA, 14 nt, Human
gcuucauaaaugaa

SEQ ID NO: 2875679 - RNA, 19 nt, Human
gcuucaguggcagcugcuu

SEQ ID NO: 2875680 - RNA, 15 nt, Human
gcuuauccauaaaaa

SEQ ID NO: 2875681 - RNA, 16 nt, Human
gcuuauccauaaaaaa

SEQ ID NO: 2875682 - RNA, 17 nt, Human
gcuuaucaauaaaccug

SEQ ID NO: 2875683 - RNA, 13 nt, Human
gcuuacuauuucu

SEQ ID NO: 2875684 - RNA, 23 nt, Human
gcuuauauucaaccauggacuuu

SEQ ID NO: 2875685 - RNA, 13 nt, Human
gcuucaucuguca

SEQ ID NO: 2875686 - RNA, 18 nt, Human
gcuucaucugucaagugg

SEQ ID NO: 2875687 - RNA, 18 nt, Human
gcuucauaaaugaagcag

SEQ ID NO: 2875688 - RNA, 22 nt, Human
gcuucauaaaugaagcagcuuu

SEQ ID NO: 2875689 - RNA, 14 nt, Human
gcuucaugccagcu

SEQ ID NO: 2875690 - RNA, 20 nt, Human
gcuggucucaaacuccugac

SEQ ID NO: 2875691 - RNA, 19 nt, Human
gcuggucucaaacuccuga

SEQ ID NO: 2875692 - RNA, 13 nt, Human
gcuggugcccgga

SEQ ID NO: 2875693 - RNA, 18 nt, Human
gcuggugagugaugcggc

SEQ ID NO: 2875694 - RNA, 20 nt, Human
gcuggugagugaugcggcag

SEQ ID NO: 2875695 - RNA, 20 nt, Human
gcugguccucauucaaaggg

SEQ ID NO: 2875696 - RNA, 23 nt, Human
gcuggucucgaacuccugaccuu

SEQ ID NO: 2875697 - RNA, 22 nt, Human
gcuggucucgaacuccugaccu

SEQ ID NO: 2875698 - RNA, 19 nt, Human
gcuggucucgaacuccuga

SEQ ID NO: 2875699 - RNA, 13 nt, Human
gcugggggccuca

SEQ ID NO: 2875700 - RNA, 17 nt, Human
gcuggggcaagucccug

SEQ ID NO: 2875701 - RNA, 18 nt, Human
gcugggggccucagugcc

SEQ ID NO: 2875702 - RNA, 22 nt, Human
gcuggucaaacaaacucucuga

SEQ ID NO: 2875703 - RNA, 18 nt, Human
gcugguauugguggcuuu

SEQ ID NO: 2875704 - RNA, 13 nt, Human
gcuggucacagcc

SEQ ID NO: 2875705 - RNA, 15 nt, Human
gcuggucacagccuc

SEQ ID NO: 2875706 - RNA, 17 nt, Human
gcuggucacagccuccu

SEQ ID NO: 2875707 - RNA, 18 nt, Human
gcuggucacagccuccuc

SEQ ID NO: 2875708 - RNA, 20 nt, Human
gcuggucacagccuccucug

SEQ ID NO: 2875709 - RNA, 22 nt, Human
gcuggucacagccuccucuguc

SEQ ID NO: 2875710 - RNA, 15 nt, Human
gcugggggccucagu

SEQ ID NO: 2875711 - RNA, 14 nt, Human
gcugggggccucag

SEQ ID NO: 2875712 - RNA, 20 nt, Human
gcuggggaaguccucugggu

SEQ ID NO: 2875713 - RNA, 16 nt, Human
gcuggggaccugguac

SEQ ID NO: 2875714 - RNA, 23 nt, Human
gcuggggaccugguacccuccug

SEQ ID NO: 2875715 - RNA, 15 nt, Human
gcuggggagaggaaa

SEQ ID NO: 2875716 - RNA, 13 nt, Human
gcuggggaggagc

SEQ ID NO: 2875717 - RNA, 20 nt, Human
gcugggcuucaguggcagcu

SEQ ID NO: 2875718 - RNA, 13 nt, Human
gcugggcucugca

SEQ ID NO: 2875719 - RNA, 22 nt, Human
gcugggcuucaguggcagcugc

SEQ ID NO: 2875720 - RNA, 21 nt, Human
gcugggcuucaguggcagcug

SEQ ID NO: 2875721 - RNA, 20 nt, Human
gcugggaggcauggcccugg

SEQ ID NO: 2875722 - RNA, 18 nt, Human
gcugggaguaguugucuu

SEQ ID NO: 2875723 - RNA, 14 nt, Human
gcugggaggcaugg

SEQ ID NO: 2875724 - RNA, 15 nt, Human
gcugggaggcauggc

SEQ ID NO: 2875725 - RNA, 14 nt, Human
gcuggugcccggag

SEQ ID NO: 2875726 - RNA, 15 nt, Human
gcuggugucaccuga

SEQ ID NO: 2875727 - RNA, 14 nt, Human
gcuggugucaccug

SEQ ID NO: 2875728 - RNA, 15 nt, Human
gcugucaccucuccc

SEQ ID NO: 2875729 - RNA, 21 nt, Human
gcugucaccucucccacggga

SEQ ID NO: 2875730 - RNA, 22 nt, Human
gcugucaccucucccacgggac

SEQ ID NO: 2875731 - RNA, 13 nt, Human
gcugucaucucag

SEQ ID NO: 2875732 - RNA, 16 nt, Human
gcuguccuaggccaca

SEQ ID NO: 2875733 - RNA, 14 nt, Human
gcuguccuaggcca

SEQ ID NO: 2875734 - RNA, 13 nt, Human
gcuguccuaggcc

SEQ ID NO: 2875735 - RNA, 23 nt, Human
gcuguccccuuggcagguccugg

SEQ ID NO: 2875736 - RNA, 22 nt, Human
gcugucccaucuccacuguuau

SEQ ID NO: 2875737 - RNA, 16 nt, Human
gcuguccaugcuucuc

SEQ ID NO: 2875738 - RNA, 11 nt, Human
gcugucaucug

SEQ ID NO: 2875739 - RNA, 16 nt, Human
gcuguccagagaaaag

SEQ ID NO: 2875740 - RNA, 18 nt, Human
gcuguguuaaauaaaccu

SEQ ID NO: 2875741 - RNA, 19 nt, Human
gcuguguuggguagaauag

SEQ ID NO: 2875742 - RNA, 15 nt, Human
gcugugugccugggg

SEQ ID NO: 2875743 - RNA, 22 nt, Human
gcuguguuguugcuucuuguga

SEQ ID NO: 2875744 - RNA, 16 nt, Human
gcuguguuuaauuuga

SEQ ID NO: 2875745 - RNA, 12 nt, Human
gcuguuaaacug

SEQ ID NO: 2875746 - RNA, 13 nt, Human
gcuguuaaacugu

SEQ ID NO: 2875747 - RNA, 14 nt, Human
gcuguuaaacuguu

SEQ ID NO: 2875748 - RNA, 15 nt, Human
gcuguuaaacuguua

SEQ ID NO: 2875749 - RNA, 22 nt, Human
gcuguuaaacuguuagcacugu

SEQ ID NO: 2875750 - RNA, 18 nt, Human
gcuguuaauagaucuuag

SEQ ID NO: 2875751 - RNA, 12 nt, Human
gcuuaccugaca

SEQ ID NO: 2875752 - RNA, 14 nt, Human
gcuuaccugacaca

SEQ ID NO: 2875753 - RNA, 16 nt, Human
gcuuaccugacacaag

SEQ ID NO: 2875754 - RNA, 13 nt, Human
gcuuaccugaccu

SEQ ID NO: 2875755 - RNA, 21 nt, Human
gcuuaccugaccucuugcugu

SEQ ID NO: 2875756 - RNA, 22 nt, Human
gcuuaccugaccucuugcuguc

SEQ ID NO: 2875757 - RNA, 23 nt, Human
gcuuaccugaccucuugcugucu

SEQ ID NO: 2875758 - RNA, 15 nt, Human
gcuuacauaguuuua

SEQ ID NO: 2875759 - RNA, 15 nt, Human
gcuguuaccauucac

SEQ ID NO: 2875760 - RNA, 18 nt, Human
gcuguuaccauucacaau

SEQ ID NO: 2875761 - RNA, 17 nt, Human
gcuguuaccgccugucu

SEQ ID NO: 2875762 - RNA, 21 nt, Human
gcuguuaccgccugucucuuu

SEQ ID NO: 2875763 - RNA, 18 nt, Human
gcuguuacuguuaaccau

SEQ ID NO: 2875764 - RNA, 22 nt, Human
gcuuacaagccagcuggagaaa

SEQ ID NO: 2875765 - RNA, 19 nt, Human
gcuguuaugucuguuuaag

SEQ ID NO: 2875766 - RNA, 20 nt, Human
gcuguuaugucuguuuaaga

SEQ ID NO: 2875767 - RNA, 13 nt, Human
gcugugugaccuu

SEQ ID NO: 2875768 - RNA, 20 nt, Human
gcugucccuuggaacucuug

SEQ ID NO: 2875769 - RNA, 14 nt, Human
gcuguggccugggc

SEQ ID NO: 2875770 - RNA, 15 nt, Human
gcuguggccugggca

SEQ ID NO: 2875771 - RNA, 20 nt, Human
gcugcccuccuuguccaccc

SEQ ID NO: 2875772 - RNA, 21 nt, Human
gcugcccuccuuguccaccca

SEQ ID NO: 2875773 - RNA, 22 nt, Human
gcugcccuccuuguccacccac

SEQ ID NO: 2875774 - RNA, 16 nt, Human
gcugcccuccuugucc

SEQ ID NO: 2875775 - RNA, 20 nt, Human
gcugcaggggcucuggagag

SEQ ID NO: 2875776 - RNA, 21 nt, Human
gcugccacaaccagccaggca

SEQ ID NO: 2875777 - RNA, 23 nt, Human
gcugccacaccagucacaugacc

SEQ ID NO: 2875778 - RNA, 17 nt, Human
gcugccaaggccagagu

SEQ ID NO: 2875779 - RNA, 16 nt, Human
gcugccaaggccagag

SEQ ID NO: 2875780 - RNA, 15 nt, Human
gcugccacacuucag

SEQ ID NO: 2875781 - RNA, 17 nt, Human
gcugccacacuucaggc

SEQ ID NO: 2875782 - RNA, 18 nt, Human
gcugccacacuucaggcu

SEQ ID NO: 2875783 - RNA, 21 nt, Human
gcugccacacuucaggcucuu

SEQ ID NO: 2875784 - RNA, 22 nt, Human
gcugccacacuucaggcucuuc

SEQ ID NO: 2875785 - RNA, 23 nt, Human
gcugccacacuucaggcucuucu

SEQ ID NO: 2875786 - RNA, 15 nt, Human
gcugccaaggccaga

SEQ ID NO: 2875787 - RNA, 21 nt, Human
gcugcaggggcucuggagaga

SEQ ID NO: 2875788 - RNA, 20 nt, Human
gcugcagugacgugcaccug

SEQ ID NO: 2875789 - RNA, 23 nt, Human
gcugcaguccguguggauccaau

SEQ ID NO: 2875790 - RNA, 22 nt, Human
gcugcaggggcucuggagagaa

SEQ ID NO: 2875791 - RNA, 16 nt, Human
gcugcaguaggggagg

SEQ ID NO: 2875792 - RNA, 20 nt, Human
gcugcaguaggggaggagca

SEQ ID NO: 2875793 - RNA, 22 nt, Human
gcugaucugcggaucucagcuu

SEQ ID NO: 2875794 - RNA, 13 nt, Human
gcugauucucagg

SEQ ID NO: 2875795 - RNA, 21 nt, Human
gcugaugaacuuauucuguag

SEQ ID NO: 2875796 - RNA, 17 nt, Human
gcugaugaaucacuguu

SEQ ID NO: 2875797 - RNA, 18 nt, Human
gcugaugaaucacuguuu

SEQ ID NO: 2875798 - RNA, 21 nt, Human
gcugaugaaucacuguuuuua

SEQ ID NO: 2875799 - RNA, 20 nt, Human
gcugauguuggaagagaaag

SEQ ID NO: 2875800 - RNA, 20 nt, Human
gcugauucucagggucucug

SEQ ID NO: 2875801 - RNA, 23 nt, Human
gcugcaaaggguaucaggugcug

SEQ ID NO: 2875802 - RNA, 22 nt, Human
gcugcaaaggguaucaggugcu

SEQ ID NO: 2875803 - RNA, 17 nt, Human
gcugauuuggugaccaa

SEQ ID NO: 2875804 - RNA, 15 nt, Human
gcugauuuccccucu

SEQ ID NO: 2875805 - RNA, 21 nt, Human
gcugauucucagggucucugc

SEQ ID NO: 2875806 - RNA, 14 nt, Human
gcugauuuuaaugg

SEQ ID NO: 2875807 - RNA, 19 nt, Human
gcugagacaggagaaacac

SEQ ID NO: 2875808 - RNA, 14 nt, Human
gcugagacugcggg

SEQ ID NO: 2875809 - RNA, 18 nt, Human
gcugacuuugcucuuucu

SEQ ID NO: 2875810 - RNA, 14 nt, Human
gcugagaacacugu

SEQ ID NO: 2875811 - RNA, 16 nt, Human
gcugagaauguggaau

SEQ ID NO: 2875812 - RNA, 14 nt, Human
gcugagacaggaga

SEQ ID NO: 2875813 - RNA, 14 nt, Human
gcugagaacuccug

SEQ ID NO: 2875814 - RNA, 15 nt, Human
gcugagaacuccuga

SEQ ID NO: 2875815 - RNA, 16 nt, Human
gcugagaacuccugac

SEQ ID NO: 2875816 - RNA, 17 nt, Human
gcugagaacuccugacu

SEQ ID NO: 2875817 - RNA, 18 nt, Human
gcugaucaucgccagagg

SEQ ID NO: 2875818 - RNA, 20 nt, Human
gcugaucaucgccagaggug

SEQ ID NO: 2875819 - RNA, 22 nt, Human
gcugaucaucgccagaggugcu

SEQ ID NO: 2875820 - RNA, 14 nt, Human
gcugagagacuuuu

SEQ ID NO: 2875821 - RNA, 18 nt, Human
gcugauacauaacuaaau

SEQ ID NO: 2875822 - RNA, 19 nt, Human
gcugauacauaacuaaauu

SEQ ID NO: 2875823 - RNA, 21 nt, Human
gcugauacauaacuaaauuug

SEQ ID NO: 2875824 - RNA, 23 nt, Human
gcugauacauaacuaaauuugau

SEQ ID NO: 2875825 - RNA, 14 nt, Human
gcugauacuucauu

SEQ ID NO: 2875826 - RNA, 13 nt, Human
gcugauauaaauu

SEQ ID NO: 2875827 - RNA, 15 nt, Human
gcugauauaaauucu

SEQ ID NO: 2875828 - RNA, 17 nt, Human
gcugauauaaauucugu

SEQ ID NO: 2875829 - RNA, 15 nt, Human
gcugacgugugaggg

SEQ ID NO: 2875830 - RNA, 14 nt, Human
gcugacuaaauuug

SEQ ID NO: 2875831 - RNA, 18 nt, Human
gcugacuguccucucccc

SEQ ID NO: 2875832 - RNA, 23 nt, Human
gcugacuguccucuccccuccag

SEQ ID NO: 2875833 - RNA, 13 nt, Human
gcugacuucacuu

SEQ ID NO: 2875834 - RNA, 20 nt, Human
gcugacuucacuuauuaguc

SEQ ID NO: 2875835 - RNA, 21 nt, Human
gcugacuucacuuauuagucu

SEQ ID NO: 2875836 - RNA, 15 nt, Human
gcugaccugccucuc

SEQ ID NO: 2875837 - RNA, 16 nt, Human
gcugaccugccucuca

SEQ ID NO: 2875838 - RNA, 22 nt, Human
gcugaccugccucucacacaca

SEQ ID NO: 2875839 - RNA, 23 nt, Human
gcugaccugccucucacacacau

SEQ ID NO: 2875840 - RNA, 19 nt, Human
gcugacagacacaggcccg

SEQ ID NO: 2875841 - RNA, 18 nt, Human
gcugacagacacaggccc

SEQ ID NO: 2875842 - RNA, 17 nt, Human
gcugacagacacaggcc

SEQ ID NO: 2875843 - RNA, 18 nt, Human
gcucuuugguagaaaagg

SEQ ID NO: 2875844 - RNA, 13 nt, Human
gcucuuugguaga

SEQ ID NO: 2875845 - RNA, 22 nt, Human
gcucuuugguagaaaaggcuag

SEQ ID NO: 2875846 - RNA, 19 nt, Human
gcugacauggcucuggacu

SEQ ID NO: 2875847 - RNA, 15 nt, Human
gcugaccaauugugc

SEQ ID NO: 2875848 - RNA, 16 nt, Human
gcugaccaauugugcu

SEQ ID NO: 2875849 - RNA, 19 nt, Human
gcugaccaauugugcugcc

SEQ ID NO: 2875850 - RNA, 20 nt, Human
gcugaccaauugugcugcca

SEQ ID NO: 2875851 - RNA, 21 nt, Human
gcugaccaauugugcugccau

SEQ ID NO: 2875852 - RNA, 14 nt, Human
gcucucaucugagg

SEQ ID NO: 2875853 - RNA, 15 nt, Human
gcucucaucugaggc

SEQ ID NO: 2875854 - RNA, 17 nt, Human
gcucucaucugaggcau

SEQ ID NO: 2875855 - RNA, 22 nt, Human
gcucucaucugaggcauccagc

SEQ ID NO: 2875856 - RNA, 16 nt, Human
gcucgcaccccccugu

SEQ ID NO: 2875857 - RNA, 20 nt, Human
gcucgcaccccccuguucua

SEQ ID NO: 2875858 - RNA, 21 nt, Human
gcucgcaccccccuguucuaa

SEQ ID NO: 2875859 - RNA, 16 nt, Human
gcucgcccuccuuucu

SEQ ID NO: 2875860 - RNA, 19 nt, Human
gcucgcccuccuuucugug

SEQ ID NO: 2875861 - RNA, 20 nt, Human
gcucgcccuccuuucugugc

SEQ ID NO: 2875862 - RNA, 18 nt, Human
gcucuccaagucucagug

SEQ ID NO: 2875863 - RNA, 22 nt, Human
gcucuccaagucucaguggcuu

SEQ ID NO: 2875864 - RNA, 21 nt, Human
gcucuugaacuccugaccuca

SEQ ID NO: 2875865 - RNA, 19 nt, Human
gcucuugaacuccugaccu

SEQ ID NO: 2875866 - RNA, 16 nt, Human
gcucuugaacuccuga

SEQ ID NO: 2875867 - RNA, 14 nt, Human
gcucuugaacuccu

SEQ ID NO: 2875868 - RNA, 14 nt, Human
gcucuuuggagauc

SEQ ID NO: 2875869 - RNA, 23 nt, Human
gcucuuugaaauagucuguguga

SEQ ID NO: 2875870 - RNA, 21 nt, Human
gcucuuugaaauagucugugu

SEQ ID NO: 2875871 - RNA, 18 nt, Human
gcucuuucugggccaagu

SEQ ID NO: 2875872 - RNA, 14 nt, Human
gcucuuucugggcc

SEQ ID NO: 2875873 - RNA, 13 nt, Human
gcucuuucugggc

SEQ ID NO: 2875874 - RNA, 21 nt, Human
gcucuuguagcccaggcugga

SEQ ID NO: 2875875 - RNA, 14 nt, Human
gcucuugucccacg

SEQ ID NO: 2875876 - RNA, 17 nt, Human
gcucuugauaccccccu

SEQ ID NO: 2875877 - RNA, 19 nt, Human
gcucuugauaccccccucu

SEQ ID NO: 2875878 - RNA, 19 nt, Human
gcucuuggcagguacucag

SEQ ID NO: 2875879 - RNA, 13 nt, Human
gcuccuuuccccu

SEQ ID NO: 2875880 - RNA, 18 nt, Human
gcucuugaccuuguagag

SEQ ID NO: 2875881 - RNA, 14 nt, Human
gcugcccugaagaa

SEQ ID NO: 2875882 - RNA, 12 nt, Human
gcugcccugaga

SEQ ID NO: 2875883 - RNA, 13 nt, Human
gcugcccugagaa

SEQ ID NO: 2875884 - RNA, 16 nt, Human
gcugcccugagaagcu

SEQ ID NO: 2875885 - RNA, 18 nt, Human
gcugcccugagaagcugc

SEQ ID NO: 2875886 - RNA, 21 nt, Human
gcugcccugagaagcugcucc

SEQ ID NO: 2875887 - RNA, 22 nt, Human
gcugcccugagaagcugcucca

SEQ ID NO: 2875888 - RNA, 22 nt, Human
gcugcccugagcgccuggauuu

SEQ ID NO: 2875889 - RNA, 15 nt, Human
gcugcccugccacuu

SEQ ID NO: 2875890 - RNA, 19 nt, Human
gcugccuguucagcuccag

SEQ ID NO: 2875891 - RNA, 18 nt, Human
gcugccuguucagcucca

SEQ ID NO: 2875892 - RNA, 12 nt, Human
gcugcccuggug

SEQ ID NO: 2875893 - RNA, 13 nt, Human
gcugcccuggugc

SEQ ID NO: 2875894 - RNA, 14 nt, Human
gcugcccuggugcu

SEQ ID NO: 2875895 - RNA, 15 nt, Human
gcugcccuggugcug

SEQ ID NO: 2875896 - RNA, 22 nt, Human
gcugccuguucagcuccagcuc

SEQ ID NO: 2875897 - RNA, 20 nt, Human
gcugccuguucagcuccagc

SEQ ID NO: 2875898 - RNA, 20 nt, Human
gcugccuuagaaccuuucuu

SEQ ID NO: 2875899 - RNA, 17 nt, Human
gcugcccuggugcugcc

SEQ ID NO: 2875900 - RNA, 15 nt, Human
gcugccuuagaaccu

SEQ ID NO: 2875901 - RNA, 15 nt, Human
gcugcgguccaccca

SEQ ID NO: 2875902 - RNA, 14 nt, Human
gcugcgguccaccc

SEQ ID NO: 2875903 - RNA, 21 nt, Human
gcugccuucccaugaaucugu

SEQ ID NO: 2875904 - RNA, 19 nt, Human
gcugccuucugacggcccu

SEQ ID NO: 2875905 - RNA, 20 nt, Human
gcugccuucugacggcccug

SEQ ID NO: 2875906 - RNA, 21 nt, Human
gcugccuucugacggcccugc

SEQ ID NO: 2875907 - RNA, 22 nt, Human
gcugccuucugacggcccugca

SEQ ID NO: 2875908 - RNA, 23 nt, Human
gcugccuucugacggcccugcaa

SEQ ID NO: 2875909 - RNA, 21 nt, Human
gcugcgguccacccaggagcc

SEQ ID NO: 2875910 - RNA, 22 nt, Human
gcugcgguccacccaggagccc

SEQ ID NO: 2875911 - RNA, 20 nt, Human
gcuggaaacagacucgauuc

SEQ ID NO: 2875912 - RNA, 16 nt, Human
gcuggaacagauucac

SEQ ID NO: 2875913 - RNA, 21 nt, Human
gcuggaacagauucacacugu

SEQ ID NO: 2875914 - RNA, 21 nt, Human
gcuggaaccugcaaaaaauac

SEQ ID NO: 2875915 - RNA, 13 nt, Human
gcuggaaggguca

SEQ ID NO: 2875916 - RNA, 23 nt, Human
gcuggaaugauuucagcucacug

SEQ ID NO: 2875917 - RNA, 22 nt, Human
gcugcuuuugucuaugggacuc

SEQ ID NO: 2875918 - RNA, 14 nt, Human
gcugcuuuuauauc

SEQ ID NO: 2875919 - RNA, 18 nt, Human
gcugcuuuuauaucugua

SEQ ID NO: 2875920 - RNA, 19 nt, Human
gcugcuuuuauaucuguau

SEQ ID NO: 2875921 - RNA, 22 nt, Human
gcugcuaccguugacuuccagg

SEQ ID NO: 2875922 - RNA, 10 nt, Human
gcugcuagaa

SEQ ID NO: 2875923 - RNA, 12 nt, Human
gcugcuagaacu

SEQ ID NO: 2875924 - RNA, 13 nt, Human
gcugcuagaacuu

SEQ ID NO: 2875925 - RNA, 14 nt, Human
gcugcuagaacuuu

SEQ ID NO: 2875926 - RNA, 15 nt, Human
gcugcuagaacuuuu

SEQ ID NO: 2875927 - RNA, 16 nt, Human
gcugcuagaacuuuuu

SEQ ID NO: 2875928 - RNA, 14 nt, Human
gcugcuacccagaa

SEQ ID NO: 2875929 - RNA, 12 nt, Human
gcugcuacccag

SEQ ID NO: 2875930 - RNA, 16 nt, Human
gcugcgugccccugcu

SEQ ID NO: 2875931 - RNA, 18 nt, Human
gcugcgugccccugcugc

SEQ ID NO: 2875932 - RNA, 15 nt, Human
gcuggaccuugaacu

SEQ ID NO: 2875933 - RNA, 16 nt, Human
gcuggacaugcugacu

SEQ ID NO: 2875934 - RNA, 20 nt, Human
gcuggaccaguggugccuug

SEQ ID NO: 2875935 - RNA, 13 nt, Human
gcuggacagaggg

SEQ ID NO: 2875936 - RNA, 14 nt, Human
gcuggacagagggg

SEQ ID NO: 2875937 - RNA, 21 nt, Human
gcuggacagaggggacucugg

SEQ ID NO: 2875938 - RNA, 22 nt, Human
gcuggacagaggggacucuggg

SEQ ID NO: 2875939 - RNA, 23 nt, Human
gcuggcagaaagggaacagaaag

SEQ ID NO: 2875940 - RNA, 16 nt, Human
gcuggcauuugcaccu

SEQ ID NO: 2875941 - RNA, 14 nt, Human
gcuggcagggcugg

SEQ ID NO: 2875942 - RNA, 13 nt, Human
gcuggccagccgc

SEQ ID NO: 2875943 - RNA, 14 nt, Human
gcuggccagccgcu

SEQ ID NO: 2875944 - RNA, 21 nt, Human
gcuggccagccgcucuccugc

SEQ ID NO: 2875945 - RNA, 12 nt, Human
gcuggccagccu

SEQ ID NO: 2875946 - RNA, 13 nt, Human
gcuggccagccug

SEQ ID NO: 2875947 - RNA, 14 nt, Human
gcuggccagccugg

SEQ ID NO: 2875948 - RNA, 15 nt, Human
gcuggccagccuggg

SEQ ID NO: 2875949 - RNA, 16 nt, Human
gcuggccagccugggg

SEQ ID NO: 2875950 - RNA, 21 nt, Human
gcuggccagccuggggccugg

SEQ ID NO: 2875951 - RNA, 22 nt, Human
gcuggccagccuggggccuggc

SEQ ID NO: 2875952 - RNA, 23 nt, Human
gcuggccagccuggggccuggca

SEQ ID NO: 2875953 - RNA, 14 nt, Human
gcuggcccagccaa

SEQ ID NO: 2875954 - RNA, 19 nt, Human
gcuggccgaggguccuggc

SEQ ID NO: 2875955 - RNA, 15 nt, Human
gcuggccgagggucc

SEQ ID NO: 2875956 - RNA, 19 nt, Human
gcuggcccuggcucccaca

SEQ ID NO: 2875957 - RNA, 24 nt, Human
gcuggccgaggguccuggcuccug

SEQ ID NO: 2875958 - RNA, 20 nt, Human
gcuggccgaggguccuggcu

SEQ ID NO: 2875959 - RNA, 16 nt, Human
gcuggcccugcccugg

SEQ ID NO: 2875960 - RNA, 15 nt, Human
gcuggcccugcccug

SEQ ID NO: 2875961 - RNA, 14 nt, Human
gcuggcccugcccu

SEQ ID NO: 2875962 - RNA, 13 nt, Human
gcuggcccugccc

SEQ ID NO: 2875963 - RNA, 23 nt, Human
gcuccagggaauccaagccucca

SEQ ID NO: 2875964 - RNA, 18 nt, Human
gcuccagggagauuuuga

SEQ ID NO: 2875965 - RNA, 21 nt, Human
gcuccagguggcucugaggug

SEQ ID NO: 2875966 - RNA, 16 nt, Human
gcuccagguggcucug

SEQ ID NO: 2875967 - RNA, 18 nt, Human
gcuccagguggcucugag

SEQ ID NO: 2875968 - RNA, 22 nt, Human
gcuccagggaauccaagccucc

SEQ ID NO: 2875969 - RNA, 21 nt, Human
gcuccagggaauccaagccuc

SEQ ID NO: 2875970 - RNA, 20 nt, Human
gcuccagggaauccaagccu

SEQ ID NO: 2875971 - RNA, 21 nt, Human
gcuccaggcaggcuaaggcgu

SEQ ID NO: 2875972 - RNA, 15 nt, Human
gcuccagguggcucu

SEQ ID NO: 2875973 - RNA, 21 nt, Human
gcuccagguaccuugaccuuu

SEQ ID NO: 2875974 - RNA, 11 nt, Human
gcucccaaggg

SEQ ID NO: 2875975 - RNA, 12 nt, Human
gcucccaaggga

SEQ ID NO: 2875976 - RNA, 23 nt, Human
gcucccaagggauggugcccugu

SEQ ID NO: 2875977 - RNA, 15 nt, Human
gcucccacaggcccu

SEQ ID NO: 2875978 - RNA, 23 nt, Human
gcuccgcuuucuacccagcgagc

SEQ ID NO: 2875979 - RNA, 22 nt, Human
gcuccgcuuucuacccagcgag

SEQ ID NO: 2875980 - RNA, 21 nt, Human
gcuccgcuuucuacccagcga

SEQ ID NO: 2875981 - RNA, 18 nt, Human
gcuccgcuuucuacccag

SEQ ID NO: 2875982 - RNA, 12 nt, Human
gcuccgcccuua

SEQ ID NO: 2875983 - RNA, 16 nt, Human
gcuccgcccuuagucc

SEQ ID NO: 2875984 - RNA, 20 nt, Human
gcuccgcccuuaguccccca

SEQ ID NO: 2875985 - RNA, 24 nt, Human
gcuccaggcuccuuuagcgcccag

SEQ ID NO: 2875986 - RNA, 12 nt, Human
gcuccaggcucc

SEQ ID NO: 2875987 - RNA, 13 nt, Human
gcuccaggcaggc

SEQ ID NO: 2875988 - RNA, 15 nt, Human
gcuccaggccugcag

SEQ ID NO: 2875989 - RNA, 16 nt, Human
gcuccaggccugcagc

SEQ ID NO: 2875990 - RNA, 19 nt, Human
gcuccaggccugcagcagg

SEQ ID NO: 2875991 - RNA, 22 nt, Human
gcuccaggccugcagcaggagu

SEQ ID NO: 2875992 - RNA, 15 nt, Human
gcucaauaggaccag

SEQ ID NO: 2875993 - RNA, 15 nt, Human
gcuccaggcacccag

SEQ ID NO: 2875994 - RNA, 15 nt, Human
gcucauuuuuucuua

SEQ ID NO: 2875995 - RNA, 12 nt, Human
gcucauuucaug

SEQ ID NO: 2875996 - RNA, 11 nt, Human
gcucauuuaag

SEQ ID NO: 2875997 - RNA, 12 nt, Human
gcucauuuaagu

SEQ ID NO: 2875998 - RNA, 15 nt, Human
gcucauucauuuuau

SEQ ID NO: 2875999 - RNA, 17 nt, Human
gcucauucauuuuauau

SEQ ID NO: 2876000 - RNA, 18 nt, Human
gcucauucauuuuauauu

SEQ ID NO: 2876001 - RNA, 22 nt, Human
gcucauucauuuuauauugaaa

SEQ ID NO: 2876002 - RNA, 23 nt, Human
gcucauucauuuuauauugaaaa

SEQ ID NO: 2876003 - RNA, 15 nt, Human
gcuccuguccuccca

SEQ ID NO: 2876004 - RNA, 22 nt, Human
gcuccuguccucccauccccug

SEQ ID NO: 2876005 - RNA, 11 nt, Human
gcuccucccac

SEQ ID NO: 2876006 - RNA, 12 nt, Human
gcuccucccagc

SEQ ID NO: 2876007 - RNA, 13 nt, Human
gcuccucccagcu

SEQ ID NO: 2876008 - RNA, 23 nt, Human
gcuccucccagcuuguaggagcu

SEQ ID NO: 2876009 - RNA, 13 nt, Human
gcuccuguccucc

SEQ ID NO: 2876010 - RNA, 23 nt, Human
gcuccuggggguucuuucuuccu

SEQ ID NO: 2876011 - RNA, 14 nt, Human
gcuccucccggugc

SEQ ID NO: 2876012 - RNA, 24 nt, Human
gcuccgcuuucuacccagcgagcc

SEQ ID NO: 2876013 - RNA, 15 nt, Human
gcuccgcugccgugc

SEQ ID NO: 2876014 - RNA, 12 nt, Human
gcuccgcugcuc

SEQ ID NO: 2876015 - RNA, 14 nt, Human
gcuccgcugcuccu

SEQ ID NO: 2876016 - RNA, 19 nt, Human
gcuccgcugcuccuuggcu

SEQ ID NO: 2876017 - RNA, 22 nt, Human
gcuccgcugcuccuuggcuuac

SEQ ID NO: 2876018 - RNA, 23 nt, Human
gcuccguccaggagccugugccu

SEQ ID NO: 2876019 - RNA, 22 nt, Human
gcuccguccaggagccugugcc

SEQ ID NO: 2876020 - RNA, 21 nt, Human
gcuccucauccagggcucuga

SEQ ID NO: 2876021 - RNA, 19 nt, Human
gcuccucaugguggguuca

SEQ ID NO: 2876022 - RNA, 18 nt, Human
gcuccucauccagggcuc

SEQ ID NO: 2876023 - RNA, 14 nt, Human
gcuccucacauagc

SEQ ID NO: 2876024 - RNA, 14 nt, Human
gcuccucacugccc

SEQ ID NO: 2876025 - RNA, 16 nt, Human
gcuccucacugcccgc

SEQ ID NO: 2876026 - RNA, 18 nt, Human
gcuccucacugcccgcac

SEQ ID NO: 2876027 - RNA, 23 nt, Human
gcuccucacugcccgcacacccu

SEQ ID NO: 2876028 - RNA, 15 nt, Human
gcuccucacuguggu

SEQ ID NO: 2876029 - RNA, 15 nt, Human
gcuccuaagcuucaa

SEQ ID NO: 2876030 - RNA, 23 nt, Human
gcuccuuuacaaaagaaauaccu

SEQ ID NO: 2876031 - RNA, 20 nt, Human
gcucgauccaaauugugcuu

SEQ ID NO: 2876032 - RNA, 21 nt, Human
gcucgauccaaauugugcuuc

SEQ ID NO: 2876033 - RNA, 17 nt, Human
gcuccuuuagcgcccag

SEQ ID NO: 2876034 - RNA, 13 nt, Human
gcuccuucugucc

SEQ ID NO: 2876035 - RNA, 13 nt, Human
gcuccugugucuu

SEQ ID NO: 2876036 - RNA, 12 nt, Human
gcuccugugucu

SEQ ID NO: 2876037 - RNA, 17 nt, Human
gcuccuguuagcuccuc

SEQ ID NO: 2876038 - RNA, 18 nt, Human
gcuccuguuagcuccuca

SEQ ID NO: 2876039 - RNA, 22 nt, Human
gcuccuuccucugaggcugaaa

SEQ ID NO: 2876040 - RNA, 20 nt, Human
gcuccuuccucugaggcuga

SEQ ID NO: 2876041 - RNA, 13 nt, Human
gcuccuucccauc

SEQ ID NO: 2876042 - RNA, 18 nt, Human
gcuccuucccaucgcugu

SEQ ID NO: 2876043 - RNA, 18 nt, Human
gcuccuuccucugaggcu

SEQ ID NO: 2876044 - RNA, 20 nt, Human
gcuauaacuauguugauaaa

SEQ ID NO: 2876045 - RNA, 16 nt, Human
gcuauaccugugccuc

SEQ ID NO: 2876046 - RNA, 15 nt, Human
gcuauaccugugccu

SEQ ID NO: 2876047 - RNA, 17 nt, Human
gcuauaccugugccucg

SEQ ID NO: 2876048 - RNA, 11 nt, Human
gcuauauauau

SEQ ID NO: 2876049 - RNA, 13 nt, Human
gcuauauauauaa

SEQ ID NO: 2876050 - RNA, 14 nt, Human
gcuauauauauaaa

SEQ ID NO: 2876051 - RNA, 15 nt, Human
gcuauauauauaaau

SEQ ID NO: 2876052 - RNA, 16 nt, Human
gcuauauauauaaaua

SEQ ID NO: 2876053 - RNA, 19 nt, Human
gcuauauauauaaauauuu

SEQ ID NO: 2876054 - RNA, 13 nt, Human
gcuauaguauuug

SEQ ID NO: 2876055 - RNA, 14 nt, Human
gcuauaguauuuga

SEQ ID NO: 2876056 - RNA, 16 nt, Human
gcuauaguauuugauu

SEQ ID NO: 2876057 - RNA, 20 nt, Human
gcuauaguauuugauucaaa

SEQ ID NO: 2876058 - RNA, 19 nt, Human
gcuauauugcccaggcugg

SEQ ID NO: 2876059 - RNA, 20 nt, Human
gcuauccugccaaaaucauu

SEQ ID NO: 2876060 - RNA, 20 nt, Human
gcuaucaaagaauaagaaaa

SEQ ID NO: 2876061 - RNA, 13 nt, Human
gcuaucaagaggc

SEQ ID NO: 2876062 - RNA, 19 nt, Human
gcuaucaagaggcugagac

SEQ ID NO: 2876063 - RNA, 20 nt, Human
gcuaucaagaggcugagaca

SEQ ID NO: 2876064 - RNA, 18 nt, Human
gcuagaguccucacuccc

SEQ ID NO: 2876065 - RNA, 20 nt, Human
gcuagaguccucacucccag

SEQ ID NO: 2876066 - RNA, 13 nt, Human
gcuagauaaaagc

SEQ ID NO: 2876067 - RNA, 19 nt, Human
gcuagaucauuuguucugg

SEQ ID NO: 2876068 - RNA, 21 nt, Human
gcuaguugggcuuccucauag

SEQ ID NO: 2876069 - RNA, 17 nt, Human
gcggguuccgcaggcag

SEQ ID NO: 2876070 - RNA, 22 nt, Human
gcucaaguccucuuuucugaga

SEQ ID NO: 2876071 - RNA, 19 nt, Human
gcucaaguccucuuuucug

SEQ ID NO: 2876072 - RNA, 15 nt, Human
gcucaagggacaagg

SEQ ID NO: 2876073 - RNA, 19 nt, Human
gcucaagggacaaggacac

SEQ ID NO: 2876074 - RNA, 20 nt, Human
gcucaaggaaaggccugaaa

SEQ ID NO: 2876075 - RNA, 19 nt, Human
gcucaaggaaaggccugaa

SEQ ID NO: 2876076 - RNA, 21 nt, Human
gcucaaguguucacaaccugg

SEQ ID NO: 2876077 - RNA, 12 nt, Human
gcucaaguucau

SEQ ID NO: 2876078 - RNA, 14 nt, Human
gcucaauaaagauu

SEQ ID NO: 2876079 - RNA, 16 nt, Human
gcucaaucaagaaaau

SEQ ID NO: 2876080 - RNA, 15 nt, Human
gcucacaccaaauuu

SEQ ID NO: 2876081 - RNA, 14 nt, Human
gcucacaccuguaa

SEQ ID NO: 2876082 - RNA, 16 nt, Human
gcucaauccucuaagc

SEQ ID NO: 2876083 - RNA, 14 nt, Human
gcucaauccucuaa

SEQ ID NO: 2876084 - RNA, 14 nt, Human
gcucacaaaccaug

SEQ ID NO: 2876085 - RNA, 17 nt, Human
gcucaauggacuggaag

SEQ ID NO: 2876086 - RNA, 18 nt, Human
gcucaaguccucuuuucu

SEQ ID NO: 2876087 - RNA, 18 nt, Human
gcucaagcgauucuccug

SEQ ID NO: 2876088 - RNA, 17 nt, Human
gcucaaggaaaggccug

SEQ ID NO: 2876089 - RNA, 19 nt, Human
gcucaagcaggaaguucaa

SEQ ID NO: 2876090 - RNA, 14 nt, Human
gcuaucuaaaguuu

SEQ ID NO: 2876091 - RNA, 15 nt, Human
gcuauccuggcucuu

SEQ ID NO: 2876092 - RNA, 19 nt, Human
gcuaucggggaagccagac

SEQ ID NO: 2876093 - RNA, 15 nt, Human
gcucaccagccccag

SEQ ID NO: 2876094 - RNA, 14 nt, Human
gcucaccagcccca

SEQ ID NO: 2876095 - RNA, 13 nt, Human
gcucaccagcccc

SEQ ID NO: 2876096 - RNA, 12 nt, Human
gcucaccagccc

SEQ ID NO: 2876097 - RNA, 16 nt, Human
gcucacauaucuguca

SEQ ID NO: 2876098 - RNA, 13 nt, Human
gcucacagcugug

SEQ ID NO: 2876099 - RNA, 15 nt, Human
gcucacaguacagca

SEQ ID NO: 2876100 - RNA, 20 nt, Human
gcucacaguacagcaugugc

SEQ ID NO: 2876101 - RNA, 22 nt, Human
gcucacaguacagcaugugccu

SEQ ID NO: 2876102 - RNA, 22 nt, Human
gcucacagaacccuuggagcca

SEQ ID NO: 2876103 - RNA, 13 nt, Human
gcucacaccugua

SEQ ID NO: 2876104 - RNA, 15 nt, Human
gcucagcccucccug

SEQ ID NO: 2876105 - RNA, 16 nt, Human
gcucagcccucccugc

SEQ ID NO: 2876106 - RNA, 12 nt, Human
gcucagcccucc

SEQ ID NO: 2876107 - RNA, 18 nt, Human
gcucagccccgagcuguc

SEQ ID NO: 2876108 - RNA, 19 nt, Human
gcucagccccgagcugucc

SEQ ID NO: 2876109 - RNA, 20 nt, Human
gcucagccccgagcuguccc

SEQ ID NO: 2876110 - RNA, 23 nt, Human
gcucagcggggacagcuccuucu

SEQ ID NO: 2876111 - RNA, 19 nt, Human
gcucagcggggacagcucc

SEQ ID NO: 2876112 - RNA, 18 nt, Human
gcucagcggggacagcuc

SEQ ID NO: 2876113 - RNA, 17 nt, Human
gcucagcggggacagcu

SEQ ID NO: 2876114 - RNA, 16 nt, Human
gcucagcggggacagc

SEQ ID NO: 2876115 - RNA, 17 nt, Human
gcucagcccucccugcc

SEQ ID NO: 2876116 - RNA, 18 nt, Human
gcucagcccucccugccc

SEQ ID NO: 2876117 - RNA, 19 nt, Human
gcucagcccucccugcccc

SEQ ID NO: 2876118 - RNA, 21 nt, Human
gcucagcccucccugccccuc

SEQ ID NO: 2876119 - RNA, 16 nt, Human
gcucaucucuguccca

SEQ ID NO: 2876120 - RNA, 13 nt, Human
gcucaucuguugu

SEQ ID NO: 2876121 - RNA, 22 nt, Human
gcucaucucugucccacuuggc

SEQ ID NO: 2876122 - RNA, 19 nt, Human
gcucagcucggggagccuu

SEQ ID NO: 2876123 - RNA, 20 nt, Human
gcucagcuacugauuuuugu

SEQ ID NO: 2876124 - RNA, 21 nt, Human
gcucagcuuuuugucuuuucu

SEQ ID NO: 2876125 - RNA, 14 nt, Human
gcucauauuuugua

SEQ ID NO: 2876126 - RNA, 18 nt, Human
gcucauauuuuguauaua

SEQ ID NO: 2876127 - RNA, 18 nt, Human
gccugaagucacacagug

SEQ ID NO: 2876128 - RNA, 17 nt, Human
gccugaagucacacagu

SEQ ID NO: 2876129 - RNA, 16 nt, Human
gccugaagucacacag

SEQ ID NO: 2876130 - RNA, 15 nt, Human
gccugaagucacaca

SEQ ID NO: 2876131 - RNA, 21 nt, Human
gcccaguuggguggaugccug

SEQ ID NO: 2876132 - RNA, 19 nt, Human
gcccaguuggguggaugcc

SEQ ID NO: 2876133 - RNA, 17 nt, Human
gccugagccuggccagc

SEQ ID NO: 2876134 - RNA, 16 nt, Human
gccugagccuggccag

SEQ ID NO: 2876135 - RNA, 14 nt, Human
gccugagccuggcc

SEQ ID NO: 2876136 - RNA, 23 nt, Human
gccugagcucacucggcacccug

SEQ ID NO: 2876137 - RNA, 14 nt, Human
gccugagcucacuc

SEQ ID NO: 2876138 - RNA, 17 nt, Human
gccugagcucacucggc

SEQ ID NO: 2876139 - RNA, 14 nt, Human
gccugaggcugaga

SEQ ID NO: 2876140 - RNA, 13 nt, Human
gccugaggcugag

SEQ ID NO: 2876141 - RNA, 13 nt, Human
gccugaggcuggg

SEQ ID NO: 2876142 - RNA, 18 nt, Human
gccugaggcugagacugc

SEQ ID NO: 2876143 - RNA, 17 nt, Human
gccugaggcugagacug

SEQ ID NO: 2876144 - RNA, 15 nt, Human
gccugaggcugagac

SEQ ID NO: 2876145 - RNA, 14 nt, Human
gccugaggcuggga

SEQ ID NO: 2876146 - RNA, 22 nt, Human
gccugcaggaccugccuguagc

SEQ ID NO: 2876147 - RNA, 16 nt, Human
gccuggauuucugguu

SEQ ID NO: 2876148 - RNA, 22 nt, Human
gccuggauuucugguucugaug

SEQ ID NO: 2876149 - RNA, 23 nt, Human
gccuggauuucugguucugaugc

SEQ ID NO: 2876150 - RNA, 13 nt, Human
gccuggcacaggg

SEQ ID NO: 2876151 - RNA, 14 nt, Human
gccuggcacagggc

SEQ ID NO: 2876152 - RNA, 13 nt, Human
gccuggcacacau

SEQ ID NO: 2876153 - RNA, 16 nt, Human
gccuggcacacaucag

SEQ ID NO: 2876154 - RNA, 13 nt, Human
gccuggcacagga

SEQ ID NO: 2876155 - RNA, 15 nt, Human
gccuggcacaggacu

SEQ ID NO: 2876156 - RNA, 16 nt, Human
gccuggcacaggacug

SEQ ID NO: 2876157 - RNA, 17 nt, Human
gccuggcacaggacuga

SEQ ID NO: 2876158 - RNA, 21 nt, Human
gccuggacaguaucccacauc

SEQ ID NO: 2876159 - RNA, 22 nt, Human
gccuggacaguaucccacaucc

SEQ ID NO: 2876160 - RNA, 20 nt, Human
gccuggacauuugccuugcu

SEQ ID NO: 2876161 - RNA, 11 nt, Human
gccugcugcau

SEQ ID NO: 2876162 - RNA, 10 nt, Human
gccugcugca

SEQ ID NO: 2876163 - RNA, 18 nt, Human
gccugcugcauggggugg

SEQ ID NO: 2876164 - RNA, 13 nt, Human
gccugcugcccag

SEQ ID NO: 2876165 - RNA, 18 nt, Human
gccugcugcccaggcugu

SEQ ID NO: 2876166 - RNA, 14 nt, Human
gccuggaagacaga

SEQ ID NO: 2876167 - RNA, 15 nt, Human
gccuggaagacagag

SEQ ID NO: 2876168 - RNA, 22 nt, Human
gccuggaagacagagaccuccu

SEQ ID NO: 2876169 - RNA, 23 nt, Human
gccuggaagacagagaccuccug

SEQ ID NO: 2876170 - RNA, 16 nt, Human
gccuggaagcuuuguc

SEQ ID NO: 2876171 - RNA, 22 nt, Human
gccuggaagcuuuguccccugc

SEQ ID NO: 2876172 - RNA, 13 nt, Human
gccuggaagacag

SEQ ID NO: 2876173 - RNA, 16 nt, Human
gccugcauguaaacac

SEQ ID NO: 2876174 - RNA, 23 nt, Human
gccugcaucccaggaugcugggu

SEQ ID NO: 2876175 - RNA, 17 nt, Human
gccugcaguccuggaag

SEQ ID NO: 2876176 - RNA, 24 nt, Human
gccugcaguuaauuagcauucugg

SEQ ID NO: 2876177 - RNA, 13 nt, Human
gccugguccaugc

SEQ ID NO: 2876178 - RNA, 20 nt, Human
gccugguccaugcagggggc

SEQ ID NO: 2876179 - RNA, 17 nt, Human
gccuggucacagggcau

SEQ ID NO: 2876180 - RNA, 18 nt, Human
gccuggucaggcccuggu

SEQ ID NO: 2876181 - RNA, 20 nt, Human
gccuguaauucaguguauuu

SEQ ID NO: 2876182 - RNA, 11 nt, Human
gccuguacagu

SEQ ID NO: 2876183 - RNA, 12 nt, Human
gccuguacaguc

SEQ ID NO: 2876184 - RNA, 13 nt, Human
gccuguacagucu

SEQ ID NO: 2876185 - RNA, 15 nt, Human
gccuguacagucugu

SEQ ID NO: 2876186 - RNA, 17 nt, Human
gccuguacagucugucu

SEQ ID NO: 2876187 - RNA, 20 nt, Human
gccuguacagucugucuucu

SEQ ID NO: 2876188 - RNA, 21 nt, Human
gccuguacagucugucuucug

SEQ ID NO: 2876189 - RNA, 22 nt, Human
gccuguacagucugucuucugu

SEQ ID NO: 2876190 - RNA, 18 nt, Human
gccugucucauccccagg

SEQ ID NO: 2876191 - RNA, 17 nt, Human
gccugucucauccccag

SEQ ID NO: 2876192 - RNA, 22 nt, Human
gccugucucauccccagggguc

SEQ ID NO: 2876193 - RNA, 19 nt, Human
gccugucucauccccaggg

SEQ ID NO: 2876194 - RNA, 19 nt, Human
gccugucucuuuaagggca

SEQ ID NO: 2876195 - RNA, 15 nt, Human
gccugucugagacuc

SEQ ID NO: 2876196 - RNA, 23 nt, Human
gccugucugagacucacaggaag

SEQ ID NO: 2876197 - RNA, 21 nt, Human
gccugggccuccucacaacau

SEQ ID NO: 2876198 - RNA, 20 nt, Human
gccugggcgacagagcgaga

SEQ ID NO: 2876199 - RNA, 21 nt, Human
gccugggcugaccccgguggc

SEQ ID NO: 2876200 - RNA, 12 nt, Human
gccugggcuagg

SEQ ID NO: 2876201 - RNA, 20 nt, Human
gccuggguuuaaggggagag

SEQ ID NO: 2876202 - RNA, 13 nt, Human
gccuggggccuga

SEQ ID NO: 2876203 - RNA, 14 nt, Human
gccuggggccugag

SEQ ID NO: 2876204 - RNA, 15 nt, Human
gccuggggccugaga

SEQ ID NO: 2876205 - RNA, 16 nt, Human
gccuggggccugagag

SEQ ID NO: 2876206 - RNA, 17 nt, Human
gccuggggccugagaga

SEQ ID NO: 2876207 - RNA, 18 nt, Human
gccuggggccugagagaa

SEQ ID NO: 2876208 - RNA, 13 nt, Human
gccuggggccugg

SEQ ID NO: 2876209 - RNA, 14 nt, Human
gccuggggccuggc

SEQ ID NO: 2876210 - RNA, 15 nt, Human
gccuggggccuggca

SEQ ID NO: 2876211 - RNA, 17 nt, Human
gccuggggccuggcagg

SEQ ID NO: 2876212 - RNA, 17 nt, Human
gccugguauggcugcag

SEQ ID NO: 2876213 - RNA, 23 nt, Human
gccugguaggaaagggcaagucu

SEQ ID NO: 2876214 - RNA, 22 nt, Human
gccuggccagaugcaccagccc

SEQ ID NO: 2876215 - RNA, 21 nt, Human
gccuggccagaugcaccagcc

SEQ ID NO: 2876216 - RNA, 16 nt, Human
gccuggccagaugcac

SEQ ID NO: 2876217 - RNA, 22 nt, Human
gccuggcagccgugccuucagc

SEQ ID NO: 2876218 - RNA, 20 nt, Human
gccuggccagaugcaccagc

SEQ ID NO: 2876219 - RNA, 18 nt, Human
gccuggcacagggcagug

SEQ ID NO: 2876220 - RNA, 19 nt, Human
gccuggcacagggcagugg

SEQ ID NO: 2876221 - RNA, 14 nt, Human
gccuggcacacauc

SEQ ID NO: 2876222 - RNA, 12 nt, Human
gccuggcagccg

SEQ ID NO: 2876223 - RNA, 20 nt, Human
gccuggcagccgugccuuca

SEQ ID NO: 2876224 - RNA, 21 nt, Human
gccuggcagccgugccuucag

SEQ ID NO: 2876225 - RNA, 14 nt, Human
gccuggcccauaga

SEQ ID NO: 2876226 - RNA, 19 nt, Human
gccuggcccauagaaacau

SEQ ID NO: 2876227 - RNA, 20 nt, Human
gccugggccccagcucgcgg

SEQ ID NO: 2876228 - RNA, 15 nt, Human
gccugggccccagcu

SEQ ID NO: 2876229 - RNA, 13 nt, Human
gccugggccagag

SEQ ID NO: 2876230 - RNA, 23 nt, Human
gccugggcagccaggcugccaag

SEQ ID NO: 2876231 - RNA, 20 nt, Human
gccugggcagccaggcugcc

SEQ ID NO: 2876232 - RNA, 18 nt, Human
gccugggcagccaggcug

SEQ ID NO: 2876233 - RNA, 17 nt, Human
gccugggcagccaggcu

SEQ ID NO: 2876234 - RNA, 19 nt, Human
gccugggcagcauagcaag

SEQ ID NO: 2876235 - RNA, 13 nt, Human
gccugggcagcau

SEQ ID NO: 2876236 - RNA, 13 nt, Human
gccuuccucucuc

SEQ ID NO: 2876237 - RNA, 16 nt, Human
gccuuccucucuccag

SEQ ID NO: 2876238 - RNA, 17 nt, Human
gccuuccucucuccaga

SEQ ID NO: 2876239 - RNA, 18 nt, Human
gccuuccucucuccagau

SEQ ID NO: 2876240 - RNA, 18 nt, Human
gccuugguucccuugugu

SEQ ID NO: 2876241 - RNA, 14 nt, Human
gccuugucuccuac

SEQ ID NO: 2876242 - RNA, 19 nt, Human
gccuugucuccuacuccug

SEQ ID NO: 2876243 - RNA, 20 nt, Human
gccuugucuccuacuccuga

SEQ ID NO: 2876244 - RNA, 23 nt, Human
gccuugucuccuacuccugacuc

SEQ ID NO: 2876245 - RNA, 13 nt, Human
gccuuguguauau

SEQ ID NO: 2876246 - RNA, 17 nt, Human
gccuugugcuguuaaua

SEQ ID NO: 2876247 - RNA, 20 nt, Human
gccuuccgccccuucccuuc

SEQ ID NO: 2876248 - RNA, 15 nt, Human
gccuuaauacuuuuu

SEQ ID NO: 2876249 - RNA, 23 nt, Human
gccuuaauacuuuuuuauuuugu

SEQ ID NO: 2876250 - RNA, 15 nt, Human
gccuuccuaagccug

SEQ ID NO: 2876251 - RNA, 17 nt, Human
gccuuccuaagccugug

SEQ ID NO: 2876252 - RNA, 18 nt, Human
gccuuccuaagccugugg

SEQ ID NO: 2876253 - RNA, 19 nt, Human
gccuuccuaagccuguggc

SEQ ID NO: 2876254 - RNA, 20 nt, Human
gccuuccuaagccuguggcu

SEQ ID NO: 2876255 - RNA, 21 nt, Human
gccuuccuaagccuguggcug

SEQ ID NO: 2876256 - RNA, 22 nt, Human
gccuuccuaagccuguggcugu

SEQ ID NO: 2876257 - RNA, 14 nt, Human
gccuuaagcugauc

SEQ ID NO: 2876258 - RNA, 16 nt, Human
gccuuaagcugauccu

SEQ ID NO: 2876259 - RNA, 18 nt, Human
gccuuaagcugauccugc

SEQ ID NO: 2876260 - RNA, 16 nt, Human
gccuuaaagaaagucg

SEQ ID NO: 2876261 - RNA, 13 nt, Human
gccuuaaaaugga

SEQ ID NO: 2876262 - RNA, 14 nt, Human
gccuuaaaauggaa

SEQ ID NO: 2876263 - RNA, 19 nt, Human
gccuuaaaauggaauugaa

SEQ ID NO: 2876264 - RNA, 22 nt, Human
gccuuaaaauggaauugaaaaa

SEQ ID NO: 2876265 - RNA, 15 nt, Human
gccugucugugaccu

SEQ ID NO: 2876266 - RNA, 16 nt, Human
gccugucugugaccug

SEQ ID NO: 2876267 - RNA, 22 nt, Human
gcgcaggcuggcccugcccugg

SEQ ID NO: 2876268 - RNA, 21 nt, Human
gcgcaggcuggcccugcccug

SEQ ID NO: 2876269 - RNA, 20 nt, Human
gcgcaggcuggcccugcccu

SEQ ID NO: 2876270 - RNA, 17 nt, Human
gcgcaggcuggcccugc

SEQ ID NO: 2876271 - RNA, 19 nt, Human
gcgcaggcuggcccugccc

SEQ ID NO: 2876272 - RNA, 18 nt, Human
gcgcaggcuggcccugcc

SEQ ID NO: 2876273 - RNA, 13 nt, Human
gccuuuccucucu

SEQ ID NO: 2876274 - RNA, 18 nt, Human
gccuuuccucucuccugu

SEQ ID NO: 2876275 - RNA, 21 nt, Human
gccuuucccaccgcccucccu

SEQ ID NO: 2876276 - RNA, 14 nt, Human
gccuuucugcaguu

SEQ ID NO: 2876277 - RNA, 19 nt, Human
gccuuucugcaguuuuuca

SEQ ID NO: 2876278 - RNA, 16 nt, Human
gcgaaggggcccuggu

SEQ ID NO: 2876279 - RNA, 16 nt, Human
gcgaaguagcuugcuc

SEQ ID NO: 2876280 - RNA, 20 nt, Human
gcgaaguagcuugcucccug

SEQ ID NO: 2876281 - RNA, 20 nt, Human
gcgaaguauauaaauuggcu

SEQ ID NO: 2876282 - RNA, 14 nt, Human
gcgaaguccuaugg

SEQ ID NO: 2876283 - RNA, 17 nt, Human
gcgaaguccuauggaaa

SEQ ID NO: 2876284 - RNA, 15 nt, Human
gcgaaggggcccugg

SEQ ID NO: 2876285 - RNA, 14 nt, Human
gcgaaggggcccug

SEQ ID NO: 2876286 - RNA, 13 nt, Human
gcgaauccaagcu

SEQ ID NO: 2876287 - RNA, 15 nt, Human
gcgaauccaagcucc

SEQ ID NO: 2876288 - RNA, 18 nt, Human
gcgaauccaagcucccug

SEQ ID NO: 2876289 - RNA, 21 nt, Human
gcgaauccaagcucccugccc

SEQ ID NO: 2876290 - RNA, 22 nt, Human
gcgaauccaagcucccugcccc

SEQ ID NO: 2876291 - RNA, 22 nt, Human
gcgaauggacuuuggaagcagg

SEQ ID NO: 2876292 - RNA, 23 nt, Human
gcgcccaguuggguggaugccug

SEQ ID NO: 2876293 - RNA, 22 nt, Human
gcgcccaguccuuccaccucga

SEQ ID NO: 2876294 - RNA, 19 nt, Human
gcgcccaguccuuccaccu

SEQ ID NO: 2876295 - RNA, 14 nt, Human
gcgccccccuccca

SEQ ID NO: 2876296 - RNA, 15 nt, Human
gcgccccccucccag

SEQ ID NO: 2876297 - RNA, 16 nt, Human
gcgccccccucccaga

SEQ ID NO: 2876298 - RNA, 17 nt, Human
gcgccccccucccagag

SEQ ID NO: 2876299 - RNA, 18 nt, Human
gcgccccccucccagagg

SEQ ID NO: 2876300 - RNA, 16 nt, Human
gcgcccgccccugcag

SEQ ID NO: 2876301 - RNA, 17 nt, Human
gcgcccgccccugcagc

SEQ ID NO: 2876302 - RNA, 22 nt, Human
gcgcccgccccugcagcacgga

SEQ ID NO: 2876303 - RNA, 13 nt, Human
gcgccccuucccc

SEQ ID NO: 2876304 - RNA, 20 nt, Human
gcgcauccaaucucaaggaa

SEQ ID NO: 2876305 - RNA, 21 nt, Human
gcgcauccaaucucaaggaau

SEQ ID NO: 2876306 - RNA, 15 nt, Human
gcgccaccagcucug

SEQ ID NO: 2876307 - RNA, 22 nt, Human
gcgccacuacacuccagccuga

SEQ ID NO: 2876308 - RNA, 21 nt, Human
gcgccacuacacuccagccug

SEQ ID NO: 2876309 - RNA, 18 nt, Human
gcgccacucgcuuccccc

SEQ ID NO: 2876310 - RNA, 16 nt, Human
gcgccacucgcuuccc

SEQ ID NO: 2876311 - RNA, 24 nt, Human
gcgccacuacacuccagccugagc

SEQ ID NO: 2876312 - RNA, 16 nt, Human
gcgccuggccuccagg

SEQ ID NO: 2876313 - RNA, 17 nt, Human
gcgccuggccuccaggc

SEQ ID NO: 2876314 - RNA, 22 nt, Human
gcgccuggccuccaggcccguc

SEQ ID NO: 2876315 - RNA, 12 nt, Human
gcgccugugacc

SEQ ID NO: 2876316 - RNA, 16 nt, Human
gcgccugugaugcugg

SEQ ID NO: 2876317 - RNA, 15 nt, Human
gcgccugugcacaca

SEQ ID NO: 2876318 - RNA, 16 nt, Human
gcgccugugcacacac

SEQ ID NO: 2876319 - RNA, 17 nt, Human
gcgccugugcacacaca

SEQ ID NO: 2876320 - RNA, 22 nt, Human
gcgccuccuuccuugcuguccu

SEQ ID NO: 2876321 - RNA, 15 nt, Human
gcgccuccuuccuug

SEQ ID NO: 2876322 - RNA, 17 nt, Human
gcgccgcaaaccacacu

SEQ ID NO: 2876323 - RNA, 18 nt, Human
gcgcccuuuccccgacgc

SEQ ID NO: 2876324 - RNA, 12 nt, Human
gcgcccuuuccc

SEQ ID NO: 2876325 - RNA, 23 nt, Human
gcgcccuuuccccgacgcccacc

SEQ ID NO: 2876326 - RNA, 20 nt, Human
gcgcccuuggcuucugugau

SEQ ID NO: 2876327 - RNA, 16 nt, Human
gcgcccuuggcuucug

SEQ ID NO: 2876328 - RNA, 14 nt, Human
gcggggacagcucc

SEQ ID NO: 2876329 - RNA, 19 nt, Human
gcggagacggagucccacc

SEQ ID NO: 2876330 - RNA, 21 nt, Human
gcggaccccagcugugagccu

SEQ ID NO: 2876331 - RNA, 14 nt, Human
gcggaccccagcug

SEQ ID NO: 2876332 - RNA, 20 nt, Human
gcggaccccagcugugagcc

SEQ ID NO: 2876333 - RNA, 13 nt, Human
gcggaccccagcu

SEQ ID NO: 2876334 - RNA, 16 nt, Human
gcggacaucagcuggu

SEQ ID NO: 2876335 - RNA, 21 nt, Human
gcgccuugucuccuacuccug

SEQ ID NO: 2876336 - RNA, 22 nt, Human
gcgccuugucuccuacuccuga

SEQ ID NO: 2876337 - RNA, 14 nt, Human
gcgguccacccagg

SEQ ID NO: 2876338 - RNA, 13 nt, Human
gcgguccacccag

SEQ ID NO: 2876339 - RNA, 19 nt, Human
gcggugagaggggaacaga

SEQ ID NO: 2876340 - RNA, 17 nt, Human
gcggggacagcuccuuc

SEQ ID NO: 2876341 - RNA, 15 nt, Human
gcggggacagcuccu

SEQ ID NO: 2876342 - RNA, 19 nt, Human
gcggguggaucaccugagg

SEQ ID NO: 2876343 - RNA, 17 nt, Human
gcggacuccuccuuucu

SEQ ID NO: 2876344 - RNA, 19 nt, Human
gcggacuccuccuuucucc

SEQ ID NO: 2876345 - RNA, 23 nt, Human
ggcucacgccuaugaucccagca

SEQ ID NO: 2876346 - RNA, 21 nt, Human
ggcucacgccuaugaucccag

SEQ ID NO: 2876347 - RNA, 20 nt, Human
ggcucacgccuaugauccca

SEQ ID NO: 2876348 - RNA, 21 nt, Human
ggcuaucaaagaauaagaaaa

SEQ ID NO: 2876349 - RNA, 23 nt, Human
ggcucacaguacagcaugugccu

SEQ ID NO: 2876350 - RNA, 13 nt, Human
ggcuccaggcucc

SEQ ID NO: 2876351 - RNA, 12 nt, Human
ggcuccaggcuc

SEQ ID NO: 2876352 - RNA, 20 nt, Human
ggcuauagcuacaggaagca

SEQ ID NO: 2876353 - RNA, 22 nt, Human
ggcgggugccuguaaucccagc

SEQ ID NO: 2876354 - RNA, 13 nt, Human
ggcuagguacaca

SEQ ID NO: 2876355 - RNA, 15 nt, Human
ggcuagguagaaaaa

SEQ ID NO: 2876356 - RNA, 20 nt, Human
ggcuagguagaaaaaggguc

SEQ ID NO: 2876357 - RNA, 21 nt, Human
ggcuagguagaaaaaggguca

SEQ ID NO: 2876358 - RNA, 22 nt, Human
ggcgggcaccuauagucccagc

SEQ ID NO: 2876359 - RNA, 16 nt, Human
ggcgcuauuacaaaua

SEQ ID NO: 2876360 - RNA, 16 nt, Human
ggcgggagcaucucuu

SEQ ID NO: 2876361 - RNA, 18 nt, Human
ggcgcccuuggcuucugu

SEQ ID NO: 2876362 - RNA, 13 nt, Human
ggcgcccaccucc

SEQ ID NO: 2876363 - RNA, 14 nt, Human
ggcgcccaccuccc

SEQ ID NO: 2876364 - RNA, 15 nt, Human
ggcgcccaccucccc

SEQ ID NO: 2876365 - RNA, 24 nt, Human
ggcgcccaccuccccacgcccucc

SEQ ID NO: 2876366 - RNA, 13 nt, Human
ggcgccccugcca

SEQ ID NO: 2876367 - RNA, 15 nt, Human
ggcgccccugccacc

SEQ ID NO: 2876368 - RNA, 20 nt, Human
ggcgccccgcaccuguacag

SEQ ID NO: 2876369 - RNA, 21 nt, Human
ggcgccccgcaccuguacagu

SEQ ID NO: 2876370 - RNA, 22 nt, Human
ggcgccccugccaccucccuga

SEQ ID NO: 2876371 - RNA, 22 nt, Human
ggcuccccauguguccugguuc

SEQ ID NO: 2876372 - RNA, 17 nt, Human
ggcuccccauguguccu

SEQ ID NO: 2876373 - RNA, 21 nt, Human
ggcuccccauguguccugguu

SEQ ID NO: 2876374 - RNA, 14 nt, Human
ggcuccaggcuccu

SEQ ID NO: 2876375 - RNA, 14 nt, Human
ggcuccagaaaugu

SEQ ID NO: 2876376 - RNA, 19 nt, Human
ggcucccaugaccauacug

SEQ ID NO: 2876377 - RNA, 21 nt, Human
ggcucugccccagcucuggcu

SEQ ID NO: 2876378 - RNA, 20 nt, Human
ggcucugccccagcucuggc

SEQ ID NO: 2876379 - RNA, 14 nt, Human
ggcucugccccagc

SEQ ID NO: 2876380 - RNA, 16 nt, Human
ggcucugcaccccucu

SEQ ID NO: 2876381 - RNA, 19 nt, Human
ggcucugcaauuccccucu

SEQ ID NO: 2876382 - RNA, 20 nt, Human
ggcucugcaauuccccucug

SEQ ID NO: 2876383 - RNA, 12 nt, Human
ggcucugcccca

SEQ ID NO: 2876384 - RNA, 13 nt, Human
ggcucugccccag

SEQ ID NO: 2876385 - RNA, 17 nt, Human
ggcucugaggugccugu

SEQ ID NO: 2876386 - RNA, 19 nt, Human
ggcucugaggugccugucc

SEQ ID NO: 2876387 - RNA, 20 nt, Human
ggcucugaggugccuguccc

SEQ ID NO: 2876388 - RNA, 23 nt, Human
ggcucugaggugccugucccacc

SEQ ID NO: 2876389 - RNA, 20 nt, Human
ggcucugcaaugggcacugg

SEQ ID NO: 2876390 - RNA, 13 nt, Human
ggcucugaccagu

SEQ ID NO: 2876391 - RNA, 15 nt, Human
ggcucugagagucua

SEQ ID NO: 2876392 - RNA, 18 nt, Human
ggcucugagagucuagau

SEQ ID NO: 2876393 - RNA, 20 nt, Human
ggcucugagagucuagauuc

SEQ ID NO: 2876394 - RNA, 22 nt, Human
ggcucugagagucuagauucuc

SEQ ID NO: 2876395 - RNA, 16 nt, Human
ggcucugaagcaaggc

SEQ ID NO: 2876396 - RNA, 22 nt, Human
ggcucugaagcaaggcggugga

SEQ ID NO: 2876397 - RNA, 23 nt, Human
ggcucugaagcaaggcgguggac

SEQ ID NO: 2876398 - RNA, 12 nt, Human
ggcucucugagu

SEQ ID NO: 2876399 - RNA, 20 nt, Human
ggcucucugaguccuggccc

SEQ ID NO: 2876400 - RNA, 14 nt, Human
ggccuccucuucac

SEQ ID NO: 2876401 - RNA, 21 nt, Human
ggccuccucuucaccccggca

SEQ ID NO: 2876402 - RNA, 22 nt, Human
ggccuccucuucaccccggcag

SEQ ID NO: 2876403 - RNA, 23 nt, Human
ggccuccucuucaccccggcagg

SEQ ID NO: 2876404 - RNA, 14 nt, Human
ggccuccugugugu

SEQ ID NO: 2876405 - RNA, 16 nt, Human
ggccuccuugcuuguu

SEQ ID NO: 2876406 - RNA, 17 nt, Human
ggccuccuugcuuguua

SEQ ID NO: 2876407 - RNA, 13 nt, Human
ggccucucuagca

SEQ ID NO: 2876408 - RNA, 14 nt, Human
ggccucucucccuc

SEQ ID NO: 2876409 - RNA, 19 nt, Human
ggccucuccuuguggccug

SEQ ID NO: 2876410 - RNA, 19 nt, Human
ggccucuaccacaagggcu

SEQ ID NO: 2876411 - RNA, 23 nt, Human
ggccucucaccucugugccucug

SEQ ID NO: 2876412 - RNA, 22 nt, Human
ggccuccucacaacaugguguc

SEQ ID NO: 2876413 - RNA, 21 nt, Human
ggccuccguccaggagccugg

SEQ ID NO: 2876414 - RNA, 22 nt, Human
ggccucaagugauucuccugcc

SEQ ID NO: 2876415 - RNA, 14 nt, Human
ggccucaagugauu

SEQ ID NO: 2876416 - RNA, 13 nt, Human
ggcccagaggcug

SEQ ID NO: 2876417 - RNA, 14 nt, Human
ggcccagaggcuga

SEQ ID NO: 2876418 - RNA, 23 nt, Human
ggcccagaggcugaguuuucucu

SEQ ID NO: 2876419 - RNA, 14 nt, Human
ggcccagagcagga

SEQ ID NO: 2876420 - RNA, 16 nt, Human
ggcccagagcaggaag

SEQ ID NO: 2876421 - RNA, 15 nt, Human
ggccggcgagcccug

SEQ ID NO: 2876422 - RNA, 22 nt, Human
ggcccagaucuggucccuugca

SEQ ID NO: 2876423 - RNA, 18 nt, Human
ggccuaaaacuggccuga

SEQ ID NO: 2876424 - RNA, 20 nt, Human
ggccuaaaacuggccugacu

SEQ ID NO: 2876425 - RNA, 17 nt, Human
ggccgugggccuggggu

SEQ ID NO: 2876426 - RNA, 16 nt, Human
ggccguggggguugag

SEQ ID NO: 2876427 - RNA, 19 nt, Human
ggccguugauguuggcugg

SEQ ID NO: 2876428 - RNA, 21 nt, Human
ggccguugauguuggcuggga

SEQ ID NO: 2876429 - RNA, 14 nt, Human
ggccgugggccugg

SEQ ID NO: 2876430 - RNA, 14 nt, Human
ggccuaaaaucuug

SEQ ID NO: 2876431 - RNA, 15 nt, Human
ggccgggagccugau

SEQ ID NO: 2876432 - RNA, 22 nt, Human
ggccgggccuguacagucuguc

SEQ ID NO: 2876433 - RNA, 23 nt, Human
ggccgggccuguacagucugucu

SEQ ID NO: 2876434 - RNA, 22 nt, Human
ggccggcuucaugccagcuacu

SEQ ID NO: 2876435 - RNA, 19 nt, Human
ggccggcugugcucagaga

SEQ ID NO: 2876436 - RNA, 18 nt, Human
ggccggcgagcccugugg

SEQ ID NO: 2876437 - RNA, 17 nt, Human
ggccggcgagcccugug

SEQ ID NO: 2876438 - RNA, 16 nt, Human
ggccugagccuggcca

SEQ ID NO: 2876439 - RNA, 15 nt, Human
ggccugagccuggcc

SEQ ID NO: 2876440 - RNA, 18 nt, Human
ggccugagaggggaagcg

SEQ ID NO: 2876441 - RNA, 15 nt, Human
ggccugagacccagg

SEQ ID NO: 2876442 - RNA, 16 nt, Human
ggccugagacccagga

SEQ ID NO: 2876443 - RNA, 17 nt, Human
ggccugagacccaggac

SEQ ID NO: 2876444 - RNA, 18 nt, Human
ggccugagacccaggacu

SEQ ID NO: 2876445 - RNA, 20 nt, Human
ggccugagacccaggacucc

SEQ ID NO: 2876446 - RNA, 13 nt, Human
ggccugagagaau

SEQ ID NO: 2876447 - RNA, 21 nt, Human
ggccugagagaauuggcucaa

SEQ ID NO: 2876448 - RNA, 23 nt, Human
ggccugaaugcuuauagguggcc

SEQ ID NO: 2876449 - RNA, 18 nt, Human
ggcgccaccagcucugcc

SEQ ID NO: 2876450 - RNA, 17 nt, Human
ggcgccaccagcucugc

SEQ ID NO: 2876451 - RNA, 12 nt, Human
ggcgcccaccuc

SEQ ID NO: 2876452 - RNA, 16 nt, Human
ggcgccaccagcucug

SEQ ID NO: 2876453 - RNA, 11 nt, Human
ggcgcaggagg

SEQ ID NO: 2876454 - RNA, 16 nt, Human
ggccuguacagucugu

SEQ ID NO: 2876455 - RNA, 18 nt, Human
ggccuguacagucugucu

SEQ ID NO: 2876456 - RNA, 17 nt, Human
ggccugguugaagaaga

SEQ ID NO: 2876457 - RNA, 19 nt, Human
ggccugguugaagaagaug

SEQ ID NO: 2876458 - RNA, 23 nt, Human
ggccuggguggaucggccuccuc

SEQ ID NO: 2876459 - RNA, 21 nt, Human
ggccugagcguccagaaaugg

SEQ ID NO: 2876460 - RNA, 12 nt, Human
ggccuggcccug

SEQ ID NO: 2876461 - RNA, 13 nt, Human
ggccuggcccugc

SEQ ID NO: 2876462 - RNA, 14 nt, Human
ggccuggcccugcc

SEQ ID NO: 2876463 - RNA, 18 nt, Human
ggccuggcccugcccuga

SEQ ID NO: 2876464 - RNA, 19 nt, Human
ggccuggcccugcccugag

SEQ ID NO: 2876465 - RNA, 18 nt, Human
ggccugggguaccaagag

SEQ ID NO: 2876466 - RNA, 13 nt, Human
ggccugggcuagg

SEQ ID NO: 2876467 - RNA, 17 nt, Human
ggccugggcuaggggac

SEQ ID NO: 2876468 - RNA, 14 nt, Human
ggccugggccagag

SEQ ID NO: 2876469 - RNA, 11 nt, Human
ggccugggccc

SEQ ID NO: 2876470 - RNA, 23 nt, Human
gggacucaaugcacugacauugu

SEQ ID NO: 2876471 - RNA, 16 nt, Human
gggagccccagggucu

SEQ ID NO: 2876472 - RNA, 14 nt, Human
gggagccccagggu

SEQ ID NO: 2876473 - RNA, 21 nt, Human
gggagccccagggucuucccu

SEQ ID NO: 2876474 - RNA, 13 nt, Human
gggagccccaggg

SEQ ID NO: 2876475 - RNA, 12 nt, Human
gggagccccagg

SEQ ID NO: 2876476 - RNA, 19 nt, Human
gggacucaaugcacugaca

SEQ ID NO: 2876477 - RNA, 17 nt, Human
gggacucaaugcacuga

SEQ ID NO: 2876478 - RNA, 20 nt, Human
gggacgcuccgcugccgugc

SEQ ID NO: 2876479 - RNA, 20 nt, Human
gggacggucaguuugguguc

SEQ ID NO: 2876480 - RNA, 21 nt, Human
gggacgaagaagagccacagu

SEQ ID NO: 2876481 - RNA, 17 nt, Human
gggacgaagaagagcca

SEQ ID NO: 2876482 - RNA, 19 nt, Human
gggacgaagaagagccaca

SEQ ID NO: 2876483 - RNA, 20 nt, Human
gggacgaagaagagccacag

SEQ ID NO: 2876484 - RNA, 13 nt, Human
gggacccccgccc

SEQ ID NO: 2876485 - RNA, 20 nt, Human
gggacccauagaucuucuga

SEQ ID NO: 2876486 - RNA, 15 nt, Human
gggaccccaggccca

SEQ ID NO: 2876487 - RNA, 21 nt, Human
gggaccccaggcccacucagg

SEQ ID NO: 2876488 - RNA, 14 nt, Human
gggacccccgcccc

SEQ ID NO: 2876489 - RNA, 17 nt, Human
gggacccccgcccccug

SEQ ID NO: 2876490 - RNA, 18 nt, Human
gggacccccgcccccugc

SEQ ID NO: 2876491 - RNA, 19 nt, Human
gggacccccgcccccugcc

SEQ ID NO: 2876492 - RNA, 18 nt, Human
gggaccugguacccuccu

SEQ ID NO: 2876493 - RNA, 21 nt, Human
gggaccugguacccuccuggc

SEQ ID NO: 2876494 - RNA, 23 nt, Human
gggaccucucccagggucccugg

SEQ ID NO: 2876495 - RNA, 21 nt, Human
gggacccccgcccccugcccu

SEQ ID NO: 2876496 - RNA, 24 nt, Human
gggacccccgcccccugcccuccc

SEQ ID NO: 2876497 - RNA, 21 nt, Human
ggcuuuggagacuuucuuuaa

SEQ ID NO: 2876498 - RNA, 12 nt, Human
ggcuuuggauuu

SEQ ID NO: 2876499 - RNA, 22 nt, Human
ggcuuugauuaguuuucuuguu

SEQ ID NO: 2876500 - RNA, 23 nt, Human
gggaagugaagacuggaagcuaa

SEQ ID NO: 2876501 - RNA, 11 nt, Human
ggcuuuguguu

SEQ ID NO: 2876502 - RNA, 13 nt, Human
ggcuuuguguugu

SEQ ID NO: 2876503 - RNA, 15 nt, Human
gggaauccaagccuc

SEQ ID NO: 2876504 - RNA, 12 nt, Human
gggaaucacauc

SEQ ID NO: 2876505 - RNA, 12 nt, Human
gggaauauuuua

SEQ ID NO: 2876506 - RNA, 22 nt, Human
gggaauccaagccuccacagcg

SEQ ID NO: 2876507 - RNA, 21 nt, Human
gggaauccaagccuccacagc

SEQ ID NO: 2876508 - RNA, 18 nt, Human
gggaauccaagccuccac

SEQ ID NO: 2876509 - RNA, 19 nt, Human
gggaauccccgaaggugcu

SEQ ID NO: 2876510 - RNA, 22 nt, Human
gggaauccccgaaggugcugga

SEQ ID NO: 2876511 - RNA, 22 nt, Human
gggaaguugcauuccuuugucu

SEQ ID NO: 2876512 - RNA, 24 nt, Human
gggaauaaaauccuaagacacaaa

SEQ ID NO: 2876513 - RNA, 14 nt, Human
gggaauaaccuucc

SEQ ID NO: 2876514 - RNA, 16 nt, Human
gggaauauuguuucuu

SEQ ID NO: 2876515 - RNA, 21 nt, Human
gggacccaauguaggagcugc

SEQ ID NO: 2876516 - RNA, 12 nt, Human
gggacccaggcu

SEQ ID NO: 2876517 - RNA, 13 nt, Human
gggacccaggcuc

SEQ ID NO: 2876518 - RNA, 17 nt, Human
gggacccaggcuccgcc

SEQ ID NO: 2876519 - RNA, 19 nt, Human
gggacccaggcuccgcccu

SEQ ID NO: 2876520 - RNA, 22 nt, Human
gggacccaggcuccgcccuuag

SEQ ID NO: 2876521 - RNA, 13 nt, Human
gggaccauguguc

SEQ ID NO: 2876522 - RNA, 17 nt, Human
gggaccaugugucacuu

SEQ ID NO: 2876523 - RNA, 21 nt, Human
gggaauguuugccucugccuc

SEQ ID NO: 2876524 - RNA, 19 nt, Human
gggaauguuugccucugcc

SEQ ID NO: 2876525 - RNA, 22 nt, Human
gggaaucuaagagagcugccau

SEQ ID NO: 2876526 - RNA, 20 nt, Human
gggaauucucagugccaacu

SEQ ID NO: 2876527 - RNA, 18 nt, Human
gggacacaaaacuccgcc

SEQ ID NO: 2876528 - RNA, 19 nt, Human
gggacacaaaacuccgccc

SEQ ID NO: 2876529 - RNA, 20 nt, Human
gggacacaaaacuccgcccc

SEQ ID NO: 2876530 - RNA, 23 nt, Human
gggacacaaaacuccgcccccag

SEQ ID NO: 2876531 - RNA, 14 nt, Human
gggaggagaaugag

SEQ ID NO: 2876532 - RNA, 17 nt, Human
gggaggaucacuggagc

SEQ ID NO: 2876533 - RNA, 20 nt, Human
gggaggagguggcagcccug

SEQ ID NO: 2876534 - RNA, 22 nt, Human
gggaggauguucugggacacag

SEQ ID NO: 2876535 - RNA, 17 nt, Human
gggagugacagaggcag

SEQ ID NO: 2876536 - RNA, 15 nt, Human
gggaguccaggcaca

SEQ ID NO: 2876537 - RNA, 16 nt, Human
gggaguccaggcacag

SEQ ID NO: 2876538 - RNA, 17 nt, Human
gggaguccaggcacagg

SEQ ID NO: 2876539 - RNA, 19 nt, Human
gggaguccaggcacaggau

SEQ ID NO: 2876540 - RNA, 16 nt, Human
gggagucaccuucccu

SEQ ID NO: 2876541 - RNA, 15 nt, Human
gggagugcuggcuca

SEQ ID NO: 2876542 - RNA, 16 nt, Human
gggagugcuggcucac

SEQ ID NO: 2876543 - RNA, 19 nt, Human
gggagugcuggcucacagu

SEQ ID NO: 2876544 - RNA, 23 nt, Human
gggagugcuggcucacaguacag

SEQ ID NO: 2876545 - RNA, 23 nt, Human
gggaggaucacuggagcccagga

SEQ ID NO: 2876546 - RNA, 22 nt, Human
gggaggaucacuggagcccagg

SEQ ID NO: 2876547 - RNA, 19 nt, Human
gggaggaucacuggagccc

SEQ ID NO: 2876548 - RNA, 13 nt, Human
gggagguguucac

SEQ ID NO: 2876549 - RNA, 18 nt, Human
gggaggcaaguguggggg

SEQ ID NO: 2876550 - RNA, 22 nt, Human
gggagcugccuguucagcucca

SEQ ID NO: 2876551 - RNA, 21 nt, Human
gggagcugccuguucagcucc

SEQ ID NO: 2876552 - RNA, 13 nt, Human
gggagcugccugu

SEQ ID NO: 2876553 - RNA, 22 nt, Human
gggagcuccucuccuggaggau

SEQ ID NO: 2876554 - RNA, 20 nt, Human
gggagcuccucuccuggagg

SEQ ID NO: 2876555 - RNA, 21 nt, Human
gggagcuccucuccuggagga

SEQ ID NO: 2876556 - RNA, 16 nt, Human
gggaggaaagagagca

SEQ ID NO: 2876557 - RNA, 19 nt, Human
gggagcugguuagaaaugc

SEQ ID NO: 2876558 - RNA, 16 nt, Human
gggaggacaaaacuuc

SEQ ID NO: 2876559 - RNA, 23 nt, Human
gggaggacaaaacuucuugucag

SEQ ID NO: 2876560 - RNA, 12 nt, Human
gggaggacaggc

SEQ ID NO: 2876561 - RNA, 20 nt, Human
gggaggaccacaggugugag

SEQ ID NO: 2876562 - RNA, 23 nt, Human
gggaggaagcagguugaggggcu

SEQ ID NO: 2876563 - RNA, 19 nt, Human
gggaggaccugacccuacu

SEQ ID NO: 2876564 - RNA, 20 nt, Human
gggaggaccugacccuacuc

SEQ ID NO: 2876565 - RNA, 12 nt, Human
gggaggaccugg

SEQ ID NO: 2876566 - RNA, 13 nt, Human
gggaggaccuggg

SEQ ID NO: 2876567 - RNA, 16 nt, Human
gggaggaccuggggca

SEQ ID NO: 2876568 - RNA, 17 nt, Human
gggaggaccuggggcac

SEQ ID NO: 2876569 - RNA, 19 nt, Human
gggaggaccuggggcacag

SEQ ID NO: 2876570 - RNA, 22 nt, Human
gggagccuuugguucuggccag

SEQ ID NO: 2876571 - RNA, 18 nt, Human
gggagccuuagccgccca

SEQ ID NO: 2876572 - RNA, 18 nt, Human
gggagcuccucuccugga

SEQ ID NO: 2876573 - RNA, 12 nt, Human
gggagcucugca

SEQ ID NO: 2876574 - RNA, 16 nt, Human
gggagccuaggaccac

SEQ ID NO: 2876575 - RNA, 20 nt, Human
gggagccuaggaccacucag

SEQ ID NO: 2876576 - RNA, 23 nt, Human
gggagcccucaggcaccugcacu

SEQ ID NO: 2876577 - RNA, 21 nt, Human
gggagccuuugguucuggcca

SEQ ID NO: 2876578 - RNA, 21 nt, Human
gggagccugaucaccugcccu

SEQ ID NO: 2876579 - RNA, 18 nt, Human
ggcuuagcuuugcucugc

SEQ ID NO: 2876580 - RNA, 12 nt, Human
ggcuucacagau

SEQ ID NO: 2876581 - RNA, 15 nt, Human
ggcuucacuguauaa

SEQ ID NO: 2876582 - RNA, 18 nt, Human
ggcuucacuguauaaaua

SEQ ID NO: 2876583 - RNA, 19 nt, Human
ggcuucacuguauaaauag

SEQ ID NO: 2876584 - RNA, 21 nt, Human
ggcuucacuguauaaauagga

SEQ ID NO: 2876585 - RNA, 22 nt, Human
ggcuucacuguauaaauaggag

SEQ ID NO: 2876586 - RNA, 13 nt, Human
ggcuugccugcag

SEQ ID NO: 2876587 - RNA, 14 nt, Human
ggcuuucuggagag

SEQ ID NO: 2876588 - RNA, 13 nt, Human
ggcuuucuggaga

SEQ ID NO: 2876589 - RNA, 12 nt, Human
ggcuuucuggag

SEQ ID NO: 2876590 - RNA, 18 nt, Human
ggcuuggcguggagcagg

SEQ ID NO: 2876591 - RNA, 16 nt, Human
ggcuuggccuaucucc

SEQ ID NO: 2876592 - RNA, 17 nt, Human
ggcuuggccuaucuccu

SEQ ID NO: 2876593 - RNA, 14 nt, Human
ggcuugccugcagg

SEQ ID NO: 2876594 - RNA, 15 nt, Human
ggcuugccugcaggc

SEQ ID NO: 2876595 - RNA, 11 nt, Human
ggcuugcugcc

SEQ ID NO: 2876596 - RNA, 15 nt, Human
ggcuguuggcaguga

SEQ ID NO: 2876597 - RNA, 17 nt, Human
ggcuguuggcagugagu

SEQ ID NO: 2876598 - RNA, 20 nt, Human
ggcuguuggcugggggccuc

SEQ ID NO: 2876599 - RNA, 16 nt, Human
ggcuguuggcuggggg

SEQ ID NO: 2876600 - RNA, 15 nt, Human
ggcuguuggcugggg

SEQ ID NO: 2876601 - RNA, 14 nt, Human
ggcuguuggcuggg

SEQ ID NO: 2876602 - RNA, 17 nt, Human
ggcuguugaagucaccu

SEQ ID NO: 2876603 - RNA, 13 nt, Human
ggcuguucugcac

SEQ ID NO: 2876604 - RNA, 15 nt, Human
ggcuguucugcacug

SEQ ID NO: 2876605 - RNA, 17 nt, Human
ggcuguucugcacugaa

SEQ ID NO: 2876606 - RNA, 18 nt, Human
ggcuguucugcacugaaa

SEQ ID NO: 2876607 - RNA, 19 nt, Human
ggcuguucugcacugaaaa

SEQ ID NO: 2876608 - RNA, 21 nt, Human
ggcuguucugcacugaaaagg

SEQ ID NO: 2876609 - RNA, 20 nt, Human
ggcuggagaauguggagaac

SEQ ID NO: 2876610 - RNA, 16 nt, Human
ggcugugcugcccuga

SEQ ID NO: 2876611 - RNA, 13 nt, Human
ggcuguggagaca

SEQ ID NO: 2876612 - RNA, 21 nt, Human
ggcuguggagacaaugucugc

SEQ ID NO: 2876613 - RNA, 23 nt, Human
ggcuguggagacaaugucugcag

SEQ ID NO: 2876614 - RNA, 12 nt, Human
ggcuguggaagg

SEQ ID NO: 2876615 - RNA, 15 nt, Human
ggcugugcugcccug

SEQ ID NO: 2876616 - RNA, 14 nt, Human
ggcugugcugcccu

SEQ ID NO: 2876617 - RNA, 20 nt, Human
ggcugugcucccugguucug

SEQ ID NO: 2876618 - RNA, 13 nt, Human
ggcugugcucaga

SEQ ID NO: 2876619 - RNA, 14 nt, Human
ggcugugcucagag

SEQ ID NO: 2876620 - RNA, 15 nt, Human
ggcugugcucagaga

SEQ ID NO: 2876621 - RNA, 17 nt, Human
ggcugggggcaggaggg

SEQ ID NO: 2876622 - RNA, 16 nt, Human
ggcugggggcaggagg

SEQ ID NO: 2876623 - RNA, 18 nt, Human
ggcugggggcaggagggc

SEQ ID NO: 2876624 - RNA, 13 nt, Human
ggcugugccucug

SEQ ID NO: 2876625 - RNA, 16 nt, Human
ggcugugccucugccu

SEQ ID NO: 2876626 - RNA, 13 nt, Human
ggcugugaggccc

SEQ ID NO: 2876627 - RNA, 13 nt, Human
ggcuggaguacag

SEQ ID NO: 2876628 - RNA, 20 nt, Human
ggcuggaguacaguggugcc

SEQ ID NO: 2876629 - RNA, 15 nt, Human
ggcuggacguggugg

SEQ ID NO: 2876630 - RNA, 14 nt, Human
ggcugaggcaggag

SEQ ID NO: 2876631 - RNA, 20 nt, Human
ggcugaggaggccuccaucu

SEQ ID NO: 2876632 - RNA, 15 nt, Human
ggcugaggaggccuc

SEQ ID NO: 2876633 - RNA, 16 nt, Human
ggcugaggaggccucc

SEQ ID NO: 2876634 - RNA, 19 nt, Human
ggcugaggaggccuccauc

SEQ ID NO: 2876635 - RNA, 23 nt, Human
ggcucugccccagcucuggcuuc

SEQ ID NO: 2876636 - RNA, 21 nt, Human
ggcucugccccagucguuaga

SEQ ID NO: 2876637 - RNA, 17 nt, Human
ggcugggcaaggaggcc

SEQ ID NO: 2876638 - RNA, 23 nt, Human
ggcugggaguaguugucuuuccu

SEQ ID NO: 2876639 - RNA, 19 nt, Human
ggcugggcaaggaaaaaga

SEQ ID NO: 2876640 - RNA, 23 nt, Human
ggcugggcaaggaaaaagaaaau

SEQ ID NO: 2876641 - RNA, 19 nt, Human
ggcuggaguggaguggcgu

SEQ ID NO: 2876642 - RNA, 20 nt, Human
ggcuggagugcaguggugug

SEQ ID NO: 2876643 - RNA, 19 nt, Human
ggcuggagugcaguggcgu

SEQ ID NO: 2876644 - RNA, 20 nt, Human
ggcuggagugcaguggugca

SEQ ID NO: 2876645 - RNA, 15 nt, Human
ggcugggagcucugc

SEQ ID NO: 2876646 - RNA, 18 nt, Human
ggcugggcuucaguggca

SEQ ID NO: 2876647 - RNA, 17 nt, Human
ggcuggggaaguccucu

SEQ ID NO: 2876648 - RNA, 22 nt, Human
ggcugggcuucaguggcagcug

SEQ ID NO: 2876649 - RNA, 21 nt, Human
ggcugggcuucaguggcagcu

SEQ ID NO: 2876650 - RNA, 11 nt, Human
ggcugggcuuc

SEQ ID NO: 2876651 - RNA, 14 nt, Human
ggcugggggccuca

SEQ ID NO: 2876652 - RNA, 14 nt, Human
ggcugggggcagga

SEQ ID NO: 2876653 - RNA, 18 nt, Human
ggcuggggaaguccucug

SEQ ID NO: 2876654 - RNA, 21 nt, Human
ggcuggggaaguccucugggu

SEQ ID NO: 2876655 - RNA, 15 nt, Human
ggcuggggaggaccu

SEQ ID NO: 2876656 - RNA, 16 nt, Human
ggcuggggaggaccug

SEQ ID NO: 2876657 - RNA, 19 nt, Human
ggauucugggaggaagcag

SEQ ID NO: 2876658 - RNA, 21 nt, Human
ggauucugaggcccugcccaa

SEQ ID NO: 2876659 - RNA, 20 nt, Human
ggauugaacuucuuugaauu

SEQ ID NO: 2876660 - RNA, 22 nt, Human
ggauugaucuucagggcuguuu

SEQ ID NO: 2876661 - RNA, 22 nt, Human
ggcaacuuuccuuguuccccau

SEQ ID NO: 2876662 - RNA, 17 nt, Human
ggcaagcaccuccugcc

SEQ ID NO: 2876663 - RNA, 22 nt, Human
ggcaagagcccccuugacaccg

SEQ ID NO: 2876664 - RNA, 19 nt, Human
ggcaagagcccccuugaca

SEQ ID NO: 2876665 - RNA, 23 nt, Human
ggcaagagaaucgcuugaaccca

SEQ ID NO: 2876666 - RNA, 21 nt, Human
ggcaagcaggcgcugugcuau

SEQ ID NO: 2876667 - RNA, 13 nt, Human
ggcaccagccagc

SEQ ID NO: 2876668 - RNA, 14 nt, Human
ggcaccagccagcg

SEQ ID NO: 2876669 - RNA, 14 nt, Human
ggcaccagucccug

SEQ ID NO: 2876670 - RNA, 14 nt, Human
ggcaccaucucccu

SEQ ID NO: 2876671 - RNA, 18 nt, Human
ggcaccagucccuguccg

SEQ ID NO: 2876672 - RNA, 17 nt, Human
ggcaccagucccugucc

SEQ ID NO: 2876673 - RNA, 15 nt, Human
ggcaccagucccugu

SEQ ID NO: 2876674 - RNA, 19 nt, Human
ggcaagcaccuccugccuc

SEQ ID NO: 2876675 - RNA, 18 nt, Human
ggcaagcaccuccugccu

SEQ ID NO: 2876676 - RNA, 22 nt, Human
ggcaagcugugacuucuccagg

SEQ ID NO: 2876677 - RNA, 10 nt, Human
ggcaaggaaa

SEQ ID NO: 2876678 - RNA, 12 nt, Human
ggcaaggaaaaa

SEQ ID NO: 2876679 - RNA, 14 nt, Human
ggcaaggaaaaaga

SEQ ID NO: 2876680 - RNA, 17 nt, Human
ggcaaggaaaaagaaaa

SEQ ID NO: 2876681 - RNA, 19 nt, Human
ggcaaggaaaaagaaaaua

SEQ ID NO: 2876682 - RNA, 11 nt, Human
ggcaaggaaag

SEQ ID NO: 2876683 - RNA, 22 nt, Human
ggcaaggaaaggggagaaggga

SEQ ID NO: 2876684 - RNA, 16 nt, Human
ggcaaggacacagaug

SEQ ID NO: 2876685 - RNA, 23 nt, Human
ggcaagcugugacuucuccaggu

SEQ ID NO: 2876686 - RNA, 14 nt, Human
ggcaaggacacaga

SEQ ID NO: 2876687 - RNA, 21 nt, Human
ggcagagguugcagugagccg

SEQ ID NO: 2876688 - RNA, 15 nt, Human
ggcagagguuguagu

SEQ ID NO: 2876689 - RNA, 20 nt, Human
ggcagagguuguagugagcc

SEQ ID NO: 2876690 - RNA, 22 nt, Human
ggcagagguuguagugagccca

SEQ ID NO: 2876691 - RNA, 16 nt, Human
ggcagagccgggaagc

SEQ ID NO: 2876692 - RNA, 12 nt, Human
ggcagagcauuu

SEQ ID NO: 2876693 - RNA, 19 nt, Human
ggcacucagaagacacuga

SEQ ID NO: 2876694 - RNA, 18 nt, Human
ggcacucagaagacacug

SEQ ID NO: 2876695 - RNA, 17 nt, Human
ggcacccggccccugcu

SEQ ID NO: 2876696 - RNA, 20 nt, Human
ggcacccggccccugcuggu

SEQ ID NO: 2876697 - RNA, 19 nt, Human
ggcacccggccccugcugg

SEQ ID NO: 2876698 - RNA, 18 nt, Human
ggcacccggccccugcug

SEQ ID NO: 2876699 - RNA, 20 nt, Human
ggcacccaccaucaugucug

SEQ ID NO: 2876700 - RNA, 11 nt, Human
ggaugccuccu

SEQ ID NO: 2876701 - RNA, 13 nt, Human
ggauuauccugag

SEQ ID NO: 2876702 - RNA, 21 nt, Human
ggaugccugguggcagcugcg

SEQ ID NO: 2876703 - RNA, 20 nt, Human
ggaugccugguggcagcugc

SEQ ID NO: 2876704 - RNA, 19 nt, Human
ggaugccugguggcagcug

SEQ ID NO: 2876705 - RNA, 18 nt, Human
ggaugccugguggcagcu

SEQ ID NO: 2876706 - RNA, 21 nt, Human
ggauucaggaauguguggccu

SEQ ID NO: 2876707 - RNA, 13 nt, Human
ggauucaggcugc

SEQ ID NO: 2876708 - RNA, 15 nt, Human
ggauucaggcugcuu

SEQ ID NO: 2876709 - RNA, 14 nt, Human
ggauucaggcugcu

SEQ ID NO: 2876710 - RNA, 22 nt, Human
ggauucauucucauaauuccua

SEQ ID NO: 2876711 - RNA, 22 nt, Human
ggauucauugucucucacagau

SEQ ID NO: 2876712 - RNA, 17 nt, Human
ggauuauuuaauaacau

SEQ ID NO: 2876713 - RNA, 19 nt, Human
ggauuauuuaauaacauua

SEQ ID NO: 2876714 - RNA, 22 nt, Human
ggauuauuuaauaacauuaccu

SEQ ID NO: 2876715 - RNA, 15 nt, Human
ggauucgcuugaguu

SEQ ID NO: 2876716 - RNA, 13 nt, Human
ggauucugggagg

SEQ ID NO: 2876717 - RNA, 20 nt, Human
ggauucugaggcccugccca

SEQ ID NO: 2876718 - RNA, 12 nt, Human
ggauuccaugcu

SEQ ID NO: 2876719 - RNA, 13 nt, Human
ggauuccaugcua

SEQ ID NO: 2876720 - RNA, 23 nt, Human
ggagucccaccuuggcugcaggg

SEQ ID NO: 2876721 - RNA, 13 nt, Human
ggaguccccucac

SEQ ID NO: 2876722 - RNA, 15 nt, Human
ggaguccccucaccu

SEQ ID NO: 2876723 - RNA, 17 nt, Human
ggaugagcauggagcug

SEQ ID NO: 2876724 - RNA, 19 nt, Human
ggaugagcauggagcuggc

SEQ ID NO: 2876725 - RNA, 20 nt, Human
ggaugagcauggagcuggcc

SEQ ID NO: 2876726 - RNA, 23 nt, Human
ggaugagagcccagagguaacag

SEQ ID NO: 2876727 - RNA, 20 nt, Human
ggaugaggugguggagugga

SEQ ID NO: 2876728 - RNA, 17 nt, Human
ggaugccugguggcagc

SEQ ID NO: 2876729 - RNA, 13 nt, Human
ggaugccuggugg

SEQ ID NO: 2876730 - RNA, 17 nt, Human
ggaugccccgucccccu

SEQ ID NO: 2876731 - RNA, 17 nt, Human
ggaugccagggccgacc

SEQ ID NO: 2876732 - RNA, 22 nt, Human
ggaugccaauauuaaaucugcu

SEQ ID NO: 2876733 - RNA, 18 nt, Human
ggaugccacuccucccuc

SEQ ID NO: 2876734 - RNA, 19 nt, Human
ggaugccacuccucccucc

SEQ ID NO: 2876735 - RNA, 20 nt, Human
ggaugccacuccucccuccg

SEQ ID NO: 2876736 - RNA, 16 nt, Human
ggaugauucagaaauu

SEQ ID NO: 2876737 - RNA, 20 nt, Human
ggaugauucagaaauuggaa

SEQ ID NO: 2876738 - RNA, 21 nt, Human
ggaugauucagaaauuggaac

SEQ ID NO: 2876739 - RNA, 21 nt, Human
ggcagcugaacuauuggaggg

SEQ ID NO: 2876740 - RNA, 12 nt, Human
ggcagcugccac

SEQ ID NO: 2876741 - RNA, 21 nt, Human
ggcagcugcgguccacccagg

SEQ ID NO: 2876742 - RNA, 22 nt, Human
ggcagcugcuauuuauuuuccu

SEQ ID NO: 2876743 - RNA, 11 nt, Human
ggcagcugcua

SEQ ID NO: 2876744 - RNA, 24 nt, Human
ggcagcugcgguccacccaggagc

SEQ ID NO: 2876745 - RNA, 23 nt, Human
ggcagcugcgguccacccaggag

SEQ ID NO: 2876746 - RNA, 18 nt, Human
ggcagggucucacucugu

SEQ ID NO: 2876747 - RNA, 17 nt, Human
ggcagggucucacucug

SEQ ID NO: 2876748 - RNA, 11 nt, Human
ggcagucccuu

SEQ ID NO: 2876749 - RNA, 14 nt, Human
ggcaguaggccggu

SEQ ID NO: 2876750 - RNA, 13 nt, Human
ggcaugaccagau

SEQ ID NO: 2876751 - RNA, 12 nt, Human
ggcaguggaggu

SEQ ID NO: 2876752 - RNA, 16 nt, Human
ggcauguaggacccug

SEQ ID NO: 2876753 - RNA, 12 nt, Human
ggcaugagauag

SEQ ID NO: 2876754 - RNA, 21 nt, Human
ggcaugaguuacugugcauug

SEQ ID NO: 2876755 - RNA, 14 nt, Human
ggcaugcaccugca

SEQ ID NO: 2876756 - RNA, 16 nt, Human
ggcaugcaccugcaau

SEQ ID NO: 2876757 - RNA, 21 nt, Human
ggcaugcaccugcaaucccag

SEQ ID NO: 2876758 - RNA, 22 nt, Human
ggcaugccccggccaccucugc

SEQ ID NO: 2876759 - RNA, 23 nt, Human
ggcaugccucugauaugggacug

SEQ ID NO: 2876760 - RNA, 15 nt, Human
ggcaugccccggcca

SEQ ID NO: 2876761 - RNA, 18 nt, Human
ggcaugccccggccaccu

SEQ ID NO: 2876762 - RNA, 19 nt, Human
ggcaugccccggccaccuc

SEQ ID NO: 2876763 - RNA, 20 nt, Human
ggcaugccccggccaccucu

SEQ ID NO: 2876764 - RNA, 19 nt, Human
ggcaugguacggagauguu

SEQ ID NO: 2876765 - RNA, 21 nt, Human
ggcaugccccggccaccucug

SEQ ID NO: 2876766 - RNA, 16 nt, Human
ggcaugguaccagccc

SEQ ID NO: 2876767 - RNA, 17 nt, Human
ggcaugguaccagcccu

SEQ ID NO: 2876768 - RNA, 18 nt, Human
ggcaugguaccagcccug

SEQ ID NO: 2876769 - RNA, 19 nt, Human
ggcaugguaccagcccugg

SEQ ID NO: 2876770 - RNA, 20 nt, Human
ggcaugguaccagcccuggg

SEQ ID NO: 2876771 - RNA, 18 nt, Human
ggcccacaggaggcaagc

SEQ ID NO: 2876772 - RNA, 23 nt, Human
ggcccacaggaggcaagcaagcu

SEQ ID NO: 2876773 - RNA, 12 nt, Human
ggcccagagagg

SEQ ID NO: 2876774 - RNA, 16 nt, Human
ggccauggagagcugg

SEQ ID NO: 2876775 - RNA, 17 nt, Human
ggccauggagagcugga

SEQ ID NO: 2876776 - RNA, 13 nt, Human
ggcccacacacag

SEQ ID NO: 2876777 - RNA, 14 nt, Human
ggcccacacacagg

SEQ ID NO: 2876778 - RNA, 15 nt, Human
ggcccacacacaggu

SEQ ID NO: 2876779 - RNA, 14 nt, Human
ggccauggagagcu

SEQ ID NO: 2876780 - RNA, 13 nt, Human
ggccaugccugcc

SEQ ID NO: 2876781 - RNA, 14 nt, Human
ggccaugccugccc

SEQ ID NO: 2876782 - RNA, 15 nt, Human
ggccaggacugagcc

SEQ ID NO: 2876783 - RNA, 20 nt, Human
ggccaggacugagccccgca

SEQ ID NO: 2876784 - RNA, 13 nt, Human
ggccaggacugag

SEQ ID NO: 2876785 - RNA, 11 nt, Human
ggccaccugcc

SEQ ID NO: 2876786 - RNA, 12 nt, Human
ggccaccucugc

SEQ ID NO: 2876787 - RNA, 23 nt, Human
ggccaccucugcggaccccagcu

SEQ ID NO: 2876788 - RNA, 15 nt, Human
ggccacuuuugacua

SEQ ID NO: 2876789 - RNA, 13 nt, Human
ggccacuucuguc

SEQ ID NO: 2876790 - RNA, 14 nt, Human
ggccacuucugucc

SEQ ID NO: 2876791 - RNA, 15 nt, Human
ggccacuucugucca

SEQ ID NO: 2876792 - RNA, 21 nt, Human
ggccacuuuaagagagaaauc

SEQ ID NO: 2876793 - RNA, 15 nt, Human
ggccacacugugaca

SEQ ID NO: 2876794 - RNA, 17 nt, Human
ggccacacugugacaca

SEQ ID NO: 2876795 - RNA, 14 nt, Human
ggcauguuccucug

SEQ ID NO: 2876796 - RNA, 20 nt, Human
ggcauguucucugaggacac

SEQ ID NO: 2876797 - RNA, 14 nt, Human
ggcaugugggcuuc

SEQ ID NO: 2876798 - RNA, 20 nt, Human
ggccacaguagucuugauga

SEQ ID NO: 2876799 - RNA, 17 nt, Human
ggacagcuccuucuguc

SEQ ID NO: 2876800 - RNA, 16 nt, Human
ggacagcuccuucugu

SEQ ID NO: 2876801 - RNA, 15 nt, Human
ggacagcuccuucug

SEQ ID NO: 2876802 - RNA, 11 nt, Human
ggacagcuccu

SEQ ID NO: 2876803 - RNA, 22 nt, Human
ggacagccacggccaggccaga

SEQ ID NO: 2876804 - RNA, 17 nt, Human
ggacagaggccugcccg

SEQ ID NO: 2876805 - RNA, 12 nt, Human
ggacagagggga

SEQ ID NO: 2876806 - RNA, 13 nt, Human
ggacagaggggac

SEQ ID NO: 2876807 - RNA, 16 nt, Human
ggacagaggggacucu

SEQ ID NO: 2876808 - RNA, 18 nt, Human
ggacagaggggacucugg

SEQ ID NO: 2876809 - RNA, 19 nt, Human
ggacagaggggacucuggg

SEQ ID NO: 2876810 - RNA, 20 nt, Human
ggacagaggggacucugggc

SEQ ID NO: 2876811 - RNA, 23 nt, Human
ggacagaggggacucugggcuau

SEQ ID NO: 2876812 - RNA, 16 nt, Human
ggacagccccuccucc

SEQ ID NO: 2876813 - RNA, 15 nt, Human
ggacagccccuccuc

SEQ ID NO: 2876814 - RNA, 14 nt, Human
ggacagagccaugc

SEQ ID NO: 2876815 - RNA, 14 nt, Human
ggacagaggccugc

SEQ ID NO: 2876816 - RNA, 15 nt, Human
ggacagaggccugcc

SEQ ID NO: 2876817 - RNA, 16 nt, Human
ggacagaggccugccc

SEQ ID NO: 2876818 - RNA, 22 nt, Human
ggacagaaaggagaguggccau

SEQ ID NO: 2876819 - RNA, 15 nt, Human
gcuuuuauuaaauuu

SEQ ID NO: 2876820 - RNA, 17 nt, Human
gcuuuuauuaaauuugu

SEQ ID NO: 2876821 - RNA, 16 nt, Human
gcuuuuauaucuguau

SEQ ID NO: 2876822 - RNA, 18 nt, Human
gcuuuuauaucuguaugu

SEQ ID NO: 2876823 - RNA, 15 nt, Human
gcuuuuauuguauaa

SEQ ID NO: 2876824 - RNA, 15 nt, Human
gcuuuuauuuugaaa

SEQ ID NO: 2876825 - RNA, 16 nt, Human
gcuuuuauuuugaaaa

SEQ ID NO: 2876826 - RNA, 22 nt, Human
gcuuuuauuuugaaaagcuucu

SEQ ID NO: 2876827 - RNA, 18 nt, Human
gcuuuucaaacaagaaug

SEQ ID NO: 2876828 - RNA, 12 nt, Human
gcuuuucacugc

SEQ ID NO: 2876829 - RNA, 14 nt, Human
ggacacucagaccu

SEQ ID NO: 2876830 - RNA, 14 nt, Human
ggacacuccagugc

SEQ ID NO: 2876831 - RNA, 15 nt, Human
ggacacuccagugcc

SEQ ID NO: 2876832 - RNA, 16 nt, Human
ggacacuccagugcca

SEQ ID NO: 2876833 - RNA, 18 nt, Human
ggacacuccagugccagc

SEQ ID NO: 2876834 - RNA, 16 nt, Human
ggacacuuaauacuac

SEQ ID NO: 2876835 - RNA, 15 nt, Human
ggacacuccuagaga

SEQ ID NO: 2876836 - RNA, 21 nt, Human
ggacacuccagugccagcaau

SEQ ID NO: 2876837 - RNA, 14 nt, Human
ggacacuccuagag

SEQ ID NO: 2876838 - RNA, 13 nt, Human
ggagaagagagga

SEQ ID NO: 2876839 - RNA, 14 nt, Human
ggagaagagaggag

SEQ ID NO: 2876840 - RNA, 15 nt, Human
ggagaagagaggaga

SEQ ID NO: 2876841 - RNA, 16 nt, Human
ggagaagagaggagag

SEQ ID NO: 2876842 - RNA, 22 nt, Human
ggagaagagaggagaggagaga

SEQ ID NO: 2876843 - RNA, 12 nt, Human
ggacugagcccc

SEQ ID NO: 2876844 - RNA, 13 nt, Human
ggagaacuagaga

SEQ ID NO: 2876845 - RNA, 17 nt, Human
ggacugagggacucuga

SEQ ID NO: 2876846 - RNA, 15 nt, Human
ggacugagccccgca

SEQ ID NO: 2876847 - RNA, 13 nt, Human
ggacugagccugg

SEQ ID NO: 2876848 - RNA, 17 nt, Human
ggacugagccuggccca

SEQ ID NO: 2876849 - RNA, 21 nt, Human
ggacugagggacucugaagcc

SEQ ID NO: 2876850 - RNA, 19 nt, Human
ggagaagaguugaggaacu

SEQ ID NO: 2876851 - RNA, 20 nt, Human
ggagaagaguugaggaacug

SEQ ID NO: 2876852 - RNA, 17 nt, Human
ggagaagggaaguugaa

SEQ ID NO: 2876853 - RNA, 14 nt, Human
ggagaagggaugga

SEQ ID NO: 2876854 - RNA, 21 nt, Human
ggagaagggauggaggucaca

SEQ ID NO: 2876855 - RNA, 22 nt, Human
ggagacagccccagagcagggu

SEQ ID NO: 2876856 - RNA, 23 nt, Human
ggagacagccccagagcagggug

SEQ ID NO: 2876857 - RNA, 21 nt, Human
ggagacagccccagagcaggg

SEQ ID NO: 2876858 - RNA, 20 nt, Human
ggagacagccccagagcagg

SEQ ID NO: 2876859 - RNA, 23 nt, Human
ggacgcagcaggaggccaggccg

SEQ ID NO: 2876860 - RNA, 20 nt, Human
ggacgaagaagagccacagu

SEQ ID NO: 2876861 - RNA, 15 nt, Human
ggacgcuuugucugu

SEQ ID NO: 2876862 - RNA, 17 nt, Human
ggacugaaaaccucucc

SEQ ID NO: 2876863 - RNA, 16 nt, Human
ggacugaaaaccucuc

SEQ ID NO: 2876864 - RNA, 18 nt, Human
ggacugaaaaccucuccu

SEQ ID NO: 2876865 - RNA, 13 nt, Human
ggacugacagcau

SEQ ID NO: 2876866 - RNA, 20 nt, Human
ggacugacagcaugugcccu

SEQ ID NO: 2876867 - RNA, 21 nt, Human
ggacugacagcaugugcccuc

SEQ ID NO: 2876868 - RNA, 18 nt, Human
ggaccuugaacuggguac

SEQ ID NO: 2876869 - RNA, 19 nt, Human
ggacccaauguaggagcug

SEQ ID NO: 2876870 - RNA, 17 nt, Human
ggaccagguauagagaa

SEQ ID NO: 2876871 - RNA, 13 nt, Human
ggaccuuuuaaag

SEQ ID NO: 2876872 - RNA, 15 nt, Human
ggaccuuuuaaagug

SEQ ID NO: 2876873 - RNA, 21 nt, Human
ggaccuuuuaaaguguuucag

SEQ ID NO: 2876874 - RNA, 22 nt, Human
ggaccuuuuaaaguguuucagc

SEQ ID NO: 2876875 - RNA, 19 nt, Human
ggacgaagaagagccacag

SEQ ID NO: 2876876 - RNA, 22 nt, Human
ggacgcagcaggaggccaggcc

SEQ ID NO: 2876877 - RNA, 21 nt, Human
ggacgagaugggaaggcacag

SEQ ID NO: 2876878 - RNA, 13 nt, Human
ggaccaggcaaug

SEQ ID NO: 2876879 - RNA, 23 nt, Human
ggaccaggcaaugugacuuugca

SEQ ID NO: 2876880 - RNA, 14 nt, Human
ggaccauccuauuu

SEQ ID NO: 2876881 - RNA, 20 nt, Human
ggaccagugguuuccaguca

SEQ ID NO: 2876882 - RNA, 22 nt, Human
ggaccagugguuuccagucaug

SEQ ID NO: 2876883 - RNA, 19 nt, Human
ggacccaaggaaaacugca

SEQ ID NO: 2876884 - RNA, 22 nt, Human
ggacccaaggaaaacugcaugg

SEQ ID NO: 2876885 - RNA, 16 nt, Human
ggaccaugugucacuu

SEQ ID NO: 2876886 - RNA, 21 nt, Human
ggaccaugugucacuugugcu

SEQ ID NO: 2876887 - RNA, 22 nt, Human
ggaccaugugucacuugugcuu

SEQ ID NO: 2876888 - RNA, 22 nt, Human
ggagggcguucuuaggcugcug

SEQ ID NO: 2876889 - RNA, 16 nt, Human
ggagggcccuaccuga

SEQ ID NO: 2876890 - RNA, 13 nt, Human
ggagggccugggc

SEQ ID NO: 2876891 - RNA, 13 nt, Human
ggaggggccuggc

SEQ ID NO: 2876892 - RNA, 22 nt, Human
ggagucccaccuuggcugcagg

SEQ ID NO: 2876893 - RNA, 15 nt, Human
ggagucagccaggag

SEQ ID NO: 2876894 - RNA, 18 nt, Human
ggagucagccaggagcug

SEQ ID NO: 2876895 - RNA, 19 nt, Human
ggagucagccaggagcugu

SEQ ID NO: 2876896 - RNA, 17 nt, Human
ggaguaugucugaugga

SEQ ID NO: 2876897 - RNA, 22 nt, Human
ggagucaccuucccuugccacu

SEQ ID NO: 2876898 - RNA, 17 nt, Human
ggaguacaggugaagca

SEQ ID NO: 2876899 - RNA, 17 nt, Human
ggaguaaccgcuccagg

SEQ ID NO: 2876900 - RNA, 21 nt, Human
ggaguaauaguaaacacaggg

SEQ ID NO: 2876901 - RNA, 14 nt, Human
ggagguuugucggg

SEQ ID NO: 2876902 - RNA, 15 nt, Human
ggagguugggugggc

SEQ ID NO: 2876903 - RNA, 17 nt, Human
ggagguugcauugagcu

SEQ ID NO: 2876904 - RNA, 17 nt, Human
ggagggcggcacagguc

SEQ ID NO: 2876905 - RNA, 14 nt, Human
ggaggggccuggca

SEQ ID NO: 2876906 - RNA, 18 nt, Human
ggaggggccuggcagccg

SEQ ID NO: 2876907 - RNA, 21 nt, Human
ggaggggccuggcagccgugc

SEQ ID NO: 2876908 - RNA, 17 nt, Human
ggaggggcgcccaccuc

SEQ ID NO: 2876909 - RNA, 22 nt, Human
ggaggggcgcccaccuccccac

SEQ ID NO: 2876910 - RNA, 16 nt, Human
ggagccuagaagcugg

SEQ ID NO: 2876911 - RNA, 22 nt, Human
ggaggaccugacccuacucccu

SEQ ID NO: 2876912 - RNA, 21 nt, Human
ggaggauguucugggacacag

SEQ ID NO: 2876913 - RNA, 18 nt, Human
ggaggauguucugggaca

SEQ ID NO: 2876914 - RNA, 20 nt, Human
ggaggcaaagcuggcucacc

SEQ ID NO: 2876915 - RNA, 17 nt, Human
ggaggcaaagcuggcuc

SEQ ID NO: 2876916 - RNA, 21 nt, Human
ggaggcaaagcuggcucaccu

SEQ ID NO: 2876917 - RNA, 12 nt, Human
ggaggcaagcaa

SEQ ID NO: 2876918 - RNA, 22 nt, Human
ggaggauugcuugagcccagga

SEQ ID NO: 2876919 - RNA, 20 nt, Human
ggaggauugcuugagcccag

SEQ ID NO: 2876920 - RNA, 12 nt, Human
ggaggaccuggg

SEQ ID NO: 2876921 - RNA, 13 nt, Human
ggaggaccugggg

SEQ ID NO: 2876922 - RNA, 18 nt, Human
ggaggaccuggggcacag

SEQ ID NO: 2876923 - RNA, 19 nt, Human
ggaggaccuggggcacagu

SEQ ID NO: 2876924 - RNA, 21 nt, Human
ggagggaugcugccugaguca

SEQ ID NO: 2876925 - RNA, 11 nt, Human
ggaggcagccu

SEQ ID NO: 2876926 - RNA, 17 nt, Human
ggaggcagccagggcuu

SEQ ID NO: 2876927 - RNA, 20 nt, Human
ggaggcagagguugcaguga

SEQ ID NO: 2876928 - RNA, 20 nt, Human
ggaggcagagguuguaguga

SEQ ID NO: 2876929 - RNA, 12 nt, Human
ggaggcagaguu

SEQ ID NO: 2876930 - RNA, 21 nt, Human
ggaggcagaguuugccuuccu

SEQ ID NO: 2876931 - RNA, 21 nt, Human
ggaggcacagcaaacuguccc

SEQ ID NO: 2876932 - RNA, 20 nt, Human
ggagccuccacugccucugg

SEQ ID NO: 2876933 - RNA, 14 nt, Human
ggagccuaggacca

SEQ ID NO: 2876934 - RNA, 21 nt, Human
ggagccuaggaccacucagcc

SEQ ID NO: 2876935 - RNA, 22 nt, Human
ggagccuaggaccacucagccc

SEQ ID NO: 2876936 - RNA, 14 nt, Human
ggagcacagguccc

SEQ ID NO: 2876937 - RNA, 15 nt, Human
ggagcacagguccca

SEQ ID NO: 2876938 - RNA, 17 nt, Human
ggagcacaggucccacc

SEQ ID NO: 2876939 - RNA, 18 nt, Human
ggagcacaggucccaccu

SEQ ID NO: 2876940 - RNA, 21 nt, Human
ggagcaauuacggggugaccu

SEQ ID NO: 2876941 - RNA, 14 nt, Human
ggagcaaaggcuga

SEQ ID NO: 2876942 - RNA, 21 nt, Human
ggagaagucuuucaagaauga

SEQ ID NO: 2876943 - RNA, 19 nt, Human
ggagacccaccccaccugc

SEQ ID NO: 2876944 - RNA, 20 nt, Human
ggagacccaccccaccugca

SEQ ID NO: 2876945 - RNA, 17 nt, Human
ggagaccaaggcgggag

SEQ ID NO: 2876946 - RNA, 15 nt, Human
ggagcuaucaggaac

SEQ ID NO: 2876947 - RNA, 22 nt, Human
ggagcuaucaggaacagcuaug

SEQ ID NO: 2876948 - RNA, 14 nt, Human
ggagcucagagagg

SEQ ID NO: 2876949 - RNA, 17 nt, Human
ggagcucagagagggca

SEQ ID NO: 2876950 - RNA, 20 nt, Human
ggagcucagagagggcaggc

SEQ ID NO: 2876951 - RNA, 12 nt, Human
ggagcucagccc

SEQ ID NO: 2876952 - RNA, 23 nt, Human
ggagcgcaccugcccccuggugg

SEQ ID NO: 2876953 - RNA, 21 nt, Human
ggagcgcaccugcccccuggu

SEQ ID NO: 2876954 - RNA, 19 nt, Human
ggagcgcaccugcccccug

SEQ ID NO: 2876955 - RNA, 12 nt, Human
ggagcuaaggcu

SEQ ID NO: 2876956 - RNA, 15 nt, Human
ggagcuaaggcucua

SEQ ID NO: 2876957 - RNA, 20 nt, Human
ggagcuaaggcucuaugagu

SEQ ID NO: 2876958 - RNA, 15 nt, Human
ggagcgguggcccug

SEQ ID NO: 2876959 - RNA, 22 nt, Human
ggagcgguggcccugucccucc

SEQ ID NO: 2876960 - RNA, 16 nt, Human
ggagcgucaggguugg

SEQ ID NO: 2876961 - RNA, 20 nt, Human
ggagccugagucagggccca

SEQ ID NO: 2876962 - RNA, 21 nt, Human
ggagccugagucagggcccag

SEQ ID NO: 2876963 - RNA, 22 nt, Human
ggagccugagucagggcccaga

SEQ ID NO: 2876964 - RNA, 23 nt, Human
ggagccugagucagggcccagag

SEQ ID NO: 2876965 - RNA, 13 nt, Human
ggagccugcuggu

SEQ ID NO: 2876966 - RNA, 12 nt, Human
ggagccuggugc

SEQ ID NO: 2876967 - RNA, 22 nt, Human
ggagccugcuggucacagccuc

SEQ ID NO: 2876968 - RNA, 13 nt, Human
ggagccuggcaca

SEQ ID NO: 2876969 - RNA, 14 nt, Human
ggagccuggcacag

SEQ ID NO: 2876970 - RNA, 16 nt, Human
ggagccuggcacagga

SEQ ID NO: 2876971 - RNA, 19 nt, Human
ggagccuggcacaggacug

SEQ ID NO: 2876972 - RNA, 20 nt, Human
ggagccuggcacaggacuga

SEQ ID NO: 2876973 - RNA, 20 nt, Human
ggagccuuugguucuggcca

SEQ ID NO: 2876974 - RNA, 16 nt, Human
ggagccuuuuaacugu

SEQ ID NO: 2876975 - RNA, 19 nt, Human
ggagccuuuuuaaaacaca

SEQ ID NO: 2876976 - RNA, 15 nt, Human
ggagcgcaccugccc

SEQ ID NO: 2876977 - RNA, 14 nt, Human
ucagacuuuuguac

SEQ ID NO: 2876978 - RNA, 15 nt, Human
ucagacuuuuguaca

SEQ ID NO: 2876979 - RNA, 16 nt, Human
ucagacuuuuguacau

SEQ ID NO: 2876980 - RNA, 12 nt, Human
ucagagaauuuc

SEQ ID NO: 2876981 - RNA, 21 nt, Human
ucagaggggaauaaacuguug

SEQ ID NO: 2876982 - RNA, 15 nt, Human
ucagacagaacuuga

SEQ ID NO: 2876983 - RNA, 16 nt, Human
ucagaaacuagaaaug

SEQ ID NO: 2876984 - RNA, 16 nt, Human
ucagacagaacuugaa

SEQ ID NO: 2876985 - RNA, 23 nt, Human
ucagacagaacuugaauguguca

SEQ ID NO: 2876986 - RNA, 21 nt, Human
ucagaccuuggaucagaugaa

SEQ ID NO: 2876987 - RNA, 19 nt, Human
ucagacuaagaaauauucc

SEQ ID NO: 2876988 - RNA, 21 nt, Human
ucagacuaagaaauauuccaa

SEQ ID NO: 2876989 - RNA, 21 nt, Human
ucagacugcugggacuggcca

SEQ ID NO: 2876990 - RNA, 20 nt, Human
ucagaccuuggaucagauga

SEQ ID NO: 2876991 - RNA, 21 nt, Human
ucagacuggcuggcugcagug

SEQ ID NO: 2876992 - RNA, 20 nt, Human
ucagacuggcuggcugcagu

SEQ ID NO: 2876993 - RNA, 23 nt, Human
ucagacuugccaugugacucugg

SEQ ID NO: 2876994 - RNA, 13 nt, Human
ucagacuugucaa

SEQ ID NO: 2876995 - RNA, 14 nt, Human
ucagacuugucaag

SEQ ID NO: 2876996 - RNA, 15 nt, Human
ucagacuugucaagc

SEQ ID NO: 2876997 - RNA, 14 nt, Human
ucagacuggcuggc

SEQ ID NO: 2876998 - RNA, 13 nt, Human
ucagacuggcugg

SEQ ID NO: 2876999 - RNA, 23 nt, Human
ucagacugcugggacuggccagg

SEQ ID NO: 2877000 - RNA, 13 nt, Human
ucacuuuaaaccu

SEQ ID NO: 2877001 - RNA, 18 nt, Human
ucagaaaccaaacaguuu

SEQ ID NO: 2877002 - RNA, 12 nt, Human
ucagaaacuguu

SEQ ID NO: 2877003 - RNA, 21 nt, Human
ucagaaauuggaacagaaugu

SEQ ID NO: 2877004 - RNA, 17 nt, Human
ucagaaauuuuuaucag

SEQ ID NO: 2877005 - RNA, 19 nt, Human
ucagaaauuuuuaucaguu

SEQ ID NO: 2877006 - RNA, 22 nt, Human
ucagaaauuuuuaucaguuucc

SEQ ID NO: 2877007 - RNA, 16 nt, Human
ucagaaauuggaacag

SEQ ID NO: 2877008 - RNA, 18 nt, Human
ucagaaauuggaacagaa

SEQ ID NO: 2877009 - RNA, 21 nt, Human
ucagaauugaucauuuucccc

SEQ ID NO: 2877010 - RNA, 16 nt, Human
ucagaauugaaacacu

SEQ ID NO: 2877011 - RNA, 17 nt, Human
ucagaauugaaacacuu

SEQ ID NO: 2877012 - RNA, 18 nt, Human
ucagaauugaaacacuuu

SEQ ID NO: 2877013 - RNA, 23 nt, Human
ucagacacccucaaccucuucug

SEQ ID NO: 2877014 - RNA, 18 nt, Human
ucagacagaaccccuaca

SEQ ID NO: 2877015 - RNA, 17 nt, Human
ucagacacccucaaccu

SEQ ID NO: 2877016 - RNA, 22 nt, Human
ucagacacccucaaccucuucu

SEQ ID NO: 2877017 - RNA, 15 nt, Human
ucagacacccucaac

SEQ ID NO: 2877018 - RNA, 19 nt, Human
ucacuugugccaacacuca

SEQ ID NO: 2877019 - RNA, 21 nt, Human
ucacuugugccaacacucaag

SEQ ID NO: 2877020 - RNA, 13 nt, Human
ucacuugugcuuu

SEQ ID NO: 2877021 - RNA, 15 nt, Human
ucacuugugcuuugc

SEQ ID NO: 2877022 - RNA, 16 nt, Human
ucacuugugcuuugcu

SEQ ID NO: 2877023 - RNA, 18 nt, Human
ucacuugugcuuugcucu

SEQ ID NO: 2877024 - RNA, 19 nt, Human
ucacuugugcuuugcucuu

SEQ ID NO: 2877025 - RNA, 20 nt, Human
ucacuugugcuuugcucuug

SEQ ID NO: 2877026 - RNA, 23 nt, Human
ucacuugugcuuugcucuugucc

SEQ ID NO: 2877027 - RNA, 23 nt, Human
ucacuguaagacucauucccuag

SEQ ID NO: 2877028 - RNA, 20 nt, Human
ucacugguagaccaaaauaa

SEQ ID NO: 2877029 - RNA, 19 nt, Human
ucacugguagaccaaaaua

SEQ ID NO: 2877030 - RNA, 18 nt, Human
ucacugguagaccaaaau

SEQ ID NO: 2877031 - RNA, 18 nt, Human
ucacuggaccacugggca

SEQ ID NO: 2877032 - RNA, 17 nt, Human
ucacuggggccuacagc

SEQ ID NO: 2877033 - RNA, 20 nt, Human
ucacugggccaauucaauac

SEQ ID NO: 2877034 - RNA, 15 nt, Human
ucacuggagcccagg

SEQ ID NO: 2877035 - RNA, 14 nt, Human
ucacuggagcccag

SEQ ID NO: 2877036 - RNA, 13 nt, Human
ucacuggagccca

SEQ ID NO: 2877037 - RNA, 12 nt, Human
ucacuggagccc

SEQ ID NO: 2877038 - RNA, 11 nt, Human
ucacuggagcc

SEQ ID NO: 2877039 - RNA, 15 nt, Human
ucacugcuugaugaa

SEQ ID NO: 2877040 - RNA, 21 nt, Human
ucacugcuugaugaagcaagg

SEQ ID NO: 2877041 - RNA, 16 nt, Human
ucacugcuuuuggccu

SEQ ID NO: 2877042 - RNA, 17 nt, Human
ucacugcuuuuggccug

SEQ ID NO: 2877043 - RNA, 18 nt, Human
ucacugcuuuuggccugg

SEQ ID NO: 2877044 - RNA, 19 nt, Human
ucacugcuuuuggccugga

SEQ ID NO: 2877045 - RNA, 23 nt, Human
ucacugcuuuuggccuggaguuu

SEQ ID NO: 2877046 - RNA, 17 nt, Human
ucacugcuggcugccuu

SEQ ID NO: 2877047 - RNA, 18 nt, Human
ucacugcuggcugccuua

SEQ ID NO: 2877048 - RNA, 22 nt, Human
ucacugcuggcugccuuagaac

SEQ ID NO: 2877049 - RNA, 13 nt, Human
ucacugcuggcug

SEQ ID NO: 2877050 - RNA, 14 nt, Human
ucacugcuggcugc

SEQ ID NO: 2877051 - RNA, 15 nt, Human
ucacugcuggcugcc

SEQ ID NO: 2877052 - RNA, 16 nt, Human
ucacugcuggcugccu

SEQ ID NO: 2877053 - RNA, 14 nt, Human
ucacugcucccuga

SEQ ID NO: 2877054 - RNA, 18 nt, Human
ucacugcucccugaagcc

SEQ ID NO: 2877055 - RNA, 19 nt, Human
ucacugcucccugaagcca

SEQ ID NO: 2877056 - RNA, 20 nt, Human
ucacugcucccugaagccag

SEQ ID NO: 2877057 - RNA, 21 nt, Human
ucacugcucccugaagccagc

SEQ ID NO: 2877058 - RNA, 23 nt, Human
ucacugcucccugaagccagccu

SEQ ID NO: 2877059 - RNA, 24 nt, Human
ucacugcucccugaagccagccuu

SEQ ID NO: 2877060 - RNA, 12 nt, Human
ucacugcuggcu

SEQ ID NO: 2877061 - RNA, 20 nt, Human
ucacucuuauugcccacgcu

SEQ ID NO: 2877062 - RNA, 18 nt, Human
ucacugcauccuccgccu

SEQ ID NO: 2877063 - RNA, 12 nt, Human
ucacucuuaggc

SEQ ID NO: 2877064 - RNA, 20 nt, Human
ucacugccacacucuccauc

SEQ ID NO: 2877065 - RNA, 15 nt, Human
ucacugccacuuugc

SEQ ID NO: 2877066 - RNA, 16 nt, Human
ucacugccacuuugca

SEQ ID NO: 2877067 - RNA, 17 nt, Human
ucacugccacuuugcac

SEQ ID NO: 2877068 - RNA, 19 nt, Human
ucacugccacuuugcacau

SEQ ID NO: 2877069 - RNA, 20 nt, Human
ucacugccacuuugcacauu

SEQ ID NO: 2877070 - RNA, 22 nt, Human
ucacugccacuuugcacauuuu

SEQ ID NO: 2877071 - RNA, 23 nt, Human
ucacugccacuuugcacauuuug

SEQ ID NO: 2877072 - RNA, 20 nt, Human
ucacugccagagauaaacua

SEQ ID NO: 2877073 - RNA, 19 nt, Human
ucacugccacacucuccau

SEQ ID NO: 2877074 - RNA, 15 nt, Human
ucacugccacacucu

SEQ ID NO: 2877075 - RNA, 19 nt, Human
ucacugcauccuccgccuc

SEQ ID NO: 2877076 - RNA, 13 nt, Human
ucacugcauccuc

SEQ ID NO: 2877077 - RNA, 17 nt, Human
ucacugcauuauucucu

SEQ ID NO: 2877078 - RNA, 18 nt, Human
ucacugcauuauucucuu

SEQ ID NO: 2877079 - RNA, 18 nt, Human
ucacugccaucaaacugu

SEQ ID NO: 2877080 - RNA, 12 nt, Human
ucacugcccgca

SEQ ID NO: 2877081 - RNA, 18 nt, Human
ucacugcccgcacacccu

SEQ ID NO: 2877082 - RNA, 19 nt, Human
ucacugcccgcacacccuc

SEQ ID NO: 2877083 - RNA, 20 nt, Human
ucacugcccgcacacccuca

SEQ ID NO: 2877084 - RNA, 22 nt, Human
ucacugcccgcacacccucacu

SEQ ID NO: 2877085 - RNA, 22 nt, Human
ucacucugucgcccagucugga

SEQ ID NO: 2877086 - RNA, 17 nt, Human
ucacucuuauugcccac

SEQ ID NO: 2877087 - RNA, 24 nt, Human
ucaccagccccacugccagcagca

SEQ ID NO: 2877088 - RNA, 23 nt, Human
ucaccagccccacugccagcagc

SEQ ID NO: 2877089 - RNA, 17 nt, Human
ucaccccguuacagcuc

SEQ ID NO: 2877090 - RNA, 13 nt, Human
ucaccccuccagg

SEQ ID NO: 2877091 - RNA, 14 nt, Human
ucaccccuccagga

SEQ ID NO: 2877092 - RNA, 13 nt, Human
ucaccagccccag

SEQ ID NO: 2877093 - RNA, 22 nt, Human
ucaccagccccacugccagcag

SEQ ID NO: 2877094 - RNA, 21 nt, Human
ucaccagccccacugccagca

SEQ ID NO: 2877095 - RNA, 19 nt, Human
ucaccagccccacugccag

SEQ ID NO: 2877096 - RNA, 15 nt, Human
ucaccagccccacug

SEQ ID NO: 2877097 - RNA, 13 nt, Human
ucagcuccccaga

SEQ ID NO: 2877098 - RNA, 15 nt, Human
ucagcuccccagagu

SEQ ID NO: 2877099 - RNA, 17 nt, Human
ucagcuccccagagucc

SEQ ID NO: 2877100 - RNA, 16 nt, Human
ucagccugcugcccag

SEQ ID NO: 2877101 - RNA, 21 nt, Human
ucagccugcugcccaggcugu

SEQ ID NO: 2877102 - RNA, 22 nt, Human
ucagccugcugcccaggcugug

SEQ ID NO: 2877103 - RNA, 19 nt, Human
ucagcucuuggcuccacug

SEQ ID NO: 2877104 - RNA, 13 nt, Human
ucagcucuuuuug

SEQ ID NO: 2877105 - RNA, 22 nt, Human
ucagccucccgaguagcuggga

SEQ ID NO: 2877106 - RNA, 21 nt, Human
ucagccucccgaguagcuggg

SEQ ID NO: 2877107 - RNA, 20 nt, Human
ucagccuccugaguagcugg

SEQ ID NO: 2877108 - RNA, 20 nt, Human
ucagccuccggaguagcugg

SEQ ID NO: 2877109 - RNA, 16 nt, Human
ucagccucccaaagug

SEQ ID NO: 2877110 - RNA, 13 nt, Human
ucagccuccugag

SEQ ID NO: 2877111 - RNA, 21 nt, Human
ucagccuccugaguagcugga

SEQ ID NO: 2877112 - RNA, 22 nt, Human
ucagccuccugaguagcuggga

SEQ ID NO: 2877113 - RNA, 21 nt, Human
ucagccucccaaagugcuggg

SEQ ID NO: 2877114 - RNA, 19 nt, Human
ucagccucccaaagugcug

SEQ ID NO: 2877115 - RNA, 14 nt, Human
ucagccucccaaag

SEQ ID NO: 2877116 - RNA, 22 nt, Human
ucagccucccgaauagcuggga

SEQ ID NO: 2877117 - RNA, 21 nt, Human
ucagccucccgaauagcuggg

SEQ ID NO: 2877118 - RNA, 18 nt, Human
ucagccucccgaguagcu

SEQ ID NO: 2877119 - RNA, 20 nt, Human
ucagccucccgaguagcugg

SEQ ID NO: 2877120 - RNA, 17 nt, Human
ucagcauucucacuccu

SEQ ID NO: 2877121 - RNA, 20 nt, Human
ucagcauucucacuccuacc

SEQ ID NO: 2877122 - RNA, 15 nt, Human
ucagaguauggagcu

SEQ ID NO: 2877123 - RNA, 18 nt, Human
ucagauauauaucauauu

SEQ ID NO: 2877124 - RNA, 18 nt, Human
ucagagguagggcugcca

SEQ ID NO: 2877125 - RNA, 17 nt, Human
ucagagggggacugcug

SEQ ID NO: 2877126 - RNA, 18 nt, Human
ucagagggggacugcugc

SEQ ID NO: 2877127 - RNA, 22 nt, Human
ucagagggggacugcugcugcc

SEQ ID NO: 2877128 - RNA, 17 nt, Human
ucagagguucuuugagg

SEQ ID NO: 2877129 - RNA, 23 nt, Human
ucagagguuuaccuagagaacag

SEQ ID NO: 2877130 - RNA, 13 nt, Human
ucagaguagaaau

SEQ ID NO: 2877131 - RNA, 14 nt, Human
ucagaguagaaaua

SEQ ID NO: 2877132 - RNA, 15 nt, Human
ucagaguagaaauaa

SEQ ID NO: 2877133 - RNA, 19 nt, Human
ucaggcaauucuccugccu

SEQ ID NO: 2877134 - RNA, 18 nt, Human
ucaggcaccagucccugu

SEQ ID NO: 2877135 - RNA, 12 nt, Human
ucaggcaccagu

SEQ ID NO: 2877136 - RNA, 13 nt, Human
ucaggcacagguc

SEQ ID NO: 2877137 - RNA, 14 nt, Human
ucaggcacagguca

SEQ ID NO: 2877138 - RNA, 15 nt, Human
ucaggcacaggucag

SEQ ID NO: 2877139 - RNA, 16 nt, Human
ucaggauuuaaaaacu

SEQ ID NO: 2877140 - RNA, 20 nt, Human
ucaggauuuaaaaacuggaa

SEQ ID NO: 2877141 - RNA, 21 nt, Human
ucaggauuuaaaaacuggaac

SEQ ID NO: 2877142 - RNA, 13 nt, Human
ucaggcuccccag

SEQ ID NO: 2877143 - RNA, 15 nt, Human
ucaggcacuagccuu

SEQ ID NO: 2877144 - RNA, 19 nt, Human
ucaggcaccagucccuguc

SEQ ID NO: 2877145 - RNA, 16 nt, Human
ucaggcacuagccuuu

SEQ ID NO: 2877146 - RNA, 21 nt, Human
ucaggcacuagccuuuggcuc

SEQ ID NO: 2877147 - RNA, 22 nt, Human
ucaggcacuagccuuuggcucu

SEQ ID NO: 2877148 - RNA, 23 nt, Human
ucaggcuuccuuggcaucacagg

SEQ ID NO: 2877149 - RNA, 15 nt, Human
ucaggcuuccuuggc

SEQ ID NO: 2877150 - RNA, 14 nt, Human
ucaggcuuccuugg

SEQ ID NO: 2877151 - RNA, 16 nt, Human
ucaggcuggugggagg

SEQ ID NO: 2877152 - RNA, 17 nt, Human
ucaggcuggugggaggg

SEQ ID NO: 2877153 - RNA, 15 nt, Human
ucaggcugcuuggga

SEQ ID NO: 2877154 - RNA, 24 nt, Human
ucaggcugcuggggccucagacga

SEQ ID NO: 2877155 - RNA, 14 nt, Human
ucaggcugguggga

SEQ ID NO: 2877156 - RNA, 21 nt, Human
ucagcugaaugccuccugugg

SEQ ID NO: 2877157 - RNA, 22 nt, Human
ucagcugaaugccuccuguggg

SEQ ID NO: 2877158 - RNA, 23 nt, Human
ucagcugaaugccuccugugggg

SEQ ID NO: 2877159 - RNA, 14 nt, Human
ucagcauucccucc

SEQ ID NO: 2877160 - RNA, 18 nt, Human
ucagggccuggggccuga

SEQ ID NO: 2877161 - RNA, 20 nt, Human
ucagggccuggggccugaga

SEQ ID NO: 2877162 - RNA, 21 nt, Human
ucagggccuggggccugagag

SEQ ID NO: 2877163 - RNA, 22 nt, Human
ucagggccuggggccugagaga

SEQ ID NO: 2877164 - RNA, 23 nt, Human
ucagggccuggggccugagagaa

SEQ ID NO: 2877165 - RNA, 15 nt, Human
ucagggccugguuga

SEQ ID NO: 2877166 - RNA, 13 nt, Human
ucagggcuccucc

SEQ ID NO: 2877167 - RNA, 15 nt, Human
ucagggcuccuccca

SEQ ID NO: 2877168 - RNA, 16 nt, Human
ucagggcuccucccag

SEQ ID NO: 2877169 - RNA, 17 nt, Human
ucagggcuccucccagc

SEQ ID NO: 2877170 - RNA, 18 nt, Human
ucagggcuccucccagcu

SEQ ID NO: 2877171 - RNA, 23 nt, Human
ucagggcuaaacgggcauugccu

SEQ ID NO: 2877172 - RNA, 17 nt, Human
ucagggccaugccugcc

SEQ ID NO: 2877173 - RNA, 12 nt, Human
ucagggcccaga

SEQ ID NO: 2877174 - RNA, 13 nt, Human
ucagggcccagag

SEQ ID NO: 2877175 - RNA, 14 nt, Human
ucagggcccagagg

SEQ ID NO: 2877176 - RNA, 17 nt, Human
ucagggcccagaggcug

SEQ ID NO: 2877177 - RNA, 18 nt, Human
ucagggcccagaggcuga

SEQ ID NO: 2877178 - RNA, 19 nt, Human
ucagggcccagaggcugag

SEQ ID NO: 2877179 - RNA, 14 nt, Human
ucagggccaugccu

SEQ ID NO: 2877180 - RNA, 14 nt, Human
ucagggcagguggg

SEQ ID NO: 2877181 - RNA, 20 nt, Human
ucagggauuuuuuuuuuaaa

SEQ ID NO: 2877182 - RNA, 23 nt, Human
ucagggaaaagcagcucuccccu

SEQ ID NO: 2877183 - RNA, 19 nt, Human
ucagggaaaagcagcucuc

SEQ ID NO: 2877184 - RNA, 18 nt, Human
ucagggaaaagcagcucu

SEQ ID NO: 2877185 - RNA, 16 nt, Human
ucagggaaaagcagcu

SEQ ID NO: 2877186 - RNA, 13 nt, Human
ucagggagugcug

SEQ ID NO: 2877187 - RNA, 17 nt, Human
ucagggagugcuggcuc

SEQ ID NO: 2877188 - RNA, 19 nt, Human
ucagggagugcuggcucac

SEQ ID NO: 2877189 - RNA, 22 nt, Human
ucagggagugcuggcucacagu

SEQ ID NO: 2877190 - RNA, 23 nt, Human
ucagggagcagggaaggccugac

SEQ ID NO: 2877191 - RNA, 21 nt, Human
ucagggagcagggaaggccug

SEQ ID NO: 2877192 - RNA, 22 nt, Human
uccacagagagggagagcagag

SEQ ID NO: 2877193 - RNA, 23 nt, Human
uccacagagagggagagcagaga

SEQ ID NO: 2877194 - RNA, 17 nt, Human
uccacagaguaagacau

SEQ ID NO: 2877195 - RNA, 18 nt, Human
uccacagaguaagacauu

SEQ ID NO: 2877196 - RNA, 19 nt, Human
uccacagaguaagacauug

SEQ ID NO: 2877197 - RNA, 11 nt, Human
uccacagauug

SEQ ID NO: 2877198 - RNA, 15 nt, Human
uccacagauuguuuc

SEQ ID NO: 2877199 - RNA, 16 nt, Human
uccacagauuguuucu

SEQ ID NO: 2877200 - RNA, 17 nt, Human
uccacagauuguuucua

SEQ ID NO: 2877201 - RNA, 22 nt, Human
uccacagauuguuucuauacaa

SEQ ID NO: 2877202 - RNA, 12 nt, Human
uccacccugcuc

SEQ ID NO: 2877203 - RNA, 23 nt, Human
uccaccugggcauauccaccacc

SEQ ID NO: 2877204 - RNA, 20 nt, Human
uccaccugguacucccucuc

SEQ ID NO: 2877205 - RNA, 21 nt, Human
uccaccugguacucccucuca

SEQ ID NO: 2877206 - RNA, 23 nt, Human
uccaccugguacucccucucagg

SEQ ID NO: 2877207 - RNA, 19 nt, Human
uccaaaauaauuuuaagaa

SEQ ID NO: 2877208 - RNA, 15 nt, Human
uccaaaauaauuuua

SEQ ID NO: 2877209 - RNA, 17 nt, Human
ucauuucucacugugua

SEQ ID NO: 2877210 - RNA, 15 nt, Human
uccaauuuuaauuua

SEQ ID NO: 2877211 - RNA, 17 nt, Human
uccaauuuuaauuuagu

SEQ ID NO: 2877212 - RNA, 23 nt, Human
uccaauuuuaauuuaguaaaugu

SEQ ID NO: 2877213 - RNA, 16 nt, Human
uccaauuguugacagu

SEQ ID NO: 2877214 - RNA, 19 nt, Human
uccaaaauguguauuucuu

SEQ ID NO: 2877215 - RNA, 21 nt, Human
uccaauuguugacaguucuga

SEQ ID NO: 2877216 - RNA, 22 nt, Human
uccaauuguugacaguucugaa

SEQ ID NO: 2877217 - RNA, 14 nt, Human
uccaauuuucugga

SEQ ID NO: 2877218 - RNA, 21 nt, Human
uccacaagugccgcaaauugu

SEQ ID NO: 2877219 - RNA, 15 nt, Human
uccacacaagggaag

SEQ ID NO: 2877220 - RNA, 18 nt, Human
uccacacaagggaaggac

SEQ ID NO: 2877221 - RNA, 19 nt, Human
uccacacaagggaaggaca

SEQ ID NO: 2877222 - RNA, 23 nt, Human
uccacacaagggaaggacagaaa

SEQ ID NO: 2877223 - RNA, 20 nt, Human
uccaccugucucagccuccc

SEQ ID NO: 2877224 - RNA, 12 nt, Human
uccaccuguggg

SEQ ID NO: 2877225 - RNA, 13 nt, Human
uccaccugugggu

SEQ ID NO: 2877226 - RNA, 17 nt, Human
uccaccugucucagccu

SEQ ID NO: 2877227 - RNA, 16 nt, Human
uccaccugucucagcc

SEQ ID NO: 2877228 - RNA, 13 nt, Human
uccaccugucuca

SEQ ID NO: 2877229 - RNA, 12 nt, Human
uccaccuuccca

SEQ ID NO: 2877230 - RNA, 15 nt, Human
uccaccuucccacuu

SEQ ID NO: 2877231 - RNA, 13 nt, Human
uccagccagggcu

SEQ ID NO: 2877232 - RNA, 14 nt, Human
uccagccagggcug

SEQ ID NO: 2877233 - RNA, 15 nt, Human
uccagccagggcugc

SEQ ID NO: 2877234 - RNA, 17 nt, Human
uccagccagggcugcua

SEQ ID NO: 2877235 - RNA, 17 nt, Human
uccagcucaccagcccc

SEQ ID NO: 2877236 - RNA, 16 nt, Human
uccagcucaccagccc

SEQ ID NO: 2877237 - RNA, 18 nt, Human
uccagcucaccagcccca

SEQ ID NO: 2877238 - RNA, 15 nt, Human
uccagcucaccagcc

SEQ ID NO: 2877239 - RNA, 13 nt, Human
uccagcuggugag

SEQ ID NO: 2877240 - RNA, 15 nt, Human
uccagcccacauugg

SEQ ID NO: 2877241 - RNA, 11 nt, Human
uccagcccauc

SEQ ID NO: 2877242 - RNA, 18 nt, Human
uccagcccaucucggagc

SEQ ID NO: 2877243 - RNA, 19 nt, Human
uccagcccaucucggagca

SEQ ID NO: 2877244 - RNA, 13 nt, Human
uccagcuugccag

SEQ ID NO: 2877245 - RNA, 23 nt, Human
uccagcuugccagaugcugcaga

SEQ ID NO: 2877246 - RNA, 16 nt, Human
uccagguucagcuugu

SEQ ID NO: 2877247 - RNA, 15 nt, Human
uccagguucagcuug

SEQ ID NO: 2877248 - RNA, 13 nt, Human
uccaggugcccag

SEQ ID NO: 2877249 - RNA, 11 nt, Human
uccaggguggu

SEQ ID NO: 2877250 - RNA, 16 nt, Human
uccagguguuacugua

SEQ ID NO: 2877251 - RNA, 19 nt, Human
uccagcuuucuccccgcua

SEQ ID NO: 2877252 - RNA, 21 nt, Human
ucaggugacaugugaaaccuu

SEQ ID NO: 2877253 - RNA, 15 nt, Human
ucauaccuaaguacu

SEQ ID NO: 2877254 - RNA, 16 nt, Human
ucauaccuaaguacug

SEQ ID NO: 2877255 - RNA, 17 nt, Human
ucauaccuaaguacugu

SEQ ID NO: 2877256 - RNA, 18 nt, Human
ucauaccuaaguacugua

SEQ ID NO: 2877257 - RNA, 19 nt, Human
ucauaccuaaguacuguaa

SEQ ID NO: 2877258 - RNA, 20 nt, Human
ucauaccuaaguacuguaau

SEQ ID NO: 2877259 - RNA, 21 nt, Human
ucauaccuaaguacuguaaua

SEQ ID NO: 2877260 - RNA, 17 nt, Human
ucaggugacaugugaaa

SEQ ID NO: 2877261 - RNA, 15 nt, Human
ucaggugcugccauc

SEQ ID NO: 2877262 - RNA, 14 nt, Human
ucaggugcugccau

SEQ ID NO: 2877263 - RNA, 13 nt, Human
ucaggugcugcca

SEQ ID NO: 2877264 - RNA, 21 nt, Human
ucauagcccucacccuggggc

SEQ ID NO: 2877265 - RNA, 13 nt, Human
ucauagcauucac

SEQ ID NO: 2877266 - RNA, 14 nt, Human
ucauaccucagaau

SEQ ID NO: 2877267 - RNA, 18 nt, Human
ucauaccucagaauguaa

SEQ ID NO: 2877268 - RNA, 14 nt, Human
ucauaccucugacc

SEQ ID NO: 2877269 - RNA, 21 nt, Human
ucauacuacauugaguagaca

SEQ ID NO: 2877270 - RNA, 20 nt, Human
ucauacuacugaaacagauu

SEQ ID NO: 2877271 - RNA, 21 nt, Human
ucauacuacugaaacagauuu

SEQ ID NO: 2877272 - RNA, 18 nt, Human
ucaugcucugcaaaagga

SEQ ID NO: 2877273 - RNA, 16 nt, Human
ucaucuucuucuuuaa

SEQ ID NO: 2877274 - RNA, 18 nt, Human
ucaucuugaagggcccag

SEQ ID NO: 2877275 - RNA, 12 nt, Human
ucaucuuacugu

SEQ ID NO: 2877276 - RNA, 16 nt, Human
ucaucuuacuguaccu

SEQ ID NO: 2877277 - RNA, 12 nt, Human
ucaucagggccu

SEQ ID NO: 2877278 - RNA, 13 nt, Human
ucaucagggccug

SEQ ID NO: 2877279 - RNA, 14 nt, Human
ucaucagggccugg

SEQ ID NO: 2877280 - RNA, 16 nt, Human
ucaucagggccugggg

SEQ ID NO: 2877281 - RNA, 21 nt, Human
ucaucagggccuggggccuga

SEQ ID NO: 2877282 - RNA, 23 nt, Human
ucaucagggccuggggccugaga

SEQ ID NO: 2877283 - RNA, 16 nt, Human
ucaucugcacccuucu

SEQ ID NO: 2877284 - RNA, 20 nt, Human
ucaucugcacccuucuuuuc

SEQ ID NO: 2877285 - RNA, 21 nt, Human
ucaucugcacccuucuuuucu

SEQ ID NO: 2877286 - RNA, 22 nt, Human
ucaucugcacccuucuuuucuc

SEQ ID NO: 2877287 - RNA, 23 nt, Human
ucaucugcacccuucuuuucuca

SEQ ID NO: 2877288 - RNA, 21 nt, Human
ucaucugcccaacuguguagc

SEQ ID NO: 2877289 - RNA, 18 nt, Human
ucaucugaggcauccagc

SEQ ID NO: 2877290 - RNA, 21 nt, Human
ucaucugauuggacaggcaug

SEQ ID NO: 2877291 - RNA, 22 nt, Human
ucaucugaauuugcccugggaa

SEQ ID NO: 2877292 - RNA, 23 nt, Human
ucaucugaauuugcccugggaaa

SEQ ID NO: 2877293 - RNA, 16 nt, Human
ucaucacacacaugga

SEQ ID NO: 2877294 - RNA, 15 nt, Human
ucaucacagggauuu

SEQ ID NO: 2877295 - RNA, 14 nt, Human
ucaucacuguggcu

SEQ ID NO: 2877296 - RNA, 15 nt, Human
ucaucacuguggcug

SEQ ID NO: 2877297 - RNA, 17 nt, Human
ucaucacuguggcuguc

SEQ ID NO: 2877298 - RNA, 15 nt, Human
ucaucacuuuucagu

SEQ ID NO: 2877299 - RNA, 17 nt, Human
ucaucacuuuucaguga

SEQ ID NO: 2877300 - RNA, 15 nt, Human
ucaucagauggaaau

SEQ ID NO: 2877301 - RNA, 18 nt, Human
ucaucagauggaaauauu

SEQ ID NO: 2877302 - RNA, 20 nt, Human
ucaucagauggaaauauuuu

SEQ ID NO: 2877303 - RNA, 22 nt, Human
ucaucagauggaaauauuuuga

SEQ ID NO: 2877304 - RNA, 18 nt, Human
ucaucagccaccauccua

SEQ ID NO: 2877305 - RNA, 12 nt, Human
ucaucagcauuu

SEQ ID NO: 2877306 - RNA, 16 nt, Human
ucaucagccaccaucc

SEQ ID NO: 2877307 - RNA, 13 nt, Human
ucaucagaagugg

SEQ ID NO: 2877308 - RNA, 22 nt, Human
ucaucagaagugguaggaaagc

SEQ ID NO: 2877309 - RNA, 17 nt, Human
ucaucagagcuccucug

SEQ ID NO: 2877310 - RNA, 21 nt, Human
ucaucagagcuccucuguccu

SEQ ID NO: 2877311 - RNA, 19 nt, Human
ucaugcuggaaccugcaaa

SEQ ID NO: 2877312 - RNA, 20 nt, Human
ucaugcuggaaccugcaaaa

SEQ ID NO: 2877313 - RNA, 22 nt, Human
ucaugcuggaaccugcaaaaaa

SEQ ID NO: 2877314 - RNA, 13 nt, Human
ucauuauguaaaa

SEQ ID NO: 2877315 - RNA, 20 nt, Human
ucauuauguaaaauguuuua

SEQ ID NO: 2877316 - RNA, 20 nt, Human
ucauuauaucauuggaacaa

SEQ ID NO: 2877317 - RNA, 21 nt, Human
ucauuccaacuucccaguuca

SEQ ID NO: 2877318 - RNA, 15 nt, Human
ucauucaauauugac

SEQ ID NO: 2877319 - RNA, 16 nt, Human
ucauucaauauugaca

SEQ ID NO: 2877320 - RNA, 20 nt, Human
ucauucaauauugacauuug

SEQ ID NO: 2877321 - RNA, 21 nt, Human
ucauucaauauugacauuugu

SEQ ID NO: 2877322 - RNA, 23 nt, Human
ucauuccaccuucccaugcccug

SEQ ID NO: 2877323 - RNA, 17 nt, Human
ucauuccaacagugagu

SEQ ID NO: 2877324 - RNA, 20 nt, Human
ucauucauuuuauauugaaa

SEQ ID NO: 2877325 - RNA, 22 nt, Human
ucauucauuuuauauugaaaaa

SEQ ID NO: 2877326 - RNA, 12 nt, Human
ucauuccaaaua

SEQ ID NO: 2877327 - RNA, 14 nt, Human
ucauuucauuguau

SEQ ID NO: 2877328 - RNA, 13 nt, Human
ucauuucauucca

SEQ ID NO: 2877329 - RNA, 14 nt, Human
ucauuucauuccau

SEQ ID NO: 2877330 - RNA, 15 nt, Human
ucauuucauuccauu

SEQ ID NO: 2877331 - RNA, 16 nt, Human
ucauuucauuccauug

SEQ ID NO: 2877332 - RNA, 19 nt, Human
ucauuucauuguaugaugu

SEQ ID NO: 2877333 - RNA, 18 nt, Human
ucauuuccccauaacuca

SEQ ID NO: 2877334 - RNA, 22 nt, Human
ucauuuccccauaacucaaugg

SEQ ID NO: 2877335 - RNA, 16 nt, Human
ucauuuccugugucuu

SEQ ID NO: 2877336 - RNA, 21 nt, Human
ucauuuccuucaaggcaucau

SEQ ID NO: 2877337 - RNA, 13 nt, Human
ucauuucuaaaag

SEQ ID NO: 2877338 - RNA, 15 nt, Human
ucauuucuaaaagaa

SEQ ID NO: 2877339 - RNA, 17 nt, Human
ucauuucuaaaagaaua

SEQ ID NO: 2877340 - RNA, 13 nt, Human
ucauuuccugugu

SEQ ID NO: 2877341 - RNA, 15 nt, Human
ucauuucaugcucug

SEQ ID NO: 2877342 - RNA, 15 nt, Human
ucauuucaggagcag

SEQ ID NO: 2877343 - RNA, 16 nt, Human
ucauuucaggagcagc

SEQ ID NO: 2877344 - RNA, 15 nt, Human
ucauuguuauuuaua

SEQ ID NO: 2877345 - RNA, 22 nt, Human
ucauuguuauuuauacaagauu

SEQ ID NO: 2877346 - RNA, 20 nt, Human
uauguacuccucuuuacacu

SEQ ID NO: 2877347 - RNA, 17 nt, Human
uauguacuaguacugug

SEQ ID NO: 2877348 - RNA, 18 nt, Human
uauguacuaguacugugu

SEQ ID NO: 2877349 - RNA, 19 nt, Human
uauguacuaguacugugua

SEQ ID NO: 2877350 - RNA, 23 nt, Human
uauguacuaguacuguguacugu

SEQ ID NO: 2877351 - RNA, 14 nt, Human
uauguacuaguguu

SEQ ID NO: 2877352 - RNA, 18 nt, Human
uauguacguuuguaugug

SEQ ID NO: 2877353 - RNA, 19 nt, Human
uauguacguuuguaugugu

SEQ ID NO: 2877354 - RNA, 21 nt, Human
uauguacguuuguaugugugu

SEQ ID NO: 2877355 - RNA, 22 nt, Human
uauguacguuuguaugugugua

SEQ ID NO: 2877356 - RNA, 16 nt, Human
uauguacguuuguaug

SEQ ID NO: 2877357 - RNA, 16 nt, Human
uauguaaugaaguaaa

SEQ ID NO: 2877358 - RNA, 23 nt, Human
uauguaaugaaguaaagccauua

SEQ ID NO: 2877359 - RNA, 14 nt, Human
uauguaaugcaaaa

SEQ ID NO: 2877360 - RNA, 15 nt, Human
uauguaaugcaaaau

SEQ ID NO: 2877361 - RNA, 17 nt, Human
uauguaaugcaaaauuu

SEQ ID NO: 2877362 - RNA, 23 nt, Human
uauguaaugugugguggccucag

SEQ ID NO: 2877363 - RNA, 14 nt, Human
uauguacaaguguu

SEQ ID NO: 2877364 - RNA, 14 nt, Human
uauguacaauugug

SEQ ID NO: 2877365 - RNA, 15 nt, Human
uauguacaugagaag

SEQ ID NO: 2877366 - RNA, 21 nt, Human
uauguaccauaugaucuguuu

SEQ ID NO: 2877367 - RNA, 22 nt, Human
uauguaccauaugaucuguuuu

SEQ ID NO: 2877368 - RNA, 21 nt, Human
uauguacuuuuauuuuacaca

SEQ ID NO: 2877369 - RNA, 21 nt, Human
uauguacuccucuuuacacug

SEQ ID NO: 2877370 - RNA, 14 nt, Human
uauguacuguacua

SEQ ID NO: 2877371 - RNA, 17 nt, Human
uauguagacuauauaca

SEQ ID NO: 2877372 - RNA, 18 nt, Human
uauguagacuauauacau

SEQ ID NO: 2877373 - RNA, 19 nt, Human
uauguagacuauauacaug

SEQ ID NO: 2877374 - RNA, 22 nt, Human
uauguagacuauauacaugugu

SEQ ID NO: 2877375 - RNA, 15 nt, Human
uauguagauauuugg

SEQ ID NO: 2877376 - RNA, 16 nt, Human
uauguagauauuuggc

SEQ ID NO: 2877377 - RNA, 17 nt, Human
uauguagauauuuggcu

SEQ ID NO: 2877378 - RNA, 18 nt, Human
uauguagauauuuggcuu

SEQ ID NO: 2877379 - RNA, 22 nt, Human
uauguagauauuuggcuuaaau

SEQ ID NO: 2877380 - RNA, 23 nt, Human
uauguagauauuuggcuuaaaua

SEQ ID NO: 2877381 - RNA, 18 nt, Human
uauguaggaaaaaaauag

SEQ ID NO: 2877382 - RNA, 14 nt, Human
uauguaguaauuga

SEQ ID NO: 2877383 - RNA, 20 nt, Human
uauguaguaauugacaugug

SEQ ID NO: 2877384 - RNA, 17 nt, Human
uauguaguaauugacau

SEQ ID NO: 2877385 - RNA, 21 nt, Human
uauguagcaggaaauaaagua

SEQ ID NO: 2877386 - RNA, 21 nt, Human
uauguaagaauucagaagacc

SEQ ID NO: 2877387 - RNA, 16 nt, Human
uauguaucagaagaga

SEQ ID NO: 2877388 - RNA, 19 nt, Human
uauguauauuuuuuuaauu

SEQ ID NO: 2877389 - RNA, 23 nt, Human
uauguauauuuuuuuaauuuaac

SEQ ID NO: 2877390 - RNA, 14 nt, Human
uauguaaaguaugu

SEQ ID NO: 2877391 - RNA, 17 nt, Human
uauguaaaguauguaaa

SEQ ID NO: 2877392 - RNA, 18 nt, Human
uauguaaaguauguaaac

SEQ ID NO: 2877393 - RNA, 19 nt, Human
uauguaaaguauguaaaca

SEQ ID NO: 2877394 - RNA, 20 nt, Human
uauguaaaguauguaaacag

SEQ ID NO: 2877395 - RNA, 19 nt, Human
uauguaaaauaaaauuaug

SEQ ID NO: 2877396 - RNA, 12 nt, Human
uauguaaaauaa

SEQ ID NO: 2877397 - RNA, 15 nt, Human
uauguaaacaggaga

SEQ ID NO: 2877398 - RNA, 15 nt, Human
uauguaaaauguuuu

SEQ ID NO: 2877399 - RNA, 17 nt, Human
uauguaaaauguuuuag

SEQ ID NO: 2877400 - RNA, 20 nt, Human
uauggaugauucagaaauug

SEQ ID NO: 2877401 - RNA, 22 nt, Human
uauggauucauuuauaagaaga

SEQ ID NO: 2877402 - RNA, 19 nt, Human
uauggaugauucagaaauu

SEQ ID NO: 2877403 - RNA, 22 nt, Human
uauggcagaaaaaaugucugua

SEQ ID NO: 2877404 - RNA, 14 nt, Human
uauggcaaaaaugg

SEQ ID NO: 2877405 - RNA, 12 nt, Human
uauggcagaaga

SEQ ID NO: 2877406 - RNA, 23 nt, Human
uauggauugggggggccaaaagg

SEQ ID NO: 2877407 - RNA, 15 nt, Human
uauggauuuguuaca

SEQ ID NO: 2877408 - RNA, 13 nt, Human
uauggcagaagac

SEQ ID NO: 2877409 - RNA, 14 nt, Human
uauggcagaagaca

SEQ ID NO: 2877410 - RNA, 15 nt, Human
uauggcagaagacac

SEQ ID NO: 2877411 - RNA, 16 nt, Human
uauggcagaagacacc

SEQ ID NO: 2877412 - RNA, 22 nt, Human
uauggcagaagacaccagagca

SEQ ID NO: 2877413 - RNA, 23 nt, Human
uauggcagaagacaccagagcag

SEQ ID NO: 2877414 - RNA, 13 nt, Human
uaugguuaugaaa

SEQ ID NO: 2877415 - RNA, 20 nt, Human
uaugguugauaguuuaccug

SEQ ID NO: 2877416 - RNA, 21 nt, Human
uaugguugauaguuuaccuga

SEQ ID NO: 2877417 - RNA, 22 nt, Human
uaugguugauaguuuaccugaa

SEQ ID NO: 2877418 - RNA, 11 nt, Human
uauuaaucuug

SEQ ID NO: 2877419 - RNA, 16 nt, Human
uauuaaucuuggauag

SEQ ID NO: 2877420 - RNA, 21 nt, Human
uauuaaucuuggauagcuaau

SEQ ID NO: 2877421 - RNA, 22 nt, Human
uauuaaucuuggauagcuaaua

SEQ ID NO: 2877422 - RNA, 13 nt, Human
uauuaauauuuaa

SEQ ID NO: 2877423 - RNA, 14 nt, Human
uauuaauauaugua

SEQ ID NO: 2877424 - RNA, 15 nt, Human
uauuaauacugguau

SEQ ID NO: 2877425 - RNA, 22 nt, Human
uauuaaauuuguugacaaaauu

SEQ ID NO: 2877426 - RNA, 12 nt, Human
uauguuugaaua

SEQ ID NO: 2877427 - RNA, 14 nt, Human
uauguuugaauaug

SEQ ID NO: 2877428 - RNA, 16 nt, Human
uauguuugaauaugga

SEQ ID NO: 2877429 - RNA, 17 nt, Human
uauguuugaauauggac

SEQ ID NO: 2877430 - RNA, 19 nt, Human
uauguuuaaucuguuaugu

SEQ ID NO: 2877431 - RNA, 22 nt, Human
uauuaagaggcagaaaauugca

SEQ ID NO: 2877432 - RNA, 19 nt, Human
uauguugcccaggcagguc

SEQ ID NO: 2877433 - RNA, 16 nt, Human
uauguugcccaggcag

SEQ ID NO: 2877434 - RNA, 13 nt, Human
uauguugcccagg

SEQ ID NO: 2877435 - RNA, 22 nt, Human
uauguuuagauagggcugggca

SEQ ID NO: 2877436 - RNA, 18 nt, Human
uauguuuauuuacuaauu

SEQ ID NO: 2877437 - RNA, 12 nt, Human
uauguuuccuug

SEQ ID NO: 2877438 - RNA, 14 nt, Human
uauguuuccuuguu

SEQ ID NO: 2877439 - RNA, 20 nt, Human
uauguugcccaggcaggucu

SEQ ID NO: 2877440 - RNA, 15 nt, Human
uaugucacuagaaug

SEQ ID NO: 2877441 - RNA, 23 nt, Human
uaugucauuuccuucaaggcauc

SEQ ID NO: 2877442 - RNA, 18 nt, Human
uauguugaauacuuuuua

SEQ ID NO: 2877443 - RNA, 14 nt, Human
uauguugauaaaag

SEQ ID NO: 2877444 - RNA, 18 nt, Human
uauguugauccauccagc

SEQ ID NO: 2877445 - RNA, 12 nt, Human
uauguauucuuu

SEQ ID NO: 2877446 - RNA, 18 nt, Human
uauguauuguaaacaugu

SEQ ID NO: 2877447 - RNA, 20 nt, Human
uauguauuguaaacaugugu

SEQ ID NO: 2877448 - RNA, 22 nt, Human
uauguauuguaaacauguguuu

SEQ ID NO: 2877449 - RNA, 16 nt, Human
uaugucaagaggcuga

SEQ ID NO: 2877450 - RNA, 11 nt, Human
uauguauuucc

SEQ ID NO: 2877451 - RNA, 10 nt, Human
uauguauuuu

SEQ ID NO: 2877452 - RNA, 21 nt, Human
uauguauuauuuauaauuccu

SEQ ID NO: 2877453 - RNA, 13 nt, Human
uauguauuauuua

SEQ ID NO: 2877454 - RNA, 18 nt, Human
uauguauuaauaaauaga

SEQ ID NO: 2877455 - RNA, 22 nt, Human
uauguauuaauaaauagagcaa

SEQ ID NO: 2877456 - RNA, 17 nt, Human
uauguauuagugauauu

SEQ ID NO: 2877457 - RNA, 20 nt, Human
uauguauuagugauauuucu

SEQ ID NO: 2877458 - RNA, 21 nt, Human
uauguauuagugauauuucuc

SEQ ID NO: 2877459 - RNA, 22 nt, Human
uauguauuagugauauuucucu

SEQ ID NO: 2877460 - RNA, 23 nt, Human
uauguauuagugauauuucucua

SEQ ID NO: 2877461 - RNA, 12 nt, Human
uauuauuaucuu

SEQ ID NO: 2877462 - RNA, 15 nt, Human
uauuauuaucuuuaa

SEQ ID NO: 2877463 - RNA, 15 nt, Human
uauuauuauuuuggg

SEQ ID NO: 2877464 - RNA, 19 nt, Human
uauuauuacuuauuuuuga

SEQ ID NO: 2877465 - RNA, 13 nt, Human
uauuauuagaaau

SEQ ID NO: 2877466 - RNA, 18 nt, Human
uauuauuagaaauuagaa

SEQ ID NO: 2877467 - RNA, 19 nt, Human
uauuauuagaaauuagaaa

SEQ ID NO: 2877468 - RNA, 21 nt, Human
uauuacacuguauuuguaucu

SEQ ID NO: 2877469 - RNA, 18 nt, Human
uauuacacauuuguacag

SEQ ID NO: 2877470 - RNA, 13 nt, Human
uauuacacuguau

SEQ ID NO: 2877471 - RNA, 17 nt, Human
uauuacacuguauuugu

SEQ ID NO: 2877472 - RNA, 19 nt, Human
uauuacacuguauuuguau

SEQ ID NO: 2877473 - RNA, 11 nt, Human
uauuacaaaua

SEQ ID NO: 2877474 - RNA, 21 nt, Human
uauuaauuguuuugcacuuuu

SEQ ID NO: 2877475 - RNA, 19 nt, Human
uauuaauuuucuacaaaua

SEQ ID NO: 2877476 - RNA, 13 nt, Human
uauuccagcucau

SEQ ID NO: 2877477 - RNA, 18 nt, Human
uauuccagcucauucauu

SEQ ID NO: 2877478 - RNA, 23 nt, Human
uauuccagcucauucauuuuaua

SEQ ID NO: 2877479 - RNA, 23 nt, Human
uauuccagaaugcuguacaucua

SEQ ID NO: 2877480 - RNA, 21 nt, Human
uauuccagaaugcuguacauc

SEQ ID NO: 2877481 - RNA, 14 nt, Human
uauuauugaaauug

SEQ ID NO: 2877482 - RNA, 15 nt, Human
uauuauugaaauugu

SEQ ID NO: 2877483 - RNA, 16 nt, Human
uauuccagaaugcugu

SEQ ID NO: 2877484 - RNA, 20 nt, Human
uauuccagaaugcuguacau

SEQ ID NO: 2877485 - RNA, 17 nt, Human
uauuccagaaugcugua

SEQ ID NO: 2877486 - RNA, 17 nt, Human
uauuccccauucuuccu

SEQ ID NO: 2877487 - RNA, 20 nt, Human
uauucccaagcccaugaguc

SEQ ID NO: 2877488 - RNA, 22 nt, Human
uauucccaagcccaugaguccu

SEQ ID NO: 2877489 - RNA, 15 nt, Human
uauuccauauuuauu

SEQ ID NO: 2877490 - RNA, 17 nt, Human
uauuccauauuuauuca

SEQ ID NO: 2877491 - RNA, 16 nt, Human
uauucgaaugaaaaga

SEQ ID NO: 2877492 - RNA, 17 nt, Human
uauucgaaugaaaagac

SEQ ID NO: 2877493 - RNA, 14 nt, Human
uauuccuucuggcc

SEQ ID NO: 2877494 - RNA, 15 nt, Human
uauuccuucuggccu

SEQ ID NO: 2877495 - RNA, 16 nt, Human
uauuccuucuggccuu

SEQ ID NO: 2877496 - RNA, 19 nt, Human
uauuccuucuggccuuucc

SEQ ID NO: 2877497 - RNA, 21 nt, Human
uauuccuucuggccuuuccuc

SEQ ID NO: 2877498 - RNA, 22 nt, Human
uauuccuugauacuaaaaguuc

SEQ ID NO: 2877499 - RNA, 16 nt, Human
uauuccuugaucauuu

SEQ ID NO: 2877500 - RNA, 12 nt, Human
uauuccuuuccc

SEQ ID NO: 2877501 - RNA, 13 nt, Human
uauuccuuucccu

SEQ ID NO: 2877502 - RNA, 15 nt, Human
uauuccuuucccuuc

SEQ ID NO: 2877503 - RNA, 16 nt, Human
uauuccuuucccuucc

SEQ ID NO: 2877504 - RNA, 17 nt, Human
uauuccuuucccuuccu

SEQ ID NO: 2877505 - RNA, 19 nt, Human
uauuccuuucccuuccucu

SEQ ID NO: 2877506 - RNA, 11 nt, Human
uauuccugccu

SEQ ID NO: 2877507 - RNA, 14 nt, Human
uauuccuguauguu

SEQ ID NO: 2877508 - RNA, 17 nt, Human
uauuccuguauguuguc

SEQ ID NO: 2877509 - RNA, 21 nt, Human
uauuccuuugggccucugcuu

SEQ ID NO: 2877510 - RNA, 17 nt, Human
uauuccugcauuuguga

SEQ ID NO: 2877511 - RNA, 19 nt, Human
uauuccugcauuugugaaa

SEQ ID NO: 2877512 - RNA, 20 nt, Human
uauuccugcauuugugaaau

SEQ ID NO: 2877513 - RNA, 21 nt, Human
uauuccugcauuugugaaaug

SEQ ID NO: 2877514 - RNA, 21 nt, Human
uauuccuauauaguuuauuga

SEQ ID NO: 2877515 - RNA, 20 nt, Human
uauuccuauauaguuuauug

SEQ ID NO: 2877516 - RNA, 14 nt, Human
uauuccuaguuggu

SEQ ID NO: 2877517 - RNA, 23 nt, Human
uauuccuaguuggugagaaaccu

SEQ ID NO: 2877518 - RNA, 24 nt, Human
uauuccuaguuggugagaaaccug

SEQ ID NO: 2877519 - RNA, 22 nt, Human
uauuccuauauaguuuauugac

SEQ ID NO: 2877520 - RNA, 15 nt, Human
uauucuaaaaccauu

SEQ ID NO: 2877521 - RNA, 19 nt, Human
uauucuagcuaauguaaua

SEQ ID NO: 2877522 - RNA, 22 nt, Human
uauucuaagacuuacucuaaga

SEQ ID NO: 2877523 - RNA, 23 nt, Human
uauucuaagacuuacucuaagau

SEQ ID NO: 2877524 - RNA, 11 nt, Human
uauucuaagac

SEQ ID NO: 2877525 - RNA, 12 nt, Human
uauucuaagacu

SEQ ID NO: 2877526 - RNA, 13 nt, Human
uauucuaagacuu

SEQ ID NO: 2877527 - RNA, 21 nt, Human
uauucuaagacuuacucuaag

SEQ ID NO: 2877528 - RNA, 13 nt, Human
uauucuacuauac

SEQ ID NO: 2877529 - RNA, 14 nt, Human
uauucuauaugaau

SEQ ID NO: 2877530 - RNA, 15 nt, Human
uauucuauaugaauu

SEQ ID NO: 2877531 - RNA, 17 nt, Human
uauucuauaugaauuua

SEQ ID NO: 2877532 - RNA, 19 nt, Human
uauucuauaugaauuuaaa

SEQ ID NO: 2877533 - RNA, 13 nt, Human
uauucuauuaacu

SEQ ID NO: 2877534 - RNA, 19 nt, Human
uauucuauuaacuuuaauu

SEQ ID NO: 2877535 - RNA, 17 nt, Human
uauuguuucuuuaucac

SEQ ID NO: 2877536 - RNA, 13 nt, Human
uauuguuucuuua

SEQ ID NO: 2877537 - RNA, 14 nt, Human
uauuguucaaacaa

SEQ ID NO: 2877538 - RNA, 16 nt, Human
uauuguucaaacaaua

SEQ ID NO: 2877539 - RNA, 20 nt, Human
uauuguucaaacaauaucau

SEQ ID NO: 2877540 - RNA, 17 nt, Human
uauuguuaacucuuguc

SEQ ID NO: 2877541 - RNA, 21 nt, Human
uauuguuaacucuugucuauu

SEQ ID NO: 2877542 - RNA, 14 nt, Human
uauuguuacucuua

SEQ ID NO: 2877543 - RNA, 18 nt, Human
uauuguuacucuuacgaa

SEQ ID NO: 2877544 - RNA, 20 nt, Human
uauuuaguuauaguuucaga

SEQ ID NO: 2877545 - RNA, 16 nt, Human
uauuuauaaagaaugu

SEQ ID NO: 2877546 - RNA, 12 nt, Human
uauuuaaacuau

SEQ ID NO: 2877547 - RNA, 15 nt, Human
uauuuaaacuaucuu

SEQ ID NO: 2877548 - RNA, 17 nt, Human
uauuuaaacucaagaca

SEQ ID NO: 2877549 - RNA, 16 nt, Human
uauuuaaacuuauaaa

SEQ ID NO: 2877550 - RNA, 20 nt, Human
uauuuaaacuuauaaaucau

SEQ ID NO: 2877551 - RNA, 21 nt, Human
uauuuaaacuuauaaaucaua

SEQ ID NO: 2877552 - RNA, 12 nt, Human
uauuuaaaaaug

SEQ ID NO: 2877553 - RNA, 13 nt, Human
uauuuaaaaaugu

SEQ ID NO: 2877554 - RNA, 15 nt, Human
uauuuaaaaaugucu

SEQ ID NO: 2877555 - RNA, 16 nt, Human
uauuuaaaaaugucuu

SEQ ID NO: 2877556 - RNA, 17 nt, Human
uauuuaaaaaugucuug

SEQ ID NO: 2877557 - RNA, 18 nt, Human
uauuuaaaaaugucuugc

SEQ ID NO: 2877558 - RNA, 12 nt, Human
uauuuaaaagau

SEQ ID NO: 2877559 - RNA, 13 nt, Human
uauuuaaaagauu

SEQ ID NO: 2877560 - RNA, 15 nt, Human
uauuuaaaagauuca

SEQ ID NO: 2877561 - RNA, 16 nt, Human
uauuuaaaagauucau

SEQ ID NO: 2877562 - RNA, 14 nt, Human
uauuguguugugaa

SEQ ID NO: 2877563 - RNA, 16 nt, Human
uauuguguuuguguau

SEQ ID NO: 2877564 - RNA, 15 nt, Human
uauuggaaaaaucac

SEQ ID NO: 2877565 - RNA, 18 nt, Human
uauuggaaauggaugcaa

SEQ ID NO: 2877566 - RNA, 19 nt, Human
uauuggaaauggaugcaaa

SEQ ID NO: 2877567 - RNA, 19 nt, Human
uauugauucugcuugagaa

SEQ ID NO: 2877568 - RNA, 14 nt, Human
uauugcuaguauuu

SEQ ID NO: 2877569 - RNA, 15 nt, Human
uauugcuaguauuug

SEQ ID NO: 2877570 - RNA, 16 nt, Human
uauugcuaguauuuga

SEQ ID NO: 2877571 - RNA, 17 nt, Human
uauugcuaguauuugaa

SEQ ID NO: 2877572 - RNA, 18 nt, Human
uauugcuaguauuugaau

SEQ ID NO: 2877573 - RNA, 20 nt, Human
uauugcuaguauuugaauua

SEQ ID NO: 2877574 - RNA, 13 nt, Human
uauugaugaaaag

SEQ ID NO: 2877575 - RNA, 17 nt, Human
uauugaugaaaagauuu

SEQ ID NO: 2877576 - RNA, 18 nt, Human
uauugaugaaaagauuua

SEQ ID NO: 2877577 - RNA, 23 nt, Human
uauugaugaaaagauuuaagcac

SEQ ID NO: 2877578 - RNA, 14 nt, Human
uauugcgcugcuac

SEQ ID NO: 2877579 - RNA, 22 nt, Human
uauugcaaagguuccaacugua

SEQ ID NO: 2877580 - RNA, 15 nt, Human
uauugccuucuuuga

SEQ ID NO: 2877581 - RNA, 16 nt, Human
uauugccuucuuugaa

SEQ ID NO: 2877582 - RNA, 17 nt, Human
uauugccuucuuugaag

SEQ ID NO: 2877583 - RNA, 18 nt, Human
uauugccuucuuugaaga

SEQ ID NO: 2877584 - RNA, 19 nt, Human
uauugccuucuuugaagaa

SEQ ID NO: 2877585 - RNA, 20 nt, Human
uauugcaaaauagcauuugu

SEQ ID NO: 2877586 - RNA, 21 nt, Human
uauugcaaagguuccaacugu

SEQ ID NO: 2877587 - RNA, 23 nt, Human
uauugcaaagguuccaacuguau

SEQ ID NO: 2877588 - RNA, 20 nt, Human
ucaaauuggacuuucaaaau

SEQ ID NO: 2877589 - RNA, 23 nt, Human
ucaaccccuucgcuccugugucu

SEQ ID NO: 2877590 - RNA, 20 nt, Human
ucaaauugucagcaauuuaa

SEQ ID NO: 2877591 - RNA, 19 nt, Human
ucaacccucaggggaaaac

SEQ ID NO: 2877592 - RNA, 19 nt, Human
ucaaaugcucagaccagcu

SEQ ID NO: 2877593 - RNA, 14 nt, Human
ucaaaugcucagac

SEQ ID NO: 2877594 - RNA, 16 nt, Human
ucaaaugcaguauauu

SEQ ID NO: 2877595 - RNA, 19 nt, Human
ucaaaugcaguauauuucu

SEQ ID NO: 2877596 - RNA, 20 nt, Human
ucaaaugcaguauauuucuu

SEQ ID NO: 2877597 - RNA, 16 nt, Human
ucaaauccuuccaaaa

SEQ ID NO: 2877598 - RNA, 19 nt, Human
ucaaauccuuccaaaaauu

SEQ ID NO: 2877599 - RNA, 21 nt, Human
ucaaauccuuccaaaaauuau

SEQ ID NO: 2877600 - RNA, 22 nt, Human
ucaaauccuuccaaaaauuauu

SEQ ID NO: 2877601 - RNA, 20 nt, Human
ucaaauuaaaacagcugcau

SEQ ID NO: 2877602 - RNA, 21 nt, Human
ucaaaugcucagaccagcucu

SEQ ID NO: 2877603 - RNA, 20 nt, Human
ucaaauggaagacacauuga

SEQ ID NO: 2877604 - RNA, 18 nt, Human
ucaaaugggcugcugcuu

SEQ ID NO: 2877605 - RNA, 17 nt, Human
ucaaauggaagacacau

SEQ ID NO: 2877606 - RNA, 16 nt, Human
ucaaagagaaaacuua

SEQ ID NO: 2877607 - RNA, 15 nt, Human
ucaaaucagucagug

SEQ ID NO: 2877608 - RNA, 24 nt, Human
ucaaaucagucagugcaaauguca

SEQ ID NO: 2877609 - RNA, 16 nt, Human
ucaaauccacccauau

SEQ ID NO: 2877610 - RNA, 22 nt, Human
ucaaauccacccauauguuaaa

SEQ ID NO: 2877611 - RNA, 23 nt, Human
ucaaaucaggcuacuagaauucu

SEQ ID NO: 2877612 - RNA, 14 nt, Human
ucaaaucagucagu

SEQ ID NO: 2877613 - RNA, 22 nt, Human
ucaaagaaggauggcaccuaaa

SEQ ID NO: 2877614 - RNA, 16 nt, Human
ucaaagaaggauggca

SEQ ID NO: 2877615 - RNA, 16 nt, Human
ucaaagaauaagaaaa

SEQ ID NO: 2877616 - RNA, 12 nt, Human
ucaaagaaaugc

SEQ ID NO: 2877617 - RNA, 16 nt, Human
ucaaagaaaugcugau

SEQ ID NO: 2877618 - RNA, 19 nt, Human
ucaaagaaaugcugaugga

SEQ ID NO: 2877619 - RNA, 21 nt, Human
ucaaaacacaucuuuccuguc

SEQ ID NO: 2877620 - RNA, 12 nt, Human
ucaaaacacugu

SEQ ID NO: 2877621 - RNA, 13 nt, Human
ucaaaacacugug

SEQ ID NO: 2877622 - RNA, 14 nt, Human
ucaaaacacugugg

SEQ ID NO: 2877623 - RNA, 15 nt, Human
ucaaaacacugugga

SEQ ID NO: 2877624 - RNA, 16 nt, Human
ucaaaacacuguggaa

SEQ ID NO: 2877625 - RNA, 17 nt, Human
ucaaaacacuguggaac

SEQ ID NO: 2877626 - RNA, 14 nt, Human
ucaaaaauauaacu

SEQ ID NO: 2877627 - RNA, 15 nt, Human
ucaaaaauauaacuu

SEQ ID NO: 2877628 - RNA, 16 nt, Human
ucaaaaauauaacuua

SEQ ID NO: 2877629 - RNA, 20 nt, Human
ucaaaaauuaucuauagcua

SEQ ID NO: 2877630 - RNA, 16 nt, Human
ucaaaaauugaagaga

SEQ ID NO: 2877631 - RNA, 18 nt, Human
ucaaaaauugaagagaga

SEQ ID NO: 2877632 - RNA, 21 nt, Human
ucaaaaauugaagagagauau

SEQ ID NO: 2877633 - RNA, 20 nt, Human
uauuuuauuauccuagauua

SEQ ID NO: 2877634 - RNA, 22 nt, Human
uauuuauaauagcaacuuuugu

SEQ ID NO: 2877635 - RNA, 16 nt, Human
uauuuauagucauuua

SEQ ID NO: 2877636 - RNA, 15 nt, Human
uauuuauaauuccua

SEQ ID NO: 2877637 - RNA, 19 nt, Human
uauuuauacaagauugaaa

SEQ ID NO: 2877638 - RNA, 20 nt, Human
uauuuauacaagauugaaaa

SEQ ID NO: 2877639 - RNA, 20 nt, Human
uauuuauaacucaucauaaa

SEQ ID NO: 2877640 - RNA, 13 nt, Human
uauuuauaacuca

SEQ ID NO: 2877641 - RNA, 22 nt, Human
uauuuauaacucaucauaaaau

SEQ ID NO: 2877642 - RNA, 21 nt, Human
uauuuauaacucaucauaaaa

SEQ ID NO: 2877643 - RNA, 23 nt, Human
uauuuauaacucaucauaaaaua

SEQ ID NO: 2877644 - RNA, 16 nt, Human
uauuuuccccuaucau

SEQ ID NO: 2877645 - RNA, 19 nt, Human
uauuuuccccuaucauuua

SEQ ID NO: 2877646 - RNA, 20 nt, Human
uauuuuccccuaucauuuau

SEQ ID NO: 2877647 - RNA, 21 nt, Human
uauuuuccccuaucauuuauu

SEQ ID NO: 2877648 - RNA, 13 nt, Human
uauuuuauguuua

SEQ ID NO: 2877649 - RNA, 20 nt, Human
uauuuuauuuccaucauguc

SEQ ID NO: 2877650 - RNA, 19 nt, Human
uauuuuauucccuuucaca

SEQ ID NO: 2877651 - RNA, 13 nt, Human
uauuuuauucccu

SEQ ID NO: 2877652 - RNA, 15 nt, Human
uauuuuuucuugcau

SEQ ID NO: 2877653 - RNA, 18 nt, Human
uauuuuuucuugcauuga

SEQ ID NO: 2877654 - RNA, 19 nt, Human
uauuuuuucuugcauugac

SEQ ID NO: 2877655 - RNA, 12 nt, Human
uauuuucuguca

SEQ ID NO: 2877656 - RNA, 13 nt, Human
uauuuucugucag

SEQ ID NO: 2877657 - RNA, 14 nt, Human
uauuuucugucaga

SEQ ID NO: 2877658 - RNA, 17 nt, Human
uauuuucugucagauga

SEQ ID NO: 2877659 - RNA, 20 nt, Human
uauuuucugucagaugagaa

SEQ ID NO: 2877660 - RNA, 21 nt, Human
uauuuucugucagaugagaac

SEQ ID NO: 2877661 - RNA, 22 nt, Human
uauuuucugucagaugagaaca

SEQ ID NO: 2877662 - RNA, 16 nt, Human
uauuuuccuaaagaga

SEQ ID NO: 2877663 - RNA, 12 nt, Human
uauuuuccuaaa

SEQ ID NO: 2877664 - RNA, 14 nt, Human
uauuuucuauguac

SEQ ID NO: 2877665 - RNA, 15 nt, Human
uauuuucuauguacu

SEQ ID NO: 2877666 - RNA, 16 nt, Human
uauuuucuauguacua

SEQ ID NO: 2877667 - RNA, 17 nt, Human
uauuuucuauguacuag

SEQ ID NO: 2877668 - RNA, 21 nt, Human
uauuuucuauguacuaguacu

SEQ ID NO: 2877669 - RNA, 16 nt, Human
uauuuucguaugaaaa

SEQ ID NO: 2877670 - RNA, 17 nt, Human
uauuuucguaugaaaau

SEQ ID NO: 2877671 - RNA, 20 nt, Human
uauuuuuuuuuuuugaaaaa

SEQ ID NO: 2877672 - RNA, 15 nt, Human
uauuuuuuuuuuccu

SEQ ID NO: 2877673 - RNA, 19 nt, Human
uauuuuuuuguaauugcuu

SEQ ID NO: 2877674 - RNA, 16 nt, Human
uauuuuuuuaauuuaa

SEQ ID NO: 2877675 - RNA, 18 nt, Human
uauuuuuuuaauuuaaca

SEQ ID NO: 2877676 - RNA, 20 nt, Human
uauuuuuuuaauuuaacaug

SEQ ID NO: 2877677 - RNA, 17 nt, Human
uauuuuuuuuaaguauu

SEQ ID NO: 2877678 - RNA, 18 nt, Human
uauuuuuuuuaauauuau

SEQ ID NO: 2877679 - RNA, 19 nt, Human
uauuuuuuuuaauauuauu

SEQ ID NO: 2877680 - RNA, 21 nt, Human
ucaaguuuuaagugaaaguga

SEQ ID NO: 2877681 - RNA, 19 nt, Human
ucaaguuuuggguauguuu

SEQ ID NO: 2877682 - RNA, 21 nt, Human
ucaaguuuuggguauguuuaa

SEQ ID NO: 2877683 - RNA, 12 nt, Human
ucaauaaacuua

SEQ ID NO: 2877684 - RNA, 14 nt, Human
ucaauaaagaaaac

SEQ ID NO: 2877685 - RNA, 15 nt, Human
ucaauaaagaaaacu

SEQ ID NO: 2877686 - RNA, 16 nt, Human
ucaauaaagaaaacuu

SEQ ID NO: 2877687 - RNA, 21 nt, Human
ucaauaaagaaaacuuccaua

SEQ ID NO: 2877688 - RNA, 20 nt, Human
ucaaguuugggucugugcug

SEQ ID NO: 2877689 - RNA, 21 nt, Human
ucaaguuguaacuuauauuga

SEQ ID NO: 2877690 - RNA, 16 nt, Human
ucaaguucuaagauuc

SEQ ID NO: 2877691 - RNA, 17 nt, Human
ucaaguucuaagauucu

SEQ ID NO: 2877692 - RNA, 18 nt, Human
ucaaguucuaagauucua

SEQ ID NO: 2877693 - RNA, 19 nt, Human
ucaaguucuaagauucuaa

SEQ ID NO: 2877694 - RNA, 14 nt, Human
ucaaguuccuuugg

SEQ ID NO: 2877695 - RNA, 16 nt, Human
ucaaguuccuuugggu

SEQ ID NO: 2877696 - RNA, 13 nt, Human
ucaaguucuaaga

SEQ ID NO: 2877697 - RNA, 14 nt, Human
ucaaguucuaagau

SEQ ID NO: 2877698 - RNA, 15 nt, Human
ucaaguucuaagauu

SEQ ID NO: 2877699 - RNA, 20 nt, Human
ucaagugauucuccugccuc

SEQ ID NO: 2877700 - RNA, 18 nt, Human
ucaagugauucuccugcc

SEQ ID NO: 2877701 - RNA, 21 nt, Human
ucaagugauucuccugccuca

SEQ ID NO: 2877702 - RNA, 19 nt, Human
ucaagugauucuccugccu

SEQ ID NO: 2877703 - RNA, 21 nt, Human
ucaaauaugaguacaaaugcc

SEQ ID NO: 2877704 - RNA, 13 nt, Human
ucaaguuauugua

SEQ ID NO: 2877705 - RNA, 17 nt, Human
ucaaguuauuguacagc

SEQ ID NO: 2877706 - RNA, 18 nt, Human
ucaacgcagcccugcuuu

SEQ ID NO: 2877707 - RNA, 14 nt, Human
ucaacgcagcccug

SEQ ID NO: 2877708 - RNA, 15 nt, Human
ucaacgcagcccugc

SEQ ID NO: 2877709 - RNA, 23 nt, Human
ucaaccuuaagaccuacuguucu

SEQ ID NO: 2877710 - RNA, 15 nt, Human
ucaaccuuaagaccu

SEQ ID NO: 2877711 - RNA, 16 nt, Human
ucaacccuucuggaaa

SEQ ID NO: 2877712 - RNA, 12 nt, Human
ucaauaauaaaa

SEQ ID NO: 2877713 - RNA, 13 nt, Human
ucaauaagaaggu

SEQ ID NO: 2877714 - RNA, 22 nt, Human
ucaauaagaagguagaaugagu

SEQ ID NO: 2877715 - RNA, 16 nt, Human
ucaauaaaugucuguu

SEQ ID NO: 2877716 - RNA, 12 nt, Human
ucaauaaaucuu

SEQ ID NO: 2877717 - RNA, 15 nt, Human
ucaauaaaugucugu

SEQ ID NO: 2877718 - RNA, 12 nt, Human
ucaaugugaaaa

SEQ ID NO: 2877719 - RNA, 15 nt, Human
ucaaugugauucuaa

SEQ ID NO: 2877720 - RNA, 16 nt, Human
ucaaugugauucuaau

SEQ ID NO: 2877721 - RNA, 17 nt, Human
ucaaugugauucuaaug

SEQ ID NO: 2877722 - RNA, 18 nt, Human
ucaaugugauucuaaugu

SEQ ID NO: 2877723 - RNA, 21 nt, Human
ucaaugugauucuaaugucuu

SEQ ID NO: 2877724 - RNA, 20 nt, Human
ucaauguucacgcaacuuga

SEQ ID NO: 2877725 - RNA, 21 nt, Human
ucaauguucacgcaacuugaa

SEQ ID NO: 2877726 - RNA, 22 nt, Human
ucaauguucacgcaacuugaaa

SEQ ID NO: 2877727 - RNA, 22 nt, Human
ucaaugugauucuaaugucuuc

SEQ ID NO: 2877728 - RNA, 15 nt, Human
ucacaccucacucuu

SEQ ID NO: 2877729 - RNA, 22 nt, Human
ucacaccucacucuuuauagug

SEQ ID NO: 2877730 - RNA, 12 nt, Human
ucacacccugca

SEQ ID NO: 2877731 - RNA, 13 nt, Human
ucacacccugcaa

SEQ ID NO: 2877732 - RNA, 14 nt, Human
ucacacccugcaag

SEQ ID NO: 2877733 - RNA, 15 nt, Human
ucacacccugcaagg

SEQ ID NO: 2877734 - RNA, 17 nt, Human
ucacacccugcaaggcc

SEQ ID NO: 2877735 - RNA, 20 nt, Human
ucacacccugcaaggcccac

SEQ ID NO: 2877736 - RNA, 21 nt, Human
ucacacccugcaaggcccaca

SEQ ID NO: 2877737 - RNA, 23 nt, Human
ucacacccugcaaggcccacagg

SEQ ID NO: 2877738 - RNA, 23 nt, Human
ucacaccaggcuugccugcaggc

SEQ ID NO: 2877739 - RNA, 18 nt, Human
ucacaggcagguccaggg

SEQ ID NO: 2877740 - RNA, 17 nt, Human
ucacaggcagguccagg

SEQ ID NO: 2877741 - RNA, 16 nt, Human
ucacaggcagguccag

SEQ ID NO: 2877742 - RNA, 17 nt, Human
ucacauuuuuuaugggc

SEQ ID NO: 2877743 - RNA, 20 nt, Human
ucaccacaugcggagaacaa

SEQ ID NO: 2877744 - RNA, 21 nt, Human
ucaccagauuugcuaauuuau

SEQ ID NO: 2877745 - RNA, 13 nt, Human
ucaccagcaccaa

SEQ ID NO: 2877746 - RNA, 19 nt, Human
ucaccagcaccaacaccac

SEQ ID NO: 2877747 - RNA, 15 nt, Human
ucaccagauuugcua

SEQ ID NO: 2877748 - RNA, 12 nt, Human
ucaccaaggaaa

SEQ ID NO: 2877749 - RNA, 13 nt, Human
ucaccaaggaaac

SEQ ID NO: 2877750 - RNA, 16 nt, Human
ucacagugacccuucc

SEQ ID NO: 2877751 - RNA, 17 nt, Human
ucacagugacccuuccc

SEQ ID NO: 2877752 - RNA, 18 nt, Human
ucacagugacccuuccca

SEQ ID NO: 2877753 - RNA, 15 nt, Human
ucacagucccacugu

SEQ ID NO: 2877754 - RNA, 17 nt, Human
ucacagucccacugugc

SEQ ID NO: 2877755 - RNA, 18 nt, Human
ucacagucccacugugca

SEQ ID NO: 2877756 - RNA, 22 nt, Human
ucacagucccacugugcaggug

SEQ ID NO: 2877757 - RNA, 14 nt, Human
ucacagugcugugu

SEQ ID NO: 2877758 - RNA, 17 nt, Human
ucacagugcugugugcc

SEQ ID NO: 2877759 - RNA, 17 nt, Human
ucacauuuauucugcuc

SEQ ID NO: 2877760 - RNA, 19 nt, Human
ucacauuuauucugcucac

SEQ ID NO: 2877761 - RNA, 18 nt, Human
ucacauuuauucugcuca

SEQ ID NO: 2877762 - RNA, 16 nt, Human
uccuuggaaguuucau

SEQ ID NO: 2877763 - RNA, 12 nt, Human
uccuuggcacca

SEQ ID NO: 2877764 - RNA, 14 nt, Human
uccuuggcaccaaa

SEQ ID NO: 2877765 - RNA, 15 nt, Human
uccuuggcaccaaag

SEQ ID NO: 2877766 - RNA, 16 nt, Human
uccuuggcaccaaaga

SEQ ID NO: 2877767 - RNA, 10 nt, Human
uccuuuguuc

SEQ ID NO: 2877768 - RNA, 20 nt, Human
uccuuggcaucacagggcag

SEQ ID NO: 2877769 - RNA, 22 nt, Human
uccuuuguuuucugacuaauua

SEQ ID NO: 2877770 - RNA, 18 nt, Human
uccuuuguuuucugacua

SEQ ID NO: 2877771 - RNA, 20 nt, Human
uccuuuguuuucugacuaau

SEQ ID NO: 2877772 - RNA, 24 nt, Human
uccuuuguucuuaccuguaugucu

SEQ ID NO: 2877773 - RNA, 16 nt, Human
uccuuuguucuuaccu

SEQ ID NO: 2877774 - RNA, 19 nt, Human
uccuuuuaaaacacuucca

SEQ ID NO: 2877775 - RNA, 19 nt, Human
ucgaaaccugggauucagg

SEQ ID NO: 2877776 - RNA, 14 nt, Human
ucgaaagcucuaga

SEQ ID NO: 2877777 - RNA, 16 nt, Human
ucgaaagcucuagaau

SEQ ID NO: 2877778 - RNA, 13 nt, Human
ucgaaacacagaa

SEQ ID NO: 2877779 - RNA, 18 nt, Human
ucgaaacacagaaaccuu

SEQ ID NO: 2877780 - RNA, 15 nt, Human
uccuuuuccucucuc

SEQ ID NO: 2877781 - RNA, 15 nt, Human
uccuuuuauagguga

SEQ ID NO: 2877782 - RNA, 12 nt, Human
uccuuuuaugug

SEQ ID NO: 2877783 - RNA, 20 nt, Human
ucgaggcugcagucagucau

SEQ ID NO: 2877784 - RNA, 16 nt, Human
ucgaggcugcagucag

SEQ ID NO: 2877785 - RNA, 12 nt, Human
ucgaaauaacaa

SEQ ID NO: 2877786 - RNA, 14 nt, Human
ucgaaauaacaaug

SEQ ID NO: 2877787 - RNA, 19 nt, Human
ucgaaagcucuagaaucug

SEQ ID NO: 2877788 - RNA, 16 nt, Human
ucgaaauaacaauguu

SEQ ID NO: 2877789 - RNA, 18 nt, Human
ucgaaauaacaauguuaa

SEQ ID NO: 2877790 - RNA, 19 nt, Human
ucgaaauaacaauguuaag

SEQ ID NO: 2877791 - RNA, 20 nt, Human
ucgaaauaacaauguuaagg

SEQ ID NO: 2877792 - RNA, 15 nt, Human
ucgaacuccugaccu

SEQ ID NO: 2877793 - RNA, 18 nt, Human
ucgaaccguuuugaagcu

SEQ ID NO: 2877794 - RNA, 15 nt, Human
ucgaaccguuuugaa

SEQ ID NO: 2877795 - RNA, 12 nt, Human
uccuucagacac

SEQ ID NO: 2877796 - RNA, 13 nt, Human
uccuucagacacc

SEQ ID NO: 2877797 - RNA, 13 nt, Human
uccuugaucauuu

SEQ ID NO: 2877798 - RNA, 22 nt, Human
uccuugcuuaugacaucacuug

SEQ ID NO: 2877799 - RNA, 15 nt, Human
uccuugcuuguuaca

SEQ ID NO: 2877800 - RNA, 16 nt, Human
uccuugagagaccagg

SEQ ID NO: 2877801 - RNA, 20 nt, Human
uccuugagagaccaggcaaa

SEQ ID NO: 2877802 - RNA, 17 nt, Human
uccuugagacacggagc

SEQ ID NO: 2877803 - RNA, 14 nt, Human
uccuugaccuuccu

SEQ ID NO: 2877804 - RNA, 17 nt, Human
uccuugaccuuccucug

SEQ ID NO: 2877805 - RNA, 19 nt, Human
uccuugaccuuccucuggg

SEQ ID NO: 2877806 - RNA, 21 nt, Human
uccuugaccuuccucuggggc

SEQ ID NO: 2877807 - RNA, 22 nt, Human
uccuugaccuuccucuggggcu

SEQ ID NO: 2877808 - RNA, 21 nt, Human
uccuugagacacggagcccag

SEQ ID NO: 2877809 - RNA, 23 nt, Human
uccuugagacacggagcccagcc

SEQ ID NO: 2877810 - RNA, 19 nt, Human
uccuugaauaucuuucgau

SEQ ID NO: 2877811 - RNA, 14 nt, Human
uccugccucagccu

SEQ ID NO: 2877812 - RNA, 13 nt, Human
uccucuucuuuau

SEQ ID NO: 2877813 - RNA, 20 nt, Human
uccugagauuuccuccuggc

SEQ ID NO: 2877814 - RNA, 14 nt, Human
uccuggcacccggc

SEQ ID NO: 2877815 - RNA, 19 nt, Human
uccuggcacccggccccug

SEQ ID NO: 2877816 - RNA, 16 nt, Human
uccuggcacccggccc

SEQ ID NO: 2877817 - RNA, 15 nt, Human
uccugccucagccuc

SEQ ID NO: 2877818 - RNA, 13 nt, Human
uccugccucagcc

SEQ ID NO: 2877819 - RNA, 16 nt, Human
uccugccucagccucc

SEQ ID NO: 2877820 - RNA, 17 nt, Human
uccugccucagccuccc

SEQ ID NO: 2877821 - RNA, 11 nt, Human
uccuguccucc

SEQ ID NO: 2877822 - RNA, 21 nt, Human
uccuguccucccauccccugg

SEQ ID NO: 2877823 - RNA, 16 nt, Human
uccuguaagccaaaga

SEQ ID NO: 2877824 - RNA, 17 nt, Human
uccuguaagccaaagaa

SEQ ID NO: 2877825 - RNA, 21 nt, Human
uccuguaagccaaagaaauga

SEQ ID NO: 2877826 - RNA, 23 nt, Human
uccuguaagccaaagaaaugaac

SEQ ID NO: 2877827 - RNA, 15 nt, Human
uccuggcagcccaga

SEQ ID NO: 2877828 - RNA, 14 nt, Human
uccuggcagcccag

SEQ ID NO: 2877829 - RNA, 13 nt, Human
uccuggcagccca

SEQ ID NO: 2877830 - RNA, 14 nt, Human
uccuggcagaaggg

SEQ ID NO: 2877831 - RNA, 11 nt, Human
uccuggcagcc

SEQ ID NO: 2877832 - RNA, 22 nt, Human
uccuggcacccggccccugcug

SEQ ID NO: 2877833 - RNA, 21 nt, Human
uccuggcacccggccccugcu

SEQ ID NO: 2877834 - RNA, 20 nt, Human
uccuggcacccggccccugc

SEQ ID NO: 2877835 - RNA, 16 nt, Human
ucguuaaaaaguuguu

SEQ ID NO: 2877836 - RNA, 17 nt, Human
ucguuaaaaaguuguuu

SEQ ID NO: 2877837 - RNA, 19 nt, Human
ucgugugcaacagacaagu

SEQ ID NO: 2877838 - RNA, 15 nt, Human
ucguguguagaaaaa

SEQ ID NO: 2877839 - RNA, 17 nt, Human
ucgugugcaacagacaa

SEQ ID NO: 2877840 - RNA, 14 nt, Human
ucuaaaucuauuua

SEQ ID NO: 2877841 - RNA, 16 nt, Human
ucuaaaucuauuuauu

SEQ ID NO: 2877842 - RNA, 17 nt, Human
ucuaaaucuauuuauua

SEQ ID NO: 2877843 - RNA, 19 nt, Human
ucuaaaucuauuuauuaau

SEQ ID NO: 2877844 - RNA, 20 nt, Human
ucuaaaucuauuuauuaaua

SEQ ID NO: 2877845 - RNA, 21 nt, Human
ucuaaaucuauuuauuaauau

SEQ ID NO: 2877846 - RNA, 17 nt, Human
ucuaaauauucagaauc

SEQ ID NO: 2877847 - RNA, 15 nt, Human
ucguuagaccgcucu

SEQ ID NO: 2877848 - RNA, 23 nt, Human
ucguuagaccgcucucuuuucug

SEQ ID NO: 2877849 - RNA, 19 nt, Human
ucuaacacuggcauguuca

SEQ ID NO: 2877850 - RNA, 15 nt, Human
ucuaauauauaugaa

SEQ ID NO: 2877851 - RNA, 19 nt, Human
ucuaauauauaugaauaaa

SEQ ID NO: 2877852 - RNA, 15 nt, Human
ucuaauauauuuuua

SEQ ID NO: 2877853 - RNA, 14 nt, Human
ucuaauaucauuca

SEQ ID NO: 2877854 - RNA, 17 nt, Human
ucuaauaucauucacua

SEQ ID NO: 2877855 - RNA, 14 nt, Human
ucuaauauggccac

SEQ ID NO: 2877856 - RNA, 20 nt, Human
ucuaauauggcaaaaauggc

SEQ ID NO: 2877857 - RNA, 19 nt, Human
ucuaauauccccaaauuag

SEQ ID NO: 2877858 - RNA, 20 nt, Human
ucuaauauccccaaauuagg

SEQ ID NO: 2877859 - RNA, 21 nt, Human
ucuaauagcggguuacuuuca

SEQ ID NO: 2877860 - RNA, 15 nt, Human
ucgaggucagaggag

SEQ ID NO: 2877861 - RNA, 14 nt, Human
ucgaggugccuucu

SEQ ID NO: 2877862 - RNA, 17 nt, Human
ucgaggugccuucuuca

SEQ ID NO: 2877863 - RNA, 20 nt, Human
ucgaggugccuucuucaggg

SEQ ID NO: 2877864 - RNA, 23 nt, Human
ucgaggugccuucuucagggccu

SEQ ID NO: 2877865 - RNA, 14 nt, Human
ucgaggggcucuca

SEQ ID NO: 2877866 - RNA, 16 nt, Human
ucgaggggcucucagc

SEQ ID NO: 2877867 - RNA, 18 nt, Human
ucgaggggcucucagcuc

SEQ ID NO: 2877868 - RNA, 20 nt, Human
ucgaggggcucucagcucag

SEQ ID NO: 2877869 - RNA, 14 nt, Human
ucgugagucauuua

SEQ ID NO: 2877870 - RNA, 19 nt, Human
ucgugagucauuuaaaugu

SEQ ID NO: 2877871 - RNA, 22 nt, Human
ucggccucccaaagugcuggga

SEQ ID NO: 2877872 - RNA, 23 nt, Human
ucguggcagauaaucagccucuu

SEQ ID NO: 2877873 - RNA, 22 nt, Human
ucguggcagauaaucagccucu

SEQ ID NO: 2877874 - RNA, 18 nt, Human
ucgugcggaaucagcuuc

SEQ ID NO: 2877875 - RNA, 20 nt, Human
ucgugcccccccuucccccu

SEQ ID NO: 2877876 - RNA, 15 nt, Human
ucgugauaaacuuug

SEQ ID NO: 2877877 - RNA, 13 nt, Human
ucgugauggggca

SEQ ID NO: 2877878 - RNA, 16 nt, Human
ucuaugagucuagaug

SEQ ID NO: 2877879 - RNA, 20 nt, Human
ucuaucaacuuuaaucaagu

SEQ ID NO: 2877880 - RNA, 23 nt, Human
ucuaucaacuuuaaucaaguugu

SEQ ID NO: 2877881 - RNA, 14 nt, Human
ucuaucaagcccag

SEQ ID NO: 2877882 - RNA, 18 nt, Human
ucuaugagucuagauguu

SEQ ID NO: 2877883 - RNA, 11 nt, Human
ucuaugauaua

SEQ ID NO: 2877884 - RNA, 16 nt, Human
ucucaaaguuuugaaa

SEQ ID NO: 2877885 - RNA, 22 nt, Human
ucucaaaguuuccuaaucagaa

SEQ ID NO: 2877886 - RNA, 12 nt, Human
ucuaugcucucg

SEQ ID NO: 2877887 - RNA, 15 nt, Human
ucuaugcugcuuuua

SEQ ID NO: 2877888 - RNA, 22 nt, Human
ucuaugcugcuuuuauaucugu

SEQ ID NO: 2877889 - RNA, 21 nt, Human
ucuaugcuguuuguagugaaa

SEQ ID NO: 2877890 - RNA, 22 nt, Human
ucuaugauucguguaauuacuu

SEQ ID NO: 2877891 - RNA, 14 nt, Human
ucuaugccagcuca

SEQ ID NO: 2877892 - RNA, 18 nt, Human
ucuaugccccaaauauag

SEQ ID NO: 2877893 - RNA, 19 nt, Human
ucuaggagggagacacugg

SEQ ID NO: 2877894 - RNA, 13 nt, Human
ucuagaacacagg

SEQ ID NO: 2877895 - RNA, 16 nt, Human
ucuagaacacaggcaa

SEQ ID NO: 2877896 - RNA, 15 nt, Human
ucuagaacacaggca

SEQ ID NO: 2877897 - RNA, 18 nt, Human
ucuaggacgccacccagc

SEQ ID NO: 2877898 - RNA, 23 nt, Human
ucuaggaccaugguuaagagucc

SEQ ID NO: 2877899 - RNA, 20 nt, Human
ucgugauuuucaagcagcau

SEQ ID NO: 2877900 - RNA, 21 nt, Human
ucuaauuccauccauaaaucc

SEQ ID NO: 2877901 - RNA, 16 nt, Human
ucuaauuaaaacacuu

SEQ ID NO: 2877902 - RNA, 14 nt, Human
ucuaauauguaaca

SEQ ID NO: 2877903 - RNA, 14 nt, Human
ucuaaugugugaau

SEQ ID NO: 2877904 - RNA, 22 nt, Human
ucuagaaacgaguuggugucuu

SEQ ID NO: 2877905 - RNA, 12 nt, Human
ucuagaaaacca

SEQ ID NO: 2877906 - RNA, 14 nt, Human
ucuacuuuauuaau

SEQ ID NO: 2877907 - RNA, 21 nt, Human
ucuacuuuauuaauuguuuug

SEQ ID NO: 2877908 - RNA, 22 nt, Human
ucuacuugcugucccuuggaac

SEQ ID NO: 2877909 - RNA, 19 nt, Human
ucuaauucuauuaaagugc

SEQ ID NO: 2877910 - RNA, 15 nt, Human
uccucuagcuguggg

SEQ ID NO: 2877911 - RNA, 14 nt, Human
uccucggaaccgcu

SEQ ID NO: 2877912 - RNA, 19 nt, Human
uccucugcuugccuggaga

SEQ ID NO: 2877913 - RNA, 21 nt, Human
uccucuagcugugggggugag

SEQ ID NO: 2877914 - RNA, 21 nt, Human
uccucuuccugaauuuuauuu

SEQ ID NO: 2877915 - RNA, 16 nt, Human
uccucuucggcccuca

SEQ ID NO: 2877916 - RNA, 18 nt, Human
uccucuucggcccucaga

SEQ ID NO: 2877917 - RNA, 21 nt, Human
uccucuucggcccucagaugu

SEQ ID NO: 2877918 - RNA, 19 nt, Human
uccucuucuauuuuguaaa

SEQ ID NO: 2877919 - RNA, 13 nt, Human
uccuccuuucucc

SEQ ID NO: 2877920 - RNA, 15 nt, Human
uccucguuccuuucu

SEQ ID NO: 2877921 - RNA, 17 nt, Human
uccucguuccuuucucc

SEQ ID NO: 2877922 - RNA, 17 nt, Human
uccucauguucugcuuu

SEQ ID NO: 2877923 - RNA, 18 nt, Human
uccuccagaagccucugg

SEQ ID NO: 2877924 - RNA, 16 nt, Human
uccuccagaagccucu

SEQ ID NO: 2877925 - RNA, 14 nt, Human
uccuccagaagccu

SEQ ID NO: 2877926 - RNA, 22 nt, Human
uccuccagaagccucuggcuag

SEQ ID NO: 2877927 - RNA, 21 nt, Human
uccuccagaagccucuggcua

SEQ ID NO: 2877928 - RNA, 20 nt, Human
uccuccagaagccucuggcu

SEQ ID NO: 2877929 - RNA, 19 nt, Human
uccuccagaagccucuggc

SEQ ID NO: 2877930 - RNA, 16 nt, Human
uccuccuuggugccug

SEQ ID NO: 2877931 - RNA, 17 nt, Human
uccuccuuggugccugg

SEQ ID NO: 2877932 - RNA, 19 nt, Human
uccuccuuggugccuggcc

SEQ ID NO: 2877933 - RNA, 17 nt, Human
uccgaccagacaccuug

SEQ ID NO: 2877934 - RNA, 13 nt, Human
uccgaccagacac

SEQ ID NO: 2877935 - RNA, 18 nt, Human
uccuacccacccuccuuu

SEQ ID NO: 2877936 - RNA, 15 nt, Human
uccuacaagacacag

SEQ ID NO: 2877937 - RNA, 18 nt, Human
uccuaauuaccagucuuu

SEQ ID NO: 2877938 - RNA, 18 nt, Human
uccuaauucuucuguccu

SEQ ID NO: 2877939 - RNA, 14 nt, Human
uccuaauuucccuu

SEQ ID NO: 2877940 - RNA, 18 nt, Human
uccuaauuucccuucuug

SEQ ID NO: 2877941 - RNA, 19 nt, Human
uccuaauuucccuucuugc

SEQ ID NO: 2877942 - RNA, 18 nt, Human
uccuaauuccacagcugc

SEQ ID NO: 2877943 - RNA, 17 nt, Human
uccuaauuccacagcug

SEQ ID NO: 2877944 - RNA, 16 nt, Human
uccuaauuccacagcu

SEQ ID NO: 2877945 - RNA, 15 nt, Human
uccuaauuccacagc

SEQ ID NO: 2877946 - RNA, 22 nt, Human
uccuaaugaaugcauaaaaugu

SEQ ID NO: 2877947 - RNA, 14 nt, Human
uccuaauaucaaau

SEQ ID NO: 2877948 - RNA, 22 nt, Human
uccuaaucagaaauuuuuauca

SEQ ID NO: 2877949 - RNA, 15 nt, Human
uccuauauaguuuau

SEQ ID NO: 2877950 - RNA, 15 nt, Human
uccuauaaucuguca

SEQ ID NO: 2877951 - RNA, 16 nt, Human
uccuauaaucugucaa

SEQ ID NO: 2877952 - RNA, 17 nt, Human
uccuauaaucugucaaa

SEQ ID NO: 2877953 - RNA, 22 nt, Human
uccuauaaucugucaaaacacu

SEQ ID NO: 2877954 - RNA, 23 nt, Human
uccuauaaucugucaaaacacug

SEQ ID NO: 2877955 - RNA, 13 nt, Human
uccuaguuuucuc

SEQ ID NO: 2877956 - RNA, 20 nt, Human
uccuaguuuucuccucccag

SEQ ID NO: 2877957 - RNA, 13 nt, Human
uccuauaacuuga

SEQ ID NO: 2877958 - RNA, 14 nt, Human
uccuauaacuugau

SEQ ID NO: 2877959 - RNA, 18 nt, Human
uccuauaacuugaugcau

SEQ ID NO: 2877960 - RNA, 20 nt, Human
uccuauaacuugaugcaugu

SEQ ID NO: 2877961 - RNA, 21 nt, Human
uccuacccacaccucugccag

SEQ ID NO: 2877962 - RNA, 22 nt, Human
uccuacccacaccucugccaga

SEQ ID NO: 2877963 - RNA, 15 nt, Human
uccuacccacaccuc

SEQ ID NO: 2877964 - RNA, 16 nt, Human
uccuacccacaccucu

SEQ ID NO: 2877965 - RNA, 20 nt, Human
uccuacccacaccucugcca

SEQ ID NO: 2877966 - RNA, 14 nt, Human
uccuaguuggugag

SEQ ID NO: 2877967 - RNA, 21 nt, Human
uccuaguuggugagaaaccug

SEQ ID NO: 2877968 - RNA, 17 nt, Human
uccuaguuuccucuccu

SEQ ID NO: 2877969 - RNA, 15 nt, Human
uccuaguuugaccuc

SEQ ID NO: 2877970 - RNA, 16 nt, Human
uccuaguuugaccuca

SEQ ID NO: 2877971 - RNA, 18 nt, Human
uccuaguuugaccucaca

SEQ ID NO: 2877972 - RNA, 21 nt, Human
uccuaguuugaccucacagug

SEQ ID NO: 2877973 - RNA, 23 nt, Human
uccuaguuugaccucacagugac

SEQ ID NO: 2877974 - RNA, 14 nt, Human
uccuauugcaaagg

SEQ ID NO: 2877975 - RNA, 22 nt, Human
uccucaucccguguucuccuuu

SEQ ID NO: 2877976 - RNA, 17 nt, Human
uccucauccucagaugc

SEQ ID NO: 2877977 - RNA, 20 nt, Human
uccucauccucagaugcuca

SEQ ID NO: 2877978 - RNA, 14 nt, Human
uccucaucccgugu

SEQ ID NO: 2877979 - RNA, 18 nt, Human
uccucauccagggcucug

SEQ ID NO: 2877980 - RNA, 16 nt, Human
uccucauccagggcuc

SEQ ID NO: 2877981 - RNA, 23 nt, Human
uccuauaucauuaaaagaacaua

SEQ ID NO: 2877982 - RNA, 18 nt, Human
uccuauauaguuuauuga

SEQ ID NO: 2877983 - RNA, 18 nt, Human
uccuauauccugugacug

SEQ ID NO: 2877984 - RNA, 12 nt, Human
uccuauguguga

SEQ ID NO: 2877985 - RNA, 20 nt, Human
ucccuucgguggaagagcuc

SEQ ID NO: 2877986 - RNA, 22 nt, Human
ucccuucgguggaagagcucaa

SEQ ID NO: 2877987 - RNA, 15 nt, Human
ucccuucucacagca

SEQ ID NO: 2877988 - RNA, 16 nt, Human
ucccuucucacagcac

SEQ ID NO: 2877989 - RNA, 15 nt, Human
ucccuugaugcacag

SEQ ID NO: 2877990 - RNA, 16 nt, Human
ucccuugaugcacaga

SEQ ID NO: 2877991 - RNA, 18 nt, Human
ucccuugaugcacagaga

SEQ ID NO: 2877992 - RNA, 22 nt, Human
ucccuugaugcacagagaagcu

SEQ ID NO: 2877993 - RNA, 13 nt, Human
ucccuugccacuu

SEQ ID NO: 2877994 - RNA, 17 nt, Human
ucccuugccacuuugca

SEQ ID NO: 2877995 - RNA, 21 nt, Human
ucccuugccauccuaaaagcc

SEQ ID NO: 2877996 - RNA, 23 nt, Human
ucccuugaggaaacaacagcuuu

SEQ ID NO: 2877997 - RNA, 18 nt, Human
uccgaagcuacuucucca

SEQ ID NO: 2877998 - RNA, 21 nt, Human
uccgaaguaugagggaaaaug

SEQ ID NO: 2877999 - RNA, 20 nt, Human
uccgaccacuaauugccaag

SEQ ID NO: 2878000 - RNA, 18 nt, Human
uccgaccacuuccagggg

SEQ ID NO: 2878001 - RNA, 13 nt, Human
ucccuuccacugc

SEQ ID NO: 2878002 - RNA, 14 nt, Human
ucccuuccacugcc

SEQ ID NO: 2878003 - RNA, 17 nt, Human
ucccuuccacugccucu

SEQ ID NO: 2878004 - RNA, 18 nt, Human
ucccuuccacugccucug

SEQ ID NO: 2878005 - RNA, 19 nt, Human
ucccuuccacugccucugc

SEQ ID NO: 2878006 - RNA, 20 nt, Human
ucccuuccacugccucugcc

SEQ ID NO: 2878007 - RNA, 22 nt, Human
ucccuuccacugccucugccuu

SEQ ID NO: 2878008 - RNA, 10 nt, Human
ucccuggagu

SEQ ID NO: 2878009 - RNA, 21 nt, Human
ucccuggagccuccacugccu

SEQ ID NO: 2878010 - RNA, 11 nt, Human
ucccuggagug

SEQ ID NO: 2878011 - RNA, 21 nt, Human
ucccuggaguguggcugagga

SEQ ID NO: 2878012 - RNA, 22 nt, Human
ucccuggaguguggcugaggag

SEQ ID NO: 2878013 - RNA, 13 nt, Human
ucccugcacuugc

SEQ ID NO: 2878014 - RNA, 14 nt, Human
ucccugcacuugca

SEQ ID NO: 2878015 - RNA, 19 nt, Human
ucccugccccucccuucaa

SEQ ID NO: 2878016 - RNA, 20 nt, Human
ucccugcacuaaagccagcc

SEQ ID NO: 2878017 - RNA, 21 nt, Human
ucccugcacuaaagccagccu

SEQ ID NO: 2878018 - RNA, 22 nt, Human
ucccugcacuaaagccagccug

SEQ ID NO: 2878019 - RNA, 23 nt, Human
ucccugcacuaaagccagccuga

SEQ ID NO: 2878020 - RNA, 12 nt, Human
ucccucucccug

SEQ ID NO: 2878021 - RNA, 14 nt, Human
ucccucucccuguc

SEQ ID NO: 2878022 - RNA, 12 nt, Human
ucccucucggaa

SEQ ID NO: 2878023 - RNA, 23 nt, Human
ucccucucggaaggcuggcuggg

SEQ ID NO: 2878024 - RNA, 22 nt, Human
ucccucucggaaggcuggcugg

SEQ ID NO: 2878025 - RNA, 19 nt, Human
ucccucucucuucugcucc

SEQ ID NO: 2878026 - RNA, 18 nt, Human
ucccucucucuucugcuc

SEQ ID NO: 2878027 - RNA, 16 nt, Human
ucccucucucuucugc

SEQ ID NO: 2878028 - RNA, 12 nt, Human
ucccucucucuu

SEQ ID NO: 2878029 - RNA, 15 nt, Human
ucccugccuggucac

SEQ ID NO: 2878030 - RNA, 15 nt, Human
ucccugcuaaucucc

SEQ ID NO: 2878031 - RNA, 11 nt, Human
ucccugccugg

SEQ ID NO: 2878032 - RNA, 20 nt, Human
ucccugccuuaggccuaccu

SEQ ID NO: 2878033 - RNA, 16 nt, Human
ucccugcgccugugau

SEQ ID NO: 2878034 - RNA, 17 nt, Human
ucccugcgccugugaug

SEQ ID NO: 2878035 - RNA, 21 nt, Human
ucccugcgccugugaugcugg

SEQ ID NO: 2878036 - RNA, 20 nt, Human
ucccugccccucccuucaac

SEQ ID NO: 2878037 - RNA, 19 nt, Human
uccccuuaauuaggaugca

SEQ ID NO: 2878038 - RNA, 17 nt, Human
uccccuuacccuuagaa

SEQ ID NO: 2878039 - RNA, 18 nt, Human
uccccuuacccuuagaau

SEQ ID NO: 2878040 - RNA, 15 nt, Human
ucccgggacgcagca

SEQ ID NO: 2878041 - RNA, 18 nt, Human
uccagguguuacuguaau

SEQ ID NO: 2878042 - RNA, 20 nt, Human
uccagguucaacccacagcu

SEQ ID NO: 2878043 - RNA, 23 nt, Human
uccagguucaacccacagcuacu

SEQ ID NO: 2878044 - RNA, 15 nt, Human
ucccguguucuccuu

SEQ ID NO: 2878045 - RNA, 20 nt, Human
ucccguuucuccaccuagac

SEQ ID NO: 2878046 - RNA, 14 nt, Human
ucccggggcuccac

SEQ ID NO: 2878047 - RNA, 18 nt, Human
ucccuccucaccucugga

SEQ ID NO: 2878048 - RNA, 17 nt, Human
ucccuccucaccucugg

SEQ ID NO: 2878049 - RNA, 16 nt, Human
ucccuccucaccucug

SEQ ID NO: 2878050 - RNA, 14 nt, Human
ucccuccucaccuc

SEQ ID NO: 2878051 - RNA, 13 nt, Human
ucccuauguauuu

SEQ ID NO: 2878052 - RNA, 15 nt, Human
ucccuauguauuugc

SEQ ID NO: 2878053 - RNA, 14 nt, Human
ucccuaaugcugca

SEQ ID NO: 2878054 - RNA, 20 nt, Human
ucccuaaugcugcagauuug

SEQ ID NO: 2878055 - RNA, 16 nt, Human
ucccuaaaauacauuu

SEQ ID NO: 2878056 - RNA, 14 nt, Human
ucccggucccgagu

SEQ ID NO: 2878057 - RNA, 15 nt, Human
ucccuaggagaccaa

SEQ ID NO: 2878058 - RNA, 21 nt, Human
ucccuagggcuggcagaaagg

SEQ ID NO: 2878059 - RNA, 16 nt, Human
ucccuaguaaaaauac

SEQ ID NO: 2878060 - RNA, 22 nt, Human
ucccuccugcccgccacacaga

SEQ ID NO: 2878061 - RNA, 18 nt, Human
ucccuauguauuugcagu

SEQ ID NO: 2878062 - RNA, 20 nt, Human
ucccuccuggugucacccca

SEQ ID NO: 2878063 - RNA, 21 nt, Human
ucccuccuggugucaccccag

SEQ ID NO: 2878064 - RNA, 22 nt, Human
ucccuccuggugucaccccaga

SEQ ID NO: 2878065 - RNA, 19 nt, Human
ucccucuaaugagacugac

SEQ ID NO: 2878066 - RNA, 22 nt, Human
ucccucucccccuuaccccaca

SEQ ID NO: 2878067 - RNA, 15 nt, Human
ucccucuacauggac

SEQ ID NO: 2878068 - RNA, 22 nt, Human
ucccucuacuaaggcuuuccua

SEQ ID NO: 2878069 - RNA, 17 nt, Human
ucccucuaaugagacug

SEQ ID NO: 2878070 - RNA, 16 nt, Human
ucccucuaaugagacu

SEQ ID NO: 2878071 - RNA, 19 nt, Human
ucccucgcugcacaaauac

SEQ ID NO: 2878072 - RNA, 22 nt, Human
ucccucgcugcacaaauacucc

SEQ ID NO: 2878073 - RNA, 15 nt, Human
ucccuccuuuaguga

SEQ ID NO: 2878074 - RNA, 19 nt, Human
ucucuggcuguaaggcucu

SEQ ID NO: 2878075 - RNA, 20 nt, Human
ucucuggcuguaaggcucua

SEQ ID NO: 2878076 - RNA, 22 nt, Human
ucucuggcuguaaggcucuaga

SEQ ID NO: 2878077 - RNA, 15 nt, Human
ucucugggccucaga

SEQ ID NO: 2878078 - RNA, 17 nt, Human
ucucugggccucagagg

SEQ ID NO: 2878079 - RNA, 16 nt, Human
ucucuggggcaggcug

SEQ ID NO: 2878080 - RNA, 20 nt, Human
ucucuggggcaggcugcuuc

SEQ ID NO: 2878081 - RNA, 23 nt, Human
ucucuggcuguaaggcucuagau

SEQ ID NO: 2878082 - RNA, 13 nt, Human
ucucugguccgga

SEQ ID NO: 2878083 - RNA, 20 nt, Human
ucucugguccggacacuccu

SEQ ID NO: 2878084 - RNA, 22 nt, Human
ucucuguccagcagucacuucg

SEQ ID NO: 2878085 - RNA, 15 nt, Human
ucucuguauaaacau

SEQ ID NO: 2878086 - RNA, 16 nt, Human
ucucuguauaaacauu

SEQ ID NO: 2878087 - RNA, 21 nt, Human
ucucuguauaaacauuaaaug

SEQ ID NO: 2878088 - RNA, 22 nt, Human
ucucuguauaaacauuaaaugu

SEQ ID NO: 2878089 - RNA, 14 nt, Human
ucucugucccuugc

SEQ ID NO: 2878090 - RNA, 15 nt, Human
ucucugucccuugcu

SEQ ID NO: 2878091 - RNA, 16 nt, Human
ucucugucccuugcug

SEQ ID NO: 2878092 - RNA, 17 nt, Human
ucucugucccuugcugu

SEQ ID NO: 2878093 - RNA, 18 nt, Human
ucucugucccuugcugua

SEQ ID NO: 2878094 - RNA, 19 nt, Human
ucucugucccuugcuguau

SEQ ID NO: 2878095 - RNA, 20 nt, Human
ucucugucccuugcuguaug

SEQ ID NO: 2878096 - RNA, 19 nt, Human
ucucugugcuucaauuaau

SEQ ID NO: 2878097 - RNA, 15 nt, Human
ucucugugcugugga

SEQ ID NO: 2878098 - RNA, 11 nt, Human
ucucugugcuu

SEQ ID NO: 2878099 - RNA, 18 nt, Human
ucucugugaccugccccg

SEQ ID NO: 2878100 - RNA, 13 nt, Human
ucucugugaccca

SEQ ID NO: 2878101 - RNA, 18 nt, Human
ucucugugacccacuucu

SEQ ID NO: 2878102 - RNA, 14 nt, Human
ucucuaggcugggg

SEQ ID NO: 2878103 - RNA, 15 nt, Human
ucucuaggcugggga

SEQ ID NO: 2878104 - RNA, 11 nt, Human
ucucuaguagu

SEQ ID NO: 2878105 - RNA, 12 nt, Human
ucucuaguaguu

SEQ ID NO: 2878106 - RNA, 15 nt, Human
ucucuaguaguuaaa

SEQ ID NO: 2878107 - RNA, 18 nt, Human
ucucuaguaguuaaaaaa

SEQ ID NO: 2878108 - RNA, 13 nt, Human
ucucucucuacaa

SEQ ID NO: 2878109 - RNA, 14 nt, Human
ucucucucuacaaa

SEQ ID NO: 2878110 - RNA, 12 nt, Human
ucucucugcagc

SEQ ID NO: 2878111 - RNA, 14 nt, Human
ucucucugcagcug

SEQ ID NO: 2878112 - RNA, 15 nt, Human
ucucucugcagcugc

SEQ ID NO: 2878113 - RNA, 16 nt, Human
ucucucugcagcugcc

SEQ ID NO: 2878114 - RNA, 18 nt, Human
ucucucugcagcugccgg

SEQ ID NO: 2878115 - RNA, 11 nt, Human
ucucugaaccc

SEQ ID NO: 2878116 - RNA, 17 nt, Human
ucucugaggacacuaac

SEQ ID NO: 2878117 - RNA, 14 nt, Human
ucucugaggacacu

SEQ ID NO: 2878118 - RNA, 22 nt, Human
ucucugaagcauguuucauguu

SEQ ID NO: 2878119 - RNA, 19 nt, Human
ucucugaagcauguuucau

SEQ ID NO: 2878120 - RNA, 21 nt, Human
ucucugaagcauguuucaugu

SEQ ID NO: 2878121 - RNA, 12 nt, Human
ucucugaagcau

SEQ ID NO: 2878122 - RNA, 13 nt, Human
ucucugaagcaug

SEQ ID NO: 2878123 - RNA, 14 nt, Human
ucucugaagcaugu

SEQ ID NO: 2878124 - RNA, 16 nt, Human
ucucugaagcauguuu

SEQ ID NO: 2878125 - RNA, 18 nt, Human
ucuccugccucagccucc

SEQ ID NO: 2878126 - RNA, 22 nt, Human
ucucuaggaccaugguuaagag

SEQ ID NO: 2878127 - RNA, 15 nt, Human
ucucuaauaagaaaa

SEQ ID NO: 2878128 - RNA, 16 nt, Human
ucucuaauaagaaaac

SEQ ID NO: 2878129 - RNA, 11 nt, Human
ucucuaauaug

SEQ ID NO: 2878130 - RNA, 15 nt, Human
ucucuaaucgaaaga

SEQ ID NO: 2878131 - RNA, 13 nt, Human
ucucuaacuuauu

SEQ ID NO: 2878132 - RNA, 18 nt, Human
ucucuaacuuauuuuauu

SEQ ID NO: 2878133 - RNA, 22 nt, Human
ucucuaacuucaaggcccauau

SEQ ID NO: 2878134 - RNA, 19 nt, Human
ucucuaaagaguuuauuuu

SEQ ID NO: 2878135 - RNA, 21 nt, Human
ucucuaaagaguuuauuuuaa

SEQ ID NO: 2878136 - RNA, 14 nt, Human
ucucguuugugauu

SEQ ID NO: 2878137 - RNA, 17 nt, Human
ucucguuugugauucuu

SEQ ID NO: 2878138 - RNA, 12 nt, Human
ucucguuuuucu

SEQ ID NO: 2878139 - RNA, 22 nt, Human
ucucuaaagaguuuauuuuaag

SEQ ID NO: 2878140 - RNA, 13 nt, Human
ucucuaaagcacu

SEQ ID NO: 2878141 - RNA, 23 nt, Human
ucucuaaagcacuaccgauucuu

SEQ ID NO: 2878142 - RNA, 19 nt, Human
ucucgguugaaaccuguau

SEQ ID NO: 2878143 - RNA, 21 nt, Human
ucucggcuccccauguguccu

SEQ ID NO: 2878144 - RNA, 14 nt, Human
ucucgggagaggau

SEQ ID NO: 2878145 - RNA, 23 nt, Human
ucucggcucagugcaaccucugc

SEQ ID NO: 2878146 - RNA, 15 nt, Human
ucucgugagucauuu

SEQ ID NO: 2878147 - RNA, 20 nt, Human
ucucgugagucauuuaaaug

SEQ ID NO: 2878148 - RNA, 17 nt, Human
ucuccuggaggauugca

SEQ ID NO: 2878149 - RNA, 19 nt, Human
ucuccuggaguugcauuga

SEQ ID NO: 2878150 - RNA, 12 nt, Human
ucuccuggagga

SEQ ID NO: 2878151 - RNA, 13 nt, Human
ucuccuggaggau

SEQ ID NO: 2878152 - RNA, 15 nt, Human
ucuccugccucagcc

SEQ ID NO: 2878153 - RNA, 17 nt, Human
ucuccugccucagccuc

SEQ ID NO: 2878154 - RNA, 13 nt, Human
ucucaaugaaaaa

SEQ ID NO: 2878155 - RNA, 14 nt, Human
ucuccugccucagc

SEQ ID NO: 2878156 - RNA, 14 nt, Human
ucucaaugaaaaau

SEQ ID NO: 2878157 - RNA, 12 nt, Human
ucucaaugaaaa

SEQ ID NO: 2878158 - RNA, 18 nt, Human
ucucaauccugcaguggg

SEQ ID NO: 2878159 - RNA, 19 nt, Human
ucucaauccugcagugggg

SEQ ID NO: 2878160 - RNA, 16 nt, Human
ucucaaugaagccagc

SEQ ID NO: 2878161 - RNA, 17 nt, Human
ucucaaugaagccagcu

SEQ ID NO: 2878162 - RNA, 12 nt, Human
ucucaaugugaa

SEQ ID NO: 2878163 - RNA, 12 nt, Human
ucuccugccuca

SEQ ID NO: 2878164 - RNA, 14 nt, Human
ucucaauaugcuua

SEQ ID NO: 2878165 - RNA, 21 nt, Human
ucucaaguucuaagauucuaa

SEQ ID NO: 2878166 - RNA, 22 nt, Human
ucucaaguucuaagauucuaau

SEQ ID NO: 2878167 - RNA, 16 nt, Human
ucucaaguucuaagau

SEQ ID NO: 2878168 - RNA, 17 nt, Human
ucucaaguucuaagauu

SEQ ID NO: 2878169 - RNA, 18 nt, Human
ucucaaguucuaagauuc

SEQ ID NO: 2878170 - RNA, 20 nt, Human
ucucaaguucuaagauucua

SEQ ID NO: 2878171 - RNA, 23 nt, Human
ucucaagggcuagcaucccugag

SEQ ID NO: 2878172 - RNA, 12 nt, Human
ucucaaguucua

SEQ ID NO: 2878173 - RNA, 13 nt, Human
ucucaaguucuaa

SEQ ID NO: 2878174 - RNA, 14 nt, Human
ucucaaguucuaag

SEQ ID NO: 2878175 - RNA, 15 nt, Human
ucucaaguucuaaga

SEQ ID NO: 2878176 - RNA, 19 nt, Human
ucucaagagggcacuggug

SEQ ID NO: 2878177 - RNA, 17 nt, Human
ucucaagagggcacugg

SEQ ID NO: 2878178 - RNA, 18 nt, Human
ucucaagagggcacuggu

SEQ ID NO: 2878179 - RNA, 17 nt, Human
ucucaaaguuuugaaaa

SEQ ID NO: 2878180 - RNA, 18 nt, Human
ucucaaaguuuugaaaag

SEQ ID NO: 2878181 - RNA, 20 nt, Human
ucucaaaguuuugaaaagcu

SEQ ID NO: 2878182 - RNA, 23 nt, Human
ucucaaaguuuugaaaagcuauu

SEQ ID NO: 2878183 - RNA, 12 nt, Human
ucugcacauguc

SEQ ID NO: 2878184 - RNA, 15 nt, Human
ucugcacaugucuug

SEQ ID NO: 2878185 - RNA, 16 nt, Human
ucugcacaugucuugu

SEQ ID NO: 2878186 - RNA, 17 nt, Human
ucugcacaugucuugua

SEQ ID NO: 2878187 - RNA, 14 nt, Human
ucugcaucccagca

SEQ ID NO: 2878188 - RNA, 18 nt, Human
ucugcaucccagcaccug

SEQ ID NO: 2878189 - RNA, 19 nt, Human
ucugcaucccagcaccugc

SEQ ID NO: 2878190 - RNA, 21 nt, Human
ucugcaucccagcaccugccu

SEQ ID NO: 2878191 - RNA, 22 nt, Human
ucugcaucccagcaccugccuc

SEQ ID NO: 2878192 - RNA, 23 nt, Human
ucugcaucccagcaccugccucc

SEQ ID NO: 2878193 - RNA, 24 nt, Human
ucugcaucccagcaccugccuccu

SEQ ID NO: 2878194 - RNA, 17 nt, Human
ucugcaucuccugucuu

SEQ ID NO: 2878195 - RNA, 18 nt, Human
ucugcaucuccugucuuu

SEQ ID NO: 2878196 - RNA, 20 nt, Human
ucugccagaagauccccuca

SEQ ID NO: 2878197 - RNA, 21 nt, Human
ucugccagaagauccccucag

SEQ ID NO: 2878198 - RNA, 22 nt, Human
ucugccagaagauccccucagg

SEQ ID NO: 2878199 - RNA, 23 nt, Human
ucugccagaagauccccucagga

SEQ ID NO: 2878200 - RNA, 22 nt, Human
ucugccaauuuuugccuucauu

SEQ ID NO: 2878201 - RNA, 15 nt, Human
ucugccacacucuga

SEQ ID NO: 2878202 - RNA, 19 nt, Human
ucugccaauuuuugccuuc

SEQ ID NO: 2878203 - RNA, 15 nt, Human
ucugccaccagagac

SEQ ID NO: 2878204 - RNA, 17 nt, Human
ucugcauucaggaucaa

SEQ ID NO: 2878205 - RNA, 14 nt, Human
ucugcauugcccag

SEQ ID NO: 2878206 - RNA, 18 nt, Human
ucugcauugcccagucuu

SEQ ID NO: 2878207 - RNA, 18 nt, Human
ucugcauugcuagauaaa

SEQ ID NO: 2878208 - RNA, 21 nt, Human
ucugcauugcuagauaaaagc

SEQ ID NO: 2878209 - RNA, 15 nt, Human
ucugcauuuuucugc

SEQ ID NO: 2878210 - RNA, 18 nt, Human
ucugcauuuuucugcaga

SEQ ID NO: 2878211 - RNA, 20 nt, Human
ucugcauuuuucugcagaag

SEQ ID NO: 2878212 - RNA, 21 nt, Human
ucugcauuuucaccccacccu

SEQ ID NO: 2878213 - RNA, 17 nt, Human
ucugcauuuucacccca

SEQ ID NO: 2878214 - RNA, 22 nt, Human
ucugaggagaaacaaauaagac

SEQ ID NO: 2878215 - RNA, 14 nt, Human
ucugaggcccugcc

SEQ ID NO: 2878216 - RNA, 23 nt, Human
ucugaccaguuuaaccugaugca

SEQ ID NO: 2878217 - RNA, 23 nt, Human
ucugaggaauccagacccggcug

SEQ ID NO: 2878218 - RNA, 15 nt, Human
ucugacccacugcuu

SEQ ID NO: 2878219 - RNA, 14 nt, Human
ucugacccacugcu

SEQ ID NO: 2878220 - RNA, 21 nt, Human
ucugaggcucuuucugggcca

SEQ ID NO: 2878221 - RNA, 19 nt, Human
ucugaggcucuuucugggc

SEQ ID NO: 2878222 - RNA, 23 nt, Human
ucugaggcugaaauucagaauau

SEQ ID NO: 2878223 - RNA, 11 nt, Human
ucugaggcuga

SEQ ID NO: 2878224 - RNA, 12 nt, Human
ucugcacaugaa

SEQ ID NO: 2878225 - RNA, 23 nt, Human
ucugcacaugaaucccacccaca

SEQ ID NO: 2878226 - RNA, 14 nt, Human
ucugcacacagcac

SEQ ID NO: 2878227 - RNA, 13 nt, Human
ucugacccacugc

SEQ ID NO: 2878228 - RNA, 17 nt, Human
ucugacaguuuuucugu

SEQ ID NO: 2878229 - RNA, 20 nt, Human
ucugacaguuuuucuguuuu

SEQ ID NO: 2878230 - RNA, 22 nt, Human
ucugacaggcaaugcuggcugu

SEQ ID NO: 2878231 - RNA, 21 nt, Human
ucugacaggcaaugcuggcug

SEQ ID NO: 2878232 - RNA, 12 nt, Human
ucugacaggcaa

SEQ ID NO: 2878233 - RNA, 16 nt, Human
ucugacagaaagcaga

SEQ ID NO: 2878234 - RNA, 19 nt, Human
ucugacacacagcucuguc

SEQ ID NO: 2878235 - RNA, 18 nt, Human
ucugacacacagcucugu

SEQ ID NO: 2878236 - RNA, 17 nt, Human
ucugacacacagcucug

SEQ ID NO: 2878237 - RNA, 16 nt, Human
ucugacacacagcucu

SEQ ID NO: 2878238 - RNA, 15 nt, Human
ucugaacacaggcag

SEQ ID NO: 2878239 - RNA, 16 nt, Human
ucugaacacaggcagc

SEQ ID NO: 2878240 - RNA, 17 nt, Human
ucugaacacaggcagcu

SEQ ID NO: 2878241 - RNA, 18 nt, Human
ucugaacacaggcagcuu

SEQ ID NO: 2878242 - RNA, 12 nt, Human
ucugaaaacugg

SEQ ID NO: 2878243 - RNA, 14 nt, Human
ucugaaaacuggaa

SEQ ID NO: 2878244 - RNA, 12 nt, Human
ucugaaaagaaa

SEQ ID NO: 2878245 - RNA, 13 nt, Human
ucugaaaagaaau

SEQ ID NO: 2878246 - RNA, 15 nt, Human
ucugaaaagaaauaa

SEQ ID NO: 2878247 - RNA, 23 nt, Human
ucugaaaaauuccuuuguguuuc

SEQ ID NO: 2878248 - RNA, 22 nt, Human
ucugaaaaccccauuugcuuuc

SEQ ID NO: 2878249 - RNA, 18 nt, Human
ucugaaacacacugaaag

SEQ ID NO: 2878250 - RNA, 20 nt, Human
ucugaaacacacugaaagcu

SEQ ID NO: 2878251 - RNA, 21 nt, Human
ucugaaacacacugaaagcuc

SEQ ID NO: 2878252 - RNA, 23 nt, Human
ucugaaacccuggaccagugguc

SEQ ID NO: 2878253 - RNA, 12 nt, Human
ucugaaagcaca

SEQ ID NO: 2878254 - RNA, 13 nt, Human
ucugaaagcacag

SEQ ID NO: 2878255 - RNA, 23 nt, Human
ucugaaagcacaggagacacugu

SEQ ID NO: 2878256 - RNA, 22 nt, Human
ucucuguucuacccguuccaaa

SEQ ID NO: 2878257 - RNA, 23 nt, Human
ucucuguucuacccguuccaaaa

SEQ ID NO: 2878258 - RNA, 18 nt, Human
ucucuguugacuggcugu

SEQ ID NO: 2878259 - RNA, 18 nt, Human
ucucuuaaacuugugaau

SEQ ID NO: 2878260 - RNA, 13 nt, Human
ucucuuaaaguug

SEQ ID NO: 2878261 - RNA, 14 nt, Human
ucucuguuccaugu

SEQ ID NO: 2878262 - RNA, 22 nt, Human
ucucuguuccaugucuccuuua

SEQ ID NO: 2878263 - RNA, 10 nt, Human
ucucuguguu

SEQ ID NO: 2878264 - RNA, 23 nt, Human
ucucugugucuaagauucuagau

SEQ ID NO: 2878265 - RNA, 18 nt, Human
ucucugugugcacaaaua

SEQ ID NO: 2878266 - RNA, 21 nt, Human
ucucugugucuaagauucuag

SEQ ID NO: 2878267 - RNA, 22 nt, Human
ucucugugucuaagauucuaga

SEQ ID NO: 2878268 - RNA, 15 nt, Human
ucucugugucuaaga

SEQ ID NO: 2878269 - RNA, 16 nt, Human
ucucugugucuaagau

SEQ ID NO: 2878270 - RNA, 17 nt, Human
ucucugugucuaagauu

SEQ ID NO: 2878271 - RNA, 20 nt, Human
ucucugugucuaagauucua

SEQ ID NO: 2878272 - RNA, 22 nt, Human
ucugucuucacagcucuguguu

SEQ ID NO: 2878273 - RNA, 15 nt, Human
ucugucuucacagcu

SEQ ID NO: 2878274 - RNA, 14 nt, Human
ucugucuucacagc

SEQ ID NO: 2878275 - RNA, 12 nt, Human
ucugucuucaca

SEQ ID NO: 2878276 - RNA, 17 nt, Human
ucuguuuugaaggcaaa

SEQ ID NO: 2878277 - RNA, 13 nt, Human
ucugucuucugua

SEQ ID NO: 2878278 - RNA, 14 nt, Human
ucugucuucuguau

SEQ ID NO: 2878279 - RNA, 15 nt, Human
ucugucuucuguaua

SEQ ID NO: 2878280 - RNA, 18 nt, Human
ucugucuucuguauauaa

SEQ ID NO: 2878281 - RNA, 12 nt, Human
ucugucuuguaa

SEQ ID NO: 2878282 - RNA, 13 nt, Human
ucugucuuguaau

SEQ ID NO: 2878283 - RNA, 18 nt, Human
ucugucuggagugacaga

SEQ ID NO: 2878284 - RNA, 22 nt, Human
ucugucugcccuucaccccagu

SEQ ID NO: 2878285 - RNA, 13 nt, Human
ucugucugcccuu

SEQ ID NO: 2878286 - RNA, 18 nt, Human
ucuuaaagugcaguucuu

SEQ ID NO: 2878287 - RNA, 23 nt, Human
ucuuaaagcugccuguaguuagg

SEQ ID NO: 2878288 - RNA, 21 nt, Human
ucuuaaagcugccuguaguua

SEQ ID NO: 2878289 - RNA, 20 nt, Human
ucuuaaagcugccuguaguu

SEQ ID NO: 2878290 - RNA, 19 nt, Human
ucuuaaagcugccuguagu

SEQ ID NO: 2878291 - RNA, 16 nt, Human
ucuuaaagcugccugu

SEQ ID NO: 2878292 - RNA, 16 nt, Human
ucuuaaagaaacagcu

SEQ ID NO: 2878293 - RNA, 17 nt, Human
ucuuaaagaaacagcuu

SEQ ID NO: 2878294 - RNA, 18 nt, Human
ucuuaaagaaacagcuuu

SEQ ID NO: 2878295 - RNA, 22 nt, Human
ucuuaaagaaacagcuuucaag

SEQ ID NO: 2878296 - RNA, 23 nt, Human
ucuuaaagaaacagcuuucaagu

SEQ ID NO: 2878297 - RNA, 19 nt, Human
ucuuaaagcaaaaaaugaa

SEQ ID NO: 2878298 - RNA, 23 nt, Human
ucuguuuuguuuggcaaggaaag

SEQ ID NO: 2878299 - RNA, 14 nt, Human
ucuguuuuucuuuu

SEQ ID NO: 2878300 - RNA, 17 nt, Human
ucuguuuuguaucuuaa

SEQ ID NO: 2878301 - RNA, 18 nt, Human
ucuguuuuguaucuuaaa

SEQ ID NO: 2878302 - RNA, 14 nt, Human
ucuuaaacuuguga

SEQ ID NO: 2878303 - RNA, 15 nt, Human
ucuuaaacuugugaa

SEQ ID NO: 2878304 - RNA, 16 nt, Human
ucuuaaacuugugaau

SEQ ID NO: 2878305 - RNA, 15 nt, Human
ucuuaagacuuuugg

SEQ ID NO: 2878306 - RNA, 16 nt, Human
ucuuaagaggcugaca

SEQ ID NO: 2878307 - RNA, 18 nt, Human
ucuuaagccuaaaugccu

SEQ ID NO: 2878308 - RNA, 20 nt, Human
ucuuaagccuaaaugccuua

SEQ ID NO: 2878309 - RNA, 23 nt, Human
ucuuagcugucugcucagacaga

SEQ ID NO: 2878310 - RNA, 14 nt, Human
ucuuagcuuuuuaa

SEQ ID NO: 2878311 - RNA, 18 nt, Human
ucuuagcugucugcucag

SEQ ID NO: 2878312 - RNA, 15 nt, Human
ucuuagcugucugcu

SEQ ID NO: 2878313 - RNA, 23 nt, Human
ucuuaaauuggguucaugaugca

SEQ ID NO: 2878314 - RNA, 19 nt, Human
ucuuaaauaaugcuucaga

SEQ ID NO: 2878315 - RNA, 22 nt, Human
ucuuaaauaaugcuucagauau

SEQ ID NO: 2878316 - RNA, 13 nt, Human
ucuuaaauaucuu

SEQ ID NO: 2878317 - RNA, 14 nt, Human
ucuuaaauaucuuu

SEQ ID NO: 2878318 - RNA, 15 nt, Human
ucuuaaauaucuuuu

SEQ ID NO: 2878319 - RNA, 17 nt, Human
ucuuaaauaucuuuuau

SEQ ID NO: 2878320 - RNA, 16 nt, Human
ucuucagccaccucuc

SEQ ID NO: 2878321 - RNA, 19 nt, Human
ucuucagcauucccuccca

SEQ ID NO: 2878322 - RNA, 19 nt, Human
ucuucagccaccucucuuu

SEQ ID NO: 2878323 - RNA, 14 nt, Human
ucuuaggcacuuug

SEQ ID NO: 2878324 - RNA, 22 nt, Human
ucuuagcuuuuuaauuguuguu

SEQ ID NO: 2878325 - RNA, 16 nt, Human
ucuuagcuuuuuaauu

SEQ ID NO: 2878326 - RNA, 17 nt, Human
ucuuagcuuuuuaauug

SEQ ID NO: 2878327 - RNA, 18 nt, Human
ucuuagcuuuuuaauugu

SEQ ID NO: 2878328 - RNA, 21 nt, Human
ucuuagcuuuuuaauuguugu

SEQ ID NO: 2878329 - RNA, 22 nt, Human
ucuucagccucuuucugucccu

SEQ ID NO: 2878330 - RNA, 16 nt, Human
ucuucagcguaaaaug

SEQ ID NO: 2878331 - RNA, 18 nt, Human
ucuucagcguaaaauggu

SEQ ID NO: 2878332 - RNA, 19 nt, Human
ucuucagcguaaaauggug

SEQ ID NO: 2878333 - RNA, 15 nt, Human
ucuucaggccucccu

SEQ ID NO: 2878334 - RNA, 14 nt, Human
ucuucaggccuccc

SEQ ID NO: 2878335 - RNA, 13 nt, Human
ucuucaggccucc

SEQ ID NO: 2878336 - RNA, 21 nt, Human
ucuucauauucuaaaaccauu

SEQ ID NO: 2878337 - RNA, 22 nt, Human
ucuucauacuuuuuuucacagu

SEQ ID NO: 2878338 - RNA, 13 nt, Human
ucuucauacuuuu

SEQ ID NO: 2878339 - RNA, 15 nt, Human
ucuucauacuuuuuu

SEQ ID NO: 2878340 - RNA, 18 nt, Human
ucuucaggccucccucuc

SEQ ID NO: 2878341 - RNA, 20 nt, Human
ucuucagcuugugcacaauu

SEQ ID NO: 2878342 - RNA, 14 nt, Human
ucuucaucugccca

SEQ ID NO: 2878343 - RNA, 16 nt, Human
ucuucaucugcccaac

SEQ ID NO: 2878344 - RNA, 13 nt, Human
ucuuccugugauc

SEQ ID NO: 2878345 - RNA, 13 nt, Human
ucuuccuggcuuu

SEQ ID NO: 2878346 - RNA, 22 nt, Human
ucuuccuggcuuuuuaacuccc

SEQ ID NO: 2878347 - RNA, 17 nt, Human
ucuuccuggauuauuca

SEQ ID NO: 2878348 - RNA, 22 nt, Human
ucuuccugccccucuuucucuu

SEQ ID NO: 2878349 - RNA, 12 nt, Human
ucuugaacuccu

SEQ ID NO: 2878350 - RNA, 19 nt, Human
ucuugaacuccugaccuca

SEQ ID NO: 2878351 - RNA, 17 nt, Human
ucuugaacuccugaccu

SEQ ID NO: 2878352 - RNA, 22 nt, Human
ucuugaaauuaagaaggcaaaa

SEQ ID NO: 2878353 - RNA, 23 nt, Human
ucuugaaagauucagguauguug

SEQ ID NO: 2878354 - RNA, 17 nt, Human
ucuugaaagaagaaugu

SEQ ID NO: 2878355 - RNA, 18 nt, Human
ucuugaaagaagaaugug

SEQ ID NO: 2878356 - RNA, 19 nt, Human
ucuucuuuuugcuucaaaa

SEQ ID NO: 2878357 - RNA, 16 nt, Human
ucuucuuuuuuuguga

SEQ ID NO: 2878358 - RNA, 17 nt, Human
ucuucuuuuuuugugau

SEQ ID NO: 2878359 - RNA, 18 nt, Human
ucuucuuuuuuugugaug

SEQ ID NO: 2878360 - RNA, 14 nt, Human
ucuucuccuuucac

SEQ ID NO: 2878361 - RNA, 21 nt, Human
ucuucuccuggaguugcauug

SEQ ID NO: 2878362 - RNA, 13 nt, Human
ucuucuccuuuca

SEQ ID NO: 2878363 - RNA, 17 nt, Human
ucuuccuguuaauguau

SEQ ID NO: 2878364 - RNA, 19 nt, Human
ucuuccuguuaauguauuu

SEQ ID NO: 2878365 - RNA, 18 nt, Human
ucuuccuguuuuguacau

SEQ ID NO: 2878366 - RNA, 21 nt, Human
ucuuccuguuuuguacauaga

SEQ ID NO: 2878367 - RNA, 12 nt, Human
ucuucuccacug

SEQ ID NO: 2878368 - RNA, 12 nt, Human
ucuucuccacca

SEQ ID NO: 2878369 - RNA, 12 nt, Human
ucuucucccaga

SEQ ID NO: 2878370 - RNA, 13 nt, Human
ucuucucccagaa

SEQ ID NO: 2878371 - RNA, 16 nt, Human
ucuucucccagaaucc

SEQ ID NO: 2878372 - RNA, 21 nt, Human
ucuucucccagaaucccagcc

SEQ ID NO: 2878373 - RNA, 22 nt, Human
ucuucucccagaaucccagccg

SEQ ID NO: 2878374 - RNA, 12 nt, Human
ucuucuccccag

SEQ ID NO: 2878375 - RNA, 15 nt, Human
ucuggcuccagcugg

SEQ ID NO: 2878376 - RNA, 17 nt, Human
ucuggcuccuuuacaaa

SEQ ID NO: 2878377 - RNA, 20 nt, Human
ucuggcucccucuucuuuca

SEQ ID NO: 2878378 - RNA, 14 nt, Human
ucuggcugaaaaag

SEQ ID NO: 2878379 - RNA, 18 nt, Human
ucuggcugacuaaauuug

SEQ ID NO: 2878380 - RNA, 22 nt, Human
ucuggcugacuaaauuugggga

SEQ ID NO: 2878381 - RNA, 14 nt, Human
ucugggacacaguu

SEQ ID NO: 2878382 - RNA, 13 nt, Human
ucuggugccucca

SEQ ID NO: 2878383 - RNA, 16 nt, Human
ucuggugauaaggaca

SEQ ID NO: 2878384 - RNA, 17 nt, Human
ucuggugauaaggacau

SEQ ID NO: 2878385 - RNA, 17 nt, Human
ucuggugaucucccaag

SEQ ID NO: 2878386 - RNA, 15 nt, Human
ucuggugccuccaga

SEQ ID NO: 2878387 - RNA, 16 nt, Human
ucuggugccuccagag

SEQ ID NO: 2878388 - RNA, 14 nt, Human
ucuguccuacucug

SEQ ID NO: 2878389 - RNA, 21 nt, Human
ucugguuccuccccuccuccu

SEQ ID NO: 2878390 - RNA, 20 nt, Human
ucugguuccuccccuccucc

SEQ ID NO: 2878391 - RNA, 13 nt, Human
ucugguuccuccc

SEQ ID NO: 2878392 - RNA, 19 nt, Human
ucuguccuacucuguguca

SEQ ID NO: 2878393 - RNA, 15 nt, Human
ucuguccuacucugu

SEQ ID NO: 2878394 - RNA, 21 nt, Human
ucuguccugggagugagcugg

SEQ ID NO: 2878395 - RNA, 13 nt, Human
ucuguccugugac

SEQ ID NO: 2878396 - RNA, 21 nt, Human
ucuguccugugagguuuccca

SEQ ID NO: 2878397 - RNA, 22 nt, Human
ucuguccugugagguuucccaa

SEQ ID NO: 2878398 - RNA, 11 nt, Human
ucugguucuaa

SEQ ID NO: 2878399 - RNA, 13 nt, Human
ucugguucuaaca

SEQ ID NO: 2878400 - RNA, 14 nt, Human
ucugucgcccaguc

SEQ ID NO: 2878401 - RNA, 22 nt, Human
ucugucuccuuaacacugagcu

SEQ ID NO: 2878402 - RNA, 12 nt, Human
ucugucucucuc

SEQ ID NO: 2878403 - RNA, 13 nt, Human
ucugucucugaag

SEQ ID NO: 2878404 - RNA, 17 nt, Human
ucugccagcaaagagga

SEQ ID NO: 2878405 - RNA, 12 nt, Human
ucugccagggag

SEQ ID NO: 2878406 - RNA, 20 nt, Human
ucugccaggcccccaccaca

SEQ ID NO: 2878407 - RNA, 23 nt, Human
ucugccaggcccccaccacacau

SEQ ID NO: 2878408 - RNA, 19 nt, Human
ucugccagggagcuugaaa

SEQ ID NO: 2878409 - RNA, 11 nt, Human
ucugccagggc

SEQ ID NO: 2878410 - RNA, 12 nt, Human
ucugccagggca

SEQ ID NO: 2878411 - RNA, 13 nt, Human
ucugccagggcag

SEQ ID NO: 2878412 - RNA, 16 nt, Human
ucugccagggcagugc

SEQ ID NO: 2878413 - RNA, 17 nt, Human
ucugccagggcagugcu

SEQ ID NO: 2878414 - RNA, 14 nt, Human
ucugccagggagcu

SEQ ID NO: 2878415 - RNA, 13 nt, Human
ucugccagggagc

SEQ ID NO: 2878416 - RNA, 13 nt, Human
ucugccagccaca

SEQ ID NO: 2878417 - RNA, 13 nt, Human
ucugccugcccag

SEQ ID NO: 2878418 - RNA, 14 nt, Human
ucugccugcccagg

SEQ ID NO: 2878419 - RNA, 17 nt, Human
ucugcugacagacacag

SEQ ID NO: 2878420 - RNA, 18 nt, Human
ucugcugacagacacagg

SEQ ID NO: 2878421 - RNA, 18 nt, Human
ucugcuccucuccccagc

SEQ ID NO: 2878422 - RNA, 16 nt, Human
ucugccugcccaggcc

SEQ ID NO: 2878423 - RNA, 15 nt, Human
ucugccugcccaggc

SEQ ID NO: 2878424 - RNA, 16 nt, Human
ucugcuccccagggga

SEQ ID NO: 2878425 - RNA, 22 nt, Human
ucugcugacagacacaggcccg

SEQ ID NO: 2878426 - RNA, 21 nt, Human
ucugcugacagacacaggccc

SEQ ID NO: 2878427 - RNA, 20 nt, Human
ucugcugacagacacaggcc

SEQ ID NO: 2878428 - RNA, 19 nt, Human
ucugcugacagacacaggc

SEQ ID NO: 2878429 - RNA, 14 nt, Human
ucugcuggcccagc

SEQ ID NO: 2878430 - RNA, 12 nt, Human
ucugcuggccca

SEQ ID NO: 2878431 - RNA, 23 nt, Human
ucugcuggaguuucauguacaag

SEQ ID NO: 2878432 - RNA, 20 nt, Human
ucugcuggcccagccaaacc

SEQ ID NO: 2878433 - RNA, 23 nt, Human
ucugcuggcaucaagagguggga

SEQ ID NO: 2878434 - RNA, 15 nt, Human
ucuggaaugcagugg

SEQ ID NO: 2878435 - RNA, 22 nt, Human
ucuggaauacaugaaauauaga

SEQ ID NO: 2878436 - RNA, 14 nt, Human
ucuggaauacauga

SEQ ID NO: 2878437 - RNA, 14 nt, Human
ucuggacaggcaug

SEQ ID NO: 2878438 - RNA, 16 nt, Human
ucuggaaugcaguggu

SEQ ID NO: 2878439 - RNA, 21 nt, Human
ucuggacaggcauguucucug

SEQ ID NO: 2878440 - RNA, 14 nt, Human
ucuggacaggcucu

SEQ ID NO: 2878441 - RNA, 18 nt, Human
ucuggacaggcucugcuu

SEQ ID NO: 2878442 - RNA, 20 nt, Human
ucuggacaggcucugcuucu

SEQ ID NO: 2878443 - RNA, 17 nt, Human
ucuggacagucagcucu

SEQ ID NO: 2878444 - RNA, 18 nt, Human
ucuggacagucagcucuu

SEQ ID NO: 2878445 - RNA, 19 nt, Human
ucuggaaucuggagaccag

SEQ ID NO: 2878446 - RNA, 14 nt, Human
ucuggaaugagccu

SEQ ID NO: 2878447 - RNA, 14 nt, Human
uguaaaauguaaug

SEQ ID NO: 2878448 - RNA, 12 nt, Human
uguaaacugcca

SEQ ID NO: 2878449 - RNA, 13 nt, Human
uguaaacugccau

SEQ ID NO: 2878450 - RNA, 14 nt, Human
uguaaacugccaua

SEQ ID NO: 2878451 - RNA, 22 nt, Human
uguaaacugccauauauaacag

SEQ ID NO: 2878452 - RNA, 20 nt, Human
uguaaacuggaauuaaaagg

SEQ ID NO: 2878453 - RNA, 20 nt, Human
uguaaacucaaaauauuugu

SEQ ID NO: 2878454 - RNA, 15 nt, Human
uguaaacucaaaaua

SEQ ID NO: 2878455 - RNA, 14 nt, Human
uguaaaccgcuuug

SEQ ID NO: 2878456 - RNA, 19 nt, Human
uguaaaccgcuuuggccug

SEQ ID NO: 2878457 - RNA, 19 nt, Human
uguaaacgacaagaauaau

SEQ ID NO: 2878458 - RNA, 16 nt, Human
uguaaacucaaaacuu

SEQ ID NO: 2878459 - RNA, 21 nt, Human
uguaaacucaaaacuuaacau

SEQ ID NO: 2878460 - RNA, 18 nt, Human
uguaaaauauacuuaaau

SEQ ID NO: 2878461 - RNA, 18 nt, Human
uguaaaauaagaaugauu

SEQ ID NO: 2878462 - RNA, 12 nt, Human
uguaaaauagcu

SEQ ID NO: 2878463 - RNA, 14 nt, Human
uguaaaauagcuug

SEQ ID NO: 2878464 - RNA, 17 nt, Human
uguaaaauagcuuguau

SEQ ID NO: 2878465 - RNA, 20 nt, Human
uguaaaauagcuuguauagu

SEQ ID NO: 2878466 - RNA, 21 nt, Human
uguaaaauagcuuguauagug

SEQ ID NO: 2878467 - RNA, 18 nt, Human
uguaaaagauuaaacugc

SEQ ID NO: 2878468 - RNA, 14 nt, Human
uguaaaauaaaauu

SEQ ID NO: 2878469 - RNA, 18 nt, Human
uguaaaaccugucaauga

SEQ ID NO: 2878470 - RNA, 12 nt, Human
uguaaaacgcug

SEQ ID NO: 2878471 - RNA, 16 nt, Human
uguaaaacgcugucaa

SEQ ID NO: 2878472 - RNA, 16 nt, Human
uguaaaaccugucaau

SEQ ID NO: 2878473 - RNA, 12 nt, Human
uguaaaaagaaa

SEQ ID NO: 2878474 - RNA, 13 nt, Human
uguaaaaagaaaa

SEQ ID NO: 2878475 - RNA, 19 nt, Human
uguaaaaaaaaaugccuuu

SEQ ID NO: 2878476 - RNA, 15 nt, Human
ugguuuuuaaauuuu

SEQ ID NO: 2878477 - RNA, 20 nt, Human
ugguuuuuaaauuuuguaau

SEQ ID NO: 2878478 - RNA, 21 nt, Human
ugguuuuuaaauuuuguaaug

SEQ ID NO: 2878479 - RNA, 17 nt, Human
uguaaaaaagaaaaaca

SEQ ID NO: 2878480 - RNA, 17 nt, Human
uguaaaaaaugugugua

SEQ ID NO: 2878481 - RNA, 14 nt, Human
uguaaaaacacuga

SEQ ID NO: 2878482 - RNA, 16 nt, Human
uguaaaaacacugaaa

SEQ ID NO: 2878483 - RNA, 18 nt, Human
uguaaaaaaaaaugccuu

SEQ ID NO: 2878484 - RNA, 22 nt, Human
ugguuuuuuuuuuuuuuuuggc

SEQ ID NO: 2878485 - RNA, 23 nt, Human
ugguuuuuuuuuuuuuuuuggcu

SEQ ID NO: 2878486 - RNA, 10 nt, Human
ugguuuuuuu

SEQ ID NO: 2878487 - RNA, 14 nt, Human
ugguuuucuuaagg

SEQ ID NO: 2878488 - RNA, 21 nt, Human
ugguuguuaguuauagauguc

SEQ ID NO: 2878489 - RNA, 15 nt, Human
ugguugugucugcuu

SEQ ID NO: 2878490 - RNA, 14 nt, Human
ugguugugucuuuu

SEQ ID NO: 2878491 - RNA, 22 nt, Human
ugguuguuaguuauagaugucu

SEQ ID NO: 2878492 - RNA, 16 nt, Human
ugguuggcuggccuuc

SEQ ID NO: 2878493 - RNA, 19 nt, Human
ugguuggggcccugcccug

SEQ ID NO: 2878494 - RNA, 19 nt, Human
ugguuggguggcaauucca

SEQ ID NO: 2878495 - RNA, 22 nt, Human
ugguugguaacacaaauuuuca

SEQ ID NO: 2878496 - RNA, 13 nt, Human
ugguugcauccua

SEQ ID NO: 2878497 - RNA, 16 nt, Human
ugguugcacuuuguag

SEQ ID NO: 2878498 - RNA, 17 nt, Human
ugguugccuuaaagaaa

SEQ ID NO: 2878499 - RNA, 18 nt, Human
ugguugccuuaaagaaag

SEQ ID NO: 2878500 - RNA, 21 nt, Human
uguaaugaaaaugaauaucua

SEQ ID NO: 2878501 - RNA, 17 nt, Human
uguacacugacuugaga

SEQ ID NO: 2878502 - RNA, 17 nt, Human
uguacacguguccugua

SEQ ID NO: 2878503 - RNA, 16 nt, Human
uguacacguguccugu

SEQ ID NO: 2878504 - RNA, 21 nt, Human
uguacagaaaagggcggcuuc

SEQ ID NO: 2878505 - RNA, 15 nt, Human
uguacagacagagaa

SEQ ID NO: 2878506 - RNA, 14 nt, Human
uguacagacauauu

SEQ ID NO: 2878507 - RNA, 17 nt, Human
uguacagacauauuuaa

SEQ ID NO: 2878508 - RNA, 19 nt, Human
uguacagacauauuuaacu

SEQ ID NO: 2878509 - RNA, 20 nt, Human
uguacagacauauuuaacug

SEQ ID NO: 2878510 - RNA, 22 nt, Human
uguacagacauauuuaacuggu

SEQ ID NO: 2878511 - RNA, 15 nt, Human
uguaaugaaaaugaa

SEQ ID NO: 2878512 - RNA, 18 nt, Human
uguaaugaaaaugaauau

SEQ ID NO: 2878513 - RNA, 15 nt, Human
uguaauaagacauaa

SEQ ID NO: 2878514 - RNA, 14 nt, Human
uguaauaauugcuc

SEQ ID NO: 2878515 - RNA, 13 nt, Human
uguaauaauaccu

SEQ ID NO: 2878516 - RNA, 14 nt, Human
uguaauaauaccuc

SEQ ID NO: 2878517 - RNA, 16 nt, Human
uguaauaauaccucaa

SEQ ID NO: 2878518 - RNA, 17 nt, Human
uguaauaauaccucaau

SEQ ID NO: 2878519 - RNA, 20 nt, Human
uguaauaauaccucaauguu

SEQ ID NO: 2878520 - RNA, 21 nt, Human
uguaauaauaccucaauguuu

SEQ ID NO: 2878521 - RNA, 23 nt, Human
uguaauaauaccucaauguuuga

SEQ ID NO: 2878522 - RNA, 22 nt, Human
uguaauaacugugaaguuuaca

SEQ ID NO: 2878523 - RNA, 14 nt, Human
uguaauaacuguga

SEQ ID NO: 2878524 - RNA, 12 nt, Human
uguaauaagaca

SEQ ID NO: 2878525 - RNA, 13 nt, Human
uguaauaagacau

SEQ ID NO: 2878526 - RNA, 14 nt, Human
uguaauaagacaua

SEQ ID NO: 2878527 - RNA, 18 nt, Human
uguaauaagacauaacgu

SEQ ID NO: 2878528 - RNA, 21 nt, Human
uguaauaagacuuagauugug

SEQ ID NO: 2878529 - RNA, 12 nt, Human
uguaaccauuuu

SEQ ID NO: 2878530 - RNA, 13 nt, Human
uguaaccauuuua

SEQ ID NO: 2878531 - RNA, 19 nt, Human
uguaaccauuuuauaaagu

SEQ ID NO: 2878532 - RNA, 22 nt, Human
uguaaccauuuuauaaagugcu

SEQ ID NO: 2878533 - RNA, 17 nt, Human
uguaacauacuggccug

SEQ ID NO: 2878534 - RNA, 22 nt, Human
uguaacaucacuauccaugcac

SEQ ID NO: 2878535 - RNA, 14 nt, Human
uguaacaagccacc

SEQ ID NO: 2878536 - RNA, 22 nt, Human
uguaaacucaaaacuuaacaua

SEQ ID NO: 2878537 - RNA, 23 nt, Human
uguaaacucaaaauauuuguaca

SEQ ID NO: 2878538 - RNA, 17 nt, Human
uguaacaagccacccca

SEQ ID NO: 2878539 - RNA, 23 nt, Human
uguaacacagcugagagacuuuu

SEQ ID NO: 2878540 - RNA, 20 nt, Human
uguaacacagcugagagacu

SEQ ID NO: 2878541 - RNA, 21 nt, Human
uguaacacagcugagagacuu

SEQ ID NO: 2878542 - RNA, 23 nt, Human
ugguuccccuguucacucuacuu

SEQ ID NO: 2878543 - RNA, 18 nt, Human
ugguucccguuucuccac

SEQ ID NO: 2878544 - RNA, 20 nt, Human
ugguucccguuucuccaccu

SEQ ID NO: 2878545 - RNA, 15 nt, Human
ugguuccucucuggu

SEQ ID NO: 2878546 - RNA, 17 nt, Human
ugguuccuuucucagcc

SEQ ID NO: 2878547 - RNA, 11 nt, Human
ugguucucaau

SEQ ID NO: 2878548 - RNA, 12 nt, Human
ugguucucaaug

SEQ ID NO: 2878549 - RNA, 17 nt, Human
ugguucuaaggaccuga

SEQ ID NO: 2878550 - RNA, 22 nt, Human
ugguucuaaggaccugaaauuc

SEQ ID NO: 2878551 - RNA, 12 nt, Human
ugguuccucccc

SEQ ID NO: 2878552 - RNA, 23 nt, Human
ugguuccuccccuccuccuggac

SEQ ID NO: 2878553 - RNA, 18 nt, Human
ugguuccuccccuccucc

SEQ ID NO: 2878554 - RNA, 18 nt, Human
ugguugaugaucuuugca

SEQ ID NO: 2878555 - RNA, 15 nt, Human
ugguugacuggguuu

SEQ ID NO: 2878556 - RNA, 12 nt, Human
ugguugaagaag

SEQ ID NO: 2878557 - RNA, 15 nt, Human
ugguucucaaugaaa

SEQ ID NO: 2878558 - RNA, 14 nt, Human
ugguucucaaugaa

SEQ ID NO: 2878559 - RNA, 16 nt, Human
ugguucucaaugaaaa

SEQ ID NO: 2878560 - RNA, 12 nt, Human
ugguucuggcca

SEQ ID NO: 2878561 - RNA, 20 nt, Human
ugguucugaugaugugccug

SEQ ID NO: 2878562 - RNA, 13 nt, Human
ugguucugaugcc

SEQ ID NO: 2878563 - RNA, 15 nt, Human
ugguucugcuucaau

SEQ ID NO: 2878564 - RNA, 13 nt, Human
ugguucugugcca

SEQ ID NO: 2878565 - RNA, 15 nt, Human
ugguucuucauuuau

SEQ ID NO: 2878566 - RNA, 12 nt, Human
ugguucuucuca

SEQ ID NO: 2878567 - RNA, 19 nt, Human
ugguucuucucaaaagaac

SEQ ID NO: 2878568 - RNA, 16 nt, Human
ugguucauuaauucua

SEQ ID NO: 2878569 - RNA, 11 nt, Human
ugguuccccug

SEQ ID NO: 2878570 - RNA, 18 nt, Human
ugguuccccuguucacuc

SEQ ID NO: 2878571 - RNA, 19 nt, Human
ugguuccccuguucacucu

SEQ ID NO: 2878572 - RNA, 20 nt, Human
ugguuccccuguucacucua

SEQ ID NO: 2878573 - RNA, 23 nt, Human
ugguguauagaaguuuguccauu

SEQ ID NO: 2878574 - RNA, 18 nt, Human
uggugucaguauccaggc

SEQ ID NO: 2878575 - RNA, 16 nt, Human
uggugucaccugaaga

SEQ ID NO: 2878576 - RNA, 12 nt, Human
uggugucacugu

SEQ ID NO: 2878577 - RNA, 14 nt, Human
uggugucacugucc

SEQ ID NO: 2878578 - RNA, 15 nt, Human
uggugucacuguccc

SEQ ID NO: 2878579 - RNA, 19 nt, Human
uggugucacugucccuccu

SEQ ID NO: 2878580 - RNA, 20 nt, Human
uggugucacugucccuccug

SEQ ID NO: 2878581 - RNA, 21 nt, Human
uggugucacugucccuccugg

SEQ ID NO: 2878582 - RNA, 22 nt, Human
uggugucacugucccuccuggu

SEQ ID NO: 2878583 - RNA, 23 nt, Human
ugguguauccccccccuguauag

SEQ ID NO: 2878584 - RNA, 19 nt, Human
uggugucaacaugaaacac

SEQ ID NO: 2878585 - RNA, 14 nt, Human
uggugucaccccag

SEQ ID NO: 2878586 - RNA, 15 nt, Human
uggugucaccccaga

SEQ ID NO: 2878587 - RNA, 16 nt, Human
uggugucaccccagag

SEQ ID NO: 2878588 - RNA, 17 nt, Human
uggugucaccccagagc

SEQ ID NO: 2878589 - RNA, 18 nt, Human
uggugucaccccagagcc

SEQ ID NO: 2878590 - RNA, 19 nt, Human
uggugucaccccagagcca

SEQ ID NO: 2878591 - RNA, 21 nt, Human
uggugucaccccagagccaca

SEQ ID NO: 2878592 - RNA, 19 nt, Human
ugguguaauaagacauaac

SEQ ID NO: 2878593 - RNA, 13 nt, Human
ugguguaauuuau

SEQ ID NO: 2878594 - RNA, 14 nt, Human
ugguguaauaagac

SEQ ID NO: 2878595 - RNA, 15 nt, Human
ugguguaauaagaca

SEQ ID NO: 2878596 - RNA, 16 nt, Human
ugguguaauaagacau

SEQ ID NO: 2878597 - RNA, 17 nt, Human
ugguguaauaagacaua

SEQ ID NO: 2878598 - RNA, 23 nt, Human
uggguacuuguggacacagcucu

SEQ ID NO: 2878599 - RNA, 20 nt, Human
uggguacuuguggacacagc

SEQ ID NO: 2878600 - RNA, 14 nt, Human
uggugagaaaccug

SEQ ID NO: 2878601 - RNA, 20 nt, Human
uggugagaaaccuguaucuu

SEQ ID NO: 2878602 - RNA, 19 nt, Human
uggugagaaauuucuguga

SEQ ID NO: 2878603 - RNA, 22 nt, Human
uggugagaaauuucugugaaac

SEQ ID NO: 2878604 - RNA, 18 nt, Human
ugguggcagugggagcug

SEQ ID NO: 2878605 - RNA, 13 nt, Human
ugguggcaguggg

SEQ ID NO: 2878606 - RNA, 20 nt, Human
ugguggcagugggagcugcc

SEQ ID NO: 2878607 - RNA, 19 nt, Human
ugguggcccgacagccugg

SEQ ID NO: 2878608 - RNA, 17 nt, Human
ugguggcaguggaggug

SEQ ID NO: 2878609 - RNA, 19 nt, Human
ugguggcaguggagguggg

SEQ ID NO: 2878610 - RNA, 12 nt, Human
ugguggcagugg

SEQ ID NO: 2878611 - RNA, 13 nt, Human
ugguggcuggguu

SEQ ID NO: 2878612 - RNA, 12 nt, Human
uggugggagggg

SEQ ID NO: 2878613 - RNA, 14 nt, Human
ugguggcuguggaa

SEQ ID NO: 2878614 - RNA, 14 nt, Human
ugguggcuucagcu

SEQ ID NO: 2878615 - RNA, 15 nt, Human
ugguggcuucagcuc

SEQ ID NO: 2878616 - RNA, 16 nt, Human
ugguggcuucagcucc

SEQ ID NO: 2878617 - RNA, 17 nt, Human
ugguggcuucagcucca

SEQ ID NO: 2878618 - RNA, 21 nt, Human
ugguggcuucagcuccagccc

SEQ ID NO: 2878619 - RNA, 13 nt, Human
ugguggcuuuccu

SEQ ID NO: 2878620 - RNA, 10 nt, Human
ugguggccuc

SEQ ID NO: 2878621 - RNA, 12 nt, Human
ugguggccucag

SEQ ID NO: 2878622 - RNA, 13 nt, Human
ugguggccucagc

SEQ ID NO: 2878623 - RNA, 21 nt, Human
ugguggcccgacagccuggca

SEQ ID NO: 2878624 - RNA, 23 nt, Human
uggugggaggggcgcccaccucc

SEQ ID NO: 2878625 - RNA, 19 nt, Human
uggugggaugugguuuucu

SEQ ID NO: 2878626 - RNA, 21 nt, Human
uggugggaggggcgcccaccu

SEQ ID NO: 2878627 - RNA, 22 nt, Human
uggugggaggggcgcccaccuc

SEQ ID NO: 2878628 - RNA, 14 nt, Human
uggugggcuucagg

SEQ ID NO: 2878629 - RNA, 18 nt, Human
uggugggcuucagggcag

SEQ ID NO: 2878630 - RNA, 13 nt, Human
ugguguaauaaga

SEQ ID NO: 2878631 - RNA, 21 nt, Human
ugguggguucaggggacucag

SEQ ID NO: 2878632 - RNA, 19 nt, Human
ugguggguucaggggacuc

SEQ ID NO: 2878633 - RNA, 13 nt, Human
ugucuaauuaaaa

SEQ ID NO: 2878634 - RNA, 18 nt, Human
ugucuaauuaaaacacuu

SEQ ID NO: 2878635 - RNA, 18 nt, Human
ugucuaauugcaucucaa

SEQ ID NO: 2878636 - RNA, 19 nt, Human
ugucuaauugcaucucaaa

SEQ ID NO: 2878637 - RNA, 12 nt, Human
ugucuacaaaua

SEQ ID NO: 2878638 - RNA, 13 nt, Human
ugucuacaaauau

SEQ ID NO: 2878639 - RNA, 15 nt, Human
ugucuacaaauauaa

SEQ ID NO: 2878640 - RNA, 21 nt, Human
ugucuacaaauauaagauuuu

SEQ ID NO: 2878641 - RNA, 18 nt, Human
ugucuaagauucuagauc

SEQ ID NO: 2878642 - RNA, 17 nt, Human
ugucuaagauucuagau

SEQ ID NO: 2878643 - RNA, 22 nt, Human
uguccugccuaaggcugaacuu

SEQ ID NO: 2878644 - RNA, 22 nt, Human
uguccugccugcaauauuugaa

SEQ ID NO: 2878645 - RNA, 15 nt, Human
uguccugaugcuuuu

SEQ ID NO: 2878646 - RNA, 18 nt, Human
uguccugaugcuuuuguc

SEQ ID NO: 2878647 - RNA, 20 nt, Human
uguccugggagugagcuggu

SEQ ID NO: 2878648 - RNA, 19 nt, Human
uguccugggagugagcugg

SEQ ID NO: 2878649 - RNA, 12 nt, Human
uguccugggagu

SEQ ID NO: 2878650 - RNA, 12 nt, Human
uguccugcuggu

SEQ ID NO: 2878651 - RNA, 15 nt, Human
uguccugcuucugaa

SEQ ID NO: 2878652 - RNA, 20 nt, Human
ugucauccuuggucuuugua

SEQ ID NO: 2878653 - RNA, 23 nt, Human
ugucauccuuggucuuuguaucu

SEQ ID NO: 2878654 - RNA, 13 nt, Human
ugucaucucagcu

SEQ ID NO: 2878655 - RNA, 13 nt, Human
uguccuaugugug

SEQ ID NO: 2878656 - RNA, 14 nt, Human
uguccuauguguga

SEQ ID NO: 2878657 - RNA, 22 nt, Human
uguccuaugugugacucuaaau

SEQ ID NO: 2878658 - RNA, 13 nt, Human
uguccuaugaaug

SEQ ID NO: 2878659 - RNA, 21 nt, Human
uguccuaugaaugcuuugcau

SEQ ID NO: 2878660 - RNA, 12 nt, Human
uguccuaugcaa

SEQ ID NO: 2878661 - RNA, 14 nt, Human
uguccuaugcaaua

SEQ ID NO: 2878662 - RNA, 15 nt, Human
uguccuaugcaauaa

SEQ ID NO: 2878663 - RNA, 16 nt, Human
uguccuaugcaauaaa

SEQ ID NO: 2878664 - RNA, 19 nt, Human
uguccuaucuaucuuccaa

SEQ ID NO: 2878665 - RNA, 20 nt, Human
uguccuaucuaucuuccaaa

SEQ ID NO: 2878666 - RNA, 18 nt, Human
uguccccuccacugucac

SEQ ID NO: 2878667 - RNA, 12 nt, Human
uguccccuccca

SEQ ID NO: 2878668 - RNA, 16 nt, Human
uguccccgcagcccug

SEQ ID NO: 2878669 - RNA, 20 nt, Human
ugucaucugaauuugcccug

SEQ ID NO: 2878670 - RNA, 15 nt, Human
ugucacaucagauaa

SEQ ID NO: 2878671 - RNA, 16 nt, Human
uguccccggggcccag

SEQ ID NO: 2878672 - RNA, 18 nt, Human
uguccccggggcccaggg

SEQ ID NO: 2878673 - RNA, 17 nt, Human
uguccccguguugcaug

SEQ ID NO: 2878674 - RNA, 13 nt, Human
uguccccuauccu

SEQ ID NO: 2878675 - RNA, 17 nt, Human
uguccuccaagccagcg

SEQ ID NO: 2878676 - RNA, 17 nt, Human
uguccuccagaagccuc

SEQ ID NO: 2878677 - RNA, 16 nt, Human
uguccuccagaagccu

SEQ ID NO: 2878678 - RNA, 21 nt, Human
uguccuccagaagccucuggc

SEQ ID NO: 2878679 - RNA, 20 nt, Human
uguccuccagaagccucugg

SEQ ID NO: 2878680 - RNA, 19 nt, Human
uguccuccagaagccucug

SEQ ID NO: 2878681 - RNA, 18 nt, Human
uguccuccagaagccucu

SEQ ID NO: 2878682 - RNA, 14 nt, Human
uguccucaccacau

SEQ ID NO: 2878683 - RNA, 13 nt, Human
uguccucaccaug

SEQ ID NO: 2878684 - RNA, 20 nt, Human
uguccucaccaugauggggc

SEQ ID NO: 2878685 - RNA, 14 nt, Human
uguccucacugcuc

SEQ ID NO: 2878686 - RNA, 15 nt, Human
uguccucacugcucc

SEQ ID NO: 2878687 - RNA, 15 nt, Human
uguccucagcauuuc

SEQ ID NO: 2878688 - RNA, 19 nt, Human
uguccucacugcucccuga

SEQ ID NO: 2878689 - RNA, 22 nt, Human
uguccucacugcucccugaagc

SEQ ID NO: 2878690 - RNA, 13 nt, Human
uguccucccaucc

SEQ ID NO: 2878691 - RNA, 23 nt, Human
uguccuccagaagccucuggcua

SEQ ID NO: 2878692 - RNA, 22 nt, Human
uguccuccagaagccucuggcu

SEQ ID NO: 2878693 - RNA, 23 nt, Human
uguccucccauccccuggacugg

SEQ ID NO: 2878694 - RNA, 17 nt, Human
uguccucccauccccug

SEQ ID NO: 2878695 - RNA, 18 nt, Human
uguccucccauccccugg

SEQ ID NO: 2878696 - RNA, 19 nt, Human
uguccucccauccccugga

SEQ ID NO: 2878697 - RNA, 22 nt, Human
uguccucccauccccuggacug

SEQ ID NO: 2878698 - RNA, 21 nt, Human
ugucucaaacuucagauggga

SEQ ID NO: 2878699 - RNA, 17 nt, Human
ugucucacugaaacauu

SEQ ID NO: 2878700 - RNA, 13 nt, Human
ugucucagccucc

SEQ ID NO: 2878701 - RNA, 14 nt, Human
ugucucagacuuuu

SEQ ID NO: 2878702 - RNA, 15 nt, Human
ugucucagacuuuug

SEQ ID NO: 2878703 - RNA, 20 nt, Human
ugucucagacuuuuguacau

SEQ ID NO: 2878704 - RNA, 22 nt, Human
ugucucagacuuuuguacaucu

SEQ ID NO: 2878705 - RNA, 15 nt, Human
ugucucagccuccca

SEQ ID NO: 2878706 - RNA, 14 nt, Human
ugucucagccuccc

SEQ ID NO: 2878707 - RNA, 17 nt, Human
ugucucaagagggcacu

SEQ ID NO: 2878708 - RNA, 18 nt, Human
ugucucaagagggcacug

SEQ ID NO: 2878709 - RNA, 11 nt, Human
ugucuauuuua

SEQ ID NO: 2878710 - RNA, 12 nt, Human
ugucuauuuuaa

SEQ ID NO: 2878711 - RNA, 15 nt, Human
ugucuauuuuaaaau

SEQ ID NO: 2878712 - RNA, 16 nt, Human
ugucuauuuuaaaaua

SEQ ID NO: 2878713 - RNA, 22 nt, Human
ugucuauuuuaaaauaaauuag

SEQ ID NO: 2878714 - RNA, 14 nt, Human
ugucuagaguagcu

SEQ ID NO: 2878715 - RNA, 16 nt, Human
ugucuaugggacucaa

SEQ ID NO: 2878716 - RNA, 15 nt, Human
ugucuaugggacuca

SEQ ID NO: 2878717 - RNA, 14 nt, Human
ugucuaugggacuc

SEQ ID NO: 2878718 - RNA, 17 nt, Human
ugucuagcaugccaaca

SEQ ID NO: 2878719 - RNA, 20 nt, Human
ugucuagcaugccaacaaga

SEQ ID NO: 2878720 - RNA, 21 nt, Human
ugucuagcaugccaacaagaa

SEQ ID NO: 2878721 - RNA, 22 nt, Human
ugucuauaaucccagcacuuug

SEQ ID NO: 2878722 - RNA, 17 nt, Human
ugucuauaguugucagu

SEQ ID NO: 2878723 - RNA, 18 nt, Human
ugucuauaguugucagua

SEQ ID NO: 2878724 - RNA, 11 nt, Human
ugucuuuguaa

SEQ ID NO: 2878725 - RNA, 12 nt, Human
ugucuuuguaag

SEQ ID NO: 2878726 - RNA, 13 nt, Human
ugucuuuguaagu

SEQ ID NO: 2878727 - RNA, 17 nt, Human
ugucuuuguaagucagu

SEQ ID NO: 2878728 - RNA, 14 nt, Human
ugucuuuuaaugcu

SEQ ID NO: 2878729 - RNA, 18 nt, Human
ugucuuuuaaugcuucau

SEQ ID NO: 2878730 - RNA, 20 nt, Human
ugucuuuuaaugcuucauuc

SEQ ID NO: 2878731 - RNA, 20 nt, Human
ugucuuuuauaguggaaaaa

SEQ ID NO: 2878732 - RNA, 22 nt, Human
ugucuuuuauaguggaaaaaca

SEQ ID NO: 2878733 - RNA, 15 nt, Human
ugucuuuuauauuug

SEQ ID NO: 2878734 - RNA, 16 nt, Human
ugucuuuuauauuugu

SEQ ID NO: 2878735 - RNA, 18 nt, Human
ugucuuuuauauuuguau

SEQ ID NO: 2878736 - RNA, 17 nt, Human
ugucuuuuaugcagaua

SEQ ID NO: 2878737 - RNA, 19 nt, Human
ugucuuuuaugcagauaga

SEQ ID NO: 2878738 - RNA, 20 nt, Human
ugucuuuuaugcagauagaa

SEQ ID NO: 2878739 - RNA, 13 nt, Human
ugucuguuuguuu

SEQ ID NO: 2878740 - RNA, 15 nt, Human
ugucuguuuguuuca

SEQ ID NO: 2878741 - RNA, 16 nt, Human
ugucuguuuguuucaa

SEQ ID NO: 2878742 - RNA, 19 nt, Human
ugucuguuuguuucaagaa

SEQ ID NO: 2878743 - RNA, 20 nt, Human
ugucuguuuguuucaagaac

SEQ ID NO: 2878744 - RNA, 22 nt, Human
ugucuguuuguuucaagaaccu

SEQ ID NO: 2878745 - RNA, 23 nt, Human
ugucuguuuguuucaagaaccug

SEQ ID NO: 2878746 - RNA, 15 nt, Human
ugucuguuuaagaaa

SEQ ID NO: 2878747 - RNA, 16 nt, Human
ugucuguuuaagaaaa

SEQ ID NO: 2878748 - RNA, 17 nt, Human
ugucuguuuaagaaaag

SEQ ID NO: 2878749 - RNA, 21 nt, Human
ugucuguuuaagaaaaguauu

SEQ ID NO: 2878750 - RNA, 17 nt, Human
ugucuguggauggucau

SEQ ID NO: 2878751 - RNA, 20 nt, Human
ugucuguggauggucauugc

SEQ ID NO: 2878752 - RNA, 21 nt, Human
ugucuguggauggucauugca

SEQ ID NO: 2878753 - RNA, 15 nt, Human
ugucugauuggcuug

SEQ ID NO: 2878754 - RNA, 16 nt, Human
ugucugauuggcuugu

SEQ ID NO: 2878755 - RNA, 21 nt, Human
ugucugauuggcuuguagaau

SEQ ID NO: 2878756 - RNA, 23 nt, Human
ugucugauuggcuuguagaauug

SEQ ID NO: 2878757 - RNA, 12 nt, Human
ugucugcagccc

SEQ ID NO: 2878758 - RNA, 13 nt, Human
ugucugcagcccu

SEQ ID NO: 2878759 - RNA, 16 nt, Human
ugucugcagcccugag

SEQ ID NO: 2878760 - RNA, 17 nt, Human
ugucugcagcccugaga

SEQ ID NO: 2878761 - RNA, 18 nt, Human
ugucugcagcccugagaa

SEQ ID NO: 2878762 - RNA, 12 nt, Human
ugucugcagccu

SEQ ID NO: 2878763 - RNA, 13 nt, Human
ugucugcagccuu

SEQ ID NO: 2878764 - RNA, 20 nt, Human
ugucugaagucacugcacag

SEQ ID NO: 2878765 - RNA, 22 nt, Human
ugucugaaucgagugagacaaa

SEQ ID NO: 2878766 - RNA, 23 nt, Human
ugucugaaucgagugagacaaaa

SEQ ID NO: 2878767 - RNA, 19 nt, Human
uguaggaaggucucauucu

SEQ ID NO: 2878768 - RNA, 20 nt, Human
uguaggaaggucucauucuu

SEQ ID NO: 2878769 - RNA, 21 nt, Human
uguaggaaggucucauucuuc

SEQ ID NO: 2878770 - RNA, 19 nt, Human
uguacagagugcuuuucug

SEQ ID NO: 2878771 - RNA, 15 nt, Human
uguagcuuugcucuu

SEQ ID NO: 2878772 - RNA, 13 nt, Human
uguagcuuuucac

SEQ ID NO: 2878773 - RNA, 15 nt, Human
uguagcuuuucaccu

SEQ ID NO: 2878774 - RNA, 16 nt, Human
uguagcuuuucaccuu

SEQ ID NO: 2878775 - RNA, 13 nt, Human
uguagcuuugcuc

SEQ ID NO: 2878776 - RNA, 12 nt, Human
uguagcuuugcu

SEQ ID NO: 2878777 - RNA, 19 nt, Human
uguacagaauuuuggaaga

SEQ ID NO: 2878778 - RNA, 12 nt, Human
uguacagcccag

SEQ ID NO: 2878779 - RNA, 17 nt, Human
uguacagcguuuuaaaa

SEQ ID NO: 2878780 - RNA, 16 nt, Human
uguacaggaacugcau

SEQ ID NO: 2878781 - RNA, 17 nt, Human
uguauagacaguuugua

SEQ ID NO: 2878782 - RNA, 21 nt, Human
uguauagacaguuuguaaaug

SEQ ID NO: 2878783 - RNA, 22 nt, Human
uguauagacaguuuguaaaugu

SEQ ID NO: 2878784 - RNA, 18 nt, Human
uguauaacccuguuacaa

SEQ ID NO: 2878785 - RNA, 23 nt, Human
uguauaguaaagugauaauuucu

SEQ ID NO: 2878786 - RNA, 15 nt, Human
uguauaguacuggca

SEQ ID NO: 2878787 - RNA, 18 nt, Human
uguauaaauaggagagga

SEQ ID NO: 2878788 - RNA, 21 nt, Human
uguauaaaucuuucuuuugau

SEQ ID NO: 2878789 - RNA, 11 nt, Human
uguauaaaugu

SEQ ID NO: 2878790 - RNA, 12 nt, Human
uguauaaaugua

SEQ ID NO: 2878791 - RNA, 14 nt, Human
uguauaaauguaua

SEQ ID NO: 2878792 - RNA, 15 nt, Human
uguauaaauguauau

SEQ ID NO: 2878793 - RNA, 16 nt, Human
uguauaaauguauaua

SEQ ID NO: 2878794 - RNA, 18 nt, Human
uguauaaauguauauaca

SEQ ID NO: 2878795 - RNA, 20 nt, Human
uguauaaauguauauacaca

SEQ ID NO: 2878796 - RNA, 21 nt, Human
uguauaaauguauauacacau

SEQ ID NO: 2878797 - RNA, 20 nt, Human
uguauaaacauuaaaugucu

SEQ ID NO: 2878798 - RNA, 14 nt, Human
uguauaaauaggag

SEQ ID NO: 2878799 - RNA, 19 nt, Human
uguauaaagcaacuguuau

SEQ ID NO: 2878800 - RNA, 23 nt, Human
uguauaaagcaacuguuaugaaa

SEQ ID NO: 2878801 - RNA, 14 nt, Human
uguauaaaugugau

SEQ ID NO: 2878802 - RNA, 18 nt, Human
uguauaacuucuuaaaag

SEQ ID NO: 2878803 - RNA, 21 nt, Human
uguauaacuucuuaaaaguug

SEQ ID NO: 2878804 - RNA, 16 nt, Human
uguauaagcacugaaa

SEQ ID NO: 2878805 - RNA, 18 nt, Human
uguauaagcacugaaaaa

SEQ ID NO: 2878806 - RNA, 17 nt, Human
uguauaagauccuagau

SEQ ID NO: 2878807 - RNA, 21 nt, Human
uguauaguacuggcaugguac

SEQ ID NO: 2878808 - RNA, 17 nt, Human
uguaucucugaagcaug

SEQ ID NO: 2878809 - RNA, 18 nt, Human
uguaucucugaagcaugu

SEQ ID NO: 2878810 - RNA, 19 nt, Human
uguaucucugaagcauguu

SEQ ID NO: 2878811 - RNA, 21 nt, Human
uguaucucugaagcauguuuc

SEQ ID NO: 2878812 - RNA, 22 nt, Human
uguaucucugaagcauguuuca

SEQ ID NO: 2878813 - RNA, 13 nt, Human
uguaucugugaag

SEQ ID NO: 2878814 - RNA, 23 nt, Human
uguaucucugaagcauguuucau

SEQ ID NO: 2878815 - RNA, 16 nt, Human
uguaucucuuucacau

SEQ ID NO: 2878816 - RNA, 12 nt, Human
uguaucugaguu

SEQ ID NO: 2878817 - RNA, 15 nt, Human
uguaucugaguugcc

SEQ ID NO: 2878818 - RNA, 16 nt, Human
uguaucugaguugcca

SEQ ID NO: 2878819 - RNA, 19 nt, Human
uguaucugaguugccaaga

SEQ ID NO: 2878820 - RNA, 23 nt, Human
uguaucugaguugccaagacaaa

SEQ ID NO: 2878821 - RNA, 14 nt, Human
uguaucuuucuaug

SEQ ID NO: 2878822 - RNA, 21 nt, Human
uguaucuuucuaugcugcuuu

SEQ ID NO: 2878823 - RNA, 20 nt, Human
uguaugaacuuuaucuaaag

SEQ ID NO: 2878824 - RNA, 14 nt, Human
uguaugaaggcuuu

SEQ ID NO: 2878825 - RNA, 19 nt, Human
uguaugaauacagcagcaa

SEQ ID NO: 2878826 - RNA, 13 nt, Human
uguaucuguguag

SEQ ID NO: 2878827 - RNA, 16 nt, Human
uguaucuguguagacu

SEQ ID NO: 2878828 - RNA, 15 nt, Human
uguaucuuaaauuug

SEQ ID NO: 2878829 - RNA, 16 nt, Human
uguaucuuccauauuu

SEQ ID NO: 2878830 - RNA, 18 nt, Human
uguaucuuccauauuugg

SEQ ID NO: 2878831 - RNA, 21 nt, Human
uguaucuuccauauuuggaag

SEQ ID NO: 2878832 - RNA, 12 nt, Human
uguaucugugua

SEQ ID NO: 2878833 - RNA, 11 nt, Human
uguaucugugu

SEQ ID NO: 2878834 - RNA, 22 nt, Human
uguaugaaagauggcugugccu

SEQ ID NO: 2878835 - RNA, 14 nt, Human
ugucacaggcaggu

SEQ ID NO: 2878836 - RNA, 12 nt, Human
ugucacaaagaa

SEQ ID NO: 2878837 - RNA, 13 nt, Human
uguaugcgugugu

SEQ ID NO: 2878838 - RNA, 14 nt, Human
uguaugcugaucau

SEQ ID NO: 2878839 - RNA, 15 nt, Human
uguaugcugaucauc

SEQ ID NO: 2878840 - RNA, 23 nt, Human
uguaugcugaucaucgccagagg

SEQ ID NO: 2878841 - RNA, 17 nt, Human
uguauggggaaucuaag

SEQ ID NO: 2878842 - RNA, 13 nt, Human
uguauggggaggc

SEQ ID NO: 2878843 - RNA, 15 nt, Human
uguaugguucugugc

SEQ ID NO: 2878844 - RNA, 12 nt, Human
uguaugcuggac

SEQ ID NO: 2878845 - RNA, 18 nt, Human
uguauggaaauaaaugua

SEQ ID NO: 2878846 - RNA, 23 nt, Human
uguauggaaauaaauguaucaua

SEQ ID NO: 2878847 - RNA, 19 nt, Human
uguauggaaucccacugua

SEQ ID NO: 2878848 - RNA, 21 nt, Human
ugucaucagccaccauccuau

SEQ ID NO: 2878849 - RNA, 15 nt, Human
ugucaucagccacca

SEQ ID NO: 2878850 - RNA, 18 nt, Human
ugucaucagccaccaucc

SEQ ID NO: 2878851 - RNA, 18 nt, Human
ugucaucagagcuccucu

SEQ ID NO: 2878852 - RNA, 19 nt, Human
ugucaucagagcuccucug

SEQ ID NO: 2878853 - RNA, 20 nt, Human
ugucaucagagcuccucugu

SEQ ID NO: 2878854 - RNA, 14 nt, Human
ugucaucagaugga

SEQ ID NO: 2878855 - RNA, 22 nt, Human
ugucacuucgcgugcccucgcu

SEQ ID NO: 2878856 - RNA, 13 nt, Human
ugucacuugcaug

SEQ ID NO: 2878857 - RNA, 14 nt, Human
ugucacuugcaugu

SEQ ID NO: 2878858 - RNA, 15 nt, Human
ugucacuugcauguc

SEQ ID NO: 2878859 - RNA, 14 nt, Human
ugucacuugugcuu

SEQ ID NO: 2878860 - RNA, 15 nt, Human
ugucacuugugcuuu

SEQ ID NO: 2878861 - RNA, 17 nt, Human
ugucacuugugcuuugc

SEQ ID NO: 2878862 - RNA, 18 nt, Human
ugucacuugugcuuugcu

SEQ ID NO: 2878863 - RNA, 20 nt, Human
ugucacuugugcuuugcucu

SEQ ID NO: 2878864 - RNA, 21 nt, Human
ugucacaggcagguccagggu

SEQ ID NO: 2878865 - RNA, 17 nt, Human
ugucacaggcaggucca

SEQ ID NO: 2878866 - RNA, 16 nt, Human
ugucacaggcaggucc

SEQ ID NO: 2878867 - RNA, 15 nt, Human
ugucacaggcagguc

SEQ ID NO: 2878868 - RNA, 13 nt, Human
ugucacaggcagg

SEQ ID NO: 2878869 - RNA, 17 nt, Human
ugucacagggacugaaa

SEQ ID NO: 2878870 - RNA, 20 nt, Human
ugucacaugaaacauuugca

SEQ ID NO: 2878871 - RNA, 16 nt, Human
ugucacugcuuuuggc

SEQ ID NO: 2878872 - RNA, 19 nt, Human
ugucacugcuuuuggccug

SEQ ID NO: 2878873 - RNA, 21 nt, Human
ugucacugcuuuuggccugga

SEQ ID NO: 2878874 - RNA, 11 nt, Human
ugucacagggc

SEQ ID NO: 2878875 - RNA, 12 nt, Human
ugucacagggcc

SEQ ID NO: 2878876 - RNA, 13 nt, Human
ugucacagggcca

SEQ ID NO: 2878877 - RNA, 14 nt, Human
ugucacagggccaa

SEQ ID NO: 2878878 - RNA, 21 nt, Human
ugucacugguagaccaaaaua

SEQ ID NO: 2878879 - RNA, 23 nt, Human
ugucacugguagaccaaaauaaa

SEQ ID NO: 2878880 - RNA, 18 nt, Human
ugucacugucccuccugg

SEQ ID NO: 2878881 - RNA, 19 nt, Human
ugucacugucccuccuggu

SEQ ID NO: 2878882 - RNA, 22 nt, Human
ugucacugucccuccugguguc

SEQ ID NO: 2878883 - RNA, 15 nt, Human
ugcuucucacuuuuu

SEQ ID NO: 2878884 - RNA, 23 nt, Human
ugcuuccucccaacaagcagcug

SEQ ID NO: 2878885 - RNA, 14 nt, Human
ugcuucucaucccc

SEQ ID NO: 2878886 - RNA, 17 nt, Human
ugcuucucaucuuguga

SEQ ID NO: 2878887 - RNA, 18 nt, Human
ugcuucucaucuugugaa

SEQ ID NO: 2878888 - RNA, 19 nt, Human
ugcuucucaucuugugaaa

SEQ ID NO: 2878889 - RNA, 13 nt, Human
ugcuucuccccag

SEQ ID NO: 2878890 - RNA, 14 nt, Human
ugcuucuccccaga

SEQ ID NO: 2878891 - RNA, 15 nt, Human
ugcuucuccccagaa

SEQ ID NO: 2878892 - RNA, 16 nt, Human
ugcuucuccccagaau

SEQ ID NO: 2878893 - RNA, 19 nt, Human
ugcuucuccccagaauuca

SEQ ID NO: 2878894 - RNA, 15 nt, Human
ugcuuccucccaaca

SEQ ID NO: 2878895 - RNA, 21 nt, Human
ugcuuccgguagggaggcagc

SEQ ID NO: 2878896 - RNA, 22 nt, Human
ugcuuccgguagggaggcagcc

SEQ ID NO: 2878897 - RNA, 16 nt, Human
ugcuuaccuugacugu

SEQ ID NO: 2878898 - RNA, 19 nt, Human
ugcuuaccuugacuguuga

SEQ ID NO: 2878899 - RNA, 23 nt, Human
ugcuuaccuugacuguugaugua

SEQ ID NO: 2878900 - RNA, 14 nt, Human
ugcuuaauuucuaa

SEQ ID NO: 2878901 - RNA, 15 nt, Human
ugcuuaauuucuaaa

SEQ ID NO: 2878902 - RNA, 19 nt, Human
ugcuuaauuucuaaagaua

SEQ ID NO: 2878903 - RNA, 20 nt, Human
ugcuuaauuucuaaagauaa

SEQ ID NO: 2878904 - RNA, 14 nt, Human
ugcuucccaccucc

SEQ ID NO: 2878905 - RNA, 17 nt, Human
ugcuucccaccucccug

SEQ ID NO: 2878906 - RNA, 19 nt, Human
ugcuucccaccucccugcc

SEQ ID NO: 2878907 - RNA, 20 nt, Human
ugcuucccaccucccugccc

SEQ ID NO: 2878908 - RNA, 21 nt, Human
ugcuucccaccucccugccca

SEQ ID NO: 2878909 - RNA, 23 nt, Human
ugcuucccaccucccugcccagg

SEQ ID NO: 2878910 - RNA, 14 nt, Human
ugcuucccagguuc

SEQ ID NO: 2878911 - RNA, 15 nt, Human
ugcuuccccuuuugc

SEQ ID NO: 2878912 - RNA, 18 nt, Human
ugcuuccccuuuugccaa

SEQ ID NO: 2878913 - RNA, 18 nt, Human
ugcuuaagggaguuuaau

SEQ ID NO: 2878914 - RNA, 19 nt, Human
ugcuuaagggaguuuaaua

SEQ ID NO: 2878915 - RNA, 13 nt, Human
ugcuuaaguucca

SEQ ID NO: 2878916 - RNA, 14 nt, Human
ugcuuaaguuccag

SEQ ID NO: 2878917 - RNA, 15 nt, Human
ugcuuaaguuccagc

SEQ ID NO: 2878918 - RNA, 16 nt, Human
ugcuuaaguuccagca

SEQ ID NO: 2878919 - RNA, 18 nt, Human
ugcuuaaaagguugcaua

SEQ ID NO: 2878920 - RNA, 18 nt, Human
ugccuguccagccugggc

SEQ ID NO: 2878921 - RNA, 16 nt, Human
ugccuguccagccugg

SEQ ID NO: 2878922 - RNA, 15 nt, Human
ugccuguccagccug

SEQ ID NO: 2878923 - RNA, 23 nt, Human
ugccuguaguuaggaaauaaaac

SEQ ID NO: 2878924 - RNA, 16 nt, Human
ugccuguauacuuuag

SEQ ID NO: 2878925 - RNA, 20 nt, Human
ugccuguccagccugggcag

SEQ ID NO: 2878926 - RNA, 19 nt, Human
ugccuguccagccugggca

SEQ ID NO: 2878927 - RNA, 16 nt, Human
ugccugucccaccccc

SEQ ID NO: 2878928 - RNA, 19 nt, Human
ugccugucccacccccacc

SEQ ID NO: 2878929 - RNA, 21 nt, Human
ugcuguuuguagugaaauaau

SEQ ID NO: 2878930 - RNA, 20 nt, Human
ugccugucgcuuucccuugg

SEQ ID NO: 2878931 - RNA, 18 nt, Human
ugcuguuuugauuuguac

SEQ ID NO: 2878932 - RNA, 12 nt, Human
ugcuuguguuaa

SEQ ID NO: 2878933 - RNA, 16 nt, Human
ugcuugugaaaaugug

SEQ ID NO: 2878934 - RNA, 15 nt, Human
ugcuucuuacugaua

SEQ ID NO: 2878935 - RNA, 17 nt, Human
ugcuucuuacugauaau

SEQ ID NO: 2878936 - RNA, 15 nt, Human
ugcuuguguuaagua

SEQ ID NO: 2878937 - RNA, 14 nt, Human
ugcuuguuaacuga

SEQ ID NO: 2878938 - RNA, 20 nt, Human
ugcuugugaaaauguguucu

SEQ ID NO: 2878939 - RNA, 20 nt, Human
ugcuuguguaauuuauguga

SEQ ID NO: 2878940 - RNA, 16 nt, Human
ugcuuguuaacugagu

SEQ ID NO: 2878941 - RNA, 19 nt, Human
ugcuuucguguaaauuaug

SEQ ID NO: 2878942 - RNA, 19 nt, Human
ugcuuucuaugcuguuugu

SEQ ID NO: 2878943 - RNA, 21 nt, Human
ugcuuucuaugcuguuuguag

SEQ ID NO: 2878944 - RNA, 12 nt, Human
ugcuuucucccc

SEQ ID NO: 2878945 - RNA, 13 nt, Human
ugcuuugcccagc

SEQ ID NO: 2878946 - RNA, 17 nt, Human
ugcuuugauuuacagca

SEQ ID NO: 2878947 - RNA, 18 nt, Human
ugcuuugauuuacagcaa

SEQ ID NO: 2878948 - RNA, 22 nt, Human
ugcuuugauuuacagcaaguag

SEQ ID NO: 2878949 - RNA, 12 nt, Human
ugcuuugcauuu

SEQ ID NO: 2878950 - RNA, 18 nt, Human
ugcuuugcuuugucugga

SEQ ID NO: 2878951 - RNA, 15 nt, Human
uggaaaagaacuguu

SEQ ID NO: 2878952 - RNA, 12 nt, Human
ugcuuugcucuu

SEQ ID NO: 2878953 - RNA, 13 nt, Human
ugcuuugcucuug

SEQ ID NO: 2878954 - RNA, 14 nt, Human
ugcuuugcucuugu

SEQ ID NO: 2878955 - RNA, 14 nt, Human
ugcuuugcccagca

SEQ ID NO: 2878956 - RNA, 21 nt, Human
uggaacuucuaauauauuuuu

SEQ ID NO: 2878957 - RNA, 16 nt, Human
uggaacuuuuauuaga

SEQ ID NO: 2878958 - RNA, 21 nt, Human
uggaacuuuuauuagauaaca

SEQ ID NO: 2878959 - RNA, 21 nt, Human
uggaagaaaaaaaccacacaa

SEQ ID NO: 2878960 - RNA, 18 nt, Human
uggaagaaaaaaaucuuc

SEQ ID NO: 2878961 - RNA, 22 nt, Human
uggaagaaaaaaaucuucucca

SEQ ID NO: 2878962 - RNA, 15 nt, Human
uggaagaaaaugguu

SEQ ID NO: 2878963 - RNA, 22 nt, Human
uggaagaaaaugguuuauuuug

SEQ ID NO: 2878964 - RNA, 13 nt, Human
uggaacuucuaau

SEQ ID NO: 2878965 - RNA, 14 nt, Human
uggaacuucuaaua

SEQ ID NO: 2878966 - RNA, 15 nt, Human
uggaacuucuaauau

SEQ ID NO: 2878967 - RNA, 16 nt, Human
uggaacuucuaauaua

SEQ ID NO: 2878968 - RNA, 18 nt, Human
uggaacuucuaauauauu

SEQ ID NO: 2878969 - RNA, 16 nt, Human
uggaacagaauguuuu

SEQ ID NO: 2878970 - RNA, 23 nt, Human
uggaacagauucacacugucugg

SEQ ID NO: 2878971 - RNA, 18 nt, Human
uggaacauaaaaaggaca

SEQ ID NO: 2878972 - RNA, 21 nt, Human
uggaacagaauguuuuacugu

SEQ ID NO: 2878973 - RNA, 19 nt, Human
uggaacagauucacacugu

SEQ ID NO: 2878974 - RNA, 20 nt, Human
uggaacagauucacacuguc

SEQ ID NO: 2878975 - RNA, 13 nt, Human
uggaaccucuguc

SEQ ID NO: 2878976 - RNA, 16 nt, Human
uggaaccucugucuca

SEQ ID NO: 2878977 - RNA, 20 nt, Human
uggaaccucugucucauccu

SEQ ID NO: 2878978 - RNA, 16 nt, Human
uggaaccugcaaaaaa

SEQ ID NO: 2878979 - RNA, 19 nt, Human
uggaaccugcaaaaaauac

SEQ ID NO: 2878980 - RNA, 13 nt, Human
uggaaccuugcug

SEQ ID NO: 2878981 - RNA, 14 nt, Human
uggaaccuugcugu

SEQ ID NO: 2878982 - RNA, 15 nt, Human
uggaaccuugcuguc

SEQ ID NO: 2878983 - RNA, 16 nt, Human
uggaaccuugcugucc

SEQ ID NO: 2878984 - RNA, 18 nt, Human
uggaaccuugcuguccug

SEQ ID NO: 2878985 - RNA, 22 nt, Human
uggaaccuugcuguccugaucu

SEQ ID NO: 2878986 - RNA, 23 nt, Human
uggaaccuugcuguccugaucug

SEQ ID NO: 2878987 - RNA, 15 nt, Human
uggaaaccugaaaaa

SEQ ID NO: 2878988 - RNA, 20 nt, Human
uggaaacauuuauauuuuua

SEQ ID NO: 2878989 - RNA, 18 nt, Human
uggaaacauuuuuuaaaa

SEQ ID NO: 2878990 - RNA, 17 nt, Human
uggaaaccucuacauau

SEQ ID NO: 2878991 - RNA, 19 nt, Human
uggaaaccucuacauauuu

SEQ ID NO: 2878992 - RNA, 17 nt, Human
uggaaacccauaggccc

SEQ ID NO: 2878993 - RNA, 21 nt, Human
uggaaacccauaggcccacac

SEQ ID NO: 2878994 - RNA, 18 nt, Human
uggaaacccgaggguuga

SEQ ID NO: 2878995 - RNA, 17 nt, Human
uggaaaccugaaaaaaa

SEQ ID NO: 2878996 - RNA, 17 nt, Human
uggacauuugccuugcu

SEQ ID NO: 2878997 - RNA, 18 nt, Human
uggacauuugccuugcug

SEQ ID NO: 2878998 - RNA, 19 nt, Human
uggacauuugccuugcugg

SEQ ID NO: 2878999 - RNA, 22 nt, Human
uggacauuugccuugcuggacg

SEQ ID NO: 2879000 - RNA, 17 nt, Human
uggacaggcauguucuc

SEQ ID NO: 2879001 - RNA, 15 nt, Human
uggacauugucugcg

SEQ ID NO: 2879002 - RNA, 12 nt, Human
uggacauggccc

SEQ ID NO: 2879003 - RNA, 17 nt, Human
uggacauggccccugug

SEQ ID NO: 2879004 - RNA, 22 nt, Human
uggacaggcauguucucugagg

SEQ ID NO: 2879005 - RNA, 18 nt, Human
uggacaggcauguucucu

SEQ ID NO: 2879006 - RNA, 18 nt, Human
uggaagacaaaauguuuu

SEQ ID NO: 2879007 - RNA, 11 nt, Human
uggaagacaca

SEQ ID NO: 2879008 - RNA, 17 nt, Human
uggacguucggggcaug

SEQ ID NO: 2879009 - RNA, 14 nt, Human
uggacuaaaugccu

SEQ ID NO: 2879010 - RNA, 16 nt, Human
uggacuaaaugccuag

SEQ ID NO: 2879011 - RNA, 22 nt, Human
uggacuaaaugccuaguuuuua

SEQ ID NO: 2879012 - RNA, 21 nt, Human
uggacuaaccccaacgcacag

SEQ ID NO: 2879013 - RNA, 22 nt, Human
uggacuaaccccaacgcacagg

SEQ ID NO: 2879014 - RNA, 15 nt, Human
uggacggcugggcac

SEQ ID NO: 2879015 - RNA, 16 nt, Human
uggacggggacugggg

SEQ ID NO: 2879016 - RNA, 14 nt, Human
uggacggugcucca

SEQ ID NO: 2879017 - RNA, 16 nt, Human
uggacggugcuccagg

SEQ ID NO: 2879018 - RNA, 17 nt, Human
uggacggugcuccaggc

SEQ ID NO: 2879019 - RNA, 18 nt, Human
uggacggugcuccaggca

SEQ ID NO: 2879020 - RNA, 19 nt, Human
uggacggugcuccaggcag

SEQ ID NO: 2879021 - RNA, 22 nt, Human
uggacggugcuccaggcaggcu

SEQ ID NO: 2879022 - RNA, 14 nt, Human
uggacgucuuucuu

SEQ ID NO: 2879023 - RNA, 17 nt, Human
uggagacacaacuauuu

SEQ ID NO: 2879024 - RNA, 21 nt, Human
uggacuguggcacuugccugg

SEQ ID NO: 2879025 - RNA, 12 nt, Human
uggagacagccc

SEQ ID NO: 2879026 - RNA, 13 nt, Human
uggagacagcccc

SEQ ID NO: 2879027 - RNA, 17 nt, Human
uggagacagccccagag

SEQ ID NO: 2879028 - RNA, 19 nt, Human
uggagacagccccagagca

SEQ ID NO: 2879029 - RNA, 20 nt, Human
uggagacagccccagagcag

SEQ ID NO: 2879030 - RNA, 21 nt, Human
uggagacagccccagagcagg

SEQ ID NO: 2879031 - RNA, 22 nt, Human
uggagacagccccagagcaggg

SEQ ID NO: 2879032 - RNA, 18 nt, Human
uggagaccagggagccuu

SEQ ID NO: 2879033 - RNA, 19 nt, Human
uggagaccagggagccuuu

SEQ ID NO: 2879034 - RNA, 22 nt, Human
uggagacccaccccaccugcag

SEQ ID NO: 2879035 - RNA, 19 nt, Human
uggagacccugcaaacaga

SEQ ID NO: 2879036 - RNA, 19 nt, Human
uggagaccucuccuuccua

SEQ ID NO: 2879037 - RNA, 14 nt, Human
uggagaccuuaccc

SEQ ID NO: 2879038 - RNA, 12 nt, Human
uggagacgugga

SEQ ID NO: 2879039 - RNA, 20 nt, Human
uggagacguggaaccucugu

SEQ ID NO: 2879040 - RNA, 21 nt, Human
uggagagcccggcgccccugc

SEQ ID NO: 2879041 - RNA, 11 nt, Human
uggagagcugg

SEQ ID NO: 2879042 - RNA, 13 nt, Human
uggagagcuggag

SEQ ID NO: 2879043 - RNA, 15 nt, Human
uggagagcuggagcc

SEQ ID NO: 2879044 - RNA, 17 nt, Human
uggagagcuggagccug

SEQ ID NO: 2879045 - RNA, 19 nt, Human
uggagagcuggugcccgga

SEQ ID NO: 2879046 - RNA, 11 nt, Human
uggagaggaac

SEQ ID NO: 2879047 - RNA, 12 nt, Human
uggagaggaaca

SEQ ID NO: 2879048 - RNA, 16 nt, Human
uggagagcuggugccc

SEQ ID NO: 2879049 - RNA, 14 nt, Human
uggagagcuggugc

SEQ ID NO: 2879050 - RNA, 18 nt, Human
uggagagcuggagccugg

SEQ ID NO: 2879051 - RNA, 20 nt, Human
uggagagcuggagccuggug

SEQ ID NO: 2879052 - RNA, 22 nt, Human
uggacuguggcacuugccuggg

SEQ ID NO: 2879053 - RNA, 18 nt, Human
uggagacaaugucugcag

SEQ ID NO: 2879054 - RNA, 19 nt, Human
uggagacaaugucugcagc

SEQ ID NO: 2879055 - RNA, 21 nt, Human
uggagacaaugucugcagccc

SEQ ID NO: 2879056 - RNA, 22 nt, Human
uggagacaaugucugcagcccu

SEQ ID NO: 2879057 - RNA, 24 nt, Human
uggagacaaugucugcagcccuga

SEQ ID NO: 2879058 - RNA, 20 nt, Human
uggacuguggcacuugccug

SEQ ID NO: 2879059 - RNA, 18 nt, Human
uggacuguggcacuugcc

SEQ ID NO: 2879060 - RNA, 12 nt, Human
uggacuguggca

SEQ ID NO: 2879061 - RNA, 13 nt, Human
uggacuguggcac

SEQ ID NO: 2879062 - RNA, 15 nt, Human
uggacugucauagaa

SEQ ID NO: 2879063 - RNA, 21 nt, Human
uggacugucauagaaauuaca

SEQ ID NO: 2879064 - RNA, 13 nt, Human
uggacugggaggu

SEQ ID NO: 2879065 - RNA, 22 nt, Human
uggacuggcuagaguccucacu

SEQ ID NO: 2879066 - RNA, 20 nt, Human
uggacuggcuagaguccuca

SEQ ID NO: 2879067 - RNA, 19 nt, Human
uggacuggcuagaguccuc

SEQ ID NO: 2879068 - RNA, 13 nt, Human
uggacuggcuaga

SEQ ID NO: 2879069 - RNA, 17 nt, Human
uggacuggccccugggu

SEQ ID NO: 2879070 - RNA, 20 nt, Human
uggacuggccccugggucag

SEQ ID NO: 2879071 - RNA, 14 nt, Human
uggacuggccccug

SEQ ID NO: 2879072 - RNA, 15 nt, Human
uggacuggccccugg

SEQ ID NO: 2879073 - RNA, 16 nt, Human
uggacuggccccuggg

SEQ ID NO: 2879074 - RNA, 13 nt, Human
uggacucuucaaa

SEQ ID NO: 2879075 - RNA, 20 nt, Human
uggacucuucaaaaacuguu

SEQ ID NO: 2879076 - RNA, 21 nt, Human
uggacucuucaaaaacuguuu

SEQ ID NO: 2879077 - RNA, 19 nt, Human
uggacucugcacaugucuu

SEQ ID NO: 2879078 - RNA, 21 nt, Human
uggacucuggugccuccagag

SEQ ID NO: 2879079 - RNA, 22 nt, Human
uggacucuggugccuccagagg

SEQ ID NO: 2879080 - RNA, 15 nt, Human
uggacucugcacaug

SEQ ID NO: 2879081 - RNA, 14 nt, Human
uggacucugcacau

SEQ ID NO: 2879082 - RNA, 20 nt, Human
uggacggugcuccaggcagg

SEQ ID NO: 2879083 - RNA, 16 nt, Human
uggacucugcacauga

SEQ ID NO: 2879084 - RNA, 17 nt, Human
uggacucugcacaugaa

SEQ ID NO: 2879085 - RNA, 17 nt, Human
uggacucugcacauguc

SEQ ID NO: 2879086 - RNA, 18 nt, Human
uggacucugcacaugucu

SEQ ID NO: 2879087 - RNA, 22 nt, Human
uggacucugcacaugucuugua

SEQ ID NO: 2879088 - RNA, 13 nt, Human
uggacucugcauc

SEQ ID NO: 2879089 - RNA, 14 nt, Human
uggacucugcaucc

SEQ ID NO: 2879090 - RNA, 16 nt, Human
uggacucugcauccca

SEQ ID NO: 2879091 - RNA, 18 nt, Human
uggacucugcaucccagc

SEQ ID NO: 2879092 - RNA, 20 nt, Human
uggacucugcaucccagcac

SEQ ID NO: 2879093 - RNA, 13 nt, Human
uggaugcaaagua

SEQ ID NO: 2879094 - RNA, 20 nt, Human
uggaugcaaaguacaaugug

SEQ ID NO: 2879095 - RNA, 16 nt, Human
uggagauacuggugga

SEQ ID NO: 2879096 - RNA, 16 nt, Human
uggauauuauuagaaa

SEQ ID NO: 2879097 - RNA, 17 nt, Human
uggauauuauuagaaau

SEQ ID NO: 2879098 - RNA, 21 nt, Human
uggauauuuguacuguuuaau

SEQ ID NO: 2879099 - RNA, 16 nt, Human
uggaggggaguguugg

SEQ ID NO: 2879100 - RNA, 16 nt, Human
uggagauagggaaaga

SEQ ID NO: 2879101 - RNA, 12 nt, Human
uggcaaggcugu

SEQ ID NO: 2879102 - RNA, 19 nt, Human
uggcaaggacacagaugaa

SEQ ID NO: 2879103 - RNA, 17 nt, Human
uggcaagaguguggagg

SEQ ID NO: 2879104 - RNA, 19 nt, Human
uggcaagaguguggaggcu

SEQ ID NO: 2879105 - RNA, 19 nt, Human
uggcaagaaagcugguaaa

SEQ ID NO: 2879106 - RNA, 13 nt, Human
uggcaagagcccc

SEQ ID NO: 2879107 - RNA, 15 nt, Human
uggcaagaaagcugg

SEQ ID NO: 2879108 - RNA, 22 nt, Human
uggcaaccuugucucuaugcca

SEQ ID NO: 2879109 - RNA, 16 nt, Human
uggcaaggaaaaacag

SEQ ID NO: 2879110 - RNA, 12 nt, Human
uggcaaggaaag

SEQ ID NO: 2879111 - RNA, 13 nt, Human
uggcaagcuguga

SEQ ID NO: 2879112 - RNA, 11 nt, Human
uggcaaggaaa

SEQ ID NO: 2879113 - RNA, 16 nt, Human
uggcaacauuccaaga

SEQ ID NO: 2879114 - RNA, 18 nt, Human
uggauuguuaauuucagu

SEQ ID NO: 2879115 - RNA, 21 nt, Human
uggauuguuaauuucaguccu

SEQ ID NO: 2879116 - RNA, 14 nt, Human
uggcaaggcugugc

SEQ ID NO: 2879117 - RNA, 15 nt, Human
uggcaaggcugugcu

SEQ ID NO: 2879118 - RNA, 16 nt, Human
uggcaaggcugugcuc

SEQ ID NO: 2879119 - RNA, 15 nt, Human
uggcacucccuccag

SEQ ID NO: 2879120 - RNA, 16 nt, Human
uggcacucccuccagc

SEQ ID NO: 2879121 - RNA, 17 nt, Human
uggcacucccuccagca

SEQ ID NO: 2879122 - RNA, 19 nt, Human
uggcacucccuccagcaca

SEQ ID NO: 2879123 - RNA, 20 nt, Human
uggcacucccuccagcacaa

SEQ ID NO: 2879124 - RNA, 21 nt, Human
uggcacucccuccagcacaaa

SEQ ID NO: 2879125 - RNA, 15 nt, Human
uggcuccaugcuccu

SEQ ID NO: 2879126 - RNA, 20 nt, Human
uggcucccaugaccauacug

SEQ ID NO: 2879127 - RNA, 17 nt, Human
uggcuccagcuggccgg

SEQ ID NO: 2879128 - RNA, 15 nt, Human
uggcuccagaaaugu

SEQ ID NO: 2879129 - RNA, 20 nt, Human
uggcuccagaaaugucuaaa

SEQ ID NO: 2879130 - RNA, 17 nt, Human
uggcucccucuucuuuc

SEQ ID NO: 2879131 - RNA, 19 nt, Human
uggcuccgaacacccucga

SEQ ID NO: 2879132 - RNA, 23 nt, Human
uggcucccaugaccauacugagg

SEQ ID NO: 2879133 - RNA, 16 nt, Human
uggcuuguuguaaagc

SEQ ID NO: 2879134 - RNA, 18 nt, Human
uggcuuguuguaaagcaa

SEQ ID NO: 2879135 - RNA, 16 nt, Human
uggcuuuucacugcug

SEQ ID NO: 2879136 - RNA, 24 nt, Human
uggcuuguaucaacacuguuacuu

SEQ ID NO: 2879137 - RNA, 14 nt, Human
uggcuuguccucac

SEQ ID NO: 2879138 - RNA, 17 nt, Human
uggcuugggcagggucu

SEQ ID NO: 2879139 - RNA, 12 nt, Human
uggcuuguagaa

SEQ ID NO: 2879140 - RNA, 14 nt, Human
uggcuuguagaauu

SEQ ID NO: 2879141 - RNA, 16 nt, Human
uggcuuguagaauugu

SEQ ID NO: 2879142 - RNA, 17 nt, Human
uggcuuguagaauuguu

SEQ ID NO: 2879143 - RNA, 18 nt, Human
uggcuuguagaauuguua

SEQ ID NO: 2879144 - RNA, 19 nt, Human
uggcuuguagaauuguuau

SEQ ID NO: 2879145 - RNA, 22 nt, Human
uggcuuggccuaucuccuaggg

SEQ ID NO: 2879146 - RNA, 15 nt, Human
uggcuuuucacugcu

SEQ ID NO: 2879147 - RNA, 21 nt, Human
uggcuuuucaugcgugugugu

SEQ ID NO: 2879148 - RNA, 18 nt, Human
uggcuuuucacugcuggc

SEQ ID NO: 2879149 - RNA, 19 nt, Human
uggcuuuucacugcuggcu

SEQ ID NO: 2879150 - RNA, 21 nt, Human
uggcuuuucacugcuggcugc

SEQ ID NO: 2879151 - RNA, 22 nt, Human
uggcuuuucacugcuggcugcc

SEQ ID NO: 2879152 - RNA, 14 nt, Human
uggcuggcugcagu

SEQ ID NO: 2879153 - RNA, 13 nt, Human
uggcuggcugcag

SEQ ID NO: 2879154 - RNA, 22 nt, Human
uggcuggaugaaauuuucuaga

SEQ ID NO: 2879155 - RNA, 21 nt, Human
uggcuggccuuccacuuggcu

SEQ ID NO: 2879156 - RNA, 12 nt, Human
uggcugggcaug

SEQ ID NO: 2879157 - RNA, 15 nt, Human
uggcugggaacucac

SEQ ID NO: 2879158 - RNA, 23 nt, Human
uggcugggaacucaccuggggcu

SEQ ID NO: 2879159 - RNA, 22 nt, Human
uggcuucccgcucagcccuccc

SEQ ID NO: 2879160 - RNA, 18 nt, Human
uggcuucccgcucagccc

SEQ ID NO: 2879161 - RNA, 19 nt, Human
uggcuucccgcucagcccu

SEQ ID NO: 2879162 - RNA, 20 nt, Human
uggcuucccgcucagcccuc

SEQ ID NO: 2879163 - RNA, 21 nt, Human
uggcuucccgcucagcccucc

SEQ ID NO: 2879164 - RNA, 20 nt, Human
uggccccugaacaagaauug

SEQ ID NO: 2879165 - RNA, 14 nt, Human
uggccccugaacaa

SEQ ID NO: 2879166 - RNA, 16 nt, Human
uggccccucugaccug

SEQ ID NO: 2879167 - RNA, 18 nt, Human
uggccccucugaccugca

SEQ ID NO: 2879168 - RNA, 13 nt, Human
uggccccucgccu

SEQ ID NO: 2879169 - RNA, 17 nt, Human
uggccccucgccugugg

SEQ ID NO: 2879170 - RNA, 10 nt, Human
uggccccucu

SEQ ID NO: 2879171 - RNA, 12 nt, Human
uggccccucuga

SEQ ID NO: 2879172 - RNA, 13 nt, Human
uggccccucugac

SEQ ID NO: 2879173 - RNA, 14 nt, Human
uggccccucugacc

SEQ ID NO: 2879174 - RNA, 14 nt, Human
uggccccagggcac

SEQ ID NO: 2879175 - RNA, 18 nt, Human
uggccccagggcacccug

SEQ ID NO: 2879176 - RNA, 17 nt, Human
uggcagcugcgguccac

SEQ ID NO: 2879177 - RNA, 16 nt, Human
uggcagcugccacgcc

SEQ ID NO: 2879178 - RNA, 14 nt, Human
uggccuagcccacc

SEQ ID NO: 2879179 - RNA, 17 nt, Human
uggccuagcccacccug

SEQ ID NO: 2879180 - RNA, 18 nt, Human
uggccuagcccacccugc

SEQ ID NO: 2879181 - RNA, 19 nt, Human
uggccuagcccacccugcu

SEQ ID NO: 2879182 - RNA, 20 nt, Human
uggccuagcccacccugcug

SEQ ID NO: 2879183 - RNA, 22 nt, Human
uggccuagcccacccugcugcc

SEQ ID NO: 2879184 - RNA, 23 nt, Human
uggccuagcccacccugcugccu

SEQ ID NO: 2879185 - RNA, 23 nt, Human
uggccucaagugauucuccugcc

SEQ ID NO: 2879186 - RNA, 18 nt, Human
uggccucaagugauucuc

SEQ ID NO: 2879187 - RNA, 14 nt, Human
uggccuccaggccc

SEQ ID NO: 2879188 - RNA, 15 nt, Human
uggccuccaggcccg

SEQ ID NO: 2879189 - RNA, 21 nt, Human
uggccuccaggcccgucuguc

SEQ ID NO: 2879190 - RNA, 22 nt, Human
uggccuccaggcccgucugucc

SEQ ID NO: 2879191 - RNA, 23 nt, Human
uggccuccaggcccgucugucca

SEQ ID NO: 2879192 - RNA, 13 nt, Human
uggccucucuagc

SEQ ID NO: 2879193 - RNA, 21 nt, Human
uggccucuccuuguggccugg

SEQ ID NO: 2879194 - RNA, 19 nt, Human
uggccucgggacaccugcc

SEQ ID NO: 2879195 - RNA, 15 nt, Human
uggccuccuugcuug

SEQ ID NO: 2879196 - RNA, 23 nt, Human
uggccucgggacaccugcccugc

SEQ ID NO: 2879197 - RNA, 17 nt, Human
uggccucuaccacaagg

SEQ ID NO: 2879198 - RNA, 23 nt, Human
ugggauaaagaugcaaggaccag

SEQ ID NO: 2879199 - RNA, 16 nt, Human
ugggaugagccgcugu

SEQ ID NO: 2879200 - RNA, 20 nt, Human
ugggaucacaggugucagcc

SEQ ID NO: 2879201 - RNA, 16 nt, Human
ugggauacugcagggc

SEQ ID NO: 2879202 - RNA, 12 nt, Human
ugggauacaacc

SEQ ID NO: 2879203 - RNA, 15 nt, Human
ugggauacaaccucc

SEQ ID NO: 2879204 - RNA, 20 nt, Human
ugggauacaaccucccucuu

SEQ ID NO: 2879205 - RNA, 10 nt, Human
ugggcagcuc

SEQ ID NO: 2879206 - RNA, 19 nt, Human
ugggcagcucaucucuguc

SEQ ID NO: 2879207 - RNA, 17 nt, Human
ugggcaggacucagcuc

SEQ ID NO: 2879208 - RNA, 18 nt, Human
ugggcaggacucagcucc

SEQ ID NO: 2879209 - RNA, 21 nt, Human
ugggcaggacucagcucccca

SEQ ID NO: 2879210 - RNA, 12 nt, Human
ugggaugcuccu

SEQ ID NO: 2879211 - RNA, 22 nt, Human
ugggcaggacucagcuccccag

SEQ ID NO: 2879212 - RNA, 21 nt, Human
ugggccggcuucaugccagcu

SEQ ID NO: 2879213 - RNA, 15 nt, Human
ugggauggaggggag

SEQ ID NO: 2879214 - RNA, 12 nt, Human
ugggcagcaauu

SEQ ID NO: 2879215 - RNA, 17 nt, Human
ugggcagcaauuuaaau

SEQ ID NO: 2879216 - RNA, 19 nt, Human
ugggcagcaauuuaaaugu

SEQ ID NO: 2879217 - RNA, 18 nt, Human
ugggcagcaauuuaaaug

SEQ ID NO: 2879218 - RNA, 16 nt, Human
ugggcagccaggcugc

SEQ ID NO: 2879219 - RNA, 15 nt, Human
ugggcagccaggcug

SEQ ID NO: 2879220 - RNA, 14 nt, Human
ugggcagccaggcu

SEQ ID NO: 2879221 - RNA, 18 nt, Human
ugggcagcauagcaagac

SEQ ID NO: 2879222 - RNA, 16 nt, Human
ugggcagcauagcaag

SEQ ID NO: 2879223 - RNA, 21 nt, Human
ugggcagcaauuuaaauguua

SEQ ID NO: 2879224 - RNA, 16 nt, Human
ugggguguuugggagg

SEQ ID NO: 2879225 - RNA, 19 nt, Human
ugggguuaucucuguguua

SEQ ID NO: 2879226 - RNA, 20 nt, Human
ugggggggccaaaaggaaaa

SEQ ID NO: 2879227 - RNA, 21 nt, Human
ugggggggccaaaaggaaaaa

SEQ ID NO: 2879228 - RNA, 23 nt, Human
ugggggggcucccguggccugua

SEQ ID NO: 2879229 - RNA, 18 nt, Human
ugggguuaucucuguguu

SEQ ID NO: 2879230 - RNA, 16 nt, Human
ugggggccucagugcc

SEQ ID NO: 2879231 - RNA, 22 nt, Human
ugggggcaggagggcccuaccu

SEQ ID NO: 2879232 - RNA, 13 nt, Human
uggggccaggccg

SEQ ID NO: 2879233 - RNA, 22 nt, Human
uggggccaggccgggccuguac

SEQ ID NO: 2879234 - RNA, 14 nt, Human
ugggggccaccugc

SEQ ID NO: 2879235 - RNA, 16 nt, Human
ugggggccaccugccu

SEQ ID NO: 2879236 - RNA, 17 nt, Human
ugggggccaccugccug

SEQ ID NO: 2879237 - RNA, 18 nt, Human
ugggggccaccugccugc

SEQ ID NO: 2879238 - RNA, 19 nt, Human
ugggggccaccugccugcg

SEQ ID NO: 2879239 - RNA, 21 nt, Human
uggggccaccaaagcugccca

SEQ ID NO: 2879240 - RNA, 20 nt, Human
uggggccaccaaagcugccc

SEQ ID NO: 2879241 - RNA, 13 nt, Human
uggggcagcuuga

SEQ ID NO: 2879242 - RNA, 13 nt, Human
uggggcagagccu

SEQ ID NO: 2879243 - RNA, 14 nt, Human
uggggcagagccuc

SEQ ID NO: 2879244 - RNA, 15 nt, Human
uggggcagagccucc

SEQ ID NO: 2879245 - RNA, 19 nt, Human
uggggcaagucccugacuc

SEQ ID NO: 2879246 - RNA, 15 nt, Human
uggggcaagucaugu

SEQ ID NO: 2879247 - RNA, 11 nt, Human
uggggcacagu

SEQ ID NO: 2879248 - RNA, 15 nt, Human
uggggcacaguccag

SEQ ID NO: 2879249 - RNA, 17 nt, Human
uggggcacaguccagga

SEQ ID NO: 2879250 - RNA, 18 nt, Human
uggggcacaguccaggaa

SEQ ID NO: 2879251 - RNA, 12 nt, Human
ugggccuggcau

SEQ ID NO: 2879252 - RNA, 17 nt, Human
ugggccuggcauucuug

SEQ ID NO: 2879253 - RNA, 21 nt, Human
ugggcuucaguggcagcugcu

SEQ ID NO: 2879254 - RNA, 22 nt, Human
ugggcuucaguggcagcugcuu

SEQ ID NO: 2879255 - RNA, 20 nt, Human
ugggccucugcuucucucac

SEQ ID NO: 2879256 - RNA, 13 nt, Human
ugggccuccucac

SEQ ID NO: 2879257 - RNA, 16 nt, Human
ugacucuggcuuggcc

SEQ ID NO: 2879258 - RNA, 14 nt, Human
ugacucugcccccu

SEQ ID NO: 2879259 - RNA, 15 nt, Human
ugacucugcccccug

SEQ ID NO: 2879260 - RNA, 18 nt, Human
ugacucugcccccugcug

SEQ ID NO: 2879261 - RNA, 19 nt, Human
ugacucugcccccugcugg

SEQ ID NO: 2879262 - RNA, 19 nt, Human
ugacgugcaccuguacuca

SEQ ID NO: 2879263 - RNA, 18 nt, Human
ugacgugcaccuguacuc

SEQ ID NO: 2879264 - RNA, 23 nt, Human
ugacgugcaccuguacucaggag

SEQ ID NO: 2879265 - RNA, 13 nt, Human
ugacucugccccc

SEQ ID NO: 2879266 - RNA, 16 nt, Human
ugacugguuaucacac

SEQ ID NO: 2879267 - RNA, 20 nt, Human
ugacugguuaucacaccauc

SEQ ID NO: 2879268 - RNA, 19 nt, Human
ugacugguuuacaggcccu

SEQ ID NO: 2879269 - RNA, 20 nt, Human
ugacugguuuacaggcccug

SEQ ID NO: 2879270 - RNA, 21 nt, Human
ugacugguuuacaggcccugc

SEQ ID NO: 2879271 - RNA, 23 nt, Human
ugacugguuuacaggcccugcuc

SEQ ID NO: 2879272 - RNA, 14 nt, Human
ugacugcccagcau

SEQ ID NO: 2879273 - RNA, 17 nt, Human
ugacugaggcaggcaug

SEQ ID NO: 2879274 - RNA, 20 nt, Human
ugacugaugcugagauucuu

SEQ ID NO: 2879275 - RNA, 14 nt, Human
ugacgucugaagcu

SEQ ID NO: 2879276 - RNA, 19 nt, Human
ugacugaagaugcagcuca

SEQ ID NO: 2879277 - RNA, 18 nt, Human
ugacgaaacuggccccgg

SEQ ID NO: 2879278 - RNA, 19 nt, Human
ugacgaaacuggccccgga

SEQ ID NO: 2879279 - RNA, 19 nt, Human
ugaccuccucccuguuauu

SEQ ID NO: 2879280 - RNA, 23 nt, Human
ugaccuuuuauguaguaauugac

SEQ ID NO: 2879281 - RNA, 18 nt, Human
ugaccuuuuauguaguaa

SEQ ID NO: 2879282 - RNA, 17 nt, Human
ugaccuuuuauguagua

SEQ ID NO: 2879283 - RNA, 14 nt, Human
ugaccuuuguacag

SEQ ID NO: 2879284 - RNA, 15 nt, Human
ugaccuuuguacagc

SEQ ID NO: 2879285 - RNA, 19 nt, Human
ugaccuuuguacagcccag

SEQ ID NO: 2879286 - RNA, 20 nt, Human
ugaccuuuguacagcccaga

SEQ ID NO: 2879287 - RNA, 21 nt, Human
ugaccuuuguacagcccagag

SEQ ID NO: 2879288 - RNA, 16 nt, Human
ugacgauuccuucucu

SEQ ID NO: 2879289 - RNA, 17 nt, Human
ugacgauuccuucucug

SEQ ID NO: 2879290 - RNA, 21 nt, Human
ugacgauuccuucucugaaca

SEQ ID NO: 2879291 - RNA, 14 nt, Human
ugacgcaaugaaaa

SEQ ID NO: 2879292 - RNA, 14 nt, Human
ugacgcugauacau

SEQ ID NO: 2879293 - RNA, 15 nt, Human
ugacgcugauacaua

SEQ ID NO: 2879294 - RNA, 21 nt, Human
ugacgcugauacauaacuaaa

SEQ ID NO: 2879295 - RNA, 23 nt, Human
ugacgcugauacauaacuaaauu

SEQ ID NO: 2879296 - RNA, 15 nt, Human
ugacggugacaaaga

SEQ ID NO: 2879297 - RNA, 14 nt, Human
ugacggcccucauc

SEQ ID NO: 2879298 - RNA, 20 nt, Human
ugacggcccucaucuaugag

SEQ ID NO: 2879299 - RNA, 12 nt, Human
ugacggcccugc

SEQ ID NO: 2879300 - RNA, 13 nt, Human
ugacggcccugca

SEQ ID NO: 2879301 - RNA, 14 nt, Human
ugacggcccugcaa

SEQ ID NO: 2879302 - RNA, 15 nt, Human
ugacggcccugcaau

SEQ ID NO: 2879303 - RNA, 12 nt, Human
ugaccucugccu

SEQ ID NO: 2879304 - RNA, 21 nt, Human
ugaccucucauaaauuuacuu

SEQ ID NO: 2879305 - RNA, 22 nt, Human
ugaccucaggugauccacccac

SEQ ID NO: 2879306 - RNA, 14 nt, Human
ugaccucacuguga

SEQ ID NO: 2879307 - RNA, 15 nt, Human
ugaccucacagugac

SEQ ID NO: 2879308 - RNA, 18 nt, Human
ugaccucacagugacccu

SEQ ID NO: 2879309 - RNA, 21 nt, Human
ugaccucauuaaccgaugcuu

SEQ ID NO: 2879310 - RNA, 22 nt, Human
ugaccucauuaaccgaugcuuu

SEQ ID NO: 2879311 - RNA, 18 nt, Human
ugaccucgugauccaccc

SEQ ID NO: 2879312 - RNA, 15 nt, Human
ucuugaacuccuggc

SEQ ID NO: 2879313 - RNA, 12 nt, Human
ucuugaaguccu

SEQ ID NO: 2879314 - RNA, 13 nt, Human
ucuugaaguccug

SEQ ID NO: 2879315 - RNA, 16 nt, Human
ucuugaaguccuggcu

SEQ ID NO: 2879316 - RNA, 18 nt, Human
ucuugaaguccuggcuuc

SEQ ID NO: 2879317 - RNA, 19 nt, Human
ucuugaaguccuggcuuca

SEQ ID NO: 2879318 - RNA, 22 nt, Human
ucuugaaguccuggcuucaggc

SEQ ID NO: 2879319 - RNA, 23 nt, Human
ucuugaaguccuggcuucaggca

SEQ ID NO: 2879320 - RNA, 15 nt, Human
ucuugaagggcccag

SEQ ID NO: 2879321 - RNA, 16 nt, Human
ucuugaagggcccagg

SEQ ID NO: 2879322 - RNA, 19 nt, Human
ucuugaaggaaaaugauac

SEQ ID NO: 2879323 - RNA, 16 nt, Human
ucuugaaugucuuuug

SEQ ID NO: 2879324 - RNA, 11 nt, Human
ucuugaaugug

SEQ ID NO: 2879325 - RNA, 12 nt, Human
ucuugaaugugg

SEQ ID NO: 2879326 - RNA, 18 nt, Human
ucuugaauguggucucag

SEQ ID NO: 2879327 - RNA, 19 nt, Human
ucuugaauguggucucagg

SEQ ID NO: 2879328 - RNA, 20 nt, Human
ugacccugcgaaggggcccu

SEQ ID NO: 2879329 - RNA, 20 nt, Human
ugaccucaagugaucugccc

SEQ ID NO: 2879330 - RNA, 21 nt, Human
ugacccucugcugaagacuug

SEQ ID NO: 2879331 - RNA, 15 nt, Human
ugacccugaugaaaa

SEQ ID NO: 2879332 - RNA, 15 nt, Human
ugacccugaagugag

SEQ ID NO: 2879333 - RNA, 14 nt, Human
ucuugaaugucuuu

SEQ ID NO: 2879334 - RNA, 16 nt, Human
ugacuguacuccuccc

SEQ ID NO: 2879335 - RNA, 17 nt, Human
ugacuguacuccuccca

SEQ ID NO: 2879336 - RNA, 18 nt, Human
ugacuguacuccucccag

SEQ ID NO: 2879337 - RNA, 22 nt, Human
ugacuguacuccucccaggcgc

SEQ ID NO: 2879338 - RNA, 23 nt, Human
ugacuggguuucucuguauagua

SEQ ID NO: 2879339 - RNA, 21 nt, Human
ugacuggguuucucuguauag

SEQ ID NO: 2879340 - RNA, 15 nt, Human
ugacuguaucugugu

SEQ ID NO: 2879341 - RNA, 14 nt, Human
ugagaaauguaaug

SEQ ID NO: 2879342 - RNA, 23 nt, Human
ugagaaauguaaugcgauuuuau

SEQ ID NO: 2879343 - RNA, 14 nt, Human
ugagaaauguuaaa

SEQ ID NO: 2879344 - RNA, 12 nt, Human
ugagacccuguc

SEQ ID NO: 2879345 - RNA, 15 nt, Human
ugagacccugucucu

SEQ ID NO: 2879346 - RNA, 14 nt, Human
ugagacccugucuc

SEQ ID NO: 2879347 - RNA, 13 nt, Human
ugagacccuggug

SEQ ID NO: 2879348 - RNA, 16 nt, Human
ugagacaguccagccu

SEQ ID NO: 2879349 - RNA, 18 nt, Human
ugagacaguccagccugg

SEQ ID NO: 2879350 - RNA, 22 nt, Human
ugagacaggagaaacacuugaa

SEQ ID NO: 2879351 - RNA, 22 nt, Human
ugagacccccacaccucaguuc

SEQ ID NO: 2879352 - RNA, 19 nt, Human
ugagacaguccagccugga

SEQ ID NO: 2879353 - RNA, 14 nt, Human
ugagacagugcaca

SEQ ID NO: 2879354 - RNA, 16 nt, Human
ugagacagugcacaug

SEQ ID NO: 2879355 - RNA, 17 nt, Human
ugagacccccacaccuc

SEQ ID NO: 2879356 - RNA, 14 nt, Human
ugagagguuugacu

SEQ ID NO: 2879357 - RNA, 18 nt, Human
ugagagguggcuuuugcg

SEQ ID NO: 2879358 - RNA, 21 nt, Human
ugagagguggcuuuugcggcc

SEQ ID NO: 2879359 - RNA, 19 nt, Human
ugagaggggaacagacugg

SEQ ID NO: 2879360 - RNA, 16 nt, Human
ugagaggggaagcggc

SEQ ID NO: 2879361 - RNA, 12 nt, Human
ugagaggggaag

SEQ ID NO: 2879362 - RNA, 21 nt, Human
ugagaggcgacaggaguauuu

SEQ ID NO: 2879363 - RNA, 12 nt, Human
ugagauccccug

SEQ ID NO: 2879364 - RNA, 16 nt, Human
ugagauccccugagcc

SEQ ID NO: 2879365 - RNA, 16 nt, Human
ugagaugauuaaaaug

SEQ ID NO: 2879366 - RNA, 18 nt, Human
ugagaucgugccacugca

SEQ ID NO: 2879367 - RNA, 20 nt, Human
ugagaucgugccacugcacu

SEQ ID NO: 2879368 - RNA, 17 nt, Human
ugagaguaucaggucuc

SEQ ID NO: 2879369 - RNA, 19 nt, Human
ugagaguaucaggucuccc

SEQ ID NO: 2879370 - RNA, 22 nt, Human
ugagagguuugacuagaugaug

SEQ ID NO: 2879371 - RNA, 18 nt, Human
ugagaggcagacuucccu

SEQ ID NO: 2879372 - RNA, 22 nt, Human
ugagacucuaggguccagugga

SEQ ID NO: 2879373 - RNA, 21 nt, Human
ugagacucuaggguccagugg

SEQ ID NO: 2879374 - RNA, 14 nt, Human
ugagacucugucuc

SEQ ID NO: 2879375 - RNA, 13 nt, Human
ugagacucugucu

SEQ ID NO: 2879376 - RNA, 12 nt, Human
ugagacucuguc

SEQ ID NO: 2879377 - RNA, 21 nt, Human
ugagaugagggaugggccugg

SEQ ID NO: 2879378 - RNA, 22 nt, Human
ugagaugagggaugggccuggc

SEQ ID NO: 2879379 - RNA, 23 nt, Human
ugagaugagggaugggccuggca

SEQ ID NO: 2879380 - RNA, 22 nt, Human
ugagaugcguuguuacaggaag

SEQ ID NO: 2879381 - RNA, 13 nt, Human
ugagcccaggagu

SEQ ID NO: 2879382 - RNA, 12 nt, Human
ugagcccaggag

SEQ ID NO: 2879383 - RNA, 18 nt, Human
ugagcccagcccuguucu

SEQ ID NO: 2879384 - RNA, 13 nt, Human
ugagcccagagaa

SEQ ID NO: 2879385 - RNA, 15 nt, Human
ugagcccagagaaca

SEQ ID NO: 2879386 - RNA, 16 nt, Human
ugagcccagagaacag

SEQ ID NO: 2879387 - RNA, 17 nt, Human
ugagcccagagaacagc

SEQ ID NO: 2879388 - RNA, 17 nt, Human
ugagcccauggcccucc

SEQ ID NO: 2879389 - RNA, 18 nt, Human
ugagcccauguucugccc

SEQ ID NO: 2879390 - RNA, 21 nt, Human
ugagcccauguucugccccca

SEQ ID NO: 2879391 - RNA, 22 nt, Human
ugagcccauguucugcccccag

SEQ ID NO: 2879392 - RNA, 23 nt, Human
ugagcccauguucugcccccagc

SEQ ID NO: 2879393 - RNA, 15 nt, Human
ugagccccuggaggc

SEQ ID NO: 2879394 - RNA, 15 nt, Human
ugagccucagcaucc

SEQ ID NO: 2879395 - RNA, 13 nt, Human
ugagccucagcau

SEQ ID NO: 2879396 - RNA, 14 nt, Human
ugagccgugaacug

SEQ ID NO: 2879397 - RNA, 19 nt, Human
ugagccgugaacugugcau

SEQ ID NO: 2879398 - RNA, 21 nt, Human
ugagccgcugugagccccugg

SEQ ID NO: 2879399 - RNA, 20 nt, Human
ugagcccuacucccugcaga

SEQ ID NO: 2879400 - RNA, 19 nt, Human
ugagcccuacucccugcag

SEQ ID NO: 2879401 - RNA, 23 nt, Human
ugagcccuacucccugcagaugc

SEQ ID NO: 2879402 - RNA, 12 nt, Human
ugagcccucaga

SEQ ID NO: 2879403 - RNA, 17 nt, Human
ugagcccucagaacccu

SEQ ID NO: 2879404 - RNA, 14 nt, Human
ugagcccucagaac

SEQ ID NO: 2879405 - RNA, 15 nt, Human
ugagccccugguccu

SEQ ID NO: 2879406 - RNA, 18 nt, Human
ugauaguugauuuucaaa

SEQ ID NO: 2879407 - RNA, 12 nt, Human
ugauauaaauuc

SEQ ID NO: 2879408 - RNA, 13 nt, Human
ugauauaaauucu

SEQ ID NO: 2879409 - RNA, 14 nt, Human
ugauauaaauucug

SEQ ID NO: 2879410 - RNA, 15 nt, Human
ugauauaaauucugu

SEQ ID NO: 2879411 - RNA, 16 nt, Human
ugauauaaauucugug

SEQ ID NO: 2879412 - RNA, 17 nt, Human
ugauauaaauucugugg

SEQ ID NO: 2879413 - RNA, 22 nt, Human
ugauauagaacagugcuugcca

SEQ ID NO: 2879414 - RNA, 11 nt, Human
ugauauagaau

SEQ ID NO: 2879415 - RNA, 14 nt, Human
ugauauagaauuag

SEQ ID NO: 2879416 - RNA, 17 nt, Human
ugauauagaauuagcuu

SEQ ID NO: 2879417 - RNA, 18 nt, Human
ugauauagaauuagcuuu

SEQ ID NO: 2879418 - RNA, 22 nt, Human
ugauauagaauuagcuuuuuca

SEQ ID NO: 2879419 - RNA, 18 nt, Human
ugauauauguauuaauaa

SEQ ID NO: 2879420 - RNA, 16 nt, Human
ugauauauauuauaaa

SEQ ID NO: 2879421 - RNA, 22 nt, Human
ugaucacggcucacugcagccu

SEQ ID NO: 2879422 - RNA, 15 nt, Human
ugauauggcagaaga

SEQ ID NO: 2879423 - RNA, 15 nt, Human
ugaucacuagccugu

SEQ ID NO: 2879424 - RNA, 16 nt, Human
ugaucacuagccuguc

SEQ ID NO: 2879425 - RNA, 22 nt, Human
ugaucacuccagguaguuuggg

SEQ ID NO: 2879426 - RNA, 18 nt, Human
ugauaucuauaguagaca

SEQ ID NO: 2879427 - RNA, 12 nt, Human
ugauaucccuga

SEQ ID NO: 2879428 - RNA, 18 nt, Human
ugauaucccugauccuaa

SEQ ID NO: 2879429 - RNA, 14 nt, Human
ugauauauuuucca

SEQ ID NO: 2879430 - RNA, 19 nt, Human
ugauaugcaguuuuccuua

SEQ ID NO: 2879431 - RNA, 16 nt, Human
ugauauggagcaagag

SEQ ID NO: 2879432 - RNA, 15 nt, Human
ugauaugauuuaaaa

SEQ ID NO: 2879433 - RNA, 19 nt, Human
ugauaugauuuaaaacaug

SEQ ID NO: 2879434 - RNA, 12 nt, Human
ugauaugaguau

SEQ ID NO: 2879435 - RNA, 15 nt, Human
ugauaugaguauaca

SEQ ID NO: 2879436 - RNA, 16 nt, Human
ugauaugaguauacaa

SEQ ID NO: 2879437 - RNA, 17 nt, Human
ugauaugaguauacaau

SEQ ID NO: 2879438 - RNA, 18 nt, Human
ugauaugaguauacaaua

SEQ ID NO: 2879439 - RNA, 19 nt, Human
ugauaugaguauacaauau

SEQ ID NO: 2879440 - RNA, 20 nt, Human
ugauccacccaccucagccu

SEQ ID NO: 2879441 - RNA, 15 nt, Human
ugauccacccaccuc

SEQ ID NO: 2879442 - RNA, 21 nt, Human
ugauccaagcuggucccacuc

SEQ ID NO: 2879443 - RNA, 17 nt, Human
ugauccaagcugguccc

SEQ ID NO: 2879444 - RNA, 17 nt, Human
ugaucauaagugaauuu

SEQ ID NO: 2879445 - RNA, 18 nt, Human
ugaucauaagugaauuua

SEQ ID NO: 2879446 - RNA, 19 nt, Human
ugaucauagguauuucaaa

SEQ ID NO: 2879447 - RNA, 24 nt, Human
ugaucauccacugugccaugugcc

SEQ ID NO: 2879448 - RNA, 13 nt, Human
ugaucauccacug

SEQ ID NO: 2879449 - RNA, 15 nt, Human
ugaucaguggacagu

SEQ ID NO: 2879450 - RNA, 19 nt, Human
ugaucaguggacagucugc

SEQ ID NO: 2879451 - RNA, 11 nt, Human
ugaucaguguu

SEQ ID NO: 2879452 - RNA, 12 nt, Human
ugaucaguguug

SEQ ID NO: 2879453 - RNA, 18 nt, Human
ugaucaguguuguugcuc

SEQ ID NO: 2879454 - RNA, 20 nt, Human
ugaucauaaacugacuauca

SEQ ID NO: 2879455 - RNA, 22 nt, Human
ugauccacccaccucagccucc

SEQ ID NO: 2879456 - RNA, 21 nt, Human
ugauccacccaccucagccuc

SEQ ID NO: 2879457 - RNA, 16 nt, Human
ugauccacccaacccu

SEQ ID NO: 2879458 - RNA, 15 nt, Human
ugauccacccaaccc

SEQ ID NO: 2879459 - RNA, 20 nt, Human
ugaucauagguauuucaaaa

SEQ ID NO: 2879460 - RNA, 23 nt, Human
ugaucaucccaucuaagcugcag

SEQ ID NO: 2879461 - RNA, 15 nt, Human
ugaucaucgccagag

SEQ ID NO: 2879462 - RNA, 21 nt, Human
ugauccacccaacccuaucuc

SEQ ID NO: 2879463 - RNA, 23 nt, Human
ugaucucuucuuuuggcuuccau

SEQ ID NO: 2879464 - RNA, 20 nt, Human
ugaucugaugcaagcaagaa

SEQ ID NO: 2879465 - RNA, 16 nt, Human
ugaucucaaacuauga

SEQ ID NO: 2879466 - RNA, 12 nt, Human
ugaucucuuccu

SEQ ID NO: 2879467 - RNA, 13 nt, Human
ugaucucuuccug

SEQ ID NO: 2879468 - RNA, 14 nt, Human
ugaucucuuccugu

SEQ ID NO: 2879469 - RNA, 14 nt, Human
ugaugccaggacac

SEQ ID NO: 2879470 - RNA, 14 nt, Human
ugaugcucccuccc

SEQ ID NO: 2879471 - RNA, 16 nt, Human
ugaugcucccuccccu

SEQ ID NO: 2879472 - RNA, 15 nt, Human
ugaugcucccucccc

SEQ ID NO: 2879473 - RNA, 22 nt, Human
ugaugcucccuccccugcccug

SEQ ID NO: 2879474 - RNA, 21 nt, Human
ugaugcucccuccccugcccu

SEQ ID NO: 2879475 - RNA, 20 nt, Human
ugaugcucccuccccugccc

SEQ ID NO: 2879476 - RNA, 17 nt, Human
ugaugcucccuccccug

SEQ ID NO: 2879477 - RNA, 23 nt, Human
ugaugcucccuccccugcccugg

SEQ ID NO: 2879478 - RNA, 14 nt, Human
ugaugcugagauuc

SEQ ID NO: 2879479 - RNA, 21 nt, Human
ugaugcugagauucuucaggc

SEQ ID NO: 2879480 - RNA, 20 nt, Human
ugauguauucuagcuaaugu

SEQ ID NO: 2879481 - RNA, 14 nt, Human
ugauguauucuagc

SEQ ID NO: 2879482 - RNA, 21 nt, Human
ugauguauucuagcuaaugua

SEQ ID NO: 2879483 - RNA, 18 nt, Human
ugauguaucugaguugcc

SEQ ID NO: 2879484 - RNA, 13 nt, Human
ugauguauucuag

SEQ ID NO: 2879485 - RNA, 19 nt, Human
ugauguacugauugagaag

SEQ ID NO: 2879486 - RNA, 21 nt, Human
ugauguacugauugagaaguu

SEQ ID NO: 2879487 - RNA, 18 nt, Human
ugauguaccaugaaacaa

SEQ ID NO: 2879488 - RNA, 20 nt, Human
ugauguaccaugaaacaaag

SEQ ID NO: 2879489 - RNA, 17 nt, Human
ugauguaaucucucugc

SEQ ID NO: 2879490 - RNA, 22 nt, Human
ugauguaaucucucugcagcug

SEQ ID NO: 2879491 - RNA, 23 nt, Human
ugauguaaucucucugcagcugc

SEQ ID NO: 2879492 - RNA, 11 nt, Human
ugauguaauug

SEQ ID NO: 2879493 - RNA, 20 nt, Human
ugaucuuugcagacaggcaa

SEQ ID NO: 2879494 - RNA, 19 nt, Human
ugaucuuugcagacaggca

SEQ ID NO: 2879495 - RNA, 21 nt, Human
ugaucugaugcaagcaagaaa

SEQ ID NO: 2879496 - RNA, 23 nt, Human
ugaucuuugcagacaggcaagca

SEQ ID NO: 2879497 - RNA, 21 nt, Human
ugaucuuugcagacaggcaag

SEQ ID NO: 2879498 - RNA, 18 nt, Human
ugaucuuugcagacaggc

SEQ ID NO: 2879499 - RNA, 14 nt, Human
ugaucuuuuaaagu

SEQ ID NO: 2879500 - RNA, 15 nt, Human
ugaucuuuuaaagug

SEQ ID NO: 2879501 - RNA, 17 nt, Human
ugaucuuuuaaaguguu

SEQ ID NO: 2879502 - RNA, 18 nt, Human
ugaucuuuuaaaguguua

SEQ ID NO: 2879503 - RNA, 19 nt, Human
ugaucuuuuaaaguguuac

SEQ ID NO: 2879504 - RNA, 21 nt, Human
ugaucuuuuaaaguguuacuu

SEQ ID NO: 2879505 - RNA, 14 nt, Human
ugaugaaaagauuu

SEQ ID NO: 2879506 - RNA, 15 nt, Human
ugaugaaaagauuua

SEQ ID NO: 2879507 - RNA, 20 nt, Human
ugaugaugaaaugaggucag

SEQ ID NO: 2879508 - RNA, 23 nt, Human
ugaugaucuuugcagacaggcaa

SEQ ID NO: 2879509 - RNA, 22 nt, Human
ugaugaucuuugcagacaggca

SEQ ID NO: 2879510 - RNA, 14 nt, Human
ugaugaugaaaauu

SEQ ID NO: 2879511 - RNA, 13 nt, Human
ugaugauguaauu

SEQ ID NO: 2879512 - RNA, 14 nt, Human
ugaugauguaauug

SEQ ID NO: 2879513 - RNA, 22 nt, Human
ugaugccaauacuagucacccc

SEQ ID NO: 2879514 - RNA, 12 nt, Human
ugaggcugggaa

SEQ ID NO: 2879515 - RNA, 17 nt, Human
ugaggagagaaaauaua

SEQ ID NO: 2879516 - RNA, 21 nt, Human
ugaggagagaaaauauaugua

SEQ ID NO: 2879517 - RNA, 23 nt, Human
ugaggacuuaaaauauuccugca

SEQ ID NO: 2879518 - RNA, 21 nt, Human
ugaggacauguuuuuguuuuc

SEQ ID NO: 2879519 - RNA, 13 nt, Human
ugaggcugcagcg

SEQ ID NO: 2879520 - RNA, 12 nt, Human
ugaggagcugcu

SEQ ID NO: 2879521 - RNA, 18 nt, Human
ugaggcugagacugcggg

SEQ ID NO: 2879522 - RNA, 11 nt, Human
ugaggagcugc

SEQ ID NO: 2879523 - RNA, 16 nt, Human
ugaggagccccagcua

SEQ ID NO: 2879524 - RNA, 20 nt, Human
ugaggagccccaucugucua

SEQ ID NO: 2879525 - RNA, 11 nt, Human
ugaggagcccc

SEQ ID NO: 2879526 - RNA, 14 nt, Human
ugaggagccccagc

SEQ ID NO: 2879527 - RNA, 15 nt, Human
ugaggagcauguuuu

SEQ ID NO: 2879528 - RNA, 19 nt, Human
ugaggagcauguuuuguau

SEQ ID NO: 2879529 - RNA, 23 nt, Human
ugaggagcauguuuuguauacaa

SEQ ID NO: 2879530 - RNA, 15 nt, Human
ugaggagccaggccg

SEQ ID NO: 2879531 - RNA, 20 nt, Human
ugaggagcccauacucagcc

SEQ ID NO: 2879532 - RNA, 21 nt, Human
ugaggagcccauacucagccu

SEQ ID NO: 2879533 - RNA, 22 nt, Human
ugaggagcccauacucagccug

SEQ ID NO: 2879534 - RNA, 23 nt, Human
ugaggagcccauacucagccugc

SEQ ID NO: 2879535 - RNA, 14 nt, Human
ugaggucuguuuaa

SEQ ID NO: 2879536 - RNA, 17 nt, Human
ugaggucuguuuaaagu

SEQ ID NO: 2879537 - RNA, 21 nt, Human
ugagggaaagugcauaugaaa

SEQ ID NO: 2879538 - RNA, 23 nt, Human
ugaggcuuuggauuugacauugc

SEQ ID NO: 2879539 - RNA, 14 nt, Human
ugaggcuuuguguu

SEQ ID NO: 2879540 - RNA, 17 nt, Human
ugaggcuuuguguugua

SEQ ID NO: 2879541 - RNA, 18 nt, Human
ugaggcuuuguguuguaa

SEQ ID NO: 2879542 - RNA, 18 nt, Human
ugaggcuuuggauuugac

SEQ ID NO: 2879543 - RNA, 13 nt, Human
ugaggcuuuggau

SEQ ID NO: 2879544 - RNA, 23 nt, Human
ugaggcuuagcuuugcucugcca

SEQ ID NO: 2879545 - RNA, 14 nt, Human
ugagucgaggacag

SEQ ID NO: 2879546 - RNA, 13 nt, Human
ugaguccuggccc

SEQ ID NO: 2879547 - RNA, 14 nt, Human
ugaguccuggccca

SEQ ID NO: 2879548 - RNA, 15 nt, Human
ugaguccuggcccaa

SEQ ID NO: 2879549 - RNA, 15 nt, Human
ugaguccuugaaaau

SEQ ID NO: 2879550 - RNA, 15 nt, Human
ugagguuucacccuu

SEQ ID NO: 2879551 - RNA, 13 nt, Human
ugagguuucccaa

SEQ ID NO: 2879552 - RNA, 14 nt, Human
ugagguuucccaau

SEQ ID NO: 2879553 - RNA, 16 nt, Human
ugagguugcuagagaa

SEQ ID NO: 2879554 - RNA, 12 nt, Human
ugagguuaggag

SEQ ID NO: 2879555 - RNA, 16 nt, Human
ugagucgaggacaggg

SEQ ID NO: 2879556 - RNA, 15 nt, Human
ugagucgaggacagg

SEQ ID NO: 2879557 - RNA, 16 nt, Human
ugaguccuugaaaaua

SEQ ID NO: 2879558 - RNA, 18 nt, Human
ugaguccuugaaaauauu

SEQ ID NO: 2879559 - RNA, 16 nt, Human
ugaguugauugagaag

SEQ ID NO: 2879560 - RNA, 17 nt, Human
ugaguugccaagacaaa

SEQ ID NO: 2879561 - RNA, 18 nt, Human
ugaguugccaagacaaau

SEQ ID NO: 2879562 - RNA, 19 nt, Human
ugaguugccaagacaaauc

SEQ ID NO: 2879563 - RNA, 23 nt, Human
ugaguugccaagacaaaucaaca

SEQ ID NO: 2879564 - RNA, 18 nt, Human
ugaguuucauucuccugc

SEQ ID NO: 2879565 - RNA, 19 nt, Human
ugaguuucauucuccugcc

SEQ ID NO: 2879566 - RNA, 14 nt, Human
ugauaaacuuugcu

SEQ ID NO: 2879567 - RNA, 18 nt, Human
ugauaaaacaacagcucg

SEQ ID NO: 2879568 - RNA, 18 nt, Human
ugauaaaagggcaaaucu

SEQ ID NO: 2879569 - RNA, 20 nt, Human
ugauaaaagggcaaaucugc

SEQ ID NO: 2879570 - RNA, 20 nt, Human
ugauaaagccucaagguuuu

SEQ ID NO: 2879571 - RNA, 13 nt, Human
ugauaaaguuucu

SEQ ID NO: 2879572 - RNA, 16 nt, Human
ugauaaaguuucucag

SEQ ID NO: 2879573 - RNA, 13 nt, Human
ugauaaagccuca

SEQ ID NO: 2879574 - RNA, 14 nt, Human
ugaguuuaaagcaa

SEQ ID NO: 2879575 - RNA, 18 nt, Human
ugaguugugaaaguuuug

SEQ ID NO: 2879576 - RNA, 16 nt, Human
ugaguuguuguggguu

SEQ ID NO: 2879577 - RNA, 16 nt, Human
ugauagcuaacauuuu

SEQ ID NO: 2879578 - RNA, 18 nt, Human
ugauagcuaacauuuuaa

SEQ ID NO: 2879579 - RNA, 21 nt, Human
ugauagcuaacauuuuaaaua

SEQ ID NO: 2879580 - RNA, 13 nt, Human
ugauagcauugcu

SEQ ID NO: 2879581 - RNA, 21 nt, Human
ugauaggaaugugaaagcacg

SEQ ID NO: 2879582 - RNA, 16 nt, Human
ugauaggaauucaucu

SEQ ID NO: 2879583 - RNA, 18 nt, Human
ugauagguauaaguggug

SEQ ID NO: 2879584 - RNA, 23 nt, Human
ugauagcuuuauuuuuuaaguau

SEQ ID NO: 2879585 - RNA, 14 nt, Human
ugauagcuuuauuu

SEQ ID NO: 2879586 - RNA, 13 nt, Human
ugauagcuuuauu

SEQ ID NO: 2879587 - RNA, 11 nt, Human
ugauagcuuua

SEQ ID NO: 2879588 - RNA, 19 nt, Human
ugauaaauuccacuggacu

SEQ ID NO: 2879589 - RNA, 22 nt, Human
ugauaaaguuucucagauccuu

SEQ ID NO: 2879590 - RNA, 18 nt, Human
ugauaaaguuucucagau

SEQ ID NO: 2879591 - RNA, 21 nt, Human
ugauaaaguuucucagauccu

SEQ ID NO: 2879592 - RNA, 21 nt, Human
ugcauuagagcccauuucaau

SEQ ID NO: 2879593 - RNA, 14 nt, Human
ugcauuagcacaga

SEQ ID NO: 2879594 - RNA, 16 nt, Human
ugcauuagcacagauu

SEQ ID NO: 2879595 - RNA, 17 nt, Human
ugcauuagcacagauuu

SEQ ID NO: 2879596 - RNA, 18 nt, Human
ugcauuagcacagauuuu

SEQ ID NO: 2879597 - RNA, 19 nt, Human
ugcauuagcacagauuuua

SEQ ID NO: 2879598 - RNA, 23 nt, Human
ugcauuagcacagauuuuaauug

SEQ ID NO: 2879599 - RNA, 21 nt, Human
ugcauguuuuccagcuccuca

SEQ ID NO: 2879600 - RNA, 16 nt, Human
ugcauguuugaaauga

SEQ ID NO: 2879601 - RNA, 14 nt, Human
ugcauguuaccauc

SEQ ID NO: 2879602 - RNA, 19 nt, Human
ugcauuagggaugccuccu

SEQ ID NO: 2879603 - RNA, 22 nt, Human
ugcauuagggaugccuccuuuc

SEQ ID NO: 2879604 - RNA, 17 nt, Human
ugcauuuucaccccacc

SEQ ID NO: 2879605 - RNA, 16 nt, Human
ugccacaucuuaaacu

SEQ ID NO: 2879606 - RNA, 15 nt, Human
ugccacauuagaacu

SEQ ID NO: 2879607 - RNA, 17 nt, Human
ugccacauuagaacuuc

SEQ ID NO: 2879608 - RNA, 18 nt, Human
ugccacauuagaacuucu

SEQ ID NO: 2879609 - RNA, 15 nt, Human
ugccaccacgcccgg

SEQ ID NO: 2879610 - RNA, 17 nt, Human
ugcagauaacuuugacu

SEQ ID NO: 2879611 - RNA, 16 nt, Human
ugcagauagaaagcau

SEQ ID NO: 2879612 - RNA, 20 nt, Human
ugcagaugccacccuagcca

SEQ ID NO: 2879613 - RNA, 17 nt, Human
ugcagaugccacccuag

SEQ ID NO: 2879614 - RNA, 15 nt, Human
ugcagaugcaauugu

SEQ ID NO: 2879615 - RNA, 17 nt, Human
ugcagaugcaauuguuu

SEQ ID NO: 2879616 - RNA, 16 nt, Human
ugcagauuugggcugg

SEQ ID NO: 2879617 - RNA, 12 nt, Human
ugcaucccagca

SEQ ID NO: 2879618 - RNA, 14 nt, Human
ugcaucccagcacc

SEQ ID NO: 2879619 - RNA, 19 nt, Human
ugcaucccagcaccugccu

SEQ ID NO: 2879620 - RNA, 20 nt, Human
ugcaucccagcaccugccuc

SEQ ID NO: 2879621 - RNA, 16 nt, Human
ugcauccccuuggcug

SEQ ID NO: 2879622 - RNA, 14 nt, Human
ugcauccuccgccu

SEQ ID NO: 2879623 - RNA, 20 nt, Human
ugcauguaaacacgccugca

SEQ ID NO: 2879624 - RNA, 19 nt, Human
ugcauguuuuccagcuccu

SEQ ID NO: 2879625 - RNA, 18 nt, Human
ugcauguugaccaugucu

SEQ ID NO: 2879626 - RNA, 22 nt, Human
ugcauguuaggaaaauuucaca

SEQ ID NO: 2879627 - RNA, 13 nt, Human
ugcauguaugucu

SEQ ID NO: 2879628 - RNA, 14 nt, Human
ugcauguaugucuu

SEQ ID NO: 2879629 - RNA, 15 nt, Human
ugcauguaugucuug

SEQ ID NO: 2879630 - RNA, 12 nt, Human
ugccauguaccu

SEQ ID NO: 2879631 - RNA, 14 nt, Human
ugccauguaccucc

SEQ ID NO: 2879632 - RNA, 17 nt, Human
ugccauguaccuccccu

SEQ ID NO: 2879633 - RNA, 18 nt, Human
ugccauguaccuccccug

SEQ ID NO: 2879634 - RNA, 19 nt, Human
ugccauguaccuccccugc

SEQ ID NO: 2879635 - RNA, 21 nt, Human
ugccauguaccuccccugccu

SEQ ID NO: 2879636 - RNA, 22 nt, Human
ugccauguaccuccccugccuu

SEQ ID NO: 2879637 - RNA, 23 nt, Human
ugccauguaccuccccugccuug

SEQ ID NO: 2879638 - RNA, 14 nt, Human
ugccaugugccagg

SEQ ID NO: 2879639 - RNA, 15 nt, Human
ugccaugugccaggu

SEQ ID NO: 2879640 - RNA, 17 nt, Human
ugccaugugugcugaac

SEQ ID NO: 2879641 - RNA, 16 nt, Human
ugccaugugacucugg

SEQ ID NO: 2879642 - RNA, 19 nt, Human
ugccaugugacucuggcuu

SEQ ID NO: 2879643 - RNA, 21 nt, Human
ugccaugugacucuggcuugg

SEQ ID NO: 2879644 - RNA, 12 nt, Human
ugcccacuguuu

SEQ ID NO: 2879645 - RNA, 16 nt, Human
ugcccagaacuucccu

SEQ ID NO: 2879646 - RNA, 17 nt, Human
ugcccagaacuucccug

SEQ ID NO: 2879647 - RNA, 18 nt, Human
ugcccagaacuucccuga

SEQ ID NO: 2879648 - RNA, 18 nt, Human
ugcccacgcuggagugca

SEQ ID NO: 2879649 - RNA, 16 nt, Human
ugccauguuggccagg

SEQ ID NO: 2879650 - RNA, 12 nt, Human
ugccauguuggc

SEQ ID NO: 2879651 - RNA, 15 nt, Human
ugccauguuggccag

SEQ ID NO: 2879652 - RNA, 12 nt, Human
ugccauccaggu

SEQ ID NO: 2879653 - RNA, 15 nt, Human
ugccauccagguuca

SEQ ID NO: 2879654 - RNA, 14 nt, Human
ugccaucauugcug

SEQ ID NO: 2879655 - RNA, 15 nt, Human
ugccaucauugcugu

SEQ ID NO: 2879656 - RNA, 16 nt, Human
ugccaucauugcuguc

SEQ ID NO: 2879657 - RNA, 18 nt, Human
ugccaucauugcugucug

SEQ ID NO: 2879658 - RNA, 21 nt, Human
ugccaucauugcugucugcag

SEQ ID NO: 2879659 - RNA, 22 nt, Human
ugccaucauugcugucugcagc

SEQ ID NO: 2879660 - RNA, 17 nt, Human
ugccagguuuuuggucu

SEQ ID NO: 2879661 - RNA, 16 nt, Human
ugccagggccgaccag

SEQ ID NO: 2879662 - RNA, 19 nt, Human
ugccagggcagugcuagug

SEQ ID NO: 2879663 - RNA, 14 nt, Human
ugccaccagagacc

SEQ ID NO: 2879664 - RNA, 13 nt, Human
ugccaccagagac

SEQ ID NO: 2879665 - RNA, 18 nt, Human
ugccaccacuauaaaaug

SEQ ID NO: 2879666 - RNA, 22 nt, Human
ugccaccacuauaaaaugucuu

SEQ ID NO: 2879667 - RNA, 15 nt, Human
ugccaccaccucugu

SEQ ID NO: 2879668 - RNA, 16 nt, Human
ugccaccaccucugug

SEQ ID NO: 2879669 - RNA, 18 nt, Human
ugccaccaccucuguggc

SEQ ID NO: 2879670 - RNA, 19 nt, Human
ugccaccaccucuguggca

SEQ ID NO: 2879671 - RNA, 22 nt, Human
ugccaccaccucuguggcauug

SEQ ID NO: 2879672 - RNA, 16 nt, Human
ugccacugcacuccag

SEQ ID NO: 2879673 - RNA, 19 nt, Human
ugccacugauauucagaau

SEQ ID NO: 2879674 - RNA, 17 nt, Human
ugccacucauuccugua

SEQ ID NO: 2879675 - RNA, 18 nt, Human
ugccacucauuccuguag

SEQ ID NO: 2879676 - RNA, 14 nt, Human
ugccacuccucccu

SEQ ID NO: 2879677 - RNA, 15 nt, Human
ugccacuccucccuc

SEQ ID NO: 2879678 - RNA, 16 nt, Human
ugccacuccucccucc

SEQ ID NO: 2879679 - RNA, 17 nt, Human
ugccacuccucccuccg

SEQ ID NO: 2879680 - RNA, 23 nt, Human
ugcccugcugccgccucccagcc

SEQ ID NO: 2879681 - RNA, 11 nt, Human
ugcccugcugc

SEQ ID NO: 2879682 - RNA, 21 nt, Human
ugcccugcugccgccucccag

SEQ ID NO: 2879683 - RNA, 12 nt, Human
ugcccugcuccc

SEQ ID NO: 2879684 - RNA, 13 nt, Human
ugcccugcucccu

SEQ ID NO: 2879685 - RNA, 18 nt, Human
ugcccuggauccaucagg

SEQ ID NO: 2879686 - RNA, 20 nt, Human
ugcccuggugcugccacacu

SEQ ID NO: 2879687 - RNA, 18 nt, Human
ugcccuggugcugccaca

SEQ ID NO: 2879688 - RNA, 22 nt, Human
ugcccuggcagggucauccugu

SEQ ID NO: 2879689 - RNA, 23 nt, Human
ugcccuggcagggucauccugug

SEQ ID NO: 2879690 - RNA, 17 nt, Human
ugcccugguuucacugg

SEQ ID NO: 2879691 - RNA, 15 nt, Human
ugcccugguuucacu

SEQ ID NO: 2879692 - RNA, 21 nt, Human
ugcccuggugcugccacacuu

SEQ ID NO: 2879693 - RNA, 18 nt, Human
ugccggguuuuauauuuu

SEQ ID NO: 2879694 - RNA, 20 nt, Human
ugccgguaaacacgccugca

SEQ ID NO: 2879695 - RNA, 14 nt, Human
ugccggguuuuaua

SEQ ID NO: 2879696 - RNA, 22 nt, Human
ugcccugguuucacuggcccaa

SEQ ID NO: 2879697 - RNA, 16 nt, Human
ugccgugugaguguga

SEQ ID NO: 2879698 - RNA, 19 nt, Human
ugccgugugagugugacag

SEQ ID NO: 2879699 - RNA, 20 nt, Human
ugccgugugagugugacagg

SEQ ID NO: 2879700 - RNA, 21 nt, Human
ugccgugugagugugacaggg

SEQ ID NO: 2879701 - RNA, 22 nt, Human
ugccgugugagugugacagggc

SEQ ID NO: 2879702 - RNA, 23 nt, Human
ugccgugugagugugacagggcc

SEQ ID NO: 2879703 - RNA, 14 nt, Human
ugccgucucuggag

SEQ ID NO: 2879704 - RNA, 13 nt, Human
ugccgucucugga

SEQ ID NO: 2879705 - RNA, 12 nt, Human
ugccgucucugg

SEQ ID NO: 2879706 - RNA, 22 nt, Human
ugcccacugcugcaguagggga

SEQ ID NO: 2879707 - RNA, 14 nt, Human
ugcccguguacaua

SEQ ID NO: 2879708 - RNA, 22 nt, Human
ugcccgggcgcggccagccccg

SEQ ID NO: 2879709 - RNA, 19 nt, Human
ugcccgggcgcggccagcc

SEQ ID NO: 2879710 - RNA, 20 nt, Human
ugcccgggcgcggccagccc

SEQ ID NO: 2879711 - RNA, 14 nt, Human
ugcccggucccacc

SEQ ID NO: 2879712 - RNA, 20 nt, Human
ugcccguaaacacgccugca

SEQ ID NO: 2879713 - RNA, 23 nt, Human
ugcccguaaacacgccugcaaac

SEQ ID NO: 2879714 - RNA, 21 nt, Human
ugcccacuguuucucuugagc

SEQ ID NO: 2879715 - RNA, 11 nt, Human
ugcccagaacu

SEQ ID NO: 2879716 - RNA, 17 nt, Human
ugcccguucuugaaaug

SEQ ID NO: 2879717 - RNA, 14 nt, Human
ugcccguucuugaa

SEQ ID NO: 2879718 - RNA, 16 nt, Human
ugcccugcccccacga

SEQ ID NO: 2879719 - RNA, 23 nt, Human
ugcccugcugagucccaggcuga

SEQ ID NO: 2879720 - RNA, 22 nt, Human
ugcccugcugagucccaggcug

SEQ ID NO: 2879721 - RNA, 18 nt, Human
ugcccugcugagucccag

SEQ ID NO: 2879722 - RNA, 19 nt, Human
ugcccugcgggucacagga

SEQ ID NO: 2879723 - RNA, 13 nt, Human
ugccuaagacaug

SEQ ID NO: 2879724 - RNA, 18 nt, Human
ugccuaagcauugccugg

SEQ ID NO: 2879725 - RNA, 19 nt, Human
ugccuaagcauugccuggc

SEQ ID NO: 2879726 - RNA, 22 nt, Human
ugccuaagcauugccuggccuu

SEQ ID NO: 2879727 - RNA, 19 nt, Human
ugccuccgccucaguaaga

SEQ ID NO: 2879728 - RNA, 22 nt, Human
ugccuccgcgugaucaaagcca

SEQ ID NO: 2879729 - RNA, 12 nt, Human
ugccuccucacc

SEQ ID NO: 2879730 - RNA, 17 nt, Human
ugccucgaaacacagaa

SEQ ID NO: 2879731 - RNA, 13 nt, Human
ugccucgaaacac

SEQ ID NO: 2879732 - RNA, 24 nt, Human
ugccuccucacccccagcuuugcu

SEQ ID NO: 2879733 - RNA, 19 nt, Human
ugccuccucacccccagcu

SEQ ID NO: 2879734 - RNA, 13 nt, Human
ugccucugccuua

SEQ ID NO: 2879735 - RNA, 14 nt, Human
ugccucugccuuag

SEQ ID NO: 2879736 - RNA, 22 nt, Human
ugccucugccuuagaggagccc

SEQ ID NO: 2879737 - RNA, 12 nt, Human
ugccucugccug

SEQ ID NO: 2879738 - RNA, 18 nt, Human
ugccucugccugucuccc

SEQ ID NO: 2879739 - RNA, 13 nt, Human
ugccucugccugu

SEQ ID NO: 2879740 - RNA, 14 nt, Human
ugccucugccuguc

SEQ ID NO: 2879741 - RNA, 11 nt, Human
ugccugcagcc

SEQ ID NO: 2879742 - RNA, 13 nt, Human
ugccucuuccucc

SEQ ID NO: 2879743 - RNA, 17 nt, Human
ugccucuuacgguaguu

SEQ ID NO: 2879744 - RNA, 22 nt, Human
ugccugcagccccgcgccuccu

SEQ ID NO: 2879745 - RNA, 15 nt, Human
ugccugcagccccgc

SEQ ID NO: 2879746 - RNA, 15 nt, Human
ugccugcagaguuug

SEQ ID NO: 2879747 - RNA, 12 nt, Human
ugccugccaugu

SEQ ID NO: 2879748 - RNA, 21 nt, Human
ugccugccauguaccuccccu

SEQ ID NO: 2879749 - RNA, 23 nt, Human
ugccugccauguaccuccccugc

SEQ ID NO: 2879750 - RNA, 14 nt, Human
ugccugggggaguu

SEQ ID NO: 2879751 - RNA, 19 nt, Human
ugccugggggaguuuuccu

SEQ ID NO: 2879752 - RNA, 20 nt, Human
ugccugggggaguuuuccuc

SEQ ID NO: 2879753 - RNA, 21 nt, Human
ugccugggggaguuuuccucu

SEQ ID NO: 2879754 - RNA, 21 nt, Human
ugccuggguggacauggcccc

SEQ ID NO: 2879755 - RNA, 19 nt, Human
ugccugguggcagcugcgg

SEQ ID NO: 2879756 - RNA, 16 nt, Human
ugccuggucacagggc

SEQ ID NO: 2879757 - RNA, 17 nt, Human
ugccuggucacagggca

SEQ ID NO: 2879758 - RNA, 22 nt, Human
ugccuggucacagggcaugccc

SEQ ID NO: 2879759 - RNA, 22 nt, Human
ugccuguaguuaggaaauaaaa

SEQ ID NO: 2879760 - RNA, 21 nt, Human
ugccuguaguuaggaaauaaa

SEQ ID NO: 2879761 - RNA, 20 nt, Human
ugccuguaguuaggaaauaa

SEQ ID NO: 2879762 - RNA, 19 nt, Human
ugccuguaguuaggaaaua

SEQ ID NO: 2879763 - RNA, 18 nt, Human
ugccuguaguuaggaaau

SEQ ID NO: 2879764 - RNA, 17 nt, Human
ugccuguaguuaggaaa

SEQ ID NO: 2879765 - RNA, 16 nt, Human
ugccuguaguuaggaa

SEQ ID NO: 2879766 - RNA, 15 nt, Human
ugccuguaguuagga

SEQ ID NO: 2879767 - RNA, 18 nt, Human
ugccugguggcagcugcg

SEQ ID NO: 2879768 - RNA, 17 nt, Human
ugccugguggcagcugc

SEQ ID NO: 2879769 - RNA, 22 nt, Human
ugccuggguuuaaggggagagg

SEQ ID NO: 2879770 - RNA, 22 nt, Human
ugccuggguuccaauccuggcu

SEQ ID NO: 2879771 - RNA, 12 nt, Human
ugcacugacccu

SEQ ID NO: 2879772 - RNA, 15 nt, Human
ugcacugacccuucc

SEQ ID NO: 2879773 - RNA, 21 nt, Human
ugcacugacauuguuggccaa

SEQ ID NO: 2879774 - RNA, 18 nt, Human
ugcacugacauuguuggc

SEQ ID NO: 2879775 - RNA, 15 nt, Human
ugcagaggucagacu

SEQ ID NO: 2879776 - RNA, 22 nt, Human
ugcagaggggcuuucuggagag

SEQ ID NO: 2879777 - RNA, 21 nt, Human
ugcagaggggcuuucuggaga

SEQ ID NO: 2879778 - RNA, 19 nt, Human
ugcagagguccacaacaca

SEQ ID NO: 2879779 - RNA, 20 nt, Human
ugcagaggggcuuucuggag

SEQ ID NO: 2879780 - RNA, 21 nt, Human
ugcacuuauaagguguuuucu

SEQ ID NO: 2879781 - RNA, 21 nt, Human
ugcacuuaaggcacucuguua

SEQ ID NO: 2879782 - RNA, 16 nt, Human
ugcacuuaaggcacuc

SEQ ID NO: 2879783 - RNA, 15 nt, Human
ugcacgacgcccucu

SEQ ID NO: 2879784 - RNA, 19 nt, Human
ugcacgacgcccucucccc

SEQ ID NO: 2879785 - RNA, 20 nt, Human
ugcacgacgcccucucccca

SEQ ID NO: 2879786 - RNA, 14 nt, Human
ugcaccuugugucu

SEQ ID NO: 2879787 - RNA, 20 nt, Human
ugcaccuuaccaacuuucug

SEQ ID NO: 2879788 - RNA, 21 nt, Human
ugcaccuuaccaacuuucugu

SEQ ID NO: 2879789 - RNA, 15 nt, Human
ugcaccuugugucug

SEQ ID NO: 2879790 - RNA, 16 nt, Human
ugcaccuugugucugu

SEQ ID NO: 2879791 - RNA, 20 nt, Human
ugcaccuguacucaggaggc

SEQ ID NO: 2879792 - RNA, 13 nt, Human
ugcaccuuaccaa

SEQ ID NO: 2879793 - RNA, 18 nt, Human
ugcaccuuaccaacuuuc

SEQ ID NO: 2879794 - RNA, 19 nt, Human
ugcaccuuaccaacuuucu

SEQ ID NO: 2879795 - RNA, 17 nt, Human
ugcaccuguacucagga

SEQ ID NO: 2879796 - RNA, 16 nt, Human
ugcaccuguacucagg

SEQ ID NO: 2879797 - RNA, 23 nt, Human
ugcaauuuucuaagcaauuucuu

SEQ ID NO: 2879798 - RNA, 22 nt, Human
ugcaccugccagccuggcuucu

SEQ ID NO: 2879799 - RNA, 16 nt, Human
ugcacagugcaucuca

SEQ ID NO: 2879800 - RNA, 17 nt, Human
ugcacagugcaucucag

SEQ ID NO: 2879801 - RNA, 21 nt, Human
ugcacaaauauuuauuuucuu

SEQ ID NO: 2879802 - RNA, 15 nt, Human
ugcacagugcaucuc

SEQ ID NO: 2879803 - RNA, 20 nt, Human
ugcaauuucauaugcuguau

SEQ ID NO: 2879804 - RNA, 14 nt, Human
ugcaauuucauaug

SEQ ID NO: 2879805 - RNA, 23 nt, Human
ugcaauuugauugacugcccauu

SEQ ID NO: 2879806 - RNA, 14 nt, Human
ugcaauuuauuaaa

SEQ ID NO: 2879807 - RNA, 15 nt, Human
ugcaauuuauuaaaa

SEQ ID NO: 2879808 - RNA, 18 nt, Human
ugcaauuuauuaaaauga

SEQ ID NO: 2879809 - RNA, 22 nt, Human
ugcaauuuauuaaaaugauugu

SEQ ID NO: 2879810 - RNA, 12 nt, Human
ugcaauuucaag

SEQ ID NO: 2879811 - RNA, 13 nt, Human
ugcaauuucaagg

SEQ ID NO: 2879812 - RNA, 17 nt, Human
ugcaauuucaagguucu

SEQ ID NO: 2879813 - RNA, 18 nt, Human
ugcaauuucaagguucua

SEQ ID NO: 2879814 - RNA, 19 nt, Human
ugcaauuucaagguucuaa

SEQ ID NO: 2879815 - RNA, 20 nt, Human
ugcaauuucaagguucuaac

SEQ ID NO: 2879816 - RNA, 19 nt, Human
ugcaauuagccucauaguu

SEQ ID NO: 2879817 - RNA, 17 nt, Human
ugcaauuaggauuuuga

SEQ ID NO: 2879818 - RNA, 20 nt, Human
ugcaauuagguuuuuccuua

SEQ ID NO: 2879819 - RNA, 23 nt, Human
ugcaauuagguuuuuccuuauuu

SEQ ID NO: 2879820 - RNA, 14 nt, Human
ugcaauucaaaagu

SEQ ID NO: 2879821 - RNA, 16 nt, Human
ugcaauucaaaaguuc

SEQ ID NO: 2879822 - RNA, 17 nt, Human
ugcaauucaaaaguucc

SEQ ID NO: 2879823 - RNA, 18 nt, Human
ugcaauucaaaaguucca

SEQ ID NO: 2879824 - RNA, 13 nt, Human
ugcaauuccccuc

SEQ ID NO: 2879825 - RNA, 19 nt, Human
ugcaauucaaaaguuccaa

SEQ ID NO: 2879826 - RNA, 21 nt, Human
ugcaauucaaaaguuccaaga

SEQ ID NO: 2879827 - RNA, 14 nt, Human
ugcaauuccccucu

SEQ ID NO: 2879828 - RNA, 18 nt, Human
ugcaauuccccucugcug

SEQ ID NO: 2879829 - RNA, 16 nt, Human
ugcaauugauuucuuu

SEQ ID NO: 2879830 - RNA, 23 nt, Human
ugcacaaaaugaaugaggucugg

SEQ ID NO: 2879831 - RNA, 15 nt, Human
ugcacaaacucacca

SEQ ID NO: 2879832 - RNA, 15 nt, Human
ugcacaaagcccuuc

SEQ ID NO: 2879833 - RNA, 17 nt, Human
ugcacaaagcccuucca

SEQ ID NO: 2879834 - RNA, 21 nt, Human
ugcaaugacacagucuuggcu

SEQ ID NO: 2879835 - RNA, 18 nt, Human
ugcaagaacucaucacug

SEQ ID NO: 2879836 - RNA, 21 nt, Human
ugcaagaacucaucacugugg

SEQ ID NO: 2879837 - RNA, 22 nt, Human
ugcaagaacucaucacuguggc

SEQ ID NO: 2879838 - RNA, 23 nt, Human
ugcaagaacucaucacuguggcu

SEQ ID NO: 2879839 - RNA, 16 nt, Human
ugcaauggcagccuug

SEQ ID NO: 2879840 - RNA, 15 nt, Human
ugcaauggcagccuu

SEQ ID NO: 2879841 - RNA, 14 nt, Human
ugcaauggcagccu

SEQ ID NO: 2879842 - RNA, 13 nt, Human
ugcaauggcagcc

SEQ ID NO: 2879843 - RNA, 16 nt, Human
ugcaaugacucaggac

SEQ ID NO: 2879844 - RNA, 13 nt, Human
ugcaauggauuuu

SEQ ID NO: 2879845 - RNA, 18 nt, Human
ugcaauggcuauauggca

SEQ ID NO: 2879846 - RNA, 17 nt, Human
ugcaaugggauguauga

SEQ ID NO: 2879847 - RNA, 18 nt, Human
ugcaaugggauguaugaa

SEQ ID NO: 2879848 - RNA, 22 nt, Human
ugcaaugggauguaugaauaca

SEQ ID NO: 2879849 - RNA, 15 nt, Human
ugcaaugggcacugg

SEQ ID NO: 2879850 - RNA, 19 nt, Human
ugcaauguaucccuucuca

SEQ ID NO: 2879851 - RNA, 24 nt, Human
ugcaauguaucccuucucacagca

SEQ ID NO: 2879852 - RNA, 18 nt, Human
ugcaaugugaucuauguu

SEQ ID NO: 2879853 - RNA, 13 nt, Human
ugauuuuugucuc

SEQ ID NO: 2879854 - RNA, 14 nt, Human
ugauuuuuguugau

SEQ ID NO: 2879855 - RNA, 19 nt, Human
ugauuuuuguugauuaaaa

SEQ ID NO: 2879856 - RNA, 13 nt, Human
ugauuuuuuaaaa

SEQ ID NO: 2879857 - RNA, 16 nt, Human
ugauuuuuuaaaagaa

SEQ ID NO: 2879858 - RNA, 17 nt, Human
ugauuuuuuaaaagaaa

SEQ ID NO: 2879859 - RNA, 20 nt, Human
ugauuuuuagaugagauugu

SEQ ID NO: 2879860 - RNA, 14 nt, Human
ugauuuucccucua

SEQ ID NO: 2879861 - RNA, 22 nt, Human
ugauuuuucuaaccuugaaugc

SEQ ID NO: 2879862 - RNA, 20 nt, Human
ugauuuuuaugaugaugaaa

SEQ ID NO: 2879863 - RNA, 18 nt, Human
ugcaaaaaaauuaaaaug

SEQ ID NO: 2879864 - RNA, 22 nt, Human
ugcaaaaaauacuuuuucuaau

SEQ ID NO: 2879865 - RNA, 16 nt, Human
ugauuuuuuuuuuuca

SEQ ID NO: 2879866 - RNA, 15 nt, Human
ugcaaaaagaaauga

SEQ ID NO: 2879867 - RNA, 22 nt, Human
ugcaaaaagaaaugacuaauua

SEQ ID NO: 2879868 - RNA, 13 nt, Human
ugcaaaacauuuc

SEQ ID NO: 2879869 - RNA, 14 nt, Human
ugcaaaaccuuuga

SEQ ID NO: 2879870 - RNA, 23 nt, Human
ugcaaaagacuaauuuaaaaaau

SEQ ID NO: 2879871 - RNA, 13 nt, Human
ugcaaaagcagug

SEQ ID NO: 2879872 - RNA, 15 nt, Human
ugcaaaagcuucaaa

SEQ ID NO: 2879873 - RNA, 22 nt, Human
ugauuuuaggagcuaaggcucu

SEQ ID NO: 2879874 - RNA, 12 nt, Human
ugauuuuaugau

SEQ ID NO: 2879875 - RNA, 18 nt, Human
ugauuuuaugaucagugu

SEQ ID NO: 2879876 - RNA, 20 nt, Human
ugauuuucaaagcuuuuucc

SEQ ID NO: 2879877 - RNA, 17 nt, Human
ugauuuucaagcagcau

SEQ ID NO: 2879878 - RNA, 19 nt, Human
ugauuuucaagcagcaucu

SEQ ID NO: 2879879 - RNA, 15 nt, Human
ugauuuucauaacuu

SEQ ID NO: 2879880 - RNA, 13 nt, Human
ugauuuuuacugu

SEQ ID NO: 2879881 - RNA, 13 nt, Human
ugaugugccuggg

SEQ ID NO: 2879882 - RNA, 18 nt, Human
ugaugucuuuucuuggca

SEQ ID NO: 2879883 - RNA, 23 nt, Human
ugaugucuuuucuuggcaaaagc

SEQ ID NO: 2879884 - RNA, 16 nt, Human
ugaugugacaauaaua

SEQ ID NO: 2879885 - RNA, 17 nt, Human
ugaugugacaauaauau

SEQ ID NO: 2879886 - RNA, 18 nt, Human
ugaugugacaauaauauu

SEQ ID NO: 2879887 - RNA, 20 nt, Human
ugauuuuaggagcuaaggcu

SEQ ID NO: 2879888 - RNA, 12 nt, Human
ugauuuuaaugg

SEQ ID NO: 2879889 - RNA, 21 nt, Human
ugauuuuaauggauuguuaau

SEQ ID NO: 2879890 - RNA, 14 nt, Human
ugcaaccuccgccu

SEQ ID NO: 2879891 - RNA, 13 nt, Human
ugcaaccuccgcc

SEQ ID NO: 2879892 - RNA, 16 nt, Human
ugcaacccaaggacug

SEQ ID NO: 2879893 - RNA, 20 nt, Human
ugcaacccaaggacugaggg

SEQ ID NO: 2879894 - RNA, 17 nt, Human
ugcaacccuuaccccuu

SEQ ID NO: 2879895 - RNA, 15 nt, Human
ugcaacccuuacccc

SEQ ID NO: 2879896 - RNA, 20 nt, Human
ugcaacaggcugggcuucag

SEQ ID NO: 2879897 - RNA, 19 nt, Human
ugcaacaggcugggcuuca

SEQ ID NO: 2879898 - RNA, 14 nt, Human
ugcaaccacacacc

SEQ ID NO: 2879899 - RNA, 14 nt, Human
ugcaacaggcuugu

SEQ ID NO: 2879900 - RNA, 15 nt, Human
ugcaacauuuacagu

SEQ ID NO: 2879901 - RNA, 23 nt, Human
ugcaacauuuacaguccuucaaa

SEQ ID NO: 2879902 - RNA, 17 nt, Human
ugcaacaggcugggcuu

SEQ ID NO: 2879903 - RNA, 16 nt, Human
ugcaacaggcugggcu

SEQ ID NO: 2879904 - RNA, 15 nt, Human
ugcaacaggcugggc

SEQ ID NO: 2879905 - RNA, 14 nt, Human
ugcaacaggcuggg

SEQ ID NO: 2879906 - RNA, 23 nt, Human
ugcaaaagguucacuaaagcagu

SEQ ID NO: 2879907 - RNA, 22 nt, Human
ugcaaaagguucacuaaagcag

SEQ ID NO: 2879908 - RNA, 12 nt, Human
ugcaaaauggaa

SEQ ID NO: 2879909 - RNA, 20 nt, Human
ugcaaaagacuaauuuaaaa

SEQ ID NO: 2879910 - RNA, 21 nt, Human
ugcaaaauuugaugccaggac

SEQ ID NO: 2879911 - RNA, 22 nt, Human
ugcaaaauuugaugccaggaca

SEQ ID NO: 2879912 - RNA, 19 nt, Human
ugcaaaauuuuuuuaaucu

SEQ ID NO: 2879913 - RNA, 14 nt, Human
ugcaaacagaacag

SEQ ID NO: 2879914 - RNA, 15 nt, Human
ugcaaacagaacagg

SEQ ID NO: 2879915 - RNA, 17 nt, Human
ugcaaacagaacagggu

SEQ ID NO: 2879916 - RNA, 18 nt, Human
ugcaaacagaacaggguc

SEQ ID NO: 2879917 - RNA, 19 nt, Human
ugcaaacagaacaggguca

SEQ ID NO: 2879918 - RNA, 21 nt, Human
ugcaaccuucgccaccugggu

SEQ ID NO: 2879919 - RNA, 18 nt, Human
ugcaaccuucgccaccug

SEQ ID NO: 2879920 - RNA, 14 nt, Human
ugcaaccuucaccu

SEQ ID NO: 2879921 - RNA, 12 nt, Human
ugcaaccucugc

SEQ ID NO: 2879922 - RNA, 18 nt, Human
ugcaacugacacucccac

SEQ ID NO: 2879923 - RNA, 19 nt, Human
ugcaacucaucaucgguga

SEQ ID NO: 2879924 - RNA, 13 nt, Human
ugcaacuucugcc

SEQ ID NO: 2879925 - RNA, 14 nt, Human
ugcaacuucugccu

SEQ ID NO: 2879926 - RNA, 21 nt, Human
ugcaacuucuuuuuauuuucu

SEQ ID NO: 2879927 - RNA, 17 nt, Human
ugcaacuucuuuuuauu

SEQ ID NO: 2879928 - RNA, 16 nt, Human
ugcaacuuguaaaugu

SEQ ID NO: 2879929 - RNA, 18 nt, Human
ugcaacuuguaaaugugg

SEQ ID NO: 2879930 - RNA, 21 nt, Human
ugcaaccuccgccucuugggu

SEQ ID NO: 2879931 - RNA, 20 nt, Human
ugcaaccuccgccucuuggg

SEQ ID NO: 2879932 - RNA, 18 nt, Human
ugcaaccuccgccucuug

SEQ ID NO: 2879933 - RNA, 21 nt, Human
ugcaacccaaggacugaggga

SEQ ID NO: 2879934 - RNA, 12 nt, Human
ugcaaaaaugga

SEQ ID NO: 2879935 - RNA, 21 nt, Human
ugcaaccucugccuccugggu

SEQ ID NO: 2879936 - RNA, 18 nt, Human
ugcaaccucugcuuccca

SEQ ID NO: 2879937 - RNA, 19 nt, Human
ugcaaccucugcuucccag

SEQ ID NO: 2879938 - RNA, 20 nt, Human
ugcaaccucugcuucccagg

SEQ ID NO: 2879939 - RNA, 21 nt, Human
ugcaaccucugcuucccaggu

SEQ ID NO: 2879940 - RNA, 17 nt, Human
uuuucaccuccuucaau

SEQ ID NO: 2879941 - RNA, 17 nt, Human
uuuuccuacaggcaguc

SEQ ID NO: 2879942 - RNA, 19 nt, Human
uuuuccccucuuuuguuaa

SEQ ID NO: 2879943 - RNA, 22 nt, Human
uuuucccucuuuggcuccccug

SEQ ID NO: 2879944 - RNA, 15 nt, Human
uuuucccucuuuucu

SEQ ID NO: 2879945 - RNA, 17 nt, Human
uuuuccuaaagagagua

SEQ ID NO: 2879946 - RNA, 11 nt, Human
uuuucuuccuu

SEQ ID NO: 2879947 - RNA, 15 nt, Human
uuuucuucacugucc

SEQ ID NO: 2879948 - RNA, 13 nt, Human
uuuucuuacauaa

SEQ ID NO: 2879949 - RNA, 16 nt, Human
uuuucuuacuccuccu

SEQ ID NO: 2879950 - RNA, 17 nt, Human
uuuucuuacuccuccuc

SEQ ID NO: 2879951 - RNA, 14 nt, Human
uuuucuugugacag

SEQ ID NO: 2879952 - RNA, 18 nt, Human
uuuucuuuaaagaaguug

SEQ ID NO: 2879953 - RNA, 15 nt, Human
uuuucuuuaaagaug

SEQ ID NO: 2879954 - RNA, 20 nt, Human
uuuugaaauuaugugacauu

SEQ ID NO: 2879955 - RNA, 18 nt, Human
uuuugaacuaagaaacuu

SEQ ID NO: 2879956 - RNA, 23 nt, Human
uuuugaacuaagaaacuuuugua

SEQ ID NO: 2879957 - RNA, 15 nt, Human
uuuucuuuagagaac

SEQ ID NO: 2879958 - RNA, 17 nt, Human
uuuucuuuagagaacug

SEQ ID NO: 2879959 - RNA, 18 nt, Human
uuuucuuuagagaacuga

SEQ ID NO: 2879960 - RNA, 19 nt, Human
uuuucuuuagagaacugaa

SEQ ID NO: 2879961 - RNA, 21 nt, Human
uuuucuuuagagaacugaaaa

SEQ ID NO: 2879962 - RNA, 17 nt, Human
uuuucuuaaccaguugu

SEQ ID NO: 2879963 - RNA, 22 nt, Human
uuuugaaaugugguuuuccuga

SEQ ID NO: 2879964 - RNA, 23 nt, Human
uuuucagaaaauauuauguguuu

SEQ ID NO: 2879965 - RNA, 18 nt, Human
uuuucagaaccucuuccc

SEQ ID NO: 2879966 - RNA, 17 nt, Human
uuuucagaaccucuucc

SEQ ID NO: 2879967 - RNA, 22 nt, Human
uuuucagaaccucuuccccaga

SEQ ID NO: 2879968 - RNA, 23 nt, Human
uuuucccagacuacuauuuucuu

SEQ ID NO: 2879969 - RNA, 16 nt, Human
uuuucagacuugucaa

SEQ ID NO: 2879970 - RNA, 22 nt, Human
uuuucagagauuuauauaaaug

SEQ ID NO: 2879971 - RNA, 19 nt, Human
uuuuccccccacucucccc

SEQ ID NO: 2879972 - RNA, 18 nt, Human
uuuuccccccacucuccc

SEQ ID NO: 2879973 - RNA, 15 nt, Human
uuuucccauuuguaa

SEQ ID NO: 2879974 - RNA, 22 nt, Human
uuuucagaaaauauuauguguu

SEQ ID NO: 2879975 - RNA, 20 nt, Human
uuuucaccccacccuucccc

SEQ ID NO: 2879976 - RNA, 13 nt, Human
uuuucaccccacc

SEQ ID NO: 2879977 - RNA, 19 nt, Human
uuuucaccagauuugcuaa

SEQ ID NO: 2879978 - RNA, 19 nt, Human
uuuucaaaauagaaaaguu

SEQ ID NO: 2879979 - RNA, 20 nt, Human
uuuucaaaauagaaaaguua

SEQ ID NO: 2879980 - RNA, 20 nt, Human
uuuucaaaauccaaaaagaa

SEQ ID NO: 2879981 - RNA, 20 nt, Human
uuuucaacaaauaucuugug

SEQ ID NO: 2879982 - RNA, 22 nt, Human
uuuucaacaaauaucuuguguu

SEQ ID NO: 2879983 - RNA, 23 nt, Human
uuuucaaccagauaacauaccuu

SEQ ID NO: 2879984 - RNA, 12 nt, Human
uuuucaacccca

SEQ ID NO: 2879985 - RNA, 19 nt, Human
uuuucaaccccacccuguu

SEQ ID NO: 2879986 - RNA, 22 nt, Human
uuuuauauaauaucuaaaguua

SEQ ID NO: 2879987 - RNA, 22 nt, Human
uuuuauauacagaggaaaucug

SEQ ID NO: 2879988 - RNA, 13 nt, Human
uuuuauauuuagu

SEQ ID NO: 2879989 - RNA, 23 nt, Human
uuuuauauuuaguuauaguuuca

SEQ ID NO: 2879990 - RNA, 13 nt, Human
uuuuauaguggaa

SEQ ID NO: 2879991 - RNA, 14 nt, Human
uuuuauaguggaaa

SEQ ID NO: 2879992 - RNA, 15 nt, Human
uuuuauaguggaaaa

SEQ ID NO: 2879993 - RNA, 19 nt, Human
uuuuauacucuuucuguau

SEQ ID NO: 2879994 - RNA, 18 nt, Human
uuuuauacucuuucugua

SEQ ID NO: 2879995 - RNA, 13 nt, Human
uuuuauacucuuu

SEQ ID NO: 2879996 - RNA, 18 nt, Human
uuuuauuuuuagacagag

SEQ ID NO: 2879997 - RNA, 14 nt, Human
uuuuauuuuguuuu

SEQ ID NO: 2879998 - RNA, 14 nt, Human
uuuuauuuuuuagu

SEQ ID NO: 2879999 - RNA, 22 nt, Human
uuuuaucuauucugagaaaaca

SEQ ID NO: 2880000 - RNA, 14 nt, Human
uuuuaucuguuuaa

SEQ ID NO: 2880001 - RNA, 21 nt, Human
uuuuaugaagugcgugaaugu

SEQ ID NO: 2880002 - RNA, 19 nt, Human
uuuuaucuuucgugauaaa

SEQ ID NO: 2880003 - RNA, 11 nt, Human
uuuuaugagaa

SEQ ID NO: 2880004 - RNA, 12 nt, Human
uuuuaugagaaa

SEQ ID NO: 2880005 - RNA, 12 nt, Human
uuuuauuuugaa

SEQ ID NO: 2880006 - RNA, 20 nt, Human
uuuuauuuugaaaagcuucu

SEQ ID NO: 2880007 - RNA, 13 nt, Human
uuuuaugagaaau

SEQ ID NO: 2880008 - RNA, 14 nt, Human
uuuuaugagaaaug

SEQ ID NO: 2880009 - RNA, 15 nt, Human
uuuuaugagaaaugu

SEQ ID NO: 2880010 - RNA, 16 nt, Human
uuuuaugagaaaugua

SEQ ID NO: 2880011 - RNA, 12 nt, Human
uuuuaugagaug

SEQ ID NO: 2880012 - RNA, 16 nt, Human
uuuuaaagguggauuu

SEQ ID NO: 2880013 - RNA, 16 nt, Human
uuuuaaaggcuuuuug

SEQ ID NO: 2880014 - RNA, 20 nt, Human
uuuuaaagaucuguaaguaa

SEQ ID NO: 2880015 - RNA, 18 nt, Human
uuuuaaagguggauuuug

SEQ ID NO: 2880016 - RNA, 13 nt, Human
uuuuaaaguguuu

SEQ ID NO: 2880017 - RNA, 18 nt, Human
uuuuaaaguguuucagcu

SEQ ID NO: 2880018 - RNA, 11 nt, Human
uuuuaaauaaa

SEQ ID NO: 2880019 - RNA, 13 nt, Human
uuuuaaauaaacu

SEQ ID NO: 2880020 - RNA, 14 nt, Human
uuuuaaauaaacuu

SEQ ID NO: 2880021 - RNA, 19 nt, Human
uuuuacaaaaaagaaaaga

SEQ ID NO: 2880022 - RNA, 11 nt, Human
uuuuacaaagg

SEQ ID NO: 2880023 - RNA, 17 nt, Human
uuuuacaauaaaaucuu

SEQ ID NO: 2880024 - RNA, 17 nt, Human
uuuuacaagaaguuuau

SEQ ID NO: 2880025 - RNA, 14 nt, Human
uuuuauacaaaccu

SEQ ID NO: 2880026 - RNA, 14 nt, Human
uuuuauacaaaaua

SEQ ID NO: 2880027 - RNA, 22 nt, Human
uuuuacuaccaaugccaagaua

SEQ ID NO: 2880028 - RNA, 22 nt, Human
uuuuacacagaaacacugccuu

SEQ ID NO: 2880029 - RNA, 19 nt, Human
uuuuacacauuagauuuua

SEQ ID NO: 2880030 - RNA, 21 nt, Human
uuuuacacagaaacacugccu

SEQ ID NO: 2880031 - RNA, 18 nt, Human
uuuuacacagaaacacug

SEQ ID NO: 2880032 - RNA, 17 nt, Human
uuuuacacagaaacacu

SEQ ID NO: 2880033 - RNA, 15 nt, Human
uuuuacacagaaaca

SEQ ID NO: 2880034 - RNA, 22 nt, Human
uuuuacccuaaugucuucauaa

SEQ ID NO: 2880035 - RNA, 19 nt, Human
uuuuaccugucacauugca

SEQ ID NO: 2880036 - RNA, 20 nt, Human
uuuuaccugucacauugcau

SEQ ID NO: 2880037 - RNA, 21 nt, Human
uuuuaccugucacauugcauu

SEQ ID NO: 2880038 - RNA, 23 nt, Human
uuuuaccugucacauugcauucu

SEQ ID NO: 2880039 - RNA, 17 nt, Human
uuuccaacguuuggaag

SEQ ID NO: 2880040 - RNA, 19 nt, Human
uuuccacaaaaucugucca

SEQ ID NO: 2880041 - RNA, 15 nt, Human
uuuccacaugcucug

SEQ ID NO: 2880042 - RNA, 17 nt, Human
uuucccuugcuuccccu

SEQ ID NO: 2880043 - RNA, 19 nt, Human
uuucccuugcuuuucccuc

SEQ ID NO: 2880044 - RNA, 20 nt, Human
uuucccuugcuuuucccucu

SEQ ID NO: 2880045 - RNA, 22 nt, Human
uuuccguaauaacacccuuccu

SEQ ID NO: 2880046 - RNA, 16 nt, Human
uuuccaauuauuugac

SEQ ID NO: 2880047 - RNA, 16 nt, Human
uuuccguuugcuuuug

SEQ ID NO: 2880048 - RNA, 12 nt, Human
uuugaguucuac

SEQ ID NO: 2880049 - RNA, 21 nt, Human
uuugcacuaaaucagagacaa

SEQ ID NO: 2880050 - RNA, 20 nt, Human
uuugcacuaaaucagagaca

SEQ ID NO: 2880051 - RNA, 19 nt, Human
uuugcacuaaaucagagac

SEQ ID NO: 2880052 - RNA, 14 nt, Human
uuugcacuaaauca

SEQ ID NO: 2880053 - RNA, 17 nt, Human
uuugcacgacgcccucu

SEQ ID NO: 2880054 - RNA, 19 nt, Human
uuugcacgacgcccucucc

SEQ ID NO: 2880055 - RNA, 20 nt, Human
uuugcacgacgcccucuccc

SEQ ID NO: 2880056 - RNA, 21 nt, Human
uuugcacgacgcccucucccc

SEQ ID NO: 2880057 - RNA, 18 nt, Human
uuugagugugugugugca

SEQ ID NO: 2880058 - RNA, 20 nt, Human
uuugcacccacugaaaggaa

SEQ ID NO: 2880059 - RNA, 11 nt, Human
uuuggaaaucc

SEQ ID NO: 2880060 - RNA, 19 nt, Human
uuugcauugaacacaaacu

SEQ ID NO: 2880061 - RNA, 22 nt, Human
uuugcauuaaauucacaaacuu

SEQ ID NO: 2880062 - RNA, 21 nt, Human
uuugcauuaaauucacaaacu

SEQ ID NO: 2880063 - RNA, 18 nt, Human
uuugcauuaaauucacaa

SEQ ID NO: 2880064 - RNA, 17 nt, Human
uuugcauuaaauucaca

SEQ ID NO: 2880065 - RNA, 14 nt, Human
uuugcagggcagcc

SEQ ID NO: 2880066 - RNA, 16 nt, Human
uuugcagggcagcccc

SEQ ID NO: 2880067 - RNA, 20 nt, Human
uuugcacuggaguucuaugc

SEQ ID NO: 2880068 - RNA, 16 nt, Human
uuugcaggucuuuaaa

SEQ ID NO: 2880069 - RNA, 22 nt, Human
uuugcaggucuuuaaaucauuu

SEQ ID NO: 2880070 - RNA, 22 nt, Human
uuugguauuacacuguauuugu

SEQ ID NO: 2880071 - RNA, 20 nt, Human
uuuggaccaauagcccacag

SEQ ID NO: 2880072 - RNA, 12 nt, Human
uuugguauuugc

SEQ ID NO: 2880073 - RNA, 16 nt, Human
uuuguauuuuguguga

SEQ ID NO: 2880074 - RNA, 23 nt, Human
uuuguauuuugugugaccaacug

SEQ ID NO: 2880075 - RNA, 13 nt, Human
uuuguguauuuaa

SEQ ID NO: 2880076 - RNA, 14 nt, Human
uuuguauuuuuagu

SEQ ID NO: 2880077 - RNA, 20 nt, Human
uuuguguauuuaacagggag

SEQ ID NO: 2880078 - RNA, 20 nt, Human
uuugugugaccaacuguguu

SEQ ID NO: 2880079 - RNA, 21 nt, Human
uuugugugaccaacuguguug

SEQ ID NO: 2880080 - RNA, 13 nt, Human
uuugugugucuua

SEQ ID NO: 2880081 - RNA, 14 nt, Human
uuuguguguuauac

SEQ ID NO: 2880082 - RNA, 22 nt, Human
uuugugucaaugggcaaugaca

SEQ ID NO: 2880083 - RNA, 9 nt, Human
uuuguuacu

SEQ ID NO: 2880084 - RNA, 15 nt, Human
uuuguuaguuccugu

SEQ ID NO: 2880085 - RNA, 21 nt, Human
uuuguuaguuccuguaugaaa

SEQ ID NO: 2880086 - RNA, 17 nt, Human
uuuguuauaccauuucc

SEQ ID NO: 2880087 - RNA, 16 nt, Human
uuuguuauuguuuugu

SEQ ID NO: 2880088 - RNA, 18 nt, Human
uuuguguguugucuugaa

SEQ ID NO: 2880089 - RNA, 15 nt, Human
uuuguguguugucuu

SEQ ID NO: 2880090 - RNA, 17 nt, Human
uuuguguguugucuuga

SEQ ID NO: 2880091 - RNA, 24 nt, Human
uuuguuaccuccaacagaacuaaa

SEQ ID NO: 2880092 - RNA, 12 nt, Human
uuuguuacuguu

SEQ ID NO: 2880093 - RNA, 13 nt, Human
uuuguuacuguuc

SEQ ID NO: 2880094 - RNA, 14 nt, Human
uuuguuacuguucu

SEQ ID NO: 2880095 - RNA, 15 nt, Human
uuuguuacuguucuu

SEQ ID NO: 2880096 - RNA, 16 nt, Human
uuuguuacuguucuug

SEQ ID NO: 2880097 - RNA, 17 nt, Human
uuuguuacuguucuugc

SEQ ID NO: 2880098 - RNA, 18 nt, Human
uuuguuacuguucuugcu

SEQ ID NO: 2880099 - RNA, 19 nt, Human
uuuguuacuguucuugcug

SEQ ID NO: 2880100 - RNA, 20 nt, Human
uuuguuacuguucuugcugc

SEQ ID NO: 2880101 - RNA, 21 nt, Human
uuuguuacuguucuugcugcu

SEQ ID NO: 2880102 - RNA, 22 nt, Human
uuuguuacuguucuugcugcua

SEQ ID NO: 2880103 - RNA, 23 nt, Human
uuuguuacuguucuugcugcuag

SEQ ID NO: 2880104 - RNA, 15 nt, Human
uuuguuagauagcug

SEQ ID NO: 2880105 - RNA, 21 nt, Human
uuuguuagauagcugcaugug

SEQ ID NO: 2880106 - RNA, 14 nt, Human
uuuguugcuguuuu

SEQ ID NO: 2880107 - RNA, 20 nt, Human
uuuguuauuuucaguauuuu

SEQ ID NO: 2880108 - RNA, 12 nt, Human
uuuguuauuuug

SEQ ID NO: 2880109 - RNA, 23 nt, Human
uuuuaaacaaaauagaagcugua

SEQ ID NO: 2880110 - RNA, 13 nt, Human
uuuuaaacaaaca

SEQ ID NO: 2880111 - RNA, 13 nt, Human
uuuuaaacaguga

SEQ ID NO: 2880112 - RNA, 20 nt, Human
uuuuaaacaaaauagaagcu

SEQ ID NO: 2880113 - RNA, 20 nt, Human
uuuuaaacccuauugguaaa

SEQ ID NO: 2880114 - RNA, 19 nt, Human
uuuuaaacagugagccuga

SEQ ID NO: 2880115 - RNA, 19 nt, Human
uuuuaaacuacagguaguu

SEQ ID NO: 2880116 - RNA, 12 nt, Human
uuuuaaacuaga

SEQ ID NO: 2880117 - RNA, 13 nt, Human
uuuuaaacuagau

SEQ ID NO: 2880118 - RNA, 15 nt, Human
uuuuaaacuagauga

SEQ ID NO: 2880119 - RNA, 17 nt, Human
uuuuaaacuagaugacc

SEQ ID NO: 2880120 - RNA, 20 nt, Human
uuuuaaacuagaugaccuca

SEQ ID NO: 2880121 - RNA, 12 nt, Human
uuuuaaacucau

SEQ ID NO: 2880122 - RNA, 19 nt, Human
uuuuaaaaguuucaaugug

SEQ ID NO: 2880123 - RNA, 21 nt, Human
uuuuaaaaguuucaaugugau

SEQ ID NO: 2880124 - RNA, 22 nt, Human
uuuuaaaaguuucaaugugauu

SEQ ID NO: 2880125 - RNA, 15 nt, Human
uuuguuguaaaaaga

SEQ ID NO: 2880126 - RNA, 18 nt, Human
uuuuaaaaguuucaaugu

SEQ ID NO: 2880127 - RNA, 16 nt, Human
uuuuaaaaucaacuua

SEQ ID NO: 2880128 - RNA, 14 nt, Human
uuuuucauuuucca

SEQ ID NO: 2880129 - RNA, 16 nt, Human
uuuuucauuuuccaau

SEQ ID NO: 2880130 - RNA, 17 nt, Human
uuuuucauuuuccaaua

SEQ ID NO: 2880131 - RNA, 22 nt, Human
uuuuucauuuauuguuuaugua

SEQ ID NO: 2880132 - RNA, 23 nt, Human
uuuuucauucaucccauuaauca

SEQ ID NO: 2880133 - RNA, 14 nt, Human
uuuuuccauaguuu

SEQ ID NO: 2880134 - RNA, 20 nt, Human
uuuuuccauaguuuugauga

SEQ ID NO: 2880135 - RNA, 14 nt, Human
uuuuuccaacugug

SEQ ID NO: 2880136 - RNA, 20 nt, Human
uuuuuccaauuuuagaaaau

SEQ ID NO: 2880137 - RNA, 14 nt, Human
uuuuucaguuccaa

SEQ ID NO: 2880138 - RNA, 17 nt, Human
uuuuucaguuccaagaa

SEQ ID NO: 2880139 - RNA, 21 nt, Human
uuuuucaguuccaagaaagau

SEQ ID NO: 2880140 - RNA, 13 nt, Human
uuuuucauauugu

SEQ ID NO: 2880141 - RNA, 19 nt, Human
uuuuucauauuuucuaaag

SEQ ID NO: 2880142 - RNA, 12 nt, Human
uuuuucaucccc

SEQ ID NO: 2880143 - RNA, 18 nt, Human
uuuuuaaguuaauagauu

SEQ ID NO: 2880144 - RNA, 12 nt, Human
uuuuuaauagaa

SEQ ID NO: 2880145 - RNA, 13 nt, Human
uuuuuaauagaac

SEQ ID NO: 2880146 - RNA, 23 nt, Human
uuuuuaauagucauuccaaauau

SEQ ID NO: 2880147 - RNA, 13 nt, Human
uuuuuaaucauga

SEQ ID NO: 2880148 - RNA, 17 nt, Human
uuuuuaaucaugaaauu

SEQ ID NO: 2880149 - RNA, 12 nt, Human
uuuuuaauaaac

SEQ ID NO: 2880150 - RNA, 15 nt, Human
uuuuuaauaaacuac

SEQ ID NO: 2880151 - RNA, 17 nt, Human
uuuuuaauaaagacagg

SEQ ID NO: 2880152 - RNA, 20 nt, Human
uuuuuaauaaagacaggguu

SEQ ID NO: 2880153 - RNA, 20 nt, Human
uuuuucaggagcgcaagaua

SEQ ID NO: 2880154 - RNA, 22 nt, Human
uuuuucacauaaagggaacaaa

SEQ ID NO: 2880155 - RNA, 10 nt, Human
uuuuuaaugg

SEQ ID NO: 2880156 - RNA, 19 nt, Human
uuuuuaauggcagcagaaa

SEQ ID NO: 2880157 - RNA, 22 nt, Human
uuuuuaauggcagcagaaaacu

SEQ ID NO: 2880158 - RNA, 15 nt, Human
uuuuuaaucaugaaa

SEQ ID NO: 2880159 - RNA, 16 nt, Human
uuuuuaaucuagacaa

SEQ ID NO: 2880160 - RNA, 22 nt, Human
uuuuuaaucuagacaauauaca

SEQ ID NO: 2880161 - RNA, 22 nt, Human
uuuuuaacucuacuguguaaua

SEQ ID NO: 2880162 - RNA, 16 nt, Human
uuuuuaaauuuuguaa

SEQ ID NO: 2880163 - RNA, 19 nt, Human
uuuuuaaauuuuguaauga

SEQ ID NO: 2880164 - RNA, 23 nt, Human
uuuuuaaauguauacuauaguac

SEQ ID NO: 2880165 - RNA, 13 nt, Human
uuuuuaaauuguu

SEQ ID NO: 2880166 - RNA, 15 nt, Human
uuuuuaaauguauac

SEQ ID NO: 2880167 - RNA, 22 nt, Human
uuuugacuagggauucaggcug

SEQ ID NO: 2880168 - RNA, 14 nt, Human
uuuugacuuaaugu

SEQ ID NO: 2880169 - RNA, 15 nt, Human
uuuugacuuaaugug

SEQ ID NO: 2880170 - RNA, 17 nt, Human
uuuugacuuaaugugau

SEQ ID NO: 2880171 - RNA, 18 nt, Human
uuuugacuuaaugugauu

SEQ ID NO: 2880172 - RNA, 20 nt, Human
uuuugaccuucauuucaugu

SEQ ID NO: 2880173 - RNA, 21 nt, Human
uuuugaccuucauuucaugua

SEQ ID NO: 2880174 - RNA, 24 nt, Human
uuuugacaguguugaaaauguuca

SEQ ID NO: 2880175 - RNA, 23 nt, Human
uuuugacaguguugaaaauguuc

SEQ ID NO: 2880176 - RNA, 19 nt, Human
uuuugacaguguugaaaau

SEQ ID NO: 2880177 - RNA, 21 nt, Human
uuuugaauaccauuaaaacug

SEQ ID NO: 2880178 - RNA, 14 nt, Human
uuuugaaggaauac

SEQ ID NO: 2880179 - RNA, 14 nt, Human
uuuugaaggcaaaa

SEQ ID NO: 2880180 - RNA, 13 nt, Human
uuuugaagggagg

SEQ ID NO: 2880181 - RNA, 13 nt, Human
uuuugaaggcaaa

SEQ ID NO: 2880182 - RNA, 11 nt, Human
uuuugaaguuu

SEQ ID NO: 2880183 - RNA, 15 nt, Human
uuuugaaguuuacau

SEQ ID NO: 2880184 - RNA, 16 nt, Human
uuuugaaguuuacauu

SEQ ID NO: 2880185 - RNA, 17 nt, Human
uuuugaaguuuacauuu

SEQ ID NO: 2880186 - RNA, 18 nt, Human
uuuugaaguuuacauuuu

SEQ ID NO: 2880187 - RNA, 19 nt, Human
uuuugaaguaguuuguaua

SEQ ID NO: 2880188 - RNA, 13 nt, Human
uuuugaagucuug

SEQ ID NO: 2880189 - RNA, 15 nt, Human
uuuugaagucuugua

SEQ ID NO: 2880190 - RNA, 16 nt, Human
uuuugaagucuuguau

SEQ ID NO: 2880191 - RNA, 21 nt, Human
uuuuuuuaauagucauuccaa

SEQ ID NO: 2880192 - RNA, 18 nt, Human
uuuuuuguuuuacaaugu

SEQ ID NO: 2880193 - RNA, 16 nt, Human
uuuuuuguuuguuucu

SEQ ID NO: 2880194 - RNA, 13 nt, Human
uuuuuuguuuguu

SEQ ID NO: 2880195 - RNA, 15 nt, Human
uuuuuuccuguuucu

SEQ ID NO: 2880196 - RNA, 19 nt, Human
uuuuuuccuguuucugaaa

SEQ ID NO: 2880197 - RNA, 13 nt, Human
uuuuuuccacuua

SEQ ID NO: 2880198 - RNA, 22 nt, Human
uuuuuuccaucuuuacaaaacu

SEQ ID NO: 2880199 - RNA, 13 nt, Human
uuuuuuccaucuu

SEQ ID NO: 2880200 - RNA, 11 nt, Human
uuuuuuugcca

SEQ ID NO: 2880201 - RNA, 10 nt, Human
uuuuuuuggc

SEQ ID NO: 2880202 - RNA, 13 nt, Human
uuuuuuuccuuuu

SEQ ID NO: 2880203 - RNA, 12 nt, Human
uuuuuuucuuua

SEQ ID NO: 2880204 - RNA, 10 nt, Human
uuuuuuucca

SEQ ID NO: 2880205 - RNA, 12 nt, Human
uuuuuuuacauu

SEQ ID NO: 2880206 - RNA, 10 nt, Human
uuuuuuuccu

SEQ ID NO: 2880207 - RNA, 13 nt, Human
uuuuuuuccagca

SEQ ID NO: 2880208 - RNA, 12 nt, Human
uuuuuuuccauu

SEQ ID NO: 2880209 - RNA, 12 nt, Human
uuuuuuucaaug

SEQ ID NO: 2880210 - RNA, 13 nt, Human
uuuuuuucaaugu

SEQ ID NO: 2880211 - RNA, 14 nt, Human
uuuuuuucaaugug

SEQ ID NO: 2880212 - RNA, 12 nt, Human
uuuuuuaaucua

SEQ ID NO: 2880213 - RNA, 12 nt, Human
uuuuuuaauuua

SEQ ID NO: 2880214 - RNA, 13 nt, Human
uuuuuuacagauu

SEQ ID NO: 2880215 - RNA, 12 nt, Human
uuuuuuacauuu

SEQ ID NO: 2880216 - RNA, 11 nt, Human
uuuuuuacauu

SEQ ID NO: 2880217 - RNA, 18 nt, Human
uuuuuucaaaauagaaaa

SEQ ID NO: 2880218 - RNA, 19 nt, Human
uuuuuuauugcuaguauuu

SEQ ID NO: 2880219 - RNA, 12 nt, Human
uuuuuucaaugu

SEQ ID NO: 2880220 - RNA, 13 nt, Human
uuuuuucaaugug

SEQ ID NO: 2880221 - RNA, 13 nt, Human
uuuuuucauuuau

SEQ ID NO: 2880222 - RNA, 12 nt, Human
uuuuuuaagauu

SEQ ID NO: 2880223 - RNA, 17 nt, Human
uuuuuuaaguauuuaua

SEQ ID NO: 2880224 - RNA, 11 nt, Human
uuuuuuaagau

SEQ ID NO: 2880225 - RNA, 16 nt, Human
uuuuuuaaacaaacau

SEQ ID NO: 2880226 - RNA, 13 nt, Human
uuuuuuaaaagaa

SEQ ID NO: 2880227 - RNA, 15 nt, Human
uuuuuuaaauaaacu

SEQ ID NO: 2880228 - RNA, 16 nt, Human
uuuuuuaaauaaacuu

SEQ ID NO: 2880229 - RNA, 13 nt, Human
uuuuuccaucuuu

SEQ ID NO: 2880230 - RNA, 14 nt, Human
uuuuuuuuaaacaa

SEQ ID NO: 2880231 - RNA, 13 nt, Human
uuuuuuuugaaaa

SEQ ID NO: 2880232 - RNA, 14 nt, Human
uuuuuuuuguuugu

SEQ ID NO: 2880233 - RNA, 13 nt, Human
uuuuuuuuuaaac

SEQ ID NO: 2880234 - RNA, 12 nt, Human
uuuaacauuauu

SEQ ID NO: 2880235 - RNA, 23 nt, Human
uuuaacaugaacacccuuagaaa

SEQ ID NO: 2880236 - RNA, 21 nt, Human
uuuaacgugggauucagagaa

SEQ ID NO: 2880237 - RNA, 17 nt, Human
uuuaaccucuuuaagua

SEQ ID NO: 2880238 - RNA, 14 nt, Human
uuuaacuacccuua

SEQ ID NO: 2880239 - RNA, 17 nt, Human
uuuaacuacccuuaauu

SEQ ID NO: 2880240 - RNA, 18 nt, Human
uuuaacuacccuuaauua

SEQ ID NO: 2880241 - RNA, 17 nt, Human
uuuaacucuacugugua

SEQ ID NO: 2880242 - RNA, 18 nt, Human
uuuaacucuacuguguaa

SEQ ID NO: 2880243 - RNA, 21 nt, Human
uuuaacucuacuguguaauau

SEQ ID NO: 2880244 - RNA, 18 nt, Human
uuuaacuccccuguuuca

SEQ ID NO: 2880245 - RNA, 16 nt, Human
uuuaacuaugaacuga

SEQ ID NO: 2880246 - RNA, 20 nt, Human
uuuaacuaugaacugaaggc

SEQ ID NO: 2880247 - RNA, 13 nt, Human
uuuaacuggugca

SEQ ID NO: 2880248 - RNA, 19 nt, Human
uuuaacuggugcacuuugu

SEQ ID NO: 2880249 - RNA, 22 nt, Human
uuuaacuggugcacuuuguaaa

SEQ ID NO: 2880250 - RNA, 23 nt, Human
uuuaacuggugcacuuuguaaau

SEQ ID NO: 2880251 - RNA, 19 nt, Human
uuuaacugaagauguugag

SEQ ID NO: 2880252 - RNA, 14 nt, Human
uuuaacugagaaau

SEQ ID NO: 2880253 - RNA, 22 nt, Human
uuuaaauuuuacccuuuagacu

SEQ ID NO: 2880254 - RNA, 23 nt, Human
uuuaacaacuaugauuuggaaaa

SEQ ID NO: 2880255 - RNA, 12 nt, Human
uuuaacaagaag

SEQ ID NO: 2880256 - RNA, 13 nt, Human
uuuaacaagaaga

SEQ ID NO: 2880257 - RNA, 15 nt, Human
uuuaacaagaagaug

SEQ ID NO: 2880258 - RNA, 20 nt, Human
uuuaacaagaagaugaaugg

SEQ ID NO: 2880259 - RNA, 21 nt, Human
uuuaacaagaagaugaauggc

SEQ ID NO: 2880260 - RNA, 18 nt, Human
uuguuuggagacagaguc

SEQ ID NO: 2880261 - RNA, 18 nt, Human
uuuaaauuuuacccuuua

SEQ ID NO: 2880262 - RNA, 15 nt, Human
uuuaaauuuuguaau

SEQ ID NO: 2880263 - RNA, 15 nt, Human
uuuaauaauaaucua

SEQ ID NO: 2880264 - RNA, 16 nt, Human
uuuaauaauaaucuag

SEQ ID NO: 2880265 - RNA, 23 nt, Human
uuuaauaacauuaccuuacugug

SEQ ID NO: 2880266 - RNA, 15 nt, Human
uuuaauaacauuacc

SEQ ID NO: 2880267 - RNA, 18 nt, Human
uuuaauaacauuaccuua

SEQ ID NO: 2880268 - RNA, 20 nt, Human
uuuaauaacauuaccuuacu

SEQ ID NO: 2880269 - RNA, 22 nt, Human
uuuaauaacauuaccuuacugu

SEQ ID NO: 2880270 - RNA, 12 nt, Human
uuuaauaacauu

SEQ ID NO: 2880271 - RNA, 14 nt, Human
uuuaauaacaauug

SEQ ID NO: 2880272 - RNA, 20 nt, Human
uuuaauaaaauaauucuaaa

SEQ ID NO: 2880273 - RNA, 17 nt, Human
uuuaaguuaauagauuu

SEQ ID NO: 2880274 - RNA, 16 nt, Human
uuuaauaaaauaauuc

SEQ ID NO: 2880275 - RNA, 17 nt, Human
uuuaauaaaauaauucu

SEQ ID NO: 2880276 - RNA, 19 nt, Human
uuuaauaaacuacucuuug

SEQ ID NO: 2880277 - RNA, 20 nt, Human
uuuaauaaacuacucuuuga

SEQ ID NO: 2880278 - RNA, 21 nt, Human
uuuaauaaacuacucuuugau

SEQ ID NO: 2880279 - RNA, 15 nt, Human
uuuaaguuguuugca

SEQ ID NO: 2880280 - RNA, 14 nt, Human
uuuaaguuguuugc

SEQ ID NO: 2880281 - RNA, 21 nt, Human
uuuaaguuguuugcaugugaa

SEQ ID NO: 2880282 - RNA, 22 nt, Human
uuuaaguuucaaacuuacuauu

SEQ ID NO: 2880283 - RNA, 19 nt, Human
uuuaagaaaagcccugaga

SEQ ID NO: 2880284 - RNA, 12 nt, Human
uuuaagaaaagu

SEQ ID NO: 2880285 - RNA, 15 nt, Human
uuuaagaaaaguauu

SEQ ID NO: 2880286 - RNA, 16 nt, Human
uuuaagaaaaguauuu

SEQ ID NO: 2880287 - RNA, 17 nt, Human
uuuaagaaaaguauuuu

SEQ ID NO: 2880288 - RNA, 19 nt, Human
uuuaagaaaaguauuuuga

SEQ ID NO: 2880289 - RNA, 20 nt, Human
uuuaagaaaaguauuuugaa

SEQ ID NO: 2880290 - RNA, 21 nt, Human
uuuaagaaaaguauuuugaag

SEQ ID NO: 2880291 - RNA, 22 nt, Human
uuuaagaaaaguauuuugaagu

SEQ ID NO: 2880292 - RNA, 23 nt, Human
uuuaagaaaaguauuuugaaguu

SEQ ID NO: 2880293 - RNA, 22 nt, Human
uuuaagacagucccaucaaaac

SEQ ID NO: 2880294 - RNA, 19 nt, Human
uuuaagacauuuuuggaag

SEQ ID NO: 2880295 - RNA, 19 nt, Human
uuuaacuuuuuuucuucua

SEQ ID NO: 2880296 - RNA, 18 nt, Human
uuuaagaaaaaauaacac

SEQ ID NO: 2880297 - RNA, 22 nt, Human
uuuaagaaaaaauaacacacau

SEQ ID NO: 2880298 - RNA, 14 nt, Human
uuuaacuucuuucu

SEQ ID NO: 2880299 - RNA, 16 nt, Human
uuuaccaaacagcaaa

SEQ ID NO: 2880300 - RNA, 13 nt, Human
uuuacauuuuuau

SEQ ID NO: 2880301 - RNA, 19 nt, Human
uuuacauuuuuauuuauga

SEQ ID NO: 2880302 - RNA, 20 nt, Human
uuuacauuuuuauuuaugaa

SEQ ID NO: 2880303 - RNA, 22 nt, Human
uuuacauuuuuauuuaugaagu

SEQ ID NO: 2880304 - RNA, 16 nt, Human
uuuacauuguugagcu

SEQ ID NO: 2880305 - RNA, 10 nt, Human
uuuacauuua

SEQ ID NO: 2880306 - RNA, 12 nt, Human
uuuacauuuaaa

SEQ ID NO: 2880307 - RNA, 16 nt, Human
uuuacauuuaaagcau

SEQ ID NO: 2880308 - RNA, 17 nt, Human
uuuacauuuaaagcauu

SEQ ID NO: 2880309 - RNA, 18 nt, Human
uuuacauuuaaagcauug

SEQ ID NO: 2880310 - RNA, 20 nt, Human
uuuacauuuaaagcauugcu

SEQ ID NO: 2880311 - RNA, 20 nt, Human
uuuacauuguaaauaguauu

SEQ ID NO: 2880312 - RNA, 15 nt, Human
uuuacagcuguguua

SEQ ID NO: 2880313 - RNA, 16 nt, Human
uuuacagcuuuacaca

SEQ ID NO: 2880314 - RNA, 18 nt, Human
uuuacagcuuuacacaca

SEQ ID NO: 2880315 - RNA, 19 nt, Human
uuuacagcuuuacacacac

SEQ ID NO: 2880316 - RNA, 16 nt, Human
uuuacagcugccugca

SEQ ID NO: 2880317 - RNA, 13 nt, Human
uuuacagaaaaag

SEQ ID NO: 2880318 - RNA, 16 nt, Human
uuuacagaaaaaucuu

SEQ ID NO: 2880319 - RNA, 17 nt, Human
uuuacagaaaaaucuug

SEQ ID NO: 2880320 - RNA, 15 nt, Human
uuuacagcugccugc

SEQ ID NO: 2880321 - RNA, 15 nt, Human
uuuacaguccuucaa

SEQ ID NO: 2880322 - RNA, 16 nt, Human
uuuacaguccuucaaa

SEQ ID NO: 2880323 - RNA, 13 nt, Human
uuuacaggcccug

SEQ ID NO: 2880324 - RNA, 19 nt, Human
uuuacaggcccugcuccug

SEQ ID NO: 2880325 - RNA, 22 nt, Human
uuuacaggcccugcuccugcag

SEQ ID NO: 2880326 - RNA, 19 nt, Human
uuuaauagcuauggaauca

SEQ ID NO: 2880327 - RNA, 17 nt, Human
uuuaauacaguuuauuu

SEQ ID NO: 2880328 - RNA, 17 nt, Human
uuuaauagaaccauguu

SEQ ID NO: 2880329 - RNA, 20 nt, Human
uuuacacagaaacacugccu

SEQ ID NO: 2880330 - RNA, 19 nt, Human
uuuacacagaaacacugcc

SEQ ID NO: 2880331 - RNA, 15 nt, Human
uuuacacagaaacac

SEQ ID NO: 2880332 - RNA, 14 nt, Human
uuuacacagaaaca

SEQ ID NO: 2880333 - RNA, 12 nt, Human
uuuacacagaaa

SEQ ID NO: 2880334 - RNA, 14 nt, Human
uuuacacaauucuu

SEQ ID NO: 2880335 - RNA, 15 nt, Human
uuuacacaauucuua

SEQ ID NO: 2880336 - RNA, 17 nt, Human
uuuaauagucauuccaa

SEQ ID NO: 2880337 - RNA, 20 nt, Human
uuuaauagucauuccaaaua

SEQ ID NO: 2880338 - RNA, 11 nt, Human
uuuacagaaaa

SEQ ID NO: 2880339 - RNA, 12 nt, Human
uuuacagaaaaa

SEQ ID NO: 2880340 - RNA, 18 nt, Human
uuuacacucggcuuugga

SEQ ID NO: 2880341 - RNA, 11 nt, Human
uuuacacugua

SEQ ID NO: 2880342 - RNA, 13 nt, Human
uuuacacuguacc

SEQ ID NO: 2880343 - RNA, 14 nt, Human
uuuacacuguacca

SEQ ID NO: 2880344 - RNA, 20 nt, Human
uuuacaccgacuagccagga

SEQ ID NO: 2880345 - RNA, 12 nt, Human
uuuagacagagu

SEQ ID NO: 2880346 - RNA, 14 nt, Human
uuuagacaccuuca

SEQ ID NO: 2880347 - RNA, 16 nt, Human
uuuagacaccuucauu

SEQ ID NO: 2880348 - RNA, 19 nt, Human
uuuagacaccuucauuuug

SEQ ID NO: 2880349 - RNA, 14 nt, Human
uuuaguuuacucaa

SEQ ID NO: 2880350 - RNA, 13 nt, Human
uuuaguuuucucu

SEQ ID NO: 2880351 - RNA, 15 nt, Human
uuuaguuuucucuua

SEQ ID NO: 2880352 - RNA, 16 nt, Human
uuuagaaagcugacau

SEQ ID NO: 2880353 - RNA, 16 nt, Human
uuuacuuuaaacuugu

SEQ ID NO: 2880354 - RNA, 18 nt, Human
uuuacuuuaaacuugucu

SEQ ID NO: 2880355 - RNA, 20 nt, Human
uuuacuuuagaagcacagua

SEQ ID NO: 2880356 - RNA, 13 nt, Human
uuuauggccucag

SEQ ID NO: 2880357 - RNA, 12 nt, Human
uuuauggccuca

SEQ ID NO: 2880358 - RNA, 22 nt, Human
uuuauggccacauuuaauaucu

SEQ ID NO: 2880359 - RNA, 22 nt, Human
uuuauggccucagcugccucac

SEQ ID NO: 2880360 - RNA, 12 nt, Human
uuuauacaaaau

SEQ ID NO: 2880361 - RNA, 16 nt, Human
uuuauaauuuucugaa

SEQ ID NO: 2880362 - RNA, 13 nt, Human
uuuauacaaaaua

SEQ ID NO: 2880363 - RNA, 13 nt, Human
uuuauaagguuuu

SEQ ID NO: 2880364 - RNA, 17 nt, Human
uuuauaagucauuguau

SEQ ID NO: 2880365 - RNA, 19 nt, Human
uuuauaagucauuguaugu

SEQ ID NO: 2880366 - RNA, 16 nt, Human
uuuauaaguucacaaa

SEQ ID NO: 2880367 - RNA, 18 nt, Human
uuuauaaguucacaaaau

SEQ ID NO: 2880368 - RNA, 18 nt, Human
uuuauaauagcaacuuuu

SEQ ID NO: 2880369 - RNA, 14 nt, Human
uuuauaauucagua

SEQ ID NO: 2880370 - RNA, 18 nt, Human
uuuauaauucaguauguu

SEQ ID NO: 2880371 - RNA, 19 nt, Human
uuuauaauucaguauguuu

SEQ ID NO: 2880372 - RNA, 22 nt, Human
uuuauaagccaguguugccuaa

SEQ ID NO: 2880373 - RNA, 22 nt, Human
uuuauaacucaucauaaaauaa

SEQ ID NO: 2880374 - RNA, 20 nt, Human
uuuauaacucaucauaaaau

SEQ ID NO: 2880375 - RNA, 19 nt, Human
uuuauaacucaucauaaaa

SEQ ID NO: 2880376 - RNA, 18 nt, Human
uuuauaacucaucauaaa

SEQ ID NO: 2880377 - RNA, 16 nt, Human
uuuauaacucaucaua

SEQ ID NO: 2880378 - RNA, 19 nt, Human
uuuauaacuaguccuuuac

SEQ ID NO: 2880379 - RNA, 16 nt, Human
uuuauaacuauucagu

SEQ ID NO: 2880380 - RNA, 20 nt, Human
uuuauaacuauucaguugug

SEQ ID NO: 2880381 - RNA, 21 nt, Human
uuuauaacuauucaguugugu

SEQ ID NO: 2880382 - RNA, 19 nt, Human
uuuauaaaaauaaauagaa

SEQ ID NO: 2880383 - RNA, 22 nt, Human
uuuauaaaaauaaauagaaaag

SEQ ID NO: 2880384 - RNA, 23 nt, Human
uuuauaaaaauaaauagaaaagu

SEQ ID NO: 2880385 - RNA, 16 nt, Human
uuuauaagcaaauuuc

SEQ ID NO: 2880386 - RNA, 17 nt, Human
uuuauaagcaaauuuca

SEQ ID NO: 2880387 - RNA, 23 nt, Human
uuuauaagcaaauuucaaaagac

SEQ ID NO: 2880388 - RNA, 21 nt, Human
uuuauaacucaucauaaaaua

SEQ ID NO: 2880389 - RNA, 22 nt, Human
uuuauuguuuucuauuuaugcc

SEQ ID NO: 2880390 - RNA, 14 nt, Human
uuuauuuaaaagau

SEQ ID NO: 2880391 - RNA, 15 nt, Human
uuuauuuaaaagauu

SEQ ID NO: 2880392 - RNA, 17 nt, Human
uuuauuuaaaagauuca

SEQ ID NO: 2880393 - RNA, 20 nt, Human
uuuauuuacagaugaaugua

SEQ ID NO: 2880394 - RNA, 22 nt, Human
uuuauuuaaaagauucauuuuu

SEQ ID NO: 2880395 - RNA, 14 nt, Human
uuuauuuaaagcau

SEQ ID NO: 2880396 - RNA, 15 nt, Human
uuuauuuaaagcauu

SEQ ID NO: 2880397 - RNA, 15 nt, Human
uuuauugacacagaa

SEQ ID NO: 2880398 - RNA, 14 nt, Human
uuuauugacacaga

SEQ ID NO: 2880399 - RNA, 12 nt, Human
uuuauugacaau

SEQ ID NO: 2880400 - RNA, 13 nt, Human
uuuauugacacag

SEQ ID NO: 2880401 - RNA, 12 nt, Human
uuuauugacaca

SEQ ID NO: 2880402 - RNA, 22 nt, Human
uuuauuccuauauaguuuauug

SEQ ID NO: 2880403 - RNA, 14 nt, Human
uuuauuccuuguga

SEQ ID NO: 2880404 - RNA, 14 nt, Human
uuuauucucauuug

SEQ ID NO: 2880405 - RNA, 16 nt, Human
uuuauuccuguauguu

SEQ ID NO: 2880406 - RNA, 14 nt, Human
uuuauucuucuaga

SEQ ID NO: 2880407 - RNA, 18 nt, Human
uuuauucuucuagaguuc

SEQ ID NO: 2880408 - RNA, 15 nt, Human
uuuauucuucuagag

SEQ ID NO: 2880409 - RNA, 16 nt, Human
uuuauucuucuagagu

SEQ ID NO: 2880410 - RNA, 17 nt, Human
uuucaagaaacugagga

SEQ ID NO: 2880411 - RNA, 12 nt, Human
uuucaagaauga

SEQ ID NO: 2880412 - RNA, 17 nt, Human
uuucaaggaagguucau

SEQ ID NO: 2880413 - RNA, 20 nt, Human
uuucaaggaagguucaugua

SEQ ID NO: 2880414 - RNA, 22 nt, Human
uuucaaggcacucuagauucca

SEQ ID NO: 2880415 - RNA, 20 nt, Human
uuucaaggcacucuagauuc

SEQ ID NO: 2880416 - RNA, 21 nt, Human
uuucaaggcacucuagauucc

SEQ ID NO: 2880417 - RNA, 15 nt, Human
uuucaaggcacucua

SEQ ID NO: 2880418 - RNA, 17 nt, Human
uuucaaggcacucuaga

SEQ ID NO: 2880419 - RNA, 18 nt, Human
uuucaaggcacucuagau

SEQ ID NO: 2880420 - RNA, 19 nt, Human
uuucaaggcacucuagauu

SEQ ID NO: 2880421 - RNA, 11 nt, Human
uuuauuuacua

SEQ ID NO: 2880422 - RNA, 15 nt, Human
uuucaacgcagcccu

SEQ ID NO: 2880423 - RNA, 16 nt, Human
uuucaacgcagcccug

SEQ ID NO: 2880424 - RNA, 20 nt, Human
uuucaacgcagcccugcuuu

SEQ ID NO: 2880425 - RNA, 21 nt, Human
uuucaacgcagcccugcuuug

SEQ ID NO: 2880426 - RNA, 18 nt, Human
uuucaagaaaaaauaaau

SEQ ID NO: 2880427 - RNA, 21 nt, Human
uuucaagaaaaaauaaaugga

SEQ ID NO: 2880428 - RNA, 22 nt, Human
uuucaagaaaaaauaaauggaa

SEQ ID NO: 2880429 - RNA, 19 nt, Human
uuucaagaaacugaggaau

SEQ ID NO: 2880430 - RNA, 14 nt, Human
uuucaagaaccugg

SEQ ID NO: 2880431 - RNA, 15 nt, Human
uuucaagaaccugga

SEQ ID NO: 2880432 - RNA, 16 nt, Human
uuucaagaaccuggaa

SEQ ID NO: 2880433 - RNA, 17 nt, Human
uuucaagaaccuggaaa

SEQ ID NO: 2880434 - RNA, 15 nt, Human
uuucagauauauauc

SEQ ID NO: 2880435 - RNA, 16 nt, Human
uuucagauauauauca

SEQ ID NO: 2880436 - RNA, 15 nt, Human
uuucagauguaaugu

SEQ ID NO: 2880437 - RNA, 16 nt, Human
uuucagauguaauguu

SEQ ID NO: 2880438 - RNA, 17 nt, Human
uuucagauguaauguuu

SEQ ID NO: 2880439 - RNA, 18 nt, Human
uuucagauguaauguuuu

SEQ ID NO: 2880440 - RNA, 19 nt, Human
uuucagauguaauguuuuc

SEQ ID NO: 2880441 - RNA, 22 nt, Human
uuucacaaccuucuguggcuca

SEQ ID NO: 2880442 - RNA, 16 nt, Human
uuucacaaccuucugu

SEQ ID NO: 2880443 - RNA, 14 nt, Human
uuucacaaauuugu

SEQ ID NO: 2880444 - RNA, 13 nt, Human
uuucacaacauuu

SEQ ID NO: 2880445 - RNA, 23 nt, Human
uuucaagugccuuucugcaguuu

SEQ ID NO: 2880446 - RNA, 13 nt, Human
uuucaagguucua

SEQ ID NO: 2880447 - RNA, 11 nt, Human
uuucaaguagc

SEQ ID NO: 2880448 - RNA, 16 nt, Human
uuucaaguagcuggga

SEQ ID NO: 2880449 - RNA, 14 nt, Human
uuucaagguucuaa

SEQ ID NO: 2880450 - RNA, 16 nt, Human
uuucaagguucuaacc

SEQ ID NO: 2880451 - RNA, 22 nt, Human
uuuccaacaccacagacacaca

SEQ ID NO: 2880452 - RNA, 23 nt, Human
uuuccaacaccacagacacacac

SEQ ID NO: 2880453 - RNA, 15 nt, Human
uuuccaacaccacag

SEQ ID NO: 2880454 - RNA, 18 nt, Human
uuuccaacaccacagaca

SEQ ID NO: 2880455 - RNA, 20 nt, Human
uuuccaacaccacagacaca

SEQ ID NO: 2880456 - RNA, 21 nt, Human
uuuccaacaccacagacacac

SEQ ID NO: 2880457 - RNA, 14 nt, Human
uuuccaaguaauau

SEQ ID NO: 2880458 - RNA, 18 nt, Human
uuuccaaguaauauaaug

SEQ ID NO: 2880459 - RNA, 21 nt, Human
uuuccaaguaauauaauggaa

SEQ ID NO: 2880460 - RNA, 18 nt, Human
uuucauuguaugaugugu

SEQ ID NO: 2880461 - RNA, 20 nt, Human
uuucauuguaugauguguug

SEQ ID NO: 2880462 - RNA, 23 nt, Human
uuucauuguaugauguguuguga

SEQ ID NO: 2880463 - RNA, 12 nt, Human
uuucaguuccaa

SEQ ID NO: 2880464 - RNA, 13 nt, Human
uuucaguuccaag

SEQ ID NO: 2880465 - RNA, 20 nt, Human
uuucaagcagcaucuucugg

SEQ ID NO: 2880466 - RNA, 19 nt, Human
uuucaguguaguuaauuua

SEQ ID NO: 2880467 - RNA, 19 nt, Human
uuucagugaauaugccugu

SEQ ID NO: 2880468 - RNA, 15 nt, Human
uuucagauuuugaua

SEQ ID NO: 2880469 - RNA, 18 nt, Human
uuucagauuuugauaacu

SEQ ID NO: 2880470 - RNA, 20 nt, Human
uuucagauuuuuuauuugaa

SEQ ID NO: 2880471 - RNA, 20 nt, Human
uuucagauucccagagcaaa

SEQ ID NO: 2880472 - RNA, 18 nt, Human
uuguuucaaacacaaaug

SEQ ID NO: 2880473 - RNA, 14 nt, Human
uuguuucaagaacc

SEQ ID NO: 2880474 - RNA, 18 nt, Human
uuguuucaagaaccugga

SEQ ID NO: 2880475 - RNA, 20 nt, Human
uuguuucaagaaccuggaaa

SEQ ID NO: 2880476 - RNA, 13 nt, Human
uuguuuauuucau

SEQ ID NO: 2880477 - RNA, 23 nt, Human
uuguuguuugccauacuuugucu

SEQ ID NO: 2880478 - RNA, 19 nt, Human
uuguuuauugaguuuguag

SEQ ID NO: 2880479 - RNA, 24 nt, Human
uuguuuauugaguuuguagguaaa

SEQ ID NO: 2880480 - RNA, 16 nt, Human
uuguuuccucuuccaa

SEQ ID NO: 2880481 - RNA, 19 nt, Human
uuguuuccucuuccaaagu

SEQ ID NO: 2880482 - RNA, 21 nt, Human
uuguuuccucuuccaaaguaa

SEQ ID NO: 2880483 - RNA, 11 nt, Human
uuguuucagug

SEQ ID NO: 2880484 - RNA, 12 nt, Human
uuguuucaguga

SEQ ID NO: 2880485 - RNA, 22 nt, Human
uuguuucagugaauaugccugu

SEQ ID NO: 2880486 - RNA, 15 nt, Human
uuguuugccauacuu

SEQ ID NO: 2880487 - RNA, 16 nt, Human
uuguuugccauacuuu

SEQ ID NO: 2880488 - RNA, 12 nt, Human
uuguuugcugcu

SEQ ID NO: 2880489 - RNA, 14 nt, Human
uuguuugcugcuau

SEQ ID NO: 2880490 - RNA, 13 nt, Human
uuguuucuuugug

SEQ ID NO: 2880491 - RNA, 13 nt, Human
uuguuucuuuuaa

SEQ ID NO: 2880492 - RNA, 16 nt, Human
uuguuucucccccugg

SEQ ID NO: 2880493 - RNA, 15 nt, Human
uuguuucuauacaaa

SEQ ID NO: 2880494 - RNA, 23 nt, Human
uuguuucucaaaucuuggcaaua

SEQ ID NO: 2880495 - RNA, 21 nt, Human
uuguuguuugccauacuuugu

SEQ ID NO: 2880496 - RNA, 14 nt, Human
uuguuguuugccau

SEQ ID NO: 2880497 - RNA, 14 nt, Human
uuguuguuucagug

SEQ ID NO: 2880498 - RNA, 12 nt, Human
uuguuaugcuau

SEQ ID NO: 2880499 - RNA, 14 nt, Human
uuguuaugcuauua

SEQ ID NO: 2880500 - RNA, 15 nt, Human
uuguugugugugcag

SEQ ID NO: 2880501 - RNA, 11 nt, Human
uuguugugggu

SEQ ID NO: 2880502 - RNA, 22 nt, Human
uuguuguggguucuauguuuac

SEQ ID NO: 2880503 - RNA, 17 nt, Human
uuguuguguacagacuu

SEQ ID NO: 2880504 - RNA, 20 nt, Human
uuguuagcuuccuuaaguau

SEQ ID NO: 2880505 - RNA, 16 nt, Human
uuguuaucagucaaua

SEQ ID NO: 2880506 - RNA, 13 nt, Human
uuguuaucaguaa

SEQ ID NO: 2880507 - RNA, 22 nt, Human
uuguuaucagucaauauuuuua

SEQ ID NO: 2880508 - RNA, 16 nt, Human
uuguguuugguuuaca

SEQ ID NO: 2880509 - RNA, 17 nt, Human
uuguguuugguuuacau

SEQ ID NO: 2880510 - RNA, 18 nt, Human
uuguguuugguuuacauu

SEQ ID NO: 2880511 - RNA, 19 nt, Human
uuguguuugguuuacauuu

SEQ ID NO: 2880512 - RNA, 22 nt, Human
uuguuaaaaaaaaaaagauugu

SEQ ID NO: 2880513 - RNA, 23 nt, Human
uuguuaaaaaaaaaaagauugua

SEQ ID NO: 2880514 - RNA, 13 nt, Human
uuguuaaaaauaa

SEQ ID NO: 2880515 - RNA, 21 nt, Human
uuguuaaaaauaaaucccaug

SEQ ID NO: 2880516 - RNA, 16 nt, Human
uuguuaaaauaacuag

SEQ ID NO: 2880517 - RNA, 16 nt, Human
uuguuaaaauuaugaa

SEQ ID NO: 2880518 - RNA, 20 nt, Human
uuguuaaaauuaugaaucug

SEQ ID NO: 2880519 - RNA, 22 nt, Human
uuguuaaaauuaugaaucugau

SEQ ID NO: 2880520 - RNA, 17 nt, Human
uuguguuuguguauuua

SEQ ID NO: 2880521 - RNA, 20 nt, Human
uuguuaaucucuguuaugua

SEQ ID NO: 2880522 - RNA, 22 nt, Human
uuguuaaucucuguuauguacu

SEQ ID NO: 2880523 - RNA, 22 nt, Human
uuguuaacucuugucuauuuuu

SEQ ID NO: 2880524 - RNA, 18 nt, Human
uuguuaacucuugucuau

SEQ ID NO: 2880525 - RNA, 15 nt, Human
uuguuacucuuacga

SEQ ID NO: 2880526 - RNA, 19 nt, Human
uuguuacucuuacgaauau

SEQ ID NO: 2880527 - RNA, 22 nt, Human
uuguuagaaaacaaaauuuuau

SEQ ID NO: 2880528 - RNA, 19 nt, Human
uuguuagagaaaaaugcuu

SEQ ID NO: 2880529 - RNA, 16 nt, Human
uuguuagauagcugca

SEQ ID NO: 2880530 - RNA, 17 nt, Human
uuguuaauuucaguccu

SEQ ID NO: 2880531 - RNA, 12 nt, Human
uuguuacccaug

SEQ ID NO: 2880532 - RNA, 18 nt, Human
uuguuacccaugaaaaac

SEQ ID NO: 2880533 - RNA, 21 nt, Human
uuguuaccuccaacagaacua

SEQ ID NO: 2880534 - RNA, 23 nt, Human
uuguuaccuccaacagaacuaaa

SEQ ID NO: 2880535 - RNA, 22 nt, Human
uuguuacacauuaaguaaucaa

SEQ ID NO: 2880536 - RNA, 15 nt, Human
uuguuacaggaaguc

SEQ ID NO: 2880537 - RNA, 9 nt, Human
uuguuacug

SEQ ID NO: 2880538 - RNA, 10 nt, Human
uuguuacugu

SEQ ID NO: 2880539 - RNA, 11 nt, Human
uuguuacuguu

SEQ ID NO: 2880540 - RNA, 12 nt, Human
uuguuacuguuc

SEQ ID NO: 2880541 - RNA, 13 nt, Human
uuguuacuguucu

SEQ ID NO: 2880542 - RNA, 14 nt, Human
uuguuacuguucuu

SEQ ID NO: 2880543 - RNA, 15 nt, Human
uuguuacuguucuug

SEQ ID NO: 2880544 - RNA, 16 nt, Human
uuguuacuguucuugc

SEQ ID NO: 2880545 - RNA, 17 nt, Human
uuguuacuguucuugcu

SEQ ID NO: 2880546 - RNA, 18 nt, Human
uuguuacuguucuugcug

SEQ ID NO: 2880547 - RNA, 19 nt, Human
uuguuacuguucuugcugc

SEQ ID NO: 2880548 - RNA, 20 nt, Human
uuguuacuguucuugcugcu

SEQ ID NO: 2880549 - RNA, 21 nt, Human
uuguuacuguucuugcugcua

SEQ ID NO: 2880550 - RNA, 22 nt, Human
uuguuacuguucuugcugcuag

SEQ ID NO: 2880551 - RNA, 23 nt, Human
uuguuacuguucuugcugcuaga

SEQ ID NO: 2880552 - RNA, 24 nt, Human
uuguuacuguucuugcugcuagaa

SEQ ID NO: 2880553 - RNA, 13 nt, Human
uugugccagagga

SEQ ID NO: 2880554 - RNA, 22 nt, Human
uugugccaauauguauuguaaa

SEQ ID NO: 2880555 - RNA, 17 nt, Human
uugugccaauauguauu

SEQ ID NO: 2880556 - RNA, 15 nt, Human
uugugcauuuguaaa

SEQ ID NO: 2880557 - RNA, 19 nt, Human
uugugcauuuguaaaugcu

SEQ ID NO: 2880558 - RNA, 21 nt, Human
uugugccagaggaauccuggc

SEQ ID NO: 2880559 - RNA, 22 nt, Human
uugugccauagucacauggccu

SEQ ID NO: 2880560 - RNA, 21 nt, Human
uugugccagaaugcuuuagga

SEQ ID NO: 2880561 - RNA, 16 nt, Human
uugugccagaaugcuu

SEQ ID NO: 2880562 - RNA, 21 nt, Human
uugugcuucacaguagagcca

SEQ ID NO: 2880563 - RNA, 16 nt, Human
uugugcuucacaguag

SEQ ID NO: 2880564 - RNA, 18 nt, Human
uugugcuggauggagccc

SEQ ID NO: 2880565 - RNA, 15 nt, Human
uugugcuuugcucuu

SEQ ID NO: 2880566 - RNA, 19 nt, Human
uugugcuuugcucuugucc

SEQ ID NO: 2880567 - RNA, 11 nt, Human
uugugcuucuc

SEQ ID NO: 2880568 - RNA, 12 nt, Human
uugugcuucucc

SEQ ID NO: 2880569 - RNA, 14 nt, Human
uugugcuucucccc

SEQ ID NO: 2880570 - RNA, 16 nt, Human
uugugcuucuccccag

SEQ ID NO: 2880571 - RNA, 17 nt, Human
uugugcuucuccccaga

SEQ ID NO: 2880572 - RNA, 18 nt, Human
uugugcuucuccccagaa

SEQ ID NO: 2880573 - RNA, 19 nt, Human
uugugcuucuccccagaau

SEQ ID NO: 2880574 - RNA, 14 nt, Human
uugugcuagaauac

SEQ ID NO: 2880575 - RNA, 13 nt, Human
uugugcuauaaag

SEQ ID NO: 2880576 - RNA, 14 nt, Human
uugugcuauaguau

SEQ ID NO: 2880577 - RNA, 19 nt, Human
uugugcuauaguauuugau

SEQ ID NO: 2880578 - RNA, 14 nt, Human
uugugcugaugaga

SEQ ID NO: 2880579 - RNA, 11 nt, Human
uugugcugcca

SEQ ID NO: 2880580 - RNA, 12 nt, Human
uugugcugccau

SEQ ID NO: 2880581 - RNA, 14 nt, Human
uugugcugccauuu

SEQ ID NO: 2880582 - RNA, 16 nt, Human
uugugccuuuuauagc

SEQ ID NO: 2880583 - RNA, 16 nt, Human
uugugcagucaucaga

SEQ ID NO: 2880584 - RNA, 14 nt, Human
uugugcuacagaug

SEQ ID NO: 2880585 - RNA, 16 nt, Human
uugugccaauauguau

SEQ ID NO: 2880586 - RNA, 13 nt, Human
uugugcagcuuuu

SEQ ID NO: 2880587 - RNA, 17 nt, Human
uugugcagcuuuugguc

SEQ ID NO: 2880588 - RNA, 20 nt, Human
uugugaaaguuuugaguaga

SEQ ID NO: 2880589 - RNA, 23 nt, Human
uugugaaauggccaggauccucu

SEQ ID NO: 2880590 - RNA, 21 nt, Human
uugugcaaaagcuucaaauua

SEQ ID NO: 2880591 - RNA, 22 nt, Human
uugugcaaaagcuucaaauuaa

SEQ ID NO: 2880592 - RNA, 21 nt, Human
uugugcaaaauauuugacuau

SEQ ID NO: 2880593 - RNA, 16 nt, Human
uuguggacacagcucu

SEQ ID NO: 2880594 - RNA, 18 nt, Human
uuguggaaagccucugcu

SEQ ID NO: 2880595 - RNA, 16 nt, Human
uugugcuuuuccuauu

SEQ ID NO: 2880596 - RNA, 14 nt, Human
uugugcuuuuccug

SEQ ID NO: 2880597 - RNA, 15 nt, Human
uugugcuuuuccuga

SEQ ID NO: 2880598 - RNA, 21 nt, Human
uuguggaaaaugaaaauuagg

SEQ ID NO: 2880599 - RNA, 17 nt, Human
uuguggacacagcucuu

SEQ ID NO: 2880600 - RNA, 22 nt, Human
uuguggaauggagauucaguuu

SEQ ID NO: 2880601 - RNA, 21 nt, Human
uuguggaauugggagcuuggg

SEQ ID NO: 2880602 - RNA, 17 nt, Human
uuguggaccaauuauug

SEQ ID NO: 2880603 - RNA, 18 nt, Human
uuguggaccaauuauuga

SEQ ID NO: 2880604 - RNA, 15 nt, Human
uuguggauaacaaag

SEQ ID NO: 2880605 - RNA, 16 nt, Human
uuguggauaacaaaga

SEQ ID NO: 2880606 - RNA, 18 nt, Human
uuguggauaacaaagaua

SEQ ID NO: 2880607 - RNA, 18 nt, Human
uuguggauauaaaaugug

SEQ ID NO: 2880608 - RNA, 11 nt, Human
uuguguuguca

SEQ ID NO: 2880609 - RNA, 13 nt, Human
uuguguuguccuu

SEQ ID NO: 2880610 - RNA, 13 nt, Human
uuguguugugaau

SEQ ID NO: 2880611 - RNA, 12 nt, Human
uuguguugacau

SEQ ID NO: 2880612 - RNA, 13 nt, Human
uuguguugacauu

SEQ ID NO: 2880613 - RNA, 16 nt, Human
uuguguugacauuaag

SEQ ID NO: 2880614 - RNA, 12 nt, Human
uuguguuguaau

SEQ ID NO: 2880615 - RNA, 13 nt, Human
uuguguuguaauu

SEQ ID NO: 2880616 - RNA, 14 nt, Human
uuguguuguaauuc

SEQ ID NO: 2880617 - RNA, 21 nt, Human
uuguguuguaauucuucaguu

SEQ ID NO: 2880618 - RNA, 13 nt, Human
uuguguucaccuu

SEQ ID NO: 2880619 - RNA, 15 nt, Human
uuguggauuucaguu

SEQ ID NO: 2880620 - RNA, 16 nt, Human
uuguggauuucaguuu

SEQ ID NO: 2880621 - RNA, 19 nt, Human
uuguggauuucaguuuuaa

SEQ ID NO: 2880622 - RNA, 16 nt, Human
uuguguuccuuuuuau

SEQ ID NO: 2880623 - RNA, 19 nt, Human
uuguguucuucuucauauu

SEQ ID NO: 2880624 - RNA, 11 nt, Human
uugucucagaa

SEQ ID NO: 2880625 - RNA, 12 nt, Human
uugucucagaag

SEQ ID NO: 2880626 - RNA, 18 nt, Human
uugucucauuuuaaugua

SEQ ID NO: 2880627 - RNA, 20 nt, Human
uugucugaagucacugcaca

SEQ ID NO: 2880628 - RNA, 21 nt, Human
uugucugaagucacugcacag

SEQ ID NO: 2880629 - RNA, 15 nt, Human
uugucucaguuggaa

SEQ ID NO: 2880630 - RNA, 16 nt, Human
uugugaaacacagcug

SEQ ID NO: 2880631 - RNA, 17 nt, Human
uugugaaacacagcugu

SEQ ID NO: 2880632 - RNA, 18 nt, Human
uugugaaacacagcuguu

SEQ ID NO: 2880633 - RNA, 15 nt, Human
uugucuggaagaaag

SEQ ID NO: 2880634 - RNA, 16 nt, Human
uugucuguuuguuuca

SEQ ID NO: 2880635 - RNA, 17 nt, Human
uugucuguuuguuucaa

SEQ ID NO: 2880636 - RNA, 20 nt, Human
uugucuguuuguuucaagaa

SEQ ID NO: 2880637 - RNA, 19 nt, Human
uugucuuuuaaugcuucau

SEQ ID NO: 2880638 - RNA, 18 nt, Human
uugucuuuucaaaauauu

SEQ ID NO: 2880639 - RNA, 14 nt, Human
uugugaaaugaugg

SEQ ID NO: 2880640 - RNA, 15 nt, Human
uugucuaacucagaa

SEQ ID NO: 2880641 - RNA, 19 nt, Human
uugucuaacucagaauuau

SEQ ID NO: 2880642 - RNA, 20 nt, Human
uugucgggcaccagccagcg

SEQ ID NO: 2880643 - RNA, 14 nt, Human
uuguauuaacaaaa

SEQ ID NO: 2880644 - RNA, 15 nt, Human
uuguauguaucuauu

SEQ ID NO: 2880645 - RNA, 17 nt, Human
uuguauguguguagaca

SEQ ID NO: 2880646 - RNA, 20 nt, Human
uuguauggggaggcaagugu

SEQ ID NO: 2880647 - RNA, 20 nt, Human
uuguacauguaacauuaaag

SEQ ID NO: 2880648 - RNA, 17 nt, Human
uuguacauuuaugauuu

SEQ ID NO: 2880649 - RNA, 16 nt, Human
uuguacauaguuauuu

SEQ ID NO: 2880650 - RNA, 21 nt, Human
uuguacauauuuguggaauaa

SEQ ID NO: 2880651 - RNA, 16 nt, Human
uuguacaucuggcuua

SEQ ID NO: 2880652 - RNA, 17 nt, Human
uuguacaucuggcuuau

SEQ ID NO: 2880653 - RNA, 20 nt, Human
uuguacaucuggcuuauuuu

SEQ ID NO: 2880654 - RNA, 23 nt, Human
uuguacaucuggcuuauuuuaau

SEQ ID NO: 2880655 - RNA, 12 nt, Human
uuguacaugaaa

SEQ ID NO: 2880656 - RNA, 13 nt, Human
uuguacaugaaau

SEQ ID NO: 2880657 - RNA, 22 nt, Human
uuguacaugaaauuuuuguaaa

SEQ ID NO: 2880658 - RNA, 18 nt, Human
uuguacauauguaaaaua

SEQ ID NO: 2880659 - RNA, 15 nt, Human
uuguacauauuugug

SEQ ID NO: 2880660 - RNA, 20 nt, Human
uuguacauguguagccugug

SEQ ID NO: 2880661 - RNA, 21 nt, Human
uuguacauguguagccugugc

SEQ ID NO: 2880662 - RNA, 15 nt, Human
uugguccaagauucc

SEQ ID NO: 2880663 - RNA, 14 nt, Human
uuggucaggcuggu

SEQ ID NO: 2880664 - RNA, 19 nt, Human
uuggucaugugggucuucc

SEQ ID NO: 2880665 - RNA, 23 nt, Human
uuggucaugugggucuuccaggg

SEQ ID NO: 2880666 - RNA, 13 nt, Human
uugguagauuaaa

SEQ ID NO: 2880667 - RNA, 15 nt, Human
uugguagauuaaaua

SEQ ID NO: 2880668 - RNA, 18 nt, Human
uugguagauuaaauauag

SEQ ID NO: 2880669 - RNA, 13 nt, Human
uuggucuguguga

SEQ ID NO: 2880670 - RNA, 12 nt, Human
uugguccagagc

SEQ ID NO: 2880671 - RNA, 22 nt, Human
uugguccagagcggaggcugug

SEQ ID NO: 2880672 - RNA, 13 nt, Human
uuggucuuuguau

SEQ ID NO: 2880673 - RNA, 14 nt, Human
uuggucuuuguauc

SEQ ID NO: 2880674 - RNA, 22 nt, Human
uuguaaaaauuaaaaguuaugg

SEQ ID NO: 2880675 - RNA, 22 nt, Human
uuggguucaagcgauucuucug

SEQ ID NO: 2880676 - RNA, 17 nt, Human
uuggguucaugaugcag

SEQ ID NO: 2880677 - RNA, 21 nt, Human
uuggguucaugaugcagucuc

SEQ ID NO: 2880678 - RNA, 22 nt, Human
uuggguucaugaugcagucucc

SEQ ID NO: 2880679 - RNA, 15 nt, Human
uugcacuaaaguaug

SEQ ID NO: 2880680 - RNA, 19 nt, Human
uugcacuaaaguauguaaa

SEQ ID NO: 2880681 - RNA, 18 nt, Human
uugcacgcgcccuuucua

SEQ ID NO: 2880682 - RNA, 20 nt, Human
uugcacgcgcccuuucuacc

SEQ ID NO: 2880683 - RNA, 14 nt, Human
uugcacggcugcug

SEQ ID NO: 2880684 - RNA, 15 nt, Human
uugcacggcugcuga

SEQ ID NO: 2880685 - RNA, 17 nt, Human
uuguaaauagcucaggu

SEQ ID NO: 2880686 - RNA, 17 nt, Human
uuguaaauaguauuuga

SEQ ID NO: 2880687 - RNA, 16 nt, Human
uuguaaaugugguaaa

SEQ ID NO: 2880688 - RNA, 21 nt, Human
uuguaaaugugguaaagaguu

SEQ ID NO: 2880689 - RNA, 15 nt, Human
uuguaaauaccagga

SEQ ID NO: 2880690 - RNA, 21 nt, Human
uuguaaaauagcuuguauagu

SEQ ID NO: 2880691 - RNA, 15 nt, Human
uuguaaaauagcuug

SEQ ID NO: 2880692 - RNA, 14 nt, Human
uuguaaaacuacac

SEQ ID NO: 2880693 - RNA, 21 nt, Human
uuguaaaaccugucaaugaua

SEQ ID NO: 2880694 - RNA, 23 nt, Human
uuguaaaaccugucaaugauaca

SEQ ID NO: 2880695 - RNA, 20 nt, Human
uuguaaaaccugucaaugau

SEQ ID NO: 2880696 - RNA, 20 nt, Human
uuguaaauuaggaggcucaa

SEQ ID NO: 2880697 - RNA, 12 nt, Human
uuguaaauuaua

SEQ ID NO: 2880698 - RNA, 14 nt, Human
uuguaaauuauauu

SEQ ID NO: 2880699 - RNA, 15 nt, Human
uuguaaauuauauuu

SEQ ID NO: 2880700 - RNA, 16 nt, Human
uuguaaauuauauuug

SEQ ID NO: 2880701 - RNA, 17 nt, Human
uuguaaauuauauuugu

SEQ ID NO: 2880702 - RNA, 20 nt, Human
uuguaaauuauauuugugcu

SEQ ID NO: 2880703 - RNA, 20 nt, Human
uuguaaauguguuggacaaa

SEQ ID NO: 2880704 - RNA, 22 nt, Human
uuguaaauguguuggacaaaug

SEQ ID NO: 2880705 - RNA, 12 nt, Human
uuguaaauguua

SEQ ID NO: 2880706 - RNA, 13 nt, Human
uuguaaauguuau

SEQ ID NO: 2880707 - RNA, 14 nt, Human
uuguaaauguuauu

SEQ ID NO: 2880708 - RNA, 17 nt, Human
uuguaaauguuauuucu

SEQ ID NO: 2880709 - RNA, 18 nt, Human
uuguaaauguuauuucug

SEQ ID NO: 2880710 - RNA, 19 nt, Human
uuguaaauguuauuucugc

SEQ ID NO: 2880711 - RNA, 21 nt, Human
uuguaaauuaaacauaaaaca

SEQ ID NO: 2880712 - RNA, 22 nt, Human
uuguaaauuaaacauaaaacaa

SEQ ID NO: 2880713 - RNA, 23 nt, Human
uuauggaauugauuugcauugaa

SEQ ID NO: 2880714 - RNA, 14 nt, Human
uuauggagaccucu

SEQ ID NO: 2880715 - RNA, 19 nt, Human
uuauggagaccucuccuuc

SEQ ID NO: 2880716 - RNA, 21 nt, Human
uuauggagaccucuccuuccu

SEQ ID NO: 2880717 - RNA, 21 nt, Human
uuauggaauugauuugcauug

SEQ ID NO: 2880718 - RNA, 20 nt, Human
uuauggaauugauuugcauu

SEQ ID NO: 2880719 - RNA, 11 nt, Human
uuauggaugca

SEQ ID NO: 2880720 - RNA, 15 nt, Human
uuauguuguuagaga

SEQ ID NO: 2880721 - RNA, 16 nt, Human
uuauguuguuagagaa

SEQ ID NO: 2880722 - RNA, 23 nt, Human
uuauggaagauaguuuucuccuu

SEQ ID NO: 2880723 - RNA, 12 nt, Human
uuauguuugaau

SEQ ID NO: 2880724 - RNA, 13 nt, Human
uuauguuugaaua

SEQ ID NO: 2880725 - RNA, 14 nt, Human
uuauguuugaauau

SEQ ID NO: 2880726 - RNA, 15 nt, Human
uuauguuugaauaug

SEQ ID NO: 2880727 - RNA, 19 nt, Human
uuauggaauugauuugcau

SEQ ID NO: 2880728 - RNA, 14 nt, Human
uuauggaauugauu

SEQ ID NO: 2880729 - RNA, 17 nt, Human
uuaugauuuaauaaaau

SEQ ID NO: 2880730 - RNA, 14 nt, Human
uuaugcaaaaugga

SEQ ID NO: 2880731 - RNA, 13 nt, Human
uuaugauuuaaua

SEQ ID NO: 2880732 - RNA, 15 nt, Human
uuaugauuuaauaaa

SEQ ID NO: 2880733 - RNA, 20 nt, Human
uuaugauuuaauaaaauaau

SEQ ID NO: 2880734 - RNA, 13 nt, Human
uuaugauuugggu

SEQ ID NO: 2880735 - RNA, 14 nt, Human
uuaugauuuucaua

SEQ ID NO: 2880736 - RNA, 18 nt, Human
uuaugauuuucauaacuu

SEQ ID NO: 2880737 - RNA, 19 nt, Human
uuaugauuuucauaacuua

SEQ ID NO: 2880738 - RNA, 18 nt, Human
uuauuaauauuuaacauu

SEQ ID NO: 2880739 - RNA, 11 nt, Human
uuauuaauauu

SEQ ID NO: 2880740 - RNA, 22 nt, Human
uuauuaaguucucaaugugaaa

SEQ ID NO: 2880741 - RNA, 19 nt, Human
uuauuacccccuccuucag

SEQ ID NO: 2880742 - RNA, 20 nt, Human
uuauuacccccuccuucaga

SEQ ID NO: 2880743 - RNA, 22 nt, Human
uuauuacccccuccuucagaca

SEQ ID NO: 2880744 - RNA, 20 nt, Human
uuauuacuuguugcaaaggu

SEQ ID NO: 2880745 - RNA, 15 nt, Human
uuauuaacuacauuu

SEQ ID NO: 2880746 - RNA, 16 nt, Human
uuauuaacuacauuua

SEQ ID NO: 2880747 - RNA, 18 nt, Human
uuauuaacuacauuuaug

SEQ ID NO: 2880748 - RNA, 22 nt, Human
uuauguuuuuuaaaauauuuau

SEQ ID NO: 2880749 - RNA, 18 nt, Human
uuaucuucucaaguucua

SEQ ID NO: 2880750 - RNA, 19 nt, Human
uuaucuucucaaguucuaa

SEQ ID NO: 2880751 - RNA, 22 nt, Human
uuaucuucucaaguucuaagau

SEQ ID NO: 2880752 - RNA, 20 nt, Human
uuaucuauucugagaaaaca

SEQ ID NO: 2880753 - RNA, 16 nt, Human
uuaucucacuugugcc

SEQ ID NO: 2880754 - RNA, 17 nt, Human
uuaucucagucaugcau

SEQ ID NO: 2880755 - RNA, 19 nt, Human
uuaucucagucaugcauaa

SEQ ID NO: 2880756 - RNA, 20 nt, Human
uuaucucagucaugcauaaa

SEQ ID NO: 2880757 - RNA, 18 nt, Human
uuaucuuauacuguacaa

SEQ ID NO: 2880758 - RNA, 20 nt, Human
uuaucuuauacuguacaaua

SEQ ID NO: 2880759 - RNA, 21 nt, Human
uuaucuuauacuguacaauaa

SEQ ID NO: 2880760 - RNA, 22 nt, Human
uuaucuuauacuguacaauaaa

SEQ ID NO: 2880761 - RNA, 15 nt, Human
uuaucuguucuuuug

SEQ ID NO: 2880762 - RNA, 19 nt, Human
uuaucuguuuaaagcauau

SEQ ID NO: 2880763 - RNA, 14 nt, Human
uuaucucuauuuaa

SEQ ID NO: 2880764 - RNA, 15 nt, Human
uuaucucuauuuaau

SEQ ID NO: 2880765 - RNA, 21 nt, Human
uuaucucagucaugcauaaau

SEQ ID NO: 2880766 - RNA, 22 nt, Human
uuaucucagucaugcauaaaua

SEQ ID NO: 2880767 - RNA, 14 nt, Human
uuaucuaaauuaaa

SEQ ID NO: 2880768 - RNA, 15 nt, Human
uuaucuaaauuaaag

SEQ ID NO: 2880769 - RNA, 15 nt, Human
uuaucuaagaauaca

SEQ ID NO: 2880770 - RNA, 17 nt, Human
uuaucuaagaauacagc

SEQ ID NO: 2880771 - RNA, 19 nt, Human
uuaucuaagaauacagcuu

SEQ ID NO: 2880772 - RNA, 19 nt, Human
uuaucuaauaccucugugu

SEQ ID NO: 2880773 - RNA, 22 nt, Human
uuaucgaaauaacaauguuaag

SEQ ID NO: 2880774 - RNA, 19 nt, Human
uuaucgaaauaacaauguu

SEQ ID NO: 2880775 - RNA, 21 nt, Human
uuaucgaaauaacaauguuaa

SEQ ID NO: 2880776 - RNA, 20 nt, Human
uuaucuaauaccucugugug

SEQ ID NO: 2880777 - RNA, 21 nt, Human
uuaucuacccaagggcagaaa

SEQ ID NO: 2880778 - RNA, 23 nt, Human
uuaucuacccaagggcagaaagu

SEQ ID NO: 2880779 - RNA, 18 nt, Human
uuaucuauagcuaaguac

SEQ ID NO: 2880780 - RNA, 12 nt, Human
uuauauugaaaa

SEQ ID NO: 2880781 - RNA, 14 nt, Human
uuauauugaaaaaa

SEQ ID NO: 2880782 - RNA, 15 nt, Human
uuauauugaagacaa

SEQ ID NO: 2880783 - RNA, 16 nt, Human
uuauauugaagacaau

SEQ ID NO: 2880784 - RNA, 20 nt, Human
uuauauugaagacaauuuga

SEQ ID NO: 2880785 - RNA, 22 nt, Human
uuauauugaagacaauuugaua

SEQ ID NO: 2880786 - RNA, 13 nt, Human
uuauauuuaucca

SEQ ID NO: 2880787 - RNA, 19 nt, Human
uuauauuuaguuauaguuu

SEQ ID NO: 2880788 - RNA, 22 nt, Human
uuauauuuaguuauaguuucag

SEQ ID NO: 2880789 - RNA, 17 nt, Human
uuauauuuaguuauagu

SEQ ID NO: 2880790 - RNA, 18 nt, Human
uuauauuuaguuauaguu

SEQ ID NO: 2880791 - RNA, 11 nt, Human
uuauauuuaau

SEQ ID NO: 2880792 - RNA, 16 nt, Human
uuauauuuaauuauua

SEQ ID NO: 2880793 - RNA, 20 nt, Human
uuauauuucccuaaaauaca

SEQ ID NO: 2880794 - RNA, 22 nt, Human
uuauauuucccuaaaauacauu

SEQ ID NO: 2880795 - RNA, 23 nt, Human
uuauauuucccuaaaauacauuu

SEQ ID NO: 2880796 - RNA, 11 nt, Human
uuauauuucag

SEQ ID NO: 2880797 - RNA, 15 nt, Human
uuauauuucagaugu

SEQ ID NO: 2880798 - RNA, 21 nt, Human
uuauauuucagauguaauguu

SEQ ID NO: 2880799 - RNA, 22 nt, Human
uuauauuucagauguaauguuu

SEQ ID NO: 2880800 - RNA, 13 nt, Human
uuaucccugccca

SEQ ID NO: 2880801 - RNA, 19 nt, Human
uuauccuaaaacaaauagu

SEQ ID NO: 2880802 - RNA, 20 nt, Human
uuauccuagauuauaucaaa

SEQ ID NO: 2880803 - RNA, 22 nt, Human
uuauccuagauuauaucaaagu

SEQ ID NO: 2880804 - RNA, 18 nt, Human
uuauccuagcacaugcuu

SEQ ID NO: 2880805 - RNA, 20 nt, Human
uuauccuagcacaugcuuca

SEQ ID NO: 2880806 - RNA, 21 nt, Human
uuauccuagcacaugcuucaa

SEQ ID NO: 2880807 - RNA, 13 nt, Human
uuauccuauuuca

SEQ ID NO: 2880808 - RNA, 16 nt, Human
uuauccugaaauuuca

SEQ ID NO: 2880809 - RNA, 13 nt, Human
uuaucgaaauaac

SEQ ID NO: 2880810 - RNA, 14 nt, Human
uuaucgaaauaaca

SEQ ID NO: 2880811 - RNA, 15 nt, Human
uuaucgaaauaacaa

SEQ ID NO: 2880812 - RNA, 17 nt, Human
uuauccugaaauuucag

SEQ ID NO: 2880813 - RNA, 22 nt, Human
uuauccugaacucuucugcaaa

SEQ ID NO: 2880814 - RNA, 13 nt, Human
uuauccugcauug

SEQ ID NO: 2880815 - RNA, 16 nt, Human
uuauccugcauuguua

SEQ ID NO: 2880816 - RNA, 14 nt, Human
uuauaauucaguau

SEQ ID NO: 2880817 - RNA, 22 nt, Human
uuauaauucaguauguuuuaca

SEQ ID NO: 2880818 - RNA, 19 nt, Human
uuauaauaaaggacuguaa

SEQ ID NO: 2880819 - RNA, 18 nt, Human
uuauaauaaaggacugua

SEQ ID NO: 2880820 - RNA, 14 nt, Human
uuauaauacucugu

SEQ ID NO: 2880821 - RNA, 15 nt, Human
uuauaauacucuguu

SEQ ID NO: 2880822 - RNA, 21 nt, Human
uuauaauaaaggacuguaauc

SEQ ID NO: 2880823 - RNA, 11 nt, Human
uuauaauagca

SEQ ID NO: 2880824 - RNA, 12 nt, Human
uuaguggcuuca

SEQ ID NO: 2880825 - RNA, 15 nt, Human
uuagugggccagggc

SEQ ID NO: 2880826 - RNA, 16 nt, Human
uuagugggccagggcu

SEQ ID NO: 2880827 - RNA, 19 nt, Human
uuagugguuuaucagcaaa

SEQ ID NO: 2880828 - RNA, 15 nt, Human
uuaguguaauaagac

SEQ ID NO: 2880829 - RNA, 12 nt, Human
uuauaagacucu

SEQ ID NO: 2880830 - RNA, 13 nt, Human
uuauaagacucuc

SEQ ID NO: 2880831 - RNA, 14 nt, Human
uuauaagacucuca

SEQ ID NO: 2880832 - RNA, 20 nt, Human
uuauaagacucucacacuca

SEQ ID NO: 2880833 - RNA, 23 nt, Human
uuauaagcaaauuucaaaagaca

SEQ ID NO: 2880834 - RNA, 14 nt, Human
uuagugccagaauu

SEQ ID NO: 2880835 - RNA, 12 nt, Human
uuauaagcauug

SEQ ID NO: 2880836 - RNA, 13 nt, Human
uuauaagcauuga

SEQ ID NO: 2880837 - RNA, 15 nt, Human
uuauaagcauugaaa

SEQ ID NO: 2880838 - RNA, 17 nt, Human
uuauaagcauugaaauu

SEQ ID NO: 2880839 - RNA, 18 nt, Human
uuauaagcauugaaauua

SEQ ID NO: 2880840 - RNA, 14 nt, Human
uuauaagguguuuu

SEQ ID NO: 2880841 - RNA, 20 nt, Human
uuauaagguguuuucugugu

SEQ ID NO: 2880842 - RNA, 21 nt, Human
uuauaagguguuuucugugua

SEQ ID NO: 2880843 - RNA, 22 nt, Human
uuauaagguguuuucuguguaa

SEQ ID NO: 2880844 - RNA, 23 nt, Human
uuauaagguguuuucuguguaac

SEQ ID NO: 2880845 - RNA, 17 nt, Human
uuauaagugaagugaua

SEQ ID NO: 2880846 - RNA, 15 nt, Human
uuauaaguucacaaa

SEQ ID NO: 2880847 - RNA, 17 nt, Human
uuauaaguucacaaaau

SEQ ID NO: 2880848 - RNA, 16 nt, Human
uuauaagucacaaaga

SEQ ID NO: 2880849 - RNA, 18 nt, Human
uuauaagucauuguaugu

SEQ ID NO: 2880850 - RNA, 18 nt, Human
uuauaaguagcaggccaa

SEQ ID NO: 2880851 - RNA, 14 nt, Human
uuagugcauccagu

SEQ ID NO: 2880852 - RNA, 14 nt, Human
uuagugcaucuuug

SEQ ID NO: 2880853 - RNA, 20 nt, Human
uuagugcaucuuugccucuc

SEQ ID NO: 2880854 - RNA, 14 nt, Human
uuagugccugugug

SEQ ID NO: 2880855 - RNA, 15 nt, Human
uuagugacaaaauag

SEQ ID NO: 2880856 - RNA, 14 nt, Human
uuagugaguuauuc

SEQ ID NO: 2880857 - RNA, 14 nt, Human
uuagugauauuucu

SEQ ID NO: 2880858 - RNA, 16 nt, Human
uuagugauauuucucu

SEQ ID NO: 2880859 - RNA, 17 nt, Human
uuagugauauuucucua

SEQ ID NO: 2880860 - RNA, 18 nt, Human
uuagugauauuucucuag

SEQ ID NO: 2880861 - RNA, 19 nt, Human
uuagugauauuucucuagu

SEQ ID NO: 2880862 - RNA, 23 nt, Human
uuagugauauuucucuaguaguu

SEQ ID NO: 2880863 - RNA, 17 nt, Human
uuagugaucuuagcaua

SEQ ID NO: 2880864 - RNA, 22 nt, Human
uuagucuuagggauuuauuuuc

SEQ ID NO: 2880865 - RNA, 19 nt, Human
uuagugaccucagcuuuga

SEQ ID NO: 2880866 - RNA, 17 nt, Human
uuagucucuuuauuccu

SEQ ID NO: 2880867 - RNA, 20 nt, Human
uuagucucuuuauuccuagu

SEQ ID NO: 2880868 - RNA, 19 nt, Human
uuauacaaaauaagaacga

SEQ ID NO: 2880869 - RNA, 12 nt, Human
uuauaauuuucu

SEQ ID NO: 2880870 - RNA, 15 nt, Human
uuauaauuuucugaa

SEQ ID NO: 2880871 - RNA, 18 nt, Human
uuauacagcucagcuuuu

SEQ ID NO: 2880872 - RNA, 20 nt, Human
uuauacagauagaguuccau

SEQ ID NO: 2880873 - RNA, 22 nt, Human
uuauacagauagaguuccauau

SEQ ID NO: 2880874 - RNA, 21 nt, Human
uuauacaaaccuaccaaaaug

SEQ ID NO: 2880875 - RNA, 20 nt, Human
uuauacaaaccuaccaaaau

SEQ ID NO: 2880876 - RNA, 18 nt, Human
uuauacaaauuaaaaaga

SEQ ID NO: 2880877 - RNA, 19 nt, Human
uuauacaaauuaaaaagau

SEQ ID NO: 2880878 - RNA, 15 nt, Human
uuauacaauaucauc

SEQ ID NO: 2880879 - RNA, 15 nt, Human
uuauaucauauguau

SEQ ID NO: 2880880 - RNA, 16 nt, Human
uuauaucauauguaua

SEQ ID NO: 2880881 - RNA, 20 nt, Human
uuauauauuuauaacucauc

SEQ ID NO: 2880882 - RNA, 15 nt, Human
uuauauauuuauaac

SEQ ID NO: 2880883 - RNA, 14 nt, Human
uuauauauuuauaa

SEQ ID NO: 2880884 - RNA, 13 nt, Human
uuauauauuuaua

SEQ ID NO: 2880885 - RNA, 23 nt, Human
uuauauauuuauaacucaucaua

SEQ ID NO: 2880886 - RNA, 12 nt, Human
uuauaucaaagu

SEQ ID NO: 2880887 - RNA, 13 nt, Human
uuauaucaaagua

SEQ ID NO: 2880888 - RNA, 14 nt, Human
uuauaucaaaguau

SEQ ID NO: 2880889 - RNA, 15 nt, Human
uuauaucaaaguauu

SEQ ID NO: 2880890 - RNA, 14 nt, Human
uuauauccccugcu

SEQ ID NO: 2880891 - RNA, 11 nt, Human
uuauaucugua

SEQ ID NO: 2880892 - RNA, 17 nt, Human
uuauaucuguacaauga

SEQ ID NO: 2880893 - RNA, 13 nt, Human
uuauaucuguaug

SEQ ID NO: 2880894 - RNA, 14 nt, Human
uuauaucuguaugu

SEQ ID NO: 2880895 - RNA, 22 nt, Human
uuauaucuguggucuucaaauu

SEQ ID NO: 2880896 - RNA, 20 nt, Human
uuauauuaguugcuuuguua

SEQ ID NO: 2880897 - RNA, 19 nt, Human
uuauauuaauguacuuguu

SEQ ID NO: 2880898 - RNA, 11 nt, Human
uuauauucaac

SEQ ID NO: 2880899 - RNA, 14 nt, Human
uuauauucaaccau

SEQ ID NO: 2880900 - RNA, 15 nt, Human
uuauauucaaccaug

SEQ ID NO: 2880901 - RNA, 16 nt, Human
uuauauucaaccaugg

SEQ ID NO: 2880902 - RNA, 17 nt, Human
uuauauucaaccaugga

SEQ ID NO: 2880903 - RNA, 23 nt, Human
uuauauucaaccauggacuuuau

SEQ ID NO: 2880904 - RNA, 14 nt, Human
uuauauguacuguu

SEQ ID NO: 2880905 - RNA, 13 nt, Human
uuauauguguuga

SEQ ID NO: 2880906 - RNA, 14 nt, Human
uuauauguguugaa

SEQ ID NO: 2880907 - RNA, 19 nt, Human
uuauauguguugaaaacca

SEQ ID NO: 2880908 - RNA, 19 nt, Human
uuauauguacaugagaagg

SEQ ID NO: 2880909 - RNA, 16 nt, Human
uuauauguacaugaga

SEQ ID NO: 2880910 - RNA, 20 nt, Human
uuauauggaugauucagaaa

SEQ ID NO: 2880911 - RNA, 22 nt, Human
uuauauggaugauucagaaauu

SEQ ID NO: 2880912 - RNA, 16 nt, Human
uuauauguaccguagg

SEQ ID NO: 2880913 - RNA, 14 nt, Human
uuauauguaccgua

SEQ ID NO: 2880914 - RNA, 17 nt, Human
uucagauacaaacugca

SEQ ID NO: 2880915 - RNA, 14 nt, Human
uucagcucacugca

SEQ ID NO: 2880916 - RNA, 14 nt, Human
uucacgcaacuuga

SEQ ID NO: 2880917 - RNA, 16 nt, Human
uucacgcaacuugaaa

SEQ ID NO: 2880918 - RNA, 22 nt, Human
uucacgcaacuugaaauuauau

SEQ ID NO: 2880919 - RNA, 13 nt, Human
uucaccuccucgc

SEQ ID NO: 2880920 - RNA, 13 nt, Human
uucaccuccuuca

SEQ ID NO: 2880921 - RNA, 15 nt, Human
uucaccuccuucaau

SEQ ID NO: 2880922 - RNA, 14 nt, Human
uucaccuuuguagc

SEQ ID NO: 2880923 - RNA, 13 nt, Human
uucaauaaaucuu

SEQ ID NO: 2880924 - RNA, 19 nt, Human
uucaauaaaucuuuggaaa

SEQ ID NO: 2880925 - RNA, 13 nt, Human
uucaauacaaaca

SEQ ID NO: 2880926 - RNA, 22 nt, Human
uucaauacaaacaaucucuuaa

SEQ ID NO: 2880927 - RNA, 23 nt, Human
uucaauacaaacaaucucuuaaa

SEQ ID NO: 2880928 - RNA, 18 nt, Human
uucaauaguucaaggaac

SEQ ID NO: 2880929 - RNA, 14 nt, Human
uucaauauugacau

SEQ ID NO: 2880930 - RNA, 15 nt, Human
uucaauauugacauu

SEQ ID NO: 2880931 - RNA, 16 nt, Human
uucaauauugacauuu

SEQ ID NO: 2880932 - RNA, 17 nt, Human
uucaauauugacauuug

SEQ ID NO: 2880933 - RNA, 18 nt, Human
uucaauauugacauuugu

SEQ ID NO: 2880934 - RNA, 19 nt, Human
uucaauauugacauuugua

SEQ ID NO: 2880935 - RNA, 21 nt, Human
uucaauauugacauuuguagu

SEQ ID NO: 2880936 - RNA, 22 nt, Human
uucaauauugacauuuguaguu

SEQ ID NO: 2880937 - RNA, 17 nt, Human
uucacaaacuuuuauac

SEQ ID NO: 2880938 - RNA, 16 nt, Human
uucacaaacuuuuaua

SEQ ID NO: 2880939 - RNA, 13 nt, Human
uucacaaauaaua

SEQ ID NO: 2880940 - RNA, 22 nt, Human
uucacaaacuuuuauacucuuu

SEQ ID NO: 2880941 - RNA, 12 nt, Human
uucacaaccugg

SEQ ID NO: 2880942 - RNA, 18 nt, Human
uucacccuuaacccaagg

SEQ ID NO: 2880943 - RNA, 22 nt, Human
uucacccuuaacccaaggagca

SEQ ID NO: 2880944 - RNA, 14 nt, Human
uucaccgaggacau

SEQ ID NO: 2880945 - RNA, 16 nt, Human
uucaccuaagagauuc

SEQ ID NO: 2880946 - RNA, 19 nt, Human
uucaccuaagagauucuga

SEQ ID NO: 2880947 - RNA, 20 nt, Human
uucaccuaagagauucugau

SEQ ID NO: 2880948 - RNA, 19 nt, Human
uucaccuaagucucuguga

SEQ ID NO: 2880949 - RNA, 17 nt, Human
uucaccuaagucucugu

SEQ ID NO: 2880950 - RNA, 21 nt, Human
uucaccuaagucucugugaau

SEQ ID NO: 2880951 - RNA, 18 nt, Human
uucaccuaccgaguucaa

SEQ ID NO: 2880952 - RNA, 13 nt, Human
uucacccucugua

SEQ ID NO: 2880953 - RNA, 21 nt, Human
uucacaaccuucuguggcuca

SEQ ID NO: 2880954 - RNA, 19 nt, Human
uuauuuguuuuucauucau

SEQ ID NO: 2880955 - RNA, 17 nt, Human
uuauuuuaaaaaaugaa

SEQ ID NO: 2880956 - RNA, 14 nt, Human
uuauuuuaaacaaa

SEQ ID NO: 2880957 - RNA, 16 nt, Human
uuauuuuaaacaaaau

SEQ ID NO: 2880958 - RNA, 22 nt, Human
uuauuuguguuuuaauuuaaac

SEQ ID NO: 2880959 - RNA, 13 nt, Human
uuauuuguguaau

SEQ ID NO: 2880960 - RNA, 16 nt, Human
uuauuuguguaauaga

SEQ ID NO: 2880961 - RNA, 21 nt, Human
uuauuuguguaauagaaaacu

SEQ ID NO: 2880962 - RNA, 18 nt, Human
uuauuuguuauuuucagu

SEQ ID NO: 2880963 - RNA, 22 nt, Human
uuauuuggcaguuugguauuug

SEQ ID NO: 2880964 - RNA, 11 nt, Human
uuauuagauga

SEQ ID NO: 2880965 - RNA, 12 nt, Human
uuauuagaugaa

SEQ ID NO: 2880966 - RNA, 13 nt, Human
uuauuagaugaau

SEQ ID NO: 2880967 - RNA, 22 nt, Human
uuauuucugcauauguugaaua

SEQ ID NO: 2880968 - RNA, 12 nt, Human
uuauuucuguca

SEQ ID NO: 2880969 - RNA, 16 nt, Human
uuauuucugucauuca

SEQ ID NO: 2880970 - RNA, 15 nt, Human
uuauuugacuuuaau

SEQ ID NO: 2880971 - RNA, 12 nt, Human
uuauuucuucaa

SEQ ID NO: 2880972 - RNA, 20 nt, Human
uuauuaguaaaugcuuauca

SEQ ID NO: 2880973 - RNA, 19 nt, Human
uucaaaucguuuauuucac

SEQ ID NO: 2880974 - RNA, 22 nt, Human
uucaaaugauuuuuacaaguuu

SEQ ID NO: 2880975 - RNA, 19 nt, Human
uucaaaugggcugcugcuu

SEQ ID NO: 2880976 - RNA, 16 nt, Human
uucaaauggguuuucc

SEQ ID NO: 2880977 - RNA, 21 nt, Human
uucaaauggguuuuccacgcu

SEQ ID NO: 2880978 - RNA, 19 nt, Human
uuauuuugugcucauuuaa

SEQ ID NO: 2880979 - RNA, 12 nt, Human
uuauuuuguaau

SEQ ID NO: 2880980 - RNA, 13 nt, Human
uuauuuuguaauu

SEQ ID NO: 2880981 - RNA, 14 nt, Human
uuauuuuguaauua

SEQ ID NO: 2880982 - RNA, 17 nt, Human
uuauuuuguaauuauga

SEQ ID NO: 2880983 - RNA, 17 nt, Human
uuauuuuaaacaaaaua

SEQ ID NO: 2880984 - RNA, 13 nt, Human
uuauuuuauuugu

SEQ ID NO: 2880985 - RNA, 13 nt, Human
uuauuuuaaugug

SEQ ID NO: 2880986 - RNA, 14 nt, Human
uuauuuuaauguga

SEQ ID NO: 2880987 - RNA, 16 nt, Human
uuauuuuaaugugaug

SEQ ID NO: 2880988 - RNA, 17 nt, Human
uuauuuuaaugugauga

SEQ ID NO: 2880989 - RNA, 18 nt, Human
uuauuuuaaugugaugau

SEQ ID NO: 2880990 - RNA, 23 nt, Human
uuauuuuaaugugaugauguaau

SEQ ID NO: 2880991 - RNA, 18 nt, Human
uuauuuucaagaaacuga

SEQ ID NO: 2880992 - RNA, 15 nt, Human
uuauuuucaaguagc

SEQ ID NO: 2880993 - RNA, 16 nt, Human
uuauuuucaaguagcu

SEQ ID NO: 2880994 - RNA, 15 nt, Human
uuauuuucacccucu

SEQ ID NO: 2880995 - RNA, 15 nt, Human
uuauuuuggggucuc

SEQ ID NO: 2880996 - RNA, 19 nt, Human
uuauuuuggaaagaagaaa

SEQ ID NO: 2880997 - RNA, 14 nt, Human
uucaaaugugcugu

SEQ ID NO: 2880998 - RNA, 18 nt, Human
uucaaauuggacuuucaa

SEQ ID NO: 2880999 - RNA, 19 nt, Human
uucaaauuggacuuucaaa

SEQ ID NO: 2881000 - RNA, 14 nt, Human
uucaacauccugcc

SEQ ID NO: 2881001 - RNA, 15 nt, Human
uucaacauccugcca

SEQ ID NO: 2881002 - RNA, 17 nt, Human
uucaacauccugccagc

SEQ ID NO: 2881003 - RNA, 21 nt, Human
uucaacauccugccagcccca

SEQ ID NO: 2881004 - RNA, 16 nt, Human
uucaauaauaaauauu

SEQ ID NO: 2881005 - RNA, 18 nt, Human
uucaauaaaugucuguug

SEQ ID NO: 2881006 - RNA, 19 nt, Human
uucaauaaaugucuguuga

SEQ ID NO: 2881007 - RNA, 14 nt, Human
uucaaccagauaac

SEQ ID NO: 2881008 - RNA, 14 nt, Human
uucaaccauggacu

SEQ ID NO: 2881009 - RNA, 15 nt, Human
uucaaccauggacuu

SEQ ID NO: 2881010 - RNA, 21 nt, Human
uucaaccauggacuuuauaag

SEQ ID NO: 2881011 - RNA, 19 nt, Human
uuccagaggcuauuauuuu

SEQ ID NO: 2881012 - RNA, 20 nt, Human
uuccagaggcuauuauuuuc

SEQ ID NO: 2881013 - RNA, 18 nt, Human
uuccagauaaccagcugu

SEQ ID NO: 2881014 - RNA, 20 nt, Human
uuccagacuuccuugagaca

SEQ ID NO: 2881015 - RNA, 23 nt, Human
uuccagacugcuuccaauuuucu

SEQ ID NO: 2881016 - RNA, 22 nt, Human
uuccaacguuuggaagauccug

SEQ ID NO: 2881017 - RNA, 23 nt, Human
uuccagaagaagagaagcugcug

SEQ ID NO: 2881018 - RNA, 15 nt, Human
uuccagaaugcugua

SEQ ID NO: 2881019 - RNA, 14 nt, Human
uuccagaaugcugu

SEQ ID NO: 2881020 - RNA, 18 nt, Human
uuccagaaugcuguacau

SEQ ID NO: 2881021 - RNA, 16 nt, Human
uuccagaaugcuguac

SEQ ID NO: 2881022 - RNA, 19 nt, Human
uuccagaaugcuguacauc

SEQ ID NO: 2881023 - RNA, 16 nt, Human
uuccaugcuaagcaag

SEQ ID NO: 2881024 - RNA, 17 nt, Human
uuccauccauaaaucca

SEQ ID NO: 2881025 - RNA, 23 nt, Human
uuccauccauaaauccaguucua

SEQ ID NO: 2881026 - RNA, 18 nt, Human
uuccaucccaaccagugc

SEQ ID NO: 2881027 - RNA, 20 nt, Human
uuccaucccaaccagugcca

SEQ ID NO: 2881028 - RNA, 23 nt, Human
uuccaucccaaccagugccaagg

SEQ ID NO: 2881029 - RNA, 18 nt, Human
uuccagaucacugccaca

SEQ ID NO: 2881030 - RNA, 23 nt, Human
uuccagauaaccagcuguaacac

SEQ ID NO: 2881031 - RNA, 13 nt, Human
uuccauaguuuug

SEQ ID NO: 2881032 - RNA, 22 nt, Human
uuccauaguuuugaugacuggc

SEQ ID NO: 2881033 - RNA, 23 nt, Human
uuccauaguuuugaugacuggca

SEQ ID NO: 2881034 - RNA, 15 nt, Human
uuccauauauccuuu

SEQ ID NO: 2881035 - RNA, 18 nt, Human
uuccauauauccuuuucu

SEQ ID NO: 2881036 - RNA, 15 nt, Human
uuccauaucuugcga

SEQ ID NO: 2881037 - RNA, 21 nt, Human
uuccauaucuugcgaauccaa

SEQ ID NO: 2881038 - RNA, 12 nt, Human
uuccauauuugg

SEQ ID NO: 2881039 - RNA, 14 nt, Human
uuccauauuuggaa

SEQ ID NO: 2881040 - RNA, 21 nt, Human
uuccaaaaagauuuucagaaa

SEQ ID NO: 2881041 - RNA, 15 nt, Human
uuccaaaaauuauua

SEQ ID NO: 2881042 - RNA, 12 nt, Human
uucaucugccca

SEQ ID NO: 2881043 - RNA, 18 nt, Human
uuccaaaaagguugcugu

SEQ ID NO: 2881044 - RNA, 15 nt, Human
uuccaaaagccaaug

SEQ ID NO: 2881045 - RNA, 16 nt, Human
uuccaaaagccaaugg

SEQ ID NO: 2881046 - RNA, 22 nt, Human
uuccaaagaguagaauugcauu

SEQ ID NO: 2881047 - RNA, 16 nt, Human
uuccaaagcuuuauua

SEQ ID NO: 2881048 - RNA, 22 nt, Human
uuccaaagcuuuauuaccagug

SEQ ID NO: 2881049 - RNA, 14 nt, Human
uuccaaaguuaaca

SEQ ID NO: 2881050 - RNA, 15 nt, Human
uuccaaauaaaauga

SEQ ID NO: 2881051 - RNA, 23 nt, Human
uuccaaaggccauggagagcugg

SEQ ID NO: 2881052 - RNA, 14 nt, Human
uuccaaagucucua

SEQ ID NO: 2881053 - RNA, 16 nt, Human
uuccaaagucucuaau

SEQ ID NO: 2881054 - RNA, 17 nt, Human
uuccaaagucucuaauu

SEQ ID NO: 2881055 - RNA, 23 nt, Human
uuccaacaccacagacacacaca

SEQ ID NO: 2881056 - RNA, 14 nt, Human
uuccaacagugagu

SEQ ID NO: 2881057 - RNA, 12 nt, Human
uuccaacaccac

SEQ ID NO: 2881058 - RNA, 17 nt, Human
uuccaacaccacagaca

SEQ ID NO: 2881059 - RNA, 18 nt, Human
uuccaacaccacagacac

SEQ ID NO: 2881060 - RNA, 19 nt, Human
uuccaacaccacagacaca

SEQ ID NO: 2881061 - RNA, 20 nt, Human
uuccaacaccacagacacac

SEQ ID NO: 2881062 - RNA, 21 nt, Human
uuccaacaccacagacacaca

SEQ ID NO: 2881063 - RNA, 22 nt, Human
uuccaacaccacagacacacac

SEQ ID NO: 2881064 - RNA, 18 nt, Human
uucaucuguuguuuuguu

SEQ ID NO: 2881065 - RNA, 19 nt, Human
uucaugccaccauggccag

SEQ ID NO: 2881066 - RNA, 21 nt, Human
uucaugccaauuagcaauuga

SEQ ID NO: 2881067 - RNA, 17 nt, Human
uucauuuuuaaucauga

SEQ ID NO: 2881068 - RNA, 18 nt, Human
uucauuuuuaaucaugaa

SEQ ID NO: 2881069 - RNA, 14 nt, Human
uucauuuuuaauca

SEQ ID NO: 2881070 - RNA, 22 nt, Human
uucaugccagcuacuuccuccu

SEQ ID NO: 2881071 - RNA, 22 nt, Human
uucaugccaccauggccagcca

SEQ ID NO: 2881072 - RNA, 21 nt, Human
uucaugccagcuacuuccucc

SEQ ID NO: 2881073 - RNA, 18 nt, Human
uucaugcuaucucugugu

SEQ ID NO: 2881074 - RNA, 17 nt, Human
uucaugcuaucucugug

SEQ ID NO: 2881075 - RNA, 16 nt, Human
uucaugccuggcuucg

SEQ ID NO: 2881076 - RNA, 14 nt, Human
uucaugcucugcaa

SEQ ID NO: 2881077 - RNA, 15 nt, Human
uucaugcucugcaaa

SEQ ID NO: 2881078 - RNA, 10 nt, Human
uucaguucca

SEQ ID NO: 2881079 - RNA, 14 nt, Human
uucaguuccaagaa

SEQ ID NO: 2881080 - RNA, 21 nt, Human
uucaguuccgucagaaagugu

SEQ ID NO: 2881081 - RNA, 15 nt, Human
uucauaaccuagccu

SEQ ID NO: 2881082 - RNA, 12 nt, Human
uucauaaaugaa

SEQ ID NO: 2881083 - RNA, 14 nt, Human
uucauaaagauuca

SEQ ID NO: 2881084 - RNA, 22 nt, Human
uucauaaagauucaccuaagag

SEQ ID NO: 2881085 - RNA, 16 nt, Human
uucauaaaguacuuga

SEQ ID NO: 2881086 - RNA, 20 nt, Human
uucauaaaguacuugagugu

SEQ ID NO: 2881087 - RNA, 18 nt, Human
uucaucgaaucuacuaau

SEQ ID NO: 2881088 - RNA, 16 nt, Human
uucauccuauuguuga

SEQ ID NO: 2881089 - RNA, 18 nt, Human
uucauccugacucugccc

SEQ ID NO: 2881090 - RNA, 11 nt, Human
uucauccuggc

SEQ ID NO: 2881091 - RNA, 13 nt, Human
uucauaacuuauu

SEQ ID NO: 2881092 - RNA, 18 nt, Human
uucauaacuuauugcuga

SEQ ID NO: 2881093 - RNA, 19 nt, Human
uucauaacuuauugcugau

SEQ ID NO: 2881094 - RNA, 21 nt, Human
uucauaacuuauugcugauuu

SEQ ID NO: 2881095 - RNA, 22 nt, Human
uucauaacuuauugcugauuuu

SEQ ID NO: 2881096 - RNA, 16 nt, Human
uucauaacuuccugua

SEQ ID NO: 2881097 - RNA, 20 nt, Human
uucaucgaaucuacuaauuc

SEQ ID NO: 2881098 - RNA, 16 nt, Human
uucaguggcagcugcu

SEQ ID NO: 2881099 - RNA, 15 nt, Human
uucaguggcagcugc

SEQ ID NO: 2881100 - RNA, 17 nt, Human
uucaguggcagcugcuu

SEQ ID NO: 2881101 - RNA, 20 nt, Human
uucaguguauggaaauaaau

SEQ ID NO: 2881102 - RNA, 15 nt, Human
uucaguguauuucag

SEQ ID NO: 2881103 - RNA, 14 nt, Human
uucaguguaguuaa

SEQ ID NO: 2881104 - RNA, 16 nt, Human
uucaguguaguuaauu

SEQ ID NO: 2881105 - RNA, 18 nt, Human
uucaguguaguuaauuua

SEQ ID NO: 2881106 - RNA, 19 nt, Human
uucaguguaguuaauuuau

SEQ ID NO: 2881107 - RNA, 20 nt, Human
uucaguguaguuaauuuauc

SEQ ID NO: 2881108 - RNA, 24 nt, Human
uucaguguaguuaauuuaucuaaa

SEQ ID NO: 2881109 - RNA, 13 nt, Human
uucaguggcagcu

SEQ ID NO: 2881110 - RNA, 14 nt, Human
uucaguggcagcug

SEQ ID NO: 2881111 - RNA, 22 nt, Human
uucagcuuguaaauagcucagg

SEQ ID NO: 2881112 - RNA, 16 nt, Human
uucagcuuaaaauaaa

SEQ ID NO: 2881113 - RNA, 14 nt, Human
uucagcuucauuug

SEQ ID NO: 2881114 - RNA, 15 nt, Human
uucagcuccagcuca

SEQ ID NO: 2881115 - RNA, 12 nt, Human
uucagcuccagc

SEQ ID NO: 2881116 - RNA, 13 nt, Human
uucagcucacugu

SEQ ID NO: 2881117 - RNA, 14 nt, Human
uucagcuccagccc

SEQ ID NO: 2881118 - RNA, 15 nt, Human
uucagcuccagcccc

SEQ ID NO: 2881119 - RNA, 21 nt, Human
uucagcuccagccccuuucca

SEQ ID NO: 2881120 - RNA, 22 nt, Human
uucagcuccagccccuuuccaa

SEQ ID NO: 2881121 - RNA, 23 nt, Human
uucagcuccagccccuuuccaaa

SEQ ID NO: 2881122 - RNA, 15 nt, Human
uucagcuguccuccc

SEQ ID NO: 2881123 - RNA, 16 nt, Human
uucagcuguccucccu

SEQ ID NO: 2881124 - RNA, 18 nt, Human
uucagcuguccucccucc

SEQ ID NO: 2881125 - RNA, 19 nt, Human
uucagcuguccucccucca

SEQ ID NO: 2881126 - RNA, 21 nt, Human
uucagcuguccucccuccacc

SEQ ID NO: 2881127 - RNA, 14 nt, Human
uuccuuuauauuua

SEQ ID NO: 2881128 - RNA, 16 nt, Human
uuccuugucacuggua

SEQ ID NO: 2881129 - RNA, 20 nt, Human
uuccuugcuguccuaggcca

SEQ ID NO: 2881130 - RNA, 18 nt, Human
uuccuugcuguccuaggc

SEQ ID NO: 2881131 - RNA, 17 nt, Human
uuccuuuaaaaaaauuu

SEQ ID NO: 2881132 - RNA, 23 nt, Human
uuccuuuaaaaaaauuuaagugc

SEQ ID NO: 2881133 - RNA, 15 nt, Human
uuccuuuaaaaaacu

SEQ ID NO: 2881134 - RNA, 13 nt, Human
uuccuuuacuuuc

SEQ ID NO: 2881135 - RNA, 15 nt, Human
uuccuuuacuuuccc

SEQ ID NO: 2881136 - RNA, 16 nt, Human
uuccuuuacuuucccu

SEQ ID NO: 2881137 - RNA, 17 nt, Human
uuccuuuacuuucccuu

SEQ ID NO: 2881138 - RNA, 20 nt, Human
uuccuuuacuuucccuugcu

SEQ ID NO: 2881139 - RNA, 22 nt, Human
uuccuuuacuuucccuugcuuu

SEQ ID NO: 2881140 - RNA, 13 nt, Human
uuccuugugcaaa

SEQ ID NO: 2881141 - RNA, 19 nt, Human
uuccuuguuacccaugaaa

SEQ ID NO: 2881142 - RNA, 20 nt, Human
uuccuuguuacccaugaaaa

SEQ ID NO: 2881143 - RNA, 21 nt, Human
uuccuuguuacccaugaaaaa

SEQ ID NO: 2881144 - RNA, 14 nt, Human
uuccuuguuuauca

SEQ ID NO: 2881145 - RNA, 21 nt, Human
uuccuuguuuaucagauacau

SEQ ID NO: 2881146 - RNA, 13 nt, Human
uuccuuuaaaaaa

SEQ ID NO: 2881147 - RNA, 16 nt, Human
uuccuuuaaaaaaauu

SEQ ID NO: 2881148 - RNA, 15 nt, Human
uuccuggacacucag

SEQ ID NO: 2881149 - RNA, 13 nt, Human
uuccuugccugca

SEQ ID NO: 2881150 - RNA, 13 nt, Human
uuccuugaucauu

SEQ ID NO: 2881151 - RNA, 14 nt, Human
uuccuugaucauuu

SEQ ID NO: 2881152 - RNA, 16 nt, Human
uuccuugaucauuuug

SEQ ID NO: 2881153 - RNA, 19 nt, Human
uuccuugccugcacaaacu

SEQ ID NO: 2881154 - RNA, 21 nt, Human
uuccugccuuggccucccaag

SEQ ID NO: 2881155 - RNA, 21 nt, Human
uuccugauggcaggauggccu

SEQ ID NO: 2881156 - RNA, 19 nt, Human
uuccugaugguacaggaaa

SEQ ID NO: 2881157 - RNA, 22 nt, Human
uuccugaugguacaggaaagcu

SEQ ID NO: 2881158 - RNA, 21 nt, Human
uuccugcaggccaggccagcu

SEQ ID NO: 2881159 - RNA, 17 nt, Human
uuccugcaauuuucuaa

SEQ ID NO: 2881160 - RNA, 14 nt, Human
uuccugagcuuuau

SEQ ID NO: 2881161 - RNA, 23 nt, Human
uuccugacgaaacuggccccgga

SEQ ID NO: 2881162 - RNA, 17 nt, Human
uuccugagacaaauuuu

SEQ ID NO: 2881163 - RNA, 16 nt, Human
uuccugagauuuccuc

SEQ ID NO: 2881164 - RNA, 18 nt, Human
uuccugagauuuccuccu

SEQ ID NO: 2881165 - RNA, 21 nt, Human
uuccugagauuuccuccuggc

SEQ ID NO: 2881166 - RNA, 19 nt, Human
uuccaugggauacaaccuc

SEQ ID NO: 2881167 - RNA, 17 nt, Human
uuccauguaucuuuuga

SEQ ID NO: 2881168 - RNA, 22 nt, Human
uuccaucacccguacaggcaau

SEQ ID NO: 2881169 - RNA, 16 nt, Human
uuccugacaucacagc

SEQ ID NO: 2881170 - RNA, 17 nt, Human
uuccugacaucacagca

SEQ ID NO: 2881171 - RNA, 19 nt, Human
uuccugacaucacagcagc

SEQ ID NO: 2881172 - RNA, 20 nt, Human
uuccugacaucacagcagcc

SEQ ID NO: 2881173 - RNA, 20 nt, Human
uuccauguccccucccagag

SEQ ID NO: 2881174 - RNA, 23 nt, Human
uucuacacugggugcugauccuu

SEQ ID NO: 2881175 - RNA, 14 nt, Human
uucuacaaagcacu

SEQ ID NO: 2881176 - RNA, 21 nt, Human
uucuacaaagcacuagagaau

SEQ ID NO: 2881177 - RNA, 21 nt, Human
uucuaauuucaaaaauauaac

SEQ ID NO: 2881178 - RNA, 12 nt, Human
uucuacaauuaa

SEQ ID NO: 2881179 - RNA, 17 nt, Human
uucuacaauuaauaguu

SEQ ID NO: 2881180 - RNA, 19 nt, Human
uucuacacagugggaacuc

SEQ ID NO: 2881181 - RNA, 22 nt, Human
uucuacacagugggaacucuga

SEQ ID NO: 2881182 - RNA, 19 nt, Human
uucuacccagcgagcccug

SEQ ID NO: 2881183 - RNA, 12 nt, Human
uucuacccagcg

SEQ ID NO: 2881184 - RNA, 22 nt, Human
uucuacauaaguaauucaagaa

SEQ ID NO: 2881185 - RNA, 16 nt, Human
uucuacauuucuuaga

SEQ ID NO: 2881186 - RNA, 18 nt, Human
uucuacauuauugcuuau

SEQ ID NO: 2881187 - RNA, 17 nt, Human
uucuacauuucuuagac

SEQ ID NO: 2881188 - RNA, 16 nt, Human
uucuaccaaggcauau

SEQ ID NO: 2881189 - RNA, 21 nt, Human
uucuaccacacagcagcaguu

SEQ ID NO: 2881190 - RNA, 14 nt, Human
uucuaccauuucag

SEQ ID NO: 2881191 - RNA, 13 nt, Human
uucuaauguuucu

SEQ ID NO: 2881192 - RNA, 16 nt, Human
uucuaaugucuucauu

SEQ ID NO: 2881193 - RNA, 17 nt, Human
uucuaaugucuucauuu

SEQ ID NO: 2881194 - RNA, 20 nt, Human
uucgugcggaaucagcuucu

SEQ ID NO: 2881195 - RNA, 15 nt, Human
uucgugagccccauc

SEQ ID NO: 2881196 - RNA, 20 nt, Human
uucgugagccccaucuucac

SEQ ID NO: 2881197 - RNA, 23 nt, Human
uucgugagccccaucuucaccca

SEQ ID NO: 2881198 - RNA, 14 nt, Human
uucuaaugucuuca

SEQ ID NO: 2881199 - RNA, 16 nt, Human
uucguuagaccgcucu

SEQ ID NO: 2881200 - RNA, 13 nt, Human
uucuaaugucuuc

SEQ ID NO: 2881201 - RNA, 23 nt, Human
uucuaaugugugaaucagagcac

SEQ ID NO: 2881202 - RNA, 19 nt, Human
uucguagcuuucccaaaua

SEQ ID NO: 2881203 - RNA, 13 nt, Human
uucguaugaaaau

SEQ ID NO: 2881204 - RNA, 15 nt, Human
uucguaugaaaauga

SEQ ID NO: 2881205 - RNA, 16 nt, Human
uucguccacagcuucc

SEQ ID NO: 2881206 - RNA, 17 nt, Human
uucguccacagcuuccu

SEQ ID NO: 2881207 - RNA, 18 nt, Human
uucguccacagcuuccug

SEQ ID NO: 2881208 - RNA, 19 nt, Human
uucguccacagcuuccugu

SEQ ID NO: 2881209 - RNA, 20 nt, Human
uucgguuuuuuuccuguuuc

SEQ ID NO: 2881210 - RNA, 18 nt, Human
uucgguugagaauggaaa

SEQ ID NO: 2881211 - RNA, 14 nt, Human
uucgucuucuaauu

SEQ ID NO: 2881212 - RNA, 14 nt, Human
uucgucuucacucu

SEQ ID NO: 2881213 - RNA, 15 nt, Human
uucguagcaugaguu

SEQ ID NO: 2881214 - RNA, 13 nt, Human
uucgucuucuaau

SEQ ID NO: 2881215 - RNA, 16 nt, Human
uucgucuucuaauuuc

SEQ ID NO: 2881216 - RNA, 17 nt, Human
uucgugaacauccccuc

SEQ ID NO: 2881217 - RNA, 13 nt, Human
uucuauacaaaua

SEQ ID NO: 2881218 - RNA, 14 nt, Human
uucuauacaaauau

SEQ ID NO: 2881219 - RNA, 21 nt, Human
uucuauacaaauauaaaucuu

SEQ ID NO: 2881220 - RNA, 14 nt, Human
uucuauaguucuag

SEQ ID NO: 2881221 - RNA, 15 nt, Human
uucuauaguucuaga

SEQ ID NO: 2881222 - RNA, 12 nt, Human
uucuauaugaau

SEQ ID NO: 2881223 - RNA, 16 nt, Human
uucuauaguucuagac

SEQ ID NO: 2881224 - RNA, 17 nt, Human
uucuauaguucuagaca

SEQ ID NO: 2881225 - RNA, 18 nt, Human
uucuaccauuucagagag

SEQ ID NO: 2881226 - RNA, 18 nt, Human
uucuacccaacggcccug

SEQ ID NO: 2881227 - RNA, 15 nt, Human
uucuaccauuucaga

SEQ ID NO: 2881228 - RNA, 22 nt, Human
uucuaccaugaacagaaaacau

SEQ ID NO: 2881229 - RNA, 16 nt, Human
uucuacccguuccaaa

SEQ ID NO: 2881230 - RNA, 17 nt, Human
uucuacccguuccaaaa

SEQ ID NO: 2881231 - RNA, 21 nt, Human
uucuacccagcgagcccuggu

SEQ ID NO: 2881232 - RNA, 20 nt, Human
uucuacccagcgagcccugg

SEQ ID NO: 2881233 - RNA, 14 nt, Human
uucuacggaucauc

SEQ ID NO: 2881234 - RNA, 19 nt, Human
uucuacggaucaucaacaa

SEQ ID NO: 2881235 - RNA, 20 nt, Human
uucuacggaucaucaacaag

SEQ ID NO: 2881236 - RNA, 22 nt, Human
uucuacggaucaucaacaagau

SEQ ID NO: 2881237 - RNA, 13 nt, Human
uucuacuauuuau

SEQ ID NO: 2881238 - RNA, 16 nt, Human
uucugaguuucauucu

SEQ ID NO: 2881239 - RNA, 19 nt, Human
uucugaguuucauucuccu

SEQ ID NO: 2881240 - RNA, 20 nt, Human
uucugaguuucauucuccug

SEQ ID NO: 2881241 - RNA, 23 nt, Human
uucugaguuucauucuccugccu

SEQ ID NO: 2881242 - RNA, 20 nt, Human
uucugagacaugugucaaca

SEQ ID NO: 2881243 - RNA, 13 nt, Human
uucugagaccaaa

SEQ ID NO: 2881244 - RNA, 13 nt, Human
uucugaguacaga

SEQ ID NO: 2881245 - RNA, 16 nt, Human
uucugaggcuuuauga

SEQ ID NO: 2881246 - RNA, 14 nt, Human
uucugcgccucagg

SEQ ID NO: 2881247 - RNA, 12 nt, Human
uucugccuuuuc

SEQ ID NO: 2881248 - RNA, 16 nt, Human
uucugccuuuucacug

SEQ ID NO: 2881249 - RNA, 19 nt, Human
uucugcucacauaucuguc

SEQ ID NO: 2881250 - RNA, 20 nt, Human
uucugcuccacccuuggccu

SEQ ID NO: 2881251 - RNA, 18 nt, Human
uucugcuccacccuuggc

SEQ ID NO: 2881252 - RNA, 17 nt, Human
uucugcuccacccuugg

SEQ ID NO: 2881253 - RNA, 16 nt, Human
uucugcuccacccuug

SEQ ID NO: 2881254 - RNA, 15 nt, Human
uucugcuccacccuu

SEQ ID NO: 2881255 - RNA, 13 nt, Human
uucugcuccaccc

SEQ ID NO: 2881256 - RNA, 9 nt, Human
uucugcucc

SEQ ID NO: 2881257 - RNA, 22 nt, Human
uucugauaugcaguuuuccuua

SEQ ID NO: 2881258 - RNA, 13 nt, Human
uucugauuagcuu

SEQ ID NO: 2881259 - RNA, 15 nt, Human
uucugauuagcuuug

SEQ ID NO: 2881260 - RNA, 18 nt, Human
uucugauuagcuuugugu

SEQ ID NO: 2881261 - RNA, 20 nt, Human
uucugauuagcuuuguguuu

SEQ ID NO: 2881262 - RNA, 18 nt, Human
uucugaugaugugccugg

SEQ ID NO: 2881263 - RNA, 13 nt, Human
uucugaugagcaa

SEQ ID NO: 2881264 - RNA, 14 nt, Human
uucugaugagcaac

SEQ ID NO: 2881265 - RNA, 16 nt, Human
uucugaugucucuaaa

SEQ ID NO: 2881266 - RNA, 21 nt, Human
uucugaugucucuaaagcacu

SEQ ID NO: 2881267 - RNA, 15 nt, Human
uucugauguugccuu

SEQ ID NO: 2881268 - RNA, 21 nt, Human
uucugauuugccacugauauu

SEQ ID NO: 2881269 - RNA, 23 nt, Human
uucugauuugccacugauauuca

SEQ ID NO: 2881270 - RNA, 13 nt, Human
uucugcaaaauag

SEQ ID NO: 2881271 - RNA, 12 nt, Human
uucugcaaacaa

SEQ ID NO: 2881272 - RNA, 14 nt, Human
uucugcaaacaaac

SEQ ID NO: 2881273 - RNA, 24 nt, Human
uucugauuuuaggagcuaaggcuc

SEQ ID NO: 2881274 - RNA, 17 nt, Human
uucugauuuuaggagcu

SEQ ID NO: 2881275 - RNA, 23 nt, Human
uucugauuuuaggagcuaaggcu

SEQ ID NO: 2881276 - RNA, 21 nt, Human
uucugcaagcacaucugcauu

SEQ ID NO: 2881277 - RNA, 10 nt, Human
uucugccuuu

SEQ ID NO: 2881278 - RNA, 15 nt, Human
uucugccuuugaugu

SEQ ID NO: 2881279 - RNA, 16 nt, Human
uucugccuuugauguu

SEQ ID NO: 2881280 - RNA, 23 nt, Human
uucugccuuugauguuacagauu

SEQ ID NO: 2881281 - RNA, 20 nt, Human
uucuccagcugggcucugca

SEQ ID NO: 2881282 - RNA, 20 nt, Human
uucucugaggacacuaacca

SEQ ID NO: 2881283 - RNA, 14 nt, Human
uucucugaggacac

SEQ ID NO: 2881284 - RNA, 17 nt, Human
uucuccagauuuuuaau

SEQ ID NO: 2881285 - RNA, 23 nt, Human
uucuccagauuuuucggaggccc

SEQ ID NO: 2881286 - RNA, 12 nt, Human
uucuccagcugg

SEQ ID NO: 2881287 - RNA, 13 nt, Human
uucuccagcucag

SEQ ID NO: 2881288 - RNA, 14 nt, Human
uucuccagcucaga

SEQ ID NO: 2881289 - RNA, 19 nt, Human
uucuccagcucagaaccca

SEQ ID NO: 2881290 - RNA, 20 nt, Human
uucuccagcucagaacccag

SEQ ID NO: 2881291 - RNA, 14 nt, Human
uucuccagcugggc

SEQ ID NO: 2881292 - RNA, 15 nt, Human
uucuccagcugggcu

SEQ ID NO: 2881293 - RNA, 21 nt, Human
uucucaugccucagccuccug

SEQ ID NO: 2881294 - RNA, 20 nt, Human
uucuaucuuguuccaaggcc

SEQ ID NO: 2881295 - RNA, 13 nt, Human
uucucauguguuu

SEQ ID NO: 2881296 - RNA, 23 nt, Human
uucuauccuacaacaagaguuua

SEQ ID NO: 2881297 - RNA, 17 nt, Human
uucuauccaaacaugua

SEQ ID NO: 2881298 - RNA, 20 nt, Human
uucuauccaaacauguauuu

SEQ ID NO: 2881299 - RNA, 16 nt, Human
uucuccacccugcucu

SEQ ID NO: 2881300 - RNA, 19 nt, Human
uucucauuuguuuuucuca

SEQ ID NO: 2881301 - RNA, 13 nt, Human
uucucauuuucuu

SEQ ID NO: 2881302 - RNA, 16 nt, Human
uucucauuuucuuuuc

SEQ ID NO: 2881303 - RNA, 21 nt, Human
uucuccaccuagacuguaaac

SEQ ID NO: 2881304 - RNA, 18 nt, Human
uucucauuccaacaguga

SEQ ID NO: 2881305 - RNA, 20 nt, Human
uucucauuccaacagugagu

SEQ ID NO: 2881306 - RNA, 11 nt, Human
uucucauucuu

SEQ ID NO: 2881307 - RNA, 20 nt, Human
uucucauuugccaauaauaa

SEQ ID NO: 2881308 - RNA, 12 nt, Human
uucuccagaacc

SEQ ID NO: 2881309 - RNA, 14 nt, Human
uucuccagaaccca

SEQ ID NO: 2881310 - RNA, 12 nt, Human
uucuccacugga

SEQ ID NO: 2881311 - RNA, 16 nt, Human
uugacaacugugacug

SEQ ID NO: 2881312 - RNA, 21 nt, Human
uugaccucaggugauccaccc

SEQ ID NO: 2881313 - RNA, 20 nt, Human
uugaccgcgacuaauuucaa

SEQ ID NO: 2881314 - RNA, 19 nt, Human
uugaccuccucccuguuau

SEQ ID NO: 2881315 - RNA, 21 nt, Human
uugaccuccucccuguuauuu

SEQ ID NO: 2881316 - RNA, 24 nt, Human
uugaccuccucccuguuauuuuca

SEQ ID NO: 2881317 - RNA, 20 nt, Human
uugacugaagaugcagcuca

SEQ ID NO: 2881318 - RNA, 21 nt, Human
uugacugaugcugagauucuu

SEQ ID NO: 2881319 - RNA, 19 nt, Human
uugacuggcugugugaccu

SEQ ID NO: 2881320 - RNA, 16 nt, Human
uugacucccaaguuuc

SEQ ID NO: 2881321 - RNA, 19 nt, Human
uugacucccaaguuuccau

SEQ ID NO: 2881322 - RNA, 15 nt, Human
uugacucaggauuua

SEQ ID NO: 2881323 - RNA, 23 nt, Human
uugacucaggauuuaaaaacugg

SEQ ID NO: 2881324 - RNA, 22 nt, Human
uugaacuuuccuggaugucuga

SEQ ID NO: 2881325 - RNA, 13 nt, Human
uugaauuguuaca

SEQ ID NO: 2881326 - RNA, 14 nt, Human
uugaauuguuacau

SEQ ID NO: 2881327 - RNA, 16 nt, Human
uugaacuucaccugca

SEQ ID NO: 2881328 - RNA, 18 nt, Human
uugaauuuacuggacaua

SEQ ID NO: 2881329 - RNA, 18 nt, Human
uugaacuggguacuugug

SEQ ID NO: 2881330 - RNA, 14 nt, Human
uugaacucugggcu

SEQ ID NO: 2881331 - RNA, 16 nt, Human
uugaacucugggcuca

SEQ ID NO: 2881332 - RNA, 17 nt, Human
uugaacuccugaccuca

SEQ ID NO: 2881333 - RNA, 20 nt, Human
uugaacuggcaauugucuau

SEQ ID NO: 2881334 - RNA, 23 nt, Human
uugaacuggcaauugucuauuua

SEQ ID NO: 2881335 - RNA, 16 nt, Human
uugaauuuuaaaucua

SEQ ID NO: 2881336 - RNA, 15 nt, Human
uugaauuuuaaaucu

SEQ ID NO: 2881337 - RNA, 21 nt, Human
uugacaaaaccuaacuugcgc

SEQ ID NO: 2881338 - RNA, 17 nt, Human
uugacaaaauuuucuca

SEQ ID NO: 2881339 - RNA, 18 nt, Human
uugacaaaauuuucucau

SEQ ID NO: 2881340 - RNA, 12 nt, Human
uugacaaaauuu

SEQ ID NO: 2881341 - RNA, 14 nt, Human
uugacaacugugac

SEQ ID NO: 2881342 - RNA, 13 nt, Human
uugacaaaucugu

SEQ ID NO: 2881343 - RNA, 14 nt, Human
uugacaaaucugug

SEQ ID NO: 2881344 - RNA, 17 nt, Human
uugacaaaucuguguau

SEQ ID NO: 2881345 - RNA, 20 nt, Human
uugacaaaucuguguauauu

SEQ ID NO: 2881346 - RNA, 22 nt, Human
uugacaaaucuguguauauuau

SEQ ID NO: 2881347 - RNA, 23 nt, Human
uugacaaaucuguguauauuauu

SEQ ID NO: 2881348 - RNA, 20 nt, Human
uugaugaccaaaguccuuuu

SEQ ID NO: 2881349 - RNA, 16 nt, Human
uugaugaagcaaggaa

SEQ ID NO: 2881350 - RNA, 18 nt, Human
uugaugaagcaaggaaga

SEQ ID NO: 2881351 - RNA, 21 nt, Human
uugaugaagcaaggaagauau

SEQ ID NO: 2881352 - RNA, 23 nt, Human
uugaugaagcaaggaagauauac

SEQ ID NO: 2881353 - RNA, 13 nt, Human
uugauauauauua

SEQ ID NO: 2881354 - RNA, 14 nt, Human
uugauauauauuau

SEQ ID NO: 2881355 - RNA, 23 nt, Human
uugauauauauuauaaauauaua

SEQ ID NO: 2881356 - RNA, 17 nt, Human
uugauauagaacagugc

SEQ ID NO: 2881357 - RNA, 22 nt, Human
uugauauagaacagugcuugcc

SEQ ID NO: 2881358 - RNA, 19 nt, Human
uugauagcuuuauuuuuua

SEQ ID NO: 2881359 - RNA, 14 nt, Human
uugauagcuuuauu

SEQ ID NO: 2881360 - RNA, 16 nt, Human
uugaggguugggcugg

SEQ ID NO: 2881361 - RNA, 17 nt, Human
uugagggugggguaagg

SEQ ID NO: 2881362 - RNA, 16 nt, Human
uugagguaaagauaug

SEQ ID NO: 2881363 - RNA, 21 nt, Human
uugagguagaccaggauuucu

SEQ ID NO: 2881364 - RNA, 23 nt, Human
uugagguagaccaggauuucuaa

SEQ ID NO: 2881365 - RNA, 13 nt, Human
uugaggguugggc

SEQ ID NO: 2881366 - RNA, 14 nt, Human
uugagcccucccca

SEQ ID NO: 2881367 - RNA, 15 nt, Human
uugagcccuccccag

SEQ ID NO: 2881368 - RNA, 22 nt, Human
uugagcccuccccaggaauuug

SEQ ID NO: 2881369 - RNA, 23 nt, Human
uugacuggguuucucuguauagu

SEQ ID NO: 2881370 - RNA, 21 nt, Human
uugacugguuuacaggcccug

SEQ ID NO: 2881371 - RNA, 17 nt, Human
uugacuggguuucucug

SEQ ID NO: 2881372 - RNA, 13 nt, Human
uugagcccaggag

SEQ ID NO: 2881373 - RNA, 16 nt, Human
uugaugaucuuugcag

SEQ ID NO: 2881374 - RNA, 16 nt, Human
uugaugacuggcauuu

SEQ ID NO: 2881375 - RNA, 19 nt, Human
uugaugacuggcauuuuau

SEQ ID NO: 2881376 - RNA, 22 nt, Human
uugaugacuggcauuuuauaga

SEQ ID NO: 2881377 - RNA, 17 nt, Human
uugaugacccccaacca

SEQ ID NO: 2881378 - RNA, 21 nt, Human
uugaugauacaaugaacacuu

SEQ ID NO: 2881379 - RNA, 12 nt, Human
uugaugcacaga

SEQ ID NO: 2881380 - RNA, 14 nt, Human
uugaugcacagaga

SEQ ID NO: 2881381 - RNA, 18 nt, Human
uugaugcacagagaagcu

SEQ ID NO: 2881382 - RNA, 21 nt, Human
uugaugcacagagaagcuggg

SEQ ID NO: 2881383 - RNA, 14 nt, Human
uugaugcagcauuu

SEQ ID NO: 2881384 - RNA, 15 nt, Human
uugaugcagcauuug

SEQ ID NO: 2881385 - RNA, 18 nt, Human
uugaugcagcauuugaua

SEQ ID NO: 2881386 - RNA, 18 nt, Human
uugaugcaggcacuuauu

SEQ ID NO: 2881387 - RNA, 20 nt, Human
uugauucuccuuuuaugugu

SEQ ID NO: 2881388 - RNA, 23 nt, Human
uugauucuccuuuuauguguagu

SEQ ID NO: 2881389 - RNA, 11 nt, Human
uugaugcaugu

SEQ ID NO: 2881390 - RNA, 12 nt, Human
uugaugcaugug

SEQ ID NO: 2881391 - RNA, 14 nt, Human
uugauuugaagaac

SEQ ID NO: 2881392 - RNA, 13 nt, Human
uugauuugaagaa

SEQ ID NO: 2881393 - RNA, 12 nt, Human
uugauucuuccu

SEQ ID NO: 2881394 - RNA, 19 nt, Human
uugauugacugcccauuca

SEQ ID NO: 2881395 - RNA, 20 nt, Human
uugauucugcaguaaaucuu

SEQ ID NO: 2881396 - RNA, 18 nt, Human
uugauucugcuugagaau

SEQ ID NO: 2881397 - RNA, 12 nt, Human
uugauucugcag

SEQ ID NO: 2881398 - RNA, 14 nt, Human
uugauugauuugaa

SEQ ID NO: 2881399 - RNA, 13 nt, Human
uugauugauuuga

SEQ ID NO: 2881400 - RNA, 12 nt, Human
uugcaaauaguc

SEQ ID NO: 2881401 - RNA, 12 nt, Human
uugcaaauauaa

SEQ ID NO: 2881402 - RNA, 16 nt, Human
uugcaaauauaaacau

SEQ ID NO: 2881403 - RNA, 17 nt, Human
uugcaaauauaaacauc

SEQ ID NO: 2881404 - RNA, 16 nt, Human
uugcaaaucaguguuu

SEQ ID NO: 2881405 - RNA, 17 nt, Human
uugcaaaguauuguaaa

SEQ ID NO: 2881406 - RNA, 18 nt, Human
uugcaaaguauuguaaau

SEQ ID NO: 2881407 - RNA, 20 nt, Human
uugcaaaguauuguaaauua

SEQ ID NO: 2881408 - RNA, 21 nt, Human
uugcaaaguauuguaaauuau

SEQ ID NO: 2881409 - RNA, 12 nt, Human
uugcaaaucuug

SEQ ID NO: 2881410 - RNA, 16 nt, Human
uugcaaaucuugaaau

SEQ ID NO: 2881411 - RNA, 15 nt, Human
uugcaaaucuugaaa

SEQ ID NO: 2881412 - RNA, 17 nt, Human
uugcaaaucuugaaauu

SEQ ID NO: 2881413 - RNA, 16 nt, Human
uugcacgacgcccucu

SEQ ID NO: 2881414 - RNA, 17 nt, Human
uugcacgacgcccucuc

SEQ ID NO: 2881415 - RNA, 19 nt, Human
uugcacgacgcccucuccc

SEQ ID NO: 2881416 - RNA, 20 nt, Human
uugcacgacgcccucucccc

SEQ ID NO: 2881417 - RNA, 21 nt, Human
uugcacgacgcccucucccca

SEQ ID NO: 2881418 - RNA, 18 nt, Human
uugauuugaagaacaugu

SEQ ID NO: 2881419 - RNA, 14 nt, Human
uugauuugcauuga

SEQ ID NO: 2881420 - RNA, 13 nt, Human
uugauuugcauug

SEQ ID NO: 2881421 - RNA, 19 nt, Human
uugauuugcauugaacaca

SEQ ID NO: 2881422 - RNA, 17 nt, Human
uugauuugcauugaaca

SEQ ID NO: 2881423 - RNA, 15 nt, Human
uugauuugcauugaa

SEQ ID NO: 2881424 - RNA, 23 nt, Human
uucugugucuuucacagcuccuc

SEQ ID NO: 2881425 - RNA, 12 nt, Human
uucugugucuuu

SEQ ID NO: 2881426 - RNA, 22 nt, Human
uucugugucuuucacagcuccu

SEQ ID NO: 2881427 - RNA, 15 nt, Human
uucuguguaaccauu

SEQ ID NO: 2881428 - RNA, 17 nt, Human
uucuguguaaccauuuu

SEQ ID NO: 2881429 - RNA, 18 nt, Human
uucuguguaaccauuuua

SEQ ID NO: 2881430 - RNA, 14 nt, Human
uucuguguaucucu

SEQ ID NO: 2881431 - RNA, 21 nt, Human
uucuguguaucucuuucacau

SEQ ID NO: 2881432 - RNA, 18 nt, Human
uucuguguuuauaaaaua

SEQ ID NO: 2881433 - RNA, 12 nt, Human
uucuguguuuau

SEQ ID NO: 2881434 - RNA, 17 nt, Human
uucuguguuuaauuucu

SEQ ID NO: 2881435 - RNA, 20 nt, Human
uucuguguuuaauuucuuca

SEQ ID NO: 2881436 - RNA, 23 nt, Human
uucugugugcaccuuaccaacuu

SEQ ID NO: 2881437 - RNA, 20 nt, Human
uucuggauuuugucaagcag

SEQ ID NO: 2881438 - RNA, 19 nt, Human
uucuguccuacucuguguc

SEQ ID NO: 2881439 - RNA, 14 nt, Human
uucugucccuucug

SEQ ID NO: 2881440 - RNA, 15 nt, Human
uucugucccucacag

SEQ ID NO: 2881441 - RNA, 14 nt, Human
uucugucaagaaga

SEQ ID NO: 2881442 - RNA, 13 nt, Human
uucugucacucag

SEQ ID NO: 2881443 - RNA, 16 nt, Human
uucugucacucaggcu

SEQ ID NO: 2881444 - RNA, 19 nt, Human
uucugucacucaggcugga

SEQ ID NO: 2881445 - RNA, 16 nt, Human
uucugucagaugagaa

SEQ ID NO: 2881446 - RNA, 18 nt, Human
uucugucagaugagaaca

SEQ ID NO: 2881447 - RNA, 19 nt, Human
uucugucagaugagaacaa

SEQ ID NO: 2881448 - RNA, 22 nt, Human
uucugucagaugagaacaaagc

SEQ ID NO: 2881449 - RNA, 23 nt, Human
uucugucagaugagaacaaagcu

SEQ ID NO: 2881450 - RNA, 24 nt, Human
uucugucagaugagaacaaagcug

SEQ ID NO: 2881451 - RNA, 13 nt, Human
uucuguccugcug

SEQ ID NO: 2881452 - RNA, 15 nt, Human
uucuguccugugagg

SEQ ID NO: 2881453 - RNA, 23 nt, Human
uucuguccugugagguuucccaa

SEQ ID NO: 2881454 - RNA, 15 nt, Human
uucugucucucucuu

SEQ ID NO: 2881455 - RNA, 14 nt, Human
uucugcuucagccu

SEQ ID NO: 2881456 - RNA, 18 nt, Human
uucugcuggaaacagacu

SEQ ID NO: 2881457 - RNA, 17 nt, Human
uucugcuggcaucaaga

SEQ ID NO: 2881458 - RNA, 16 nt, Human
uucugcuucagccucc

SEQ ID NO: 2881459 - RNA, 15 nt, Human
uucugcuucagccuc

SEQ ID NO: 2881460 - RNA, 19 nt, Human
uucugcuucagccucccga

SEQ ID NO: 2881461 - RNA, 18 nt, Human
uucugcuuguguuaagua

SEQ ID NO: 2881462 - RNA, 17 nt, Human
uucuggaauacaugaaa

SEQ ID NO: 2881463 - RNA, 16 nt, Human
uucugcuucaauaaau

SEQ ID NO: 2881464 - RNA, 19 nt, Human
uucugcuucaauaaaucuu

SEQ ID NO: 2881465 - RNA, 13 nt, Human
uucugcuugagaa

SEQ ID NO: 2881466 - RNA, 17 nt, Human
uucugcuugagaauauu

SEQ ID NO: 2881467 - RNA, 18 nt, Human
uucugcuuuccucuuccu

SEQ ID NO: 2881468 - RNA, 14 nt, Human
uucugcuuucuccc

SEQ ID NO: 2881469 - RNA, 22 nt, Human
uucugcuuucuccccaaugaga

SEQ ID NO: 2881470 - RNA, 15 nt, Human
uucugcuuucuuuga

SEQ ID NO: 2881471 - RNA, 19 nt, Human
uucugcuuucuuugauucu

SEQ ID NO: 2881472 - RNA, 14 nt, Human
uucuggaauuuguu

SEQ ID NO: 2881473 - RNA, 17 nt, Human
uucuggaauuuguucaa

SEQ ID NO: 2881474 - RNA, 18 nt, Human
uucuggaauuuguucaag

SEQ ID NO: 2881475 - RNA, 19 nt, Human
uucuggaauuuguucaagu

SEQ ID NO: 2881476 - RNA, 20 nt, Human
uucuggaauuuguucaaguu

SEQ ID NO: 2881477 - RNA, 21 nt, Human
uucuggaauuuguucaaguuu

SEQ ID NO: 2881478 - RNA, 22 nt, Human
uucuggaauuuguucaaguuuu

SEQ ID NO: 2881479 - RNA, 19 nt, Human
uucuggacagucagcucuu

SEQ ID NO: 2881480 - RNA, 22 nt, Human
uucuggacagucagcucuucau

SEQ ID NO: 2881481 - RNA, 19 nt, Human
uucuggaauacaugaaaua

SEQ ID NO: 2881482 - RNA, 15 nt, Human
uucuggagcccuugg

SEQ ID NO: 2881483 - RNA, 13 nt, Human
uucuggagcccuu

SEQ ID NO: 2881484 - RNA, 10 nt, Human
uucuggaguu

SEQ ID NO: 2881485 - RNA, 10 nt, Human
uucuggagcc

SEQ ID NO: 2881486 - RNA, 16 nt, Human
uucuuauacgcuuuuc

SEQ ID NO: 2881487 - RNA, 22 nt, Human
uucuucauucuaucaagcccag

SEQ ID NO: 2881488 - RNA, 20 nt, Human
uucuuccaggugcccagcua

SEQ ID NO: 2881489 - RNA, 19 nt, Human
uucuuccaggugcccagcu

SEQ ID NO: 2881490 - RNA, 17 nt, Human
uucuuccaaaaagauuu

SEQ ID NO: 2881491 - RNA, 12 nt, Human
uucuuauaauac

SEQ ID NO: 2881492 - RNA, 13 nt, Human
uucuuauaauacu

SEQ ID NO: 2881493 - RNA, 17 nt, Human
uucuuauaauacucugu

SEQ ID NO: 2881494 - RNA, 19 nt, Human
uucuuauaauacucuguug

SEQ ID NO: 2881495 - RNA, 14 nt, Human
uucuuauacacauu

SEQ ID NO: 2881496 - RNA, 11 nt, Human
uucuuccagga

SEQ ID NO: 2881497 - RNA, 22 nt, Human
uucuucccuuuuaaacacauuu

SEQ ID NO: 2881498 - RNA, 21 nt, Human
uucuuccuauuugccaugggc

SEQ ID NO: 2881499 - RNA, 13 nt, Human
uucuuccauccca

SEQ ID NO: 2881500 - RNA, 14 nt, Human
uucuuccaucccag

SEQ ID NO: 2881501 - RNA, 16 nt, Human
uucuuccaucccagga

SEQ ID NO: 2881502 - RNA, 17 nt, Human
uucuuccaucccaggac

SEQ ID NO: 2881503 - RNA, 12 nt, Human
uucuuguugcuu

SEQ ID NO: 2881504 - RNA, 15 nt, Human
uucuuguuuauugag

SEQ ID NO: 2881505 - RNA, 13 nt, Human
uucuuguuucucc

SEQ ID NO: 2881506 - RNA, 16 nt, Human
uucuuccuccagcugc

SEQ ID NO: 2881507 - RNA, 14 nt, Human
uucuuuaaagaagu

SEQ ID NO: 2881508 - RNA, 15 nt, Human
uucuuucaauucugu

SEQ ID NO: 2881509 - RNA, 18 nt, Human
uucuuucagcuaucagua

SEQ ID NO: 2881510 - RNA, 23 nt, Human
uucuuuaaaaaacaacuauggau

SEQ ID NO: 2881511 - RNA, 14 nt, Human
uugaaaaacucuuu

SEQ ID NO: 2881512 - RNA, 21 nt, Human
uugaaaaacucuuuauuuucc

SEQ ID NO: 2881513 - RNA, 18 nt, Human
uugaaaaaguuaaugcuu

SEQ ID NO: 2881514 - RNA, 14 nt, Human
uugaaaaaucacuu

SEQ ID NO: 2881515 - RNA, 16 nt, Human
uugaaaaccugacaaa

SEQ ID NO: 2881516 - RNA, 18 nt, Human
uugaaaacauaaucugca

SEQ ID NO: 2881517 - RNA, 16 nt, Human
uugaaaaccaaaauga

SEQ ID NO: 2881518 - RNA, 17 nt, Human
uugaaaaccaaaaugac

SEQ ID NO: 2881519 - RNA, 18 nt, Human
uugaaaaccaaaaugaca

SEQ ID NO: 2881520 - RNA, 19 nt, Human
uugaaaaccaaaaugacau

SEQ ID NO: 2881521 - RNA, 20 nt, Human
uugaaaaccaaaaugacauc

SEQ ID NO: 2881522 - RNA, 21 nt, Human
uugaaaaccaaaaugacaucu

SEQ ID NO: 2881523 - RNA, 22 nt, Human
uugaaaaccaaaaugacaucuu

SEQ ID NO: 2881524 - RNA, 23 nt, Human
uugaaaaccaaaaugacaucuuu

SEQ ID NO: 2881525 - RNA, 15 nt, Human
uugaaaaaaacuuca

SEQ ID NO: 2881526 - RNA, 20 nt, Human
uugaaaaaaacuucauucuc

SEQ ID NO: 2881527 - RNA, 12 nt, Human
uugaaaaaaaua

SEQ ID NO: 2881528 - RNA, 11 nt, Human
uugaaaaaagc

SEQ ID NO: 2881529 - RNA, 13 nt, Human
uugaaaaaagcuc

SEQ ID NO: 2881530 - RNA, 14 nt, Human
uugaaaaaagcuca

SEQ ID NO: 2881531 - RNA, 15 nt, Human
uugaaaaaagcucau

SEQ ID NO: 2881532 - RNA, 17 nt, Human
uugaaaaaagcucauuu

SEQ ID NO: 2881533 - RNA, 18 nt, Human
uugaaaaaagcucauuuc

SEQ ID NO: 2881534 - RNA, 20 nt, Human
uugaaaaaagcucauuucau

SEQ ID NO: 2881535 - RNA, 18 nt, Human
uucuuuuuuuucauuaua

SEQ ID NO: 2881536 - RNA, 16 nt, Human
uugaacuccuggccuc

SEQ ID NO: 2881537 - RNA, 15 nt, Human
uugaacuccuggccu

SEQ ID NO: 2881538 - RNA, 13 nt, Human
uugaaaagcuauu

SEQ ID NO: 2881539 - RNA, 18 nt, Human
uugaaaaccuaaaagaca

SEQ ID NO: 2881540 - RNA, 23 nt, Human
uugaaaagauguaccugguggau

SEQ ID NO: 2881541 - RNA, 22 nt, Human
uugaaaagcuauuagccaggau

SEQ ID NO: 2881542 - RNA, 17 nt, Human
uugaaaagcuucuuaau

SEQ ID NO: 2881543 - RNA, 19 nt, Human
uugaaaagcuucuuaauua

SEQ ID NO: 2881544 - RNA, 21 nt, Human
uugaaaagcuucuuaauuaau

SEQ ID NO: 2881545 - RNA, 22 nt, Human
uugaaaagcuucuuaauuaauu

SEQ ID NO: 2881546 - RNA, 14 nt, Human
uugaaaagcuauua

SEQ ID NO: 2881547 - RNA, 14 nt, Human
uugaacuaagaaac

SEQ ID NO: 2881548 - RNA, 16 nt, Human
uugaacuaagaaacuu

SEQ ID NO: 2881549 - RNA, 18 nt, Human
uugaacuaagaaacuuuu

SEQ ID NO: 2881550 - RNA, 19 nt, Human
uugaacuaagaaacuuuug

SEQ ID NO: 2881551 - RNA, 22 nt, Human
uugaacuaagaaacuuuuguaa

SEQ ID NO: 2881552 - RNA, 15 nt, Human
uugaacucagaucug

SEQ ID NO: 2881553 - RNA, 20 nt, Human
uugaacucagaucugucuga

SEQ ID NO: 2881554 - RNA, 13 nt, Human
uugaacuccaaga

SEQ ID NO: 2881555 - RNA, 13 nt, Human
uugaaaacuuuuc

SEQ ID NO: 2881556 - RNA, 14 nt, Human
uugaaaacuuuucu

SEQ ID NO: 2881557 - RNA, 16 nt, Human
uugaaaacuuuucuca

SEQ ID NO: 2881558 - RNA, 17 nt, Human
uugaaaacuuuucucag

SEQ ID NO: 2881559 - RNA, 12 nt, Human
uugaaaagcuau

SEQ ID NO: 2881560 - RNA, 14 nt, Human
caaugaagccagcu

SEQ ID NO: 2881561 - RNA, 21 nt, Human
caaugaagccagcucacagug

SEQ ID NO: 2881562 - RNA, 14 nt, Human
caaugacacagucu

SEQ ID NO: 2881563 - RNA, 14 nt, Human
caaugaauauugaa

SEQ ID NO: 2881564 - RNA, 19 nt, Human
caaugacacagucuuggcu

SEQ ID NO: 2881565 - RNA, 21 nt, Human
caaugacacagucuuggcuca

SEQ ID NO: 2881566 - RNA, 20 nt, Human
caaugauaguaagaaaagug

SEQ ID NO: 2881567 - RNA, 14 nt, Human
caaugaugaaugag

SEQ ID NO: 2881568 - RNA, 16 nt, Human
caaugacaucucaggg

SEQ ID NO: 2881569 - RNA, 17 nt, Human
caaugacaucucagggg

SEQ ID NO: 2881570 - RNA, 19 nt, Human
caaugacaucucaggggcc

SEQ ID NO: 2881571 - RNA, 22 nt, Human
caaugacaucucaggggccaga

SEQ ID NO: 2881572 - RNA, 18 nt, Human
caaugauaguaagaaaag

SEQ ID NO: 2881573 - RNA, 13 nt, Human
caaugcagcaagg

SEQ ID NO: 2881574 - RNA, 18 nt, Human
caaugcagcaaggcccug

SEQ ID NO: 2881575 - RNA, 20 nt, Human
caaugcagcaaggcccugcu

SEQ ID NO: 2881576 - RNA, 22 nt, Human
caaugcagcaaggcccugcugc

SEQ ID NO: 2881577 - RNA, 21 nt, Human
caaugaugaaugagaaucuac

SEQ ID NO: 2881578 - RNA, 16 nt, Human
caaugauggcaauuuu

SEQ ID NO: 2881579 - RNA, 13 nt, Human
caaugauggcaau

SEQ ID NO: 2881580 - RNA, 15 nt, Human
caauaggcuguuccc

SEQ ID NO: 2881581 - RNA, 15 nt, Human
caauagguaaagcua

SEQ ID NO: 2881582 - RNA, 15 nt, Human
caauauguaaauagu

SEQ ID NO: 2881583 - RNA, 12 nt, Human
caauaugcuuac

SEQ ID NO: 2881584 - RNA, 21 nt, Human
caauauguaaauagugcagaa

SEQ ID NO: 2881585 - RNA, 18 nt, Human
caauaguaauucucaggc

SEQ ID NO: 2881586 - RNA, 13 nt, Human
caauaugaaguua

SEQ ID NO: 2881587 - RNA, 22 nt, Human
caauaugaaguuacuuucuuaa

SEQ ID NO: 2881588 - RNA, 23 nt, Human
caauaugaaguuacuuucuuaau

SEQ ID NO: 2881589 - RNA, 11 nt, Human
caauaugcuua

SEQ ID NO: 2881590 - RNA, 19 nt, Human
caaguguuguuuuuuaagu

SEQ ID NO: 2881591 - RNA, 16 nt, Human
caaguguucacaaccu

SEQ ID NO: 2881592 - RNA, 18 nt, Human
caagugugggggguccuu

SEQ ID NO: 2881593 - RNA, 13 nt, Human
caauauguauugu

SEQ ID NO: 2881594 - RNA, 14 nt, Human
caauauguauugua

SEQ ID NO: 2881595 - RNA, 15 nt, Human
caauauguauuguaa

SEQ ID NO: 2881596 - RNA, 16 nt, Human
caauauguauuguaaa

SEQ ID NO: 2881597 - RNA, 21 nt, Human
caauauguauuguaaacaugu

SEQ ID NO: 2881598 - RNA, 22 nt, Human
caauauguauuguaaacaugug

SEQ ID NO: 2881599 - RNA, 23 nt, Human
caauauguauuguaaacaugugu

SEQ ID NO: 2881600 - RNA, 16 nt, Human
caauaugugagugccu

SEQ ID NO: 2881601 - RNA, 17 nt, Human
caauaugugagugccuu

SEQ ID NO: 2881602 - RNA, 20 nt, Human
caauaugugagugccuuuug

SEQ ID NO: 2881603 - RNA, 22 nt, Human
caauaugugagugccuuuugca

SEQ ID NO: 2881604 - RNA, 17 nt, Human
caauauguguuuacuuu

SEQ ID NO: 2881605 - RNA, 18 nt, Human
caauauguguuuacuuua

SEQ ID NO: 2881606 - RNA, 13 nt, Human
caauccucuaagc

SEQ ID NO: 2881607 - RNA, 19 nt, Human
caauccucucaccucagcc

SEQ ID NO: 2881608 - RNA, 18 nt, Human
caaugaacacuuauaagu

SEQ ID NO: 2881609 - RNA, 21 nt, Human
caaugaaaugcucuccuuucc

SEQ ID NO: 2881610 - RNA, 19 nt, Human
caaugaaaugcucuccuuu

SEQ ID NO: 2881611 - RNA, 12 nt, Human
caauccuggcuc

SEQ ID NO: 2881612 - RNA, 16 nt, Human
cacaacacacacacuc

SEQ ID NO: 2881613 - RNA, 17 nt, Human
cacaaccuucuguggcu

SEQ ID NO: 2881614 - RNA, 18 nt, Human
cacaaccuucuguggcuc

SEQ ID NO: 2881615 - RNA, 19 nt, Human
cacaaccuucuguggcuca

SEQ ID NO: 2881616 - RNA, 23 nt, Human
cacaaccuucuguggcucacaga

SEQ ID NO: 2881617 - RNA, 20 nt, Human
cacaaauuucacuuauaccu

SEQ ID NO: 2881618 - RNA, 21 nt, Human
cacaacagccaacagcuacaa

SEQ ID NO: 2881619 - RNA, 22 nt, Human
cacaacacacagauuugagcuc

SEQ ID NO: 2881620 - RNA, 15 nt, Human
cacaacauuugcaga

SEQ ID NO: 2881621 - RNA, 19 nt, Human
cacaacauuugcagauguu

SEQ ID NO: 2881622 - RNA, 20 nt, Human
cacaaccaacgcgaaaccaa

SEQ ID NO: 2881623 - RNA, 23 nt, Human
cacaaccaccguuacaaguauac

SEQ ID NO: 2881624 - RNA, 16 nt, Human
cacaaccagccaggca

SEQ ID NO: 2881625 - RNA, 18 nt, Human
cacaaaaguuucucuuuu

SEQ ID NO: 2881626 - RNA, 16 nt, Human
cacaaaaguuucucuu

SEQ ID NO: 2881627 - RNA, 14 nt, Human
cacaaaaauguuga

SEQ ID NO: 2881628 - RNA, 16 nt, Human
cacaaaaauguugaac

SEQ ID NO: 2881629 - RNA, 19 nt, Human
cacaaaaauguugaaccaa

SEQ ID NO: 2881630 - RNA, 20 nt, Human
cacaaaaauuugaacacugg

SEQ ID NO: 2881631 - RNA, 19 nt, Human
caauuuucuggaauacaug

SEQ ID NO: 2881632 - RNA, 16 nt, Human
caauuuucuaagcaau

SEQ ID NO: 2881633 - RNA, 22 nt, Human
caauuuucuaagcaauuucuug

SEQ ID NO: 2881634 - RNA, 19 nt, Human
cacaaacuuuuauacucuu

SEQ ID NO: 2881635 - RNA, 18 nt, Human
cacaaagcacaguuugaa

SEQ ID NO: 2881636 - RNA, 15 nt, Human
cacaaagaguucugg

SEQ ID NO: 2881637 - RNA, 21 nt, Human
cacaaagaguucuggaaaaga

SEQ ID NO: 2881638 - RNA, 22 nt, Human
cacaaagcacaguuugaacaaa

SEQ ID NO: 2881639 - RNA, 13 nt, Human
cacaaaacagccu

SEQ ID NO: 2881640 - RNA, 14 nt, Human
cacaaacuguaaau

SEQ ID NO: 2881641 - RNA, 17 nt, Human
cacaaaaccuguccuau

SEQ ID NO: 2881642 - RNA, 20 nt, Human
cacaaaacuccgcccccagc

SEQ ID NO: 2881643 - RNA, 21 nt, Human
cacaaaacuccgcccccagcc

SEQ ID NO: 2881644 - RNA, 22 nt, Human
cacaaaacuccgcccccagccu

SEQ ID NO: 2881645 - RNA, 23 nt, Human
cacaaaacuccgcccccagccua

SEQ ID NO: 2881646 - RNA, 23 nt, Human
cacaaacuguaaauaaaaagaaa

SEQ ID NO: 2881647 - RNA, 15 nt, Human
cacaaacuguaaaua

SEQ ID NO: 2881648 - RNA, 18 nt, Human
caauuuuaauuuaguaaa

SEQ ID NO: 2881649 - RNA, 19 nt, Human
caauuuuaauuuaguaaau

SEQ ID NO: 2881650 - RNA, 21 nt, Human
caauuuuaauuuaguaaaugu

SEQ ID NO: 2881651 - RNA, 22 nt, Human
caauuuuaauuuaguaaauguu

SEQ ID NO: 2881652 - RNA, 23 nt, Human
caauuuuaauuuaguaaauguua

SEQ ID NO: 2881653 - RNA, 13 nt, Human
caauuuuaaagac

SEQ ID NO: 2881654 - RNA, 10 nt, Human
caauuccaau

SEQ ID NO: 2881655 - RNA, 16 nt, Human
caauuccaauauuucu

SEQ ID NO: 2881656 - RNA, 17 nt, Human
caauuccaauauuucug

SEQ ID NO: 2881657 - RNA, 21 nt, Human
caauuccaauauuucugcuuu

SEQ ID NO: 2881658 - RNA, 12 nt, Human
caauuuuaaaga

SEQ ID NO: 2881659 - RNA, 12 nt, Human
caauuuucaggu

SEQ ID NO: 2881660 - RNA, 15 nt, Human
caauucaaaaguucc

SEQ ID NO: 2881661 - RNA, 17 nt, Human
caauucaaaaguuccaa

SEQ ID NO: 2881662 - RNA, 17 nt, Human
caauucaauacaaacaa

SEQ ID NO: 2881663 - RNA, 22 nt, Human
caauucaauacaaacaaucucu

SEQ ID NO: 2881664 - RNA, 14 nt, Human
caauucaacacucc

SEQ ID NO: 2881665 - RNA, 18 nt, Human
caaugugaaaaauguguc

SEQ ID NO: 2881666 - RNA, 21 nt, Human
caauucagugcuguacuugau

SEQ ID NO: 2881667 - RNA, 22 nt, Human
caaugccaaaaaaagacagggc

SEQ ID NO: 2881668 - RNA, 14 nt, Human
caaugccaagauaa

SEQ ID NO: 2881669 - RNA, 19 nt, Human
caaugucaggaacagaagg

SEQ ID NO: 2881670 - RNA, 21 nt, Human
caaugucaggaacagaaggau

SEQ ID NO: 2881671 - RNA, 14 nt, Human
caaugucaguauuu

SEQ ID NO: 2881672 - RNA, 21 nt, Human
caaugucaguauuucagugua

SEQ ID NO: 2881673 - RNA, 21 nt, Human
caaugucauauacugccaugu

SEQ ID NO: 2881674 - RNA, 13 nt, Human
caaugucugcagc

SEQ ID NO: 2881675 - RNA, 15 nt, Human
caaugucugcagccc

SEQ ID NO: 2881676 - RNA, 16 nt, Human
caaugucugcagcccu

SEQ ID NO: 2881677 - RNA, 17 nt, Human
caaugucugcagcccug

SEQ ID NO: 2881678 - RNA, 18 nt, Human
caaugucugcagcccuga

SEQ ID NO: 2881679 - RNA, 19 nt, Human
caaugucugcagcccugag

SEQ ID NO: 2881680 - RNA, 22 nt, Human
caaugucugcagcccugagaaa

SEQ ID NO: 2881681 - RNA, 11 nt, Human
caaugugaaaa

SEQ ID NO: 2881682 - RNA, 18 nt, Human
cacacuaucauaguuaac

SEQ ID NO: 2881683 - RNA, 19 nt, Human
cacacuaucauaguuaaca

SEQ ID NO: 2881684 - RNA, 12 nt, Human
cacacuauuuua

SEQ ID NO: 2881685 - RNA, 14 nt, Human
cacacuauuuuaga

SEQ ID NO: 2881686 - RNA, 14 nt, Human
cacacucauccccu

SEQ ID NO: 2881687 - RNA, 13 nt, Human
cacacucagugca

SEQ ID NO: 2881688 - RNA, 18 nt, Human
cacacugaugcuuagaug

SEQ ID NO: 2881689 - RNA, 14 nt, Human
cacacugaugcuua

SEQ ID NO: 2881690 - RNA, 13 nt, Human
cacacuggacucc

SEQ ID NO: 2881691 - RNA, 19 nt, Human
cacacuggacuccggcccu

SEQ ID NO: 2881692 - RNA, 20 nt, Human
cacacuggacuccggcccuc

SEQ ID NO: 2881693 - RNA, 18 nt, Human
cacacugcacuguuuuca

SEQ ID NO: 2881694 - RNA, 19 nt, Human
cacacugguucucaaugaa

SEQ ID NO: 2881695 - RNA, 18 nt, Human
cacacugguucucaauga

SEQ ID NO: 2881696 - RNA, 18 nt, Human
cacacugucaugcuucau

SEQ ID NO: 2881697 - RNA, 20 nt, Human
cacacugucaugcuucauca

SEQ ID NO: 2881698 - RNA, 21 nt, Human
cacacugucaugcuucaucau

SEQ ID NO: 2881699 - RNA, 22 nt, Human
cacacugucaugcuucaucauu

SEQ ID NO: 2881700 - RNA, 12 nt, Human
cacacugugaca

SEQ ID NO: 2881701 - RNA, 14 nt, Human
cacacugugacaca

SEQ ID NO: 2881702 - RNA, 17 nt, Human
cacacugugacacacua

SEQ ID NO: 2881703 - RNA, 19 nt, Human
cacacugugacacacuaca

SEQ ID NO: 2881704 - RNA, 22 nt, Human
cacacugugacacacuacacca

SEQ ID NO: 2881705 - RNA, 20 nt, Human
cacacugguucucaaugaaa

SEQ ID NO: 2881706 - RNA, 15 nt, Human
cacacuguaaauaug

SEQ ID NO: 2881707 - RNA, 16 nt, Human
cacacugguucucaau

SEQ ID NO: 2881708 - RNA, 15 nt, Human
cacacugguucucaa

SEQ ID NO: 2881709 - RNA, 14 nt, Human
cacacugguucuca

SEQ ID NO: 2881710 - RNA, 16 nt, Human
cacacugguacuuaga

SEQ ID NO: 2881711 - RNA, 18 nt, Human
cacacugguacuuagagu

SEQ ID NO: 2881712 - RNA, 19 nt, Human
cacacugguacuuagaguu

SEQ ID NO: 2881713 - RNA, 22 nt, Human
cacacugguacuuagaguuucu

SEQ ID NO: 2881714 - RNA, 18 nt, Human
cacacuucaggcucuucu

SEQ ID NO: 2881715 - RNA, 20 nt, Human
cacacuucaggcucuucucc

SEQ ID NO: 2881716 - RNA, 21 nt, Human
cacacuucaggcucuucuccu

SEQ ID NO: 2881717 - RNA, 22 nt, Human
cacacuucaggcucuucuccuu

SEQ ID NO: 2881718 - RNA, 14 nt, Human
cacacuucaggcuc

SEQ ID NO: 2881719 - RNA, 17 nt, Human
cacacuucaggcucuuc

SEQ ID NO: 2881720 - RNA, 22 nt, Human
cacacuuacuguaagacauuag

SEQ ID NO: 2881721 - RNA, 21 nt, Human
cacagagcacuagguucaauu

SEQ ID NO: 2881722 - RNA, 18 nt, Human
cacagagagggagagcag

SEQ ID NO: 2881723 - RNA, 19 nt, Human
cacagagagggagagcaga

SEQ ID NO: 2881724 - RNA, 22 nt, Human
cacagagagggagagcagagaa

SEQ ID NO: 2881725 - RNA, 23 nt, Human
cacagagagggagagcagagaaa

SEQ ID NO: 2881726 - RNA, 18 nt, Human
cacagacucaaaugcuca

SEQ ID NO: 2881727 - RNA, 19 nt, Human
cacagacugguuuugcaac

SEQ ID NO: 2881728 - RNA, 15 nt, Human
cacagacucauccug

SEQ ID NO: 2881729 - RNA, 16 nt, Human
cacagacucauccuga

SEQ ID NO: 2881730 - RNA, 21 nt, Human
cacagacucauccugaacagc

SEQ ID NO: 2881731 - RNA, 22 nt, Human
cacagacucauccugaacagca

SEQ ID NO: 2881732 - RNA, 23 nt, Human
cacagacucauccugaacagcau

SEQ ID NO: 2881733 - RNA, 13 nt, Human
cacagagaagcug

SEQ ID NO: 2881734 - RNA, 14 nt, Human
cacagagaagcugg

SEQ ID NO: 2881735 - RNA, 15 nt, Human
cacagagaagcuggg

SEQ ID NO: 2881736 - RNA, 20 nt, Human
cacagagaagcuggggagga

SEQ ID NO: 2881737 - RNA, 17 nt, Human
cacacuuguuccagcuc

SEQ ID NO: 2881738 - RNA, 16 nt, Human
cacacuuguuccagcu

SEQ ID NO: 2881739 - RNA, 22 nt, Human
cacacuuguaggauaagugaaa

SEQ ID NO: 2881740 - RNA, 21 nt, Human
cacacuuggcccaaguggcag

SEQ ID NO: 2881741 - RNA, 15 nt, Human
cacacuuguuccagc

SEQ ID NO: 2881742 - RNA, 22 nt, Human
cacacuucugugagacccccac

SEQ ID NO: 2881743 - RNA, 15 nt, Human
cacacuucugugaga

SEQ ID NO: 2881744 - RNA, 14 nt, Human
cacacuuccagaca

SEQ ID NO: 2881745 - RNA, 15 nt, Human
cacaaccugcaucuu

SEQ ID NO: 2881746 - RNA, 19 nt, Human
cacaacuauuuuuccaaaa

SEQ ID NO: 2881747 - RNA, 14 nt, Human
cacaacuauuuuuc

SEQ ID NO: 2881748 - RNA, 18 nt, Human
cacaacuaguuuuguuua

SEQ ID NO: 2881749 - RNA, 12 nt, Human
cacacacaggug

SEQ ID NO: 2881750 - RNA, 12 nt, Human
cacacacauaca

SEQ ID NO: 2881751 - RNA, 13 nt, Human
cacacacauagau

SEQ ID NO: 2881752 - RNA, 13 nt, Human
cacacacauacac

SEQ ID NO: 2881753 - RNA, 14 nt, Human
cacacaccagagcc

SEQ ID NO: 2881754 - RNA, 13 nt, Human
cacacacaugcac

SEQ ID NO: 2881755 - RNA, 14 nt, Human
cacacacaugcaca

SEQ ID NO: 2881756 - RNA, 16 nt, Human
cacaacgugcaacuga

SEQ ID NO: 2881757 - RNA, 18 nt, Human
cacacacaugcuaggaug

SEQ ID NO: 2881758 - RNA, 14 nt, Human
cacacagaccacca

SEQ ID NO: 2881759 - RNA, 12 nt, Human
cacacagaaaua

SEQ ID NO: 2881760 - RNA, 14 nt, Human
cacacagaaauaua

SEQ ID NO: 2881761 - RNA, 16 nt, Human
cacacagaaauauaua

SEQ ID NO: 2881762 - RNA, 18 nt, Human
cacacagaaauauauaua

SEQ ID NO: 2881763 - RNA, 21 nt, Human
cacacagaaauauauauacau

SEQ ID NO: 2881764 - RNA, 22 nt, Human
cacacagaaauauauauacaua

SEQ ID NO: 2881765 - RNA, 12 nt, Human
cacacagcucug

SEQ ID NO: 2881766 - RNA, 21 nt, Human
cacacccucccccgccacucc

SEQ ID NO: 2881767 - RNA, 21 nt, Human
cacacccuguacuguucugug

SEQ ID NO: 2881768 - RNA, 14 nt, Human
cacacccuguuuua

SEQ ID NO: 2881769 - RNA, 12 nt, Human
cacacccugagg

SEQ ID NO: 2881770 - RNA, 13 nt, Human
cacacccugaggu

SEQ ID NO: 2881771 - RNA, 21 nt, Human
cacacccugaggucagggagu

SEQ ID NO: 2881772 - RNA, 22 nt, Human
cacacccugaggucagggagug

SEQ ID NO: 2881773 - RNA, 11 nt, Human
cacacccugca

SEQ ID NO: 2881774 - RNA, 12 nt, Human
cacacccugcaa

SEQ ID NO: 2881775 - RNA, 13 nt, Human
cacacccugcaag

SEQ ID NO: 2881776 - RNA, 15 nt, Human
cacacccugcaaggc

SEQ ID NO: 2881777 - RNA, 16 nt, Human
cacacccugcaaggcc

SEQ ID NO: 2881778 - RNA, 18 nt, Human
cacacccucacucugcca

SEQ ID NO: 2881779 - RNA, 19 nt, Human
cacacccucacucugccag

SEQ ID NO: 2881780 - RNA, 20 nt, Human
cacacccucacucugccagg

SEQ ID NO: 2881781 - RNA, 22 nt, Human
cacaccuuuuauugacacagaa

SEQ ID NO: 2881782 - RNA, 20 nt, Human
cacacuacaccacacacaac

SEQ ID NO: 2881783 - RNA, 22 nt, Human
cacacuacaccacacacaacag

SEQ ID NO: 2881784 - RNA, 23 nt, Human
cacacuacaccacacacaacagc

SEQ ID NO: 2881785 - RNA, 23 nt, Human
cacaccuuuuauugacacagaaa

SEQ ID NO: 2881786 - RNA, 20 nt, Human
cacacgaccggggccagcac

SEQ ID NO: 2881787 - RNA, 22 nt, Human
cacaccuguaaucccagcacuu

SEQ ID NO: 2881788 - RNA, 17 nt, Human
cacaccuguaaucccag

SEQ ID NO: 2881789 - RNA, 20 nt, Human
cacaccuguaaucccagcac

SEQ ID NO: 2881790 - RNA, 12 nt, Human
cacaccucugcc

SEQ ID NO: 2881791 - RNA, 13 nt, Human
cacaccucugcca

SEQ ID NO: 2881792 - RNA, 14 nt, Human
cacaccucugccag

SEQ ID NO: 2881793 - RNA, 16 nt, Human
cacacccacucagcuc

SEQ ID NO: 2881794 - RNA, 23 nt, Human
cacacccaggcacuuaagcacaa

SEQ ID NO: 2881795 - RNA, 15 nt, Human
cacacccacucagcu

SEQ ID NO: 2881796 - RNA, 14 nt, Human
cacacccacucagc

SEQ ID NO: 2881797 - RNA, 21 nt, Human
cacaccaggcuugccugcagg

SEQ ID NO: 2881798 - RNA, 22 nt, Human
cacaccaggcuugccugcaggc

SEQ ID NO: 2881799 - RNA, 16 nt, Human
cacaccagucacauga

SEQ ID NO: 2881800 - RNA, 13 nt, Human
cacaccagagccc

SEQ ID NO: 2881801 - RNA, 12 nt, Human
cacaccagagcc

SEQ ID NO: 2881802 - RNA, 15 nt, Human
cacaccagagcccac

SEQ ID NO: 2881803 - RNA, 13 nt, Human
cacacagcuccca

SEQ ID NO: 2881804 - RNA, 12 nt, Human
cacaacugacac

SEQ ID NO: 2881805 - RNA, 13 nt, Human
cacaacugacaca

SEQ ID NO: 2881806 - RNA, 15 nt, Human
cacaacugacacagg

SEQ ID NO: 2881807 - RNA, 16 nt, Human
cacaacugacacagga

SEQ ID NO: 2881808 - RNA, 17 nt, Human
cacaacugacacaggaa

SEQ ID NO: 2881809 - RNA, 13 nt, Human
cacagcagcuuca

SEQ ID NO: 2881810 - RNA, 21 nt, Human
cacagcagccuccaacacaag

SEQ ID NO: 2881811 - RNA, 12 nt, Human
cacagcagcauu

SEQ ID NO: 2881812 - RNA, 13 nt, Human
cacagcagcauuu

SEQ ID NO: 2881813 - RNA, 14 nt, Human
cacagcagcauuuu

SEQ ID NO: 2881814 - RNA, 15 nt, Human
cacagcagcauuuuu

SEQ ID NO: 2881815 - RNA, 13 nt, Human
cacagcaucugua

SEQ ID NO: 2881816 - RNA, 15 nt, Human
cacagcagcuucacc

SEQ ID NO: 2881817 - RNA, 18 nt, Human
cacagcagcuucaccaga

SEQ ID NO: 2881818 - RNA, 19 nt, Human
cacagcagcuucaccagag

SEQ ID NO: 2881819 - RNA, 21 nt, Human
cacagccuauaggccaaugca

SEQ ID NO: 2881820 - RNA, 22 nt, Human
cacagccgcagccucccucuga

SEQ ID NO: 2881821 - RNA, 21 nt, Human
cacagccgcagccucccucug

SEQ ID NO: 2881822 - RNA, 23 nt, Human
cacagccgcagccucccucugac

SEQ ID NO: 2881823 - RNA, 14 nt, Human
cacagccgcagccu

SEQ ID NO: 2881824 - RNA, 14 nt, Human
cacagcacaugcug

SEQ ID NO: 2881825 - RNA, 19 nt, Human
cacagcacaugcuggccag

SEQ ID NO: 2881826 - RNA, 20 nt, Human
cacagcacaugcuggccagc

SEQ ID NO: 2881827 - RNA, 21 nt, Human
cacagcacaugcuggccagcc

SEQ ID NO: 2881828 - RNA, 23 nt, Human
cacagcacaugcuggccagccug

SEQ ID NO: 2881829 - RNA, 16 nt, Human
cacagcagccccugca

SEQ ID NO: 2881830 - RNA, 12 nt, Human
cacagcagccug

SEQ ID NO: 2881831 - RNA, 14 nt, Human
cacagcagccugcu

SEQ ID NO: 2881832 - RNA, 19 nt, Human
cacagcagccugcuuccca

SEQ ID NO: 2881833 - RNA, 20 nt, Human
cacagcacgggggccaagga

SEQ ID NO: 2881834 - RNA, 15 nt, Human
cacagaguguagcca

SEQ ID NO: 2881835 - RNA, 21 nt, Human
cacagaguguagccagguccc

SEQ ID NO: 2881836 - RNA, 13 nt, Human
cacagagcgggga

SEQ ID NO: 2881837 - RNA, 14 nt, Human
cacagccuccucug

SEQ ID NO: 2881838 - RNA, 15 nt, Human
cacagccuccucugu

SEQ ID NO: 2881839 - RNA, 16 nt, Human
cacaggaucagucuga

SEQ ID NO: 2881840 - RNA, 15 nt, Human
cacaggaucagucug

SEQ ID NO: 2881841 - RNA, 12 nt, Human
cacaggaucagu

SEQ ID NO: 2881842 - RNA, 22 nt, Human
cacaggaagccugcaguccugg

SEQ ID NO: 2881843 - RNA, 10 nt, Human
cacagccucu

SEQ ID NO: 2881844 - RNA, 19 nt, Human
cacagccuccucugucugc

SEQ ID NO: 2881845 - RNA, 20 nt, Human
cacagccuccucugucugcc

SEQ ID NO: 2881846 - RNA, 21 nt, Human
cacagccuccucugucugccc

SEQ ID NO: 2881847 - RNA, 23 nt, Human
cacagccuccucugucugcccuu

SEQ ID NO: 2881848 - RNA, 10 nt, Human
cacaggcagg

SEQ ID NO: 2881849 - RNA, 11 nt, Human
cacaggcagcu

SEQ ID NO: 2881850 - RNA, 13 nt, Human
cacaggcagcuuu

SEQ ID NO: 2881851 - RNA, 15 nt, Human
cacaggcagcuuucu

SEQ ID NO: 2881852 - RNA, 16 nt, Human
cacaggcagcuuucua

SEQ ID NO: 2881853 - RNA, 18 nt, Human
cacaggcagcuuucuaga

SEQ ID NO: 2881854 - RNA, 19 nt, Human
cacaggcagcuuucuagaa

SEQ ID NO: 2881855 - RNA, 19 nt, Human
cacaggcccggcuccaggc

SEQ ID NO: 2881856 - RNA, 18 nt, Human
cacaggcccggcuccagg

SEQ ID NO: 2881857 - RNA, 17 nt, Human
cacaggcccggcuccag

SEQ ID NO: 2881858 - RNA, 16 nt, Human
cacaggcccggcucca

SEQ ID NO: 2881859 - RNA, 22 nt, Human
cacaguuggcuggaugaaauuu

SEQ ID NO: 2881860 - RNA, 21 nt, Human
cacaguuggugggguccugcc

SEQ ID NO: 2881861 - RNA, 12 nt, Human
cacauaaaacuu

SEQ ID NO: 2881862 - RNA, 12 nt, Human
cacaguuugaac

SEQ ID NO: 2881863 - RNA, 20 nt, Human
cacaguuugaugucauuaau

SEQ ID NO: 2881864 - RNA, 15 nt, Human
cacauaaaugcagcc

SEQ ID NO: 2881865 - RNA, 16 nt, Human
cacauaaaugcagccc

SEQ ID NO: 2881866 - RNA, 17 nt, Human
cacauaaaugcagccca

SEQ ID NO: 2881867 - RNA, 18 nt, Human
cacauaaaugcagcccau

SEQ ID NO: 2881868 - RNA, 22 nt, Human
cacauaauucaggaagcagcuu

SEQ ID NO: 2881869 - RNA, 21 nt, Human
cacauaagggguuugccauuu

SEQ ID NO: 2881870 - RNA, 17 nt, Human
cacauacacacacacgc

SEQ ID NO: 2881871 - RNA, 15 nt, Human
cacauacacgaaaga

SEQ ID NO: 2881872 - RNA, 20 nt, Human
cacauacacgaaagagagag

SEQ ID NO: 2881873 - RNA, 13 nt, Human
cacauacaguuuu

SEQ ID NO: 2881874 - RNA, 14 nt, Human
cacauacaguuuua

SEQ ID NO: 2881875 - RNA, 14 nt, Human
cacauauaccuaua

SEQ ID NO: 2881876 - RNA, 18 nt, Human
cacauauaccuauaaugu

SEQ ID NO: 2881877 - RNA, 22 nt, Human
cacauauaccuauaaugugugu

SEQ ID NO: 2881878 - RNA, 23 nt, Human
cacauauaccuauaaugugugua

SEQ ID NO: 2881879 - RNA, 14 nt, Human
cacauauauauuac

SEQ ID NO: 2881880 - RNA, 20 nt, Human
cacauaguucuccaguugua

SEQ ID NO: 2881881 - RNA, 14 nt, Human
cacauauacacaca

SEQ ID NO: 2881882 - RNA, 15 nt, Human
cacauauacacacac

SEQ ID NO: 2881883 - RNA, 16 nt, Human
cacauauacacacaca

SEQ ID NO: 2881884 - RNA, 21 nt, Human
cacauagugaugguuccccug

SEQ ID NO: 2881885 - RNA, 21 nt, Human
cacauauaaacaucacacaca

SEQ ID NO: 2881886 - RNA, 23 nt, Human
cacaggcccggcuccaggcuccu

SEQ ID NO: 2881887 - RNA, 20 nt, Human
cacaggcccggcuccaggcu

SEQ ID NO: 2881888 - RNA, 18 nt, Human
cacagugagucgaggaca

SEQ ID NO: 2881889 - RNA, 20 nt, Human
cacagugagucgaggacagg

SEQ ID NO: 2881890 - RNA, 19 nt, Human
cacagugagucgaggacag

SEQ ID NO: 2881891 - RNA, 12 nt, Human
cacaguuggccu

SEQ ID NO: 2881892 - RNA, 15 nt, Human
cacaguuggccuuca

SEQ ID NO: 2881893 - RNA, 23 nt, Human
cacaguuggccuucagaaccauc

SEQ ID NO: 2881894 - RNA, 17 nt, Human
cacaguuggcuggauga

SEQ ID NO: 2881895 - RNA, 12 nt, Human
cacaguugccac

SEQ ID NO: 2881896 - RNA, 14 nt, Human
cacaguugccacca

SEQ ID NO: 2881897 - RNA, 17 nt, Human
cacaguugccaccaccu

SEQ ID NO: 2881898 - RNA, 20 nt, Human
cacaguugccaccaccucug

SEQ ID NO: 2881899 - RNA, 22 nt, Human
cacaguugccaccaccucugug

SEQ ID NO: 2881900 - RNA, 23 nt, Human
cacaguugccaccaccucugugg

SEQ ID NO: 2881901 - RNA, 16 nt, Human
cacauuggaaagcaca

SEQ ID NO: 2881902 - RNA, 15 nt, Human
caccaagcccaguua

SEQ ID NO: 2881903 - RNA, 16 nt, Human
cacauuguuauuuuca

SEQ ID NO: 2881904 - RNA, 17 nt, Human
cacauuguuauuuucag

SEQ ID NO: 2881905 - RNA, 20 nt, Human
cacauuguuauuuucaguga

SEQ ID NO: 2881906 - RNA, 17 nt, Human
cacauuguuguuuuuuu

SEQ ID NO: 2881907 - RNA, 21 nt, Human
cacauuguuguuuuuuuaaua

SEQ ID NO: 2881908 - RNA, 22 nt, Human
cacauuguuguuuuuuuaauag

SEQ ID NO: 2881909 - RNA, 18 nt, Human
cacauuguuugcugcuau

SEQ ID NO: 2881910 - RNA, 19 nt, Human
cacauuguuugcugcuauu

SEQ ID NO: 2881911 - RNA, 17 nt, Human
cacauugagcugugcaa

SEQ ID NO: 2881912 - RNA, 14 nt, Human
cacauugcauucua

SEQ ID NO: 2881913 - RNA, 15 nt, Human
cacauugcauucuau

SEQ ID NO: 2881914 - RNA, 16 nt, Human
cacauugcauucuauu

SEQ ID NO: 2881915 - RNA, 18 nt, Human
cacauugcauucuauugc

SEQ ID NO: 2881916 - RNA, 19 nt, Human
cacauugcauucuauugcc

SEQ ID NO: 2881917 - RNA, 23 nt, Human
cacauugcauucuauugccuucu

SEQ ID NO: 2881918 - RNA, 22 nt, Human
cacauugagcugauauaaauuc

SEQ ID NO: 2881919 - RNA, 23 nt, Human
cacauugagcugauauaaauucu

SEQ ID NO: 2881920 - RNA, 15 nt, Human
caccacacccagccc

SEQ ID NO: 2881921 - RNA, 13 nt, Human
caccacacccagc

SEQ ID NO: 2881922 - RNA, 24 nt, Human
caccaauugguuaaucuuuccuga

SEQ ID NO: 2881923 - RNA, 16 nt, Human
caccaagcucaaagcg

SEQ ID NO: 2881924 - RNA, 13 nt, Human
caccaagcucaaa

SEQ ID NO: 2881925 - RNA, 17 nt, Human
caccacacccagcccac

SEQ ID NO: 2881926 - RNA, 14 nt, Human
caccacacccagcc

SEQ ID NO: 2881927 - RNA, 16 nt, Human
caccacagacacacac

SEQ ID NO: 2881928 - RNA, 19 nt, Human
caccacagacacacacacg

SEQ ID NO: 2881929 - RNA, 12 nt, Human
caccacacacaa

SEQ ID NO: 2881930 - RNA, 13 nt, Human
caccacacacaac

SEQ ID NO: 2881931 - RNA, 15 nt, Human
caccacacacaacag

SEQ ID NO: 2881932 - RNA, 17 nt, Human
caccacacacaacagcc

SEQ ID NO: 2881933 - RNA, 18 nt, Human
caccacacacaacagcca

SEQ ID NO: 2881934 - RNA, 14 nt, Human
caccacacauccca

SEQ ID NO: 2881935 - RNA, 15 nt, Human
caccacacaucccag

SEQ ID NO: 2881936 - RNA, 16 nt, Human
caccacacaucccagc

SEQ ID NO: 2881937 - RNA, 19 nt, Human
caccacacaucccagccca

SEQ ID NO: 2881938 - RNA, 20 nt, Human
caccacagacacacacacgc

SEQ ID NO: 2881939 - RNA, 21 nt, Human
caccacagacacacacacgca

SEQ ID NO: 2881940 - RNA, 21 nt, Human
caccacauccuccguccagcc

SEQ ID NO: 2881941 - RNA, 18 nt, Human
caccacauccuccgucca

SEQ ID NO: 2881942 - RNA, 20 nt, Human
caccacuaggacucugaggc

SEQ ID NO: 2881943 - RNA, 13 nt, Human
caccacuauaaaa

SEQ ID NO: 2881944 - RNA, 14 nt, Human
caccacuauaaaau

SEQ ID NO: 2881945 - RNA, 21 nt, Human
caccacuauaaaaugucuuca

SEQ ID NO: 2881946 - RNA, 13 nt, Human
caccacuccauuc

SEQ ID NO: 2881947 - RNA, 14 nt, Human
caccacuccauucc

SEQ ID NO: 2881948 - RNA, 15 nt, Human
caccacuccauuccc

SEQ ID NO: 2881949 - RNA, 16 nt, Human
caccacuccauuccca

SEQ ID NO: 2881950 - RNA, 22 nt, Human
caccacggcguuguaccuguag

SEQ ID NO: 2881951 - RNA, 17 nt, Human
caccacgguagugccug

SEQ ID NO: 2881952 - RNA, 15 nt, Human
caccacguccagcug

SEQ ID NO: 2881953 - RNA, 18 nt, Human
caccacaugugcacaugc

SEQ ID NO: 2881954 - RNA, 15 nt, Human
caccacaugugcaca

SEQ ID NO: 2881955 - RNA, 19 nt, Human
caccacaugugcacaugca

SEQ ID NO: 2881956 - RNA, 13 nt, Human
caccaccacaccc

SEQ ID NO: 2881957 - RNA, 15 nt, Human
caccacagacacaca

SEQ ID NO: 2881958 - RNA, 21 nt, Human
caccaccaaaugccaagaaaa

SEQ ID NO: 2881959 - RNA, 16 nt, Human
caccaccccaacaaac

SEQ ID NO: 2881960 - RNA, 18 nt, Human
caccaccccaacaaacca

SEQ ID NO: 2881961 - RNA, 13 nt, Human
caccaccucugug

SEQ ID NO: 2881962 - RNA, 14 nt, Human
caccaccucugugg

SEQ ID NO: 2881963 - RNA, 13 nt, Human
caccaccucccuc

SEQ ID NO: 2881964 - RNA, 14 nt, Human
caccaccucccuca

SEQ ID NO: 2881965 - RNA, 13 nt, Human
caccaccucagag

SEQ ID NO: 2881966 - RNA, 14 nt, Human
caccaccucagagu

SEQ ID NO: 2881967 - RNA, 22 nt, Human
caccacccuagucccuuccccu

SEQ ID NO: 2881968 - RNA, 14 nt, Human
cacauggaaaccca

SEQ ID NO: 2881969 - RNA, 17 nt, Human
cacauggaaacccauag

SEQ ID NO: 2881970 - RNA, 15 nt, Human
cacauggccuaugca

SEQ ID NO: 2881971 - RNA, 10 nt, Human
cacaucagau

SEQ ID NO: 2881972 - RNA, 21 nt, Human
cacaugggagcaguccaugca

SEQ ID NO: 2881973 - RNA, 22 nt, Human
cacaugggagcaguccaugcau

SEQ ID NO: 2881974 - RNA, 23 nt, Human
cacaugggagcaguccaugcaug

SEQ ID NO: 2881975 - RNA, 17 nt, Human
cacauggggaaaaaaau

SEQ ID NO: 2881976 - RNA, 18 nt, Human
cacauggugccccuagcu

SEQ ID NO: 2881977 - RNA, 20 nt, Human
cacauggugcuacgccugca

SEQ ID NO: 2881978 - RNA, 22 nt, Human
cacauggugcuacgccugcaug

SEQ ID NO: 2881979 - RNA, 12 nt, Human
cacauaucuguc

SEQ ID NO: 2881980 - RNA, 18 nt, Human
cacauuccuugccugcac

SEQ ID NO: 2881981 - RNA, 19 nt, Human
cacauuccuugccugcaca

SEQ ID NO: 2881982 - RNA, 13 nt, Human
cacauuauuucua

SEQ ID NO: 2881983 - RNA, 23 nt, Human
cacauucagggcuauuuuuuccc

SEQ ID NO: 2881984 - RNA, 11 nt, Human
cacauuccccu

SEQ ID NO: 2881985 - RNA, 15 nt, Human
cacauuccccugggg

SEQ ID NO: 2881986 - RNA, 17 nt, Human
cacauuccccuggggac

SEQ ID NO: 2881987 - RNA, 13 nt, Human
cacauguuuuuau

SEQ ID NO: 2881988 - RNA, 13 nt, Human
cacauuaaaaaau

SEQ ID NO: 2881989 - RNA, 16 nt, Human
cacauuaaaaaaugaa

SEQ ID NO: 2881990 - RNA, 19 nt, Human
cacauuaaaaaaugaaaua

SEQ ID NO: 2881991 - RNA, 20 nt, Human
cacauuaaaaaaugaaauau

SEQ ID NO: 2881992 - RNA, 22 nt, Human
cacauuaaaaaaugaaauauuu

SEQ ID NO: 2881993 - RNA, 22 nt, Human
cacauuaaguaaucaauaaaga

SEQ ID NO: 2881994 - RNA, 18 nt, Human
cacauuaauauuugcuga

SEQ ID NO: 2881995 - RNA, 19 nt, Human
cacauuaauauuugcugac

SEQ ID NO: 2881996 - RNA, 18 nt, Human
cacauuaauggucuaaaa

SEQ ID NO: 2881997 - RNA, 22 nt, Human
cacauuaauggucuaaaaauaa

SEQ ID NO: 2881998 - RNA, 13 nt, Human
cacauuagaacuu

SEQ ID NO: 2881999 - RNA, 14 nt, Human
cacauuagaacuuc

SEQ ID NO: 2882000 - RNA, 20 nt, Human
cacauuagauuuuauuuuac

SEQ ID NO: 2882001 - RNA, 21 nt, Human
cacauuagauuuuauuuuacu

SEQ ID NO: 2882002 - RNA, 23 nt, Human
cacauuagauuuuauuuuacuau

SEQ ID NO: 2882003 - RNA, 15 nt, Human
cacauuagaauuagu

SEQ ID NO: 2882004 - RNA, 15 nt, Human
cacaugugcacaugc

SEQ ID NO: 2882005 - RNA, 14 nt, Human
cacaugugcacaug

SEQ ID NO: 2882006 - RNA, 15 nt, Human
cacaugucuuguaca

SEQ ID NO: 2882007 - RNA, 20 nt, Human
cacaugucuuguacaugugu

SEQ ID NO: 2882008 - RNA, 13 nt, Human
cacaugugacaca

SEQ ID NO: 2882009 - RNA, 17 nt, Human
cacaugugcacaugcac

SEQ ID NO: 2882010 - RNA, 13 nt, Human
cacauguggacuu

SEQ ID NO: 2882011 - RNA, 15 nt, Human
cacaugugacacaua

SEQ ID NO: 2882012 - RNA, 15 nt, Human
caaauauaagauuuu

SEQ ID NO: 2882013 - RNA, 18 nt, Human
caaauauaagauuuucug

SEQ ID NO: 2882014 - RNA, 13 nt, Human
caaauauagagau

SEQ ID NO: 2882015 - RNA, 19 nt, Human
caaauauagcguucccaac

SEQ ID NO: 2882016 - RNA, 18 nt, Human
caaaugucuuccuggauu

SEQ ID NO: 2882017 - RNA, 15 nt, Human
caaaugucuuccugg

SEQ ID NO: 2882018 - RNA, 24 nt, Human
caaaugucuuuuagaagauagaug

SEQ ID NO: 2882019 - RNA, 11 nt, Human
caaaugugaag

SEQ ID NO: 2882020 - RNA, 14 nt, Human
caaaugugaagaug

SEQ ID NO: 2882021 - RNA, 15 nt, Human
caaaugugaagaugc

SEQ ID NO: 2882022 - RNA, 17 nt, Human
caaaugugaagaugcau

SEQ ID NO: 2882023 - RNA, 18 nt, Human
caaaugugaagaugcauu

SEQ ID NO: 2882024 - RNA, 20 nt, Human
caaauguguaucggaugcuu

SEQ ID NO: 2882025 - RNA, 20 nt, Human
caaauguguacauggcagag

SEQ ID NO: 2882026 - RNA, 23 nt, Human
caaauguguacauggcagaguuu

SEQ ID NO: 2882027 - RNA, 14 nt, Human
caaauguggcuccu

SEQ ID NO: 2882028 - RNA, 16 nt, Human
caaauucauauucugu

SEQ ID NO: 2882029 - RNA, 17 nt, Human
caaauucauauucuuuu

SEQ ID NO: 2882030 - RNA, 12 nt, Human
caaauguucuaa

SEQ ID NO: 2882031 - RNA, 22 nt, Human
caaauguucuaaguuucuaaga

SEQ ID NO: 2882032 - RNA, 23 nt, Human
caaauguucuaaguuucuaagau

SEQ ID NO: 2882033 - RNA, 10 nt, Human
caaauguuga

SEQ ID NO: 2882034 - RNA, 16 nt, Human
caaauguuuaaacauu

SEQ ID NO: 2882035 - RNA, 18 nt, Human
caaauguuuaaacauuuu

SEQ ID NO: 2882036 - RNA, 14 nt, Human
caaauguucuaagu

SEQ ID NO: 2882037 - RNA, 15 nt, Human
caaauguucuaaguu

SEQ ID NO: 2882038 - RNA, 19 nt, Human
caaauguucuaaguuucua

SEQ ID NO: 2882039 - RNA, 21 nt, Human
caaauguucuaaguuucuaag

SEQ ID NO: 2882040 - RNA, 20 nt, Human
caaauaguuuauaaauguga

SEQ ID NO: 2882041 - RNA, 17 nt, Human
caaauauaaaacuuaca

SEQ ID NO: 2882042 - RNA, 13 nt, Human
caaauauaaacau

SEQ ID NO: 2882043 - RNA, 16 nt, Human
caaauauaaaucuuaa

SEQ ID NO: 2882044 - RNA, 13 nt, Human
caaauaaucacau

SEQ ID NO: 2882045 - RNA, 15 nt, Human
caaauacuuagcaaa

SEQ ID NO: 2882046 - RNA, 19 nt, Human
caaauacuuagcaaaaagu

SEQ ID NO: 2882047 - RNA, 22 nt, Human
caaauacuuagcaaaaaguggg

SEQ ID NO: 2882048 - RNA, 14 nt, Human
caaauaauaagcaa

SEQ ID NO: 2882049 - RNA, 16 nt, Human
caaauaauuuuagugu

SEQ ID NO: 2882050 - RNA, 14 nt, Human
caaaggcaaguuaa

SEQ ID NO: 2882051 - RNA, 19 nt, Human
caaaggauuaauugcugca

SEQ ID NO: 2882052 - RNA, 20 nt, Human
caaaggauuaauugcugcaa

SEQ ID NO: 2882053 - RNA, 14 nt, Human
caaaguuuuaucaa

SEQ ID NO: 2882054 - RNA, 22 nt, Human
caaaguuuccuaaucagaaauu

SEQ ID NO: 2882055 - RNA, 13 nt, Human
caaaguuuugaaa

SEQ ID NO: 2882056 - RNA, 14 nt, Human
caaaguuuugaaaa

SEQ ID NO: 2882057 - RNA, 17 nt, Human
caaaguuuugaaaagcu

SEQ ID NO: 2882058 - RNA, 18 nt, Human
caaaguuuugaaaagcua

SEQ ID NO: 2882059 - RNA, 19 nt, Human
caaaguuuugaaaagcuau

SEQ ID NO: 2882060 - RNA, 20 nt, Human
caaaguuuugaaaagcuauu

SEQ ID NO: 2882061 - RNA, 21 nt, Human
caaaguuuugaaaagcuauua

SEQ ID NO: 2882062 - RNA, 16 nt, Human
caaauaaguauuuaua

SEQ ID NO: 2882063 - RNA, 18 nt, Human
caaauaaguauuuauaau

SEQ ID NO: 2882064 - RNA, 17 nt, Human
caaauaaguauuuauaa

SEQ ID NO: 2882065 - RNA, 15 nt, Human
caaauaacuucaguc

SEQ ID NO: 2882066 - RNA, 16 nt, Human
caaauaacuucagucc

SEQ ID NO: 2882067 - RNA, 17 nt, Human
caaauaacuucaguccu

SEQ ID NO: 2882068 - RNA, 23 nt, Human
caaauaacuucaguccugcucca

SEQ ID NO: 2882069 - RNA, 19 nt, Human
caaagaaagaaaguuuaga

SEQ ID NO: 2882070 - RNA, 23 nt, Human
caaagaggacucgcuuguaaaua

SEQ ID NO: 2882071 - RNA, 20 nt, Human
caaacuuuucaaggcuuaua

SEQ ID NO: 2882072 - RNA, 21 nt, Human
caaacuuuucaaggcuuauau

SEQ ID NO: 2882073 - RNA, 21 nt, Human
caaacuuggguagaguuuaca

SEQ ID NO: 2882074 - RNA, 23 nt, Human
caaacuuggguagaguuuacagc

SEQ ID NO: 2882075 - RNA, 18 nt, Human
caaacuuuuauacucuuu

SEQ ID NO: 2882076 - RNA, 17 nt, Human
caaacuuuucaaggcuu

SEQ ID NO: 2882077 - RNA, 19 nt, Human
caaacuuuucaaggcuuau

SEQ ID NO: 2882078 - RNA, 16 nt, Human
caaagaggcugccccu

SEQ ID NO: 2882079 - RNA, 15 nt, Human
caaagaggcugcccc

SEQ ID NO: 2882080 - RNA, 13 nt, Human
caaagaggcugcc

SEQ ID NO: 2882081 - RNA, 12 nt, Human
caaagaggcugc

SEQ ID NO: 2882082 - RNA, 13 nt, Human
caaagagguauuu

SEQ ID NO: 2882083 - RNA, 22 nt, Human
caaagaggcugccccucucacc

SEQ ID NO: 2882084 - RNA, 21 nt, Human
caaagaggcugccccucucac

SEQ ID NO: 2882085 - RNA, 23 nt, Human
caaagaggcugccccucucacca

SEQ ID NO: 2882086 - RNA, 23 nt, Human
caaaaaaauauauuuaaugauaa

SEQ ID NO: 2882087 - RNA, 21 nt, Human
caaaaaaauuaaaauggaugc

SEQ ID NO: 2882088 - RNA, 15 nt, Human
caaacuuacuauuuu

SEQ ID NO: 2882089 - RNA, 16 nt, Human
caaacuuacuauuuug

SEQ ID NO: 2882090 - RNA, 18 nt, Human
caaacuuacuauuuugac

SEQ ID NO: 2882091 - RNA, 17 nt, Human
caaacuucacucugggc

SEQ ID NO: 2882092 - RNA, 13 nt, Human
caaacuugcuuua

SEQ ID NO: 2882093 - RNA, 17 nt, Human
caaaaaaguccaauuuu

SEQ ID NO: 2882094 - RNA, 18 nt, Human
caaaaaaguccaauuuua

SEQ ID NO: 2882095 - RNA, 22 nt, Human
caaaaaaguccaauuuuaauuu

SEQ ID NO: 2882096 - RNA, 19 nt, Human
caaaaaauacuuuuucuaa

SEQ ID NO: 2882097 - RNA, 17 nt, Human
caaaggaggcuggcagg

SEQ ID NO: 2882098 - RNA, 16 nt, Human
caaagcuuuuuccaga

SEQ ID NO: 2882099 - RNA, 15 nt, Human
caaagcuaggccugg

SEQ ID NO: 2882100 - RNA, 21 nt, Human
caaagccaaagcuaggccugg

SEQ ID NO: 2882101 - RNA, 20 nt, Human
caaagccaaagcuaggccug

SEQ ID NO: 2882102 - RNA, 22 nt, Human
caaagccaaacucugccagcca

SEQ ID NO: 2882103 - RNA, 18 nt, Human
caaagccaaacucugcca

SEQ ID NO: 2882104 - RNA, 17 nt, Human
caaagccaaacucugcc

SEQ ID NO: 2882105 - RNA, 17 nt, Human
caaagcuaggccuggcc

SEQ ID NO: 2882106 - RNA, 16 nt, Human
caaagcuaggccuggc

SEQ ID NO: 2882107 - RNA, 18 nt, Human
caaagcuaggccuggcca

SEQ ID NO: 2882108 - RNA, 17 nt, Human
caaagcuggcucaccuu

SEQ ID NO: 2882109 - RNA, 12 nt, Human
caaagcuguuaa

SEQ ID NO: 2882110 - RNA, 13 nt, Human
caaagcuguuaaa

SEQ ID NO: 2882111 - RNA, 16 nt, Human
caaagcuguuaaacug

SEQ ID NO: 2882112 - RNA, 17 nt, Human
caaagcuguuaaacugu

SEQ ID NO: 2882113 - RNA, 18 nt, Human
caaagcuguuaaacuguu

SEQ ID NO: 2882114 - RNA, 19 nt, Human
caaagcuguuaaacuguua

SEQ ID NO: 2882115 - RNA, 20 nt, Human
caaagcuguuaaacuguuag

SEQ ID NO: 2882116 - RNA, 22 nt, Human
caaagcuguuaaacuguuagca

SEQ ID NO: 2882117 - RNA, 16 nt, Human
caaagcuggcucaccu

SEQ ID NO: 2882118 - RNA, 15 nt, Human
caaauucucaccaaa

SEQ ID NO: 2882119 - RNA, 16 nt, Human
caaauucugaauauuu

SEQ ID NO: 2882120 - RNA, 23 nt, Human
caacaggcugggcuucaguggca

SEQ ID NO: 2882121 - RNA, 24 nt, Human
caacaggcugggcuucaguggcag

SEQ ID NO: 2882122 - RNA, 19 nt, Human
caacaggcuguucugcacu

SEQ ID NO: 2882123 - RNA, 20 nt, Human
caacaggcuguucugcacug

SEQ ID NO: 2882124 - RNA, 21 nt, Human
caacaggcuguucugcacuga

SEQ ID NO: 2882125 - RNA, 22 nt, Human
caacaggcuguucugcacugaa

SEQ ID NO: 2882126 - RNA, 23 nt, Human
caacaggcuguucugcacugaaa

SEQ ID NO: 2882127 - RNA, 24 nt, Human
caacaggcuguucugcacugaaaa

SEQ ID NO: 2882128 - RNA, 20 nt, Human
caacaggcuuaugaauauau

SEQ ID NO: 2882129 - RNA, 21 nt, Human
caacauccauguccuaugugu

SEQ ID NO: 2882130 - RNA, 23 nt, Human
caacauccauguccuauguguga

SEQ ID NO: 2882131 - RNA, 12 nt, Human
caacagucaugu

SEQ ID NO: 2882132 - RNA, 14 nt, Human
caacagucauguuu

SEQ ID NO: 2882133 - RNA, 16 nt, Human
caacagucauguuuua

SEQ ID NO: 2882134 - RNA, 19 nt, Human
caaccccuucgcuccugug

SEQ ID NO: 2882135 - RNA, 18 nt, Human
caaccccuucgcuccugu

SEQ ID NO: 2882136 - RNA, 21 nt, Human
caaccccuucgcuccuguguc

SEQ ID NO: 2882137 - RNA, 21 nt, Human
caacccucagagccaccccua

SEQ ID NO: 2882138 - RNA, 18 nt, Human
caacccucagagccaccc

SEQ ID NO: 2882139 - RNA, 14 nt, Human
caaccacacaccuc

SEQ ID NO: 2882140 - RNA, 20 nt, Human
caaccacacaccucaccaga

SEQ ID NO: 2882141 - RNA, 20 nt, Human
caaccaauuuacacugccau

SEQ ID NO: 2882142 - RNA, 18 nt, Human
caaccaagucaugugcau

SEQ ID NO: 2882143 - RNA, 20 nt, Human
caaccaagucaugugcauuu

SEQ ID NO: 2882144 - RNA, 23 nt, Human
caacauuuacaguccuucaaaau

SEQ ID NO: 2882145 - RNA, 22 nt, Human
caacauuuuagcucuauugaua

SEQ ID NO: 2882146 - RNA, 19 nt, Human
caacauuuugagaacaaag

SEQ ID NO: 2882147 - RNA, 20 nt, Human
caacauuuugagaacaaaga

SEQ ID NO: 2882148 - RNA, 21 nt, Human
caacauuuugagaacaaagau

SEQ ID NO: 2882149 - RNA, 10 nt, Human
caacauugug

SEQ ID NO: 2882150 - RNA, 16 nt, Human
caacauugugauguau

SEQ ID NO: 2882151 - RNA, 20 nt, Human
caacauuguucaccuuugua

SEQ ID NO: 2882152 - RNA, 23 nt, Human
caacauuguucaccuuuguagca

SEQ ID NO: 2882153 - RNA, 21 nt, Human
caacauuacagggaaugccug

SEQ ID NO: 2882154 - RNA, 17 nt, Human
caacauugcuugugcca

SEQ ID NO: 2882155 - RNA, 20 nt, Human
caacauguagcugaguuuaa

SEQ ID NO: 2882156 - RNA, 15 nt, Human
caacauggugucugg

SEQ ID NO: 2882157 - RNA, 16 nt, Human
caacauggugucugga

SEQ ID NO: 2882158 - RNA, 23 nt, Human
caacaugccugccccaaacaaau

SEQ ID NO: 2882159 - RNA, 15 nt, Human
caacauccugccagc

SEQ ID NO: 2882160 - RNA, 16 nt, Human
caacauccugccagcc

SEQ ID NO: 2882161 - RNA, 17 nt, Human
caacauccugccagccc

SEQ ID NO: 2882162 - RNA, 18 nt, Human
caacauccugccagcccc

SEQ ID NO: 2882163 - RNA, 13 nt, Human
caacaucuuuuua

SEQ ID NO: 2882164 - RNA, 14 nt, Human
caacucugagccca

SEQ ID NO: 2882165 - RNA, 14 nt, Human
caacuuaacauggg

SEQ ID NO: 2882166 - RNA, 15 nt, Human
caacuuaacaugggc

SEQ ID NO: 2882167 - RNA, 16 nt, Human
caacuuaacaugggcu

SEQ ID NO: 2882168 - RNA, 15 nt, Human
caacuuaauaaaaac

SEQ ID NO: 2882169 - RNA, 19 nt, Human
caacuguuguaacuaggcu

SEQ ID NO: 2882170 - RNA, 19 nt, Human
caacuguuaugaaauaaag

SEQ ID NO: 2882171 - RNA, 22 nt, Human
caacuguguuguauuaacaaaa

SEQ ID NO: 2882172 - RNA, 18 nt, Human
caacugcucuuuuauacu

SEQ ID NO: 2882173 - RNA, 23 nt, Human
caacugccucgaaacacagaaac

SEQ ID NO: 2882174 - RNA, 13 nt, Human
caacugccugccu

SEQ ID NO: 2882175 - RNA, 21 nt, Human
caacugccucgaaacacagaa

SEQ ID NO: 2882176 - RNA, 13 nt, Human
caacucugucccc

SEQ ID NO: 2882177 - RNA, 19 nt, Human
caacucuucgaagccuugc

SEQ ID NO: 2882178 - RNA, 23 nt, Human
caacuucccaguucaggaguccc

SEQ ID NO: 2882179 - RNA, 14 nt, Human
caacuucaguccug

SEQ ID NO: 2882180 - RNA, 17 nt, Human
caacuucaguccuggga

SEQ ID NO: 2882181 - RNA, 18 nt, Human
caagaaaacaacuucaau

SEQ ID NO: 2882182 - RNA, 23 nt, Human
caacuuucuguaaacucaaaacu

SEQ ID NO: 2882183 - RNA, 11 nt, Human
caacuuucugu

SEQ ID NO: 2882184 - RNA, 12 nt, Human
caacuuucugua

SEQ ID NO: 2882185 - RNA, 16 nt, Human
caacuuucuguaaacu

SEQ ID NO: 2882186 - RNA, 18 nt, Human
caacccucaggggaaaac

SEQ ID NO: 2882187 - RNA, 16 nt, Human
caaccucuucuggcuc

SEQ ID NO: 2882188 - RNA, 18 nt, Human
caaccgacaggcccuggc

SEQ ID NO: 2882189 - RNA, 20 nt, Human
caacccuuaccccuuagccu

SEQ ID NO: 2882190 - RNA, 19 nt, Human
caacccuuaccccuuagcc

SEQ ID NO: 2882191 - RNA, 15 nt, Human
caacccuuaccccuu

SEQ ID NO: 2882192 - RNA, 22 nt, Human
caacccuuaccccuuagccucc

SEQ ID NO: 2882193 - RNA, 16 nt, Human
caaccugauuguaaac

SEQ ID NO: 2882194 - RNA, 17 nt, Human
caaccucuucuggcuca

SEQ ID NO: 2882195 - RNA, 18 nt, Human
caaccucuucuggcucaa

SEQ ID NO: 2882196 - RNA, 14 nt, Human
caacgccgugggcu

SEQ ID NO: 2882197 - RNA, 14 nt, Human
caacgcacaggaaa

SEQ ID NO: 2882198 - RNA, 18 nt, Human
caacgcagcccugcuuug

SEQ ID NO: 2882199 - RNA, 12 nt, Human
caacgcagcccu

SEQ ID NO: 2882200 - RNA, 13 nt, Human
caacgcagcccug

SEQ ID NO: 2882201 - RNA, 15 nt, Human
caacgcagcccugcu

SEQ ID NO: 2882202 - RNA, 17 nt, Human
caagcacugugcucagg

SEQ ID NO: 2882203 - RNA, 11 nt, Human
caagcacugau

SEQ ID NO: 2882204 - RNA, 12 nt, Human
caagcacugaua

SEQ ID NO: 2882205 - RNA, 15 nt, Human
caagcacugauaucu

SEQ ID NO: 2882206 - RNA, 12 nt, Human
caagcacugugc

SEQ ID NO: 2882207 - RNA, 13 nt, Human
caagcacugugcu

SEQ ID NO: 2882208 - RNA, 18 nt, Human
caagcaccuccugccucg

SEQ ID NO: 2882209 - RNA, 16 nt, Human
caagaaagcugguaaa

SEQ ID NO: 2882210 - RNA, 14 nt, Human
caagaaagauguau

SEQ ID NO: 2882211 - RNA, 19 nt, Human
caagaaacugaggaauuuu

SEQ ID NO: 2882212 - RNA, 18 nt, Human
caagaaacugaggaauuu

SEQ ID NO: 2882213 - RNA, 12 nt, Human
caagaaaaucag

SEQ ID NO: 2882214 - RNA, 18 nt, Human
caagaaaaucagguauua

SEQ ID NO: 2882215 - RNA, 18 nt, Human
caagcccccccuuccacu

SEQ ID NO: 2882216 - RNA, 17 nt, Human
caagcccccccuuccac

SEQ ID NO: 2882217 - RNA, 21 nt, Human
caagccccugcuccagaagau

SEQ ID NO: 2882218 - RNA, 19 nt, Human
caagccacaagucuuccag

SEQ ID NO: 2882219 - RNA, 20 nt, Human
caagccacaagucuuccaga

SEQ ID NO: 2882220 - RNA, 16 nt, Human
caagcgugagccacug

SEQ ID NO: 2882221 - RNA, 21 nt, Human
caagcccuccccaucccaugu

SEQ ID NO: 2882222 - RNA, 17 nt, Human
caagcccuacagagcug

SEQ ID NO: 2882223 - RNA, 18 nt, Human
caagcccuacagagcugu

SEQ ID NO: 2882224 - RNA, 14 nt, Human
caagccguggcuuc

SEQ ID NO: 2882225 - RNA, 15 nt, Human
caagccguggcuucc

SEQ ID NO: 2882226 - RNA, 16 nt, Human
caagccguggcuuccc

SEQ ID NO: 2882227 - RNA, 19 nt, Human
caaggaugccccguccccc

SEQ ID NO: 2882228 - RNA, 19 nt, Human
caaggaccuccucuucccc

SEQ ID NO: 2882229 - RNA, 20 nt, Human
caaggaccuccucuuccccc

SEQ ID NO: 2882230 - RNA, 16 nt, Human
caaggacauucuugua

SEQ ID NO: 2882231 - RNA, 16 nt, Human
caaggagucagacauu

SEQ ID NO: 2882232 - RNA, 18 nt, Human
caagcgugagccacugca

SEQ ID NO: 2882233 - RNA, 17 nt, Human
caagcgugagccacugc

SEQ ID NO: 2882234 - RNA, 17 nt, Human
caaggaaagccccagca

SEQ ID NO: 2882235 - RNA, 22 nt, Human
caaggaaaccacagcugcugga

SEQ ID NO: 2882236 - RNA, 22 nt, Human
caaggaaaccgccuaguuuacu

SEQ ID NO: 2882237 - RNA, 20 nt, Human
caaggaaacgcuaccucucu

SEQ ID NO: 2882238 - RNA, 17 nt, Human
caaggaaaccacagcug

SEQ ID NO: 2882239 - RNA, 18 nt, Human
caaggaaaccacagcugc

SEQ ID NO: 2882240 - RNA, 20 nt, Human
caaggaaaccacagcugcug

SEQ ID NO: 2882241 - RNA, 21 nt, Human
caaggaaaccacagcugcugg

SEQ ID NO: 2882242 - RNA, 15 nt, Human
caaggaaaaacaggu

SEQ ID NO: 2882243 - RNA, 12 nt, Human
caaggaaaaaga

SEQ ID NO: 2882244 - RNA, 13 nt, Human
caaggaaaaagaa

SEQ ID NO: 2882245 - RNA, 16 nt, Human
caaggaaaaagaaaau

SEQ ID NO: 2882246 - RNA, 17 nt, Human
caaggaaaaagaaaaua

SEQ ID NO: 2882247 - RNA, 14 nt, Human
caaggaaaacugca

SEQ ID NO: 2882248 - RNA, 16 nt, Human
caaggaaaacugcaug

SEQ ID NO: 2882249 - RNA, 14 nt, Human
caaggaaaccacag

SEQ ID NO: 2882250 - RNA, 18 nt, Human
caaggacagccccuccuc

SEQ ID NO: 2882251 - RNA, 11 nt, Human
caaggaagagc

SEQ ID NO: 2882252 - RNA, 16 nt, Human
caaggaagauauacau

SEQ ID NO: 2882253 - RNA, 17 nt, Human
caaggaagauauacaug

SEQ ID NO: 2882254 - RNA, 20 nt, Human
caaggaaagccccagcacua

SEQ ID NO: 2882255 - RNA, 14 nt, Human
caaggaaaggccug

SEQ ID NO: 2882256 - RNA, 19 nt, Human
caaggaaaggggagaaggg

SEQ ID NO: 2882257 - RNA, 15 nt, Human
caaggaaaggcaaau

SEQ ID NO: 2882258 - RNA, 20 nt, Human
caaggaaauacccuucuuuu

SEQ ID NO: 2882259 - RNA, 16 nt, Human
caaggaacaaaaaaac

SEQ ID NO: 2882260 - RNA, 18 nt, Human
caaggaacaaaaaaacca

SEQ ID NO: 2882261 - RNA, 22 nt, Human
caaggaacuaauuucuucuccu

SEQ ID NO: 2882262 - RNA, 18 nt, Human
caaggaacuugaaaaaua

SEQ ID NO: 2882263 - RNA, 21 nt, Human
caaggaccaggacucccuccu

SEQ ID NO: 2882264 - RNA, 20 nt, Human
caaggaccaggacucccucc

SEQ ID NO: 2882265 - RNA, 18 nt, Human
caaggaccaggacucccu

SEQ ID NO: 2882266 - RNA, 16 nt, Human
caaggaccaggacucc

SEQ ID NO: 2882267 - RNA, 15 nt, Human
caaggaccaggacuc

SEQ ID NO: 2882268 - RNA, 14 nt, Human
caaggaccaggacu

SEQ ID NO: 2882269 - RNA, 13 nt, Human
caaggaccaggac

SEQ ID NO: 2882270 - RNA, 17 nt, Human
caagugauucuccugcc

SEQ ID NO: 2882271 - RNA, 16 nt, Human
caagugauucuccugc

SEQ ID NO: 2882272 - RNA, 22 nt, Human
caagugauucucaugccucagc

SEQ ID NO: 2882273 - RNA, 22 nt, Human
caagucucugcuggcccagcca

SEQ ID NO: 2882274 - RNA, 19 nt, Human
caagucucugcuggcccag

SEQ ID NO: 2882275 - RNA, 18 nt, Human
caagucucugcuggccca

SEQ ID NO: 2882276 - RNA, 16 nt, Human
caagucucaguggcuu

SEQ ID NO: 2882277 - RNA, 23 nt, Human
caagucucaguggcuucaucugu

SEQ ID NO: 2882278 - RNA, 23 nt, Human
caagucucugcuggcccagccaa

SEQ ID NO: 2882279 - RNA, 20 nt, Human
caagucuuuaggucuuugua

SEQ ID NO: 2882280 - RNA, 21 nt, Human
caagucuuuaggucuuuguaa

SEQ ID NO: 2882281 - RNA, 22 nt, Human
caagucuuuaggucuuuguaag

SEQ ID NO: 2882282 - RNA, 21 nt, Human
caagugauucuccugccucag

SEQ ID NO: 2882283 - RNA, 22 nt, Human
caagugauucuccugccucagc

SEQ ID NO: 2882284 - RNA, 14 nt, Human
caagugauucuccu

SEQ ID NO: 2882285 - RNA, 18 nt, Human
caagugauugggacagag

SEQ ID NO: 2882286 - RNA, 19 nt, Human
caagugauugggacagagg

SEQ ID NO: 2882287 - RNA, 14 nt, Human
caagugcacggggc

SEQ ID NO: 2882288 - RNA, 20 nt, Human
caagugcacggggcacagcg

SEQ ID NO: 2882289 - RNA, 20 nt, Human
caagugcacuuucuaauguu

SEQ ID NO: 2882290 - RNA, 17 nt, Human
caagugggaucugucac

SEQ ID NO: 2882291 - RNA, 19 nt, Human
caagugguuuccacaugcu

SEQ ID NO: 2882292 - RNA, 21 nt, Human
caagugguuuccacaugcucu

SEQ ID NO: 2882293 - RNA, 22 nt, Human
caagugguuuccacaugcucug

SEQ ID NO: 2882294 - RNA, 20 nt, Human
caagugggaucugucacacc

SEQ ID NO: 2882295 - RNA, 22 nt, Human
caagugggaucugucacaccag

SEQ ID NO: 2882296 - RNA, 17 nt, Human
caaggugggcugagccc

SEQ ID NO: 2882297 - RNA, 16 nt, Human
caaggugggcugagcc

SEQ ID NO: 2882298 - RNA, 12 nt, Human
caaggugggcug

SEQ ID NO: 2882299 - RNA, 17 nt, Human
caagguggccaaauuau

SEQ ID NO: 2882300 - RNA, 19 nt, Human
caagguggccaaauuauuu

SEQ ID NO: 2882301 - RNA, 24 nt, Human
caaggugggcugagcccuggcagg

SEQ ID NO: 2882302 - RNA, 23 nt, Human
caaggugggcugagcccuggcag

SEQ ID NO: 2882303 - RNA, 17 nt, Human
caagguggucaguaaau

SEQ ID NO: 2882304 - RNA, 17 nt, Human
caagguggugugaucuu

SEQ ID NO: 2882305 - RNA, 18 nt, Human
caagguggugugaucuua

SEQ ID NO: 2882306 - RNA, 17 nt, Human
caaggugucauuuaugu

SEQ ID NO: 2882307 - RNA, 21 nt, Human
caaggugggcugagcccuggc

SEQ ID NO: 2882308 - RNA, 20 nt, Human
caaggugggcugagcccugg

SEQ ID NO: 2882309 - RNA, 19 nt, Human
caaggugggcugagcccug

SEQ ID NO: 2882310 - RNA, 18 nt, Human
caaggugggcugagcccu

SEQ ID NO: 2882311 - RNA, 16 nt, Human
caagucggaacagcag

SEQ ID NO: 2882312 - RNA, 17 nt, Human
caagucggaacagcaga

SEQ ID NO: 2882313 - RNA, 18 nt, Human
caagucggaacagcagau

SEQ ID NO: 2882314 - RNA, 15 nt, Human
caaguccuuuuguaa

SEQ ID NO: 2882315 - RNA, 16 nt, Human
caaguccuuuuguaaa

SEQ ID NO: 2882316 - RNA, 17 nt, Human
caaguccuuuuguaaag

SEQ ID NO: 2882317 - RNA, 18 nt, Human
caaguccuuuuguaaagu

SEQ ID NO: 2882318 - RNA, 19 nt, Human
caaguccuggauguugugu

SEQ ID NO: 2882319 - RNA, 15 nt, Human
caaguccugugaauu

SEQ ID NO: 2882320 - RNA, 17 nt, Human
caaguccugugaauuuc

SEQ ID NO: 2882321 - RNA, 18 nt, Human
caaguccugugaauuucu

SEQ ID NO: 2882322 - RNA, 14 nt, Human
caaggauugaaaau

SEQ ID NO: 2882323 - RNA, 15 nt, Human
caaggauugaaaauu

SEQ ID NO: 2882324 - RNA, 15 nt, Human
caaggauugcuacug

SEQ ID NO: 2882325 - RNA, 15 nt, Human
caaggugcaaaucaa

SEQ ID NO: 2882326 - RNA, 14 nt, Human
caaggucuuugguu

SEQ ID NO: 2882327 - RNA, 23 nt, Human
caaggugaagaugggaacgcaga

SEQ ID NO: 2882328 - RNA, 13 nt, Human
caaggugacagaa

SEQ ID NO: 2882329 - RNA, 14 nt, Human
caaggugacagaag

SEQ ID NO: 2882330 - RNA, 20 nt, Human
caaggugacagaaggaccag

SEQ ID NO: 2882331 - RNA, 21 nt, Human
caaggugacagaaggaccagc

SEQ ID NO: 2882332 - RNA, 13 nt, Human
cacccacccuggg

SEQ ID NO: 2882333 - RNA, 14 nt, Human
cacccacccuggga

SEQ ID NO: 2882334 - RNA, 22 nt, Human
cacccaccaucaugucuggcua

SEQ ID NO: 2882335 - RNA, 20 nt, Human
cacccaccaucaugucuggc

SEQ ID NO: 2882336 - RNA, 16 nt, Human
cacccaccucagccuc

SEQ ID NO: 2882337 - RNA, 14 nt, Human
cacccaccucagcc

SEQ ID NO: 2882338 - RNA, 13 nt, Human
cacccaccucagc

SEQ ID NO: 2882339 - RNA, 12 nt, Human
cacccaccucag

SEQ ID NO: 2882340 - RNA, 13 nt, Human
caccccaggacuc

SEQ ID NO: 2882341 - RNA, 15 nt, Human
caccccagggccuga

SEQ ID NO: 2882342 - RNA, 21 nt, Human
caccccaucccacacccugga

SEQ ID NO: 2882343 - RNA, 15 nt, Human
caccccaucccacac

SEQ ID NO: 2882344 - RNA, 12 nt, Human
caccccauccca

SEQ ID NO: 2882345 - RNA, 22 nt, Human
caccccagggccugagccuggc

SEQ ID NO: 2882346 - RNA, 17 nt, Human
caccccagggccugagc

SEQ ID NO: 2882347 - RNA, 16 nt, Human
caccccagggccugag

SEQ ID NO: 2882348 - RNA, 17 nt, Human
caccccaugccaaagcu

SEQ ID NO: 2882349 - RNA, 15 nt, Human
caccccaugccaaag

SEQ ID NO: 2882350 - RNA, 12 nt, Human
caccccaugcca

SEQ ID NO: 2882351 - RNA, 18 nt, Human
caccacugcacuccagcc

SEQ ID NO: 2882352 - RNA, 13 nt, Human
caccacugcacuc

SEQ ID NO: 2882353 - RNA, 16 nt, Human
caccacuucuuuuaua

SEQ ID NO: 2882354 - RNA, 18 nt, Human
caccagaauugugcaaau

SEQ ID NO: 2882355 - RNA, 14 nt, Human
cacccaauuccacu

SEQ ID NO: 2882356 - RNA, 17 nt, Human
cacccaauuccacucug

SEQ ID NO: 2882357 - RNA, 21 nt, Human
cacccacaugugacacauaug

SEQ ID NO: 2882358 - RNA, 12 nt, Human
cacccacaugug

SEQ ID NO: 2882359 - RNA, 13 nt, Human
cacccacauguga

SEQ ID NO: 2882360 - RNA, 19 nt, Human
cacccacaugugacacaua

SEQ ID NO: 2882361 - RNA, 17 nt, Human
cacccccacccccagcu

SEQ ID NO: 2882362 - RNA, 11 nt, Human
cacccccaccc

SEQ ID NO: 2882363 - RNA, 14 nt, Human
cacccccaccccca

SEQ ID NO: 2882364 - RNA, 16 nt, Human
caccccccuguucuaa

SEQ ID NO: 2882365 - RNA, 15 nt, Human
caccccccaagcugu

SEQ ID NO: 2882366 - RNA, 13 nt, Human
cacccccaucucu

SEQ ID NO: 2882367 - RNA, 12 nt, Human
cacccccagcuu

SEQ ID NO: 2882368 - RNA, 17 nt, Human
cacccccaucucucccu

SEQ ID NO: 2882369 - RNA, 14 nt, Human
caccccccaagcug

SEQ ID NO: 2882370 - RNA, 12 nt, Human
cacccccagcuc

SEQ ID NO: 2882371 - RNA, 13 nt, Human
cacccccagcuca

SEQ ID NO: 2882372 - RNA, 14 nt, Human
cacccccagcucaa

SEQ ID NO: 2882373 - RNA, 13 nt, Human
cacccccuucucu

SEQ ID NO: 2882374 - RNA, 22 nt, Human
cacccccuucucugcuccacca

SEQ ID NO: 2882375 - RNA, 18 nt, Human
cacccccuucucugcucc

SEQ ID NO: 2882376 - RNA, 17 nt, Human
cacccccuucucugcuc

SEQ ID NO: 2882377 - RNA, 16 nt, Human
cacccccuucucugcu

SEQ ID NO: 2882378 - RNA, 16 nt, Human
caccccgccugcccuc

SEQ ID NO: 2882379 - RNA, 15 nt, Human
caccccgaggcccug

SEQ ID NO: 2882380 - RNA, 16 nt, Human
caccccgaggcccugc

SEQ ID NO: 2882381 - RNA, 17 nt, Human
caccccgaggcccugca

SEQ ID NO: 2882382 - RNA, 18 nt, Human
caccccgaggcccugcau

SEQ ID NO: 2882383 - RNA, 19 nt, Human
caccccgaggcccugcaug

SEQ ID NO: 2882384 - RNA, 20 nt, Human
caccccgaggcccugcaugg

SEQ ID NO: 2882385 - RNA, 22 nt, Human
caccccgaggcccugcaugggc

SEQ ID NO: 2882386 - RNA, 12 nt, Human
cacccccuuucc

SEQ ID NO: 2882387 - RNA, 14 nt, Human
cacccccuuuccug

SEQ ID NO: 2882388 - RNA, 20 nt, Human
caccccguuacagcucccca

SEQ ID NO: 2882389 - RNA, 14 nt, Human
caccccuaaagaga

SEQ ID NO: 2882390 - RNA, 23 nt, Human
caccccggcccccugcccguucu

SEQ ID NO: 2882391 - RNA, 18 nt, Human
caccccggcccccugccc

SEQ ID NO: 2882392 - RNA, 15 nt, Human
caccccgggcucucu

SEQ ID NO: 2882393 - RNA, 19 nt, Human
caccccgcuguaagcuccu

SEQ ID NO: 2882394 - RNA, 22 nt, Human
caccccgcuguaagcuccuuug

SEQ ID NO: 2882395 - RNA, 13 nt, Human
caccccggcaggc

SEQ ID NO: 2882396 - RNA, 14 nt, Human
caccccggcaggcc

SEQ ID NO: 2882397 - RNA, 15 nt, Human
caccccggcaggccc

SEQ ID NO: 2882398 - RNA, 16 nt, Human
caccccggcaggcccu

SEQ ID NO: 2882399 - RNA, 18 nt, Human
caccccggcaggcccugc

SEQ ID NO: 2882400 - RNA, 19 nt, Human
caccccggcaggcccugca

SEQ ID NO: 2882401 - RNA, 20 nt, Human
caccccggcaggcccugcag

SEQ ID NO: 2882402 - RNA, 22 nt, Human
caccccggcaggcccugcagug

SEQ ID NO: 2882403 - RNA, 18 nt, Human
caccccgggcucucugcu

SEQ ID NO: 2882404 - RNA, 22 nt, Human
aaaaaauuagaaauuggcugga

SEQ ID NO: 2882405 - RNA, 15 nt, Human
aaaaacaccuagcuu

SEQ ID NO: 2882406 - RNA, 17 nt, Human
aaaaacaccuagcuuua

SEQ ID NO: 2882407 - RNA, 18 nt, Human
aaaaacaccuagcuuuau

SEQ ID NO: 2882408 - RNA, 14 nt, Human
aaaaacagaggcca

SEQ ID NO: 2882409 - RNA, 15 nt, Human
aaaaacuaguaguuc

SEQ ID NO: 2882410 - RNA, 12 nt, Human
aaaaacuauuaa

SEQ ID NO: 2882411 - RNA, 23 nt, Human
aaaaacuauuaaggauguagcuu

SEQ ID NO: 2882412 - RNA, 21 nt, Human
aaaaacuauucgaaugaaaag

SEQ ID NO: 2882413 - RNA, 20 nt, Human
aaaaacuaaaucucuaauau

SEQ ID NO: 2882414 - RNA, 15 nt, Human
aaaaacgaaaacagu

SEQ ID NO: 2882415 - RNA, 11 nt, Human
aaaaaaucuuc

SEQ ID NO: 2882416 - RNA, 13 nt, Human
aaaaaauauuuau

SEQ ID NO: 2882417 - RNA, 21 nt, Human
aaaaaauagaugucuuuuaua

SEQ ID NO: 2882418 - RNA, 19 nt, Human
aaaaaauauagccuuuaca

SEQ ID NO: 2882419 - RNA, 12 nt, Human
aaaaaaucaucu

SEQ ID NO: 2882420 - RNA, 14 nt, Human
aaaaaaucaucuau

SEQ ID NO: 2882421 - RNA, 17 nt, Human
aaaaaaucaucuauuuu

SEQ ID NO: 2882422 - RNA, 13 nt, Human
aaaaaaucuaucc

SEQ ID NO: 2882423 - RNA, 11 nt, Human
aaaaaauguug

SEQ ID NO: 2882424 - RNA, 13 nt, Human
aaaaaauguuguu

SEQ ID NO: 2882425 - RNA, 11 nt, Human
aaaaaauuaag

SEQ ID NO: 2882426 - RNA, 15 nt, Human
acucuaucugggccu

SEQ ID NO: 2882427 - RNA, 16 nt, Human
acucuaucugggccug

SEQ ID NO: 2882428 - RNA, 17 nt, Human
acucuaucugggccugg

SEQ ID NO: 2882429 - RNA, 18 nt, Human
acucuaucugggccuggg

SEQ ID NO: 2882430 - RNA, 16 nt, Human
acucuaugccccaaau

SEQ ID NO: 2882431 - RNA, 17 nt, Human
acucuaugccccaaaua

SEQ ID NO: 2882432 - RNA, 19 nt, Human
acucuaugccccaaauaua

SEQ ID NO: 2882433 - RNA, 20 nt, Human
acucuaugccccaaauauag

SEQ ID NO: 2882434 - RNA, 21 nt, Human
acucuaugccccaaauauagc

SEQ ID NO: 2882435 - RNA, 17 nt, Human
acucuggucuuggaauu

SEQ ID NO: 2882436 - RNA, 14 nt, Human
acucuauucucaaa

SEQ ID NO: 2882437 - RNA, 15 nt, Human
acucugguuucucau

SEQ ID NO: 2882438 - RNA, 17 nt, Human
acucugguuucucauuc

SEQ ID NO: 2882439 - RNA, 15 nt, Human
acucuguaaaaacac

SEQ ID NO: 2882440 - RNA, 16 nt, Human
acucuguaacaucacu

SEQ ID NO: 2882441 - RNA, 14 nt, Human
acucuggugccucc

SEQ ID NO: 2882442 - RNA, 16 nt, Human
acucuggugccuccag

SEQ ID NO: 2882443 - RNA, 17 nt, Human
acucuggugccuccaga

SEQ ID NO: 2882444 - RNA, 19 nt, Human
acucugucgcccagucugg

SEQ ID NO: 2882445 - RNA, 20 nt, Human
acucaucaaucaaauaagua

SEQ ID NO: 2882446 - RNA, 13 nt, Human
acucaucacugug

SEQ ID NO: 2882447 - RNA, 18 nt, Human
acucauagauguuaugca

SEQ ID NO: 2882448 - RNA, 14 nt, Human
acucauacaucugg

SEQ ID NO: 2882449 - RNA, 15 nt, Human
acucauacaucuggc

SEQ ID NO: 2882450 - RNA, 19 nt, Human
acuagcaccugccagggag

SEQ ID NO: 2882451 - RNA, 14 nt, Human
acuagugacagcuu

SEQ ID NO: 2882452 - RNA, 15 nt, Human
acuagugacagcuug

SEQ ID NO: 2882453 - RNA, 16 nt, Human
acuagugacagcuugu

SEQ ID NO: 2882454 - RNA, 19 nt, Human
acuagugaccccuucccug

SEQ ID NO: 2882455 - RNA, 13 nt, Human
acuagucacccca

SEQ ID NO: 2882456 - RNA, 22 nt, Human
acuagucaccccaaguagucug

SEQ ID NO: 2882457 - RNA, 13 nt, Human
acuaguguucugu

SEQ ID NO: 2882458 - RNA, 22 nt, Human
acuauucaggagaguagaacag

SEQ ID NO: 2882459 - RNA, 15 nt, Human
acuaguguugcuugg

SEQ ID NO: 2882460 - RNA, 16 nt, Human
acuauucgaaugaaaa

SEQ ID NO: 2882461 - RNA, 18 nt, Human
acuauucgaaugaaaaga

SEQ ID NO: 2882462 - RNA, 19 nt, Human
acuauucgaaugaaaagac

SEQ ID NO: 2882463 - RNA, 14 nt, Human
acuauucaguugug

SEQ ID NO: 2882464 - RNA, 15 nt, Human
acuauucaguugugu

SEQ ID NO: 2882465 - RNA, 18 nt, Human
acuauucauuaaauguuu

SEQ ID NO: 2882466 - RNA, 19 nt, Human
acuauucauuaaauguuug

SEQ ID NO: 2882467 - RNA, 20 nt, Human
acuauucauuaaauguuuga

SEQ ID NO: 2882468 - RNA, 12 nt, Human
acuauuuaucug

SEQ ID NO: 2882469 - RNA, 23 nt, Human
acuauuuaguuuuuguaauuuau

SEQ ID NO: 2882470 - RNA, 21 nt, Human
acuauuuaguuuuuguaauuu

SEQ ID NO: 2882471 - RNA, 20 nt, Human
acuauuuaguuuuuguaauu

SEQ ID NO: 2882472 - RNA, 17 nt, Human
acuauucuguaucuuuc

SEQ ID NO: 2882473 - RNA, 20 nt, Human
acuauuuaaagccuccucau

SEQ ID NO: 2882474 - RNA, 11 nt, Human
acuauuuaaag

SEQ ID NO: 2882475 - RNA, 13 nt, Human
acuauuuaaacuu

SEQ ID NO: 2882476 - RNA, 14 nt, Human
acuauuuaaacuua

SEQ ID NO: 2882477 - RNA, 16 nt, Human
acuauuuaaacuuaua

SEQ ID NO: 2882478 - RNA, 18 nt, Human
acuauuuaaacuuauaaa

SEQ ID NO: 2882479 - RNA, 21 nt, Human
acuauuuaaacuuauaaauca

SEQ ID NO: 2882480 - RNA, 17 nt, Human
acucaggauuuaaaaac

SEQ ID NO: 2882481 - RNA, 22 nt, Human
acucaggauuuaaaaacuggaa

SEQ ID NO: 2882482 - RNA, 18 nt, Human
acucaggaggcugagggg

SEQ ID NO: 2882483 - RNA, 17 nt, Human
acucaggaggcugaggg

SEQ ID NO: 2882484 - RNA, 17 nt, Human
acucagcuuccuaccca

SEQ ID NO: 2882485 - RNA, 19 nt, Human
acucaggaggcugaggcag

SEQ ID NO: 2882486 - RNA, 18 nt, Human
acucaggaggcugaggca

SEQ ID NO: 2882487 - RNA, 17 nt, Human
acucaggaggcugaggc

SEQ ID NO: 2882488 - RNA, 16 nt, Human
acucaggaggcugagg

SEQ ID NO: 2882489 - RNA, 14 nt, Human
acucaggaggcuga

SEQ ID NO: 2882490 - RNA, 14 nt, Human
acucagggcuccuc

SEQ ID NO: 2882491 - RNA, 16 nt, Human
acucagggcuccuccc

SEQ ID NO: 2882492 - RNA, 17 nt, Human
acucagggcuccuccca

SEQ ID NO: 2882493 - RNA, 18 nt, Human
acucagggcuccucccag

SEQ ID NO: 2882494 - RNA, 19 nt, Human
acucagggcuccucccagc

SEQ ID NO: 2882495 - RNA, 20 nt, Human
acucagggcuccucccagcu

SEQ ID NO: 2882496 - RNA, 22 nt, Human
acucagggcuccucccagcuug

SEQ ID NO: 2882497 - RNA, 15 nt, Human
acucaggggucacug

SEQ ID NO: 2882498 - RNA, 19 nt, Human
acucaggggucacugaggc

SEQ ID NO: 2882499 - RNA, 23 nt, Human
acucauaaucuauaaacaaugaa

SEQ ID NO: 2882500 - RNA, 19 nt, Human
acucaguccauagcagaga

SEQ ID NO: 2882501 - RNA, 18 nt, Human
acucagcugucuguggcu

SEQ ID NO: 2882502 - RNA, 12 nt, Human
acucagccccua

SEQ ID NO: 2882503 - RNA, 14 nt, Human
acucagccccuagg

SEQ ID NO: 2882504 - RNA, 15 nt, Human
acucagccccuagga

SEQ ID NO: 2882505 - RNA, 16 nt, Human
acucagccccuaggag

SEQ ID NO: 2882506 - RNA, 17 nt, Human
acucagccccuaggagu

SEQ ID NO: 2882507 - RNA, 17 nt, Human
acucaaauguucuaagu

SEQ ID NO: 2882508 - RNA, 16 nt, Human
acucaaauguucuaag

SEQ ID NO: 2882509 - RNA, 23 nt, Human
acucaaaugcucagaccagcucu

SEQ ID NO: 2882510 - RNA, 21 nt, Human
acucaaaugcucagaccagcu

SEQ ID NO: 2882511 - RNA, 18 nt, Human
acucaaaugcucagacca

SEQ ID NO: 2882512 - RNA, 15 nt, Human
acucaaaacuuaaca

SEQ ID NO: 2882513 - RNA, 20 nt, Human
acucaaaacccaucugggcu

SEQ ID NO: 2882514 - RNA, 13 nt, Human
acuagaugaugga

SEQ ID NO: 2882515 - RNA, 18 nt, Human
acgcauggucaacccuca

SEQ ID NO: 2882516 - RNA, 19 nt, Human
acgcauggucaacccucag

SEQ ID NO: 2882517 - RNA, 14 nt, Human
acgcaguggccuuc

SEQ ID NO: 2882518 - RNA, 14 nt, Human
acgcauccagcaag

SEQ ID NO: 2882519 - RNA, 15 nt, Human
acgcauccagcaaga

SEQ ID NO: 2882520 - RNA, 12 nt, Human
acgccacccagc

SEQ ID NO: 2882521 - RNA, 14 nt, Human
acgucugacaggca

SEQ ID NO: 2882522 - RNA, 19 nt, Human
acgucgucuucuguauacu

SEQ ID NO: 2882523 - RNA, 13 nt, Human
acgucugacaggc

SEQ ID NO: 2882524 - RNA, 11 nt, Human
acgcuuuguca

SEQ ID NO: 2882525 - RNA, 14 nt, Human
acgcuuuucuuugu

SEQ ID NO: 2882526 - RNA, 16 nt, Human
acgcuuugauucauag

SEQ ID NO: 2882527 - RNA, 14 nt, Human
acgcuuugauucau

SEQ ID NO: 2882528 - RNA, 13 nt, Human
acgcuuugauuca

SEQ ID NO: 2882529 - RNA, 12 nt, Human
acgcuuugauuc

SEQ ID NO: 2882530 - RNA, 12 nt, Human
acgcuugugaau

SEQ ID NO: 2882531 - RNA, 11 nt, Human
acgcuuugauu

SEQ ID NO: 2882532 - RNA, 12 nt, Human
acuaagcauuuc

SEQ ID NO: 2882533 - RNA, 16 nt, Human
acuaagaauucaaacu

SEQ ID NO: 2882534 - RNA, 18 nt, Human
acuaagaauucaaacugg

SEQ ID NO: 2882535 - RNA, 12 nt, Human
acuaagaaacuu

SEQ ID NO: 2882536 - RNA, 13 nt, Human
acuaagaaacuuu

SEQ ID NO: 2882537 - RNA, 14 nt, Human
acuaagaaacuuuu

SEQ ID NO: 2882538 - RNA, 15 nt, Human
acuaagaaacuuuug

SEQ ID NO: 2882539 - RNA, 17 nt, Human
acuaagaaacuuuugua

SEQ ID NO: 2882540 - RNA, 19 nt, Human
acuaagaaacuuuuguaaa

SEQ ID NO: 2882541 - RNA, 17 nt, Human
acuaagaaauauuccaa

SEQ ID NO: 2882542 - RNA, 23 nt, Human
acuaagaaauauuccaaaugucu

SEQ ID NO: 2882543 - RNA, 16 nt, Human
acgugagaucauucac

SEQ ID NO: 2882544 - RNA, 15 nt, Human
acgugacccucugcu

SEQ ID NO: 2882545 - RNA, 20 nt, Human
acgucugaagcuugacuccc

SEQ ID NO: 2882546 - RNA, 22 nt, Human
acgucugaagcuugacucccaa

SEQ ID NO: 2882547 - RNA, 15 nt, Human
acuaauuuaaaaaau

SEQ ID NO: 2882548 - RNA, 20 nt, Human
acuaauuucaaaaugcuuuu

SEQ ID NO: 2882549 - RNA, 12 nt, Human
acuaauuucuuc

SEQ ID NO: 2882550 - RNA, 19 nt, Human
acuaauuucaaaaugcuuu

SEQ ID NO: 2882551 - RNA, 16 nt, Human
acuaauuucaaaaugc

SEQ ID NO: 2882552 - RNA, 23 nt, Human
acuaauuccacaccuuuuauuga

SEQ ID NO: 2882553 - RNA, 20 nt, Human
acuaauuggccucuuuaaga

SEQ ID NO: 2882554 - RNA, 14 nt, Human
acuaauuucaaaau

SEQ ID NO: 2882555 - RNA, 17 nt, Human
acuaaggugcuaaaucu

SEQ ID NO: 2882556 - RNA, 13 nt, Human
acuaaguucacau

SEQ ID NO: 2882557 - RNA, 15 nt, Human
acuaauuccacaccu

SEQ ID NO: 2882558 - RNA, 13 nt, Human
acuaauuccacac

SEQ ID NO: 2882559 - RNA, 14 nt, Human
acuaagccuaccug

SEQ ID NO: 2882560 - RNA, 18 nt, Human
acuaagccuaccugcucu

SEQ ID NO: 2882561 - RNA, 19 nt, Human
acuaagccuaccugcucuc

SEQ ID NO: 2882562 - RNA, 15 nt, Human
acuaagccacaagaa

SEQ ID NO: 2882563 - RNA, 16 nt, Human
acuaagccacaagaaa

SEQ ID NO: 2882564 - RNA, 18 nt, Human
acuaagccacaagaaauu

SEQ ID NO: 2882565 - RNA, 14 nt, Human
accugucucagccu

SEQ ID NO: 2882566 - RNA, 16 nt, Human
accugucuccacugug

SEQ ID NO: 2882567 - RNA, 17 nt, Human
accugucuccacugugc

SEQ ID NO: 2882568 - RNA, 12 nt, Human
accugucuccuu

SEQ ID NO: 2882569 - RNA, 22 nt, Human
accugucuccuuucaccccagg

SEQ ID NO: 2882570 - RNA, 17 nt, Human
accugucuccuuucuca

SEQ ID NO: 2882571 - RNA, 18 nt, Human
accugucugaacuguuaa

SEQ ID NO: 2882572 - RNA, 18 nt, Human
accugucugacuguagcu

SEQ ID NO: 2882573 - RNA, 22 nt, Human
accugugugguacucugaaaca

SEQ ID NO: 2882574 - RNA, 22 nt, Human
accuguccuaaggaaccuuccu

SEQ ID NO: 2882575 - RNA, 12 nt, Human
accugcccugga

SEQ ID NO: 2882576 - RNA, 13 nt, Human
accugcccuggaa

SEQ ID NO: 2882577 - RNA, 14 nt, Human
accugcccuggaac

SEQ ID NO: 2882578 - RNA, 15 nt, Human
accugcccuggaaca

SEQ ID NO: 2882579 - RNA, 23 nt, Human
accugucacgauugucaucagga

SEQ ID NO: 2882580 - RNA, 13 nt, Human
accugucacauug

SEQ ID NO: 2882581 - RNA, 15 nt, Human
accugucacauugca

SEQ ID NO: 2882582 - RNA, 16 nt, Human
accugucacauugcau

SEQ ID NO: 2882583 - RNA, 17 nt, Human
accugucacauugcauu

SEQ ID NO: 2882584 - RNA, 20 nt, Human
accugucacauugcauucua

SEQ ID NO: 2882585 - RNA, 22 nt, Human
accugucacauugcauucuauu

SEQ ID NO: 2882586 - RNA, 19 nt, Human
accucuggacuggcuagag

SEQ ID NO: 2882587 - RNA, 16 nt, Human
accucuggacuggcua

SEQ ID NO: 2882588 - RNA, 15 nt, Human
accucuggacuggcu

SEQ ID NO: 2882589 - RNA, 14 nt, Human
accucuggacuggc

SEQ ID NO: 2882590 - RNA, 20 nt, Human
accucugcggaccccagcug

SEQ ID NO: 2882591 - RNA, 14 nt, Human
accucugcuuccca

SEQ ID NO: 2882592 - RNA, 15 nt, Human
accucugcuucccag

SEQ ID NO: 2882593 - RNA, 17 nt, Human
accucugcuucccaggu

SEQ ID NO: 2882594 - RNA, 19 nt, Human
accucugcuucccagguuc

SEQ ID NO: 2882595 - RNA, 20 nt, Human
accucugcuuucugauguug

SEQ ID NO: 2882596 - RNA, 23 nt, Human
accucuggacuggcuagaguccu

SEQ ID NO: 2882597 - RNA, 21 nt, Human
accucuggauuaggucucugu

SEQ ID NO: 2882598 - RNA, 18 nt, Human
accucuggauucauuguc

SEQ ID NO: 2882599 - RNA, 13 nt, Human
accucuggcugac

SEQ ID NO: 2882600 - RNA, 16 nt, Human
accucuggcugacuaa

SEQ ID NO: 2882601 - RNA, 13 nt, Human
accucuguaauuu

SEQ ID NO: 2882602 - RNA, 23 nt, Human
accucuguaauuuuucagcucuc

SEQ ID NO: 2882603 - RNA, 20 nt, Human
accugcccugcugaguccca

SEQ ID NO: 2882604 - RNA, 21 nt, Human
accuuuagaaacucaaaaacu

SEQ ID NO: 2882605 - RNA, 18 nt, Human
accuuuaccccaucccug

SEQ ID NO: 2882606 - RNA, 13 nt, Human
accuuuacuuuag

SEQ ID NO: 2882607 - RNA, 14 nt, Human
accuuuacuuuaga

SEQ ID NO: 2882608 - RNA, 13 nt, Human
accuuuaagaaaa

SEQ ID NO: 2882609 - RNA, 21 nt, Human
accuuuaaguagauaagcaga

SEQ ID NO: 2882610 - RNA, 14 nt, Human
accuuuagguucuu

SEQ ID NO: 2882611 - RNA, 23 nt, Human
accuuuccaaaguuaacagauuu

SEQ ID NO: 2882612 - RNA, 17 nt, Human
accuuggcugcagggag

SEQ ID NO: 2882613 - RNA, 15 nt, Human
accuguugcuguguu

SEQ ID NO: 2882614 - RNA, 18 nt, Human
accuguugcuguguuuaa

SEQ ID NO: 2882615 - RNA, 19 nt, Human
accuguugcuguguuuaau

SEQ ID NO: 2882616 - RNA, 22 nt, Human
accuguugcuguguuuaauuug

SEQ ID NO: 2882617 - RNA, 18 nt, Human
accuuggcugcagggagu

SEQ ID NO: 2882618 - RNA, 12 nt, Human
accuugggccaa

SEQ ID NO: 2882619 - RNA, 14 nt, Human
accucugcggaccc

SEQ ID NO: 2882620 - RNA, 17 nt, Human
accucugcggaccccag

SEQ ID NO: 2882621 - RNA, 18 nt, Human
accucugcggaccccagc

SEQ ID NO: 2882622 - RNA, 19 nt, Human
accucugcggaccccagcu

SEQ ID NO: 2882623 - RNA, 14 nt, Human
acuuuucuuugugg

SEQ ID NO: 2882624 - RNA, 12 nt, Human
acuuuugagugu

SEQ ID NO: 2882625 - RNA, 16 nt, Human
acuuuugagugugugu

SEQ ID NO: 2882626 - RNA, 20 nt, Human
acuuuugagugugugugugc

SEQ ID NO: 2882627 - RNA, 21 nt, Human
acuuuugagugugugugugca

SEQ ID NO: 2882628 - RNA, 11 nt, Human
acuuuugcaag

SEQ ID NO: 2882629 - RNA, 22 nt, Human
acuuuucaccuccuucaauucc

SEQ ID NO: 2882630 - RNA, 17 nt, Human
acuuuuccauucccaau

SEQ ID NO: 2882631 - RNA, 12 nt, Human
acuuuucaguga

SEQ ID NO: 2882632 - RNA, 23 nt, Human
acuuuucaaggcuuauauucaac

SEQ ID NO: 2882633 - RNA, 20 nt, Human
acuuuucauaaccuagccuu

SEQ ID NO: 2882634 - RNA, 22 nt, Human
acuuuuauuuuacacagaaaca

SEQ ID NO: 2882635 - RNA, 22 nt, Human
acuuuucaaggcuuauauucaa

SEQ ID NO: 2882636 - RNA, 20 nt, Human
acuuuuauuuuacacagaaa

SEQ ID NO: 2882637 - RNA, 18 nt, Human
acuuuuauuuuacacaga

SEQ ID NO: 2882638 - RNA, 14 nt, Human
acuuuuauuugcaa

SEQ ID NO: 2882639 - RNA, 15 nt, Human
acuuuuauuugcaac

SEQ ID NO: 2882640 - RNA, 18 nt, Human
acuuuuauuugcaacauu

SEQ ID NO: 2882641 - RNA, 22 nt, Human
acuuuuauuugcaacauuuaca

SEQ ID NO: 2882642 - RNA, 23 nt, Human
acuuuuauuuccagugaaaucag

SEQ ID NO: 2882643 - RNA, 15 nt, Human
acuuuuaugagcuuc

SEQ ID NO: 2882644 - RNA, 20 nt, Human
acuuuuaugagcuuccaagg

SEQ ID NO: 2882645 - RNA, 14 nt, Human
acuuuaucaauuaa

SEQ ID NO: 2882646 - RNA, 19 nt, Human
acuuuauucuugaaagaag

SEQ ID NO: 2882647 - RNA, 21 nt, Human
acuuuauucuugaaagaagaa

SEQ ID NO: 2882648 - RNA, 23 nt, Human
acuuuaucuaauaccucugugug

SEQ ID NO: 2882649 - RNA, 13 nt, Human
acuuuaucuaaag

SEQ ID NO: 2882650 - RNA, 13 nt, Human
acuuuaucacuuu

SEQ ID NO: 2882651 - RNA, 17 nt, Human
acuuuaucacuuuuuga

SEQ ID NO: 2882652 - RNA, 20 nt, Human
acuuuaucacuuuuugaacu

SEQ ID NO: 2882653 - RNA, 14 nt, Human
acuuuuaaggcagu

SEQ ID NO: 2882654 - RNA, 20 nt, Human
acuuuuaaccaaacaauuau

SEQ ID NO: 2882655 - RNA, 21 nt, Human
agaaagugggugagaugcugg

SEQ ID NO: 2882656 - RNA, 20 nt, Human
agaaagugggugagaugcug

SEQ ID NO: 2882657 - RNA, 13 nt, Human
agaaaguguaaau

SEQ ID NO: 2882658 - RNA, 17 nt, Human
agaaaguugcacggcug

SEQ ID NO: 2882659 - RNA, 19 nt, Human
agaaaguugcacggcugcu

SEQ ID NO: 2882660 - RNA, 20 nt, Human
agaaaguugcacggcugcug

SEQ ID NO: 2882661 - RNA, 21 nt, Human
agaaaguugcacggcugcuga

SEQ ID NO: 2882662 - RNA, 13 nt, Human
agaaaguuuagaa

SEQ ID NO: 2882663 - RNA, 21 nt, Human
agaaauaaaguuugcuuagaa

SEQ ID NO: 2882664 - RNA, 18 nt, Human
agaaauaaaguuugcuua

SEQ ID NO: 2882665 - RNA, 13 nt, Human
agaaauaauaaua

SEQ ID NO: 2882666 - RNA, 15 nt, Human
agaaauaauaugcau

SEQ ID NO: 2882667 - RNA, 16 nt, Human
agaaauaauaugcauu

SEQ ID NO: 2882668 - RNA, 14 nt, Human
agaaauaauaugca

SEQ ID NO: 2882669 - RNA, 22 nt, Human
agaaauaagugguuauuucuca

SEQ ID NO: 2882670 - RNA, 17 nt, Human
agaaauaagugguuauu

SEQ ID NO: 2882671 - RNA, 21 nt, Human
agaaauaagugguuauuucuc

SEQ ID NO: 2882672 - RNA, 23 nt, Human
agaaaguacuucuccacccugcu

SEQ ID NO: 2882673 - RNA, 20 nt, Human
agaaagucgaauuaauagcu

SEQ ID NO: 2882674 - RNA, 17 nt, Human
agaaagucauuccuucu

SEQ ID NO: 2882675 - RNA, 20 nt, Human
agaaagucauuccuucuuuu

SEQ ID NO: 2882676 - RNA, 16 nt, Human
agaaagguucugcccg

SEQ ID NO: 2882677 - RNA, 22 nt, Human
agaaaguacuucuccacccugc

SEQ ID NO: 2882678 - RNA, 21 nt, Human
agaaagucgaauuaauagcuu

SEQ ID NO: 2882679 - RNA, 22 nt, Human
agaaagucuaucuaaugacaug

SEQ ID NO: 2882680 - RNA, 16 nt, Human
agaaagugggagguca

SEQ ID NO: 2882681 - RNA, 18 nt, Human
agaaagugggaggucagg

SEQ ID NO: 2882682 - RNA, 19 nt, Human
agaaagugggaggucagga

SEQ ID NO: 2882683 - RNA, 22 nt, Human
agaaagugggaggucaggaaac

SEQ ID NO: 2882684 - RNA, 16 nt, Human
agaaaaugaaaaacaa

SEQ ID NO: 2882685 - RNA, 23 nt, Human
agaaaaucaagcagguuagagaa

SEQ ID NO: 2882686 - RNA, 16 nt, Human
agaaaaugcuagaaga

SEQ ID NO: 2882687 - RNA, 15 nt, Human
agaaaggccugcaca

SEQ ID NO: 2882688 - RNA, 16 nt, Human
agaaaggccugcacac

SEQ ID NO: 2882689 - RNA, 17 nt, Human
agaaaggccugcacaca

SEQ ID NO: 2882690 - RNA, 19 nt, Human
acugucucaagagggcacu

SEQ ID NO: 2882691 - RNA, 18 nt, Human
acugguuaucacaccauc

SEQ ID NO: 2882692 - RNA, 17 nt, Human
acugguucucaaugaaa

SEQ ID NO: 2882693 - RNA, 14 nt, Human
acugguucucaaug

SEQ ID NO: 2882694 - RNA, 12 nt, Human
acugguucucaa

SEQ ID NO: 2882695 - RNA, 16 nt, Human
acugguuccuucuucc

SEQ ID NO: 2882696 - RNA, 18 nt, Human
acugguucucaaugaaaa

SEQ ID NO: 2882697 - RNA, 17 nt, Human
acugguuuacaggcccu

SEQ ID NO: 2882698 - RNA, 18 nt, Human
acugguuuacaggcccug

SEQ ID NO: 2882699 - RNA, 22 nt, Human
acugguuuacaggcccugcucc

SEQ ID NO: 2882700 - RNA, 20 nt, Human
acugguuguugccaaacagc

SEQ ID NO: 2882701 - RNA, 14 nt, Human
acugguuugagauu

SEQ ID NO: 2882702 - RNA, 22 nt, Human
acugugaaguuuacauuguaaa

SEQ ID NO: 2882703 - RNA, 23 nt, Human
acugugacaacugucuaacuuua

SEQ ID NO: 2882704 - RNA, 13 nt, Human
acugugacacacu

SEQ ID NO: 2882705 - RNA, 23 nt, Human
acugugacacacuacaccacaca

SEQ ID NO: 2882706 - RNA, 14 nt, Human
acugugccuuugca

SEQ ID NO: 2882707 - RNA, 19 nt, Human
acugugccuuugcaaauca

SEQ ID NO: 2882708 - RNA, 22 nt, Human
acugugccuuugcaaaucagug

SEQ ID NO: 2882709 - RNA, 23 nt, Human
acugugccuuugcaaaucagugu

SEQ ID NO: 2882710 - RNA, 23 nt, Human
acugugacucuuuuuagggccag

SEQ ID NO: 2882711 - RNA, 12 nt, Human
acugucucacug

SEQ ID NO: 2882712 - RNA, 23 nt, Human
acugucucaagagggcacuggug

SEQ ID NO: 2882713 - RNA, 20 nt, Human
acugucucaagagggcacug

SEQ ID NO: 2882714 - RNA, 21 nt, Human
acugucucaagagggcacugg

SEQ ID NO: 2882715 - RNA, 19 nt, Human
acuggaagcuaauuugcau

SEQ ID NO: 2882716 - RNA, 15 nt, Human
acuggagccaugggc

SEQ ID NO: 2882717 - RNA, 12 nt, Human
acuggagcccag

SEQ ID NO: 2882718 - RNA, 14 nt, Human
acuggagcccagga

SEQ ID NO: 2882719 - RNA, 13 nt, Human
acuggagcccagg

SEQ ID NO: 2882720 - RNA, 14 nt, Human
acugguccugugug

SEQ ID NO: 2882721 - RNA, 15 nt, Human
acugguccugugugc

SEQ ID NO: 2882722 - RNA, 20 nt, Human
acugguccugugugcaguga

SEQ ID NO: 2882723 - RNA, 18 nt, Human
acugguauuccugccucc

SEQ ID NO: 2882724 - RNA, 17 nt, Human
acuggaagcacagcuuc

SEQ ID NO: 2882725 - RNA, 17 nt, Human
acugcccccucugcccu

SEQ ID NO: 2882726 - RNA, 16 nt, Human
acugcccccucugccc

SEQ ID NO: 2882727 - RNA, 19 nt, Human
acuggaagcacagcuucau

SEQ ID NO: 2882728 - RNA, 16 nt, Human
acuggaagcuaauuug

SEQ ID NO: 2882729 - RNA, 16 nt, Human
acuggaagcacagcuu

SEQ ID NO: 2882730 - RNA, 19 nt, Human
acugccagcagcagcaggu

SEQ ID NO: 2882731 - RNA, 18 nt, Human
acugccagcagcagcagg

SEQ ID NO: 2882732 - RNA, 22 nt, Human
acugccccccaugaggaaggaa

SEQ ID NO: 2882733 - RNA, 19 nt, Human
acugccccccaugaggaag

SEQ ID NO: 2882734 - RNA, 15 nt, Human
acugcccccucugcc

SEQ ID NO: 2882735 - RNA, 14 nt, Human
acugcccccucugc

SEQ ID NO: 2882736 - RNA, 16 nt, Human
acugccagcagcagca

SEQ ID NO: 2882737 - RNA, 14 nt, Human
acugccagcagcag

SEQ ID NO: 2882738 - RNA, 13 nt, Human
acugccagcagca

SEQ ID NO: 2882739 - RNA, 12 nt, Human
acugccagcagc

SEQ ID NO: 2882740 - RNA, 14 nt, Human
acuucuguccugug

SEQ ID NO: 2882741 - RNA, 15 nt, Human
acuucuggucaauca

SEQ ID NO: 2882742 - RNA, 18 nt, Human
acuucacauuaaaaaaug

SEQ ID NO: 2882743 - RNA, 15 nt, Human
acuucagaauuccau

SEQ ID NO: 2882744 - RNA, 15 nt, Human
acuucacugaaagac

SEQ ID NO: 2882745 - RNA, 20 nt, Human
acuguuucucuugagcuggc

SEQ ID NO: 2882746 - RNA, 19 nt, Human
acuguuucucuugagcugg

SEQ ID NO: 2882747 - RNA, 18 nt, Human
acuguuucucuugagcug

SEQ ID NO: 2882748 - RNA, 17 nt, Human
acuguuucucuugagcu

SEQ ID NO: 2882749 - RNA, 22 nt, Human
acuguuucucuugagcuggccu

SEQ ID NO: 2882750 - RNA, 21 nt, Human
acuguuucucuugagcuggcc

SEQ ID NO: 2882751 - RNA, 23 nt, Human
acuguuucucuugagcuggccuc

SEQ ID NO: 2882752 - RNA, 13 nt, Human
acuguuucuugcu

SEQ ID NO: 2882753 - RNA, 14 nt, Human
acuguuucuugcuu

SEQ ID NO: 2882754 - RNA, 16 nt, Human
acuguuucuugcuugu

SEQ ID NO: 2882755 - RNA, 19 nt, Human
acuguuucuugcuuguacc

SEQ ID NO: 2882756 - RNA, 20 nt, Human
acuguuucuugcuuguaccu

SEQ ID NO: 2882757 - RNA, 21 nt, Human
acuguuucuugcuuguaccuc

SEQ ID NO: 2882758 - RNA, 16 nt, Human
acuguuucucuugagc

SEQ ID NO: 2882759 - RNA, 15 nt, Human
acuuauuucuucaaa

SEQ ID NO: 2882760 - RNA, 16 nt, Human
acuuauuucuucaaau

SEQ ID NO: 2882761 - RNA, 16 nt, Human
acuuauuuuauuucca

SEQ ID NO: 2882762 - RNA, 17 nt, Human
acuuauuuuauuuccau

SEQ ID NO: 2882763 - RNA, 16 nt, Human
acuuauuuuugacagu

SEQ ID NO: 2882764 - RNA, 14 nt, Human
acuuauuuuugaca

SEQ ID NO: 2882765 - RNA, 22 nt, Human
acuuauuuuugacaguguugaa

SEQ ID NO: 2882766 - RNA, 19 nt, Human
acuuauuuuugacaguguu

SEQ ID NO: 2882767 - RNA, 20 nt, Human
acuucuuauggaauugauuu

SEQ ID NO: 2882768 - RNA, 17 nt, Human
acuucuuauggaauuga

SEQ ID NO: 2882769 - RNA, 16 nt, Human
acuucuuauggaauug

SEQ ID NO: 2882770 - RNA, 17 nt, Human
acuucuucuccaucccu

SEQ ID NO: 2882771 - RNA, 14 nt, Human
acuucuucuccauc

SEQ ID NO: 2882772 - RNA, 20 nt, Human
acuucuucagagcugacaca

SEQ ID NO: 2882773 - RNA, 23 nt, Human
acuucuuauggaauugauuugca

SEQ ID NO: 2882774 - RNA, 21 nt, Human
acuucuuauggaauugauuug

SEQ ID NO: 2882775 - RNA, 13 nt, Human
acuucuucagagc

SEQ ID NO: 2882776 - RNA, 16 nt, Human
acuucuucagagcuga

SEQ ID NO: 2882777 - RNA, 21 nt, Human
acuucuucagagcugacacag

SEQ ID NO: 2882778 - RNA, 17 nt, Human
acuucuuccuuucucuu

SEQ ID NO: 2882779 - RNA, 20 nt, Human
acuuggggagauggaguucu

SEQ ID NO: 2882780 - RNA, 18 nt, Human
acuuggggagauuugcca

SEQ ID NO: 2882781 - RNA, 15 nt, Human
acuugguucugcuuc

SEQ ID NO: 2882782 - RNA, 16 nt, Human
acuugguucugcuuca

SEQ ID NO: 2882783 - RNA, 17 nt, Human
acuugguucugcuucaa

SEQ ID NO: 2882784 - RNA, 13 nt, Human
acuuggugcuggg

SEQ ID NO: 2882785 - RNA, 12 nt, Human
acuugguuugug

SEQ ID NO: 2882786 - RNA, 15 nt, Human
acugugcuacugucu

SEQ ID NO: 2882787 - RNA, 22 nt, Human
acugugcuacugucuuuggaaa

SEQ ID NO: 2882788 - RNA, 23 nt, Human
acugugcuacugucuuuggaaaa

SEQ ID NO: 2882789 - RNA, 14 nt, Human
acugugcucagggc

SEQ ID NO: 2882790 - RNA, 13 nt, Human
acugugcugaaug

SEQ ID NO: 2882791 - RNA, 15 nt, Human
acccaccucagccuc

SEQ ID NO: 2882792 - RNA, 14 nt, Human
acccaccucagccu

SEQ ID NO: 2882793 - RNA, 13 nt, Human
acccaccucagcc

SEQ ID NO: 2882794 - RNA, 16 nt, Human
acccacaccucugcca

SEQ ID NO: 2882795 - RNA, 15 nt, Human
acccacaccucugcc

SEQ ID NO: 2882796 - RNA, 17 nt, Human
acccacaccucugccag

SEQ ID NO: 2882797 - RNA, 13 nt, Human
accaucuaauagc

SEQ ID NO: 2882798 - RNA, 19 nt, Human
accauauucagugcugugg

SEQ ID NO: 2882799 - RNA, 13 nt, Human
accauaugauacu

SEQ ID NO: 2882800 - RNA, 19 nt, Human
accauaugaucuguuuugu

SEQ ID NO: 2882801 - RNA, 16 nt, Human
accauaugcccacauu

SEQ ID NO: 2882802 - RNA, 19 nt, Human
accauaugcccacauuuag

SEQ ID NO: 2882803 - RNA, 23 nt, Human
accauauaaagggggagggaaau

SEQ ID NO: 2882804 - RNA, 23 nt, Human
accauauacuguucuucauuuua

SEQ ID NO: 2882805 - RNA, 14 nt, Human
accauauagcaaaa

SEQ ID NO: 2882806 - RNA, 17 nt, Human
accauauagcaaaacuu

SEQ ID NO: 2882807 - RNA, 21 nt, Human
accauauagcaaaacuuuuaa

SEQ ID NO: 2882808 - RNA, 15 nt, Human
accaucgcuggcccc

SEQ ID NO: 2882809 - RNA, 16 nt, Human
accaucgcuggccccu

SEQ ID NO: 2882810 - RNA, 17 nt, Human
accaucgcuggccccuu

SEQ ID NO: 2882811 - RNA, 20 nt, Human
accaucgcuggccccuuugg

SEQ ID NO: 2882812 - RNA, 13 nt, Human
accauccuggcug

SEQ ID NO: 2882813 - RNA, 14 nt, Human
accauccuggcugc

SEQ ID NO: 2882814 - RNA, 16 nt, Human
accauccuauuuaacu

SEQ ID NO: 2882815 - RNA, 13 nt, Human
accauccuauuua

SEQ ID NO: 2882816 - RNA, 16 nt, Human
acccaccucagccucc

SEQ ID NO: 2882817 - RNA, 13 nt, Human
acccaccuagaac

SEQ ID NO: 2882818 - RNA, 14 nt, Human
acccaccucacccc

SEQ ID NO: 2882819 - RNA, 17 nt, Human
acccccugcaaagccca

SEQ ID NO: 2882820 - RNA, 14 nt, Human
acccccugcaaagc

SEQ ID NO: 2882821 - RNA, 20 nt, Human
acccccugcaaagcccagcu

SEQ ID NO: 2882822 - RNA, 18 nt, Human
acccccugcaaagcccag

SEQ ID NO: 2882823 - RNA, 22 nt, Human
acccccugcaaagcccagcuug

SEQ ID NO: 2882824 - RNA, 22 nt, Human
acccccucuucugagcacagau

SEQ ID NO: 2882825 - RNA, 20 nt, Human
acccccugagauccccugag

SEQ ID NO: 2882826 - RNA, 22 nt, Human
acccccugagauccccugagcc

SEQ ID NO: 2882827 - RNA, 23 nt, Human
acccccugagauccccugagccc

SEQ ID NO: 2882828 - RNA, 16 nt, Human
acccaugggcucugac

SEQ ID NO: 2882829 - RNA, 14 nt, Human
acccaugggcucug

SEQ ID NO: 2882830 - RNA, 17 nt, Human
acccaugggcucugaca

SEQ ID NO: 2882831 - RNA, 24 nt, Human
acccauguaaauaccagacugcag

SEQ ID NO: 2882832 - RNA, 13 nt, Human
acccauuccuauu

SEQ ID NO: 2882833 - RNA, 21 nt, Human
acccauucagagacugucccu

SEQ ID NO: 2882834 - RNA, 13 nt, Human
acccauucagaga

SEQ ID NO: 2882835 - RNA, 21 nt, Human
acccccucuucugagcacaga

SEQ ID NO: 2882836 - RNA, 17 nt, Human
acccauuccuauuucuu

SEQ ID NO: 2882837 - RNA, 16 nt, Human
accagcaacuugaacu

SEQ ID NO: 2882838 - RNA, 19 nt, Human
accccuccaugugggcuag

SEQ ID NO: 2882839 - RNA, 16 nt, Human
accccuccaugugggc

SEQ ID NO: 2882840 - RNA, 15 nt, Human
accccucacucuggc

SEQ ID NO: 2882841 - RNA, 18 nt, Human
accccucacucuggccuc

SEQ ID NO: 2882842 - RNA, 20 nt, Human
accccucaguugugcagcuu

SEQ ID NO: 2882843 - RNA, 17 nt, Human
accccucauagcccuca

SEQ ID NO: 2882844 - RNA, 12 nt, Human
accccuccagga

SEQ ID NO: 2882845 - RNA, 20 nt, Human
accccucacaggagcuuacu

SEQ ID NO: 2882846 - RNA, 13 nt, Human
acccccuucucug

SEQ ID NO: 2882847 - RNA, 19 nt, Human
acccccuucuacugagccu

SEQ ID NO: 2882848 - RNA, 18 nt, Human
acccccuucuacugagcc

SEQ ID NO: 2882849 - RNA, 17 nt, Human
accccucacucuggccu

SEQ ID NO: 2882850 - RNA, 12 nt, Human
acaggcaauucc

SEQ ID NO: 2882851 - RNA, 13 nt, Human
acaggcaauuccg

SEQ ID NO: 2882852 - RNA, 23 nt, Human
acaggcaaugcuggcuguuggcu

SEQ ID NO: 2882853 - RNA, 19 nt, Human
acaggcaaugcuggcuguu

SEQ ID NO: 2882854 - RNA, 19 nt, Human
acaggguuuugccauguug

SEQ ID NO: 2882855 - RNA, 14 nt, Human
acaggguugggccc

SEQ ID NO: 2882856 - RNA, 15 nt, Human
acaggguuucaccau

SEQ ID NO: 2882857 - RNA, 14 nt, Human
acaggguuuuuacc

SEQ ID NO: 2882858 - RNA, 18 nt, Human
acaggguuuuuaccuguc

SEQ ID NO: 2882859 - RNA, 20 nt, Human
acaggguuuuuaccugucac

SEQ ID NO: 2882860 - RNA, 23 nt, Human
acaggguuuuuaccugucacauu

SEQ ID NO: 2882861 - RNA, 18 nt, Human
acauaaugcuuaauuucu

SEQ ID NO: 2882862 - RNA, 19 nt, Human
acauaaugcuuaauuucua

SEQ ID NO: 2882863 - RNA, 20 nt, Human
acauaaugcuuaauuucuaa

SEQ ID NO: 2882864 - RNA, 19 nt, Human
acauaaugggccacugaaa

SEQ ID NO: 2882865 - RNA, 20 nt, Human
acauaaugggccacugaaau

SEQ ID NO: 2882866 - RNA, 21 nt, Human
acauaaugggccacugaaauc

SEQ ID NO: 2882867 - RNA, 22 nt, Human
acauaaugggccacugaaaucu

SEQ ID NO: 2882868 - RNA, 23 nt, Human
acauaaugggccacugaaaucug

SEQ ID NO: 2882869 - RNA, 12 nt, Human
acaucagcaaac

SEQ ID NO: 2882870 - RNA, 13 nt, Human
acaucagcaaaca

SEQ ID NO: 2882871 - RNA, 12 nt, Human
acaugaugcuuu

SEQ ID NO: 2882872 - RNA, 18 nt, Human
acaugaugcuuuuacuga

SEQ ID NO: 2882873 - RNA, 23 nt, Human
acaugaugcuuuuacugaacuuu

SEQ ID NO: 2882874 - RNA, 14 nt, Human
acaugauguuaugu

SEQ ID NO: 2882875 - RNA, 22 nt, Human
acaugauguuauguaccauaug

SEQ ID NO: 2882876 - RNA, 13 nt, Human
acaugauuuccuu

SEQ ID NO: 2882877 - RNA, 18 nt, Human
acaugugcacaugcacgu

SEQ ID NO: 2882878 - RNA, 16 nt, Human
acaugugcacaugcac

SEQ ID NO: 2882879 - RNA, 15 nt, Human
acaugugacacauau

SEQ ID NO: 2882880 - RNA, 21 nt, Human
acaugugacacauaugcaccu

SEQ ID NO: 2882881 - RNA, 22 nt, Human
acaugcagcccaugcccaccug

SEQ ID NO: 2882882 - RNA, 20 nt, Human
acaugcagcccaugcccacc

SEQ ID NO: 2882883 - RNA, 16 nt, Human
acaugauuuccuugaa

SEQ ID NO: 2882884 - RNA, 14 nt, Human
acauuuauucugcu

SEQ ID NO: 2882885 - RNA, 19 nt, Human
accagauaacugaggaggg

SEQ ID NO: 2882886 - RNA, 17 nt, Human
accagaggagccuuuuu

SEQ ID NO: 2882887 - RNA, 16 nt, Human
accagaggagccuuuu

SEQ ID NO: 2882888 - RNA, 15 nt, Human
accagaggagccuuu

SEQ ID NO: 2882889 - RNA, 14 nt, Human
accagaggagccuu

SEQ ID NO: 2882890 - RNA, 14 nt, Human
accaccucccucac

SEQ ID NO: 2882891 - RNA, 15 nt, Human
accagccagauccuc

SEQ ID NO: 2882892 - RNA, 11 nt, Human
accagccagcg

SEQ ID NO: 2882893 - RNA, 14 nt, Human
accagccagauccu

SEQ ID NO: 2882894 - RNA, 18 nt, Human
accagcccauggcccugu

SEQ ID NO: 2882895 - RNA, 19 nt, Human
accagcccauggcccugug

SEQ ID NO: 2882896 - RNA, 20 nt, Human
accagcccauggcccugugc

SEQ ID NO: 2882897 - RNA, 22 nt, Human
accagccauacuuaucucucug

SEQ ID NO: 2882898 - RNA, 22 nt, Human
accagaugcgucccaagauguu

SEQ ID NO: 2882899 - RNA, 21 nt, Human
accagaugcgucccaagaugu

SEQ ID NO: 2882900 - RNA, 17 nt, Human
accagcaauauguaaau

SEQ ID NO: 2882901 - RNA, 12 nt, Human
accaagcccagu

SEQ ID NO: 2882902 - RNA, 15 nt, Human
accaagcaggagacg

SEQ ID NO: 2882903 - RNA, 16 nt, Human
accaagcaucaggggg

SEQ ID NO: 2882904 - RNA, 15 nt, Human
accaaguauuuauua

SEQ ID NO: 2882905 - RNA, 19 nt, Human
accaagucggaacagcaga

SEQ ID NO: 2882906 - RNA, 15 nt, Human
accaauaaaauuucu

SEQ ID NO: 2882907 - RNA, 16 nt, Human
accaauagcccacagc

SEQ ID NO: 2882908 - RNA, 16 nt, Human
accaccgcccgucugu

SEQ ID NO: 2882909 - RNA, 18 nt, Human
accaccgcccgucugugu

SEQ ID NO: 2882910 - RNA, 15 nt, Human
acauuuauucugcuc

SEQ ID NO: 2882911 - RNA, 14 nt, Human
acauuuauuuuaug

SEQ ID NO: 2882912 - RNA, 15 nt, Human
acauuuauuuuauga

SEQ ID NO: 2882913 - RNA, 16 nt, Human
acauuuauuuuaugag

SEQ ID NO: 2882914 - RNA, 17 nt, Human
acauuuauuuuaugaga

SEQ ID NO: 2882915 - RNA, 18 nt, Human
acauuuauuuuaugagaa

SEQ ID NO: 2882916 - RNA, 20 nt, Human
acauuuauuuuaugagaaau

SEQ ID NO: 2882917 - RNA, 22 nt, Human
acauuuauuuuaugagaaaugu

SEQ ID NO: 2882918 - RNA, 21 nt, Human
acauuucacaggcuaauggga

SEQ ID NO: 2882919 - RNA, 18 nt, Human
acauuuuaaaaacauaga

SEQ ID NO: 2882920 - RNA, 23 nt, Human
acauuuuaaaaacauagaaaaau

SEQ ID NO: 2882921 - RNA, 14 nt, Human
acauuuuaaauaaa

SEQ ID NO: 2882922 - RNA, 16 nt, Human
accaagaugccaucug

SEQ ID NO: 2882923 - RNA, 22 nt, Human
accaagaugccaucuguguccu

SEQ ID NO: 2882924 - RNA, 15 nt, Human
acauuuuaaauaaaa

SEQ ID NO: 2882925 - RNA, 17 nt, Human
acauuuuaaauaaaaga

SEQ ID NO: 2882926 - RNA, 20 nt, Human
acauuuuaaauaaaagaaaa

SEQ ID NO: 2882927 - RNA, 14 nt, Human
acauuuguguguua

SEQ ID NO: 2882928 - RNA, 12 nt, Human
acauuugugaga

SEQ ID NO: 2882929 - RNA, 19 nt, Human
acauuugugauauauguau

SEQ ID NO: 2882930 - RNA, 21 nt, Human
acauuugugauauauguauua

SEQ ID NO: 2882931 - RNA, 19 nt, Human
acauuugugccgacacugu

SEQ ID NO: 2882932 - RNA, 20 nt, Human
acauuugugccgacacuguu

SEQ ID NO: 2882933 - RNA, 21 nt, Human
acauuugugccgacacuguuc

SEQ ID NO: 2882934 - RNA, 19 nt, Human
acagagugagacucugucu

SEQ ID NO: 2882935 - RNA, 15 nt, Human
acagagugagacucu

SEQ ID NO: 2882936 - RNA, 23 nt, Human
acagagucucacuguugcccagg

SEQ ID NO: 2882937 - RNA, 17 nt, Human
acagaggcuauuguccc

SEQ ID NO: 2882938 - RNA, 13 nt, Human
acagaggccugcc

SEQ ID NO: 2882939 - RNA, 15 nt, Human
acagaggggacucug

SEQ ID NO: 2882940 - RNA, 16 nt, Human
acagaggggacucugg

SEQ ID NO: 2882941 - RNA, 20 nt, Human
acagaggggacucugggcua

SEQ ID NO: 2882942 - RNA, 14 nt, Human
acagaggccugccc

SEQ ID NO: 2882943 - RNA, 13 nt, Human
acagccaagugcc

SEQ ID NO: 2882944 - RNA, 15 nt, Human
acagccaagugccaa

SEQ ID NO: 2882945 - RNA, 18 nt, Human
acagccaagugccaaaug

SEQ ID NO: 2882946 - RNA, 21 nt, Human
acagccaacagcuacaacagc

SEQ ID NO: 2882947 - RNA, 23 nt, Human
acagccaacagcuacaacagccu

SEQ ID NO: 2882948 - RNA, 20 nt, Human
acagaauguuuuacugugaa

SEQ ID NO: 2882949 - RNA, 14 nt, Human
acagaauuuuggaa

SEQ ID NO: 2882950 - RNA, 15 nt, Human
acagaauuuuuuuug

SEQ ID NO: 2882951 - RNA, 13 nt, Human
acagaauguaucu

SEQ ID NO: 2882952 - RNA, 14 nt, Human
acagaauguaucug

SEQ ID NO: 2882953 - RNA, 15 nt, Human
acagaauguaucugu

SEQ ID NO: 2882954 - RNA, 17 nt, Human
acagaauguaucuguga

SEQ ID NO: 2882955 - RNA, 18 nt, Human
acagaauguaucugugaa

SEQ ID NO: 2882956 - RNA, 20 nt, Human
acagaauguaucugugaagu

SEQ ID NO: 2882957 - RNA, 11 nt, Human
acagacacagg

SEQ ID NO: 2882958 - RNA, 21 nt, Human
acagaauguuuuacugugaaa

SEQ ID NO: 2882959 - RNA, 21 nt, Human
acacugguauuccugccucca

SEQ ID NO: 2882960 - RNA, 16 nt, Human
acacuggugugaccug

SEQ ID NO: 2882961 - RNA, 20 nt, Human
acacuggugugaccugaggg

SEQ ID NO: 2882962 - RNA, 21 nt, Human
acacuggugugaccugagggc

SEQ ID NO: 2882963 - RNA, 17 nt, Human
acacugguucucaauga

SEQ ID NO: 2882964 - RNA, 15 nt, Human
acacugguucucaau

SEQ ID NO: 2882965 - RNA, 14 nt, Human
acacugguucucaa

SEQ ID NO: 2882966 - RNA, 13 nt, Human
acacugguucuca

SEQ ID NO: 2882967 - RNA, 19 nt, Human
acacugguucucaaugaaa

SEQ ID NO: 2882968 - RNA, 18 nt, Human
acacugguucucaaugaa

SEQ ID NO: 2882969 - RNA, 21 nt, Human
acacugguucucaaugaaaaa

SEQ ID NO: 2882970 - RNA, 14 nt, Human
acagaaugaaaaau

SEQ ID NO: 2882971 - RNA, 15 nt, Human
acagaaugaaaaaug

SEQ ID NO: 2882972 - RNA, 16 nt, Human
acagaaugaaaaauga

SEQ ID NO: 2882973 - RNA, 17 nt, Human
acagaaugaaaaaugaa

SEQ ID NO: 2882974 - RNA, 18 nt, Human
acagaaugaaaaaugaaa

SEQ ID NO: 2882975 - RNA, 20 nt, Human
acagaaugaaaaaugaaaga

SEQ ID NO: 2882976 - RNA, 21 nt, Human
acagaaugaaaaaugaaagau

SEQ ID NO: 2882977 - RNA, 22 nt, Human
acagaaugaaaaaugaaagaug

SEQ ID NO: 2882978 - RNA, 24 nt, Human
acagaaugaaaaaugaaagaugau

SEQ ID NO: 2882979 - RNA, 15 nt, Human
acagaggcagcccca

SEQ ID NO: 2882980 - RNA, 14 nt, Human
acagaggcagcccc

SEQ ID NO: 2882981 - RNA, 14 nt, Human
acagacacaggccc

SEQ ID NO: 2882982 - RNA, 13 nt, Human
acagacacaggcc

SEQ ID NO: 2882983 - RNA, 19 nt, Human
acagaggcagccccauucu

SEQ ID NO: 2882984 - RNA, 12 nt, Human
acagaggccugc

SEQ ID NO: 2882985 - RNA, 21 nt, Human
acacugcaggcaucacagcua

SEQ ID NO: 2882986 - RNA, 16 nt, Human
acacuggacuccggcc

SEQ ID NO: 2882987 - RNA, 16 nt, Human
acacugcaggcaucac

SEQ ID NO: 2882988 - RNA, 20 nt, Human
acacugcaggcaucacagcu

SEQ ID NO: 2882989 - RNA, 15 nt, Human
acacuggcagacugu

SEQ ID NO: 2882990 - RNA, 18 nt, Human
acacuggcagacugugua

SEQ ID NO: 2882991 - RNA, 13 nt, Human
acacuggccccuc

SEQ ID NO: 2882992 - RNA, 14 nt, Human
acacuggccccuca

SEQ ID NO: 2882993 - RNA, 17 nt, Human
acacuggcuaaagauaa

SEQ ID NO: 2882994 - RNA, 22 nt, Human
acacuggcuaaagauaauugcu

SEQ ID NO: 2882995 - RNA, 18 nt, Human
acacugguauuccugccu

SEQ ID NO: 2882996 - RNA, 19 nt, Human
acacugguauuccugccuc

SEQ ID NO: 2882997 - RNA, 22 nt, Human
acacugcacucuuaagcuuccg

SEQ ID NO: 2882998 - RNA, 15 nt, Human
acacugcaaucauau

SEQ ID NO: 2882999 - RNA, 16 nt, Human
acacugcaaucauaug

SEQ ID NO: 2883000 - RNA, 19 nt, Human
acacugcaaucauauguga

SEQ ID NO: 2883001 - RNA, 20 nt, Human
acacugcaaucauaugugau

SEQ ID NO: 2883002 - RNA, 20 nt, Human
acaggauuugaacucagauc

SEQ ID NO: 2883003 - RNA, 14 nt, Human
acaggaugcugugu

SEQ ID NO: 2883004 - RNA, 19 nt, Human
acaggcaaaauccuugcuu

SEQ ID NO: 2883005 - RNA, 12 nt, Human
acaggcaagcac

SEQ ID NO: 2883006 - RNA, 18 nt, Human
acaggcaaugcuggcugu

SEQ ID NO: 2883007 - RNA, 19 nt, Human
acaggaugggggcuggccu

SEQ ID NO: 2883008 - RNA, 18 nt, Human
acaggaugaccuggauaa

SEQ ID NO: 2883009 - RNA, 21 nt, Human
acaggaugaggugguggagug

SEQ ID NO: 2883010 - RNA, 14 nt, Human
acaggaugaaggca

SEQ ID NO: 2883011 - RNA, 20 nt, Human
acagcucuguguugccaugu

SEQ ID NO: 2883012 - RNA, 16 nt, Human
acagcucuuaaaugua

SEQ ID NO: 2883013 - RNA, 19 nt, Human
acaggaucaguuaacuauu

SEQ ID NO: 2883014 - RNA, 15 nt, Human
acaggaucagucuga

SEQ ID NO: 2883015 - RNA, 19 nt, Human
acagcucuguguugccaug

SEQ ID NO: 2883016 - RNA, 17 nt, Human
acagcucuguguugcca

SEQ ID NO: 2883017 - RNA, 17 nt, Human
acagcucuucuccaggc

SEQ ID NO: 2883018 - RNA, 16 nt, Human
acagcucuucuccagg

SEQ ID NO: 2883019 - RNA, 17 nt, Human
acagccacggccaggcc

SEQ ID NO: 2883020 - RNA, 16 nt, Human
acagccacggccaggc

SEQ ID NO: 2883021 - RNA, 15 nt, Human
acagccacggccagg

SEQ ID NO: 2883022 - RNA, 18 nt, Human
acagccacggccaggcca

SEQ ID NO: 2883023 - RNA, 21 nt, Human
acacgcacauauacacacaca

SEQ ID NO: 2883024 - RNA, 17 nt, Human
acacgcgcgcacacaca

SEQ ID NO: 2883025 - RNA, 17 nt, Human
acacgcgugcacacacc

SEQ ID NO: 2883026 - RNA, 15 nt, Human
acacgcgugcacaca

SEQ ID NO: 2883027 - RNA, 15 nt, Human
acacauuuuuaaauu

SEQ ID NO: 2883028 - RNA, 19 nt, Human
acacauuuuuaaauuguua

SEQ ID NO: 2883029 - RNA, 14 nt, Human
acaccaaauaaaua

SEQ ID NO: 2883030 - RNA, 16 nt, Human
acaccaagaugucugu

SEQ ID NO: 2883031 - RNA, 14 nt, Human
acaccaaaguucua

SEQ ID NO: 2883032 - RNA, 15 nt, Human
acaccaaaguucuaa

SEQ ID NO: 2883033 - RNA, 22 nt, Human
acacgcgcgcacacacacacau

SEQ ID NO: 2883034 - RNA, 21 nt, Human
acacgcgggcgcgaucccaca

SEQ ID NO: 2883035 - RNA, 23 nt, Human
acacgcgggcgcgaucccacaca

SEQ ID NO: 2883036 - RNA, 14 nt, Human
acacgcuccuuccu

SEQ ID NO: 2883037 - RNA, 16 nt, Human
acacagauacacacac

SEQ ID NO: 2883038 - RNA, 17 nt, Human
acacagauacacacaca

SEQ ID NO: 2883039 - RNA, 14 nt, Human
acacagaugaaaca

SEQ ID NO: 2883040 - RNA, 21 nt, Human
acacagaugaaacacaaacaa

SEQ ID NO: 2883041 - RNA, 11 nt, Human
acacagauguu

SEQ ID NO: 2883042 - RNA, 16 nt, Human
acacagauguucgguu

SEQ ID NO: 2883043 - RNA, 14 nt, Human
acacagcucugucc

SEQ ID NO: 2883044 - RNA, 17 nt, Human
acacagauuugagcuca

SEQ ID NO: 2883045 - RNA, 20 nt, Human
acacagcucuguccugggag

SEQ ID NO: 2883046 - RNA, 22 nt, Human
acaauugagguaaguuuuuuga

SEQ ID NO: 2883047 - RNA, 22 nt, Human
acacagagaagcggauuuccag

SEQ ID NO: 2883048 - RNA, 20 nt, Human
acacagaggaauuuauaccu

SEQ ID NO: 2883049 - RNA, 19 nt, Human
acaauuguccauggucuca

SEQ ID NO: 2883050 - RNA, 21 nt, Human
acaauugucgaaaagagucuu

SEQ ID NO: 2883051 - RNA, 19 nt, Human
acaauugugggcauaaacu

SEQ ID NO: 2883052 - RNA, 22 nt, Human
acaauugugggcauaaacuguu

SEQ ID NO: 2883053 - RNA, 13 nt, Human
acacagcucuucu

SEQ ID NO: 2883054 - RNA, 11 nt, Human
acacagcucuu

SEQ ID NO: 2883055 - RNA, 21 nt, Human
acacauuuugguucuucucaa

SEQ ID NO: 2883056 - RNA, 16 nt, Human
acacagaugaaacaca

SEQ ID NO: 2883057 - RNA, 22 nt, Human
acaauucuguuuuagguuaaaa

SEQ ID NO: 2883058 - RNA, 15 nt, Human
acaauucuacauugu

SEQ ID NO: 2883059 - RNA, 15 nt, Human
acaaaauuuuauuuu

SEQ ID NO: 2883060 - RNA, 22 nt, Human
acaaaauuuuauuuugugcuca

SEQ ID NO: 2883061 - RNA, 16 nt, Human
acaaaauuuucucauu

SEQ ID NO: 2883062 - RNA, 22 nt, Human
acaaaauuuucucauuuucuuu

SEQ ID NO: 2883063 - RNA, 18 nt, Human
acaaccuucuguggcuca

SEQ ID NO: 2883064 - RNA, 22 nt, Human
acaacgugcaacugacacuccc

SEQ ID NO: 2883065 - RNA, 17 nt, Human
acaaggauugcuacugu

SEQ ID NO: 2883066 - RNA, 15 nt, Human
acaagaaaucccugu

SEQ ID NO: 2883067 - RNA, 16 nt, Human
acaagaaaucccuguu

SEQ ID NO: 2883068 - RNA, 15 nt, Human
acaacuuuuaaccaa

SEQ ID NO: 2883069 - RNA, 20 nt, Human
acaacuuuuaaccaaacaau

SEQ ID NO: 2883070 - RNA, 13 nt, Human
acaagaaaaucag

SEQ ID NO: 2883071 - RNA, 20 nt, Human
acaagaaacucaaugcacaa

SEQ ID NO: 2883072 - RNA, 21 nt, Human
acaagaaaucccuguuuaaua

SEQ ID NO: 2883073 - RNA, 23 nt, Human
acaagaaaucccuguuuaauauu

SEQ ID NO: 2883074 - RNA, 16 nt, Human
acaagggaaggacaga

SEQ ID NO: 2883075 - RNA, 13 nt, Human
aauuuuguugcug

SEQ ID NO: 2883076 - RNA, 13 nt, Human
aauuuuguaauga

SEQ ID NO: 2883077 - RNA, 15 nt, Human
aauuuuguaacgaag

SEQ ID NO: 2883078 - RNA, 22 nt, Human
aauuuucuggaauacaugaaau

SEQ ID NO: 2883079 - RNA, 18 nt, Human
aauuuucuagacuuucug

SEQ ID NO: 2883080 - RNA, 12 nt, Human
aauuuucuagac

SEQ ID NO: 2883081 - RNA, 11 nt, Human
aauuuucuaag

SEQ ID NO: 2883082 - RNA, 20 nt, Human
aauuuucuacaaauaauuuu

SEQ ID NO: 2883083 - RNA, 15 nt, Human
aauuuucuagacuuu

SEQ ID NO: 2883084 - RNA, 17 nt, Human
aauuuucuagacuuucu

SEQ ID NO: 2883085 - RNA, 20 nt, Human
aauuuucuagacuuucuguu

SEQ ID NO: 2883086 - RNA, 17 nt, Human
aauuuucucaaaagcau

SEQ ID NO: 2883087 - RNA, 23 nt, Human
aauuuucucaaaagcauuuauca

SEQ ID NO: 2883088 - RNA, 17 nt, Human
aauuuucucauuuucuu

SEQ ID NO: 2883089 - RNA, 17 nt, Human
aaaggcaccaucuaaua

SEQ ID NO: 2883090 - RNA, 17 nt, Human
aaaggcaaauguguaca

SEQ ID NO: 2883091 - RNA, 14 nt, Human
aaaggccauggaga

SEQ ID NO: 2883092 - RNA, 19 nt, Human
aaaggccauggagagcugg

SEQ ID NO: 2883093 - RNA, 13 nt, Human
aaaggccaaacug

SEQ ID NO: 2883094 - RNA, 15 nt, Human
aaaggccaaacugcu

SEQ ID NO: 2883095 - RNA, 18 nt, Human
aaaggccaaacugcugga

SEQ ID NO: 2883096 - RNA, 15 nt, Human
aaaggccugcacaca

SEQ ID NO: 2883097 - RNA, 12 nt, Human
aaaggcccccua

SEQ ID NO: 2883098 - RNA, 14 nt, Human
aaaggccucugucc

SEQ ID NO: 2883099 - RNA, 13 nt, Human
aaaggcccagccc

SEQ ID NO: 2883100 - RNA, 14 nt, Human
aaaggcccagcccc

SEQ ID NO: 2883101 - RNA, 16 nt, Human
aaaggcccagccccua

SEQ ID NO: 2883102 - RNA, 17 nt, Human
aaaggcccagccccuag

SEQ ID NO: 2883103 - RNA, 22 nt, Human
aaagcccuuccaugucgccucu

SEQ ID NO: 2883104 - RNA, 23 nt, Human
aaagcccuuccaugucgccucug

SEQ ID NO: 2883105 - RNA, 13 nt, Human
aaagccucaacca

SEQ ID NO: 2883106 - RNA, 23 nt, Human
aaagccguuguuuacuuaaagau

SEQ ID NO: 2883107 - RNA, 20 nt, Human
aaagccucaagguuuuaggu

SEQ ID NO: 2883108 - RNA, 21 nt, Human
aaagccguuguuuacuuaaag

SEQ ID NO: 2883109 - RNA, 22 nt, Human
aaaggcaaguuaagagaaacuu

SEQ ID NO: 2883110 - RNA, 23 nt, Human
aaaggcaaguuaagagaaacuuu

SEQ ID NO: 2883111 - RNA, 16 nt, Human
aaaggcaaauguguac

SEQ ID NO: 2883112 - RNA, 19 nt, Human
aaagccaauaacacacagc

SEQ ID NO: 2883113 - RNA, 17 nt, Human
aaagccacauuauuucu

SEQ ID NO: 2883114 - RNA, 18 nt, Human
aaagccacauuauuucua

SEQ ID NO: 2883115 - RNA, 20 nt, Human
aaagccacauuauuucuagu

SEQ ID NO: 2883116 - RNA, 21 nt, Human
aaagccacauuauuucuaguc

SEQ ID NO: 2883117 - RNA, 12 nt, Human
aaagccacccca

SEQ ID NO: 2883118 - RNA, 16 nt, Human
aaagccacuagacucu

SEQ ID NO: 2883119 - RNA, 17 nt, Human
aaagccacuagacucuu

SEQ ID NO: 2883120 - RNA, 18 nt, Human
aaagccaccucugucauu

SEQ ID NO: 2883121 - RNA, 19 nt, Human
aaagccaccucugucauuu

SEQ ID NO: 2883122 - RNA, 20 nt, Human
aaagccaccucugucauuug

SEQ ID NO: 2883123 - RNA, 22 nt, Human
aaagcccugucgggcuuugugu

SEQ ID NO: 2883124 - RNA, 13 nt, Human
aaagccagggucu

SEQ ID NO: 2883125 - RNA, 14 nt, Human
aaagccagggucuc

SEQ ID NO: 2883126 - RNA, 19 nt, Human
aaagccagggucucucccu

SEQ ID NO: 2883127 - RNA, 22 nt, Human
aaagccagggucucucccucag

SEQ ID NO: 2883128 - RNA, 17 nt, Human
aaagccaaggugucauu

SEQ ID NO: 2883129 - RNA, 20 nt, Human
aaauaaaguuugcuuagaaa

SEQ ID NO: 2883130 - RNA, 20 nt, Human
aaauaaaguauauauagaau

SEQ ID NO: 2883131 - RNA, 16 nt, Human
aaauaaaguauauaua

SEQ ID NO: 2883132 - RNA, 17 nt, Human
aaauaaaaccuuucaaa

SEQ ID NO: 2883133 - RNA, 15 nt, Human
aaauaaaguauauau

SEQ ID NO: 2883134 - RNA, 15 nt, Human
aaaguggaauuucuu

SEQ ID NO: 2883135 - RNA, 18 nt, Human
aaaguggaauuucuuguu

SEQ ID NO: 2883136 - RNA, 19 nt, Human
aaaguggaauuucuuguuu

SEQ ID NO: 2883137 - RNA, 22 nt, Human
aaaguggaauuucuuguuucuc

SEQ ID NO: 2883138 - RNA, 17 nt, Human
aaaguggagaagcacac

SEQ ID NO: 2883139 - RNA, 13 nt, Human
aaagugcuugugu

SEQ ID NO: 2883140 - RNA, 15 nt, Human
aaagugcuuguguaa

SEQ ID NO: 2883141 - RNA, 16 nt, Human
aaagugcuuguguaau

SEQ ID NO: 2883142 - RNA, 17 nt, Human
aaagugcuuguguaauu

SEQ ID NO: 2883143 - RNA, 23 nt, Human
aaagugcuuguguaauuuaugug

SEQ ID NO: 2883144 - RNA, 21 nt, Human
aaagugcuuuccagaauaaua

SEQ ID NO: 2883145 - RNA, 19 nt, Human
aaaguccaauuuuaauuua

SEQ ID NO: 2883146 - RNA, 20 nt, Human
aaaguccaauuuuaauuuag

SEQ ID NO: 2883147 - RNA, 13 nt, Human
aaaguccuuuucu

SEQ ID NO: 2883148 - RNA, 14 nt, Human
aaaguccuuuucuu

SEQ ID NO: 2883149 - RNA, 18 nt, Human
aaaguccuuuucuugcuu

SEQ ID NO: 2883150 - RNA, 18 nt, Human
aaaguccuuuuuuuccau

SEQ ID NO: 2883151 - RNA, 16 nt, Human
aaaguccuuuuuuucc

SEQ ID NO: 2883152 - RNA, 22 nt, Human
aaaguccuuuuuuuccaucuuu

SEQ ID NO: 2883153 - RNA, 15 nt, Human
aaagucgaauuaaua

SEQ ID NO: 2883154 - RNA, 15 nt, Human
aaagucguuuuccaa

SEQ ID NO: 2883155 - RNA, 16 nt, Human
aaagucguuuuccaaa

SEQ ID NO: 2883156 - RNA, 18 nt, Human
aaagucguuuuccaaacu

SEQ ID NO: 2883157 - RNA, 16 nt, Human
aaagucuaucuaauga

SEQ ID NO: 2883158 - RNA, 21 nt, Human
aaagucaugcaaaggcuggga

SEQ ID NO: 2883159 - RNA, 20 nt, Human
aaagucaugcaaaggcuggg

SEQ ID NO: 2883160 - RNA, 19 nt, Human
aaagucaugcaaaggcugg

SEQ ID NO: 2883161 - RNA, 15 nt, Human
aaauaaauagaaaag

SEQ ID NO: 2883162 - RNA, 14 nt, Human
aaauaaauaaaagc

SEQ ID NO: 2883163 - RNA, 16 nt, Human
aaauaaauaaaagccu

SEQ ID NO: 2883164 - RNA, 13 nt, Human
aaauaaauagcuu

SEQ ID NO: 2883165 - RNA, 14 nt, Human
aaauaaauggaaau

SEQ ID NO: 2883166 - RNA, 12 nt, Human
aaauaaauauca

SEQ ID NO: 2883167 - RNA, 13 nt, Human
aaauauuuauuuu

SEQ ID NO: 2883168 - RNA, 16 nt, Human
aaauaguuguccauau

SEQ ID NO: 2883169 - RNA, 23 nt, Human
aaauaguuguccauauuuucaca

SEQ ID NO: 2883170 - RNA, 15 nt, Human
aaaucuggucuuguu

SEQ ID NO: 2883171 - RNA, 20 nt, Human
aaaucuggucuuguuagaaa

SEQ ID NO: 2883172 - RNA, 22 nt, Human
aaaucuggucuuguuagaaaac

SEQ ID NO: 2883173 - RNA, 17 nt, Human
aaaucuguaacagguau

SEQ ID NO: 2883174 - RNA, 18 nt, Human
aaaucuguaacagguauu

SEQ ID NO: 2883175 - RNA, 19 nt, Human
aaaucuguaacagguauuu

SEQ ID NO: 2883176 - RNA, 22 nt, Human
aaaucuguaacagguauuuugu

SEQ ID NO: 2883177 - RNA, 23 nt, Human
aaaucuguaacagguauuuuguu

SEQ ID NO: 2883178 - RNA, 21 nt, Human
aaaucuguccaaaggaggcug

SEQ ID NO: 2883179 - RNA, 16 nt, Human
aaaucugucaagagua

SEQ ID NO: 2883180 - RNA, 20 nt, Human
aaaucugucaagaguaguua

SEQ ID NO: 2883181 - RNA, 22 nt, Human
aaaucuguccaaaggaggcugg

SEQ ID NO: 2883182 - RNA, 18 nt, Human
aaaucaaguauuugggaa

SEQ ID NO: 2883183 - RNA, 12 nt, Human
aaaucaaguuuu

SEQ ID NO: 2883184 - RNA, 17 nt, Human
aaaucaauaaaugaaua

SEQ ID NO: 2883185 - RNA, 13 nt, Human
aaaucaauaagaa

SEQ ID NO: 2883186 - RNA, 23 nt, Human
aaaucaaguauuugggaagugaa

SEQ ID NO: 2883187 - RNA, 16 nt, Human
aaaucaaguauuuugu

SEQ ID NO: 2883188 - RNA, 16 nt, Human
aaaucaaguccuuuaa

SEQ ID NO: 2883189 - RNA, 19 nt, Human
aaaucaaugcuauaacuau

SEQ ID NO: 2883190 - RNA, 14 nt, Human
aaaucaauuuuuag

SEQ ID NO: 2883191 - RNA, 17 nt, Human
aaaucaauuuuuaggaa

SEQ ID NO: 2883192 - RNA, 22 nt, Human
aaaucacaaaaauuugaacacu

SEQ ID NO: 2883193 - RNA, 16 nt, Human
aaaucacaauuuuuaa

SEQ ID NO: 2883194 - RNA, 24 nt, Human
aaauagcucaggugucccugcacu

SEQ ID NO: 2883195 - RNA, 18 nt, Human
aaauagcgcuguuuuugu

SEQ ID NO: 2883196 - RNA, 13 nt, Human
aaauagcauuugu

SEQ ID NO: 2883197 - RNA, 15 nt, Human
aaauagcuuguauag

SEQ ID NO: 2883198 - RNA, 18 nt, Human
aaauagcuaauaauguua

SEQ ID NO: 2883199 - RNA, 19 nt, Human
aaauagcuaauaauguuaa

SEQ ID NO: 2883200 - RNA, 14 nt, Human
aaauaggaaacaag

SEQ ID NO: 2883201 - RNA, 13 nt, Human
aaauaggaaacaa

SEQ ID NO: 2883202 - RNA, 16 nt, Human
aaauagcuuguauagu

SEQ ID NO: 2883203 - RNA, 23 nt, Human
aaauaggagaggaugagagccca

SEQ ID NO: 2883204 - RNA, 24 nt, Human
aaauaggagaggaugagagcccag

SEQ ID NO: 2883205 - RNA, 16 nt, Human
aaauaggaaacaagug

SEQ ID NO: 2883206 - RNA, 14 nt, Human
aaauaggagaggau

SEQ ID NO: 2883207 - RNA, 16 nt, Human
aaauaggagaggauga

SEQ ID NO: 2883208 - RNA, 15 nt, Human
aaauagugucuuugu

SEQ ID NO: 2883209 - RNA, 17 nt, Human
aaauaggggauauuuaa

SEQ ID NO: 2883210 - RNA, 22 nt, Human
aaauaguuaagacaugauuucc

SEQ ID NO: 2883211 - RNA, 17 nt, Human
aaauaguuaagacauga

SEQ ID NO: 2883212 - RNA, 13 nt, Human
aaagaaaugaaca

SEQ ID NO: 2883213 - RNA, 14 nt, Human
aaagaaaugaacau

SEQ ID NO: 2883214 - RNA, 15 nt, Human
aaagaaaugaacauu

SEQ ID NO: 2883215 - RNA, 16 nt, Human
aaagaaaugaacauuc

SEQ ID NO: 2883216 - RNA, 16 nt, Human
aaagaaaugacuaauu

SEQ ID NO: 2883217 - RNA, 11 nt, Human
aaagaagaccg

SEQ ID NO: 2883218 - RNA, 14 nt, Human
aaagaagaucugua

SEQ ID NO: 2883219 - RNA, 15 nt, Human
aaagaagaucuguaa

SEQ ID NO: 2883220 - RNA, 12 nt, Human
aaagaagauguu

SEQ ID NO: 2883221 - RNA, 15 nt, Human
aaagaagauguugaa

SEQ ID NO: 2883222 - RNA, 12 nt, Human
aaagaaggaagu

SEQ ID NO: 2883223 - RNA, 20 nt, Human
aaagaagguuucagaaagaa

SEQ ID NO: 2883224 - RNA, 14 nt, Human
aaagagucuagauu

SEQ ID NO: 2883225 - RNA, 13 nt, Human
aaagagucuagau

SEQ ID NO: 2883226 - RNA, 12 nt, Human
aaagaguuagaa

SEQ ID NO: 2883227 - RNA, 15 nt, Human
aaagagucuagauuc

SEQ ID NO: 2883228 - RNA, 21 nt, Human
aaagagucuagauucaaaggu

SEQ ID NO: 2883229 - RNA, 14 nt, Human
aaagagucuuccaa

SEQ ID NO: 2883230 - RNA, 14 nt, Human
aaacucugccagcc

SEQ ID NO: 2883231 - RNA, 23 nt, Human
aaagaaauccauaucuuaaagaa

SEQ ID NO: 2883232 - RNA, 14 nt, Human
aaacugaggaauuu

SEQ ID NO: 2883233 - RNA, 18 nt, Human
aaacugaggaauuuucuu

SEQ ID NO: 2883234 - RNA, 15 nt, Human
aaagauauuguucaa

SEQ ID NO: 2883235 - RNA, 22 nt, Human
aaagauauuguucaaacaauau

SEQ ID NO: 2883236 - RNA, 15 nt, Human
aaagauauggagaau

SEQ ID NO: 2883237 - RNA, 19 nt, Human
aaagauauggagaauugcu

SEQ ID NO: 2883238 - RNA, 23 nt, Human
aaagauauggagaauugcugaag

SEQ ID NO: 2883239 - RNA, 23 nt, Human
aaagaguucuggaaaagaacugu

SEQ ID NO: 2883240 - RNA, 24 nt, Human
aaagaguucuggaaaagaacuguu

SEQ ID NO: 2883241 - RNA, 15 nt, Human
aaagauaaaauagug

SEQ ID NO: 2883242 - RNA, 14 nt, Human
aaaccaucuggccu

SEQ ID NO: 2883243 - RNA, 15 nt, Human
aaaccaucuggccug

SEQ ID NO: 2883244 - RNA, 18 nt, Human
aaaccaucuggccuggcc

SEQ ID NO: 2883245 - RNA, 23 nt, Human
aaaccauccagugacaaaccauc

SEQ ID NO: 2883246 - RNA, 15 nt, Human
aaaccaugcaaaugc

SEQ ID NO: 2883247 - RNA, 13 nt, Human
aaaccccuguccc

SEQ ID NO: 2883248 - RNA, 18 nt, Human
aaaccccuucucugugac

SEQ ID NO: 2883249 - RNA, 15 nt, Human
aaacccgaggguuga

SEQ ID NO: 2883250 - RNA, 23 nt, Human
aaacccgaggguugauuaaggca

SEQ ID NO: 2883251 - RNA, 16 nt, Human
aaacccuauugguaaa

SEQ ID NO: 2883252 - RNA, 11 nt, Human
aaacccuaggu

SEQ ID NO: 2883253 - RNA, 21 nt, Human
aaacccuagguucccgguccc

SEQ ID NO: 2883254 - RNA, 13 nt, Human
aaacucucugaac

SEQ ID NO: 2883255 - RNA, 12 nt, Human
aaacucucugaa

SEQ ID NO: 2883256 - RNA, 14 nt, Human
aaaauugauguguu

SEQ ID NO: 2883257 - RNA, 12 nt, Human
aaaauugaugug

SEQ ID NO: 2883258 - RNA, 21 nt, Human
aaaauugauguguuuauuuau

SEQ ID NO: 2883259 - RNA, 23 nt, Human
aaaaucuaauauuaaaaauaugg

SEQ ID NO: 2883260 - RNA, 15 nt, Human
aaaauugcaaaucuu

SEQ ID NO: 2883261 - RNA, 22 nt, Human
aaacaccuuccagcuccuguaa

SEQ ID NO: 2883262 - RNA, 23 nt, Human
aaacaccuucuuauuauauauau

SEQ ID NO: 2883263 - RNA, 13 nt, Human
aaacacgaaacuu

SEQ ID NO: 2883264 - RNA, 14 nt, Human
aaacacgaaacuug

SEQ ID NO: 2883265 - RNA, 15 nt, Human
aaacacgaaacuugu

SEQ ID NO: 2883266 - RNA, 16 nt, Human
aaacacgaaacuuguu

SEQ ID NO: 2883267 - RNA, 17 nt, Human
aaacacgaaacuuguua

SEQ ID NO: 2883268 - RNA, 18 nt, Human
aaacacgaaacuuguuau

SEQ ID NO: 2883269 - RNA, 23 nt, Human
aaacacgaaacuuguuauuguga

SEQ ID NO: 2883270 - RNA, 24 nt, Human
aaacacucaguuguucaauaauaa

SEQ ID NO: 2883271 - RNA, 13 nt, Human
aaacacuccuugc

SEQ ID NO: 2883272 - RNA, 14 nt, Human
aaacacuccuugca

SEQ ID NO: 2883273 - RNA, 15 nt, Human
aaacacuccuugcau

SEQ ID NO: 2883274 - RNA, 16 nt, Human
aaacacuccuugcauc

SEQ ID NO: 2883275 - RNA, 21 nt, Human
aaacacgcacuuagucucuaa

SEQ ID NO: 2883276 - RNA, 13 nt, Human
aaacacuguggaa

SEQ ID NO: 2883277 - RNA, 22 nt, Human
aaacacuguggaacuaauaaau

SEQ ID NO: 2883278 - RNA, 23 nt, Human
aaacacuguggaacuaauaaaua

SEQ ID NO: 2883279 - RNA, 22 nt, Human
aaacacugccuuuuuauuuaua

SEQ ID NO: 2883280 - RNA, 14 nt, Human
aaacacugcgcuuu

SEQ ID NO: 2883281 - RNA, 21 nt, Human
aaacacugcgcuuuauuuucu

SEQ ID NO: 2883282 - RNA, 18 nt, Human
aaacacugccuuuuuauu

SEQ ID NO: 2883283 - RNA, 21 nt, Human
aaacagaaacaaaaacacuaa

SEQ ID NO: 2883284 - RNA, 19 nt, Human
aaacagaaacaaaaacacu

SEQ ID NO: 2883285 - RNA, 13 nt, Human
aaacagaaacaaa

SEQ ID NO: 2883286 - RNA, 13 nt, Human
aaacacuuucaaa

SEQ ID NO: 2883287 - RNA, 14 nt, Human
aaacacuuucaaaa

SEQ ID NO: 2883288 - RNA, 13 nt, Human
aaacacuuucucu

SEQ ID NO: 2883289 - RNA, 14 nt, Human
aaacacuuucucuu

SEQ ID NO: 2883290 - RNA, 21 nt, Human
aaacacuuucucuucuuguuu

SEQ ID NO: 2883291 - RNA, 17 nt, Human
aaacacuuugccuccug

SEQ ID NO: 2883292 - RNA, 13 nt, Human
aaacacuuuuuug

SEQ ID NO: 2883293 - RNA, 14 nt, Human
aaacacuuuuuugg

SEQ ID NO: 2883294 - RNA, 14 nt, Human
aaacagacaauaug

SEQ ID NO: 2883295 - RNA, 16 nt, Human
aaacagacaauaugug

SEQ ID NO: 2883296 - RNA, 22 nt, Human
aaacagacaauaugugagugcc

SEQ ID NO: 2883297 - RNA, 13 nt, Human
aaacagaacauca

SEQ ID NO: 2883298 - RNA, 12 nt, Human
aaacagaacagg

SEQ ID NO: 2883299 - RNA, 15 nt, Human
aaacagaacaggguc

SEQ ID NO: 2883300 - RNA, 21 nt, Human
aaacagaacaucauuagaaca

SEQ ID NO: 2883301 - RNA, 15 nt, Human
aaaaucuaauauuaa

SEQ ID NO: 2883302 - RNA, 20 nt, Human
aaaauccuugcuuaugacau

SEQ ID NO: 2883303 - RNA, 13 nt, Human
aaaauccuugcuu

SEQ ID NO: 2883304 - RNA, 16 nt, Human
aaaauccuaagacaca

SEQ ID NO: 2883305 - RNA, 21 nt, Human
aaaauccuaagacacaaaugc

SEQ ID NO: 2883306 - RNA, 22 nt, Human
aaaauccuaagacacaaaugca

SEQ ID NO: 2883307 - RNA, 21 nt, Human
aaaauccuuccaaagaauucu

SEQ ID NO: 2883308 - RNA, 19 nt, Human
aaaaucagguauuaaucuu

SEQ ID NO: 2883309 - RNA, 20 nt, Human
aaaauaaaccaaaggacauu

SEQ ID NO: 2883310 - RNA, 12 nt, Human
aaaaucaugaga

SEQ ID NO: 2883311 - RNA, 14 nt, Human
aaaaucaucuauuu

SEQ ID NO: 2883312 - RNA, 15 nt, Human
aaaaucaucuauuuu

SEQ ID NO: 2883313 - RNA, 16 nt, Human
aaaaucaucuauuuug

SEQ ID NO: 2883314 - RNA, 18 nt, Human
aaaaucaucuauuuugau

SEQ ID NO: 2883315 - RNA, 19 nt, Human
aaaaucaucuauuuugaug

SEQ ID NO: 2883316 - RNA, 13 nt, Human
aaaaguuccaaga

SEQ ID NO: 2883317 - RNA, 15 nt, Human
aaaaguuccaagagu

SEQ ID NO: 2883318 - RNA, 22 nt, Human
aaaaguuccaagagucuaaaga

SEQ ID NO: 2883319 - RNA, 23 nt, Human
aaaaguuccaagagucuaaagau

SEQ ID NO: 2883320 - RNA, 17 nt, Human
aaaaguucccugaaaca

SEQ ID NO: 2883321 - RNA, 13 nt, Human
aaaaguguuuauu

SEQ ID NO: 2883322 - RNA, 21 nt, Human
aaaaguguuuauuuuucauau

SEQ ID NO: 2883323 - RNA, 16 nt, Human
aaaaguuaaugcuuaa

SEQ ID NO: 2883324 - RNA, 18 nt, Human
aaaaguuaaugcuuaaga

SEQ ID NO: 2883325 - RNA, 23 nt, Human
aaaaguuaaugcuuaagagggaa

SEQ ID NO: 2883326 - RNA, 15 nt, Human
aaaaguuacagaaau

SEQ ID NO: 2883327 - RNA, 19 nt, Human
aaaauaaaauuaaagcuga

SEQ ID NO: 2883328 - RNA, 14 nt, Human
aaaauaaacaaaua

SEQ ID NO: 2883329 - RNA, 12 nt, Human
aaaauaaacaaa

SEQ ID NO: 2883330 - RNA, 15 nt, Human
aaaaagaaaggaggg

SEQ ID NO: 2883331 - RNA, 14 nt, Human
aaaaacucuuuauu

SEQ ID NO: 2883332 - RNA, 15 nt, Human
aaaaacucuuuauuu

SEQ ID NO: 2883333 - RNA, 14 nt, Human
aaaaagaaaaugaa

SEQ ID NO: 2883334 - RNA, 14 nt, Human
aaaaagaaacaaga

SEQ ID NO: 2883335 - RNA, 15 nt, Human
aaaaagaaaugacua

SEQ ID NO: 2883336 - RNA, 11 nt, Human
aaaaagaagaa

SEQ ID NO: 2883337 - RNA, 12 nt, Human
aaaaagaagaag

SEQ ID NO: 2883338 - RNA, 16 nt, Human
aaaaguggaagugaca

SEQ ID NO: 2883339 - RNA, 23 nt, Human
aaaaguggaauuucuuguuucuc

SEQ ID NO: 2883340 - RNA, 18 nt, Human
aaaagugggcuugauucu

SEQ ID NO: 2883341 - RNA, 13 nt, Human
aaaaguggggcag

SEQ ID NO: 2883342 - RNA, 14 nt, Human
aaaaguggggcaga

SEQ ID NO: 2883343 - RNA, 15 nt, Human
aaaaguggggcagag

SEQ ID NO: 2883344 - RNA, 18 nt, Human
aaaaguggggcagagccu

SEQ ID NO: 2883345 - RNA, 17 nt, Human
aaaagugggcuugauuc

SEQ ID NO: 2883346 - RNA, 18 nt, Human
aaaagugucaccuuuucu

SEQ ID NO: 2883347 - RNA, 17 nt, Human
aacuuuauguguaaaua

SEQ ID NO: 2883348 - RNA, 13 nt, Human
aacuuuaugugua

SEQ ID NO: 2883349 - RNA, 14 nt, Human
aacuuuauguguaa

SEQ ID NO: 2883350 - RNA, 13 nt, Human
aacuuuauacauu

SEQ ID NO: 2883351 - RNA, 15 nt, Human
aacuuuauacauuag

SEQ ID NO: 2883352 - RNA, 16 nt, Human
aacuuuauacauuagu

SEQ ID NO: 2883353 - RNA, 18 nt, Human
aacuuuauacauuaguaa

SEQ ID NO: 2883354 - RNA, 21 nt, Human
aacuuuauacauuaguaaaug

SEQ ID NO: 2883355 - RNA, 19 nt, Human
aacugaccagccuccaugc

SEQ ID NO: 2883356 - RNA, 15 nt, Human
aacugacuaucauaa

SEQ ID NO: 2883357 - RNA, 18 nt, Human
aacugacuaucauaaaau

SEQ ID NO: 2883358 - RNA, 22 nt, Human
aacugacuaucauaaaaucaaa

SEQ ID NO: 2883359 - RNA, 13 nt, Human
aacucagaucugu

SEQ ID NO: 2883360 - RNA, 16 nt, Human
aacugagugccuuuug

SEQ ID NO: 2883361 - RNA, 20 nt, Human
aacugaggaauuuucuuugu

SEQ ID NO: 2883362 - RNA, 18 nt, Human
aacugaggaauuuucuuu

SEQ ID NO: 2883363 - RNA, 19 nt, Human
aacuuaaauuuuaauuuau

SEQ ID NO: 2883364 - RNA, 16 nt, Human
aacuuaaauuuuaauu

SEQ ID NO: 2883365 - RNA, 14 nt, Human
aacuuaacauauuu

SEQ ID NO: 2883366 - RNA, 16 nt, Human
aacuuaacauauuuac

SEQ ID NO: 2883367 - RNA, 18 nt, Human
aacuuaaguggcuaaaga

SEQ ID NO: 2883368 - RNA, 13 nt, Human
aacuuaacuuuaa

SEQ ID NO: 2883369 - RNA, 15 nt, Human
aacuuaacaugggcu

SEQ ID NO: 2883370 - RNA, 22 nt, Human
aacuuaauguucuuaugcaaaa

SEQ ID NO: 2883371 - RNA, 23 nt, Human
aacuuaauguucuuaugcaaaau

SEQ ID NO: 2883372 - RNA, 20 nt, Human
aacggagccccaggccucug

SEQ ID NO: 2883373 - RNA, 15 nt, Human
aacgcugccugcccg

SEQ ID NO: 2883374 - RNA, 16 nt, Human
aacgcugucaaaaguu

SEQ ID NO: 2883375 - RNA, 17 nt, Human
aacgcuuaaaggaaguc

SEQ ID NO: 2883376 - RNA, 15 nt, Human
aacgcugccugccca

SEQ ID NO: 2883377 - RNA, 14 nt, Human
aacgcugccugccc

SEQ ID NO: 2883378 - RNA, 11 nt, Human
aacgcugccug

SEQ ID NO: 2883379 - RNA, 13 nt, Human
aacgcugccugcc

SEQ ID NO: 2883380 - RNA, 12 nt, Human
aacgcugccugc

SEQ ID NO: 2883381 - RNA, 23 nt, Human
aacgcagcccuagagccugccug

SEQ ID NO: 2883382 - RNA, 13 nt, Human
aacgcagcccuag

SEQ ID NO: 2883383 - RNA, 21 nt, Human
aacgcagcccuagagccugcc

SEQ ID NO: 2883384 - RNA, 22 nt, Human
aacgcagcccuagagccugccu

SEQ ID NO: 2883385 - RNA, 18 nt, Human
aacgcagaugauccauga

SEQ ID NO: 2883386 - RNA, 12 nt, Human
aacgcacaggaa

SEQ ID NO: 2883387 - RNA, 11 nt, Human
aacgcagcccu

SEQ ID NO: 2883388 - RNA, 15 nt, Human
aacggauuccaaaga

SEQ ID NO: 2883389 - RNA, 14 nt, Human
aacuauugcccagg

SEQ ID NO: 2883390 - RNA, 21 nt, Human
aacuauugcauuuauauguac

SEQ ID NO: 2883391 - RNA, 15 nt, Human
aacuauugcauuuau

SEQ ID NO: 2883392 - RNA, 16 nt, Human
aacuauugcauuuaua

SEQ ID NO: 2883393 - RNA, 16 nt, Human
aacuauuucuacacag

SEQ ID NO: 2883394 - RNA, 19 nt, Human
aacuauuugucuuucagga

SEQ ID NO: 2883395 - RNA, 18 nt, Human
aacuauuugucuuucagg

SEQ ID NO: 2883396 - RNA, 19 nt, Human
aacucaaaacuuaacauau

SEQ ID NO: 2883397 - RNA, 23 nt, Human
aacucagaacugucggaggaaag

SEQ ID NO: 2883398 - RNA, 18 nt, Human
aacucagaauuauuuuua

SEQ ID NO: 2883399 - RNA, 21 nt, Human
aacucagaauuauuuuuaaaa

SEQ ID NO: 2883400 - RNA, 19 nt, Human
aacggcccugcagccagcu

SEQ ID NO: 2883401 - RNA, 14 nt, Human
aacucacuuuccuc

SEQ ID NO: 2883402 - RNA, 13 nt, Human
aacgaugugucug

SEQ ID NO: 2883403 - RNA, 16 nt, Human
aacgaugugucuguau

SEQ ID NO: 2883404 - RNA, 20 nt, Human
aacgaugugucuguauuuca

SEQ ID NO: 2883405 - RNA, 14 nt, Human
aaccuagagaagau

SEQ ID NO: 2883406 - RNA, 15 nt, Human
aaccuagagaagaua

SEQ ID NO: 2883407 - RNA, 17 nt, Human
aaccgacaggcccuggc

SEQ ID NO: 2883408 - RNA, 21 nt, Human
aaccgagagaaugcugaccug

SEQ ID NO: 2883409 - RNA, 11 nt, Human
aaccuaaccug

SEQ ID NO: 2883410 - RNA, 14 nt, Human
aaccuaaccugugu

SEQ ID NO: 2883411 - RNA, 15 nt, Human
aaccuaaccuguguc

SEQ ID NO: 2883412 - RNA, 16 nt, Human
aaccuaaccugugucu

SEQ ID NO: 2883413 - RNA, 18 nt, Human
aaccuaaccugugucugc

SEQ ID NO: 2883414 - RNA, 13 nt, Human
aaccuaacuguau

SEQ ID NO: 2883415 - RNA, 15 nt, Human
aaccuaacuguaucu

SEQ ID NO: 2883416 - RNA, 17 nt, Human
aaccuaacuguaucuug

SEQ ID NO: 2883417 - RNA, 18 nt, Human
aaccuaacuugcgcagaa

SEQ ID NO: 2883418 - RNA, 15 nt, Human
aaccgagcaaagauc

SEQ ID NO: 2883419 - RNA, 15 nt, Human
aaccuacauauucca

SEQ ID NO: 2883420 - RNA, 13 nt, Human
aaccagacagagg

SEQ ID NO: 2883421 - RNA, 18 nt, Human
aaccuacacacugucaug

SEQ ID NO: 2883422 - RNA, 19 nt, Human
aacccuaucuccugacaga

SEQ ID NO: 2883423 - RNA, 16 nt, Human
aacccuaucuccugac

SEQ ID NO: 2883424 - RNA, 15 nt, Human
aacccuaucuccuga

SEQ ID NO: 2883425 - RNA, 21 nt, Human
aacccuauacuguaguauucu

SEQ ID NO: 2883426 - RNA, 20 nt, Human
aacccuagguucccgguccc

SEQ ID NO: 2883427 - RNA, 17 nt, Human
aacccuagguucccugu

SEQ ID NO: 2883428 - RNA, 17 nt, Human
aacccuacacccagacc

SEQ ID NO: 2883429 - RNA, 21 nt, Human
aacccuuuucauccuggcugg

SEQ ID NO: 2883430 - RNA, 23 nt, Human
aacccuaucuccugacagaaggu

SEQ ID NO: 2883431 - RNA, 22 nt, Human
aacccuaucuccugacagaagg

SEQ ID NO: 2883432 - RNA, 15 nt, Human
aacccuauugguaaa

SEQ ID NO: 2883433 - RNA, 21 nt, Human
aacccuuggagccaauggaga

SEQ ID NO: 2883434 - RNA, 16 nt, Human
aaccacggccacauuu

SEQ ID NO: 2883435 - RNA, 14 nt, Human
aaccacggaaaaga

SEQ ID NO: 2883436 - RNA, 13 nt, Human
aaccacuucauuc

SEQ ID NO: 2883437 - RNA, 14 nt, Human
aaccacuucauucu

SEQ ID NO: 2883438 - RNA, 16 nt, Human
aaccacuucauucugc

SEQ ID NO: 2883439 - RNA, 22 nt, Human
aacagcauccccaaaacaaagu

SEQ ID NO: 2883440 - RNA, 13 nt, Human
aaccacuuuccuu

SEQ ID NO: 2883441 - RNA, 13 nt, Human
aaccagauaacau

SEQ ID NO: 2883442 - RNA, 16 nt, Human
aaccagaaucccucua

SEQ ID NO: 2883443 - RNA, 16 nt, Human
aaccagacaaggaaau

SEQ ID NO: 2883444 - RNA, 13 nt, Human
aaccacgcuggac

SEQ ID NO: 2883445 - RNA, 22 nt, Human
aaccaccccggcccccugcccg

SEQ ID NO: 2883446 - RNA, 21 nt, Human
aaccaccccggcccccugccc

SEQ ID NO: 2883447 - RNA, 17 nt, Human
aacauccauguccuaug

SEQ ID NO: 2883448 - RNA, 22 nt, Human
aacauccauguccuauguguga

SEQ ID NO: 2883449 - RNA, 15 nt, Human
aacaucccaagauuu

SEQ ID NO: 2883450 - RNA, 22 nt, Human
aacaucccaagauuuuuucauu

SEQ ID NO: 2883451 - RNA, 16 nt, Human
aacagcuuucaagugc

SEQ ID NO: 2883452 - RNA, 22 nt, Human
aacagcuuuggggugucuuuuu

SEQ ID NO: 2883453 - RNA, 14 nt, Human
aacagcuucagguu

SEQ ID NO: 2883454 - RNA, 15 nt, Human
aacagcuucagguua

SEQ ID NO: 2883455 - RNA, 16 nt, Human
aacagcuucagguuau

SEQ ID NO: 2883456 - RNA, 16 nt, Human
aacauccaaccuuccc

SEQ ID NO: 2883457 - RNA, 11 nt, Human
aacauccaaaa

SEQ ID NO: 2883458 - RNA, 17 nt, Human
aacauccaaccuuccca

SEQ ID NO: 2883459 - RNA, 17 nt, Human
aacaucauuuuguuuuc

SEQ ID NO: 2883460 - RNA, 18 nt, Human
aacaucauuuuguuuucc

SEQ ID NO: 2883461 - RNA, 15 nt, Human
aacagcaguguuccc

SEQ ID NO: 2883462 - RNA, 18 nt, Human
aacagcugucacaacuug

SEQ ID NO: 2883463 - RNA, 11 nt, Human
aacagcagugu

SEQ ID NO: 2883464 - RNA, 13 nt, Human
aacagcaguguuc

SEQ ID NO: 2883465 - RNA, 12 nt, Human
aacaacauuuug

SEQ ID NO: 2883466 - RNA, 14 nt, Human
aacaacauuuugag

SEQ ID NO: 2883467 - RNA, 21 nt, Human
aacaacauuuugagaacaaag

SEQ ID NO: 2883468 - RNA, 15 nt, Human
aacaaccacaggaau

SEQ ID NO: 2883469 - RNA, 18 nt, Human
aacaaauucauauucugu

SEQ ID NO: 2883470 - RNA, 22 nt, Human
aacaaauucaucaaauggaaga

SEQ ID NO: 2883471 - RNA, 23 nt, Human
aacaaauucugaauauuuuuuga

SEQ ID NO: 2883472 - RNA, 14 nt, Human
aacaaaaaagcuaa

SEQ ID NO: 2883473 - RNA, 19 nt, Human
aacaaaaacacuaaaaaua

SEQ ID NO: 2883474 - RNA, 17 nt, Human
aaauuuuuuuuuuaaua

SEQ ID NO: 2883475 - RNA, 18 nt, Human
aaauuuuuuuuacauuuu

SEQ ID NO: 2883476 - RNA, 17 nt, Human
aaauuuuuuuuacauuu

SEQ ID NO: 2883477 - RNA, 16 nt, Human
aaauuuuuuuuacauu

SEQ ID NO: 2883478 - RNA, 14 nt, Human
aacaccacagaaau

SEQ ID NO: 2883479 - RNA, 13 nt, Human
aacaccacagaca

SEQ ID NO: 2883480 - RNA, 14 nt, Human
aacaccacagacac

SEQ ID NO: 2883481 - RNA, 15 nt, Human
aacaccacagacaca

SEQ ID NO: 2883482 - RNA, 16 nt, Human
aacaccacagacacac

SEQ ID NO: 2883483 - RNA, 17 nt, Human
aacaccacagacacaca

SEQ ID NO: 2883484 - RNA, 18 nt, Human
aacaccacagacacacac

SEQ ID NO: 2883485 - RNA, 17 nt, Human
aacacauguuuuuauac

SEQ ID NO: 2883486 - RNA, 17 nt, Human
aacacaucuuuccuguc

SEQ ID NO: 2883487 - RNA, 18 nt, Human
aacacauggggaaaaaaa

SEQ ID NO: 2883488 - RNA, 21 nt, Human
aacacauggggaaaaaaauca

SEQ ID NO: 2883489 - RNA, 22 nt, Human
aacacauggggaaaaaaaucau

SEQ ID NO: 2883490 - RNA, 14 nt, Human
aacacauugccuaa

SEQ ID NO: 2883491 - RNA, 16 nt, Human
aacacauuguuauuuu

SEQ ID NO: 2883492 - RNA, 17 nt, Human
aacacauuguuauuuuc

SEQ ID NO: 2883493 - RNA, 19 nt, Human
aacacauuguuauuuucag

SEQ ID NO: 2883494 - RNA, 20 nt, Human
aacacauuguuauuuucagu

SEQ ID NO: 2883495 - RNA, 22 nt, Human
aacacauuguuauuuucaguga

SEQ ID NO: 2883496 - RNA, 20 nt, Human
aacacgccugcaaacgcugc

SEQ ID NO: 2883497 - RNA, 16 nt, Human
aacacgcguauuuaca

SEQ ID NO: 2883498 - RNA, 15 nt, Human
aacacgccugcaaac

SEQ ID NO: 2883499 - RNA, 19 nt, Human
aacacgcauggucaacccu

SEQ ID NO: 2883500 - RNA, 19 nt, Human
aacaccacagacacacaca

SEQ ID NO: 2883501 - RNA, 23 nt, Human
aacaccacagacacacacacgca

SEQ ID NO: 2883502 - RNA, 15 nt, Human
aacacgugaugugau

SEQ ID NO: 2883503 - RNA, 16 nt, Human
aacacgugaugugaua

SEQ ID NO: 2883504 - RNA, 20 nt, Human
aacacuaaagauccaagaag

SEQ ID NO: 2883505 - RNA, 15 nt, Human
aacacuaaaaauaaa

SEQ ID NO: 2883506 - RNA, 13 nt, Human
aacacuaaaauuu

SEQ ID NO: 2883507 - RNA, 14 nt, Human
aacacuaaaaauaa

SEQ ID NO: 2883508 - RNA, 17 nt, Human
aaauguuuaaacauuuu

SEQ ID NO: 2883509 - RNA, 20 nt, Human
aaaucuuauaguucuaggca

SEQ ID NO: 2883510 - RNA, 13 nt, Human
aaaucuuacaaca

SEQ ID NO: 2883511 - RNA, 22 nt, Human
aaaucuuaaugaaugagucugu

SEQ ID NO: 2883512 - RNA, 16 nt, Human
aaaucuuauaguucua

SEQ ID NO: 2883513 - RNA, 17 nt, Human
aaaucuuauaguucuag

SEQ ID NO: 2883514 - RNA, 18 nt, Human
aaaucuuauaguucuagg

SEQ ID NO: 2883515 - RNA, 19 nt, Human
aaaucuuauaguucuaggc

SEQ ID NO: 2883516 - RNA, 13 nt, Human
aaaugccuuugag

SEQ ID NO: 2883517 - RNA, 14 nt, Human
aaaugccuuugaga

SEQ ID NO: 2883518 - RNA, 17 nt, Human
aaaugccuuagaaaugu

SEQ ID NO: 2883519 - RNA, 22 nt, Human
aaaugccuuagaaauguaaacu

SEQ ID NO: 2883520 - RNA, 23 nt, Human
aaaugccuuagaaauguaaacug

SEQ ID NO: 2883521 - RNA, 20 nt, Human
aaaugccuuugagacaguuu

SEQ ID NO: 2883522 - RNA, 16 nt, Human
aaaugccuuugagaca

SEQ ID NO: 2883523 - RNA, 17 nt, Human
aaaugccuuugagacag

SEQ ID NO: 2883524 - RNA, 18 nt, Human
aaaugccuuugagacagu

SEQ ID NO: 2883525 - RNA, 19 nt, Human
aaaugccuuugagacaguu

SEQ ID NO: 2883526 - RNA, 15 nt, Human
aaaugcuaauauuaa

SEQ ID NO: 2883527 - RNA, 18 nt, Human
aaaugcuaauauuaaaag

SEQ ID NO: 2883528 - RNA, 21 nt, Human
aaaugcuaauauuaaaaguca

SEQ ID NO: 2883529 - RNA, 23 nt, Human
aaaugcuaauauuaaaagucaca

SEQ ID NO: 2883530 - RNA, 20 nt, Human
aaauugacacaaguggaccu

SEQ ID NO: 2883531 - RNA, 13 nt, Human
aaauugcuccuug

SEQ ID NO: 2883532 - RNA, 22 nt, Human
aaauugcuccuaagcuucaaau

SEQ ID NO: 2883533 - RNA, 14 nt, Human
aaauugcuccuuga

SEQ ID NO: 2883534 - RNA, 15 nt, Human
aaauuuuuuuuacau

SEQ ID NO: 2883535 - RNA, 21 nt, Human
aaauugccauuggacaguugu

SEQ ID NO: 2883536 - RNA, 20 nt, Human
aaauugccuauccugcuguu

SEQ ID NO: 2883537 - RNA, 13 nt, Human
aaauugcuauguu

SEQ ID NO: 2883538 - RNA, 17 nt, Human
aaauugcuauguuacua

SEQ ID NO: 2883539 - RNA, 21 nt, Human
aaauugcuauguuacuauuuu

SEQ ID NO: 2883540 - RNA, 22 nt, Human
aaauugcuauguuacuauuuuc

SEQ ID NO: 2883541 - RNA, 17 nt, Human
aaauuaacaguccuaac

SEQ ID NO: 2883542 - RNA, 13 nt, Human
aaauuaaaucugu

SEQ ID NO: 2883543 - RNA, 23 nt, Human
aaauuaaaucugucccugagagu

SEQ ID NO: 2883544 - RNA, 16 nt, Human
aaauuaaacacaaagu

SEQ ID NO: 2883545 - RNA, 18 nt, Human
aaauuaaacauaaaacaa

SEQ ID NO: 2883546 - RNA, 21 nt, Human
aaauuaaagccuuuaguauca

SEQ ID NO: 2883547 - RNA, 22 nt, Human
aaauuaaagccuuuaguaucag

SEQ ID NO: 2883548 - RNA, 23 nt, Human
aaauuaaagccuuuaguaucagu

SEQ ID NO: 2883549 - RNA, 13 nt, Human
aaauuaaagcuga

SEQ ID NO: 2883550 - RNA, 17 nt, Human
aaauuaaagcugaaaac

SEQ ID NO: 2883551 - RNA, 16 nt, Human
aaauuaaaguuugcuu

SEQ ID NO: 2883552 - RNA, 18 nt, Human
aaauuaacaguccuaacu

SEQ ID NO: 2883553 - RNA, 15 nt, Human
aaauucuuuauuucu

SEQ ID NO: 2883554 - RNA, 17 nt, Human
aaauucuuuauuucugu

SEQ ID NO: 2883555 - RNA, 20 nt, Human
aaauucuuucagcuaucagu

SEQ ID NO: 2883556 - RNA, 12 nt, Human
aaauugaaauug

SEQ ID NO: 2883557 - RNA, 13 nt, Human
aaauugaaauugu

SEQ ID NO: 2883558 - RNA, 12 nt, Human
aaauugaagaga

SEQ ID NO: 2883559 - RNA, 17 nt, Human
aaauugaagagagauau

SEQ ID NO: 2883560 - RNA, 21 nt, Human
aaauugaagagagauauaucu

SEQ ID NO: 2883561 - RNA, 22 nt, Human
aagggaaagcuucauucuccuu

SEQ ID NO: 2883562 - RNA, 13 nt, Human
aagggaaauauca

SEQ ID NO: 2883563 - RNA, 14 nt, Human
aagggaaauaucau

SEQ ID NO: 2883564 - RNA, 15 nt, Human
aagggaaauaucauu

SEQ ID NO: 2883565 - RNA, 16 nt, Human
aagggaaauaucauuu

SEQ ID NO: 2883566 - RNA, 14 nt, Human
aagggaacagaaag

SEQ ID NO: 2883567 - RNA, 13 nt, Human
aagggaagacauu

SEQ ID NO: 2883568 - RNA, 14 nt, Human
aagggaagacauuu

SEQ ID NO: 2883569 - RNA, 15 nt, Human
aagggaagacauuuc

SEQ ID NO: 2883570 - RNA, 16 nt, Human
aagggaagacauuucu

SEQ ID NO: 2883571 - RNA, 18 nt, Human
aagggaagacauuucuuu

SEQ ID NO: 2883572 - RNA, 14 nt, Human
aagggaaggacaga

SEQ ID NO: 2883573 - RNA, 17 nt, Human
aagggaaguugugccuu

SEQ ID NO: 2883574 - RNA, 20 nt, Human
aagggaaucacaucuuuuaa

SEQ ID NO: 2883575 - RNA, 12 nt, Human
aagggaauccuc

SEQ ID NO: 2883576 - RNA, 17 nt, Human
aagggaauccuccucca

SEQ ID NO: 2883577 - RNA, 24 nt, Human
aagggagcacuggguugacuuuca

SEQ ID NO: 2883578 - RNA, 18 nt, Human
aagggagcuaucaggaac

SEQ ID NO: 2883579 - RNA, 18 nt, Human
aagggaggacgggagcug

SEQ ID NO: 2883580 - RNA, 22 nt, Human
aagggaggacgggagcugggga

SEQ ID NO: 2883581 - RNA, 11 nt, Human
aagggaggagg

SEQ ID NO: 2883582 - RNA, 21 nt, Human
aagggaggaggagcuucuggg

SEQ ID NO: 2883583 - RNA, 16 nt, Human
aagggccaguccugcc

SEQ ID NO: 2883584 - RNA, 14 nt, Human
aagggccaguccug

SEQ ID NO: 2883585 - RNA, 22 nt, Human
aagggccaguccugccuggcca

SEQ ID NO: 2883586 - RNA, 22 nt, Human
aagggccaccuacaauacaucu

SEQ ID NO: 2883587 - RNA, 17 nt, Human
aagggcaugccuugugc

SEQ ID NO: 2883588 - RNA, 19 nt, Human
aagggcaugccuugugcug

SEQ ID NO: 2883589 - RNA, 12 nt, Human
aaguagaagagg

SEQ ID NO: 2883590 - RNA, 17 nt, Human
aaguaguccuuggcaua

SEQ ID NO: 2883591 - RNA, 14 nt, Human
aaguagucugcuca

SEQ ID NO: 2883592 - RNA, 15 nt, Human
aaguagucugcucac

SEQ ID NO: 2883593 - RNA, 13 nt, Human
aaggugccacuuu

SEQ ID NO: 2883594 - RNA, 15 nt, Human
aaggugcuaaaucug

SEQ ID NO: 2883595 - RNA, 19 nt, Human
aaggugcuaaaucugcgau

SEQ ID NO: 2883596 - RNA, 13 nt, Human
aaggugaggccug

SEQ ID NO: 2883597 - RNA, 14 nt, Human
aaggugaggccugu

SEQ ID NO: 2883598 - RNA, 17 nt, Human
aaggugaggccugucug

SEQ ID NO: 2883599 - RNA, 18 nt, Human
aaggugaggccugucugu

SEQ ID NO: 2883600 - RNA, 19 nt, Human
aaggugaggccugucugug

SEQ ID NO: 2883601 - RNA, 21 nt, Human
aaggugaggccugucugugac

SEQ ID NO: 2883602 - RNA, 22 nt, Human
aaggugaggccugucugugacc

SEQ ID NO: 2883603 - RNA, 13 nt, Human
aaggucuaugcag

SEQ ID NO: 2883604 - RNA, 15 nt, Human
aaggucucauucuuc

SEQ ID NO: 2883605 - RNA, 18 nt, Human
aagguccugaaaguaacu

SEQ ID NO: 2883606 - RNA, 19 nt, Human
aagguccacaggucuagac

SEQ ID NO: 2883607 - RNA, 19 nt, Human
aagguccgguguucuaaga

SEQ ID NO: 2883608 - RNA, 21 nt, Human
aagguccgguguucuaagaug

SEQ ID NO: 2883609 - RNA, 18 nt, Human
aaguauccugcuucugau

SEQ ID NO: 2883610 - RNA, 18 nt, Human
aaguaucuaaaaguguca

SEQ ID NO: 2883611 - RNA, 12 nt, Human
aaguccaaugug

SEQ ID NO: 2883612 - RNA, 18 nt, Human
aaguccaauuuuaauuua

SEQ ID NO: 2883613 - RNA, 19 nt, Human
aaguccaauuuuaauuuag

SEQ ID NO: 2883614 - RNA, 18 nt, Human
aaguccucuuuucugaga

SEQ ID NO: 2883615 - RNA, 19 nt, Human
aaguccgcagaagcccuga

SEQ ID NO: 2883616 - RNA, 18 nt, Human
aaguccgcagaagcccug

SEQ ID NO: 2883617 - RNA, 14 nt, Human
aaguccuauggaaa

SEQ ID NO: 2883618 - RNA, 15 nt, Human
aaguccuauggaaac

SEQ ID NO: 2883619 - RNA, 16 nt, Human
aaguccuauggaaacc

SEQ ID NO: 2883620 - RNA, 14 nt, Human
aaguccaauaagac

SEQ ID NO: 2883621 - RNA, 15 nt, Human
aaguccaauaagaca

SEQ ID NO: 2883622 - RNA, 22 nt, Human
aaguccucuuuucugagaggac

SEQ ID NO: 2883623 - RNA, 12 nt, Human
aaguccuggcuu

SEQ ID NO: 2883624 - RNA, 15 nt, Human
aaguccuggcuucag

SEQ ID NO: 2883625 - RNA, 17 nt, Human
aaguccuggcuucaggc

SEQ ID NO: 2883626 - RNA, 17 nt, Human
aaguccuguaugucugu

SEQ ID NO: 2883627 - RNA, 19 nt, Human
aaguccuguaugucuguca

SEQ ID NO: 2883628 - RNA, 20 nt, Human
aaguccuguaugucugucau

SEQ ID NO: 2883629 - RNA, 15 nt, Human
aagucgaauuaauag

SEQ ID NO: 2883630 - RNA, 16 nt, Human
aagucggaacagcaga

SEQ ID NO: 2883631 - RNA, 16 nt, Human
aaguccuuuaugugga

SEQ ID NO: 2883632 - RNA, 13 nt, Human
aaguccuuuaugu

SEQ ID NO: 2883633 - RNA, 21 nt, Human
aaguccuuuuuuuccaucuuu

SEQ ID NO: 2883634 - RNA, 15 nt, Human
aaguccuuuuguaaa

SEQ ID NO: 2883635 - RNA, 16 nt, Human
aaguccuuuuguaaag

SEQ ID NO: 2883636 - RNA, 17 nt, Human
aaguccuuuuguaaagu

SEQ ID NO: 2883637 - RNA, 22 nt, Human
aagucuaucuaaugacaugccu

SEQ ID NO: 2883638 - RNA, 15 nt, Human
aagucguuuuccaaa

SEQ ID NO: 2883639 - RNA, 17 nt, Human
aagucguuuuccaaacu

SEQ ID NO: 2883640 - RNA, 19 nt, Human
aagucguuuuccaaacuga

SEQ ID NO: 2883641 - RNA, 19 nt, Human
aaguugcauuccuuugucu

SEQ ID NO: 2883642 - RNA, 20 nt, Human
aaguugauauagaacagugc

SEQ ID NO: 2883643 - RNA, 17 nt, Human
aaguugaggauuguuga

SEQ ID NO: 2883644 - RNA, 18 nt, Human
aaguugaggauuguugaa

SEQ ID NO: 2883645 - RNA, 17 nt, Human
aaguugauauagaacag

SEQ ID NO: 2883646 - RNA, 23 nt, Human
aaguugacuuauaguacaugaua

SEQ ID NO: 2883647 - RNA, 21 nt, Human
aaguugacuuauaguacauga

SEQ ID NO: 2883648 - RNA, 20 nt, Human
aaguugacuuauaguacaug

SEQ ID NO: 2883649 - RNA, 19 nt, Human
aaguugacuuauaguacau

SEQ ID NO: 2883650 - RNA, 16 nt, Human
aaguugacuuauagua

SEQ ID NO: 2883651 - RNA, 18 nt, Human
aaguguaaguucacaacu

SEQ ID NO: 2883652 - RNA, 15 nt, Human
aaguguaauaauaug

SEQ ID NO: 2883653 - RNA, 16 nt, Human
aaguguaauaauauga

SEQ ID NO: 2883654 - RNA, 13 nt, Human
aagugcuugugua

SEQ ID NO: 2883655 - RNA, 14 nt, Human
aagugcuuguguaa

SEQ ID NO: 2883656 - RNA, 15 nt, Human
aagugcuuguguaau

SEQ ID NO: 2883657 - RNA, 17 nt, Human
aaguggaauuucuuguu

SEQ ID NO: 2883658 - RNA, 21 nt, Human
aaguggaauuucuuguuucuc

SEQ ID NO: 2883659 - RNA, 22 nt, Human
aagucugccuauccuggccagg

SEQ ID NO: 2883660 - RNA, 12 nt, Human
aagucugaauca

SEQ ID NO: 2883661 - RNA, 22 nt, Human
aagucugugugaugaacuuucu

SEQ ID NO: 2883662 - RNA, 23 nt, Human
aagucugugugaugaacuuucuc

SEQ ID NO: 2883663 - RNA, 23 nt, Human
aaggauuguaaaaaaaaaugccu

SEQ ID NO: 2883664 - RNA, 12 nt, Human
aaggcagggagg

SEQ ID NO: 2883665 - RNA, 15 nt, Human
aaggauugcuacugu

SEQ ID NO: 2883666 - RNA, 12 nt, Human
aaggauuguaaa

SEQ ID NO: 2883667 - RNA, 13 nt, Human
aaggauuguaaaa

SEQ ID NO: 2883668 - RNA, 14 nt, Human
aaggauuguaaaaa

SEQ ID NO: 2883669 - RNA, 21 nt, Human
aaggauuguaaaaaaaaaugc

SEQ ID NO: 2883670 - RNA, 13 nt, Human
aaggauugaaaau

SEQ ID NO: 2883671 - RNA, 14 nt, Human
aaggauugaaaauu

SEQ ID NO: 2883672 - RNA, 16 nt, Human
aaggauucauguggaa

SEQ ID NO: 2883673 - RNA, 15 nt, Human
aaggauguugguguu

SEQ ID NO: 2883674 - RNA, 22 nt, Human
aaggauuaauugcugcaaggac

SEQ ID NO: 2883675 - RNA, 16 nt, Human
aaggaugugggggaag

SEQ ID NO: 2883676 - RNA, 14 nt, Human
aaggacugugcuuu

SEQ ID NO: 2883677 - RNA, 17 nt, Human
aaggacaucagcaaaca

SEQ ID NO: 2883678 - RNA, 16 nt, Human
aaggacaugaugcuuu

SEQ ID NO: 2883679 - RNA, 18 nt, Human
aaggacaugaugcuuuua

SEQ ID NO: 2883680 - RNA, 16 nt, Human
aaggacauuaugugug

SEQ ID NO: 2883681 - RNA, 17 nt, Human
aaggacauuaugugugc

SEQ ID NO: 2883682 - RNA, 17 nt, Human
aaggacagaguaugaac

SEQ ID NO: 2883683 - RNA, 15 nt, Human
aaggacaucagcaaa

SEQ ID NO: 2883684 - RNA, 14 nt, Human
aaggacaucagcaa

SEQ ID NO: 2883685 - RNA, 19 nt, Human
aaggacagccccuccucca

SEQ ID NO: 2883686 - RNA, 13 nt, Human
aaggacagccccu

SEQ ID NO: 2883687 - RNA, 21 nt, Human
aagcuggucccacucagucca

SEQ ID NO: 2883688 - RNA, 18 nt, Human
aagcuggucccacucagu

SEQ ID NO: 2883689 - RNA, 13 nt, Human
aagcuggggagga

SEQ ID NO: 2883690 - RNA, 17 nt, Human
aagcugguaaacuauuu

SEQ ID NO: 2883691 - RNA, 17 nt, Human
aagcugguggccuuggc

SEQ ID NO: 2883692 - RNA, 22 nt, Human
aagcuguaguagcccuuucugu

SEQ ID NO: 2883693 - RNA, 19 nt, Human
aagcugugacuucuccagg

SEQ ID NO: 2883694 - RNA, 16 nt, Human
aagcugugaacaggcu

SEQ ID NO: 2883695 - RNA, 23 nt, Human
aagcuguaguagcccuuucugug

SEQ ID NO: 2883696 - RNA, 17 nt, Human
aagcgauucuucugcuu

SEQ ID NO: 2883697 - RNA, 22 nt, Human
aagcgcauccaaucucaaggaa

SEQ ID NO: 2883698 - RNA, 23 nt, Human
aagcgcauccaaucucaaggaau

SEQ ID NO: 2883699 - RNA, 21 nt, Human
aagcgauucuucugcuucagc

SEQ ID NO: 2883700 - RNA, 14 nt, Human
aagcuaauuugcau

SEQ ID NO: 2883701 - RNA, 20 nt, Human
aagcuaauugggaguccagg

SEQ ID NO: 2883702 - RNA, 21 nt, Human
aagcggagguugcagggagcc

SEQ ID NO: 2883703 - RNA, 18 nt, Human
aagcuaauaauucuucac

SEQ ID NO: 2883704 - RNA, 23 nt, Human
aagcuaauuugcauuaaauucac

SEQ ID NO: 2883705 - RNA, 22 nt, Human
aagcuaauuugcauuaaauuca

SEQ ID NO: 2883706 - RNA, 15 nt, Human
aagcuaauuugcauu

SEQ ID NO: 2883707 - RNA, 21 nt, Human
aagauuccggauccuaagcau

SEQ ID NO: 2883708 - RNA, 24 nt, Human
aagauuccggauccuaagcaucua

SEQ ID NO: 2883709 - RNA, 11 nt, Human
aagauucuaaa

SEQ ID NO: 2883710 - RNA, 12 nt, Human
aagauucuaaag

SEQ ID NO: 2883711 - RNA, 13 nt, Human
aagauucuaaagg

SEQ ID NO: 2883712 - RNA, 14 nt, Human
aagauucuaaugau

SEQ ID NO: 2883713 - RNA, 16 nt, Human
aagauucuaaugauga

SEQ ID NO: 2883714 - RNA, 11 nt, Human
aagauucuaga

SEQ ID NO: 2883715 - RNA, 12 nt, Human
aagauucuagau

SEQ ID NO: 2883716 - RNA, 13 nt, Human
aagauucuagauc

SEQ ID NO: 2883717 - RNA, 20 nt, Human
aagauucuagaucagaugcu

SEQ ID NO: 2883718 - RNA, 13 nt, Human
aagauucuagaug

SEQ ID NO: 2883719 - RNA, 14 nt, Human
aagauucuagauga

SEQ ID NO: 2883720 - RNA, 15 nt, Human
aagauucuagaugau

SEQ ID NO: 2883721 - RNA, 17 nt, Human
aagauucuauaguucua

SEQ ID NO: 2883722 - RNA, 19 nt, Human
aagauucuauaguucuaga

SEQ ID NO: 2883723 - RNA, 17 nt, Human
aagauuaaacagaugau

SEQ ID NO: 2883724 - RNA, 22 nt, Human
aagauguugauuuuuacugugu

SEQ ID NO: 2883725 - RNA, 21 nt, Human
aagauguugauuuuuacugug

SEQ ID NO: 2883726 - RNA, 16 nt, Human
aagauguugauuuuua

SEQ ID NO: 2883727 - RNA, 15 nt, Human
aagauguugaagaau

SEQ ID NO: 2883728 - RNA, 21 nt, Human
aagauguugaagaauacaguu

SEQ ID NO: 2883729 - RNA, 19 nt, Human
aagauacauaaaagugcuu

SEQ ID NO: 2883730 - RNA, 21 nt, Human
aagaugugauauucuaagacu

SEQ ID NO: 2883731 - RNA, 20 nt, Human
aagaugugauauucuaagac

SEQ ID NO: 2883732 - RNA, 14 nt, Human
aagagucuagauuc

SEQ ID NO: 2883733 - RNA, 20 nt, Human
aagagucuagauucaaaggu

SEQ ID NO: 2883734 - RNA, 23 nt, Human
aagagucuagauucaaagguucu

SEQ ID NO: 2883735 - RNA, 13 nt, Human
aagagugauugca

SEQ ID NO: 2883736 - RNA, 14 nt, Human
aagagugauugcag

SEQ ID NO: 2883737 - RNA, 17 nt, Human
aagagugauugcagcuu

SEQ ID NO: 2883738 - RNA, 20 nt, Human
aagagugauugcagcuuuau

SEQ ID NO: 2883739 - RNA, 21 nt, Human
aagagugauugcagcuuuaug

SEQ ID NO: 2883740 - RNA, 22 nt, Human
aagagugacaguggauugcauu

SEQ ID NO: 2883741 - RNA, 18 nt, Human
aagagugacuaguacaaa

SEQ ID NO: 2883742 - RNA, 20 nt, Human
aagagugacuaguacaaauu

SEQ ID NO: 2883743 - RNA, 14 nt, Human
aagagucuucaaca

SEQ ID NO: 2883744 - RNA, 14 nt, Human
aagagucuuccaau

SEQ ID NO: 2883745 - RNA, 12 nt, Human
aacuuuauucuu

SEQ ID NO: 2883746 - RNA, 23 nt, Human
aacuuuauucuugaaagaagaau

SEQ ID NO: 2883747 - RNA, 15 nt, Human
aacuuuccuggaugu

SEQ ID NO: 2883748 - RNA, 18 nt, Human
aacuuuccuggaugucug

SEQ ID NO: 2883749 - RNA, 19 nt, Human
aacuuuccuggaugucuga

SEQ ID NO: 2883750 - RNA, 23 nt, Human
aacuuucccagguucuguuuaug

SEQ ID NO: 2883751 - RNA, 13 nt, Human
aagccacauagag

SEQ ID NO: 2883752 - RNA, 18 nt, Human
aagccacauuauuucuag

SEQ ID NO: 2883753 - RNA, 19 nt, Human
aagccacauuauuucuagu

SEQ ID NO: 2883754 - RNA, 16 nt, Human
aagccacaagaaauuu

SEQ ID NO: 2883755 - RNA, 15 nt, Human
aagccacaagaaauu

SEQ ID NO: 2883756 - RNA, 18 nt, Human
aagccacaagaaauuuga

SEQ ID NO: 2883757 - RNA, 18 nt, Human
aagccacaagucuuccag

SEQ ID NO: 2883758 - RNA, 16 nt, Human
aagcagcaucuucugg

SEQ ID NO: 2883759 - RNA, 16 nt, Human
aagcagcuaaauuuuc

SEQ ID NO: 2883760 - RNA, 19 nt, Human
aagcagcgaccgcccccuc

SEQ ID NO: 2883761 - RNA, 20 nt, Human
aagcagcgaccgcccccucc

SEQ ID NO: 2883762 - RNA, 19 nt, Human
aagcagauggaaugcugug

SEQ ID NO: 2883763 - RNA, 17 nt, Human
aagcagauggaaugcug

SEQ ID NO: 2883764 - RNA, 20 nt, Human
aagauucuauaguucuagac

SEQ ID NO: 2883765 - RNA, 20 nt, Human
aagcagauggaaugcugugu

SEQ ID NO: 2883766 - RNA, 16 nt, Human
aagccagcccggccgc

SEQ ID NO: 2883767 - RNA, 19 nt, Human
aagccagccugaccuuccu

SEQ ID NO: 2883768 - RNA, 13 nt, Human
aagccagccuggu

SEQ ID NO: 2883769 - RNA, 21 nt, Human
aagccagccugguccaugcag

SEQ ID NO: 2883770 - RNA, 11 nt, Human
aagccagccuu

SEQ ID NO: 2883771 - RNA, 21 nt, Human
aaugaaauccugcuucagugu

SEQ ID NO: 2883772 - RNA, 17 nt, Human
aaugaaauccuuuuccu

SEQ ID NO: 2883773 - RNA, 18 nt, Human
aaugaaaugcucuccuuu

SEQ ID NO: 2883774 - RNA, 17 nt, Human
aaugaaaugcucuccuu

SEQ ID NO: 2883775 - RNA, 19 nt, Human
aaugaaaugcucuccuuuc

SEQ ID NO: 2883776 - RNA, 21 nt, Human
aaugaaauaauguacaucugg

SEQ ID NO: 2883777 - RNA, 15 nt, Human
aaugaaaguuugcac

SEQ ID NO: 2883778 - RNA, 17 nt, Human
aaugaaagugaugacau

SEQ ID NO: 2883779 - RNA, 14 nt, Human
aaugaaauauugcu

SEQ ID NO: 2883780 - RNA, 18 nt, Human
aaugaaauauugcuguau

SEQ ID NO: 2883781 - RNA, 14 nt, Human
aaugaaguuggggu

SEQ ID NO: 2883782 - RNA, 17 nt, Human
aaugaaguuguagguaa

SEQ ID NO: 2883783 - RNA, 20 nt, Human
aaugauccccaagugugaac

SEQ ID NO: 2883784 - RNA, 13 nt, Human
aaucucuauacug

SEQ ID NO: 2883785 - RNA, 19 nt, Human
aaucucucaaaucuguuau

SEQ ID NO: 2883786 - RNA, 18 nt, Human
aaucucucccuccucagu

SEQ ID NO: 2883787 - RNA, 16 nt, Human
aauccaggcacagcug

SEQ ID NO: 2883788 - RNA, 17 nt, Human
aauccaggcacagcuga

SEQ ID NO: 2883789 - RNA, 18 nt, Human
aauccaggcacagcugag

SEQ ID NO: 2883790 - RNA, 13 nt, Human
aaucucuguuaug

SEQ ID NO: 2883791 - RNA, 14 nt, Human
aaucucuguuaugu

SEQ ID NO: 2883792 - RNA, 19 nt, Human
aaucucuguuauguacugu

SEQ ID NO: 2883793 - RNA, 20 nt, Human
aaucucuguuauguacugua

SEQ ID NO: 2883794 - RNA, 21 nt, Human
aaucucuguuauguacuguac

SEQ ID NO: 2883795 - RNA, 15 nt, Human
aaucucucugcagcu

SEQ ID NO: 2883796 - RNA, 16 nt, Human
aaucucucugcagcug

SEQ ID NO: 2883797 - RNA, 17 nt, Human
aaucucucugcagcugc

SEQ ID NO: 2883798 - RNA, 18 nt, Human
aaucucucugcagcugcc

SEQ ID NO: 2883799 - RNA, 19 nt, Human
aaucucucugcagcugccg

SEQ ID NO: 2883800 - RNA, 15 nt, Human
aaucucaaggaaucu

SEQ ID NO: 2883801 - RNA, 14 nt, Human
aaucugaaauucua

SEQ ID NO: 2883802 - RNA, 15 nt, Human
aaucugaaauucuaa

SEQ ID NO: 2883803 - RNA, 16 nt, Human
aaucugaaauucuaaa

SEQ ID NO: 2883804 - RNA, 17 nt, Human
aaugaaagguacuauau

SEQ ID NO: 2883805 - RNA, 20 nt, Human
aaugaaagguacuauauuug

SEQ ID NO: 2883806 - RNA, 23 nt, Human
aaugaaagguacuauauuugcua

SEQ ID NO: 2883807 - RNA, 23 nt, Human
aauccaagccuccacagcgaggg

SEQ ID NO: 2883808 - RNA, 23 nt, Human
aauccaaucagagaccaggcccu

SEQ ID NO: 2883809 - RNA, 21 nt, Human
aauccagauggugggaugugg

SEQ ID NO: 2883810 - RNA, 13 nt, Human
aauccaagcuccc

SEQ ID NO: 2883811 - RNA, 14 nt, Human
aauccaagcucccu

SEQ ID NO: 2883812 - RNA, 17 nt, Human
aauccaagcucccugcc

SEQ ID NO: 2883813 - RNA, 18 nt, Human
aauccaagcucccugccc

SEQ ID NO: 2883814 - RNA, 19 nt, Human
aauccaagcucccugcccc

SEQ ID NO: 2883815 - RNA, 20 nt, Human
aauccaagcucccugcccca

SEQ ID NO: 2883816 - RNA, 22 nt, Human
aauccaagcucccugccccaaa

SEQ ID NO: 2883817 - RNA, 17 nt, Human
aauccagacccggcugc

SEQ ID NO: 2883818 - RNA, 19 nt, Human
aauccagacccggcugcgu

SEQ ID NO: 2883819 - RNA, 22 nt, Human
aauccaagccuccacagcgagg

SEQ ID NO: 2883820 - RNA, 18 nt, Human
aauccaagccuccacagc

SEQ ID NO: 2883821 - RNA, 17 nt, Human
aauccaagccuccacag

SEQ ID NO: 2883822 - RNA, 16 nt, Human
aauacuaccuugaaaa

SEQ ID NO: 2883823 - RNA, 14 nt, Human
aauacucuguugua

SEQ ID NO: 2883824 - RNA, 22 nt, Human
aauacucuguuguacuauggaa

SEQ ID NO: 2883825 - RNA, 16 nt, Human
aauacuagucacccca

SEQ ID NO: 2883826 - RNA, 17 nt, Human
aauacuagucaccccaa

SEQ ID NO: 2883827 - RNA, 21 nt, Human
aauacuaccuugaaaauaaga

SEQ ID NO: 2883828 - RNA, 18 nt, Human
aauacuaccuugaaaaua

SEQ ID NO: 2883829 - RNA, 17 nt, Human
aauacuaccuugaaaau

SEQ ID NO: 2883830 - RNA, 14 nt, Human
aauacuguguggaa

SEQ ID NO: 2883831 - RNA, 15 nt, Human
aauacuguguggaac

SEQ ID NO: 2883832 - RNA, 16 nt, Human
aauacuguguggaacu

SEQ ID NO: 2883833 - RNA, 11 nt, Human
aauacugcacu

SEQ ID NO: 2883834 - RNA, 13 nt, Human
aauagaaaacuga

SEQ ID NO: 2883835 - RNA, 10 nt, Human
aauacuuuuu

SEQ ID NO: 2883836 - RNA, 19 nt, Human
aauagaaaacugaaaaucu

SEQ ID NO: 2883837 - RNA, 17 nt, Human
aauagaaaacugaaaau

SEQ ID NO: 2883838 - RNA, 18 nt, Human
aauagaaaacugaaaauc

SEQ ID NO: 2883839 - RNA, 15 nt, Human
aauacuuuuuacaau

SEQ ID NO: 2883840 - RNA, 16 nt, Human
aauacuuuuucuaaug

SEQ ID NO: 2883841 - RNA, 17 nt, Human
aauacuuuuucuaauga

SEQ ID NO: 2883842 - RNA, 13 nt, Human
aauacuuuuccuu

SEQ ID NO: 2883843 - RNA, 14 nt, Human
aauacuuuuccuua

SEQ ID NO: 2883844 - RNA, 15 nt, Human
aauacuuuuccuuac

SEQ ID NO: 2883845 - RNA, 20 nt, Human
aauacuuuuccuuaccuuua

SEQ ID NO: 2883846 - RNA, 18 nt, Human
aauagaagugcuccccuc

SEQ ID NO: 2883847 - RNA, 19 nt, Human
aauagaagugcuccccucu

SEQ ID NO: 2883848 - RNA, 16 nt, Human
aauauaugaacauuag

SEQ ID NO: 2883849 - RNA, 13 nt, Human
aauauguuuccuu

SEQ ID NO: 2883850 - RNA, 14 nt, Human
aauauguuuccuug

SEQ ID NO: 2883851 - RNA, 18 nt, Human
aauauguuuccuuguuua

SEQ ID NO: 2883852 - RNA, 19 nt, Human
aauauguuuccuuguuuau

SEQ ID NO: 2883853 - RNA, 13 nt, Human
aauauauaugaau

SEQ ID NO: 2883854 - RNA, 16 nt, Human
aauauaucccagaaau

SEQ ID NO: 2883855 - RNA, 22 nt, Human
aauauaucccagaaauuagaaa

SEQ ID NO: 2883856 - RNA, 15 nt, Human
aaucaccaaaggcuc

SEQ ID NO: 2883857 - RNA, 14 nt, Human
aaucaaguauuuug

SEQ ID NO: 2883858 - RNA, 15 nt, Human
aaucaaguauuuugu

SEQ ID NO: 2883859 - RNA, 19 nt, Human
aaucacauucgaguguuuc

SEQ ID NO: 2883860 - RNA, 14 nt, Human
aauauuaguuaaug

SEQ ID NO: 2883861 - RNA, 18 nt, Human
aauauuaguuaauggauu

SEQ ID NO: 2883862 - RNA, 13 nt, Human
aaucaagagcugc

SEQ ID NO: 2883863 - RNA, 14 nt, Human
aaucaagagcugcc

SEQ ID NO: 2883864 - RNA, 16 nt, Human
aaucaagagcugcccu

SEQ ID NO: 2883865 - RNA, 17 nt, Human
aaucaagagcugcccuc

SEQ ID NO: 2883866 - RNA, 17 nt, Human
aaucaagauuaugauga

SEQ ID NO: 2883867 - RNA, 16 nt, Human
aaucaagcaagccucu

SEQ ID NO: 2883868 - RNA, 16 nt, Human
aaucaagcagguuaga

SEQ ID NO: 2883869 - RNA, 18 nt, Human
aaucaagcagguuagaga

SEQ ID NO: 2883870 - RNA, 22 nt, Human
aaucaagccauguauaaaugug

SEQ ID NO: 2883871 - RNA, 23 nt, Human
aaucaagggcaaaaagucuacau

SEQ ID NO: 2883872 - RNA, 21 nt, Human
aauauuagugaccucagcuuu

SEQ ID NO: 2883873 - RNA, 12 nt, Human
aauauuaaaagu

SEQ ID NO: 2883874 - RNA, 19 nt, Human
aauauuaaaagucacaaug

SEQ ID NO: 2883875 - RNA, 12 nt, Human
aauguuuccuuu

SEQ ID NO: 2883876 - RNA, 23 nt, Human
aauguuuaugcaaggaaggaaag

SEQ ID NO: 2883877 - RNA, 22 nt, Human
aauguuuaugcaaggaaggaaa

SEQ ID NO: 2883878 - RNA, 21 nt, Human
aauguuuaugcaaggaaggaa

SEQ ID NO: 2883879 - RNA, 22 nt, Human
aauguuuacagauccccaagcc

SEQ ID NO: 2883880 - RNA, 16 nt, Human
aauguuugccucugcc

SEQ ID NO: 2883881 - RNA, 15 nt, Human
aauguuugccucugc

SEQ ID NO: 2883882 - RNA, 20 nt, Human
aauguuugacacaauuggaa

SEQ ID NO: 2883883 - RNA, 20 nt, Human
aauguuugaggagcauguuu

SEQ ID NO: 2883884 - RNA, 21 nt, Human
aauguuugaggagcauguuuu

SEQ ID NO: 2883885 - RNA, 22 nt, Human
aauguuugaggagcauguuuug

SEQ ID NO: 2883886 - RNA, 23 nt, Human
aauguuugaggagcauguuuugu

SEQ ID NO: 2883887 - RNA, 12 nt, Human
aauguuucuauc

SEQ ID NO: 2883888 - RNA, 13 nt, Human
aauguuuccuuua

SEQ ID NO: 2883889 - RNA, 20 nt, Human
aauguuuccaaccuggagua

SEQ ID NO: 2883890 - RNA, 15 nt, Human
aauguuuauuccuug

SEQ ID NO: 2883891 - RNA, 16 nt, Human
aauguuuauuccuuga

SEQ ID NO: 2883892 - RNA, 16 nt, Human
aauguuuaaacauuuu

SEQ ID NO: 2883893 - RNA, 17 nt, Human
aaugucuuuugaauauu

SEQ ID NO: 2883894 - RNA, 14 nt, Human
aauguuuaaugcug

SEQ ID NO: 2883895 - RNA, 18 nt, Human
aauguccuccagaagccu

SEQ ID NO: 2883896 - RNA, 17 nt, Human
aauguccuccagaagcc

SEQ ID NO: 2883897 - RNA, 17 nt, Human
aaugucuaaaugcugaa

SEQ ID NO: 2883898 - RNA, 12 nt, Human
aaugucuaaaug

SEQ ID NO: 2883899 - RNA, 15 nt, Human
aaugucuaaaugcug

SEQ ID NO: 2883900 - RNA, 23 nt, Human
aauguccuccagaagccucuggc

SEQ ID NO: 2883901 - RNA, 16 nt, Human
aauguccugccuuuua

SEQ ID NO: 2883902 - RNA, 15 nt, Human
aaugucuaaaauugu

SEQ ID NO: 2883903 - RNA, 21 nt, Human
aauguccuccagaagccucug

SEQ ID NO: 2883904 - RNA, 13 nt, Human
aaugucuuuugaa

SEQ ID NO: 2883905 - RNA, 15 nt, Human
aaugucuuuugaaua

SEQ ID NO: 2883906 - RNA, 13 nt, Human
aaugucuuuguaa

SEQ ID NO: 2883907 - RNA, 15 nt, Human
aaugucuuuguaagu

SEQ ID NO: 2883908 - RNA, 16 nt, Human
aaugucuuuguaaguc

SEQ ID NO: 2883909 - RNA, 19 nt, Human
aaugucuuuguaagucagu

SEQ ID NO: 2883910 - RNA, 22 nt, Human
aaugucuuuguaagucaguguu

SEQ ID NO: 2883911 - RNA, 21 nt, Human
aaugcuagguuaauuccaauu

SEQ ID NO: 2883912 - RNA, 23 nt, Human
aaugcuauaacuauguugauaaa

SEQ ID NO: 2883913 - RNA, 18 nt, Human
aaugcuauuuuuguuuuu

SEQ ID NO: 2883914 - RNA, 19 nt, Human
aaugcuauuuuuguuuuua

SEQ ID NO: 2883915 - RNA, 20 nt, Human
aaugcuauuuuuguuuuuag

SEQ ID NO: 2883916 - RNA, 14 nt, Human
aaugcuauugaaaa

SEQ ID NO: 2883917 - RNA, 15 nt, Human
aaugcuauugaaaau

SEQ ID NO: 2883918 - RNA, 16 nt, Human
aaugcuauugaaaaug

SEQ ID NO: 2883919 - RNA, 18 nt, Human
aaugcugaaaaaacaccu

SEQ ID NO: 2883920 - RNA, 18 nt, Human
aaugcugaugaaucacug

SEQ ID NO: 2883921 - RNA, 13 nt, Human
aaugcugcacuaa

SEQ ID NO: 2883922 - RNA, 12 nt, Human
aaugcugcacuu

SEQ ID NO: 2883923 - RNA, 13 nt, Human
aaugcugcacuuc

SEQ ID NO: 2883924 - RNA, 17 nt, Human
aaugcugcacuuccugu

SEQ ID NO: 2883925 - RNA, 17 nt, Human
aaugguguuauuugaaa

SEQ ID NO: 2883926 - RNA, 19 nt, Human
aaugguguuuuucuuguaa

SEQ ID NO: 2883927 - RNA, 20 nt, Human
aaugguguuuuucuuguaaa

SEQ ID NO: 2883928 - RNA, 17 nt, Human
aaugcugcaaacuuaau

SEQ ID NO: 2883929 - RNA, 20 nt, Human
aauggugucaguauccaggc

SEQ ID NO: 2883930 - RNA, 22 nt, Human
aaugcugccuucccaugaaucu

SEQ ID NO: 2883931 - RNA, 23 nt, Human
aaugcugccuuuucuuuaacuuu

SEQ ID NO: 2883932 - RNA, 12 nt, Human
aaugcugcagau

SEQ ID NO: 2883933 - RNA, 20 nt, Human
aaugcugcagauuugggcug

SEQ ID NO: 2883934 - RNA, 11 nt, Human
aaugcugccag

SEQ ID NO: 2883935 - RNA, 17 nt, Human
aaugcugccagugugga

SEQ ID NO: 2883936 - RNA, 23 nt, Human
aauguccaacuaaaaacaaaccc

SEQ ID NO: 2883937 - RNA, 15 nt, Human
aaugucauauacugc

SEQ ID NO: 2883938 - RNA, 18 nt, Human
aaugucauauacugccau

SEQ ID NO: 2883939 - RNA, 19 nt, Human
aaugucauauacugccaug

SEQ ID NO: 2883940 - RNA, 20 nt, Human
aaugucaggaacagaaggau

SEQ ID NO: 2883941 - RNA, 18 nt, Human
aaugucaggaacagaagg

SEQ ID NO: 2883942 - RNA, 16 nt, Human
aaugucagauacaaug

SEQ ID NO: 2883943 - RNA, 17 nt, Human
aaugucagauacaaugu

SEQ ID NO: 2883944 - RNA, 18 nt, Human
aaugucagauacaaugua

SEQ ID NO: 2883945 - RNA, 21 nt, Human
aaugucagauacaauguauuu

SEQ ID NO: 2883946 - RNA, 19 nt, Human
aaugucacguacugucuga

SEQ ID NO: 2883947 - RNA, 20 nt, Human
aaugucacguacugucugau

SEQ ID NO: 2883948 - RNA, 22 nt, Human
aaugucacguacugucugauug

SEQ ID NO: 2883949 - RNA, 18 nt, Human
aaugguugccuuaaagaa

SEQ ID NO: 2883950 - RNA, 15 nt, Human
aaugucagauacaau

SEQ ID NO: 2883951 - RNA, 17 nt, Human
aaugguugacuggguuu

SEQ ID NO: 2883952 - RNA, 15 nt, Human
aaugguucugaaaua

SEQ ID NO: 2883953 - RNA, 15 nt, Human
aaugguugccuuaaa

SEQ ID NO: 2883954 - RNA, 19 nt, Human
aaugcuagguuaauuccaa

SEQ ID NO: 2883955 - RNA, 18 nt, Human
aaugcuagguuaauucca

SEQ ID NO: 2883956 - RNA, 12 nt, Human
aaugccuuugag

SEQ ID NO: 2883957 - RNA, 13 nt, Human
aaugccuuugaga

SEQ ID NO: 2883958 - RNA, 14 nt, Human
aaugccuuugagac

SEQ ID NO: 2883959 - RNA, 16 nt, Human
aaugccuuugagacag

SEQ ID NO: 2883960 - RNA, 17 nt, Human
aaugccuuugagacagu

SEQ ID NO: 2883961 - RNA, 18 nt, Human
aaugccuuugagacaguu

SEQ ID NO: 2883962 - RNA, 19 nt, Human
aaugccuuugagacaguuu

SEQ ID NO: 2883963 - RNA, 22 nt, Human
aaugccuuagaaauguaaacug

SEQ ID NO: 2883964 - RNA, 17 nt, Human
aaugccuuaaaauggaa

SEQ ID NO: 2883965 - RNA, 20 nt, Human
aaugccuuaaaauggaauug

SEQ ID NO: 2883966 - RNA, 20 nt, Human
aaugccuuugagacaguuuc

SEQ ID NO: 2883967 - RNA, 22 nt, Human
aaugccuuugagacaguuucuu

SEQ ID NO: 2883968 - RNA, 23 nt, Human
aaugccuuugagacaguuucuua

SEQ ID NO: 2883969 - RNA, 13 nt, Human
aaugcgauuuuau

SEQ ID NO: 2883970 - RNA, 14 nt, Human
aaugcgauuuuauu

SEQ ID NO: 2883971 - RNA, 16 nt, Human
aaugcgauuuuauuac

SEQ ID NO: 2883972 - RNA, 22 nt, Human
aaugcgauuuuauuacuggcgu

SEQ ID NO: 2883973 - RNA, 21 nt, Human
aaugcgcaggcuggcccugcc

SEQ ID NO: 2883974 - RNA, 22 nt, Human
aaugcgcaggcuggcccugccc

SEQ ID NO: 2883975 - RNA, 21 nt, Human
aauuaaaaaaaaagaucuguu

SEQ ID NO: 2883976 - RNA, 12 nt, Human
agcaguucuguu

SEQ ID NO: 2883977 - RNA, 21 nt, Human
agcaguucuguuauauccccu

SEQ ID NO: 2883978 - RNA, 21 nt, Human
agcaguuacaaaaaccuuccc

SEQ ID NO: 2883979 - RNA, 21 nt, Human
agcaguguuccccaucugggu

SEQ ID NO: 2883980 - RNA, 19 nt, Human
agcagugugaaguacaaua

SEQ ID NO: 2883981 - RNA, 17 nt, Human
agcagugggcuccuggc

SEQ ID NO: 2883982 - RNA, 22 nt, Human
agcaugaaugguauggaacucu

SEQ ID NO: 2883983 - RNA, 21 nt, Human
agcauccuuuucugcagaggg

SEQ ID NO: 2883984 - RNA, 19 nt, Human
agcauccuuuucugcagag

SEQ ID NO: 2883985 - RNA, 16 nt, Human
agcaugacauaacagu

SEQ ID NO: 2883986 - RNA, 20 nt, Human
agcaugacauaacagugcag

SEQ ID NO: 2883987 - RNA, 23 nt, Human
agcauccuggcacccggccccug

SEQ ID NO: 2883988 - RNA, 22 nt, Human
agcauccuggcacccggccccu

SEQ ID NO: 2883989 - RNA, 18 nt, Human
agcauccuggcacccggc

SEQ ID NO: 2883990 - RNA, 18 nt, Human
agccaauaacacacagcu

SEQ ID NO: 2883991 - RNA, 18 nt, Human
agccaagugccaaaugcu

SEQ ID NO: 2883992 - RNA, 19 nt, Human
agccaagugccaaaugcuc

SEQ ID NO: 2883993 - RNA, 16 nt, Human
agccaaccuaagcaag

SEQ ID NO: 2883994 - RNA, 18 nt, Human
agccagcaccuguaagaa

SEQ ID NO: 2883995 - RNA, 15 nt, Human
agccagcacuuguau

SEQ ID NO: 2883996 - RNA, 23 nt, Human
agcaugcuugugaaaauguguuc

SEQ ID NO: 2883997 - RNA, 22 nt, Human
agcaugcuugugaaaauguguu

SEQ ID NO: 2883998 - RNA, 17 nt, Human
agcaugcuugugaaaau

SEQ ID NO: 2883999 - RNA, 23 nt, Human
agcauggacuaaccccaacgcac

SEQ ID NO: 2884000 - RNA, 21 nt, Human
agcaugcugugauugugccua

SEQ ID NO: 2884001 - RNA, 16 nt, Human
agccaaauuuaucaaa

SEQ ID NO: 2884002 - RNA, 19 nt, Human
agccaaagggaaauaugcu

SEQ ID NO: 2884003 - RNA, 14 nt, Human
agcauggagcuggc

SEQ ID NO: 2884004 - RNA, 13 nt, Human
agcauggagcugg

SEQ ID NO: 2884005 - RNA, 16 nt, Human
agcauggagcuggccg

SEQ ID NO: 2884006 - RNA, 16 nt, Human
agcauggcacucccuc

SEQ ID NO: 2884007 - RNA, 17 nt, Human
agcauggcacucccucc

SEQ ID NO: 2884008 - RNA, 18 nt, Human
agcauggcacucccucca

SEQ ID NO: 2884009 - RNA, 20 nt, Human
agcauggcacucccuccagc

SEQ ID NO: 2884010 - RNA, 21 nt, Human
agcauggcacucccuccagca

SEQ ID NO: 2884011 - RNA, 12 nt, Human
agccaacagcua

SEQ ID NO: 2884012 - RNA, 14 nt, Human
agccaacagcuaca

SEQ ID NO: 2884013 - RNA, 19 nt, Human
agccaacagcuacaacagc

SEQ ID NO: 2884014 - RNA, 20 nt, Human
agccaacagcuacaacagcc

SEQ ID NO: 2884015 - RNA, 23 nt, Human
agccaacacccugucuaaaaaac

SEQ ID NO: 2884016 - RNA, 17 nt, Human
agcacuggguugacuuu

SEQ ID NO: 2884017 - RNA, 16 nt, Human
agcacucuuaaagcaa

SEQ ID NO: 2884018 - RNA, 10 nt, Human
agcacugaaa

SEQ ID NO: 2884019 - RNA, 11 nt, Human
agcacugaaaa

SEQ ID NO: 2884020 - RNA, 22 nt, Human
agcacugaaaauaccaucaggc

SEQ ID NO: 2884021 - RNA, 14 nt, Human
agcacucgugugca

SEQ ID NO: 2884022 - RNA, 14 nt, Human
agcacacucauccc

SEQ ID NO: 2884023 - RNA, 20 nt, Human
agcacacucauccccucacu

SEQ ID NO: 2884024 - RNA, 17 nt, Human
agcacacucuggucuug

SEQ ID NO: 2884025 - RNA, 14 nt, Human
agcagcucuccccu

SEQ ID NO: 2884026 - RNA, 12 nt, Human
agcagcucuccc

SEQ ID NO: 2884027 - RNA, 18 nt, Human
agcagcgaccgcccccuc

SEQ ID NO: 2884028 - RNA, 23 nt, Human
agcagcgaccgcccccuccucua

SEQ ID NO: 2884029 - RNA, 15 nt, Human
agcacuguugaugua

SEQ ID NO: 2884030 - RNA, 17 nt, Human
agcacuguugauguauc

SEQ ID NO: 2884031 - RNA, 18 nt, Human
agcacuguugauguaucu

SEQ ID NO: 2884032 - RNA, 20 nt, Human
agcacuguugauguaucuga

SEQ ID NO: 2884033 - RNA, 21 nt, Human
agcacuguugauguaucugag

SEQ ID NO: 2884034 - RNA, 14 nt, Human
agcacugugcucag

SEQ ID NO: 2884035 - RNA, 15 nt, Human
agcacugugcucagg

SEQ ID NO: 2884036 - RNA, 18 nt, Human
agcacugugcucagggcu

SEQ ID NO: 2884037 - RNA, 19 nt, Human
agcacugugcucagggcua

SEQ ID NO: 2884038 - RNA, 17 nt, Human
agauggggauaaaauga

SEQ ID NO: 2884039 - RNA, 19 nt, Human
agauggggauaaaaugacu

SEQ ID NO: 2884040 - RNA, 20 nt, Human
agauggggauaaaaugacua

SEQ ID NO: 2884041 - RNA, 15 nt, Human
agaugggggaaagca

SEQ ID NO: 2884042 - RNA, 18 nt, Human
agaugggggaaagcacag

SEQ ID NO: 2884043 - RNA, 18 nt, Human
agaucuugcagaaguucu

SEQ ID NO: 2884044 - RNA, 15 nt, Human
agccgccuuccuuga

SEQ ID NO: 2884045 - RNA, 16 nt, Human
agccgccuuccuugac

SEQ ID NO: 2884046 - RNA, 17 nt, Human
agccgccuuccuugacc

SEQ ID NO: 2884047 - RNA, 22 nt, Human
agccgccauugccaccaggaga

SEQ ID NO: 2884048 - RNA, 21 nt, Human
agccgccauugccaccaggag

SEQ ID NO: 2884049 - RNA, 20 nt, Human
agccgccauugccaccagga

SEQ ID NO: 2884050 - RNA, 13 nt, Human
agccgcucuccug

SEQ ID NO: 2884051 - RNA, 15 nt, Human
agccgcucuccugcc

SEQ ID NO: 2884052 - RNA, 17 nt, Human
agccgcucuccugccac

SEQ ID NO: 2884053 - RNA, 23 nt, Human
agccgggaacagacaacagaagu

SEQ ID NO: 2884054 - RNA, 19 nt, Human
agccggcguggcaaauaua

SEQ ID NO: 2884055 - RNA, 21 nt, Human
agccggcguggcaaauauaaa

SEQ ID NO: 2884056 - RNA, 12 nt, Human
agcccucucccu

SEQ ID NO: 2884057 - RNA, 13 nt, Human
agcccucucccuc

SEQ ID NO: 2884058 - RNA, 19 nt, Human
agccgccauugccaccagg

SEQ ID NO: 2884059 - RNA, 18 nt, Human
agccgccauugccaccag

SEQ ID NO: 2884060 - RNA, 17 nt, Human
agccgccauugccacca

SEQ ID NO: 2884061 - RNA, 17 nt, Human
agccgccaucagcccaa

SEQ ID NO: 2884062 - RNA, 15 nt, Human
agcccuccgccuuca

SEQ ID NO: 2884063 - RNA, 16 nt, Human
agcccuccgccuucac

SEQ ID NO: 2884064 - RNA, 14 nt, Human
agcccucagaaccc

SEQ ID NO: 2884065 - RNA, 18 nt, Human
agcccucagaacccuugg

SEQ ID NO: 2884066 - RNA, 15 nt, Human
agcccucagaacccu

SEQ ID NO: 2884067 - RNA, 24 nt, Human
agcccucagaacccuuggcuugcc

SEQ ID NO: 2884068 - RNA, 19 nt, Human
agcccucagaacccuuggc

SEQ ID NO: 2884069 - RNA, 23 nt, Human
agcccucaucuugaagggcccag

SEQ ID NO: 2884070 - RNA, 19 nt, Human
agccucccgaguagcuggg

SEQ ID NO: 2884071 - RNA, 18 nt, Human
agccucccgaguagcugg

SEQ ID NO: 2884072 - RNA, 20 nt, Human
agccucccgaguagcuggga

SEQ ID NO: 2884073 - RNA, 13 nt, Human
agccucccacccc

SEQ ID NO: 2884074 - RNA, 20 nt, Human
agccuccucaucccguguuc

SEQ ID NO: 2884075 - RNA, 23 nt, Human
agccuccggaguagcugggacca

SEQ ID NO: 2884076 - RNA, 13 nt, Human
agccuccggaagc

SEQ ID NO: 2884077 - RNA, 15 nt, Human
agccuccggaagcug

SEQ ID NO: 2884078 - RNA, 21 nt, Human
agccucccaaagugcugggau

SEQ ID NO: 2884079 - RNA, 17 nt, Human
agccgugccuucagcuc

SEQ ID NO: 2884080 - RNA, 16 nt, Human
agccucccaaggagaa

SEQ ID NO: 2884081 - RNA, 19 nt, Human
agccucccaaggagaacaa

SEQ ID NO: 2884082 - RNA, 20 nt, Human
agccucccaaggagaacaaa

SEQ ID NO: 2884083 - RNA, 21 nt, Human
agccucccaaggagaacaaau

SEQ ID NO: 2884084 - RNA, 22 nt, Human
agccgggcgugguggcgggcac

SEQ ID NO: 2884085 - RNA, 17 nt, Human
agccgugaacugugcau

SEQ ID NO: 2884086 - RNA, 15 nt, Human
agccgugccuucagc

SEQ ID NO: 2884087 - RNA, 16 nt, Human
agccgugccuucagcu

SEQ ID NO: 2884088 - RNA, 17 nt, Human
agccgccuuaagcugau

SEQ ID NO: 2884089 - RNA, 16 nt, Human
agccccauucugccug

SEQ ID NO: 2884090 - RNA, 13 nt, Human
agccccauucugc

SEQ ID NO: 2884091 - RNA, 15 nt, Human
agcccgucucagugu

SEQ ID NO: 2884092 - RNA, 14 nt, Human
agcccgucucagug

SEQ ID NO: 2884093 - RNA, 19 nt, Human
agcccuaaaaauccagacu

SEQ ID NO: 2884094 - RNA, 17 nt, Human
agcccucacccuggggc

SEQ ID NO: 2884095 - RNA, 15 nt, Human
agccccagugcccac

SEQ ID NO: 2884096 - RNA, 14 nt, Human
agccccagugccca

SEQ ID NO: 2884097 - RNA, 13 nt, Human
agccccagugccc

SEQ ID NO: 2884098 - RNA, 22 nt, Human
agacugcgggaugguccugggg

SEQ ID NO: 2884099 - RNA, 20 nt, Human
agacugcgggaugguccugg

SEQ ID NO: 2884100 - RNA, 23 nt, Human
agacugcgauuugucccaggucc

SEQ ID NO: 2884101 - RNA, 23 nt, Human
agacugcgggaugguccuggggc

SEQ ID NO: 2884102 - RNA, 17 nt, Human
agacugcguucugcaag

SEQ ID NO: 2884103 - RNA, 18 nt, Human
agacugcuaguguucugu

SEQ ID NO: 2884104 - RNA, 16 nt, Human
agacuggaagcacagc

SEQ ID NO: 2884105 - RNA, 17 nt, Human
agacuggaagcacagcu

SEQ ID NO: 2884106 - RNA, 19 nt, Human
agacuggaagcacagcuuc

SEQ ID NO: 2884107 - RNA, 15 nt, Human
agacugcugggacug

SEQ ID NO: 2884108 - RNA, 14 nt, Human
agacugcugggacu

SEQ ID NO: 2884109 - RNA, 19 nt, Human
agacuggaagcuaauuugc

SEQ ID NO: 2884110 - RNA, 14 nt, Human
agacuggaagcuaa

SEQ ID NO: 2884111 - RNA, 21 nt, Human
agagaaaaaugcuuugcuuug

SEQ ID NO: 2884112 - RNA, 12 nt, Human
agagaacugaaa

SEQ ID NO: 2884113 - RNA, 14 nt, Human
agagaacugaaaag

SEQ ID NO: 2884114 - RNA, 15 nt, Human
agagaacugaaaaga

SEQ ID NO: 2884115 - RNA, 17 nt, Human
agagaacugaaaagaga

SEQ ID NO: 2884116 - RNA, 14 nt, Human
agagaacgcagccc

SEQ ID NO: 2884117 - RNA, 15 nt, Human
agagaacgcagcccu

SEQ ID NO: 2884118 - RNA, 14 nt, Human
agagaacuguggcc

SEQ ID NO: 2884119 - RNA, 10 nt, Human
agagaagaag

SEQ ID NO: 2884120 - RNA, 11 nt, Human
agagaagaaga

SEQ ID NO: 2884121 - RNA, 12 nt, Human
agagaagaagaa

SEQ ID NO: 2884122 - RNA, 13 nt, Human
agagaagaagaaa

SEQ ID NO: 2884123 - RNA, 15 nt, Human
agagaagaagaaaaa

SEQ ID NO: 2884124 - RNA, 16 nt, Human
agagaagaagaaaaaa

SEQ ID NO: 2884125 - RNA, 18 nt, Human
agagagcugccaucgcug

SEQ ID NO: 2884126 - RNA, 21 nt, Human
agagagcggucucaggcuggu

SEQ ID NO: 2884127 - RNA, 16 nt, Human
agagagcggucucagg

SEQ ID NO: 2884128 - RNA, 18 nt, Human
agagagcgagcgcuaccc

SEQ ID NO: 2884129 - RNA, 18 nt, Human
agagagccauuuugugaa

SEQ ID NO: 2884130 - RNA, 19 nt, Human
agagagccauuuugugaau

SEQ ID NO: 2884131 - RNA, 19 nt, Human
agagagcagagaauauaac

SEQ ID NO: 2884132 - RNA, 13 nt, Human
agagagccauuuu

SEQ ID NO: 2884133 - RNA, 15 nt, Human
agagagccauuuugu

SEQ ID NO: 2884134 - RNA, 17 nt, Human
agagagccauuuuguga

SEQ ID NO: 2884135 - RNA, 21 nt, Human
agagaggguggugaccucugc

SEQ ID NO: 2884136 - RNA, 20 nt, Human
agagaggguggugaccucug

SEQ ID NO: 2884137 - RNA, 22 nt, Human
agagaggguggugaccucugcc

SEQ ID NO: 2884138 - RNA, 19 nt, Human
agagcccaccuuggcucaa

SEQ ID NO: 2884139 - RNA, 18 nt, Human
agacguggaaccucuguc

SEQ ID NO: 2884140 - RNA, 20 nt, Human
agacguggaaccucugucuc

SEQ ID NO: 2884141 - RNA, 21 nt, Human
agacguggaaccucugucuca

SEQ ID NO: 2884142 - RNA, 21 nt, Human
agacggaggccuacucuucca

SEQ ID NO: 2884143 - RNA, 18 nt, Human
agacggagucccaccuug

SEQ ID NO: 2884144 - RNA, 21 nt, Human
agacggugucuuguucuguca

SEQ ID NO: 2884145 - RNA, 15 nt, Human
agacccccacaccuc

SEQ ID NO: 2884146 - RNA, 14 nt, Human
agacccccacaccu

SEQ ID NO: 2884147 - RNA, 13 nt, Human
agacccccacacc

SEQ ID NO: 2884148 - RNA, 17 nt, Human
agaccccaccuccuugg

SEQ ID NO: 2884149 - RNA, 13 nt, Human
agaccccaggcug

SEQ ID NO: 2884150 - RNA, 15 nt, Human
agacccauuccuauu

SEQ ID NO: 2884151 - RNA, 19 nt, Human
agacagcugauacuucauu

SEQ ID NO: 2884152 - RNA, 20 nt, Human
agacagcugauacuucauuu

SEQ ID NO: 2884153 - RNA, 16 nt, Human
agacccauuccuauuu

SEQ ID NO: 2884154 - RNA, 13 nt, Human
agacccaggacuc

SEQ ID NO: 2884155 - RNA, 14 nt, Human
agacccaggacucc

SEQ ID NO: 2884156 - RNA, 23 nt, Human
agacagagucucacuguugccca

SEQ ID NO: 2884157 - RNA, 15 nt, Human
agacaagauauugua

SEQ ID NO: 2884158 - RNA, 16 nt, Human
agacaagauauuguac

SEQ ID NO: 2884159 - RNA, 17 nt, Human
agacaagauauuguaca

SEQ ID NO: 2884160 - RNA, 18 nt, Human
agacaagauauuguacau

SEQ ID NO: 2884161 - RNA, 19 nt, Human
agacaagauauuguacaua

SEQ ID NO: 2884162 - RNA, 18 nt, Human
agacaagaaaucccuguu

SEQ ID NO: 2884163 - RNA, 13 nt, Human
agacaagaaaucc

SEQ ID NO: 2884164 - RNA, 17 nt, Human
agacaagaaaucccugu

SEQ ID NO: 2884165 - RNA, 14 nt, Human
agacaacagaaguc

SEQ ID NO: 2884166 - RNA, 13 nt, Human
agacaacagaagu

SEQ ID NO: 2884167 - RNA, 15 nt, Human
agacaacagaaguca

SEQ ID NO: 2884168 - RNA, 19 nt, Human
agacagccccagagcaggg

SEQ ID NO: 2884169 - RNA, 20 nt, Human
agacagccccagagcagggu

SEQ ID NO: 2884170 - RNA, 13 nt, Human
agacagccccaga

SEQ ID NO: 2884171 - RNA, 15 nt, Human
agacagccccagagc

SEQ ID NO: 2884172 - RNA, 17 nt, Human
agacagccccagagcag

SEQ ID NO: 2884173 - RNA, 18 nt, Human
agacagccccagagcagg

SEQ ID NO: 2884174 - RNA, 12 nt, Human
agacagccccag

SEQ ID NO: 2884175 - RNA, 11 nt, Human
agagugugugu

SEQ ID NO: 2884176 - RNA, 14 nt, Human
agagugucucugau

SEQ ID NO: 2884177 - RNA, 15 nt, Human
agaguguggaggcug

SEQ ID NO: 2884178 - RNA, 23 nt, Human
agaguggcuccucccggugccca

SEQ ID NO: 2884179 - RNA, 15 nt, Human
agaguggcuccuccc

SEQ ID NO: 2884180 - RNA, 19 nt, Human
agaguggcuccucccggug

SEQ ID NO: 2884181 - RNA, 11 nt, Human
agaggagagag

SEQ ID NO: 2884182 - RNA, 12 nt, Human
agaggagagagg

SEQ ID NO: 2884183 - RNA, 13 nt, Human
agaggagagaggc

SEQ ID NO: 2884184 - RNA, 15 nt, Human
agaggagagaggcag

SEQ ID NO: 2884185 - RNA, 16 nt, Human
agagggcacacacugu

SEQ ID NO: 2884186 - RNA, 18 nt, Human
agagggccaagacuuggc

SEQ ID NO: 2884187 - RNA, 19 nt, Human
agagggccaugcaauucau

SEQ ID NO: 2884188 - RNA, 17 nt, Human
agaggagagaggcagag

SEQ ID NO: 2884189 - RNA, 17 nt, Human
agagggcccaggcaggc

SEQ ID NO: 2884190 - RNA, 16 nt, Human
agagggcccaggcagg

SEQ ID NO: 2884191 - RNA, 14 nt, Human
agagggcccaggca

SEQ ID NO: 2884192 - RNA, 22 nt, Human
agaggguggugaccucugccug

SEQ ID NO: 2884193 - RNA, 20 nt, Human
agaggguggugaccucugcc

SEQ ID NO: 2884194 - RNA, 19 nt, Human
agaggguggugaccucugc

SEQ ID NO: 2884195 - RNA, 21 nt, Human
agagggcccaggcaggccacc

SEQ ID NO: 2884196 - RNA, 10 nt, Human
agaggagaga

SEQ ID NO: 2884197 - RNA, 15 nt, Human
agaggaccagugagu

SEQ ID NO: 2884198 - RNA, 19 nt, Human
agaggacaguggauuguuu

SEQ ID NO: 2884199 - RNA, 19 nt, Human
agaggaccuguauuuaagc

SEQ ID NO: 2884200 - RNA, 22 nt, Human
agaggaccuguauuuaagcaaa

SEQ ID NO: 2884201 - RNA, 23 nt, Human
agaggaccuguauuuaagcaaau

SEQ ID NO: 2884202 - RNA, 17 nt, Human
agaggacucgcuuguaa

SEQ ID NO: 2884203 - RNA, 18 nt, Human
agaggacucgcuuguaaa

SEQ ID NO: 2884204 - RNA, 19 nt, Human
agaggacucgcuuguaaau

SEQ ID NO: 2884205 - RNA, 23 nt, Human
agaggacucgcuuguaaauacca

SEQ ID NO: 2884206 - RNA, 16 nt, Human
agaggacaagggaaau

SEQ ID NO: 2884207 - RNA, 20 nt, Human
agaggaacuguccagagagc

SEQ ID NO: 2884208 - RNA, 21 nt, Human
agaggaacuguccagagagca

SEQ ID NO: 2884209 - RNA, 22 nt, Human
agaggaagaauuuguuaucagu

SEQ ID NO: 2884210 - RNA, 13 nt, Human
agaggaagagaca

SEQ ID NO: 2884211 - RNA, 16 nt, Human
agaggaagagacacuc

SEQ ID NO: 2884212 - RNA, 12 nt, Human
agaggaacuguc

SEQ ID NO: 2884213 - RNA, 13 nt, Human
agaggaacugggc

SEQ ID NO: 2884214 - RNA, 21 nt, Human
agaggaacagcacuggggagu

SEQ ID NO: 2884215 - RNA, 17 nt, Human
agaggaacuccuuggcc

SEQ ID NO: 2884216 - RNA, 19 nt, Human
agaggaacuccuuggccua

SEQ ID NO: 2884217 - RNA, 21 nt, Human
agaggaacuccuuggccuagc

SEQ ID NO: 2884218 - RNA, 15 nt, Human
agaggaacuguccag

SEQ ID NO: 2884219 - RNA, 17 nt, Human
agaggaacuguccagag

SEQ ID NO: 2884220 - RNA, 18 nt, Human
agaggaacuguccagaga

SEQ ID NO: 2884221 - RNA, 19 nt, Human
agaggaacuguccagagag

SEQ ID NO: 2884222 - RNA, 14 nt, Human
agaggaaaucugua

SEQ ID NO: 2884223 - RNA, 21 nt, Human
agaggaaaucuguaacaggua

SEQ ID NO: 2884224 - RNA, 22 nt, Human
agauggccucuuacuaauguaa

SEQ ID NO: 2884225 - RNA, 21 nt, Human
agauggcccggaugcugcuuc

SEQ ID NO: 2884226 - RNA, 21 nt, Human
agaugaaauaaagacccaggg

SEQ ID NO: 2884227 - RNA, 22 nt, Human
agaugaaagcagggaauuucua

SEQ ID NO: 2884228 - RNA, 23 nt, Human
agaugaaagcagggaauuucuau

SEQ ID NO: 2884229 - RNA, 14 nt, Human
agauggcacuuuga

SEQ ID NO: 2884230 - RNA, 20 nt, Human
agaugaaaucuuacagcugg

SEQ ID NO: 2884231 - RNA, 23 nt, Human
agaugaaaucuuacagcugggug

SEQ ID NO: 2884232 - RNA, 17 nt, Human
agaugaaacacaaacaa

SEQ ID NO: 2884233 - RNA, 14 nt, Human
agaugaaacacaaa

SEQ ID NO: 2884234 - RNA, 16 nt, Human
agauggcucagagggg

SEQ ID NO: 2884235 - RNA, 21 nt, Human
agauggcucagagggggacug

SEQ ID NO: 2884236 - RNA, 22 nt, Human
agauggcugacuuugcucuuuc

SEQ ID NO: 2884237 - RNA, 13 nt, Human
agaugggagcucc

SEQ ID NO: 2884238 - RNA, 14 nt, Human
agauggcugugccu

SEQ ID NO: 2884239 - RNA, 22 nt, Human
agaugggcauaugugucagugg

SEQ ID NO: 2884240 - RNA, 18 nt, Human
agaugggagcuccucucc

SEQ ID NO: 2884241 - RNA, 21 nt, Human
agauggcuggaagggguccag

SEQ ID NO: 2884242 - RNA, 23 nt, Human
agaugggagcuccucuccuggag

SEQ ID NO: 2884243 - RNA, 19 nt, Human
agaugggaggaaagagagc

SEQ ID NO: 2884244 - RNA, 20 nt, Human
agaugggaggaaagagagca

SEQ ID NO: 2884245 - RNA, 22 nt, Human
agaugggaggggaaaggggaga

SEQ ID NO: 2884246 - RNA, 16 nt, Human
agaucuuucuccuuga

SEQ ID NO: 2884247 - RNA, 15 nt, Human
agauauaucugaaaa

SEQ ID NO: 2884248 - RNA, 17 nt, Human
agauauaucugaaaacu

SEQ ID NO: 2884249 - RNA, 18 nt, Human
agauauaucugaaaacug

SEQ ID NO: 2884250 - RNA, 20 nt, Human
agauauaucugaaaacugga

SEQ ID NO: 2884251 - RNA, 21 nt, Human
agauauaucugaaaacuggaa

SEQ ID NO: 2884252 - RNA, 14 nt, Human
agauauaugccuuc

SEQ ID NO: 2884253 - RNA, 19 nt, Human
agaguucuauacuguaaag

SEQ ID NO: 2884254 - RNA, 20 nt, Human
agaguucuauacuguaaagc

SEQ ID NO: 2884255 - RNA, 20 nt, Human
agauauauuaagugacuguu

SEQ ID NO: 2884256 - RNA, 19 nt, Human
agaguuaguuucuuuggga

SEQ ID NO: 2884257 - RNA, 19 nt, Human
agaguuccccaugcagaca

SEQ ID NO: 2884258 - RNA, 14 nt, Human
agaguucaucccag

SEQ ID NO: 2884259 - RNA, 13 nt, Human
agaguuccagagg

SEQ ID NO: 2884260 - RNA, 22 nt, Human
aggauguacaaggacagccccu

SEQ ID NO: 2884261 - RNA, 14 nt, Human
aggauguagcuuuu

SEQ ID NO: 2884262 - RNA, 15 nt, Human
aggauguagcuuuuc

SEQ ID NO: 2884263 - RNA, 16 nt, Human
aggauguagcuuuuca

SEQ ID NO: 2884264 - RNA, 18 nt, Human
aggauguagcuuuucacc

SEQ ID NO: 2884265 - RNA, 19 nt, Human
aggauguagcuuuucaccu

SEQ ID NO: 2884266 - RNA, 16 nt, Human
aggauguucugggaca

SEQ ID NO: 2884267 - RNA, 15 nt, Human
aggauguucugggac

SEQ ID NO: 2884268 - RNA, 20 nt, Human
aggauguaucgggaagauuu

SEQ ID NO: 2884269 - RNA, 15 nt, Human
aggaugucacagggc

SEQ ID NO: 2884270 - RNA, 16 nt, Human
aggaugucacagggcc

SEQ ID NO: 2884271 - RNA, 17 nt, Human
aggaugucacagggcca

SEQ ID NO: 2884272 - RNA, 14 nt, Human
aggauuaaauaaug

SEQ ID NO: 2884273 - RNA, 16 nt, Human
aggauuacaugcaugu

SEQ ID NO: 2884274 - RNA, 20 nt, Human
aggauuaaauaauguaaaua

SEQ ID NO: 2884275 - RNA, 13 nt, Human
aggauuauugaua

SEQ ID NO: 2884276 - RNA, 18 nt, Human
aggauuauugauaguacu

SEQ ID NO: 2884277 - RNA, 17 nt, Human
aggagucccaaggaaag

SEQ ID NO: 2884278 - RNA, 16 nt, Human
aggagucccaaggaaa

SEQ ID NO: 2884279 - RNA, 14 nt, Human
aggaguggugcaga

SEQ ID NO: 2884280 - RNA, 18 nt, Human
aggaguggugcagacaga

SEQ ID NO: 2884281 - RNA, 21 nt, Human
aggagugggaaaacacugcca

SEQ ID NO: 2884282 - RNA, 20 nt, Human
aggagugggugacaagagcc

SEQ ID NO: 2884283 - RNA, 21 nt, Human
aggagugggugacaagagccu

SEQ ID NO: 2884284 - RNA, 23 nt, Human
aggagugggugacaagagccuga

SEQ ID NO: 2884285 - RNA, 20 nt, Human
aggagugugugacauuccag

SEQ ID NO: 2884286 - RNA, 17 nt, Human
aggaccguggcccugcc

SEQ ID NO: 2884287 - RNA, 19 nt, Human
aggaccguggcccugcccu

SEQ ID NO: 2884288 - RNA, 23 nt, Human
aggaccguggcccugcccucucc

SEQ ID NO: 2884289 - RNA, 17 nt, Human
aggagaagcugcaucca

SEQ ID NO: 2884290 - RNA, 14 nt, Human
aggagaagcugcau

SEQ ID NO: 2884291 - RNA, 20 nt, Human
aggagaauggcgugaacccg

SEQ ID NO: 2884292 - RNA, 12 nt, Human
aggagacacaga

SEQ ID NO: 2884293 - RNA, 13 nt, Human
aggagacacagau

SEQ ID NO: 2884294 - RNA, 14 nt, Human
aggagacacagaug

SEQ ID NO: 2884295 - RNA, 15 nt, Human
aggagacacagaugu

SEQ ID NO: 2884296 - RNA, 16 nt, Human
aggagacacagauguu

SEQ ID NO: 2884297 - RNA, 13 nt, Human
aggagacacaggg

SEQ ID NO: 2884298 - RNA, 20 nt, Human
aggagacacguguggcgggc

SEQ ID NO: 2884299 - RNA, 15 nt, Human
aggagaaugagccuc

SEQ ID NO: 2884300 - RNA, 14 nt, Human
aggagucccaagga

SEQ ID NO: 2884301 - RNA, 11 nt, Human
aggagacacaa

SEQ ID NO: 2884302 - RNA, 19 nt, Human
aggagacacaacaacuccu

SEQ ID NO: 2884303 - RNA, 17 nt, Human
aggaauccagacccggc

SEQ ID NO: 2884304 - RNA, 20 nt, Human
aggaauccagacccggcugc

SEQ ID NO: 2884305 - RNA, 22 nt, Human
agcuuuuuaauuguuguuucuu

SEQ ID NO: 2884306 - RNA, 23 nt, Human
aggaaucaugucaggccugugug

SEQ ID NO: 2884307 - RNA, 21 nt, Human
aggaauccacucccaggcagc

SEQ ID NO: 2884308 - RNA, 16 nt, Human
aggaauccacucccag

SEQ ID NO: 2884309 - RNA, 17 nt, Human
aggaauccacucccagg

SEQ ID NO: 2884310 - RNA, 14 nt, Human
agcuuuuuaauugu

SEQ ID NO: 2884311 - RNA, 15 nt, Human
agcuuuuuaauuguu

SEQ ID NO: 2884312 - RNA, 15 nt, Human
agcuuuuuaaaacau

SEQ ID NO: 2884313 - RNA, 17 nt, Human
agcuuuuuaaaacauua

SEQ ID NO: 2884314 - RNA, 19 nt, Human
agcuuuuuccagaggcuau

SEQ ID NO: 2884315 - RNA, 15 nt, Human
agcuuuuuccuccug

SEQ ID NO: 2884316 - RNA, 17 nt, Human
agcuuuuuccuccugga

SEQ ID NO: 2884317 - RNA, 17 nt, Human
agcuuuuuaauuguugu

SEQ ID NO: 2884318 - RNA, 21 nt, Human
agcuuuuuaauuguuguuucu

SEQ ID NO: 2884319 - RNA, 15 nt, Human
agcucccuaggagac

SEQ ID NO: 2884320 - RNA, 17 nt, Human
agcucccuaggagacca

SEQ ID NO: 2884321 - RNA, 11 nt, Human
agcucccugcc

SEQ ID NO: 2884322 - RNA, 12 nt, Human
agcucccugcca

SEQ ID NO: 2884323 - RNA, 13 nt, Human
agcucccugccaa

SEQ ID NO: 2884324 - RNA, 13 nt, Human
agcucccugcccc

SEQ ID NO: 2884325 - RNA, 14 nt, Human
agcucccugcccca

SEQ ID NO: 2884326 - RNA, 21 nt, Human
agcugcgguccacccaggagc

SEQ ID NO: 2884327 - RNA, 14 nt, Human
agcugagagacuuu

SEQ ID NO: 2884328 - RNA, 16 nt, Human
agcugagaacuccuga

SEQ ID NO: 2884329 - RNA, 17 nt, Human
agcugagaacuccugac

SEQ ID NO: 2884330 - RNA, 18 nt, Human
agcugagaacuccugacu

SEQ ID NO: 2884331 - RNA, 19 nt, Human
agcugagaacuccugacug

SEQ ID NO: 2884332 - RNA, 23 nt, Human
agcugagauuauaggcaccuacc

SEQ ID NO: 2884333 - RNA, 15 nt, Human
agcugagagacuuuu

SEQ ID NO: 2884334 - RNA, 20 nt, Human
agcugagaucgugccacugc

SEQ ID NO: 2884335 - RNA, 21 nt, Human
agcugagaucgugccacugca

SEQ ID NO: 2884336 - RNA, 22 nt, Human
agcugagaucgugccacugcac

SEQ ID NO: 2884337 - RNA, 21 nt, Human
agcugaacaauaggcuguucc

SEQ ID NO: 2884338 - RNA, 22 nt, Human
agcugaacaauaggcuguuccc

SEQ ID NO: 2884339 - RNA, 17 nt, Human
agcucuuuuugugaagu

SEQ ID NO: 2884340 - RNA, 18 nt, Human
agcucuuuuuuguuuguu

SEQ ID NO: 2884341 - RNA, 21 nt, Human
agcucuuuuuuguuuguuucu

SEQ ID NO: 2884342 - RNA, 22 nt, Human
agcucuuuuuuguuuguuucuu

SEQ ID NO: 2884343 - RNA, 23 nt, Human
agcucuuuuuuguuuguuucuuu

SEQ ID NO: 2884344 - RNA, 20 nt, Human
agcugaaaauauaaaacaaa

SEQ ID NO: 2884345 - RNA, 22 nt, Human
agcugaaaaccuaaguccuuua

SEQ ID NO: 2884346 - RNA, 13 nt, Human
agcuccuucuguc

SEQ ID NO: 2884347 - RNA, 12 nt, Human
agcuccuucugu

SEQ ID NO: 2884348 - RNA, 21 nt, Human
agcuccgcuuucuacccagcg

SEQ ID NO: 2884349 - RNA, 20 nt, Human
agcuccgcuuucuacccagc

SEQ ID NO: 2884350 - RNA, 23 nt, Human
agcuccgcuuucuacccagcgag

SEQ ID NO: 2884351 - RNA, 17 nt, Human
agcuccgccucccgggu

SEQ ID NO: 2884352 - RNA, 16 nt, Human
agcuccgccucugucc

SEQ ID NO: 2884353 - RNA, 23 nt, Human
agcugcgguccacccaggagccc

SEQ ID NO: 2884354 - RNA, 19 nt, Human
agcugcuauuuauuuuccu

SEQ ID NO: 2884355 - RNA, 21 nt, Human
agcugcuauuuauuuuccuaa

SEQ ID NO: 2884356 - RNA, 20 nt, Human
agcugcuauuuauuuuccua

SEQ ID NO: 2884357 - RNA, 21 nt, Human
agcugcucagggaaaagcagc

SEQ ID NO: 2884358 - RNA, 15 nt, Human
agcugcuccaggccu

SEQ ID NO: 2884359 - RNA, 16 nt, Human
agcugcuccaggccug

SEQ ID NO: 2884360 - RNA, 17 nt, Human
agcugcuccaggccugc

SEQ ID NO: 2884361 - RNA, 18 nt, Human
agcugcuccaggccugca

SEQ ID NO: 2884362 - RNA, 19 nt, Human
agcugcuccaggccugcag

SEQ ID NO: 2884363 - RNA, 16 nt, Human
agcugcucagggaaaa

SEQ ID NO: 2884364 - RNA, 14 nt, Human
agcucccucccgca

SEQ ID NO: 2884365 - RNA, 18 nt, Human
agcuucugggguccccag

SEQ ID NO: 2884366 - RNA, 19 nt, Human
agcuucugggguccccagg

SEQ ID NO: 2884367 - RNA, 21 nt, Human
agcuucugggguccccagggc

SEQ ID NO: 2884368 - RNA, 22 nt, Human
agcuucugggguccccagggcu

SEQ ID NO: 2884369 - RNA, 21 nt, Human
agcuucuggaauuuguucaag

SEQ ID NO: 2884370 - RNA, 19 nt, Human
agcuucuguugcugccuca

SEQ ID NO: 2884371 - RNA, 22 nt, Human
agcuuccuacccacaccucugc

SEQ ID NO: 2884372 - RNA, 15 nt, Human
agcuuccugucaaca

SEQ ID NO: 2884373 - RNA, 20 nt, Human
agcuuccuguccccaucugu

SEQ ID NO: 2884374 - RNA, 21 nt, Human
agcuuccuguccccaucuguc

SEQ ID NO: 2884375 - RNA, 22 nt, Human
agcuuccuuaaguauaucaugu

SEQ ID NO: 2884376 - RNA, 15 nt, Human
agcuuccagcucuaa

SEQ ID NO: 2884377 - RNA, 16 nt, Human
agcuuccgagaauagc

SEQ ID NO: 2884378 - RNA, 22 nt, Human
agcuuccaugauucuauuuaua

SEQ ID NO: 2884379 - RNA, 12 nt, Human
aggucuguuuaa

SEQ ID NO: 2884380 - RNA, 20 nt, Human
aggucuguuuaaaguggcaa

SEQ ID NO: 2884381 - RNA, 22 nt, Human
aggucugagcacuggaguggcu

SEQ ID NO: 2884382 - RNA, 18 nt, Human
aggucugagccacagcag

SEQ ID NO: 2884383 - RNA, 23 nt, Human
aggucugagccacagcagcauuu

SEQ ID NO: 2884384 - RNA, 21 nt, Human
aggucucuguugacuggcugu

SEQ ID NO: 2884385 - RNA, 16 nt, Human
aggucucuucucccag

SEQ ID NO: 2884386 - RNA, 17 nt, Human
aggucucuucucccaga

SEQ ID NO: 2884387 - RNA, 18 nt, Human
aggucucuucucccagaa

SEQ ID NO: 2884388 - RNA, 19 nt, Human
aggucucuucucccagaau

SEQ ID NO: 2884389 - RNA, 22 nt, Human
aggucucuucucccagaauccc

SEQ ID NO: 2884390 - RNA, 23 nt, Human
aggucucuucucccagaauccca

SEQ ID NO: 2884391 - RNA, 12 nt, Human
agguacacucuu

SEQ ID NO: 2884392 - RNA, 16 nt, Human
agguacacagcucuag

SEQ ID NO: 2884393 - RNA, 21 nt, Human
aggucucggacuaagccuacc

SEQ ID NO: 2884394 - RNA, 13 nt, Human
agguaaaacaaaa

SEQ ID NO: 2884395 - RNA, 14 nt, Human
agguaaaacaaaac

SEQ ID NO: 2884396 - RNA, 22 nt, Human
agguaaaacaaaacaaaacaac

SEQ ID NO: 2884397 - RNA, 14 nt, Human
agguaaaauguauu

SEQ ID NO: 2884398 - RNA, 15 nt, Human
agguaaaauguauuu

SEQ ID NO: 2884399 - RNA, 16 nt, Human
agguaaaauguauuuu

SEQ ID NO: 2884400 - RNA, 17 nt, Human
agguaaaauguauuuuu

SEQ ID NO: 2884401 - RNA, 19 nt, Human
agguaaaauguauuuuucu

SEQ ID NO: 2884402 - RNA, 13 nt, Human
aggguuuuuaccu

SEQ ID NO: 2884403 - RNA, 22 nt, Human
aggguuuuuaccugucacauug

SEQ ID NO: 2884404 - RNA, 12 nt, Human
agguaaagauau

SEQ ID NO: 2884405 - RNA, 21 nt, Human
agguaaucgaccugccucggc

SEQ ID NO: 2884406 - RNA, 18 nt, Human
agguaacagaacagcuuc

SEQ ID NO: 2884407 - RNA, 19 nt, Human
agguaacagaacagcuuca

SEQ ID NO: 2884408 - RNA, 21 nt, Human
agguaacagaacagcuucagg

SEQ ID NO: 2884409 - RNA, 19 nt, Human
agguaaucgaccugccucg

SEQ ID NO: 2884410 - RNA, 13 nt, Human
agguaacagaaca

SEQ ID NO: 2884411 - RNA, 14 nt, Human
agguaacagaacag

SEQ ID NO: 2884412 - RNA, 15 nt, Human
agguaacagaacagc

SEQ ID NO: 2884413 - RNA, 17 nt, Human
agguaacagaacagcuu

SEQ ID NO: 2884414 - RNA, 14 nt, Human
agguaauggcauga

SEQ ID NO: 2884415 - RNA, 17 nt, Human
agguacaaccuguucug

SEQ ID NO: 2884416 - RNA, 14 nt, Human
agguaauuuuuacc

SEQ ID NO: 2884417 - RNA, 21 nt, Human
agguaauuuuuacccuaaugu

SEQ ID NO: 2884418 - RNA, 23 nt, Human
agguaauuuuuacccuaaugucu

SEQ ID NO: 2884419 - RNA, 17 nt, Human
agguaauuuuuuucacc

SEQ ID NO: 2884420 - RNA, 17 nt, Human
aggugcuauuguuacuc

SEQ ID NO: 2884421 - RNA, 16 nt, Human
agguggaaggcagaca

SEQ ID NO: 2884422 - RNA, 17 nt, Human
agguggaaggcagacag

SEQ ID NO: 2884423 - RNA, 18 nt, Human
agguggaaggcagacagc

SEQ ID NO: 2884424 - RNA, 13 nt, Human
agguguuuucugu

SEQ ID NO: 2884425 - RNA, 15 nt, Human
agguguuuucugugu

SEQ ID NO: 2884426 - RNA, 16 nt, Human
agguguuuucugugua

SEQ ID NO: 2884427 - RNA, 17 nt, Human
agguguuuucuguguaa

SEQ ID NO: 2884428 - RNA, 18 nt, Human
agguguuuucuguguaac

SEQ ID NO: 2884429 - RNA, 19 nt, Human
agguguuuucuguguaacc

SEQ ID NO: 2884430 - RNA, 14 nt, Human
agguguuuauacag

SEQ ID NO: 2884431 - RNA, 12 nt, Human
agguguuuauac

SEQ ID NO: 2884432 - RNA, 20 nt, Human
agguggaggcugcagugagc

SEQ ID NO: 2884433 - RNA, 15 nt, Human
agguggagguugcau

SEQ ID NO: 2884434 - RNA, 14 nt, Human
agguggacacacaa

SEQ ID NO: 2884435 - RNA, 14 nt, Human
agguggaccuuuua

SEQ ID NO: 2884436 - RNA, 15 nt, Human
agguggaccuuuuaa

SEQ ID NO: 2884437 - RNA, 16 nt, Human
agguggaccuuuuaaa

SEQ ID NO: 2884438 - RNA, 18 nt, Human
agguggaccuuuuaaagu

SEQ ID NO: 2884439 - RNA, 22 nt, Human
agguggaccuuuuaaaguguuu

SEQ ID NO: 2884440 - RNA, 23 nt, Human
agguggaccuuuuaaaguguuuc

SEQ ID NO: 2884441 - RNA, 22 nt, Human
agguuaaaaaaaggcauuguuu

SEQ ID NO: 2884442 - RNA, 15 nt, Human
agguuaaaaaaaugg

SEQ ID NO: 2884443 - RNA, 21 nt, Human
agguuaaaaaaauggcaguga

SEQ ID NO: 2884444 - RNA, 23 nt, Human
agguuaaaaaaauggcagugaug

SEQ ID NO: 2884445 - RNA, 19 nt, Human
agguguuuuuuaugaagug

SEQ ID NO: 2884446 - RNA, 22 nt, Human
agguguuuuuuaugaagugcgu

SEQ ID NO: 2884447 - RNA, 23 nt, Human
agguguuuuuuaugaagugcgug

SEQ ID NO: 2884448 - RNA, 12 nt, Human
agguuaaaaaaa

SEQ ID NO: 2884449 - RNA, 17 nt, Human
agguuaucugucccagg

SEQ ID NO: 2884450 - RNA, 14 nt, Human
agguuaucgaaaua

SEQ ID NO: 2884451 - RNA, 16 nt, Human
agguuaucugucccag

SEQ ID NO: 2884452 - RNA, 17 nt, Human
agguuaucgaaauaaca

SEQ ID NO: 2884453 - RNA, 18 nt, Human
agguuaucgaaauaacaa

SEQ ID NO: 2884454 - RNA, 19 nt, Human
agguuaucgaaauaacaau

SEQ ID NO: 2884455 - RNA, 20 nt, Human
agguuaucgaaauaacaaug

SEQ ID NO: 2884456 - RNA, 17 nt, Human
agguuacccuguaacau

SEQ ID NO: 2884457 - RNA, 21 nt, Human
agguuacccuguaacaugcaa

SEQ ID NO: 2884458 - RNA, 21 nt, Human
agguuaggaguucgagaccag

SEQ ID NO: 2884459 - RNA, 16 nt, Human
agggucauguuugcag

SEQ ID NO: 2884460 - RNA, 20 nt, Human
agggucagaggaccuguauu

SEQ ID NO: 2884461 - RNA, 21 nt, Human
agggucagaggaccuguauuu

SEQ ID NO: 2884462 - RNA, 21 nt, Human
aggguaucaggugcugccauc

SEQ ID NO: 2884463 - RNA, 18 nt, Human
aggguaucaggugcugcc

SEQ ID NO: 2884464 - RNA, 19 nt, Human
aggguaucaggugcugcca

SEQ ID NO: 2884465 - RNA, 18 nt, Human
aggguccccaccugggac

SEQ ID NO: 2884466 - RNA, 15 nt, Human
aggguccccaccugg

SEQ ID NO: 2884467 - RNA, 23 nt, Human
aggguccacaggaagugaagaau

SEQ ID NO: 2884468 - RNA, 20 nt, Human
aggguccauuuuucuuccag

SEQ ID NO: 2884469 - RNA, 12 nt, Human
agggucccuggg

SEQ ID NO: 2884470 - RNA, 17 nt, Human
aggguccuggcuccuga

SEQ ID NO: 2884471 - RNA, 20 nt, Human
aggguccuggcuccugaggg

SEQ ID NO: 2884472 - RNA, 19 nt, Human
aggguccuggcuccugagg

SEQ ID NO: 2884473 - RNA, 15 nt, Human
aggguccuggggaac

SEQ ID NO: 2884474 - RNA, 12 nt, Human
aggguccugggg

SEQ ID NO: 2884475 - RNA, 21 nt, Human
aggguccuggcuccugagggg

SEQ ID NO: 2884476 - RNA, 23 nt, Human
aggguccuggggaaccugacccc

SEQ ID NO: 2884477 - RNA, 21 nt, Human
aggguccuggggaaccugacc

SEQ ID NO: 2884478 - RNA, 18 nt, Human
aggcuacuagaauucugu

SEQ ID NO: 2884479 - RNA, 22 nt, Human
aggcuacuagaauucuguauug

SEQ ID NO: 2884480 - RNA, 21 nt, Human
aggcgugagccaccgugccug

SEQ ID NO: 2884481 - RNA, 15 nt, Human
aggcguugcuuucac

SEQ ID NO: 2884482 - RNA, 17 nt, Human
aggcguugcuuucacuc

SEQ ID NO: 2884483 - RNA, 15 nt, Human
aggcguggagcugcc

SEQ ID NO: 2884484 - RNA, 16 nt, Human
aggcguggagcugccu

SEQ ID NO: 2884485 - RNA, 17 nt, Human
aggcguggagcugccug

SEQ ID NO: 2884486 - RNA, 18 nt, Human
aggcguggagcugccuga

SEQ ID NO: 2884487 - RNA, 13 nt, Human
aggcccuuccucu

SEQ ID NO: 2884488 - RNA, 15 nt, Human
aggcccuuccucucc

SEQ ID NO: 2884489 - RNA, 17 nt, Human
aggcccuuccucuccac

SEQ ID NO: 2884490 - RNA, 18 nt, Human
aggcccuuccucuccacu

SEQ ID NO: 2884491 - RNA, 22 nt, Human
aggcccuuauuuucaagaaacu

SEQ ID NO: 2884492 - RNA, 20 nt, Human
aggcccuuauuuucaagaaa

SEQ ID NO: 2884493 - RNA, 16 nt, Human
aggcccuuauuuucaa

SEQ ID NO: 2884494 - RNA, 21 nt, Human
aggcccuuugaagccucagcu

SEQ ID NO: 2884495 - RNA, 24 nt, Human
aggcccuuugaagccucagcuacc

SEQ ID NO: 2884496 - RNA, 19 nt, Human
aggccgauuugggaaccaa

SEQ ID NO: 2884497 - RNA, 20 nt, Human
aggccgcagcuccauuuucu

SEQ ID NO: 2884498 - RNA, 12 nt, Human
aggcugguggga

SEQ ID NO: 2884499 - RNA, 14 nt, Human
aggcuggugggagg

SEQ ID NO: 2884500 - RNA, 17 nt, Human
aggcuggugggaggggc

SEQ ID NO: 2884501 - RNA, 18 nt, Human
aggcuguaucccaugagc

SEQ ID NO: 2884502 - RNA, 13 nt, Human
aggcuguauccca

SEQ ID NO: 2884503 - RNA, 18 nt, Human
aggcuggugggaggggcg

SEQ ID NO: 2884504 - RNA, 15 nt, Human
agggaccucucccag

SEQ ID NO: 2884505 - RNA, 13 nt, Human
agggaccucuccc

SEQ ID NO: 2884506 - RNA, 16 nt, Human
agggaccucucccagg

SEQ ID NO: 2884507 - RNA, 17 nt, Human
agggacgaagaagagcc

SEQ ID NO: 2884508 - RNA, 21 nt, Human
agggacgaagaagagccacag

SEQ ID NO: 2884509 - RNA, 22 nt, Human
agggacgaagaagagccacagu

SEQ ID NO: 2884510 - RNA, 23 nt, Human
auaguauuugagaguucuaaauu

SEQ ID NO: 2884511 - RNA, 16 nt, Human
auaguauuuuuaucca

SEQ ID NO: 2884512 - RNA, 12 nt, Human
auaguauuugau

SEQ ID NO: 2884513 - RNA, 20 nt, Human
auaguauuugauucaaaaua

SEQ ID NO: 2884514 - RNA, 21 nt, Human
auaguauuugauucaaaauau

SEQ ID NO: 2884515 - RNA, 22 nt, Human
auaguauuugauucaaaauauu

SEQ ID NO: 2884516 - RNA, 22 nt, Human
auauacucuagaugaaguuuua

SEQ ID NO: 2884517 - RNA, 14 nt, Human
auagucaaagagag

SEQ ID NO: 2884518 - RNA, 20 nt, Human
auagucaaagagaguuuuua

SEQ ID NO: 2884519 - RNA, 22 nt, Human
auauacuugugguuuucaaauu

SEQ ID NO: 2884520 - RNA, 14 nt, Human
auauacuuugugga

SEQ ID NO: 2884521 - RNA, 21 nt, Human
auauacuuuguggaccaauua

SEQ ID NO: 2884522 - RNA, 15 nt, Human
auauacuuaaaugga

SEQ ID NO: 2884523 - RNA, 13 nt, Human
auauacugugugc

SEQ ID NO: 2884524 - RNA, 18 nt, Human
auauacuguucuucauuu

SEQ ID NO: 2884525 - RNA, 13 nt, Human
auauagagauguu

SEQ ID NO: 2884526 - RNA, 14 nt, Human
auauagagauguuu

SEQ ID NO: 2884527 - RNA, 20 nt, Human
auauagacaguccuuaaaaa

SEQ ID NO: 2884528 - RNA, 15 nt, Human
auauagaacagugcu

SEQ ID NO: 2884529 - RNA, 15 nt, Human
auauagaaugcugca

SEQ ID NO: 2884530 - RNA, 17 nt, Human
auauagaauuagcuuuu

SEQ ID NO: 2884531 - RNA, 11 nt, Human
auauacuuuuu

SEQ ID NO: 2884532 - RNA, 20 nt, Human
auauacuuuuuuuucuuuaa

SEQ ID NO: 2884533 - RNA, 14 nt, Human
auauagaaauauau

SEQ ID NO: 2884534 - RNA, 22 nt, Human
auauagagauguuuuuaaaagu

SEQ ID NO: 2884535 - RNA, 15 nt, Human
auauagagauguuuu

SEQ ID NO: 2884536 - RNA, 16 nt, Human
auauagagauguuuuu

SEQ ID NO: 2884537 - RNA, 23 nt, Human
auauagaucaguuauaaguagca

SEQ ID NO: 2884538 - RNA, 13 nt, Human
auauagauuagaa

SEQ ID NO: 2884539 - RNA, 14 nt, Human
auauagauuagaaa

SEQ ID NO: 2884540 - RNA, 15 nt, Human
auauagauuagaaaa

SEQ ID NO: 2884541 - RNA, 16 nt, Human
auauagauuagaaaaa

SEQ ID NO: 2884542 - RNA, 17 nt, Human
auauagauuagaaaaau

SEQ ID NO: 2884543 - RNA, 20 nt, Human
auagguugccaauaauacac

SEQ ID NO: 2884544 - RNA, 21 nt, Human
auaguauuugagaguucuaaa

SEQ ID NO: 2884545 - RNA, 20 nt, Human
auaguauuugagaguucuaa

SEQ ID NO: 2884546 - RNA, 18 nt, Human
auaguaugguggcugggu

SEQ ID NO: 2884547 - RNA, 17 nt, Human
auaguaugguggcuggg

SEQ ID NO: 2884548 - RNA, 13 nt, Human
auaggucucuucu

SEQ ID NO: 2884549 - RNA, 14 nt, Human
auaggucucuucuc

SEQ ID NO: 2884550 - RNA, 15 nt, Human
auaggucucuucucc

SEQ ID NO: 2884551 - RNA, 17 nt, Human
auaggucucuucuccca

SEQ ID NO: 2884552 - RNA, 18 nt, Human
auaggucucuucucccag

SEQ ID NO: 2884553 - RNA, 19 nt, Human
auaggucucuucucccaga

SEQ ID NO: 2884554 - RNA, 20 nt, Human
auaggucucuucucccagaa

SEQ ID NO: 2884555 - RNA, 17 nt, Human
auagcccaucccugccu

SEQ ID NO: 2884556 - RNA, 18 nt, Human
auagcccaucccugccug

SEQ ID NO: 2884557 - RNA, 19 nt, Human
auagguagggagauauuua

SEQ ID NO: 2884558 - RNA, 21 nt, Human
auagguauaaguggugugugu

SEQ ID NO: 2884559 - RNA, 13 nt, Human
auagguggccucu

SEQ ID NO: 2884560 - RNA, 18 nt, Human
auaggugagaaaaaaaca

SEQ ID NO: 2884561 - RNA, 19 nt, Human
auaggugauguuugcucuu

SEQ ID NO: 2884562 - RNA, 17 nt, Human
auagcauccaaguggca

SEQ ID NO: 2884563 - RNA, 14 nt, Human
auagcaucuguaca

SEQ ID NO: 2884564 - RNA, 19 nt, Human
auagcaucuguacaaaggg

SEQ ID NO: 2884565 - RNA, 23 nt, Human
auagcaucucaggagauuucaug

SEQ ID NO: 2884566 - RNA, 22 nt, Human
auagccacauuuggaauacuuu

SEQ ID NO: 2884567 - RNA, 21 nt, Human
auagccacauuuggaauacuu

SEQ ID NO: 2884568 - RNA, 16 nt, Human
auagccacauuuggaa

SEQ ID NO: 2884569 - RNA, 13 nt, Human
auagccacauuug

SEQ ID NO: 2884570 - RNA, 16 nt, Human
auagccaccccagaaa

SEQ ID NO: 2884571 - RNA, 23 nt, Human
auagccacauuuggaauacuuuu

SEQ ID NO: 2884572 - RNA, 16 nt, Human
auagcccaucccugcc

SEQ ID NO: 2884573 - RNA, 21 nt, Human
auagccauugaucauaaacug

SEQ ID NO: 2884574 - RNA, 21 nt, Human
auauuacuccuauuuuuguaa

SEQ ID NO: 2884575 - RNA, 22 nt, Human
auauuacuccuauuuuuguaaa

SEQ ID NO: 2884576 - RNA, 21 nt, Human
auauuacuacuuaccauuugc

SEQ ID NO: 2884577 - RNA, 15 nt, Human
auauuaccagcaaga

SEQ ID NO: 2884578 - RNA, 17 nt, Human
auauuaccuaaugaaag

SEQ ID NO: 2884579 - RNA, 21 nt, Human
auauuaccuaaugaaagugau

SEQ ID NO: 2884580 - RNA, 12 nt, Human
auauuacuuuau

SEQ ID NO: 2884581 - RNA, 13 nt, Human
auauuacuuuauc

SEQ ID NO: 2884582 - RNA, 14 nt, Human
auauuacuuuauca

SEQ ID NO: 2884583 - RNA, 16 nt, Human
auauuacuuuaucacu

SEQ ID NO: 2884584 - RNA, 17 nt, Human
auauuacuuuaucacuu

SEQ ID NO: 2884585 - RNA, 18 nt, Human
auauuacuuuaucacuuu

SEQ ID NO: 2884586 - RNA, 19 nt, Human
auauuacuuuaucacuuuu

SEQ ID NO: 2884587 - RNA, 18 nt, Human
auauuacuguuuauuucu

SEQ ID NO: 2884588 - RNA, 20 nt, Human
auauuacuguuuauuucugu

SEQ ID NO: 2884589 - RNA, 21 nt, Human
auauuacuguuuauuucuguu

SEQ ID NO: 2884590 - RNA, 11 nt, Human
auauuacuuua

SEQ ID NO: 2884591 - RNA, 21 nt, Human
auaucauuuauuuuuuacauu

SEQ ID NO: 2884592 - RNA, 23 nt, Human
auaucauuuauuuuuuacauuau

SEQ ID NO: 2884593 - RNA, 13 nt, Human
auauuauguguuu

SEQ ID NO: 2884594 - RNA, 13 nt, Human
auauuauuagaaa

SEQ ID NO: 2884595 - RNA, 19 nt, Human
auauuauuagaaauuagaa

SEQ ID NO: 2884596 - RNA, 23 nt, Human
auauuuacuaagccacaagaaau

SEQ ID NO: 2884597 - RNA, 23 nt, Human
auauuauuugcuaauuaaaaagu

SEQ ID NO: 2884598 - RNA, 12 nt, Human
auauuauuuggc

SEQ ID NO: 2884599 - RNA, 13 nt, Human
auauuauuuggca

SEQ ID NO: 2884600 - RNA, 14 nt, Human
auauuauuuggcag

SEQ ID NO: 2884601 - RNA, 16 nt, Human
auauuauuuggcaguu

SEQ ID NO: 2884602 - RNA, 18 nt, Human
auauuauuuggcaguuug

SEQ ID NO: 2884603 - RNA, 19 nt, Human
auauuauuuggcaguuugg

SEQ ID NO: 2884604 - RNA, 21 nt, Human
auauuauuuggcaguuuggua

SEQ ID NO: 2884605 - RNA, 12 nt, Human
auaucaaaugca

SEQ ID NO: 2884606 - RNA, 13 nt, Human
auaucaaaugcag

SEQ ID NO: 2884607 - RNA, 21 nt, Human
auaucaaaugcaguauauuuc

SEQ ID NO: 2884608 - RNA, 13 nt, Human
auaucaaaguauu

SEQ ID NO: 2884609 - RNA, 14 nt, Human
auaucaaaguauuu

SEQ ID NO: 2884610 - RNA, 21 nt, Human
auaucaacagauaguuguguu

SEQ ID NO: 2884611 - RNA, 15 nt, Human
auaucaagaugauuc

SEQ ID NO: 2884612 - RNA, 16 nt, Human
auaucaagaugauucu

SEQ ID NO: 2884613 - RNA, 21 nt, Human
auaucaaucaagccauguaua

SEQ ID NO: 2884614 - RNA, 20 nt, Human
auaucaugcuuuaaagugua

SEQ ID NO: 2884615 - RNA, 22 nt, Human
auaucaugcuuuaaaguguaau

SEQ ID NO: 2884616 - RNA, 13 nt, Human
auaucauguaaag

SEQ ID NO: 2884617 - RNA, 18 nt, Human
auaucauguaaagaaaug

SEQ ID NO: 2884618 - RNA, 19 nt, Human
auaucauguaaagaaaugu

SEQ ID NO: 2884619 - RNA, 21 nt, Human
auaucauguaaagaaaugucu

SEQ ID NO: 2884620 - RNA, 22 nt, Human
auaucauguaaagaaaugucuu

SEQ ID NO: 2884621 - RNA, 12 nt, Human
auaacagugcag

SEQ ID NO: 2884622 - RNA, 18 nt, Human
auaacagugcagggcaaa

SEQ ID NO: 2884623 - RNA, 12 nt, Human
auaacaagaaaa

SEQ ID NO: 2884624 - RNA, 13 nt, Human
auaacaagaaaau

SEQ ID NO: 2884625 - RNA, 13 nt, Human
auaacaaaaugga

SEQ ID NO: 2884626 - RNA, 14 nt, Human
auaacaaaauggac

SEQ ID NO: 2884627 - RNA, 14 nt, Human
auaacaaagauauc

SEQ ID NO: 2884628 - RNA, 15 nt, Human
auaacaaagauaucu

SEQ ID NO: 2884629 - RNA, 17 nt, Human
auaacaaagauaucuuu

SEQ ID NO: 2884630 - RNA, 19 nt, Human
auaacaaagauaucuuuuc

SEQ ID NO: 2884631 - RNA, 20 nt, Human
auaacaaagauaucuuuucu

SEQ ID NO: 2884632 - RNA, 23 nt, Human
auaacaaagauaucuuuucuuua

SEQ ID NO: 2884633 - RNA, 14 nt, Human
auaacaacuucaua

SEQ ID NO: 2884634 - RNA, 13 nt, Human
auaacaaauucug

SEQ ID NO: 2884635 - RNA, 14 nt, Human
auaacaugaaauga

SEQ ID NO: 2884636 - RNA, 16 nt, Human
auaacaugaaaugaua

SEQ ID NO: 2884637 - RNA, 23 nt, Human
auaacaugaaaugauagauuuga

SEQ ID NO: 2884638 - RNA, 14 nt, Human
auaaagacaaccau

SEQ ID NO: 2884639 - RNA, 19 nt, Human
auaaagacaaccauauuua

SEQ ID NO: 2884640 - RNA, 22 nt, Human
auaaagacaaccauauuuagca

SEQ ID NO: 2884641 - RNA, 12 nt, Human
auaaagaauaua

SEQ ID NO: 2884642 - RNA, 15 nt, Human
auaaagaauauauau

SEQ ID NO: 2884643 - RNA, 12 nt, Human
auaaagacaccu

SEQ ID NO: 2884644 - RNA, 17 nt, Human
auaaagaaauugcaaua

SEQ ID NO: 2884645 - RNA, 21 nt, Human
auaaagcugccccaucugggg

SEQ ID NO: 2884646 - RNA, 17 nt, Human
auaaagcgauauacaga

SEQ ID NO: 2884647 - RNA, 19 nt, Human
auaaagcgauauacagaug

SEQ ID NO: 2884648 - RNA, 21 nt, Human
auaaagcgauauacagaugaa

SEQ ID NO: 2884649 - RNA, 22 nt, Human
auaaagcgauauacagaugaaa

SEQ ID NO: 2884650 - RNA, 13 nt, Human
auaaaggauguga

SEQ ID NO: 2884651 - RNA, 14 nt, Human
auaaaggacuguaa

SEQ ID NO: 2884652 - RNA, 22 nt, Human
auaaaggaugugauuguggaau

SEQ ID NO: 2884653 - RNA, 21 nt, Human
auaaaggaugugauuguggaa

SEQ ID NO: 2884654 - RNA, 17 nt, Human
auaaaggaugugauugu

SEQ ID NO: 2884655 - RNA, 14 nt, Human
auaaaggaugugau

SEQ ID NO: 2884656 - RNA, 14 nt, Human
auaaagcauaagua

SEQ ID NO: 2884657 - RNA, 20 nt, Human
auaaagcauaaguauacagu

SEQ ID NO: 2884658 - RNA, 21 nt, Human
auaaagcauaaguauacaguu

SEQ ID NO: 2884659 - RNA, 14 nt, Human
auaaagcacagcug

SEQ ID NO: 2884660 - RNA, 14 nt, Human
auaaagccugcuuu

SEQ ID NO: 2884661 - RNA, 20 nt, Human
auaaagccuguuuugucuuu

SEQ ID NO: 2884662 - RNA, 18 nt, Human
auaaagccucaagguuuu

SEQ ID NO: 2884663 - RNA, 21 nt, Human
auaaagccucaagguuuuagg

SEQ ID NO: 2884664 - RNA, 22 nt, Human
auaaagccucaagguuuuaggu

SEQ ID NO: 2884665 - RNA, 14 nt, Human
auaaaaauauugug

SEQ ID NO: 2884666 - RNA, 23 nt, Human
auaaaaauauauauagugcuaua

SEQ ID NO: 2884667 - RNA, 15 nt, Human
auaaaaauaaauaga

SEQ ID NO: 2884668 - RNA, 17 nt, Human
auaaaaagugacacagc

SEQ ID NO: 2884669 - RNA, 19 nt, Human
auaaaaagugacacagcag

SEQ ID NO: 2884670 - RNA, 20 nt, Human
auaaaaagugacacagcagc

SEQ ID NO: 2884671 - RNA, 20 nt, Human
auaaaaaguggaauuucuug

SEQ ID NO: 2884672 - RNA, 19 nt, Human
auaaagaaaacuuccauag

SEQ ID NO: 2884673 - RNA, 15 nt, Human
auaaacuuuuuuuca

SEQ ID NO: 2884674 - RNA, 16 nt, Human
auaaacuuuuuuucaa

SEQ ID NO: 2884675 - RNA, 17 nt, Human
auaaacuuuuuuucaau

SEQ ID NO: 2884676 - RNA, 18 nt, Human
auaaacuuuuuuucaaug

SEQ ID NO: 2884677 - RNA, 19 nt, Human
auaaacuuuuuuucaaugu

SEQ ID NO: 2884678 - RNA, 20 nt, Human
auaaacuuuuuuucaaugug

SEQ ID NO: 2884679 - RNA, 16 nt, Human
auaaaaauauguacaa

SEQ ID NO: 2884680 - RNA, 15 nt, Human
auaaaagaaaaaaua

SEQ ID NO: 2884681 - RNA, 22 nt, Human
auaccauucagaucacugaauu

SEQ ID NO: 2884682 - RNA, 15 nt, Human
auaccauugacacau

SEQ ID NO: 2884683 - RNA, 18 nt, Human
auaaugggcuuagagcag

SEQ ID NO: 2884684 - RNA, 14 nt, Human
auaauguaauugua

SEQ ID NO: 2884685 - RNA, 15 nt, Human
auaauguaauuguaa

SEQ ID NO: 2884686 - RNA, 17 nt, Human
auaauguaauuguaauu

SEQ ID NO: 2884687 - RNA, 20 nt, Human
auaauuaaauuuugaguucu

SEQ ID NO: 2884688 - RNA, 12 nt, Human
auaaggaagaaa

SEQ ID NO: 2884689 - RNA, 13 nt, Human
auaaggaagaaac

SEQ ID NO: 2884690 - RNA, 14 nt, Human
auaaggaagaaaca

SEQ ID NO: 2884691 - RNA, 19 nt, Human
auaaggacaugaugcuuuu

SEQ ID NO: 2884692 - RNA, 13 nt, Human
auaaggcaggcau

SEQ ID NO: 2884693 - RNA, 19 nt, Human
auaaggccauaaaacaggu

SEQ ID NO: 2884694 - RNA, 17 nt, Human
auaaugggccacugaaa

SEQ ID NO: 2884695 - RNA, 21 nt, Human
auaaugggccacugaaaucug

SEQ ID NO: 2884696 - RNA, 22 nt, Human
auaaugggccacugaaaucugu

SEQ ID NO: 2884697 - RNA, 23 nt, Human
auaaugggccacugaaaucuguc

SEQ ID NO: 2884698 - RNA, 15 nt, Human
auaaugcuuaauuuc

SEQ ID NO: 2884699 - RNA, 17 nt, Human
auaaugcuuaauuucua

SEQ ID NO: 2884700 - RNA, 18 nt, Human
auaaugcuuaauuucuaa

SEQ ID NO: 2884701 - RNA, 14 nt, Human
auaaugcuucagau

SEQ ID NO: 2884702 - RNA, 15 nt, Human
auaaugcuucagaua

SEQ ID NO: 2884703 - RNA, 13 nt, Human
auaauggaaaaaa

SEQ ID NO: 2884704 - RNA, 14 nt, Human
auaauggaaaaaaa

SEQ ID NO: 2884705 - RNA, 21 nt, Human
auaauggaaaaaaaaaaaaga

SEQ ID NO: 2884706 - RNA, 22 nt, Human
auaauggaaaaaaaaaaaagag

SEQ ID NO: 2884707 - RNA, 23 nt, Human
auaauggaaaaaaaaaaaagagg

SEQ ID NO: 2884708 - RNA, 15 nt, Human
auaaugcuacugucu

SEQ ID NO: 2884709 - RNA, 17 nt, Human
auaaugcuaauuuaaag

SEQ ID NO: 2884710 - RNA, 21 nt, Human
auaaugcuaauuuaaagagac

SEQ ID NO: 2884711 - RNA, 16 nt, Human
auaauggaagagaaau

SEQ ID NO: 2884712 - RNA, 17 nt, Human
auaauggaagagaaauc

SEQ ID NO: 2884713 - RNA, 18 nt, Human
auaauggaagagaaaucu

SEQ ID NO: 2884714 - RNA, 20 nt, Human
auaauggaagagaaaucuca

SEQ ID NO: 2884715 - RNA, 21 nt, Human
auaauggaagagaaaucucau

SEQ ID NO: 2884716 - RNA, 13 nt, Human
auaccuauaaugu

SEQ ID NO: 2884717 - RNA, 14 nt, Human
auaccuauaaugug

SEQ ID NO: 2884718 - RNA, 15 nt, Human
auaccuauaaugugu

SEQ ID NO: 2884719 - RNA, 16 nt, Human
auaccuauaaugugug

SEQ ID NO: 2884720 - RNA, 17 nt, Human
auaccuauaaugugugu

SEQ ID NO: 2884721 - RNA, 18 nt, Human
auaccuauaaugugugua

SEQ ID NO: 2884722 - RNA, 19 nt, Human
auaccuauaauguguguau

SEQ ID NO: 2884723 - RNA, 16 nt, Human
auaccucaaacuaucu

SEQ ID NO: 2884724 - RNA, 20 nt, Human
auaccauuuuuuaaggaaac

SEQ ID NO: 2884725 - RNA, 19 nt, Human
auaccauuaaaacugcuuu

SEQ ID NO: 2884726 - RNA, 17 nt, Human
auaccauuuccucagcu

SEQ ID NO: 2884727 - RNA, 22 nt, Human
auaccauuuuuuaaggaaacaa

SEQ ID NO: 2884728 - RNA, 12 nt, Human
auaccucugugu

SEQ ID NO: 2884729 - RNA, 13 nt, Human
auaccucugugug

SEQ ID NO: 2884730 - RNA, 15 nt, Human
auaccucacccugcu

SEQ ID NO: 2884731 - RNA, 13 nt, Human
auaccucugacca

SEQ ID NO: 2884732 - RNA, 14 nt, Human
auaccucugaccaa

SEQ ID NO: 2884733 - RNA, 15 nt, Human
auaccucugaccaac

SEQ ID NO: 2884734 - RNA, 18 nt, Human
auaccucaaccuauggua

SEQ ID NO: 2884735 - RNA, 14 nt, Human
auaccucaauguuu

SEQ ID NO: 2884736 - RNA, 16 nt, Human
auaccucaauguuuga

SEQ ID NO: 2884737 - RNA, 15 nt, Human
auaccucaaccuaug

SEQ ID NO: 2884738 - RNA, 15 nt, Human
auaccucaggaaaga

SEQ ID NO: 2884739 - RNA, 17 nt, Human
auaccucaggaaagaau

SEQ ID NO: 2884740 - RNA, 18 nt, Human
auaccucaggaaagaaua

SEQ ID NO: 2884741 - RNA, 19 nt, Human
auaccucaggaaagaauag

SEQ ID NO: 2884742 - RNA, 21 nt, Human
auaccucaggaaagaauagaa

SEQ ID NO: 2884743 - RNA, 13 nt, Human
auaccucauguuu

SEQ ID NO: 2884744 - RNA, 17 nt, Human
auaccucauguuuauga

SEQ ID NO: 2884745 - RNA, 20 nt, Human
auaccucauguuuaugaaaa

SEQ ID NO: 2884746 - RNA, 21 nt, Human
auaccucauguuuaugaaaau

SEQ ID NO: 2884747 - RNA, 22 nt, Human
auaccucauguuuaugaaaaua

SEQ ID NO: 2884748 - RNA, 20 nt, Human
auaccuucgggguacaaguc

SEQ ID NO: 2884749 - RNA, 18 nt, Human
auaccuuucacagcuuuu

SEQ ID NO: 2884750 - RNA, 22 nt, Human
auaccuuucacagcuuuuauca

SEQ ID NO: 2884751 - RNA, 16 nt, Human
auaccugugccucggc

SEQ ID NO: 2884752 - RNA, 21 nt, Human
aguguccccuccacugucaca

SEQ ID NO: 2884753 - RNA, 16 nt, Human
aguguccuaugcaaua

SEQ ID NO: 2884754 - RNA, 19 nt, Human
aguguccuaugcaauaaaa

SEQ ID NO: 2884755 - RNA, 23 nt, Human
aguguccuaugcaauaaaauuau

SEQ ID NO: 2884756 - RNA, 22 nt, Human
agugucccccagguuccgaaga

SEQ ID NO: 2884757 - RNA, 13 nt, Human
aguguccccucca

SEQ ID NO: 2884758 - RNA, 14 nt, Human
agugucccccaggu

SEQ ID NO: 2884759 - RNA, 14 nt, Human
aguguccccuccac

SEQ ID NO: 2884760 - RNA, 15 nt, Human
aguguccccuccacu

SEQ ID NO: 2884761 - RNA, 17 nt, Human
aguguccccuccacugu

SEQ ID NO: 2884762 - RNA, 19 nt, Human
aguguccccuccacuguca

SEQ ID NO: 2884763 - RNA, 21 nt, Human
aguguccaaagcagggucugg

SEQ ID NO: 2884764 - RNA, 13 nt, Human
aguguccauuuug

SEQ ID NO: 2884765 - RNA, 17 nt, Human
aguguccauuuugugaa

SEQ ID NO: 2884766 - RNA, 18 nt, Human
aguguccauuuugugaag

SEQ ID NO: 2884767 - RNA, 19 nt, Human
aguguccauuuugugaagc

SEQ ID NO: 2884768 - RNA, 20 nt, Human
aguguccauuuugugaagcc

SEQ ID NO: 2884769 - RNA, 21 nt, Human
aguguccauuuugugaagccc

SEQ ID NO: 2884770 - RNA, 22 nt, Human
aguguccauuuugugaagcccu

SEQ ID NO: 2884771 - RNA, 23 nt, Human
aguguccauuuugugaagcccug

SEQ ID NO: 2884772 - RNA, 13 nt, Human
agugucaaccaga

SEQ ID NO: 2884773 - RNA, 15 nt, Human
agugucaaccagaca

SEQ ID NO: 2884774 - RNA, 16 nt, Human
agugucaaccagacag

SEQ ID NO: 2884775 - RNA, 17 nt, Human
agugucaaccagacaga

SEQ ID NO: 2884776 - RNA, 14 nt, Human
aguguccaaagcag

SEQ ID NO: 2884777 - RNA, 17 nt, Human
aguguccaaagcagggu

SEQ ID NO: 2884778 - RNA, 20 nt, Human
aguguccaaagcagggucug

SEQ ID NO: 2884779 - RNA, 13 nt, Human
aguguauuucagu

SEQ ID NO: 2884780 - RNA, 14 nt, Human
aguguauuucaguu

SEQ ID NO: 2884781 - RNA, 15 nt, Human
aguguauuucaguuc

SEQ ID NO: 2884782 - RNA, 13 nt, Human
aguguaugucuug

SEQ ID NO: 2884783 - RNA, 16 nt, Human
aguguaugucuuguau

SEQ ID NO: 2884784 - RNA, 22 nt, Human
aguguauggaaauaaauguauc

SEQ ID NO: 2884785 - RNA, 21 nt, Human
aguguauggaaauaaauguau

SEQ ID NO: 2884786 - RNA, 20 nt, Human
aguguauggaaauaaaugua

SEQ ID NO: 2884787 - RNA, 16 nt, Human
aguguauggaaauaaa

SEQ ID NO: 2884788 - RNA, 14 nt, Human
agugggagcugccu

SEQ ID NO: 2884789 - RNA, 14 nt, Human
agugggagaaggca

SEQ ID NO: 2884790 - RNA, 15 nt, Human
agugggagaaggcag

SEQ ID NO: 2884791 - RNA, 19 nt, Human
agugggagaaggcagugau

SEQ ID NO: 2884792 - RNA, 20 nt, Human
aguggcuucauuagagcagg

SEQ ID NO: 2884793 - RNA, 21 nt, Human
aguggcuucauuagagcaggc

SEQ ID NO: 2884794 - RNA, 22 nt, Human
aguggcuucauuagagcaggcg

SEQ ID NO: 2884795 - RNA, 14 nt, Human
aguggcuuguccuc

SEQ ID NO: 2884796 - RNA, 15 nt, Human
agugggagcugccug

SEQ ID NO: 2884797 - RNA, 14 nt, Human
aguguauaucagaa

SEQ ID NO: 2884798 - RNA, 23 nt, Human
aguggcuuaaaacaacacucaca

SEQ ID NO: 2884799 - RNA, 17 nt, Human
aguggcugucaucagcc

SEQ ID NO: 2884800 - RNA, 16 nt, Human
aguggcugucaucagc

SEQ ID NO: 2884801 - RNA, 17 nt, Human
aguggcuucaucuguca

SEQ ID NO: 2884802 - RNA, 19 nt, Human
aguggcuucauuagagcag

SEQ ID NO: 2884803 - RNA, 13 nt, Human
aguggcuccuccc

SEQ ID NO: 2884804 - RNA, 17 nt, Human
aguggcuccucccggug

SEQ ID NO: 2884805 - RNA, 12 nt, Human
aguggcugcugc

SEQ ID NO: 2884806 - RNA, 15 nt, Human
aguggcucgccaggc

SEQ ID NO: 2884807 - RNA, 16 nt, Human
aguggcucgccaggcc

SEQ ID NO: 2884808 - RNA, 21 nt, Human
aguggcuccucccggugccca

SEQ ID NO: 2884809 - RNA, 13 nt, Human
aguggcugcugcc

SEQ ID NO: 2884810 - RNA, 14 nt, Human
aguggcugcugccc

SEQ ID NO: 2884811 - RNA, 16 nt, Human
aguggcugcugcccag

SEQ ID NO: 2884812 - RNA, 17 nt, Human
aguggcugcugcccagg

SEQ ID NO: 2884813 - RNA, 19 nt, Human
aguggcugcugcccaggcc

SEQ ID NO: 2884814 - RNA, 22 nt, Human
aguggcugcugcccaggcccag

SEQ ID NO: 2884815 - RNA, 15 nt, Human
aguggcguugggagg

SEQ ID NO: 2884816 - RNA, 23 nt, Human
aguggcguugggagggggagaaa

SEQ ID NO: 2884817 - RNA, 15 nt, Human
aguggcguuguugca

SEQ ID NO: 2884818 - RNA, 18 nt, Human
aguggcuaaagagaugag

SEQ ID NO: 2884819 - RNA, 22 nt, Human
aguggcuauuucuuuauauuua

SEQ ID NO: 2884820 - RNA, 14 nt, Human
aguggcucacgccu

SEQ ID NO: 2884821 - RNA, 15 nt, Human
aguugaaagggcaau

SEQ ID NO: 2884822 - RNA, 21 nt, Human
aguuguggaaagccucugcug

SEQ ID NO: 2884823 - RNA, 20 nt, Human
aguuguggaaagccucugcu

SEQ ID NO: 2884824 - RNA, 19 nt, Human
aguuguggaaagccucugc

SEQ ID NO: 2884825 - RNA, 18 nt, Human
aguuguggaaagccucug

SEQ ID NO: 2884826 - RNA, 14 nt, Human
aguugugugacccu

SEQ ID NO: 2884827 - RNA, 15 nt, Human
aguuguggugugagu

SEQ ID NO: 2884828 - RNA, 20 nt, Human
aguuguggugugaguaucag

SEQ ID NO: 2884829 - RNA, 16 nt, Human
aguuguggauuucagu

SEQ ID NO: 2884830 - RNA, 17 nt, Human
aguuguggauuucaguu

SEQ ID NO: 2884831 - RNA, 18 nt, Human
aguuguggauuucaguuu

SEQ ID NO: 2884832 - RNA, 18 nt, Human
aguuguuguggguucuau

SEQ ID NO: 2884833 - RNA, 19 nt, Human
aguuguuguggguucuaug

SEQ ID NO: 2884834 - RNA, 22 nt, Human
aguuguuguggguucuauguuu

SEQ ID NO: 2884835 - RNA, 16 nt, Human
aguuguuguguacaga

SEQ ID NO: 2884836 - RNA, 20 nt, Human
aguuguguuuguugcuggcu

SEQ ID NO: 2884837 - RNA, 22 nt, Human
aguuguguuuguugcuggcuug

SEQ ID NO: 2884838 - RNA, 13 nt, Human
aguuccaagaguc

SEQ ID NO: 2884839 - RNA, 14 nt, Human
aguuccaagagucu

SEQ ID NO: 2884840 - RNA, 19 nt, Human
aguuccaagagucuaaaga

SEQ ID NO: 2884841 - RNA, 21 nt, Human
aguucaugagaaucuauauuu

SEQ ID NO: 2884842 - RNA, 13 nt, Human
aguucaugagaau

SEQ ID NO: 2884843 - RNA, 17 nt, Human
aguucauguuugcuuca

SEQ ID NO: 2884844 - RNA, 23 nt, Human
aguucauguuugcuucauaaaug

SEQ ID NO: 2884845 - RNA, 19 nt, Human
aguucagguaacaggcaga

SEQ ID NO: 2884846 - RNA, 20 nt, Human
aguucagguaacaggcagau

SEQ ID NO: 2884847 - RNA, 16 nt, Human
aguuaaugcuuaagag

SEQ ID NO: 2884848 - RNA, 20 nt, Human
aguuaaugcuuaagagggaa

SEQ ID NO: 2884849 - RNA, 13 nt, Human
aguuaagccuuug

SEQ ID NO: 2884850 - RNA, 16 nt, Human
aguuaauaagcaaaau

SEQ ID NO: 2884851 - RNA, 20 nt, Human
aguuaauaagcaaaauccug

SEQ ID NO: 2884852 - RNA, 15 nt, Human
aguuaauauugugaa

SEQ ID NO: 2884853 - RNA, 20 nt, Human
aguuaauauaucccagaaau

SEQ ID NO: 2884854 - RNA, 21 nt, Human
aguuaauauaucccagaaauu

SEQ ID NO: 2884855 - RNA, 14 nt, Human
aguuaagccuuugg

SEQ ID NO: 2884856 - RNA, 19 nt, Human
aguuaaggaccguggcccu

SEQ ID NO: 2884857 - RNA, 13 nt, Human
aguuaaaaaaaaa

SEQ ID NO: 2884858 - RNA, 22 nt, Human
aguuaaaaaaaaaaaaaggaaa

SEQ ID NO: 2884859 - RNA, 23 nt, Human
aguuaaaaaaaaaaaaaggaaaa

SEQ ID NO: 2884860 - RNA, 17 nt, Human
aguuaaaggcugacuac

SEQ ID NO: 2884861 - RNA, 22 nt, Human
agucaaaugguaggcauuuccu

SEQ ID NO: 2884862 - RNA, 21 nt, Human
agucaaaguaaaacuugcugc

SEQ ID NO: 2884863 - RNA, 12 nt, Human
agucaaaguaaa

SEQ ID NO: 2884864 - RNA, 23 nt, Human
agucaaaugguaggcauuuccua

SEQ ID NO: 2884865 - RNA, 20 nt, Human
aguaugggacuggccucugc

SEQ ID NO: 2884866 - RNA, 17 nt, Human
aguaugggacuggccuc

SEQ ID NO: 2884867 - RNA, 14 nt, Human
agucaaaauaauuc

SEQ ID NO: 2884868 - RNA, 19 nt, Human
agucaaaauauuuuuaaaa

SEQ ID NO: 2884869 - RNA, 21 nt, Human
agucaaaauauuuuuaaaaga

SEQ ID NO: 2884870 - RNA, 22 nt, Human
agucaaaauauuuuuaaaagau

SEQ ID NO: 2884871 - RNA, 16 nt, Human
agucaaagagaguuuu

SEQ ID NO: 2884872 - RNA, 22 nt, Human
agucaaagagaguuuuuaauag

SEQ ID NO: 2884873 - RNA, 23 nt, Human
agucaaagagaguuuuuaauaga

SEQ ID NO: 2884874 - RNA, 14 nt, Human
agucaacaagccug

SEQ ID NO: 2884875 - RNA, 10 nt, Human
aguaucucau

SEQ ID NO: 2884876 - RNA, 21 nt, Human
aguaucucaucaacaaagaaa

SEQ ID NO: 2884877 - RNA, 22 nt, Human
aguaucucaucaacaaagaaau

SEQ ID NO: 2884878 - RNA, 14 nt, Human
aguauggagcucag

SEQ ID NO: 2884879 - RNA, 19 nt, Human
aguauggagcucagagagg

SEQ ID NO: 2884880 - RNA, 15 nt, Human
aguauggaugggugg

SEQ ID NO: 2884881 - RNA, 16 nt, Human
aguaugcuugcucuaa

SEQ ID NO: 2884882 - RNA, 18 nt, Human
aguaugacgcugauacau

SEQ ID NO: 2884883 - RNA, 20 nt, Human
aguaugacgcugauacauaa

SEQ ID NO: 2884884 - RNA, 22 nt, Human
aguaugacgcugauacauaacu

SEQ ID NO: 2884885 - RNA, 14 nt, Human
aguaugagcccuaa

SEQ ID NO: 2884886 - RNA, 17 nt, Human
aguaucuuugcacucca

SEQ ID NO: 2884887 - RNA, 16 nt, Human
aguaugaauaaagaca

SEQ ID NO: 2884888 - RNA, 17 nt, Human
aguaucuuuuuucaaaa

SEQ ID NO: 2884889 - RNA, 22 nt, Human
aguccugggagaaccucaggcu

SEQ ID NO: 2884890 - RNA, 16 nt, Human
aguccugggagaccca

SEQ ID NO: 2884891 - RNA, 21 nt, Human
aguccuguaguuuuauuuuau

SEQ ID NO: 2884892 - RNA, 23 nt, Human
aguccuguaguuuuauuuuaugu

SEQ ID NO: 2884893 - RNA, 15 nt, Human
aguccuguaugucug

SEQ ID NO: 2884894 - RNA, 16 nt, Human
aguccuguaugucugu

SEQ ID NO: 2884895 - RNA, 17 nt, Human
aguccuguaugucuguc

SEQ ID NO: 2884896 - RNA, 19 nt, Human
aguccuguaugucugucau

SEQ ID NO: 2884897 - RNA, 20 nt, Human
aguccuguaugucugucauu

SEQ ID NO: 2884898 - RNA, 21 nt, Human
aguccuguaugucugucauug

SEQ ID NO: 2884899 - RNA, 23 nt, Human
aguccuguaugucugucauugua

SEQ ID NO: 2884900 - RNA, 21 nt, Human
aguccugggagaaccucaggc

SEQ ID NO: 2884901 - RNA, 15 nt, Human
aguccuggcuucagg

SEQ ID NO: 2884902 - RNA, 13 nt, Human
aguccuggcccaa

SEQ ID NO: 2884903 - RNA, 17 nt, Human
agugaagaauccuuuug

SEQ ID NO: 2884904 - RNA, 21 nt, Human
agugaagucaugaccuccagg

SEQ ID NO: 2884905 - RNA, 22 nt, Human
agugaagccagcugcaggaauc

SEQ ID NO: 2884906 - RNA, 12 nt, Human
agugaauaaacu

SEQ ID NO: 2884907 - RNA, 13 nt, Human
agugaauaaacuu

SEQ ID NO: 2884908 - RNA, 19 nt, Human
agugaagagggagaaggga

SEQ ID NO: 2884909 - RNA, 16 nt, Human
agugaagacuggaagc

SEQ ID NO: 2884910 - RNA, 18 nt, Human
agucugauucccaagcuc

SEQ ID NO: 2884911 - RNA, 16 nt, Human
agucugauucccaagc

SEQ ID NO: 2884912 - RNA, 19 nt, Human
agucugaugauuucuugaa

SEQ ID NO: 2884913 - RNA, 17 nt, Human
agucuggaaugcagugg

SEQ ID NO: 2884914 - RNA, 23 nt, Human
agucugcucuagaugagcugggc

SEQ ID NO: 2884915 - RNA, 19 nt, Human
agucugccuauccuggcca

SEQ ID NO: 2884916 - RNA, 19 nt, Human
agugacaguugcagcccuu

SEQ ID NO: 2884917 - RNA, 20 nt, Human
agugacauaauauauucuau

SEQ ID NO: 2884918 - RNA, 22 nt, Human
agugacauaauauauucuauuu

SEQ ID NO: 2884919 - RNA, 22 nt, Human
agugacaucucuuugaugucau

SEQ ID NO: 2884920 - RNA, 18 nt, Human
agugaccauacuaauuau

SEQ ID NO: 2884921 - RNA, 19 nt, Human
agugacaguggauugcauu

SEQ ID NO: 2884922 - RNA, 20 nt, Human
agugacaguggauugcauuu

SEQ ID NO: 2884923 - RNA, 14 nt, Human
agugaccccugccu

SEQ ID NO: 2884924 - RNA, 17 nt, Human
auguaaugaaguaaagc

SEQ ID NO: 2884925 - RNA, 22 nt, Human
auguaaugaaguaaagccauua

SEQ ID NO: 2884926 - RNA, 15 nt, Human
auguaaugcaacuac

SEQ ID NO: 2884927 - RNA, 18 nt, Human
auguaaugcgauuuuauu

SEQ ID NO: 2884928 - RNA, 21 nt, Human
auguaaugcgauuuuauuacu

SEQ ID NO: 2884929 - RNA, 22 nt, Human
auguaaugcgauuuuauuacug

SEQ ID NO: 2884930 - RNA, 14 nt, Human
auguaaugucccuu

SEQ ID NO: 2884931 - RNA, 20 nt, Human
auguaaugugugguggccuc

SEQ ID NO: 2884932 - RNA, 21 nt, Human
auguaaugugugguggccuca

SEQ ID NO: 2884933 - RNA, 22 nt, Human
auguaaugugugguggccucag

SEQ ID NO: 2884934 - RNA, 23 nt, Human
auguaaugugugguggccucagc

SEQ ID NO: 2884935 - RNA, 18 nt, Human
auguaauguuaauguuau

SEQ ID NO: 2884936 - RNA, 12 nt, Human
auguaauguuuu

SEQ ID NO: 2884937 - RNA, 21 nt, Human
auguaauguuuucuuugcaaa

SEQ ID NO: 2884938 - RNA, 23 nt, Human
auguaauguuuucuuugcaaagu

SEQ ID NO: 2884939 - RNA, 16 nt, Human
auggucgcccaggaga

SEQ ID NO: 2884940 - RNA, 15 nt, Human
auggucgcccaggag

SEQ ID NO: 2884941 - RNA, 20 nt, Human
auguauucuagcuaauguaa

SEQ ID NO: 2884942 - RNA, 14 nt, Human
auguauugauaaga

SEQ ID NO: 2884943 - RNA, 19 nt, Human
auguauucuagcuaaugua

SEQ ID NO: 2884944 - RNA, 16 nt, Human
auguauuauuuauaau

SEQ ID NO: 2884945 - RNA, 17 nt, Human
auguauuauuuauaauu

SEQ ID NO: 2884946 - RNA, 15 nt, Human
auguauuauuucauu

SEQ ID NO: 2884947 - RNA, 22 nt, Human
auguauuauuucauuauguaaa

SEQ ID NO: 2884948 - RNA, 15 nt, Human
auguauuauuuauaa

SEQ ID NO: 2884949 - RNA, 19 nt, Human
auguauuuguucauguuug

SEQ ID NO: 2884950 - RNA, 15 nt, Human
auguauuuuucuaca

SEQ ID NO: 2884951 - RNA, 16 nt, Human
auguauuuuucuacau

SEQ ID NO: 2884952 - RNA, 19 nt, Human
auguauuuuucuacauuau

SEQ ID NO: 2884953 - RNA, 23 nt, Human
auguauuuuucuacauuauugcu

SEQ ID NO: 2884954 - RNA, 14 nt, Human
auggucgcccagga

SEQ ID NO: 2884955 - RNA, 20 nt, Human
augguccuggggcucugugc

SEQ ID NO: 2884956 - RNA, 19 nt, Human
augguccuggggcucugug

SEQ ID NO: 2884957 - RNA, 17 nt, Human
augguccuggggcucug

SEQ ID NO: 2884958 - RNA, 14 nt, Human
augguccuggggcu

SEQ ID NO: 2884959 - RNA, 12 nt, Human
augguccugggg

SEQ ID NO: 2884960 - RNA, 17 nt, Human
auggucauugcaguuua

SEQ ID NO: 2884961 - RNA, 22 nt, Human
auggucaucuuggagggaccaa

SEQ ID NO: 2884962 - RNA, 18 nt, Human
augguccuaaaagcaaaa

SEQ ID NO: 2884963 - RNA, 20 nt, Human
augguccuaaaagcaaaaua

SEQ ID NO: 2884964 - RNA, 19 nt, Human
auggucacacacugaugcu

SEQ ID NO: 2884965 - RNA, 18 nt, Human
auggucacacacugaugc

SEQ ID NO: 2884966 - RNA, 16 nt, Human
auggucacacacugau

SEQ ID NO: 2884967 - RNA, 15 nt, Human
auggucacacacuga

SEQ ID NO: 2884968 - RNA, 20 nt, Human
auggucacacacugaugcuu

SEQ ID NO: 2884969 - RNA, 17 nt, Human
auggucacgcaccuggg

SEQ ID NO: 2884970 - RNA, 22 nt, Human
auggucacuuaaaaugugcagu

SEQ ID NO: 2884971 - RNA, 17 nt, Human
augguauaaguaacuuu

SEQ ID NO: 2884972 - RNA, 14 nt, Human
auggucacacacug

SEQ ID NO: 2884973 - RNA, 19 nt, Human
augguauaaugguugacug

SEQ ID NO: 2884974 - RNA, 20 nt, Human
augugaaaccuuuuuuaaga

SEQ ID NO: 2884975 - RNA, 21 nt, Human
augugaaaccuuuuuuaagau

SEQ ID NO: 2884976 - RNA, 22 nt, Human
augugaaaccuuuuuuaagauu

SEQ ID NO: 2884977 - RNA, 23 nt, Human
augugaaaccuuuuuuaagauuu

SEQ ID NO: 2884978 - RNA, 18 nt, Human
augucuuucuccaaaguu

SEQ ID NO: 2884979 - RNA, 22 nt, Human
augucuuucuccaaaguuaucc

SEQ ID NO: 2884980 - RNA, 12 nt, Human
augugaaaccuu

SEQ ID NO: 2884981 - RNA, 15 nt, Human
augucuuuucuuggc

SEQ ID NO: 2884982 - RNA, 16 nt, Human
augucuuuucuuggca

SEQ ID NO: 2884983 - RNA, 13 nt, Human
augugaaaccuuu

SEQ ID NO: 2884984 - RNA, 15 nt, Human
augugaaaccuuuuu

SEQ ID NO: 2884985 - RNA, 18 nt, Human
augugaaaccuuuuuuaa

SEQ ID NO: 2884986 - RNA, 19 nt, Human
augugaaaccuuuuuuaag

SEQ ID NO: 2884987 - RNA, 12 nt, Human
augugaaagcac

SEQ ID NO: 2884988 - RNA, 14 nt, Human
augugaagaugcau

SEQ ID NO: 2884989 - RNA, 21 nt, Human
augugaagaugcauuguaguu

SEQ ID NO: 2884990 - RNA, 23 nt, Human
augugaagaugcauuguaguuua

SEQ ID NO: 2884991 - RNA, 12 nt, Human
augugaacuugu

SEQ ID NO: 2884992 - RNA, 13 nt, Human
augugaacuugua

SEQ ID NO: 2884993 - RNA, 14 nt, Human
augugaacuuguag

SEQ ID NO: 2884994 - RNA, 16 nt, Human
augugaacuuguagcu

SEQ ID NO: 2884995 - RNA, 17 nt, Human
augugaacuuguagcug

SEQ ID NO: 2884996 - RNA, 18 nt, Human
augugaacuuguagcugu

SEQ ID NO: 2884997 - RNA, 20 nt, Human
augugaacuuguagcuguaa

SEQ ID NO: 2884998 - RNA, 22 nt, Human
augugaacuuguagcuguaaaa

SEQ ID NO: 2884999 - RNA, 23 nt, Human
augugaacuuguagcuguaaaac

SEQ ID NO: 2885000 - RNA, 18 nt, Human
augucuuuuagaagauag

SEQ ID NO: 2885001 - RNA, 14 nt, Human
augucuuuuauagu

SEQ ID NO: 2885002 - RNA, 18 nt, Human
augucuuuuauaguggaa

SEQ ID NO: 2885003 - RNA, 19 nt, Human
augucuuuuauaguggaaa

SEQ ID NO: 2885004 - RNA, 20 nt, Human
augucuuuuauaguggaaaa

SEQ ID NO: 2885005 - RNA, 21 nt, Human
augucuuuuauaguggaaaaa

SEQ ID NO: 2885006 - RNA, 16 nt, Human
augucuuuuauauuug

SEQ ID NO: 2885007 - RNA, 17 nt, Human
augucuuuuauauuugu

SEQ ID NO: 2885008 - RNA, 20 nt, Human
augucuuuuauauuuguauc

SEQ ID NO: 2885009 - RNA, 21 nt, Human
augucuuuuauauuuguaucg

SEQ ID NO: 2885010 - RNA, 22 nt, Human
augucuuuuauauuuguaucga

SEQ ID NO: 2885011 - RNA, 12 nt, Human
augucuuuguaa

SEQ ID NO: 2885012 - RNA, 13 nt, Human
augucuuuguaag

SEQ ID NO: 2885013 - RNA, 15 nt, Human
augucuuuguaaguc

SEQ ID NO: 2885014 - RNA, 21 nt, Human
augucuuuguaagucaguguu

SEQ ID NO: 2885015 - RNA, 22 nt, Human
augucuuuguaagucaguguug

SEQ ID NO: 2885016 - RNA, 16 nt, Human
augucuucaaggcuuc

SEQ ID NO: 2885017 - RNA, 17 nt, Human
augucuucaaggcuuca

SEQ ID NO: 2885018 - RNA, 19 nt, Human
augucuucaaggcuucagu

SEQ ID NO: 2885019 - RNA, 20 nt, Human
augucuucaaggcuucaguc

SEQ ID NO: 2885020 - RNA, 15 nt, Human
augucuucauaaagu

SEQ ID NO: 2885021 - RNA, 19 nt, Human
augucuucauaaaguacuu

SEQ ID NO: 2885022 - RNA, 13 nt, Human
augucuuccugga

SEQ ID NO: 2885023 - RNA, 20 nt, Human
augucuucauuucauuguau

SEQ ID NO: 2885024 - RNA, 18 nt, Human
augucuuccauguaucuu

SEQ ID NO: 2885025 - RNA, 22 nt, Human
augucuuccauguaucuuuuga

SEQ ID NO: 2885026 - RNA, 19 nt, Human
augucuucauuucauugua

SEQ ID NO: 2885027 - RNA, 17 nt, Human
augucuuaauuuuugaa

SEQ ID NO: 2885028 - RNA, 17 nt, Human
augucuucauuucauug

SEQ ID NO: 2885029 - RNA, 18 nt, Human
augucuucauuucauugu

SEQ ID NO: 2885030 - RNA, 17 nt, Human
augucaaaauuguuuaa

SEQ ID NO: 2885031 - RNA, 21 nt, Human
augugaagucaccaguggccu

SEQ ID NO: 2885032 - RNA, 21 nt, Human
auguucgguuuuuuuccuguu

SEQ ID NO: 2885033 - RNA, 23 nt, Human
auguucgguuuuuuuccuguuuc

SEQ ID NO: 2885034 - RNA, 12 nt, Human
auguucuaaggc

SEQ ID NO: 2885035 - RNA, 16 nt, Human
augugugcaugugugu

SEQ ID NO: 2885036 - RNA, 17 nt, Human
augugugcaugugugua

SEQ ID NO: 2885037 - RNA, 18 nt, Human
augugugcauguguguau

SEQ ID NO: 2885038 - RNA, 20 nt, Human
augugugcauguguguauaa

SEQ ID NO: 2885039 - RNA, 15 nt, Human
augugugccaaggcu

SEQ ID NO: 2885040 - RNA, 11 nt, Human
augugugccau

SEQ ID NO: 2885041 - RNA, 18 nt, Human
augugugccauagaguuu

SEQ ID NO: 2885042 - RNA, 20 nt, Human
augugugccauagaguuuaa

SEQ ID NO: 2885043 - RNA, 22 nt, Human
augugugccauagaguuuaaca

SEQ ID NO: 2885044 - RNA, 13 nt, Human
augugggcacugg

SEQ ID NO: 2885045 - RNA, 18 nt, Human
augugggcacuggcccag

SEQ ID NO: 2885046 - RNA, 19 nt, Human
augugugaggagcugcugg

SEQ ID NO: 2885047 - RNA, 15 nt, Human
augugugaggagcug

SEQ ID NO: 2885048 - RNA, 22 nt, Human
augugugaggagcugcuggcuu

SEQ ID NO: 2885049 - RNA, 12 nt, Human
auguucugggac

SEQ ID NO: 2885050 - RNA, 11 nt, Human
auguucuggga

SEQ ID NO: 2885051 - RNA, 13 nt, Human
auguucugcuuuc

SEQ ID NO: 2885052 - RNA, 12 nt, Human
auguucugcccc

SEQ ID NO: 2885053 - RNA, 14 nt, Human
auguucugccccca

SEQ ID NO: 2885054 - RNA, 16 nt, Human
auguucugcccccagc

SEQ ID NO: 2885055 - RNA, 17 nt, Human
auguucugcccccagcc

SEQ ID NO: 2885056 - RNA, 18 nt, Human
auguucugcccccagccc

SEQ ID NO: 2885057 - RNA, 20 nt, Human
auguucugcccccagcccaa

SEQ ID NO: 2885058 - RNA, 19 nt, Human
auguucuaugguuaugaaa

SEQ ID NO: 2885059 - RNA, 20 nt, Human
auguucuaugguuaugaaag

SEQ ID NO: 2885060 - RNA, 21 nt, Human
auguucuaugguuaugaaaga

SEQ ID NO: 2885061 - RNA, 14 nt, Human
auguucuauugugg

SEQ ID NO: 2885062 - RNA, 23 nt, Human
auguucuaaguuucuaagauucu

SEQ ID NO: 2885063 - RNA, 16 nt, Human
auguucuaaguuucua

SEQ ID NO: 2885064 - RNA, 19 nt, Human
auguucuaaguuucuaaga

SEQ ID NO: 2885065 - RNA, 20 nt, Human
auguucuaaguuucuaagau

SEQ ID NO: 2885066 - RNA, 21 nt, Human
auguucuaaguuucuaagauu

SEQ ID NO: 2885067 - RNA, 22 nt, Human
auguucuaaggcucugagaguc

SEQ ID NO: 2885068 - RNA, 12 nt, Human
auguucuaaguu

SEQ ID NO: 2885069 - RNA, 13 nt, Human
auguucuaaguuu

SEQ ID NO: 2885070 - RNA, 15 nt, Human
auguucuaaguuucu

SEQ ID NO: 2885071 - RNA, 13 nt, Human
auguucuaaggcu

SEQ ID NO: 2885072 - RNA, 14 nt, Human
auguucuaaggcuc

SEQ ID NO: 2885073 - RNA, 15 nt, Human
auguucuaaggcucu

SEQ ID NO: 2885074 - RNA, 16 nt, Human
auguucuaaggcucug

SEQ ID NO: 2885075 - RNA, 17 nt, Human
auguucuaaggcucuga

SEQ ID NO: 2885076 - RNA, 18 nt, Human
auguucuaaggcucugag

SEQ ID NO: 2885077 - RNA, 19 nt, Human
auguucuaaggcucugaga

SEQ ID NO: 2885078 - RNA, 20 nt, Human
auguucuaaggcucugagag

SEQ ID NO: 2885079 - RNA, 11 nt, Human
auuaaaucugu

SEQ ID NO: 2885080 - RNA, 13 nt, Human
auuaaaugaauau

SEQ ID NO: 2885081 - RNA, 18 nt, Human
auuaaaugaauauuuuga

SEQ ID NO: 2885082 - RNA, 19 nt, Human
auuaaaugaauauuuugau

SEQ ID NO: 2885083 - RNA, 22 nt, Human
auuaaaugaauauuuugauaau

SEQ ID NO: 2885084 - RNA, 17 nt, Human
auuaaauaguuauauaa

SEQ ID NO: 2885085 - RNA, 14 nt, Human
auuaaauauagauu

SEQ ID NO: 2885086 - RNA, 22 nt, Human
auuaaauauagauuagaaaaau

SEQ ID NO: 2885087 - RNA, 18 nt, Human
auguuuuauuauuucuau

SEQ ID NO: 2885088 - RNA, 20 nt, Human
auguuuuauuauuucuauua

SEQ ID NO: 2885089 - RNA, 15 nt, Human
auguuuuauuucauu

SEQ ID NO: 2885090 - RNA, 23 nt, Human
auguuuuauuucauugguuaauu

SEQ ID NO: 2885091 - RNA, 16 nt, Human
auguuuuauaaguuca

SEQ ID NO: 2885092 - RNA, 18 nt, Human
auguuugcuucauaaaug

SEQ ID NO: 2885093 - RNA, 20 nt, Human
auguuugcuucauaaaugaa

SEQ ID NO: 2885094 - RNA, 14 nt, Human
auguuuuacacugu

SEQ ID NO: 2885095 - RNA, 16 nt, Human
auguuuuacacuguac

SEQ ID NO: 2885096 - RNA, 23 nt, Human
auguuugcucuuguuuuuauuaa

SEQ ID NO: 2885097 - RNA, 20 nt, Human
auguuuuaccguaauaauua

SEQ ID NO: 2885098 - RNA, 16 nt, Human
auguuuuacugugaaa

SEQ ID NO: 2885099 - RNA, 21 nt, Human
auguuucacaccggaagguuu

SEQ ID NO: 2885100 - RNA, 13 nt, Human
auguucugggaca

SEQ ID NO: 2885101 - RNA, 18 nt, Human
auguuugccucugccucu

SEQ ID NO: 2885102 - RNA, 13 nt, Human
auguuuccagcag

SEQ ID NO: 2885103 - RNA, 19 nt, Human
auguuuccagcagaagaca

SEQ ID NO: 2885104 - RNA, 22 nt, Human
auguuugccucugccucugaca

SEQ ID NO: 2885105 - RNA, 19 nt, Human
auguuugccucugccucug

SEQ ID NO: 2885106 - RNA, 15 nt, Human
auguuuccagacuuc

SEQ ID NO: 2885107 - RNA, 21 nt, Human
auguuucacauaaaaccucau

SEQ ID NO: 2885108 - RNA, 13 nt, Human
auguuuccaaccu

SEQ ID NO: 2885109 - RNA, 22 nt, Human
auguuucauguuuugugacuau

SEQ ID NO: 2885110 - RNA, 19 nt, Human
auguuucacgaaguuuguu

SEQ ID NO: 2885111 - RNA, 11 nt, Human
augugggaggg

SEQ ID NO: 2885112 - RNA, 10 nt, Human
augugggagg

SEQ ID NO: 2885113 - RNA, 20 nt, Human
augugggaauuaagcaaaau

SEQ ID NO: 2885114 - RNA, 21 nt, Human
auguggcuugagaaauaugga

SEQ ID NO: 2885115 - RNA, 22 nt, Human
auguggcuuuuuuaaaaaagca

SEQ ID NO: 2885116 - RNA, 16 nt, Human
auguggcuugagaaau

SEQ ID NO: 2885117 - RNA, 19 nt, Human
augcugcaggacuugagaa

SEQ ID NO: 2885118 - RNA, 18 nt, Human
augcugcaggacuugaga

SEQ ID NO: 2885119 - RNA, 20 nt, Human
augcugcagauuugggcugg

SEQ ID NO: 2885120 - RNA, 12 nt, Human
augcugccagug

SEQ ID NO: 2885121 - RNA, 13 nt, Human
augcugccagugu

SEQ ID NO: 2885122 - RNA, 14 nt, Human
augcucuucugugg

SEQ ID NO: 2885123 - RNA, 16 nt, Human
augcucuuuuguuugg

SEQ ID NO: 2885124 - RNA, 15 nt, Human
augcucuuuuuuacu

SEQ ID NO: 2885125 - RNA, 18 nt, Human
augcucuuuuuuacucau

SEQ ID NO: 2885126 - RNA, 19 nt, Human
augcucuuuuuuacucauu

SEQ ID NO: 2885127 - RNA, 20 nt, Human
augcucuuuuuuacucauug

SEQ ID NO: 2885128 - RNA, 21 nt, Human
augcucuuuuuuacucauuga

SEQ ID NO: 2885129 - RNA, 22 nt, Human
augcucuuuuuuacucauugaa

SEQ ID NO: 2885130 - RNA, 23 nt, Human
augcucuuuuuuacucauugaaa

SEQ ID NO: 2885131 - RNA, 24 nt, Human
augcucuuuuuuacucauugaaau

SEQ ID NO: 2885132 - RNA, 17 nt, Human
augcugaaaaaacaccu

SEQ ID NO: 2885133 - RNA, 19 nt, Human
augcugaagccaaagccaa

SEQ ID NO: 2885134 - RNA, 15 nt, Human
augcucuucugugga

SEQ ID NO: 2885135 - RNA, 21 nt, Human
augcucuugaccuuguagaga

SEQ ID NO: 2885136 - RNA, 18 nt, Human
auggcugugccucugccu

SEQ ID NO: 2885137 - RNA, 20 nt, Human
auggauuggauuauuuaaua

SEQ ID NO: 2885138 - RNA, 22 nt, Human
auggauuggauuauuuaauaac

SEQ ID NO: 2885139 - RNA, 16 nt, Human
auggauuguuaauuuc

SEQ ID NO: 2885140 - RNA, 22 nt, Human
auggauuguuaauuucaguccu

SEQ ID NO: 2885141 - RNA, 16 nt, Human
auggauucuauuuauu

SEQ ID NO: 2885142 - RNA, 18 nt, Human
auggauugauaauugcau

SEQ ID NO: 2885143 - RNA, 20 nt, Human
auggauugauaauugcauuc

SEQ ID NO: 2885144 - RNA, 15 nt, Human
auggauuggauuauu

SEQ ID NO: 2885145 - RNA, 22 nt, Human
auggaggaaaaccaagccgugg

SEQ ID NO: 2885146 - RNA, 16 nt, Human
auggaaaguaacucau

SEQ ID NO: 2885147 - RNA, 16 nt, Human
auggaggaaaaccaag

SEQ ID NO: 2885148 - RNA, 17 nt, Human
auggaaaaucagcugcu

SEQ ID NO: 2885149 - RNA, 16 nt, Human
auggaaaccugaaaaa

SEQ ID NO: 2885150 - RNA, 22 nt, Human
auggaaacccauaggcccacac

SEQ ID NO: 2885151 - RNA, 21 nt, Human
auggaaacccgaggguugauu

SEQ ID NO: 2885152 - RNA, 13 nt, Human
auggaaaccucac

SEQ ID NO: 2885153 - RNA, 17 nt, Human
auggaaaccucacgcug

SEQ ID NO: 2885154 - RNA, 17 nt, Human
auggaaagaaucuaaua

SEQ ID NO: 2885155 - RNA, 11 nt, Human
auggaaagaau

SEQ ID NO: 2885156 - RNA, 23 nt, Human
auggaaaccugaaaaaaaguuua

SEQ ID NO: 2885157 - RNA, 17 nt, Human
auggcuuauccagcugg

SEQ ID NO: 2885158 - RNA, 18 nt, Human
auggcuuauccagcuggu

SEQ ID NO: 2885159 - RNA, 19 nt, Human
auggcuuauccagcuggug

SEQ ID NO: 2885160 - RNA, 19 nt, Human
auggcugugccucugccug

SEQ ID NO: 2885161 - RNA, 20 nt, Human
auggcugugccucugccugu

SEQ ID NO: 2885162 - RNA, 14 nt, Human
augaugcagucucc

SEQ ID NO: 2885163 - RNA, 15 nt, Human
augaugcagucuccu

SEQ ID NO: 2885164 - RNA, 21 nt, Human
augaugcagucuccucuuuaa

SEQ ID NO: 2885165 - RNA, 22 nt, Human
augaugcagucuccucuuuaaa

SEQ ID NO: 2885166 - RNA, 14 nt, Human
augauguguuguga

SEQ ID NO: 2885167 - RNA, 15 nt, Human
augauguguugugau

SEQ ID NO: 2885168 - RNA, 17 nt, Human
augauggagcgcaccug

SEQ ID NO: 2885169 - RNA, 16 nt, Human
augaugcuuuuacuga

SEQ ID NO: 2885170 - RNA, 21 nt, Human
augaugcuuuuacugaacuuu

SEQ ID NO: 2885171 - RNA, 15 nt, Human
augauggaauuucau

SEQ ID NO: 2885172 - RNA, 16 nt, Human
augaugcccugcucca

SEQ ID NO: 2885173 - RNA, 19 nt, Human
augaugcccugcuccaggg

SEQ ID NO: 2885174 - RNA, 20 nt, Human
augcaauuuugcauuugaau

SEQ ID NO: 2885175 - RNA, 17 nt, Human
augcaauuuccuuuuuu

SEQ ID NO: 2885176 - RNA, 12 nt, Human
augcaauuugau

SEQ ID NO: 2885177 - RNA, 17 nt, Human
augcaauuugauugacu

SEQ ID NO: 2885178 - RNA, 18 nt, Human
augauuaaauaagauucu

SEQ ID NO: 2885179 - RNA, 17 nt, Human
augauuaaauaagauuc

SEQ ID NO: 2885180 - RNA, 15 nt, Human
augauguuucacaua

SEQ ID NO: 2885181 - RNA, 11 nt, Human
augcacagaga

SEQ ID NO: 2885182 - RNA, 16 nt, Human
augcacagagaagcug

SEQ ID NO: 2885183 - RNA, 17 nt, Human
augcacagagaagcugg

SEQ ID NO: 2885184 - RNA, 18 nt, Human
augcacagagaagcuggg

SEQ ID NO: 2885185 - RNA, 12 nt, Human
augcaugaacaa

SEQ ID NO: 2885186 - RNA, 13 nt, Human
augcaugaacaag

SEQ ID NO: 2885187 - RNA, 21 nt, Human
augcaugaacaaguuuuaaug

SEQ ID NO: 2885188 - RNA, 18 nt, Human
augcauaugucacuagaa

SEQ ID NO: 2885189 - RNA, 20 nt, Human
augcauaugucacuagaaug

SEQ ID NO: 2885190 - RNA, 22 nt, Human
augcauaugucacuagaaugga

SEQ ID NO: 2885191 - RNA, 23 nt, Human
augcauaugucacuagaauggau

SEQ ID NO: 2885192 - RNA, 22 nt, Human
augcaucucacuggaugcaaag

SEQ ID NO: 2885193 - RNA, 21 nt, Human
augccugagagacauggcuuu

SEQ ID NO: 2885194 - RNA, 13 nt, Human
augccucugucua

SEQ ID NO: 2885195 - RNA, 14 nt, Human
augccucugucuag

SEQ ID NO: 2885196 - RNA, 17 nt, Human
augccucugucuagcau

SEQ ID NO: 2885197 - RNA, 22 nt, Human
augccucugucuagcaugccaa

SEQ ID NO: 2885198 - RNA, 21 nt, Human
augccucugauaugggacuga

SEQ ID NO: 2885199 - RNA, 22 nt, Human
augccucugauaugggacugag

SEQ ID NO: 2885200 - RNA, 16 nt, Human
augauuaaaaugguga

SEQ ID NO: 2885201 - RNA, 22 nt, Human
aucagcuggucaaacaaacucu

SEQ ID NO: 2885202 - RNA, 13 nt, Human
auauuuauuuaaa

SEQ ID NO: 2885203 - RNA, 16 nt, Human
auauuuauuuaaagca

SEQ ID NO: 2885204 - RNA, 17 nt, Human
auauuuauuuaaagcau

SEQ ID NO: 2885205 - RNA, 17 nt, Human
auauuuauuuauuuauu

SEQ ID NO: 2885206 - RNA, 19 nt, Human
aucacagggcagagccggg

SEQ ID NO: 2885207 - RNA, 15 nt, Human
aucacauguggacuu

SEQ ID NO: 2885208 - RNA, 15 nt, Human
aucacagggcagagc

SEQ ID NO: 2885209 - RNA, 12 nt, Human
aucacagggcag

SEQ ID NO: 2885210 - RNA, 14 nt, Human
aucagcuauuuacu

SEQ ID NO: 2885211 - RNA, 15 nt, Human
aucagcuauuuacug

SEQ ID NO: 2885212 - RNA, 18 nt, Human
aucagcuacuuaagagaa

SEQ ID NO: 2885213 - RNA, 19 nt, Human
aucagcuacuuaagagaaa

SEQ ID NO: 2885214 - RNA, 20 nt, Human
aucagcuacuuaagagaaau

SEQ ID NO: 2885215 - RNA, 21 nt, Human
aucagcuacuuaagagaaaug

SEQ ID NO: 2885216 - RNA, 22 nt, Human
aucagcuacuuaagagaaaugg

SEQ ID NO: 2885217 - RNA, 15 nt, Human
aucacccucuuccug

SEQ ID NO: 2885218 - RNA, 22 nt, Human
aucacauugagcugauauaaau

SEQ ID NO: 2885219 - RNA, 24 nt, Human
aucacauugagcugauauaaauuc

SEQ ID NO: 2885220 - RNA, 16 nt, Human
aucacccucuuccugu

SEQ ID NO: 2885221 - RNA, 12 nt, Human
aucagcacugaa

SEQ ID NO: 2885222 - RNA, 13 nt, Human
aucagcacugaaa

SEQ ID NO: 2885223 - RNA, 14 nt, Human
aucagcacugaaaa

SEQ ID NO: 2885224 - RNA, 15 nt, Human
aucagcacugaaaau

SEQ ID NO: 2885225 - RNA, 18 nt, Human
aucagcaucugugauggg

SEQ ID NO: 2885226 - RNA, 17 nt, Human
auccuccacuuguucag

SEQ ID NO: 2885227 - RNA, 18 nt, Human
auccuccacuuguucagg

SEQ ID NO: 2885228 - RNA, 21 nt, Human
auccucaaacacugcaggcau

SEQ ID NO: 2885229 - RNA, 15 nt, Human
auccucccaccucag

SEQ ID NO: 2885230 - RNA, 16 nt, Human
auccuauuguugaugg

SEQ ID NO: 2885231 - RNA, 22 nt, Human
auccuauuucaguacuucagca

SEQ ID NO: 2885232 - RNA, 15 nt, Human
auccucaaacacugc

SEQ ID NO: 2885233 - RNA, 16 nt, Human
auccucaaacacugca

SEQ ID NO: 2885234 - RNA, 17 nt, Human
auccucaaacacugcag

SEQ ID NO: 2885235 - RNA, 19 nt, Human
auccucaaacacugcaggc

SEQ ID NO: 2885236 - RNA, 18 nt, Human
auccccuggacugggagg

SEQ ID NO: 2885237 - RNA, 13 nt, Human
auccccuuacccu

SEQ ID NO: 2885238 - RNA, 23 nt, Human
auccccuuacccuuagaauccac

SEQ ID NO: 2885239 - RNA, 20 nt, Human
auccccucugucuacaaaua

SEQ ID NO: 2885240 - RNA, 12 nt, Human
auccccugagcc

SEQ ID NO: 2885241 - RNA, 14 nt, Human
auccccugagcccc

SEQ ID NO: 2885242 - RNA, 12 nt, Human
auccccugcuac

SEQ ID NO: 2885243 - RNA, 19 nt, Human
auccccucccugucaaagc

SEQ ID NO: 2885244 - RNA, 20 nt, Human
auccccaaaacaaagucuuu

SEQ ID NO: 2885245 - RNA, 19 nt, Human
auccccguuccugacauca

SEQ ID NO: 2885246 - RNA, 22 nt, Human
auccccguuccugacaucacag

SEQ ID NO: 2885247 - RNA, 13 nt, Human
auccccucaggac

SEQ ID NO: 2885248 - RNA, 15 nt, Human
auccccucccuguca

SEQ ID NO: 2885249 - RNA, 15 nt, Human
auccagacccggcug

SEQ ID NO: 2885250 - RNA, 13 nt, Human
auccccaagccug

SEQ ID NO: 2885251 - RNA, 15 nt, Human
auccaggcacagcug

SEQ ID NO: 2885252 - RNA, 16 nt, Human
auccaggcacagcuga

SEQ ID NO: 2885253 - RNA, 17 nt, Human
auccaggcacagcugag

SEQ ID NO: 2885254 - RNA, 16 nt, Human
auccagacaucaugaa

SEQ ID NO: 2885255 - RNA, 18 nt, Human
auccagacaucaugaauu

SEQ ID NO: 2885256 - RNA, 21 nt, Human
auccagacaucaugaauuuua

SEQ ID NO: 2885257 - RNA, 22 nt, Human
auccagacaucaugaauuuuac

SEQ ID NO: 2885258 - RNA, 22 nt, Human
auccagcucuaagucucaacug

SEQ ID NO: 2885259 - RNA, 14 nt, Human
auccagcuggugag

SEQ ID NO: 2885260 - RNA, 19 nt, Human
auccagcuugccagaugcu

SEQ ID NO: 2885261 - RNA, 20 nt, Human
auccagcuugccagaugcug

SEQ ID NO: 2885262 - RNA, 19 nt, Human
auccucccaccucagccuc

SEQ ID NO: 2885263 - RNA, 18 nt, Human
auccucccaccucagccu

SEQ ID NO: 2885264 - RNA, 20 nt, Human
auccucccaccucagccucc

SEQ ID NO: 2885265 - RNA, 19 nt, Human
auccuccaguaccuugcuu

SEQ ID NO: 2885266 - RNA, 20 nt, Human
auccuccaguaccuugcuuc

SEQ ID NO: 2885267 - RNA, 21 nt, Human
auccuccaguaccuugcuucu

SEQ ID NO: 2885268 - RNA, 16 nt, Human
aucgcucguguguucu

SEQ ID NO: 2885269 - RNA, 21 nt, Human
aucgcucguguguucuaucca

SEQ ID NO: 2885270 - RNA, 23 nt, Human
aucgcucguguguucuauccaaa

SEQ ID NO: 2885271 - RNA, 15 nt, Human
aucgcugacuucaug

SEQ ID NO: 2885272 - RNA, 12 nt, Human
aucgcuggcccc

SEQ ID NO: 2885273 - RNA, 14 nt, Human
aucgcuggccccuu

SEQ ID NO: 2885274 - RNA, 18 nt, Human
aucggagucagccaggag

SEQ ID NO: 2885275 - RNA, 16 nt, Human
aucgcugugaugcugg

SEQ ID NO: 2885276 - RNA, 22 nt, Human
aucuauucugagaaaacaagca

SEQ ID NO: 2885277 - RNA, 13 nt, Human
aucuauucugugu

SEQ ID NO: 2885278 - RNA, 18 nt, Human
aucuauucugagaaaaca

SEQ ID NO: 2885279 - RNA, 17 nt, Human
aucuauucugagaaaac

SEQ ID NO: 2885280 - RNA, 23 nt, Human
aucuccccuugcacuaaaguaug

SEQ ID NO: 2885281 - RNA, 15 nt, Human
aucucccgcugcugc

SEQ ID NO: 2885282 - RNA, 16 nt, Human
aucuauguuucaucuu

SEQ ID NO: 2885283 - RNA, 20 nt, Human
aucuauguuucaucuuguuu

SEQ ID NO: 2885284 - RNA, 13 nt, Human
aucuaucuuccaa

SEQ ID NO: 2885285 - RNA, 13 nt, Human
aucuaugaggaaa

SEQ ID NO: 2885286 - RNA, 13 nt, Human
aucuaugauauaa

SEQ ID NO: 2885287 - RNA, 15 nt, Human
aucuaugauauaacc

SEQ ID NO: 2885288 - RNA, 14 nt, Human
aucuauuaauauau

SEQ ID NO: 2885289 - RNA, 23 nt, Human
aucuaugggagagugucaaccag

SEQ ID NO: 2885290 - RNA, 12 nt, Human
aucuauuaauau

SEQ ID NO: 2885291 - RNA, 15 nt, Human
aucuauuaauauaug

SEQ ID NO: 2885292 - RNA, 18 nt, Human
aucuauuaauauauguau

SEQ ID NO: 2885293 - RNA, 14 nt, Human
aucugcuucagugg

SEQ ID NO: 2885294 - RNA, 14 nt, Human
aucugcuuuuauua

SEQ ID NO: 2885295 - RNA, 16 nt, Human
aucugcuuuuauuaaa

SEQ ID NO: 2885296 - RNA, 12 nt, Human
aucugcuucagu

SEQ ID NO: 2885297 - RNA, 21 nt, Human
aucuggaaaccucuacauauu

SEQ ID NO: 2885298 - RNA, 23 nt, Human
aucuggaaaccucuacauauuua

SEQ ID NO: 2885299 - RNA, 21 nt, Human
aucuggccccagguagaaacu

SEQ ID NO: 2885300 - RNA, 20 nt, Human
aucuggcccucgacacucac

SEQ ID NO: 2885301 - RNA, 21 nt, Human
aucuggcccucgacacucacc

SEQ ID NO: 2885302 - RNA, 23 nt, Human
aucuggccguugauguuggcugg

SEQ ID NO: 2885303 - RNA, 17 nt, Human
aucuggccuaaaaucuu

SEQ ID NO: 2885304 - RNA, 18 nt, Human
aucuggccuaaaaucuug

SEQ ID NO: 2885305 - RNA, 19 nt, Human
aucuggccuaaaaucuugg

SEQ ID NO: 2885306 - RNA, 20 nt, Human
aucuggccuaaaaucuugga

SEQ ID NO: 2885307 - RNA, 21 nt, Human
aucuggccuaaaaucuuggaa

SEQ ID NO: 2885308 - RNA, 22 nt, Human
aucuggccuaaaaucuuggaag

SEQ ID NO: 2885309 - RNA, 23 nt, Human
aucuggccuaaaaucuuggaagu

SEQ ID NO: 2885310 - RNA, 12 nt, Human
aucuggccuggc

SEQ ID NO: 2885311 - RNA, 13 nt, Human
aucuggccuggcc

SEQ ID NO: 2885312 - RNA, 19 nt, Human
aucuggacuccucugucca

SEQ ID NO: 2885313 - RNA, 15 nt, Human
aucuggacuccucug

SEQ ID NO: 2885314 - RNA, 16 nt, Human
aucuggacuccucugu

SEQ ID NO: 2885315 - RNA, 17 nt, Human
aucuggacuccucuguc

SEQ ID NO: 2885316 - RNA, 18 nt, Human
aucuggacuccucugucc

SEQ ID NO: 2885317 - RNA, 19 nt, Human
aucucugugugcacaaaua

SEQ ID NO: 2885318 - RNA, 13 nt, Human
aucucuguuaugu

SEQ ID NO: 2885319 - RNA, 16 nt, Human
aucucuguuauguacu

SEQ ID NO: 2885320 - RNA, 18 nt, Human
aucucuguuauguacugu

SEQ ID NO: 2885321 - RNA, 19 nt, Human
aucucuguuauguacugua

SEQ ID NO: 2885322 - RNA, 20 nt, Human
aucucuguuauguacuguac

SEQ ID NO: 2885323 - RNA, 15 nt, Human
aucucuuaaauuggg

SEQ ID NO: 2885324 - RNA, 23 nt, Human
aucucuuaaauuggguucaugau

SEQ ID NO: 2885325 - RNA, 17 nt, Human
aucucugugugcacaaa

SEQ ID NO: 2885326 - RNA, 15 nt, Human
aucucugugugcaca

SEQ ID NO: 2885327 - RNA, 17 nt, Human
aucucugcuuuggaaau

SEQ ID NO: 2885328 - RNA, 18 nt, Human
aucucuguacuuugcuug

SEQ ID NO: 2885329 - RNA, 12 nt, Human
aucucccuuccu

SEQ ID NO: 2885330 - RNA, 17 nt, Human
aucucgcucccucccag

SEQ ID NO: 2885331 - RNA, 15 nt, Human
aucuccuuucaggga

SEQ ID NO: 2885332 - RNA, 15 nt, Human
aucucggcucacugc

SEQ ID NO: 2885333 - RNA, 14 nt, Human
aucucggcucacug

SEQ ID NO: 2885334 - RNA, 19 nt, Human
aucucgcucccucccagga

SEQ ID NO: 2885335 - RNA, 19 nt, Human
aucucggagcaucccggag

SEQ ID NO: 2885336 - RNA, 16 nt, Human
aucucggcucacugca

SEQ ID NO: 2885337 - RNA, 16 nt, Human
aucugggaagauuucu

SEQ ID NO: 2885338 - RNA, 21 nt, Human
aucuucugccuuagucucagu

SEQ ID NO: 2885339 - RNA, 16 nt, Human
aucuggcugccuuugc

SEQ ID NO: 2885340 - RNA, 16 nt, Human
aucuggcuuauuuuaa

SEQ ID NO: 2885341 - RNA, 17 nt, Human
aucuggcuuauuuuaau

SEQ ID NO: 2885342 - RNA, 18 nt, Human
aucuggcuuauuuuaaug

SEQ ID NO: 2885343 - RNA, 19 nt, Human
aucuggcuuauuuuaaugu

SEQ ID NO: 2885344 - RNA, 21 nt, Human
aucuggcuuauuuuaauguga

SEQ ID NO: 2885345 - RNA, 22 nt, Human
aucuggcuuauuuuaaugugau

SEQ ID NO: 2885346 - RNA, 17 nt, Human
aucuggcuccuuuacaa

SEQ ID NO: 2885347 - RNA, 19 nt, Human
aucuggcuccuuuacaaaa

SEQ ID NO: 2885348 - RNA, 21 nt, Human
aucuggcuccuuuacaaaaga

SEQ ID NO: 2885349 - RNA, 15 nt, Human
aucuggccuggccug

SEQ ID NO: 2885350 - RNA, 16 nt, Human
aucuggccuggccugg

SEQ ID NO: 2885351 - RNA, 17 nt, Human
aucuggccuggccuggc

SEQ ID NO: 2885352 - RNA, 18 nt, Human
aucuggccuggccuggcc

SEQ ID NO: 2885353 - RNA, 22 nt, Human
aucuggccuggccuggcccugc

SEQ ID NO: 2885354 - RNA, 23 nt, Human
aucuggccuggccuggcccugcc

SEQ ID NO: 2885355 - RNA, 20 nt, Human
aucuucuuaugcaauuuccu

SEQ ID NO: 2885356 - RNA, 17 nt, Human
aucuucuuaugcaauuu

SEQ ID NO: 2885357 - RNA, 22 nt, Human
aucuucugguuuaaacuuguuu

SEQ ID NO: 2885358 - RNA, 15 nt, Human
aucucggcucagugc

SEQ ID NO: 2885359 - RNA, 12 nt, Human
aucuugaaugug

SEQ ID NO: 2885360 - RNA, 13 nt, Human
aucuugaaugugg

SEQ ID NO: 2885361 - RNA, 14 nt, Human
aucuugaauguggu

SEQ ID NO: 2885362 - RNA, 19 nt, Human
aucuugaauguggucucag

SEQ ID NO: 2885363 - RNA, 20 nt, Human
aucuugaauguggucucagg

SEQ ID NO: 2885364 - RNA, 21 nt, Human
aucuugaauguggucucagga

SEQ ID NO: 2885365 - RNA, 14 nt, Human
aucuugaagggccc

SEQ ID NO: 2885366 - RNA, 15 nt, Human
aucuugaagggccca

SEQ ID NO: 2885367 - RNA, 16 nt, Human
aucuugaagggcccag

SEQ ID NO: 2885368 - RNA, 17 nt, Human
aucuugaagggcccagg

SEQ ID NO: 2885369 - RNA, 19 nt, Human
augaaaaauagugucuuug

SEQ ID NO: 2885370 - RNA, 20 nt, Human
augaaaaauagugucuuugu

SEQ ID NO: 2885371 - RNA, 15 nt, Human
augaaaaaugaaaga

SEQ ID NO: 2885372 - RNA, 16 nt, Human
augaaaaaugaaagau

SEQ ID NO: 2885373 - RNA, 17 nt, Human
augaaaaaugaaagaug

SEQ ID NO: 2885374 - RNA, 19 nt, Human
augaaaaaugaaagaugau

SEQ ID NO: 2885375 - RNA, 13 nt, Human
augaaaaacaacc

SEQ ID NO: 2885376 - RNA, 22 nt, Human
augaaggcagaaaaaugucauu

SEQ ID NO: 2885377 - RNA, 17 nt, Human
augaaggcuuuuggucu

SEQ ID NO: 2885378 - RNA, 21 nt, Human
augaaggagaggcaacaucca

SEQ ID NO: 2885379 - RNA, 23 nt, Human
augaaguuuccuuggcuggugca

SEQ ID NO: 2885380 - RNA, 19 nt, Human
augaaguuuccuuggcugg

SEQ ID NO: 2885381 - RNA, 13 nt, Human
augaaguaaagaa

SEQ ID NO: 2885382 - RNA, 21 nt, Human
augaaguaaagaacugcacau

SEQ ID NO: 2885383 - RNA, 22 nt, Human
augaaguaaagccauuaaauga

SEQ ID NO: 2885384 - RNA, 18 nt, Human
augaaguuugaacuucau

SEQ ID NO: 2885385 - RNA, 19 nt, Human
augaaguuugaacuucaua

SEQ ID NO: 2885386 - RNA, 16 nt, Human
augaaguuuuacauug

SEQ ID NO: 2885387 - RNA, 14 nt, Human
augaaguuuuacau

SEQ ID NO: 2885388 - RNA, 22 nt, Human
augaaguuuguaguuguuuuaa

SEQ ID NO: 2885389 - RNA, 19 nt, Human
augagcucuacccagggcc

SEQ ID NO: 2885390 - RNA, 18 nt, Human
augagcucuacccagggc

SEQ ID NO: 2885391 - RNA, 16 nt, Human
augagcucuacccagg

SEQ ID NO: 2885392 - RNA, 15 nt, Human
augagcucuacccag

SEQ ID NO: 2885393 - RNA, 17 nt, Human
augacgcugauacauaa

SEQ ID NO: 2885394 - RNA, 22 nt, Human
augagcuccucuuccuggcuuc

SEQ ID NO: 2885395 - RNA, 14 nt, Human
augagcuccucuuc

SEQ ID NO: 2885396 - RNA, 13 nt, Human
augaggacauguu

SEQ ID NO: 2885397 - RNA, 21 nt, Human
augaggaggggccccccugcc

SEQ ID NO: 2885398 - RNA, 18 nt, Human
augaggcaaugucaggaa

SEQ ID NO: 2885399 - RNA, 18 nt, Human
augaggcaaccugauugu

SEQ ID NO: 2885400 - RNA, 19 nt, Human
augaggcaaccugauugua

SEQ ID NO: 2885401 - RNA, 20 nt, Human
augaggcaaccugauuguaa

SEQ ID NO: 2885402 - RNA, 21 nt, Human
augaggcaaugucaggaacag

SEQ ID NO: 2885403 - RNA, 22 nt, Human
augaggaacuguagaugaugua

SEQ ID NO: 2885404 - RNA, 14 nt, Human
augaggaauaauua

SEQ ID NO: 2885405 - RNA, 23 nt, Human
augaggaauaauuauuuauuuaa

SEQ ID NO: 2885406 - RNA, 21 nt, Human
augaggaacuguagaugaugu

SEQ ID NO: 2885407 - RNA, 22 nt, Human
augagcucuacccagggccugc

SEQ ID NO: 2885408 - RNA, 16 nt, Human
augaggaacuguagau

SEQ ID NO: 2885409 - RNA, 21 nt, Human
augaggaggaugucccugggc

SEQ ID NO: 2885410 - RNA, 24 nt, Human
augaggaggaugucccugggccag

SEQ ID NO: 2885411 - RNA, 21 nt, Human
augaggagaaaaaaagcaugu

SEQ ID NO: 2885412 - RNA, 17 nt, Human
augaggagagaaaauau

SEQ ID NO: 2885413 - RNA, 18 nt, Human
augaggagagaaaauaua

SEQ ID NO: 2885414 - RNA, 19 nt, Human
augaggagagaaaauauau

SEQ ID NO: 2885415 - RNA, 22 nt, Human
uaaauaacaggcauuuguucac

SEQ ID NO: 2885416 - RNA, 19 nt, Human
uaaauauaauucuguaaau

SEQ ID NO: 2885417 - RNA, 16 nt, Human
uaaauauaauucugua

SEQ ID NO: 2885418 - RNA, 18 nt, Human
uaaauauaauucuguaaa

SEQ ID NO: 2885419 - RNA, 13 nt, Human
uaaauauaauucu

SEQ ID NO: 2885420 - RNA, 15 nt, Human
uaaauauaauucugu

SEQ ID NO: 2885421 - RNA, 14 nt, Human
uaaauauaagccuu

SEQ ID NO: 2885422 - RNA, 22 nt, Human
uaaauauaagccuuuuauacug

SEQ ID NO: 2885423 - RNA, 18 nt, Human
uaaauaguauuugagagu

SEQ ID NO: 2885424 - RNA, 15 nt, Human
uaaaucuaaaucuau

SEQ ID NO: 2885425 - RNA, 19 nt, Human
uaaaucuaaaucuauuuau

SEQ ID NO: 2885426 - RNA, 17 nt, Human
uaaauccugccauuuaa

SEQ ID NO: 2885427 - RNA, 18 nt, Human
uaaauccugccauuuaaa

SEQ ID NO: 2885428 - RNA, 14 nt, Human
uaaaucuaaaucua

SEQ ID NO: 2885429 - RNA, 21 nt, Human
uaaauaggagaggaugagagc

SEQ ID NO: 2885430 - RNA, 16 nt, Human
uaaauaggagaggaug

SEQ ID NO: 2885431 - RNA, 19 nt, Human
uaaauaguaaaaauaaaau

SEQ ID NO: 2885432 - RNA, 20 nt, Human
uaaauaguaaaaauaaaauu

SEQ ID NO: 2885433 - RNA, 18 nt, Human
uaaauacacaacacacac

SEQ ID NO: 2885434 - RNA, 14 nt, Human
uaaauaauuuaacu

SEQ ID NO: 2885435 - RNA, 16 nt, Human
uaaauaauuuaacuac

SEQ ID NO: 2885436 - RNA, 17 nt, Human
uaaauaauuuaacuacc

SEQ ID NO: 2885437 - RNA, 16 nt, Human
uaacaaguaccaaagu

SEQ ID NO: 2885438 - RNA, 21 nt, Human
uaacaaguaccaaaguuuuau

SEQ ID NO: 2885439 - RNA, 13 nt, Human
uaacaagccaccc

SEQ ID NO: 2885440 - RNA, 13 nt, Human
uaacaagaagaug

SEQ ID NO: 2885441 - RNA, 14 nt, Human
uaacaagaagauga

SEQ ID NO: 2885442 - RNA, 15 nt, Human
uaacaagaagaugaa

SEQ ID NO: 2885443 - RNA, 16 nt, Human
uaacaagaagaugaau

SEQ ID NO: 2885444 - RNA, 18 nt, Human
uaacaagaagaugaaugg

SEQ ID NO: 2885445 - RNA, 19 nt, Human
uaacaagaagaugaauggc

SEQ ID NO: 2885446 - RNA, 15 nt, Human
uaacaagaaaaucaa

SEQ ID NO: 2885447 - RNA, 16 nt, Human
uaacaacuaugauuug

SEQ ID NO: 2885448 - RNA, 21 nt, Human
uaacaacuaugauuuggaaaa

SEQ ID NO: 2885449 - RNA, 22 nt, Human
uaacaacuaugauuuggaaaau

SEQ ID NO: 2885450 - RNA, 13 nt, Human
uaacaaccuggcc

SEQ ID NO: 2885451 - RNA, 13 nt, Human
uaacaaauucuga

SEQ ID NO: 2885452 - RNA, 19 nt, Human
uaacaaaugcuauuaaagu

SEQ ID NO: 2885453 - RNA, 20 nt, Human
uaacaaaugcuauuaaagug

SEQ ID NO: 2885454 - RNA, 17 nt, Human
uaacaaauaugcuaauu

SEQ ID NO: 2885455 - RNA, 18 nt, Human
uaacaaauaugcuaauuu

SEQ ID NO: 2885456 - RNA, 23 nt, Human
uaacaaaaaaauauauuuaauga

SEQ ID NO: 2885457 - RNA, 20 nt, Human
uaacaaaaaaauauauuuaa

SEQ ID NO: 2885458 - RNA, 15 nt, Human
uaacaaaaaagcuaa

SEQ ID NO: 2885459 - RNA, 22 nt, Human
uaacaaaacacucggcauuuca

SEQ ID NO: 2885460 - RNA, 12 nt, Human
uaacaaaagaug

SEQ ID NO: 2885461 - RNA, 14 nt, Human
uaacaaaagaugaa

SEQ ID NO: 2885462 - RNA, 15 nt, Human
uaacaaaagaugaaa

SEQ ID NO: 2885463 - RNA, 18 nt, Human
uaacaaaagaugaaagca

SEQ ID NO: 2885464 - RNA, 20 nt, Human
uaacaaaagaugaaagcagg

SEQ ID NO: 2885465 - RNA, 21 nt, Human
uaacaaaaguucccugaaaca

SEQ ID NO: 2885466 - RNA, 16 nt, Human
uaaauuuugaguucua

SEQ ID NO: 2885467 - RNA, 15 nt, Human
uaaauuuuaauuuau

SEQ ID NO: 2885468 - RNA, 16 nt, Human
uaaauuuuacccuuua

SEQ ID NO: 2885469 - RNA, 15 nt, Human
uaaauuuucugaaac

SEQ ID NO: 2885470 - RNA, 18 nt, Human
uaaauuuuacccuuuaga

SEQ ID NO: 2885471 - RNA, 14 nt, Human
uaaaugaucugccu

SEQ ID NO: 2885472 - RNA, 17 nt, Human
uaaaugauucuuaguga

SEQ ID NO: 2885473 - RNA, 16 nt, Human
uaaaugcaaaguucug

SEQ ID NO: 2885474 - RNA, 19 nt, Human
uaaaugcaaaguucugugu

SEQ ID NO: 2885475 - RNA, 21 nt, Human
uaaaugcaaaguucuguguuu

SEQ ID NO: 2885476 - RNA, 10 nt, Human
uaaauguuug

SEQ ID NO: 2885477 - RNA, 11 nt, Human
uaaauguuuga

SEQ ID NO: 2885478 - RNA, 17 nt, Human
uaaauguuugacacaau

SEQ ID NO: 2885479 - RNA, 22 nt, Human
uaaauguuugacacaauuggaa

SEQ ID NO: 2885480 - RNA, 14 nt, Human
uaaauguuuuauaa

SEQ ID NO: 2885481 - RNA, 16 nt, Human
uaaauguuuuauaagu

SEQ ID NO: 2885482 - RNA, 17 nt, Human
uaaauguuuuauaaguu

SEQ ID NO: 2885483 - RNA, 19 nt, Human
uaaauguuuuauaaguuca

SEQ ID NO: 2885484 - RNA, 22 nt, Human
uaaauguuuuauaaguucacaa

SEQ ID NO: 2885485 - RNA, 22 nt, Human
uaaaugagcaaauaucauacug

SEQ ID NO: 2885486 - RNA, 12 nt, Human
uaaauuaagaca

SEQ ID NO: 2885487 - RNA, 15 nt, Human
uaaauuaagacaugc

SEQ ID NO: 2885488 - RNA, 13 nt, Human
uaaauuaagacau

SEQ ID NO: 2885489 - RNA, 22 nt, Human
uaaauuaggaggcucaacaaua

SEQ ID NO: 2885490 - RNA, 23 nt, Human
uaaauuaggaggcucaacaauaa

SEQ ID NO: 2885491 - RNA, 22 nt, Human
aauaaaaauauuguguugugaa

SEQ ID NO: 2885492 - RNA, 17 nt, Human
aauaaaaacuuacacuc

SEQ ID NO: 2885493 - RNA, 18 nt, Human
aauaaaaacccacaaaaa

SEQ ID NO: 2885494 - RNA, 21 nt, Human
aauaaaaacccacaaaaaugu

SEQ ID NO: 2885495 - RNA, 12 nt, Human
aauaaaaacuau

SEQ ID NO: 2885496 - RNA, 19 nt, Human
aauaaaaacuauucgaaug

SEQ ID NO: 2885497 - RNA, 23 nt, Human
aauaaaaacauugccuuugaaug

SEQ ID NO: 2885498 - RNA, 19 nt, Human
aauaaaaaauuaugacaau

SEQ ID NO: 2885499 - RNA, 21 nt, Human
aauaaaaaauuaugacaaugu

SEQ ID NO: 2885500 - RNA, 13 nt, Human
aauaaaaaugaua

SEQ ID NO: 2885501 - RNA, 11 nt, Human
aauaaaagccu

SEQ ID NO: 2885502 - RNA, 14 nt, Human
aauaaaagugcaca

SEQ ID NO: 2885503 - RNA, 19 nt, Human
aauaaaagugcacaccuua

SEQ ID NO: 2885504 - RNA, 19 nt, Human
aauaaaaguuuuacaaagg

SEQ ID NO: 2885505 - RNA, 20 nt, Human
aauaaaaguuuuacaaaggg

SEQ ID NO: 2885506 - RNA, 16 nt, Human
aauaaaaucuugaaaa

SEQ ID NO: 2885507 - RNA, 13 nt, Human
aauaaaaucaauu

SEQ ID NO: 2885508 - RNA, 16 nt, Human
aauaaaaucaauuuuu

SEQ ID NO: 2885509 - RNA, 17 nt, Human
aauaaaauaauucuaaa

SEQ ID NO: 2885510 - RNA, 15 nt, Human
aauaaaauaauucua

SEQ ID NO: 2885511 - RNA, 16 nt, Human
aauaaaauaauucuaa

SEQ ID NO: 2885512 - RNA, 18 nt, Human
aauaaaggaugugauugu

SEQ ID NO: 2885513 - RNA, 15 nt, Human
aauaaaguauauaua

SEQ ID NO: 2885514 - RNA, 16 nt, Human
aauaaaguacaagagc

SEQ ID NO: 2885515 - RNA, 13 nt, Human
aauaaaaaaugga

SEQ ID NO: 2885516 - RNA, 18 nt, Human
uaaaguguaaguucacaa

SEQ ID NO: 2885517 - RNA, 12 nt, Human
uaaaguguaaua

SEQ ID NO: 2885518 - RNA, 16 nt, Human
uaaaguguaauaauau

SEQ ID NO: 2885519 - RNA, 18 nt, Human
uaaaguguaauaauauga

SEQ ID NO: 2885520 - RNA, 21 nt, Human
uaaaguggguuauucuggagu

SEQ ID NO: 2885521 - RNA, 22 nt, Human
uaaaguggguuauucuggaguu

SEQ ID NO: 2885522 - RNA, 20 nt, Human
uaaagugcuaagguucuaag

SEQ ID NO: 2885523 - RNA, 21 nt, Human
uaaagugcuaagguucuaagg

SEQ ID NO: 2885524 - RNA, 22 nt, Human
uaaagugcuaagguucuaaggc

SEQ ID NO: 2885525 - RNA, 11 nt, Human
uaaagugcuug

SEQ ID NO: 2885526 - RNA, 15 nt, Human
uaaagugcuugugua

SEQ ID NO: 2885527 - RNA, 16 nt, Human
uaaagugcuuguguaa

SEQ ID NO: 2885528 - RNA, 17 nt, Human
uaaagugcuuguguaau

SEQ ID NO: 2885529 - RNA, 19 nt, Human
uaaaguccuuuucuugcuu

SEQ ID NO: 2885530 - RNA, 21 nt, Human
uaaaguccuuuucuugcuuac

SEQ ID NO: 2885531 - RNA, 16 nt, Human
uaaagucuauggacag

SEQ ID NO: 2885532 - RNA, 14 nt, Human
uaaagucugaauca

SEQ ID NO: 2885533 - RNA, 21 nt, Human
uaaagggaaaggauucaugug

SEQ ID NO: 2885534 - RNA, 16 nt, Human
uaaagugauaauuucu

SEQ ID NO: 2885535 - RNA, 16 nt, Human
uaaagugaagaauccu

SEQ ID NO: 2885536 - RNA, 14 nt, Human
uaaagugaauuguu

SEQ ID NO: 2885537 - RNA, 22 nt, Human
uaaagugaauuguugacaaaug

SEQ ID NO: 2885538 - RNA, 15 nt, Human
uaaagugcuaagguu

SEQ ID NO: 2885539 - RNA, 16 nt, Human
uaaagugcuaagguuc

SEQ ID NO: 2885540 - RNA, 17 nt, Human
uaaagugcuaagguucu

SEQ ID NO: 2885541 - RNA, 18 nt, Human
uaaagugcuaagguucua

SEQ ID NO: 2885542 - RNA, 19 nt, Human
uaaagugcuaagguucuaa

SEQ ID NO: 2885543 - RNA, 20 nt, Human
aauaacacacauauaaacau

SEQ ID NO: 2885544 - RNA, 19 nt, Human
aauaacacuaaaauuuuag

SEQ ID NO: 2885545 - RNA, 21 nt, Human
aauaaauucccaacuucucuu

SEQ ID NO: 2885546 - RNA, 14 nt, Human
aauaaauugaaauu

SEQ ID NO: 2885547 - RNA, 15 nt, Human
aauaacaaagcccuu

SEQ ID NO: 2885548 - RNA, 14 nt, Human
aauaacaaaaugga

SEQ ID NO: 2885549 - RNA, 15 nt, Human
aauaacaaaauggac

SEQ ID NO: 2885550 - RNA, 14 nt, Human
aauaaauuaguugu

SEQ ID NO: 2885551 - RNA, 16 nt, Human
aauaaauuaguuguua

SEQ ID NO: 2885552 - RNA, 14 nt, Human
aauaaauaaaagcc

SEQ ID NO: 2885553 - RNA, 19 nt, Human
aauaaaguuugcuuagaaa

SEQ ID NO: 2885554 - RNA, 14 nt, Human
aauaaauagagcaa

SEQ ID NO: 2885555 - RNA, 21 nt, Human
aauaaauagagcaauuacaag

SEQ ID NO: 2885556 - RNA, 20 nt, Human
aauaauuagguuaacauugu

SEQ ID NO: 2885557 - RNA, 22 nt, Human
aauaauuagguuaacauuguug

SEQ ID NO: 2885558 - RNA, 16 nt, Human
aauaaguauuuauaau

SEQ ID NO: 2885559 - RNA, 21 nt, Human
aauaaggcaggcauugaggaa

SEQ ID NO: 2885560 - RNA, 14 nt, Human
aauaagcucuaguu

SEQ ID NO: 2885561 - RNA, 15 nt, Human
aauaagcucuaguuc

SEQ ID NO: 2885562 - RNA, 22 nt, Human
aauaagcucuaguucuuaacaa

SEQ ID NO: 2885563 - RNA, 14 nt, Human
aauaagcaggaugu

SEQ ID NO: 2885564 - RNA, 12 nt, Human
aauaagauucua

SEQ ID NO: 2885565 - RNA, 13 nt, Human
aauaagauucuaa

SEQ ID NO: 2885566 - RNA, 14 nt, Human
aauaagauucuaac

SEQ ID NO: 2885567 - RNA, 15 nt, Human
aauaagcaaaauccu

SEQ ID NO: 2885568 - RNA, 21 nt, Human
aauaacaggcauuuguucacu

SEQ ID NO: 2885569 - RNA, 20 nt, Human
aauaacauaauuuguacaua

SEQ ID NO: 2885570 - RNA, 19 nt, Human
aauaacuaguguugcuugg

SEQ ID NO: 2885571 - RNA, 13 nt, Human
uaaacaaacauug

SEQ ID NO: 2885572 - RNA, 15 nt, Human
uaaacaaacauugug

SEQ ID NO: 2885573 - RNA, 22 nt, Human
uaaacaaacauuguguugacau

SEQ ID NO: 2885574 - RNA, 14 nt, Human
uaaacaaaccagaa

SEQ ID NO: 2885575 - RNA, 13 nt, Human
uaaacaaacucuu

SEQ ID NO: 2885576 - RNA, 17 nt, Human
uaaacaaacucuugaag

SEQ ID NO: 2885577 - RNA, 16 nt, Human
uaaacaaagauucaug

SEQ ID NO: 2885578 - RNA, 13 nt, Human
uaaacaaagguug

SEQ ID NO: 2885579 - RNA, 18 nt, Human
uaaaccaguuuagauuuc

SEQ ID NO: 2885580 - RNA, 19 nt, Human
uaaaccaguuuagauuuca

SEQ ID NO: 2885581 - RNA, 18 nt, Human
uaaacaaagauucaugau

SEQ ID NO: 2885582 - RNA, 22 nt, Human
uaaaccaccagugcccaaaguc

SEQ ID NO: 2885583 - RNA, 12 nt, Human
uaaaccaauuuu

SEQ ID NO: 2885584 - RNA, 18 nt, Human
uaaacaaaauagaagcug

SEQ ID NO: 2885585 - RNA, 23 nt, Human
uaaacaaaauagaagcuguagua

SEQ ID NO: 2885586 - RNA, 16 nt, Human
uaaaauuuuuuugguc

SEQ ID NO: 2885587 - RNA, 22 nt, Human
uaaaauuuuuuuggucuuuuug

SEQ ID NO: 2885588 - RNA, 22 nt, Human
uaaaauuuuaggcacucuuaaa

SEQ ID NO: 2885589 - RNA, 19 nt, Human
uaaaauuuugcuuuuaauu

SEQ ID NO: 2885590 - RNA, 21 nt, Human
uaaaauuuugcuuuuaauuaa

SEQ ID NO: 2885591 - RNA, 17 nt, Human
uaaaauuaugaaucuga

SEQ ID NO: 2885592 - RNA, 20 nt, Human
uaaaauuaugaaucugauuu

SEQ ID NO: 2885593 - RNA, 22 nt, Human
uaaaauuaucaauaucuaauau

SEQ ID NO: 2885594 - RNA, 16 nt, Human
uaaaauuaaagcugaa

SEQ ID NO: 2885595 - RNA, 18 nt, Human
uaaaauuaaagcugaaaa

SEQ ID NO: 2885596 - RNA, 19 nt, Human
uaaaauuaaagcugaaaac

SEQ ID NO: 2885597 - RNA, 11 nt, Human
uaaaauuagau

SEQ ID NO: 2885598 - RNA, 16 nt, Human
uaaaauuagaugcaug

SEQ ID NO: 2885599 - RNA, 18 nt, Human
aaguuuugaaaagcuauu

SEQ ID NO: 2885600 - RNA, 12 nt, Human
aaguuuugaaaa

SEQ ID NO: 2885601 - RNA, 13 nt, Human
aaguuuugaaaag

SEQ ID NO: 2885602 - RNA, 15 nt, Human
aaguuuugaaaagcu

SEQ ID NO: 2885603 - RNA, 16 nt, Human
aaguuuugaaaagcua

SEQ ID NO: 2885604 - RNA, 20 nt, Human
aaguuuugaguagauauuac

SEQ ID NO: 2885605 - RNA, 23 nt, Human
aaguuuugaguagauauuacuuu

SEQ ID NO: 2885606 - RNA, 23 nt, Human
aaguuuuggguauguuuaaucug

SEQ ID NO: 2885607 - RNA, 14 nt, Human
uaaaauguugaaua

SEQ ID NO: 2885608 - RNA, 13 nt, Human
aaguuuuaucaag

SEQ ID NO: 2885609 - RNA, 23 nt, Human
aaguuuucagaaccucuucccca

SEQ ID NO: 2885610 - RNA, 22 nt, Human
aaguuuucccuugaggaaacaa

SEQ ID NO: 2885611 - RNA, 13 nt, Human
aaguuuuccugag

SEQ ID NO: 2885612 - RNA, 13 nt, Human
aaguuuucuguag

SEQ ID NO: 2885613 - RNA, 21 nt, Human
aaguuuucuguagucauuuac

SEQ ID NO: 2885614 - RNA, 22 nt, Human
aaguuuucuguagucauuuacu

SEQ ID NO: 2885615 - RNA, 21 nt, Human
aaguuuucccuugaggaaaca

SEQ ID NO: 2885616 - RNA, 23 nt, Human
aaguuuguuagauagcugcaugu

SEQ ID NO: 2885617 - RNA, 13 nt, Human
aaguuuuaaugua

SEQ ID NO: 2885618 - RNA, 14 nt, Human
aaguuuuaauguau

SEQ ID NO: 2885619 - RNA, 12 nt, Human
aaguuuauucuc

SEQ ID NO: 2885620 - RNA, 16 nt, Human
aaguuuauucucauuu

SEQ ID NO: 2885621 - RNA, 12 nt, Human
aaguuucaggug

SEQ ID NO: 2885622 - RNA, 14 nt, Human
aaguuucaggugac

SEQ ID NO: 2885623 - RNA, 15 nt, Human
aaguuucaggugaca

SEQ ID NO: 2885624 - RNA, 16 nt, Human
aaguuucaggugacau

SEQ ID NO: 2885625 - RNA, 16 nt, Human
aaguuucaaugugauu

SEQ ID NO: 2885626 - RNA, 22 nt, Human
aaguuucaaugugauucuaaug

SEQ ID NO: 2885627 - RNA, 20 nt, Human
aaguuucaaacuuacuauuu

SEQ ID NO: 2885628 - RNA, 22 nt, Human
aaguuucaaacuuacuauuuug

SEQ ID NO: 2885629 - RNA, 16 nt, Human
aaguuugcuuagaaaa

SEQ ID NO: 2885630 - RNA, 15 nt, Human
aaguuugcuuguuuc

SEQ ID NO: 2885631 - RNA, 16 nt, Human
aaguuugcuuguuucu

SEQ ID NO: 2885632 - RNA, 19 nt, Human
aaguuugcuuguuucuugg

SEQ ID NO: 2885633 - RNA, 15 nt, Human
aaguuugcuuagaaa

SEQ ID NO: 2885634 - RNA, 19 nt, Human
aaguuuggcaauaguuugc

SEQ ID NO: 2885635 - RNA, 19 nt, Human
aaguuuguaguuguuuuaa

SEQ ID NO: 2885636 - RNA, 20 nt, Human
aaguuuguccauuuguaaaa

SEQ ID NO: 2885637 - RNA, 13 nt, Human
aaguuugcuuaga

SEQ ID NO: 2885638 - RNA, 21 nt, Human
aaguuugcacuguaugcugga

SEQ ID NO: 2885639 - RNA, 20 nt, Human
aaguuugccuuuguaccaua

SEQ ID NO: 2885640 - RNA, 14 nt, Human
aaguuugcacugua

SEQ ID NO: 2885641 - RNA, 17 nt, Human
aaguuucaggugacaug

SEQ ID NO: 2885642 - RNA, 19 nt, Human
aaguuucaggugacaugug

SEQ ID NO: 2885643 - RNA, 21 nt, Human
aaguuucaggugacaugugaa

SEQ ID NO: 2885644 - RNA, 22 nt, Human
aaguuucaggugacaugugaaa

SEQ ID NO: 2885645 - RNA, 16 nt, Human
aaguucucaaugugaa

SEQ ID NO: 2885646 - RNA, 13 nt, Human
aaguucucauugu

SEQ ID NO: 2885647 - RNA, 19 nt, Human
aaguuuacauuguaaauag

SEQ ID NO: 2885648 - RNA, 12 nt, Human
aaguuuacauuu

SEQ ID NO: 2885649 - RNA, 13 nt, Human
aaguuuacauuuu

SEQ ID NO: 2885650 - RNA, 16 nt, Human
aaguuuacauuuuuau

SEQ ID NO: 2885651 - RNA, 22 nt, Human
aaguuuacauuuuuauuuauga

SEQ ID NO: 2885652 - RNA, 23 nt, Human
aaguuuacauuuuuauuuaugaa

SEQ ID NO: 2885653 - RNA, 18 nt, Human
aaguuuacauuguaaaua

SEQ ID NO: 2885654 - RNA, 23 nt, Human
aaguuuacaaguguauaucagaa

SEQ ID NO: 2885655 - RNA, 18 nt, Human
aaguuuacaaguguauau

SEQ ID NO: 2885656 - RNA, 21 nt, Human
aaguuuacaaguguauaucag

SEQ ID NO: 2885657 - RNA, 17 nt, Human
aaguucagaguuuucug

SEQ ID NO: 2885658 - RNA, 19 nt, Human
aaguucagaguuuucuggg

SEQ ID NO: 2885659 - RNA, 22 nt, Human
aaguucagcacuugucucauuu

SEQ ID NO: 2885660 - RNA, 19 nt, Human
aaguucauaccuaaguacu

SEQ ID NO: 2885661 - RNA, 21 nt, Human
aaguucauaccuaaguacugu

SEQ ID NO: 2885662 - RNA, 22 nt, Human
aaguucauaccuaaguacugua

SEQ ID NO: 2885663 - RNA, 23 nt, Human
aaguucauaccuaaguacuguaa

SEQ ID NO: 2885664 - RNA, 22 nt, Human
aaguucauauuccauauuuauu

SEQ ID NO: 2885665 - RNA, 23 nt, Human
aaguucauauuccauauuuauuc

SEQ ID NO: 2885666 - RNA, 15 nt, Human
aaguucauauuccau

SEQ ID NO: 2885667 - RNA, 21 nt, Human
aaguucauauuccauauuuau

SEQ ID NO: 2885668 - RNA, 15 nt, Human
aaguuccaagagucu

SEQ ID NO: 2885669 - RNA, 16 nt, Human
aaguuccaagagucua

SEQ ID NO: 2885670 - RNA, 17 nt, Human
aaguuccaagagucuaa

SEQ ID NO: 2885671 - RNA, 20 nt, Human
aaguuccaagagucuaaaga

SEQ ID NO: 2885672 - RNA, 21 nt, Human
aaguuccaagagucuaaagau

SEQ ID NO: 2885673 - RNA, 14 nt, Human
aaguuccaagucca

SEQ ID NO: 2885674 - RNA, 12 nt, Human
aaguucuaagau

SEQ ID NO: 2885675 - RNA, 11 nt, Human
aaguucuaaga

SEQ ID NO: 2885676 - RNA, 21 nt, Human
aaguucuaauaauuucuaaug

SEQ ID NO: 2885677 - RNA, 17 nt, Human
aaguucuaagauucuga

SEQ ID NO: 2885678 - RNA, 17 nt, Human
aaguucuaauaauuucu

SEQ ID NO: 2885679 - RNA, 18 nt, Human
aaguucuaauaauuucua

SEQ ID NO: 2885680 - RNA, 19 nt, Human
aaguucuaauaauuucuaa

SEQ ID NO: 2885681 - RNA, 14 nt, Human
aaguucuaagauuc

SEQ ID NO: 2885682 - RNA, 15 nt, Human
aaguucuaagauucu

SEQ ID NO: 2885683 - RNA, 16 nt, Human
aaguucuaagauucua

SEQ ID NO: 2885684 - RNA, 18 nt, Human
aaguucuaagauucuaau

SEQ ID NO: 2885685 - RNA, 19 nt, Human
aaguucuaagauucuaaug

SEQ ID NO: 2885686 - RNA, 20 nt, Human
aaguucuaagauucuaauga

SEQ ID NO: 2885687 - RNA, 21 nt, Human
aaguucuaagauucuaaugau

SEQ ID NO: 2885688 - RNA, 16 nt, Human
aaguucuaagauucug

SEQ ID NO: 2885689 - RNA, 17 nt, Human
aaguuauuagugguuua

SEQ ID NO: 2885690 - RNA, 20 nt, Human
aaguuauuagugguuuauca

SEQ ID NO: 2885691 - RNA, 14 nt, Human
aaguuagaaucuau

SEQ ID NO: 2885692 - RNA, 15 nt, Human
aaguuagaaucuauu

SEQ ID NO: 2885693 - RNA, 16 nt, Human
aaguuagaaucuauuu

SEQ ID NO: 2885694 - RNA, 17 nt, Human
aaguuagaaucuauuuu

SEQ ID NO: 2885695 - RNA, 19 nt, Human
aaguuagaaucuauuuucu

SEQ ID NO: 2885696 - RNA, 13 nt, Human
aaguuacuuucuu

SEQ ID NO: 2885697 - RNA, 16 nt, Human
aaguuacuuucuuaau

SEQ ID NO: 2885698 - RNA, 13 nt, Human
aaguuacagaaau

SEQ ID NO: 2885699 - RNA, 19 nt, Human
aaguuacagaaauacuaua

SEQ ID NO: 2885700 - RNA, 23 nt, Human
aaguguuuuguucuuucuggagu

SEQ ID NO: 2885701 - RNA, 14 nt, Human
aaguguuucuguua

SEQ ID NO: 2885702 - RNA, 21 nt, Human
aaguguuuauuuuucauauug

SEQ ID NO: 2885703 - RNA, 15 nt, Human
aaguguuucagcuaa

SEQ ID NO: 2885704 - RNA, 21 nt, Human
aaguguuucuguuauuaacaa

SEQ ID NO: 2885705 - RNA, 23 nt, Human
aaguguuucuguuauuaacaaac

SEQ ID NO: 2885706 - RNA, 15 nt, Human
aaguguuuauuuuuc

SEQ ID NO: 2885707 - RNA, 16 nt, Human
aaguguuuauuuuuca

SEQ ID NO: 2885708 - RNA, 19 nt, Human
aaguguuuauuuuucauau

SEQ ID NO: 2885709 - RNA, 18 nt, Human
aaguguugaagggaggug

SEQ ID NO: 2885710 - RNA, 21 nt, Human
aaguguuauuuuucaaggaag

SEQ ID NO: 2885711 - RNA, 22 nt, Human
aaguguuauuuuucaaggaagg

SEQ ID NO: 2885712 - RNA, 15 nt, Human
aaguguuagauagaa

SEQ ID NO: 2885713 - RNA, 16 nt, Human
guuuuuuuuuuuaaaa

SEQ ID NO: 2885714 - RNA, 21 nt, Human
guuuuuuuuuuuaaaaaaaga

SEQ ID NO: 2885715 - RNA, 22 nt, Human
guuuuuuuuuuuaaaaaaagaa

SEQ ID NO: 2885716 - RNA, 23 nt, Human
guuuuuuuuuuuaaaaaaagaaa

SEQ ID NO: 2885717 - RNA, 20 nt, Human
guuuuuuuuuuuuuuaugug

SEQ ID NO: 2885718 - RNA, 23 nt, Human
guuuuuuuuuuuuuuaugugauc

SEQ ID NO: 2885719 - RNA, 19 nt, Human
guuuuuuuuuuuuuuuugg

SEQ ID NO: 2885720 - RNA, 21 nt, Human
guuuuuuuuuuuuuuuuggcu

SEQ ID NO: 2885721 - RNA, 18 nt, Human
uaaaaaaaaaaaaaagcu

SEQ ID NO: 2885722 - RNA, 19 nt, Human
uaaaaaaaaaaaaaagcuu

SEQ ID NO: 2885723 - RNA, 20 nt, Human
uaaaaaaaaaaaaaagcuuu

SEQ ID NO: 2885724 - RNA, 14 nt, Human
guuuuuuuuucauu

SEQ ID NO: 2885725 - RNA, 14 nt, Human
uaaaccccuguccc

SEQ ID NO: 2885726 - RNA, 15 nt, Human
uaaaccccuguccca

SEQ ID NO: 2885727 - RNA, 19 nt, Human
uaaaccucaaaaugucuaa

SEQ ID NO: 2885728 - RNA, 18 nt, Human
uaaaccucaaaaugucua

SEQ ID NO: 2885729 - RNA, 20 nt, Human
uaaaccgcuuuggccugagu

SEQ ID NO: 2885730 - RNA, 15 nt, Human
uaaaccuccgccaau

SEQ ID NO: 2885731 - RNA, 20 nt, Human
uaaaccugucuccacugugc

SEQ ID NO: 2885732 - RNA, 19 nt, Human
uaaaccuguuuuuuuuuca

SEQ ID NO: 2885733 - RNA, 20 nt, Human
uaaaccuguuuuuuuuucau

SEQ ID NO: 2885734 - RNA, 21 nt, Human
uaaaccuguuuuuuuuucauu

SEQ ID NO: 2885735 - RNA, 15 nt, Human
uaaacggauuccaaa

SEQ ID NO: 2885736 - RNA, 16 nt, Human
uaaacgguucaguuuc

SEQ ID NO: 2885737 - RNA, 20 nt, Human
uaaacgguucaguuucuucu

SEQ ID NO: 2885738 - RNA, 21 nt, Human
uaaacgguucaguuucuucug

SEQ ID NO: 2885739 - RNA, 17 nt, Human
uaaacguaagcacuguu

SEQ ID NO: 2885740 - RNA, 18 nt, Human
uaaacguaagcacuguuu

SEQ ID NO: 2885741 - RNA, 19 nt, Human
uaaacgcaagcugagcugg

SEQ ID NO: 2885742 - RNA, 16 nt, Human
uaaacgcauuaucagc

SEQ ID NO: 2885743 - RNA, 11 nt, Human
uaaagaaaguc

SEQ ID NO: 2885744 - RNA, 17 nt, Human
uaaagaaagucgaauua

SEQ ID NO: 2885745 - RNA, 21 nt, Human
uaaagaaagucgaauuaauag

SEQ ID NO: 2885746 - RNA, 16 nt, Human
uaaagaaagcaacuuu

SEQ ID NO: 2885747 - RNA, 11 nt, Human
uaaacugccau

SEQ ID NO: 2885748 - RNA, 13 nt, Human
uaaacugccauau

SEQ ID NO: 2885749 - RNA, 12 nt, Human
uaaacugccccc

SEQ ID NO: 2885750 - RNA, 22 nt, Human
uaaacugaaaacucccauuuac

SEQ ID NO: 2885751 - RNA, 14 nt, Human
uaaacugacuauca

SEQ ID NO: 2885752 - RNA, 15 nt, Human
uaaacugacuaucau

SEQ ID NO: 2885753 - RNA, 18 nt, Human
uaaacugacuaucauaaa

SEQ ID NO: 2885754 - RNA, 14 nt, Human
uaaacucuaaacau

SEQ ID NO: 2885755 - RNA, 15 nt, Human
uaaacucuaaacauu

SEQ ID NO: 2885756 - RNA, 22 nt, Human
uaaacucuaaacauuaaucaau

SEQ ID NO: 2885757 - RNA, 23 nt, Human
uaaacucaaaauauuuguacaua

SEQ ID NO: 2885758 - RNA, 15 nt, Human
uaaacucaagacaau

SEQ ID NO: 2885759 - RNA, 22 nt, Human
uaaacucaaaauauuuguacau

SEQ ID NO: 2885760 - RNA, 20 nt, Human
uaaacucaaaacuuaacaua

SEQ ID NO: 2885761 - RNA, 11 nt, Human
uaaacucaggg

SEQ ID NO: 2885762 - RNA, 19 nt, Human
uaaacucagggacagagcc

SEQ ID NO: 2885763 - RNA, 20 nt, Human
uaaacucagggacagagcca

SEQ ID NO: 2885764 - RNA, 21 nt, Human
uaaacucaaaauauuuguaca

SEQ ID NO: 2885765 - RNA, 19 nt, Human
uaaacucaaaauauuugua

SEQ ID NO: 2885766 - RNA, 16 nt, Human
uaaacucaaaauauuu

SEQ ID NO: 2885767 - RNA, 14 nt, Human
uaaacucaaaauau

SEQ ID NO: 2885768 - RNA, 14 nt, Human
uaaacuacucuuug

SEQ ID NO: 2885769 - RNA, 15 nt, Human
uaaacuacucuuuga

SEQ ID NO: 2885770 - RNA, 16 nt, Human
uaaacuacucuuugau

SEQ ID NO: 2885771 - RNA, 18 nt, Human
uaaacuacucuuugauuu

SEQ ID NO: 2885772 - RNA, 11 nt, Human
uaaacuagaug

SEQ ID NO: 2885773 - RNA, 14 nt, Human
uaaacuagaugacc

SEQ ID NO: 2885774 - RNA, 15 nt, Human
uaaacuagaugaccu

SEQ ID NO: 2885775 - RNA, 16 nt, Human
uaaacuagaugaccuc

SEQ ID NO: 2885776 - RNA, 17 nt, Human
uaaacuagaugaccuca

SEQ ID NO: 2885777 - RNA, 15 nt, Human
uaaacuauuugucuu

SEQ ID NO: 2885778 - RNA, 15 nt, Human
uaaacucaaaacuua

SEQ ID NO: 2885779 - RNA, 19 nt, Human
uaaacucaaaacuuaacau

SEQ ID NO: 2885780 - RNA, 22 nt, Human
uaaacuaucuuggugaauuuuu

SEQ ID NO: 2885781 - RNA, 17 nt, Human
uaaacuaucaguuuguc

SEQ ID NO: 2885782 - RNA, 21 nt, Human
uaaacuaucuuggugaauuuu

SEQ ID NO: 2885783 - RNA, 20 nt, Human
uaaacuaucuuggugaauuu

SEQ ID NO: 2885784 - RNA, 13 nt, Human
uaaacuaucaguu

SEQ ID NO: 2885785 - RNA, 14 nt, Human
uaaacuauauuuuc

SEQ ID NO: 2885786 - RNA, 16 nt, Human
uaaagaaauugcaaua

SEQ ID NO: 2885787 - RNA, 15 nt, Human
uaaagaaaugucuua

SEQ ID NO: 2885788 - RNA, 17 nt, Human
uaaagaaaugucuuaau

SEQ ID NO: 2885789 - RNA, 17 nt, Human
uaaagaaauugcaauaa

SEQ ID NO: 2885790 - RNA, 15 nt, Human
uaaagaaauuuacua

SEQ ID NO: 2885791 - RNA, 16 nt, Human
uaaagaaauuuacuau

SEQ ID NO: 2885792 - RNA, 17 nt, Human
uaaagaaauuuacuaua

SEQ ID NO: 2885793 - RNA, 18 nt, Human
uaaagaaauuuacuauau

SEQ ID NO: 2885794 - RNA, 19 nt, Human
uaaagaaauuuacuauaua

SEQ ID NO: 2885795 - RNA, 20 nt, Human
uaaagaaauuuacuauauau

SEQ ID NO: 2885796 - RNA, 22 nt, Human
uaaagaaauuuacuauauauau

SEQ ID NO: 2885797 - RNA, 14 nt, Human
uaaagaagaucugu

SEQ ID NO: 2885798 - RNA, 14 nt, Human
uaaagaacugcaca

SEQ ID NO: 2885799 - RNA, 19 nt, Human
uaaagaacugcacaugaag

SEQ ID NO: 2885800 - RNA, 20 nt, Human
uaaagaacugcacaugaaga

SEQ ID NO: 2885801 - RNA, 23 nt, Human
uaaagaacugcacaugaagaaau

SEQ ID NO: 2885802 - RNA, 17 nt, Human
uaaagaaguugaaguuu

SEQ ID NO: 2885803 - RNA, 14 nt, Human
uaaagaagguuuca

SEQ ID NO: 2885804 - RNA, 17 nt, Human
uaaagacgauuugucag

SEQ ID NO: 2885805 - RNA, 12 nt, Human
uaaagagaagac

SEQ ID NO: 2885806 - RNA, 14 nt, Human
uaaagaauauauau

SEQ ID NO: 2885807 - RNA, 20 nt, Human
uaaagacaaccauauuuagc

SEQ ID NO: 2885808 - RNA, 21 nt, Human
uaaagacaaccauauuuagca

SEQ ID NO: 2885809 - RNA, 9 nt, Human
uaaagacag

SEQ ID NO: 2885810 - RNA, 15 nt, Human
uaaagacaccuacug

SEQ ID NO: 2885811 - RNA, 10 nt, Human
uaaagacaga

SEQ ID NO: 2885812 - RNA, 21 nt, Human
uaaagacagggaagagcagaa

SEQ ID NO: 2885813 - RNA, 21 nt, Human
uaaagacccagggggagaaug

SEQ ID NO: 2885814 - RNA, 19 nt, Human
uaaagacccagggggagaa

SEQ ID NO: 2885815 - RNA, 11 nt, Human
uaaagaccaaa

SEQ ID NO: 2885816 - RNA, 13 nt, Human
uaaagaccaaacu

SEQ ID NO: 2885817 - RNA, 14 nt, Human
uaaagaccaaacuu

SEQ ID NO: 2885818 - RNA, 16 nt, Human
uaaagcaaaaaaugaa

SEQ ID NO: 2885819 - RNA, 19 nt, Human
uaaagcaaaaaaugaaugu

SEQ ID NO: 2885820 - RNA, 21 nt, Human
uaaagcaaaaaaugaaugucu

SEQ ID NO: 2885821 - RNA, 13 nt, Human
uaaagauuugcuu

SEQ ID NO: 2885822 - RNA, 15 nt, Human
uaaagauuuaucaaa

SEQ ID NO: 2885823 - RNA, 22 nt, Human
uaaagauuuaucaaaucaguca

SEQ ID NO: 2885824 - RNA, 21 nt, Human
uaaagauucuauaguucuaga

SEQ ID NO: 2885825 - RNA, 24 nt, Human
uaaagauucuauaguucuagacau

SEQ ID NO: 2885826 - RNA, 15 nt, Human
uaaagauguuaaaaa

SEQ ID NO: 2885827 - RNA, 19 nt, Human
uaaagauucuauaguucua

SEQ ID NO: 2885828 - RNA, 20 nt, Human
uaaagauucuauaguucuag

SEQ ID NO: 2885829 - RNA, 22 nt, Human
uaaagauggaguuucuaagguc

SEQ ID NO: 2885830 - RNA, 19 nt, Human
uaaagauggaguuucuaag

SEQ ID NO: 2885831 - RNA, 21 nt, Human
uaaagauggaguuucuaaggu

SEQ ID NO: 2885832 - RNA, 18 nt, Human
uaaagagauucacacaca

SEQ ID NO: 2885833 - RNA, 19 nt, Human
uaaagaggcguugcuuuca

SEQ ID NO: 2885834 - RNA, 20 nt, Human
uaaagaggcguugcuuucac

SEQ ID NO: 2885835 - RNA, 18 nt, Human
uaaagaguuaguuugagu

SEQ ID NO: 2885836 - RNA, 12 nt, Human
uaaagauaauau

SEQ ID NO: 2885837 - RNA, 15 nt, Human
uaaagauaauauuac

SEQ ID NO: 2885838 - RNA, 19 nt, Human
uaaagauaauauuacuguu

SEQ ID NO: 2885839 - RNA, 14 nt, Human
uaaagauaauugcu

SEQ ID NO: 2885840 - RNA, 17 nt, Human
uaaagauaauugcuauu

SEQ ID NO: 2885841 - RNA, 18 nt, Human
uaaagauaauugcuauuu

SEQ ID NO: 2885842 - RNA, 13 nt, Human
uaaagagucuaga

SEQ ID NO: 2885843 - RNA, 15 nt, Human
uaaagagucuagauu

SEQ ID NO: 2885844 - RNA, 18 nt, Human
uaaagagucuagauucaa

SEQ ID NO: 2885845 - RNA, 19 nt, Human
uaaagagucuagauucaaa

SEQ ID NO: 2885846 - RNA, 21 nt, Human
uaaagagucuagauucaaagg

SEQ ID NO: 2885847 - RNA, 13 nt, Human
uaaagauggaaaa

SEQ ID NO: 2885848 - RNA, 22 nt, Human
uaaagaugcaaggaccaggacu

SEQ ID NO: 2885849 - RNA, 17 nt, Human
uaaagauggaguuucua

SEQ ID NO: 2885850 - RNA, 18 nt, Human
uaaagauggaguuucuaa

SEQ ID NO: 2885851 - RNA, 21 nt, Human
uaaagaugcaaggaccaggac

SEQ ID NO: 2885852 - RNA, 23 nt, Human
uaaagagucuagauucaaagguu

SEQ ID NO: 2885853 - RNA, 17 nt, Human
uaaagauauuguucaaa

SEQ ID NO: 2885854 - RNA, 16 nt, Human
uaaagauauggagaau

SEQ ID NO: 2885855 - RNA, 17 nt, Human
uaaagauauggagaauu

SEQ ID NO: 2885856 - RNA, 20 nt, Human
uaaagauauggagaauugcu

SEQ ID NO: 2885857 - RNA, 24 nt, Human
uaaagauauggagaauugcugaag

SEQ ID NO: 2885858 - RNA, 16 nt, Human
uaaagaucuacaugaa

SEQ ID NO: 2885859 - RNA, 17 nt, Human
uaaagaucuacaugaau

SEQ ID NO: 2885860 - RNA, 16 nt, Human
uaaagaugaacucuga

SEQ ID NO: 2885861 - RNA, 17 nt, Human
uaaagaugaacucugaa

SEQ ID NO: 2885862 - RNA, 14 nt, Human
aaggaaaaaaagac

SEQ ID NO: 2885863 - RNA, 15 nt, Human
aaggaaaaaaagacu

SEQ ID NO: 2885864 - RNA, 21 nt, Human
aaggaaaaaaagacucuuuuu

SEQ ID NO: 2885865 - RNA, 15 nt, Human
guuccccuguucacu

SEQ ID NO: 2885866 - RNA, 17 nt, Human
guuccccuguucacucu

SEQ ID NO: 2885867 - RNA, 13 nt, Human
aagcucugcuccu

SEQ ID NO: 2885868 - RNA, 14 nt, Human
aagcuguuaaacug

SEQ ID NO: 2885869 - RNA, 15 nt, Human
aagcuguuaaacugu

SEQ ID NO: 2885870 - RNA, 16 nt, Human
aagcuguuaaacuguu

SEQ ID NO: 2885871 - RNA, 17 nt, Human
aagcuguuaaacuguua

SEQ ID NO: 2885872 - RNA, 18 nt, Human
aagcuguuaaacuguuag

SEQ ID NO: 2885873 - RNA, 20 nt, Human
aagcuguuaaacuguuagca

SEQ ID NO: 2885874 - RNA, 12 nt, Human
aagcuguuguac

SEQ ID NO: 2885875 - RNA, 13 nt, Human
aagcuguuguaca

SEQ ID NO: 2885876 - RNA, 15 nt, Human
aagcuuucugucucc

SEQ ID NO: 2885877 - RNA, 21 nt, Human
aagcuuuggacccaaggaaaa

SEQ ID NO: 2885878 - RNA, 15 nt, Human
aagcuuuguccccug

SEQ ID NO: 2885879 - RNA, 18 nt, Human
aagcuuuguccccugcuu

SEQ ID NO: 2885880 - RNA, 19 nt, Human
aagcuuuguccccugcuuc

SEQ ID NO: 2885881 - RNA, 20 nt, Human
aagcuuuguccccugcuuca

SEQ ID NO: 2885882 - RNA, 22 nt, Human
aagcuuuguccccugcuucaga

SEQ ID NO: 2885883 - RNA, 14 nt, Human
aagcuguuguacau

SEQ ID NO: 2885884 - RNA, 17 nt, Human
aagcuguuguacauuua

SEQ ID NO: 2885885 - RNA, 18 nt, Human
aagcuguuguacauuuau

SEQ ID NO: 2885886 - RNA, 20 nt, Human
aagcuguuguacauuuauga

SEQ ID NO: 2885887 - RNA, 21 nt, Human
aagcuguuguacauuuaugau

SEQ ID NO: 2885888 - RNA, 11 nt, Human
aagcucccugc

SEQ ID NO: 2885889 - RNA, 15 nt, Human
aagcucccugcccca

SEQ ID NO: 2885890 - RNA, 16 nt, Human
aagcucccugccccaa

SEQ ID NO: 2885891 - RNA, 17 nt, Human
aagcucccugccccaaa

SEQ ID NO: 2885892 - RNA, 17 nt, Human
aagcuccuaucuguuuu

SEQ ID NO: 2885893 - RNA, 14 nt, Human
aagcuccuccucgg

SEQ ID NO: 2885894 - RNA, 17 nt, Human
aagcuccuccucggaac

SEQ ID NO: 2885895 - RNA, 20 nt, Human
aagcucuaguucuuaacaac

SEQ ID NO: 2885896 - RNA, 15 nt, Human
aagcucuagaaucug

SEQ ID NO: 2885897 - RNA, 22 nt, Human
aagcucugaagucacaucacag

SEQ ID NO: 2885898 - RNA, 12 nt, Human
aagcucugacau

SEQ ID NO: 2885899 - RNA, 16 nt, Human
aagcucugaagucaca

SEQ ID NO: 2885900 - RNA, 12 nt, Human
aagcucugaagu

SEQ ID NO: 2885901 - RNA, 22 nt, Human
aagcucucuugccgaggagcca

SEQ ID NO: 2885902 - RNA, 23 nt, Human
aagcucucuugccgaggagccag

SEQ ID NO: 2885903 - RNA, 17 nt, Human
aagcucccaagggaugg

SEQ ID NO: 2885904 - RNA, 19 nt, Human
aagcucccaagggauggug

SEQ ID NO: 2885905 - RNA, 16 nt, Human
aagcuccaugugccuc

SEQ ID NO: 2885906 - RNA, 18 nt, Human
aagcuccaugugccucuu

SEQ ID NO: 2885907 - RNA, 21 nt, Human
aagcucccaagggauggugcc

SEQ ID NO: 2885908 - RNA, 13 nt, Human
guguuuauuuaua

SEQ ID NO: 2885909 - RNA, 20 nt, Human
aagcuccaucuccacuccag

SEQ ID NO: 2885910 - RNA, 10 nt, Human
guguuuauuu

SEQ ID NO: 2885911 - RNA, 22 nt, Human
guguuuauaaaauauaaacaaa

SEQ ID NO: 2885912 - RNA, 14 nt, Human
guguuuauaaaaua

SEQ ID NO: 2885913 - RNA, 13 nt, Human
guguuuauaaaau

SEQ ID NO: 2885914 - RNA, 16 nt, Human
guguuuaauuucuuca

SEQ ID NO: 2885915 - RNA, 17 nt, Human
guguuuaauuucuucaa

SEQ ID NO: 2885916 - RNA, 22 nt, Human
guguuuaagacauuuuuggaag

SEQ ID NO: 2885917 - RNA, 15 nt, Human
guucucaaugaaaaa

SEQ ID NO: 2885918 - RNA, 16 nt, Human
guucucaaugugaaaa

SEQ ID NO: 2885919 - RNA, 23 nt, Human
guucucaaugugaaaaauguguc

SEQ ID NO: 2885920 - RNA, 14 nt, Human
guucucaaugaaaa

SEQ ID NO: 2885921 - RNA, 13 nt, Human
guucucaaugaaa

SEQ ID NO: 2885922 - RNA, 12 nt, Human
guucucaaugaa

SEQ ID NO: 2885923 - RNA, 18 nt, Human
guuccccuguucacucua

SEQ ID NO: 2885924 - RNA, 14 nt, Human
guucuaguuugcau

SEQ ID NO: 2885925 - RNA, 15 nt, Human
guucuaguuugcauu

SEQ ID NO: 2885926 - RNA, 12 nt, Human
guucuauccaaa

SEQ ID NO: 2885927 - RNA, 14 nt, Human
guucuauccaaaca

SEQ ID NO: 2885928 - RNA, 21 nt, Human
guucuauccaaacauguauuu

SEQ ID NO: 2885929 - RNA, 22 nt, Human
guucuauccaaacauguauuua

SEQ ID NO: 2885930 - RNA, 14 nt, Human
guucuaugaacaac

SEQ ID NO: 2885931 - RNA, 16 nt, Human
guucuaugguuaugaa

SEQ ID NO: 2885932 - RNA, 17 nt, Human
guucuaugguuaugaaa

SEQ ID NO: 2885933 - RNA, 20 nt, Human
guucuaugguuaugaaagaa

SEQ ID NO: 2885934 - RNA, 12 nt, Human
guucuauguuua

SEQ ID NO: 2885935 - RNA, 16 nt, Human
guucucugaggacacu

SEQ ID NO: 2885936 - RNA, 14 nt, Human
guucucugaggaca

SEQ ID NO: 2885937 - RNA, 13 nt, Human
guucugugucuuu

SEQ ID NO: 2885938 - RNA, 22 nt, Human
guucugugucuuucacagcucc

SEQ ID NO: 2885939 - RNA, 23 nt, Human
guucugugucuuucacagcuccu

SEQ ID NO: 2885940 - RNA, 15 nt, Human
guucuguguuuaauu

SEQ ID NO: 2885941 - RNA, 21 nt, Human
guucuguguuuaauuucuuca

SEQ ID NO: 2885942 - RNA, 22 nt, Human
guucuguguuuaauuucuucaa

SEQ ID NO: 2885943 - RNA, 16 nt, Human
guugacaacugugacu

SEQ ID NO: 2885944 - RNA, 16 nt, Human
guugacaccugagaaa

SEQ ID NO: 2885945 - RNA, 19 nt, Human
guugacacaguuguagggu

SEQ ID NO: 2885946 - RNA, 14 nt, Human
guugacaacuguga

SEQ ID NO: 2885947 - RNA, 15 nt, Human
guugacaacugugac

SEQ ID NO: 2885948 - RNA, 15 nt, Human
guugacaaaauuuuc

SEQ ID NO: 2885949 - RNA, 18 nt, Human
guucuguuucaaggcacu

SEQ ID NO: 2885950 - RNA, 14 nt, Human
guucuguuuguuau

SEQ ID NO: 2885951 - RNA, 18 nt, Human
guucuguuuguuauuguu

SEQ ID NO: 2885952 - RNA, 22 nt, Human
guucuguuuguuauuguuuugu

SEQ ID NO: 2885953 - RNA, 23 nt, Human
guucuguuuguuauuguuuuguu

SEQ ID NO: 2885954 - RNA, 21 nt, Human
guucuguuauauccccugcua

SEQ ID NO: 2885955 - RNA, 23 nt, Human
guucuguuauauccccugcuacc

SEQ ID NO: 2885956 - RNA, 13 nt, Human
guucuguuucaag

SEQ ID NO: 2885957 - RNA, 14 nt, Human
guucuguuucaagg

SEQ ID NO: 2885958 - RNA, 20 nt, Human
guugauauuucgaaagcugc

SEQ ID NO: 2885959 - RNA, 12 nt, Human
guugauaguuua

SEQ ID NO: 2885960 - RNA, 15 nt, Human
guugagccccuggag

SEQ ID NO: 2885961 - RNA, 14 nt, Human
guugagccuuuucc

SEQ ID NO: 2885962 - RNA, 14 nt, Human
guugagcaagcagu

SEQ ID NO: 2885963 - RNA, 20 nt, Human
guucucccucccaccuuaaa

SEQ ID NO: 2885964 - RNA, 17 nt, Human
guugacaguucugaaga

SEQ ID NO: 2885965 - RNA, 22 nt, Human
guugacauaccuuuuauuuuuu

SEQ ID NO: 2885966 - RNA, 14 nt, Human
guugacauauuuaa

SEQ ID NO: 2885967 - RNA, 17 nt, Human
guugacauauuuaaugu

SEQ ID NO: 2885968 - RNA, 18 nt, Human
guugacauauuuaauguu

SEQ ID NO: 2885969 - RNA, 19 nt, Human
guugacauauuuaauguuu

SEQ ID NO: 2885970 - RNA, 20 nt, Human
guugacauauuuaauguuuu

SEQ ID NO: 2885971 - RNA, 22 nt, Human
guugacauauuuaauguuuuaa

SEQ ID NO: 2885972 - RNA, 23 nt, Human
guugacauauuuaauguuuuaaa

SEQ ID NO: 2885973 - RNA, 16 nt, Human
guugacaguucugaag

SEQ ID NO: 2885974 - RNA, 23 nt, Human
aaggaggauuccauuuggcagag

SEQ ID NO: 2885975 - RNA, 16 nt, Human
aaggaggcaugccucu

SEQ ID NO: 2885976 - RNA, 18 nt, Human
aaggaggcaugccucuga

SEQ ID NO: 2885977 - RNA, 20 nt, Human
aaggaggcaugccucugaua

SEQ ID NO: 2885978 - RNA, 17 nt, Human
aaggauaguauuuuuau

SEQ ID NO: 2885979 - RNA, 13 nt, Human
aaggaucaucuga

SEQ ID NO: 2885980 - RNA, 14 nt, Human
aaggagagccugcu

SEQ ID NO: 2885981 - RNA, 13 nt, Human
aaggagcacaagc

SEQ ID NO: 2885982 - RNA, 12 nt, Human
aaggagcacagg

SEQ ID NO: 2885983 - RNA, 21 nt, Human
aaggagcacaggucccaccuc

SEQ ID NO: 2885984 - RNA, 16 nt, Human
aaggagagaaaguggg

SEQ ID NO: 2885985 - RNA, 13 nt, Human
aaggagagccugc

SEQ ID NO: 2885986 - RNA, 18 nt, Human
aaggagagacucccauga

SEQ ID NO: 2885987 - RNA, 20 nt, Human
aaggagagacucccaugaag

SEQ ID NO: 2885988 - RNA, 21 nt, Human
aaggagagacucccaugaagc

SEQ ID NO: 2885989 - RNA, 22 nt, Human
aaggagagacucccaugaagcc

SEQ ID NO: 2885990 - RNA, 23 nt, Human
aaggagagacucccaugaagccu

SEQ ID NO: 2885991 - RNA, 15 nt, Human
aaggaagguucaugu

SEQ ID NO: 2885992 - RNA, 12 nt, Human
aaggagacacaa

SEQ ID NO: 2885993 - RNA, 13 nt, Human
aaggagacacaga

SEQ ID NO: 2885994 - RNA, 14 nt, Human
aaggagacacagau

SEQ ID NO: 2885995 - RNA, 15 nt, Human
aaggagacacagaug

SEQ ID NO: 2885996 - RNA, 16 nt, Human
aaggagacacagaugu

SEQ ID NO: 2885997 - RNA, 17 nt, Human
aaggagacacagauguu

SEQ ID NO: 2885998 - RNA, 18 nt, Human
aaggagacacagauguuc

SEQ ID NO: 2885999 - RNA, 14 nt, Human
aaggagacaaguuc

SEQ ID NO: 2886000 - RNA, 11 nt, Human
aaggagagaaa

SEQ ID NO: 2886001 - RNA, 12 nt, Human
aaggagagaaag

SEQ ID NO: 2886002 - RNA, 14 nt, Human
aaggagagaaagug

SEQ ID NO: 2886003 - RNA, 16 nt, Human
aaggaaaccacagcug

SEQ ID NO: 2886004 - RNA, 17 nt, Human
aaggaaaccacagcugc

SEQ ID NO: 2886005 - RNA, 18 nt, Human
aaggaaaccacagcugcu

SEQ ID NO: 2886006 - RNA, 12 nt, Human
aaggaaaaugau

SEQ ID NO: 2886007 - RNA, 14 nt, Human
aaggaaaaugauac

SEQ ID NO: 2886008 - RNA, 15 nt, Human
guugauccauccagc

SEQ ID NO: 2886009 - RNA, 21 nt, Human
aaggaaggcucuucuccccag

SEQ ID NO: 2886010 - RNA, 16 nt, Human
aaggaaggaaagaaag

SEQ ID NO: 2886011 - RNA, 13 nt, Human
aaggaaggaaaga

SEQ ID NO: 2886012 - RNA, 12 nt, Human
aaggaaggaaag

SEQ ID NO: 2886013 - RNA, 20 nt, Human
aaggaaaccacagcugcugg

SEQ ID NO: 2886014 - RNA, 11 nt, Human
aaggaaggaaa

SEQ ID NO: 2886015 - RNA, 18 nt, Human
aaggaagcuccacuguca

SEQ ID NO: 2886016 - RNA, 17 nt, Human
guugggcuggugucacc

SEQ ID NO: 2886017 - RNA, 22 nt, Human
guuggggggacucugagcggga

SEQ ID NO: 2886018 - RNA, 13 nt, Human
guuggggugacag

SEQ ID NO: 2886019 - RNA, 14 nt, Human
guuggggugacagu

SEQ ID NO: 2886020 - RNA, 15 nt, Human
guuggggugacaguc

SEQ ID NO: 2886021 - RNA, 19 nt, Human
guuggggugacagucauca

SEQ ID NO: 2886022 - RNA, 15 nt, Human
guugggcugguguca

SEQ ID NO: 2886023 - RNA, 15 nt, Human
guugguugugucuuu

SEQ ID NO: 2886024 - RNA, 16 nt, Human
guugguugugucuuuu

SEQ ID NO: 2886025 - RNA, 14 nt, Human
guugguuuacuuuc

SEQ ID NO: 2886026 - RNA, 15 nt, Human
guugguuuacuuuca

SEQ ID NO: 2886027 - RNA, 18 nt, Human
guugguugcacuuuguag

SEQ ID NO: 2886028 - RNA, 12 nt, Human
guuguaaaaaga

SEQ ID NO: 2886029 - RNA, 13 nt, Human
guuguaaaaagaa

SEQ ID NO: 2886030 - RNA, 16 nt, Human
guugcccaggcuggcg

SEQ ID NO: 2886031 - RNA, 14 nt, Human
guugcuaacugaac

SEQ ID NO: 2886032 - RNA, 17 nt, Human
guugcuaacugaacuuu

SEQ ID NO: 2886033 - RNA, 21 nt, Human
guugcuaacugaacuuugaag

SEQ ID NO: 2886034 - RNA, 22 nt, Human
guugcuaacugaacuuugaaga

SEQ ID NO: 2886035 - RNA, 15 nt, Human
guugcccaggcuggc

SEQ ID NO: 2886036 - RNA, 19 nt, Human
aaggcguggagcugccuga

SEQ ID NO: 2886037 - RNA, 13 nt, Human
aaggcuaaaaagu

SEQ ID NO: 2886038 - RNA, 16 nt, Human
aaggcguggagcugcc

SEQ ID NO: 2886039 - RNA, 18 nt, Human
aaggcguggagcugccug

SEQ ID NO: 2886040 - RNA, 23 nt, Human
guuggcugggggccucagugcca

SEQ ID NO: 2886041 - RNA, 19 nt, Human
guugcugaaacuugcugag

SEQ ID NO: 2886042 - RNA, 20 nt, Human
guugcucuaggaagacauuu

SEQ ID NO: 2886043 - RNA, 14 nt, Human
aaggcccccuacgc

SEQ ID NO: 2886044 - RNA, 21 nt, Human
aaggcccccucucaggagcca

SEQ ID NO: 2886045 - RNA, 22 nt, Human
aaggcccccucucaggagccau

SEQ ID NO: 2886046 - RNA, 14 nt, Human
guugcccaggcugg

SEQ ID NO: 2886047 - RNA, 18 nt, Human
aaggcgggagcaucucuu

SEQ ID NO: 2886048 - RNA, 21 nt, Human
aaggcgguggacuugaacuuu

SEQ ID NO: 2886049 - RNA, 22 nt, Human
aaggcgguggacuugaacuuuc

SEQ ID NO: 2886050 - RNA, 22 nt, Human
aaggcguagcaucauccugcag

SEQ ID NO: 2886051 - RNA, 13 nt, Human
aaggcggccccuc

SEQ ID NO: 2886052 - RNA, 14 nt, Human
aaggcguggagcug

SEQ ID NO: 2886053 - RNA, 13 nt, Human
aaggccucugucc

SEQ ID NO: 2886054 - RNA, 14 nt, Human
aaggccugcacaca

SEQ ID NO: 2886055 - RNA, 15 nt, Human
aaggccugcacacaa

SEQ ID NO: 2886056 - RNA, 12 nt, Human
aaggccucuugg

SEQ ID NO: 2886057 - RNA, 16 nt, Human
aaggccucuuggagac

SEQ ID NO: 2886058 - RNA, 20 nt, Human
aaggccucuuggagaccuua

SEQ ID NO: 2886059 - RNA, 23 nt, Human
aaggccucuuggagaccuuaccc

SEQ ID NO: 2886060 - RNA, 19 nt, Human
aaggccucccuagccagca

SEQ ID NO: 2886061 - RNA, 20 nt, Human
aaggccuucauggccccagc

SEQ ID NO: 2886062 - RNA, 11 nt, Human
aaggccuuaag

SEQ ID NO: 2886063 - RNA, 12 nt, Human
aaggccugggug

SEQ ID NO: 2886064 - RNA, 12 nt, Human
aaggccuucucc

SEQ ID NO: 2886065 - RNA, 15 nt, Human
aaggccuucuccucc

SEQ ID NO: 2886066 - RNA, 23 nt, Human
aaggcgaucccaucuugauaaga

SEQ ID NO: 2886067 - RNA, 16 nt, Human
guuuuuuuccuguuuc

SEQ ID NO: 2886068 - RNA, 10 nt, Human
guuuuuuugc

SEQ ID NO: 2886069 - RNA, 11 nt, Human
guuuuuuugcc

SEQ ID NO: 2886070 - RNA, 19 nt, Human
guuuuuuuguauaguaaag

SEQ ID NO: 2886071 - RNA, 20 nt, Human
guuuuuuugucaacauugug

SEQ ID NO: 2886072 - RNA, 13 nt, Human
guuuuuuccuuug

SEQ ID NO: 2886073 - RNA, 16 nt, Human
guuuuuuccuuugcuc

SEQ ID NO: 2886074 - RNA, 21 nt, Human
guuuuuuaaaauauuuaucug

SEQ ID NO: 2886075 - RNA, 16 nt, Human
guuuuuuaugaagugc

SEQ ID NO: 2886076 - RNA, 16 nt, Human
guuuuuuauuauugug

SEQ ID NO: 2886077 - RNA, 14 nt, Human
guuuuuucaaaaua

SEQ ID NO: 2886078 - RNA, 15 nt, Human
guuuuuucaaaauag

SEQ ID NO: 2886079 - RNA, 18 nt, Human
guuuuuucaaaauagaaa

SEQ ID NO: 2886080 - RNA, 17 nt, Human
guuuuuguuuggagagc

SEQ ID NO: 2886081 - RNA, 17 nt, Human
guuuuucugccagggag

SEQ ID NO: 2886082 - RNA, 14 nt, Human
guuuuucugccagg

SEQ ID NO: 2886083 - RNA, 11 nt, Human
guuuuucucac

SEQ ID NO: 2886084 - RNA, 16 nt, Human
guuuuucuccagugcu

SEQ ID NO: 2886085 - RNA, 18 nt, Human
guuuuugauagcuuuauu

SEQ ID NO: 2886086 - RNA, 21 nt, Human
aagucaucuauaguugauaug

SEQ ID NO: 2886087 - RNA, 23 nt, Human
aagucaugaagcccaagugaaau

SEQ ID NO: 2886088 - RNA, 17 nt, Human
aagucaugaagcccaag

SEQ ID NO: 2886089 - RNA, 15 nt, Human
aagucaugaagccca

SEQ ID NO: 2886090 - RNA, 17 nt, Human
aagucaugcaaaggcug

SEQ ID NO: 2886091 - RNA, 12 nt, Human
aagugaauaaac

SEQ ID NO: 2886092 - RNA, 13 nt, Human
aagugaauaaacu

SEQ ID NO: 2886093 - RNA, 14 nt, Human
aagugaauaaacuu

SEQ ID NO: 2886094 - RNA, 15 nt, Human
aagugaauaaacuuc

SEQ ID NO: 2886095 - RNA, 16 nt, Human
aagugaauaaacuuca

SEQ ID NO: 2886096 - RNA, 17 nt, Human
aagugaauaaacuucag

SEQ ID NO: 2886097 - RNA, 18 nt, Human
aagugaauaaacuucagc

SEQ ID NO: 2886098 - RNA, 20 nt, Human
aagugaauaaacuucagcac

SEQ ID NO: 2886099 - RNA, 16 nt, Human
aagugaaugaaagauu

SEQ ID NO: 2886100 - RNA, 19 nt, Human
aagugaaugaaagauuaaa

SEQ ID NO: 2886101 - RNA, 14 nt, Human
aagugaagugauac

SEQ ID NO: 2886102 - RNA, 18 nt, Human
aagugagaauaggcagcc

SEQ ID NO: 2886103 - RNA, 13 nt, Human
aagugaauuuaua

SEQ ID NO: 2886104 - RNA, 19 nt, Human
aagugacuguucaagagca

SEQ ID NO: 2886105 - RNA, 18 nt, Human
aagugacuguaucugugu

SEQ ID NO: 2886106 - RNA, 17 nt, Human
aagugacuguaucugug

SEQ ID NO: 2886107 - RNA, 16 nt, Human
aagugacuguaucugu

SEQ ID NO: 2886108 - RNA, 24 nt, Human
aagugacacagcagcuucaccaga

SEQ ID NO: 2886109 - RNA, 23 nt, Human
aaguacuucuccacccugcucuc

SEQ ID NO: 2886110 - RNA, 22 nt, Human
aaguacuucuccacccugcucu

SEQ ID NO: 2886111 - RNA, 14 nt, Human
aaguauuaaaacau

SEQ ID NO: 2886112 - RNA, 15 nt, Human
aaguauuaaaacauu

SEQ ID NO: 2886113 - RNA, 17 nt, Human
aaguauuaaaacauugg

SEQ ID NO: 2886114 - RNA, 13 nt, Human
aaguauuaaaaca

SEQ ID NO: 2886115 - RNA, 21 nt, Human
aaguauuaaaacauuggauua

SEQ ID NO: 2886116 - RNA, 21 nt, Human
aaguacuucuccacccugcuc

SEQ ID NO: 2886117 - RNA, 24 nt, Human
aagucacacaguauuacuucugcu

SEQ ID NO: 2886118 - RNA, 16 nt, Human
aagucaaucauuucuc

SEQ ID NO: 2886119 - RNA, 17 nt, Human
aagucaaucauuucuca

SEQ ID NO: 2886120 - RNA, 18 nt, Human
aagucaaucauuucucac

SEQ ID NO: 2886121 - RNA, 22 nt, Human
aagucaaucauuucucacugug

SEQ ID NO: 2886122 - RNA, 19 nt, Human
aagucaaggguaggguggg

SEQ ID NO: 2886123 - RNA, 11 nt, Human
aaguacuguaa

SEQ ID NO: 2886124 - RNA, 13 nt, Human
aagucacacagug

SEQ ID NO: 2886125 - RNA, 15 nt, Human
aagucacaauguucu

SEQ ID NO: 2886126 - RNA, 18 nt, Human
aagucacaauguucuuua

SEQ ID NO: 2886127 - RNA, 19 nt, Human
aagucacaucacaggacac

SEQ ID NO: 2886128 - RNA, 15 nt, Human
aagucacaugcguaa

SEQ ID NO: 2886129 - RNA, 17 nt, Human
aagucacaucacaggac

SEQ ID NO: 2886130 - RNA, 16 nt, Human
aagucacaucacagga

SEQ ID NO: 2886131 - RNA, 15 nt, Human
aagucaguuucuaca

SEQ ID NO: 2886132 - RNA, 15 nt, Human
aagucaguguugaga

SEQ ID NO: 2886133 - RNA, 16 nt, Human
aagucaguguugagau

SEQ ID NO: 2886134 - RNA, 17 nt, Human
aagucaguguugagaug

SEQ ID NO: 2886135 - RNA, 12 nt, Human
aagucacugcac

SEQ ID NO: 2886136 - RNA, 19 nt, Human
aagucaccuuguguguucc

SEQ ID NO: 2886137 - RNA, 16 nt, Human
aagucacccuagcccu

SEQ ID NO: 2886138 - RNA, 20 nt, Human
aagucacccuagcccucucc

SEQ ID NO: 2886139 - RNA, 22 nt, Human
aagucacccuagcccucucccu

SEQ ID NO: 2886140 - RNA, 23 nt, Human
aagucacccuagcccucucccuc

SEQ ID NO: 2886141 - RNA, 19 nt, Human
aagucaccacuccauuccc

SEQ ID NO: 2886142 - RNA, 20 nt, Human
aagucaccacuccauuccca

SEQ ID NO: 2886143 - RNA, 22 nt, Human
aagggucagaggaccuguauuu

SEQ ID NO: 2886144 - RNA, 16 nt, Human
aagggugggugcucag

SEQ ID NO: 2886145 - RNA, 17 nt, Human
aagggugggugcucaga

SEQ ID NO: 2886146 - RNA, 18 nt, Human
aagggugggugcucagaa

SEQ ID NO: 2886147 - RNA, 19 nt, Human
aagggugggugcucagaau

SEQ ID NO: 2886148 - RNA, 16 nt, Human
aagggucauagaaagg

SEQ ID NO: 2886149 - RNA, 17 nt, Human
aagggucauagaaaggg

SEQ ID NO: 2886150 - RNA, 17 nt, Human
aaggguuuguggcuggg

SEQ ID NO: 2886151 - RNA, 17 nt, Human
aaggguucuggcugccc

SEQ ID NO: 2886152 - RNA, 20 nt, Human
aaggguuuguggcugggggc

SEQ ID NO: 2886153 - RNA, 12 nt, Human
aaguaaaacuug

SEQ ID NO: 2886154 - RNA, 13 nt, Human
aaguaaaagaaac

SEQ ID NO: 2886155 - RNA, 16 nt, Human
aaguaaagaacugcac

SEQ ID NO: 2886156 - RNA, 17 nt, Human
aaguaaagccauuaaau

SEQ ID NO: 2886157 - RNA, 21 nt, Human
aaguaaagccauuaaaugaau

SEQ ID NO: 2886158 - RNA, 22 nt, Human
guuucuaagguccgguguucua

SEQ ID NO: 2886159 - RNA, 11 nt, Human
guuucuaaggu

SEQ ID NO: 2886160 - RNA, 20 nt, Human
guuucuaagauucuaaaggu

SEQ ID NO: 2886161 - RNA, 21 nt, Human
guuucuaagauucuaaagguc

SEQ ID NO: 2886162 - RNA, 13 nt, Human
aaguaaaauugcu

SEQ ID NO: 2886163 - RNA, 16 nt, Human
guuucuaagauucuaa

SEQ ID NO: 2886164 - RNA, 17 nt, Human
guuucuaagauucuaaa

SEQ ID NO: 2886165 - RNA, 18 nt, Human
guuucuaagauucuaaag

SEQ ID NO: 2886166 - RNA, 19 nt, Human
guuucuaagauucuaaagg

SEQ ID NO: 2886167 - RNA, 19 nt, Human
aaggguaucaggugcugcc

SEQ ID NO: 2886168 - RNA, 17 nt, Human
aaggguaucaggugcug

SEQ ID NO: 2886169 - RNA, 16 nt, Human
aagggcccagauucua

SEQ ID NO: 2886170 - RNA, 11 nt, Human
aagggcccagg

SEQ ID NO: 2886171 - RNA, 14 nt, Human
aagggcccccacau

SEQ ID NO: 2886172 - RNA, 16 nt, Human
aaggcuggcugggcau

SEQ ID NO: 2886173 - RNA, 19 nt, Human
aagggccugccuggccccu

SEQ ID NO: 2886174 - RNA, 19 nt, Human
aaggggagucaccuucccu

SEQ ID NO: 2886175 - RNA, 21 nt, Human
aaggggagucaccuucccuug

SEQ ID NO: 2886176 - RNA, 18 nt, Human
aaggggaucauaaaguua

SEQ ID NO: 2886177 - RNA, 21 nt, Human
aaggggaucauaaaguuagaa

SEQ ID NO: 2886178 - RNA, 12 nt, Human
aaggggcaaauu

SEQ ID NO: 2886179 - RNA, 14 nt, Human
aaggggcaaauuuu

SEQ ID NO: 2886180 - RNA, 18 nt, Human
aaggggcaaauuuuuauu

SEQ ID NO: 2886181 - RNA, 13 nt, Human
aagggcccagaga

SEQ ID NO: 2886182 - RNA, 15 nt, Human
aagggcccagagagg

SEQ ID NO: 2886183 - RNA, 18 nt, Human
aaggcugcagauaacaga

SEQ ID NO: 2886184 - RNA, 20 nt, Human
aaggcugccaacggggagcg

SEQ ID NO: 2886185 - RNA, 14 nt, Human
guuguaaagcaaua

SEQ ID NO: 2886186 - RNA, 17 nt, Human
guuguaaagcaauaaaa

SEQ ID NO: 2886187 - RNA, 18 nt, Human
aaggcugacuacauuuuu

SEQ ID NO: 2886188 - RNA, 21 nt, Human
guuguaacuaggcucagagau

SEQ ID NO: 2886189 - RNA, 12 nt, Human
guuguaacuuau

SEQ ID NO: 2886190 - RNA, 19 nt, Human
aaggcugagaggagagaga

SEQ ID NO: 2886191 - RNA, 13 nt, Human
guuguaacuaggc

SEQ ID NO: 2886192 - RNA, 18 nt, Human
guuguaacuaggcucaga

SEQ ID NO: 2886193 - RNA, 19 nt, Human
guuguaacuaggcucagag

SEQ ID NO: 2886194 - RNA, 14 nt, Human
guuuuacugugaaa

SEQ ID NO: 2886195 - RNA, 16 nt, Human
guuuuauaaugaaccc

SEQ ID NO: 2886196 - RNA, 15 nt, Human
guuuggccaucucug

SEQ ID NO: 2886197 - RNA, 15 nt, Human
guuuggcaauaguuu

SEQ ID NO: 2886198 - RNA, 17 nt, Human
guuuggcaauaguuugc

SEQ ID NO: 2886199 - RNA, 19 nt, Human
guuuggcaauaguuugcau

SEQ ID NO: 2886200 - RNA, 17 nt, Human
guuugcuauuagagcau

SEQ ID NO: 2886201 - RNA, 20 nt, Human
guuuggauucuuauguagca

SEQ ID NO: 2886202 - RNA, 16 nt, Human
guuuggauuuuuaauu

SEQ ID NO: 2886203 - RNA, 21 nt, Human
guuuggauuuuuaauuaaaaa

SEQ ID NO: 2886204 - RNA, 14 nt, Human
guuuggcaaggaaa

SEQ ID NO: 2886205 - RNA, 15 nt, Human
guuuggcaaggaaag

SEQ ID NO: 2886206 - RNA, 16 nt, Human
guuuuaagaggcaggg

SEQ ID NO: 2886207 - RNA, 14 nt, Human
guuuuaagaaaugu

SEQ ID NO: 2886208 - RNA, 15 nt, Human
guuuuaagaaaugua

SEQ ID NO: 2886209 - RNA, 16 nt, Human
guuuuaagaaauguag

SEQ ID NO: 2886210 - RNA, 14 nt, Human
guuuuaagaggcag

SEQ ID NO: 2886211 - RNA, 14 nt, Human
guuucuggucucua

SEQ ID NO: 2886212 - RNA, 16 nt, Human
guuucuggguccugaa

SEQ ID NO: 2886213 - RNA, 19 nt, Human
guuucuggguccugaagaa

SEQ ID NO: 2886214 - RNA, 22 nt, Human
guuucuggguccugaagaauua

SEQ ID NO: 2886215 - RNA, 23 nt, Human
guuucuggguccugaagaauuaa

SEQ ID NO: 2886216 - RNA, 16 nt, Human
guuucucucuacagug

SEQ ID NO: 2886217 - RNA, 19 nt, Human
guuucucucuacagugcca

SEQ ID NO: 2886218 - RNA, 23 nt, Human
guuucucugccgcuaccucccuc

SEQ ID NO: 2886219 - RNA, 13 nt, Human
guuucucauucuu

SEQ ID NO: 2886220 - RNA, 14 nt, Human
guuucucauucuug

SEQ ID NO: 2886221 - RNA, 14 nt, Human
guuucucauuuguu

SEQ ID NO: 2886222 - RNA, 15 nt, Human
guuucucauuuguuu

SEQ ID NO: 2886223 - RNA, 14 nt, Human
guuucucccccugg

SEQ ID NO: 2886224 - RNA, 23 nt, Human
guuucucccccugggcucugccc

SEQ ID NO: 2886225 - RNA, 22 nt, Human
guuucucccccugggcucugcc

SEQ ID NO: 2886226 - RNA, 17 nt, Human
guuucucccccugggcu

SEQ ID NO: 2886227 - RNA, 15 nt, Human
guuucucccccuggg

SEQ ID NO: 2886228 - RNA, 19 nt, Human
guuucucagauccuuguuu

SEQ ID NO: 2886229 - RNA, 21 nt, Human
guuucucagauccuuguuuca

SEQ ID NO: 2886230 - RNA, 13 nt, Human
guuucuauacaaa

SEQ ID NO: 2886231 - RNA, 15 nt, Human
guuucuauacaaaua

SEQ ID NO: 2886232 - RNA, 23 nt, Human
guuucuauacaaauauaaaucuu

SEQ ID NO: 2886233 - RNA, 14 nt, Human
guuucucagcuccc

SEQ ID NO: 2886234 - RNA, 20 nt, Human
guuucuggucucuaggcugg

SEQ ID NO: 2886235 - RNA, 20 nt, Human
guuugcacuguaugcuggac

SEQ ID NO: 2886236 - RNA, 19 nt, Human
guuugcacuguaugcugga

SEQ ID NO: 2886237 - RNA, 15 nt, Human
guuugcaggggugac

SEQ ID NO: 2886238 - RNA, 16 nt, Human
guuugcaggggugacg

SEQ ID NO: 2886239 - RNA, 19 nt, Human
guuugcauaaacauucuuu

SEQ ID NO: 2886240 - RNA, 22 nt, Human
guuugcacuguaugcuggacgg

SEQ ID NO: 2886241 - RNA, 18 nt, Human
guuugccuuccuuucucc

SEQ ID NO: 2886242 - RNA, 17 nt, Human
guuugccucugccucug

SEQ ID NO: 2886243 - RNA, 14 nt, Human
aagaauguugguuu

SEQ ID NO: 2886244 - RNA, 17 nt, Human
aagaauguugguuuacu

SEQ ID NO: 2886245 - RNA, 18 nt, Human
aagaauguugguuuacuu

SEQ ID NO: 2886246 - RNA, 19 nt, Human
aagaauguugguuuacuuu

SEQ ID NO: 2886247 - RNA, 20 nt, Human
aagaauguugguuuacuuuc

SEQ ID NO: 2886248 - RNA, 21 nt, Human
aagaauguugguuuacuuuca

SEQ ID NO: 2886249 - RNA, 18 nt, Human
aagaauuaagauacaaau

SEQ ID NO: 2886250 - RNA, 19 nt, Human
aagaauuaagauacaaauu

SEQ ID NO: 2886251 - RNA, 14 nt, Human
aagaaucagaguag

SEQ ID NO: 2886252 - RNA, 16 nt, Human
aagaaucagaguagaa

SEQ ID NO: 2886253 - RNA, 16 nt, Human
aagaauguguuucaaa

SEQ ID NO: 2886254 - RNA, 16 nt, Human
aagaauguuagagcac

SEQ ID NO: 2886255 - RNA, 17 nt, Human
guggcagcugcggucca

SEQ ID NO: 2886256 - RNA, 19 nt, Human
guggcagagcuuggacugg

SEQ ID NO: 2886257 - RNA, 18 nt, Human
aagaauauguuuccuugu

SEQ ID NO: 2886258 - RNA, 21 nt, Human
aagaauauguuuccuuguuua

SEQ ID NO: 2886259 - RNA, 16 nt, Human
aagaauauucagagaa

SEQ ID NO: 2886260 - RNA, 17 nt, Human
aagaauauucagagaau

SEQ ID NO: 2886261 - RNA, 21 nt, Human
aagaauauucagagaauauca

SEQ ID NO: 2886262 - RNA, 22 nt, Human
aagaauauucagagaauaucaa

SEQ ID NO: 2886263 - RNA, 23 nt, Human
aagaccagagauaguggggagac

SEQ ID NO: 2886264 - RNA, 13 nt, Human
aagaauuuuuuug

SEQ ID NO: 2886265 - RNA, 14 nt, Human
aagaauuuuuuugu

SEQ ID NO: 2886266 - RNA, 15 nt, Human
aagaauuuuuuuguc

SEQ ID NO: 2886267 - RNA, 22 nt, Human
aagaauuuuccugagacaaauu

SEQ ID NO: 2886268 - RNA, 13 nt, Human
aagaauuuuuaaa

SEQ ID NO: 2886269 - RNA, 23 nt, Human
aagaauuucuugguaagaagccg

SEQ ID NO: 2886270 - RNA, 22 nt, Human
aagaauuucuugguaagaagcc

SEQ ID NO: 2886271 - RNA, 20 nt, Human
aagaauuucuugguaagaag

SEQ ID NO: 2886272 - RNA, 12 nt, Human
aagaauucuuau

SEQ ID NO: 2886273 - RNA, 19 nt, Human
aagaauucuuauacacauu

SEQ ID NO: 2886274 - RNA, 19 nt, Human
aagaauucaaacuggggcc

SEQ ID NO: 2886275 - RNA, 20 nt, Human
guggcagauaaucagccucu

SEQ ID NO: 2886276 - RNA, 23 nt, Human
guggcagauaaucagccucuuaa

SEQ ID NO: 2886277 - RNA, 21 nt, Human
guggcagauaaucagccucuu

SEQ ID NO: 2886278 - RNA, 19 nt, Human
guggcacuugccuggguca

SEQ ID NO: 2886279 - RNA, 9 nt, Human
guggcagag

SEQ ID NO: 2886280 - RNA, 13 nt, Human
guggcagagagag

SEQ ID NO: 2886281 - RNA, 17 nt, Human
guggcagagagagagaa

SEQ ID NO: 2886282 - RNA, 15 nt, Human
guggcagagcuugga

SEQ ID NO: 2886283 - RNA, 23 nt, Human
guggcagagcuuggacuggaugc

SEQ ID NO: 2886284 - RNA, 11 nt, Human
guggcagagga

SEQ ID NO: 2886285 - RNA, 14 nt, Human
guggcagcugcggu

SEQ ID NO: 2886286 - RNA, 17 nt, Human
guggcacuugccugggu

SEQ ID NO: 2886287 - RNA, 16 nt, Human
guggcacaggcccccu

SEQ ID NO: 2886288 - RNA, 18 nt, Human
guggauuuuguuuaaaaa

SEQ ID NO: 2886289 - RNA, 15 nt, Human
guggacuggccccug

SEQ ID NO: 2886290 - RNA, 13 nt, Human
guggcaaggcugu

SEQ ID NO: 2886291 - RNA, 15 nt, Human
guggcaaggcugugc

SEQ ID NO: 2886292 - RNA, 16 nt, Human
guggcaaggcugugcu

SEQ ID NO: 2886293 - RNA, 12 nt, Human
guggcacaggcc

SEQ ID NO: 2886294 - RNA, 21 nt, Human
guggcaagcugugacuucucc

SEQ ID NO: 2886295 - RNA, 17 nt, Human
guggcaagaguguggag

SEQ ID NO: 2886296 - RNA, 13 nt, Human
guggcaaauauaa

SEQ ID NO: 2886297 - RNA, 15 nt, Human
guggcaaauauaaaa

SEQ ID NO: 2886298 - RNA, 16 nt, Human
guggcaaauauaaaac

SEQ ID NO: 2886299 - RNA, 13 nt, Human
guggauuucaguu

SEQ ID NO: 2886300 - RNA, 14 nt, Human
guggauuucaguuu

SEQ ID NO: 2886301 - RNA, 14 nt, Human
guggacucugcaca

SEQ ID NO: 2886302 - RNA, 17 nt, Human
guggacucugcacaugu

SEQ ID NO: 2886303 - RNA, 12 nt, Human
guggacucuggu

SEQ ID NO: 2886304 - RNA, 12 nt, Human
gugcuguaauuu

SEQ ID NO: 2886305 - RNA, 20 nt, Human
gugcuggauggagcccaggc

SEQ ID NO: 2886306 - RNA, 21 nt, Human
gugcugggggaaugagcccag

SEQ ID NO: 2886307 - RNA, 23 nt, Human
gugcugggggaaugagcccagag

SEQ ID NO: 2886308 - RNA, 21 nt, Human
gugcuggauauuuuacuacca

SEQ ID NO: 2886309 - RNA, 18 nt, Human
gugcuggauggagcccag

SEQ ID NO: 2886310 - RNA, 19 nt, Human
gugcuggauggagcccagg

SEQ ID NO: 2886311 - RNA, 15 nt, Human
gugcuggcaaccacu

SEQ ID NO: 2886312 - RNA, 16 nt, Human
gugcuggaggugggag

SEQ ID NO: 2886313 - RNA, 17 nt, Human
gugcuggaggugggagc

SEQ ID NO: 2886314 - RNA, 19 nt, Human
gugcuggaggugggagcag

SEQ ID NO: 2886315 - RNA, 21 nt, Human
gugcuggaggugggagcagga

SEQ ID NO: 2886316 - RNA, 24 nt, Human
gugcuggaggugggagcaggagau

SEQ ID NO: 2886317 - RNA, 16 nt, Human
aagaagguggaccuuu

SEQ ID NO: 2886318 - RNA, 18 nt, Human
aagaagguggaccuuuua

SEQ ID NO: 2886319 - RNA, 20 nt, Human
aagaagguggaccuuuuaaa

SEQ ID NO: 2886320 - RNA, 22 nt, Human
aagaagguggaccuuuuaaagu

SEQ ID NO: 2886321 - RNA, 21 nt, Human
aagaaggggacaauggcagaa

SEQ ID NO: 2886322 - RNA, 23 nt, Human
aagaagguuucagaaagaagugg

SEQ ID NO: 2886323 - RNA, 20 nt, Human
guggaaggcaucagucccua

SEQ ID NO: 2886324 - RNA, 15 nt, Human
guggaauuucuuguu

SEQ ID NO: 2886325 - RNA, 18 nt, Human
guggaauuucuuguuucu

SEQ ID NO: 2886326 - RNA, 23 nt, Human
guggaauuucuuguuucuccaga

SEQ ID NO: 2886327 - RNA, 17 nt, Human
guggacaaacuggaguc

SEQ ID NO: 2886328 - RNA, 20 nt, Human
guggacaaacuggagucugg

SEQ ID NO: 2886329 - RNA, 24 nt, Human
guggacacagcucuucuccaggcu

SEQ ID NO: 2886330 - RNA, 15 nt, Human
guggacacagcucuu

SEQ ID NO: 2886331 - RNA, 14 nt, Human
guggacacagcucu

SEQ ID NO: 2886332 - RNA, 15 nt, Human
guggaaggcagacag

SEQ ID NO: 2886333 - RNA, 20 nt, Human
guggaaggcagacagcaggc

SEQ ID NO: 2886334 - RNA, 15 nt, Human
guggaagagugugug

SEQ ID NO: 2886335 - RNA, 13 nt, Human
gugcuguggaagc

SEQ ID NO: 2886336 - RNA, 18 nt, Human
gugcuguccaugcuucuc

SEQ ID NO: 2886337 - RNA, 11 nt, Human
gugcuguggcc

SEQ ID NO: 2886338 - RNA, 14 nt, Human
gugcuguggaagca

SEQ ID NO: 2886339 - RNA, 17 nt, Human
gugcuguggccugggca

SEQ ID NO: 2886340 - RNA, 16 nt, Human
gugcuguggccugggc

SEQ ID NO: 2886341 - RNA, 20 nt, Human
guggaagaaaaugguuuauu

SEQ ID NO: 2886342 - RNA, 12 nt, Human
aagaaaaugguu

SEQ ID NO: 2886343 - RNA, 23 nt, Human
aagaaaaucagauggagcaugaa

SEQ ID NO: 2886344 - RNA, 20 nt, Human
aagaaaguugcacggcugcu

SEQ ID NO: 2886345 - RNA, 22 nt, Human
aagaaaguugcacggcugcuga

SEQ ID NO: 2886346 - RNA, 13 nt, Human
aagaaauaaccac

SEQ ID NO: 2886347 - RNA, 12 nt, Human
aagaaauaauaa

SEQ ID NO: 2886348 - RNA, 13 nt, Human
aagaaauaauaau

SEQ ID NO: 2886349 - RNA, 15 nt, Human
aagaaauaauaauau

SEQ ID NO: 2886350 - RNA, 19 nt, Human
aagaaagucuaucuaauga

SEQ ID NO: 2886351 - RNA, 22 nt, Human
aagaaagucuaucuaaugacau

SEQ ID NO: 2886352 - RNA, 23 nt, Human
aagaaagucuaucuaaugacaug

SEQ ID NO: 2886353 - RNA, 20 nt, Human
aagaaaaccaccccuuagau

SEQ ID NO: 2886354 - RNA, 17 nt, Human
aagaaagugggagguca

SEQ ID NO: 2886355 - RNA, 23 nt, Human
aagaaagugggaggucaggaaac

SEQ ID NO: 2886356 - RNA, 19 nt, Human
aagaaaauuuuuguaguag

SEQ ID NO: 2886357 - RNA, 19 nt, Human
aagaagcaggcuacacuga

SEQ ID NO: 2886358 - RNA, 12 nt, Human
aagaagcaggcu

SEQ ID NO: 2886359 - RNA, 14 nt, Human
aagaagcaggcuac

SEQ ID NO: 2886360 - RNA, 12 nt, Human
aagaagcagaga

SEQ ID NO: 2886361 - RNA, 13 nt, Human
aagaagcagagag

SEQ ID NO: 2886362 - RNA, 17 nt, Human
aagaagccgggaacaga

SEQ ID NO: 2886363 - RNA, 14 nt, Human
aacuugucuuuuca

SEQ ID NO: 2886364 - RNA, 11 nt, Human
aacuugugaau

SEQ ID NO: 2886365 - RNA, 12 nt, Human
aacuugugaaug

SEQ ID NO: 2886366 - RNA, 13 nt, Human
aacuugugaaugc

SEQ ID NO: 2886367 - RNA, 17 nt, Human
aacuugugaaugcuucu

SEQ ID NO: 2886368 - RNA, 18 nt, Human
aacuuguuacuaaagaaa

SEQ ID NO: 2886369 - RNA, 15 nt, Human
aacuuguuauuguga

SEQ ID NO: 2886370 - RNA, 17 nt, Human
aacuuguuauugugaau

SEQ ID NO: 2886371 - RNA, 18 nt, Human
aacuuguuauugugaaug

SEQ ID NO: 2886372 - RNA, 19 nt, Human
aacuuguuauugugaauga

SEQ ID NO: 2886373 - RNA, 20 nt, Human
aacuuguuauugugaaugau

SEQ ID NO: 2886374 - RNA, 16 nt, Human
aacuuguuugcuguga

SEQ ID NO: 2886375 - RNA, 17 nt, Human
aacuuguuugcugugaa

SEQ ID NO: 2886376 - RNA, 20 nt, Human
aacuuguuugcugugaacaa

SEQ ID NO: 2886377 - RNA, 13 nt, Human
aagaaaagaccuu

SEQ ID NO: 2886378 - RNA, 18 nt, Human
aagaaaagacuuguaaua

SEQ ID NO: 2886379 - RNA, 15 nt, Human
aagaaaagagaagaa

SEQ ID NO: 2886380 - RNA, 16 nt, Human
aagaaaagagaagaag

SEQ ID NO: 2886381 - RNA, 15 nt, Human
aagaaaagugcauau

SEQ ID NO: 2886382 - RNA, 20 nt, Human
aagaaaagugcauauuuauc

SEQ ID NO: 2886383 - RNA, 22 nt, Human
aagaaaagugcauauuuaucca

SEQ ID NO: 2886384 - RNA, 22 nt, Human
aagaaaaguagguuuacauuca

SEQ ID NO: 2886385 - RNA, 13 nt, Human
aagaaaaguauuu

SEQ ID NO: 2886386 - RNA, 14 nt, Human
aagaaaaguauuuu

SEQ ID NO: 2886387 - RNA, 15 nt, Human
aagaaaaguauuuug

SEQ ID NO: 2886388 - RNA, 16 nt, Human
aagaaaaguauuuuga

SEQ ID NO: 2886389 - RNA, 17 nt, Human
aagaaaaguauuuugaa

SEQ ID NO: 2886390 - RNA, 21 nt, Human
aagaaaaguauuuugaaguuu

SEQ ID NO: 2886391 - RNA, 22 nt, Human
aagaaaaguauuuugaaguuua

SEQ ID NO: 2886392 - RNA, 23 nt, Human
aagaaaaguauuuugaaguuuac

SEQ ID NO: 2886393 - RNA, 19 nt, Human
aagaaaagggucaaacauc

SEQ ID NO: 2886394 - RNA, 16 nt, Human
aagaaaagugguuguu

SEQ ID NO: 2886395 - RNA, 16 nt, Human
aacuugguucugcuuc

SEQ ID NO: 2886396 - RNA, 17 nt, Human
aacuugguucugcuuca

SEQ ID NO: 2886397 - RNA, 15 nt, Human
aacuuguaaaugugg

SEQ ID NO: 2886398 - RNA, 13 nt, Human
aacuuguagcugu

SEQ ID NO: 2886399 - RNA, 14 nt, Human
aacuuguagcugua

SEQ ID NO: 2886400 - RNA, 16 nt, Human
aacuuguagcuguaaa

SEQ ID NO: 2886401 - RNA, 17 nt, Human
aacuuguagcuguaaaa

SEQ ID NO: 2886402 - RNA, 18 nt, Human
aacuuguagcuguaaaac

SEQ ID NO: 2886403 - RNA, 23 nt, Human
aacuuguagcuguaaaacgcugu

SEQ ID NO: 2886404 - RNA, 22 nt, Human
gugccuggguggacauggcccc

SEQ ID NO: 2886405 - RNA, 15 nt, Human
gugccaauauguauu

SEQ ID NO: 2886406 - RNA, 17 nt, Human
gugccaauauguauugu

SEQ ID NO: 2886407 - RNA, 19 nt, Human
gugccaauauguauuguaa

SEQ ID NO: 2886408 - RNA, 16 nt, Human
gugccugacugcccag

SEQ ID NO: 2886409 - RNA, 20 nt, Human
gugccaauauguauuguaaa

SEQ ID NO: 2886410 - RNA, 21 nt, Human
gugccaauauguauuguaaac

SEQ ID NO: 2886411 - RNA, 14 nt, Human
gugccugggggagu

SEQ ID NO: 2886412 - RNA, 16 nt, Human
gugccugggggaguuu

SEQ ID NO: 2886413 - RNA, 12 nt, Human
gugccuggccug

SEQ ID NO: 2886414 - RNA, 15 nt, Human
gugccuggccuggca

SEQ ID NO: 2886415 - RNA, 19 nt, Human
gugccuggccuggcacaca

SEQ ID NO: 2886416 - RNA, 22 nt, Human
gugccuggacauuugccuugcu

SEQ ID NO: 2886417 - RNA, 16 nt, Human
gugccuggccacgccc

SEQ ID NO: 2886418 - RNA, 11 nt, Human
gugccugcagc

SEQ ID NO: 2886419 - RNA, 21 nt, Human
gugcacguggagagcuggugc

SEQ ID NO: 2886420 - RNA, 12 nt, Human
gugcacguugcu

SEQ ID NO: 2886421 - RNA, 18 nt, Human
gugcacguugcuucaggc

SEQ ID NO: 2886422 - RNA, 15 nt, Human
gugccaacuccucac

SEQ ID NO: 2886423 - RNA, 15 nt, Human
gugccaacuguggcu

SEQ ID NO: 2886424 - RNA, 16 nt, Human
gugccaacuguggcug

SEQ ID NO: 2886425 - RNA, 18 nt, Human
gugccaacuguggcuggu

SEQ ID NO: 2886426 - RNA, 22 nt, Human
gugccaacacucaagaagcagg

SEQ ID NO: 2886427 - RNA, 23 nt, Human
gugccaacacucaagaagcaggc

SEQ ID NO: 2886428 - RNA, 11 nt, Human
gugccaaggac

SEQ ID NO: 2886429 - RNA, 20 nt, Human
gugccaaggaccuccucuuc

SEQ ID NO: 2886430 - RNA, 17 nt, Human
gugcacacaccagagcc

SEQ ID NO: 2886431 - RNA, 18 nt, Human
gugcacgcaguggccuuc

SEQ ID NO: 2886432 - RNA, 13 nt, Human
gugcacaaggauu

SEQ ID NO: 2886433 - RNA, 13 nt, Human
gugcacacacaca

SEQ ID NO: 2886434 - RNA, 18 nt, Human
gugcacguacacacacau

SEQ ID NO: 2886435 - RNA, 18 nt, Human
gugcacguggagagcugg

SEQ ID NO: 2886436 - RNA, 16 nt, Human
gugcacguggagagcu

SEQ ID NO: 2886437 - RNA, 15 nt, Human
gugcacguggagagc

SEQ ID NO: 2886438 - RNA, 18 nt, Human
gugcacgcagauuagcag

SEQ ID NO: 2886439 - RNA, 14 nt, Human
gugcacacaccaga

SEQ ID NO: 2886440 - RNA, 12 nt, Human
gugcacacacca

SEQ ID NO: 2886441 - RNA, 20 nt, Human
aagaugcaaggaccaggacu

SEQ ID NO: 2886442 - RNA, 15 nt, Human
aagaugcaaggacca

SEQ ID NO: 2886443 - RNA, 15 nt, Human
aagaugaucagaccu

SEQ ID NO: 2886444 - RNA, 15 nt, Human
aagaugauuugcaau

SEQ ID NO: 2886445 - RNA, 16 nt, Human
aagaugauuugcaaug

SEQ ID NO: 2886446 - RNA, 18 nt, Human
aagaugagagaacuggag

SEQ ID NO: 2886447 - RNA, 20 nt, Human
aagaugagauuggcauggcu

SEQ ID NO: 2886448 - RNA, 21 nt, Human
aagaugagauuggcauggcuu

SEQ ID NO: 2886449 - RNA, 22 nt, Human
aagaugagauuggcauggcuuu

SEQ ID NO: 2886450 - RNA, 17 nt, Human
aagaugagagaacugga

SEQ ID NO: 2886451 - RNA, 14 nt, Human
aagauguauauagg

SEQ ID NO: 2886452 - RNA, 13 nt, Human
aagcaaauacuua

SEQ ID NO: 2886453 - RNA, 18 nt, Human
aagcaaauacuuagcaaa

SEQ ID NO: 2886454 - RNA, 23 nt, Human
aagcaaauacuuagcaaaaagug

SEQ ID NO: 2886455 - RNA, 12 nt, Human
aagcaaaugucu

SEQ ID NO: 2886456 - RNA, 14 nt, Human
gugguuauuucuca

SEQ ID NO: 2886457 - RNA, 22 nt, Human
gugguuauuucucaacaaagca

SEQ ID NO: 2886458 - RNA, 15 nt, Human
aagaucaaaauaaaa

SEQ ID NO: 2886459 - RNA, 17 nt, Human
aagaucaaaauaaaaag

SEQ ID NO: 2886460 - RNA, 21 nt, Human
aagaucaaaauaaaaagugac

SEQ ID NO: 2886461 - RNA, 20 nt, Human
aagaucacugccagagauaa

SEQ ID NO: 2886462 - RNA, 22 nt, Human
aagaucaaaauaaaaagugaca

SEQ ID NO: 2886463 - RNA, 14 nt, Human
aagauccaagaagg

SEQ ID NO: 2886464 - RNA, 15 nt, Human
aagauccccucagga

SEQ ID NO: 2886465 - RNA, 16 nt, Human
aagauccccucaggac

SEQ ID NO: 2886466 - RNA, 22 nt, Human
aagauccuaaaacaaaagcuca

SEQ ID NO: 2886467 - RNA, 21 nt, Human
aagauccugucuuuaaggaaa

SEQ ID NO: 2886468 - RNA, 22 nt, Human
aagauccuagauccuaaggguc

SEQ ID NO: 2886469 - RNA, 15 nt, Human
guguccaccuguggg

SEQ ID NO: 2886470 - RNA, 16 nt, Human
guguccaccugugggu

SEQ ID NO: 2886471 - RNA, 17 nt, Human
guguccaccugugggug

SEQ ID NO: 2886472 - RNA, 14 nt, Human
aagcaaggcggugg

SEQ ID NO: 2886473 - RNA, 15 nt, Human
aagcaagggggugau

SEQ ID NO: 2886474 - RNA, 16 nt, Human
aagcaaggaaaacuua

SEQ ID NO: 2886475 - RNA, 20 nt, Human
aagcaaggaagauauacaug

SEQ ID NO: 2886476 - RNA, 15 nt, Human
aagcaagcuaaccuu

SEQ ID NO: 2886477 - RNA, 12 nt, Human
aagcaagcucuc

SEQ ID NO: 2886478 - RNA, 16 nt, Human
aagcaagcucucuugc

SEQ ID NO: 2886479 - RNA, 16 nt, Human
aagcaagcaacacaga

SEQ ID NO: 2886480 - RNA, 20 nt, Human
gugucccaaaaagaaaggag

SEQ ID NO: 2886481 - RNA, 19 nt, Human
gugucuugcaauggcagcc

SEQ ID NO: 2886482 - RNA, 17 nt, Human
guguccauuuugugaag

SEQ ID NO: 2886483 - RNA, 19 nt, Human
guguccauuuugugaagcc

SEQ ID NO: 2886484 - RNA, 20 nt, Human
guguccauuuugugaagccc

SEQ ID NO: 2886485 - RNA, 21 nt, Human
guguccauuuugugaagcccu

SEQ ID NO: 2886486 - RNA, 22 nt, Human
guguccauuuugugaagcccug

SEQ ID NO: 2886487 - RNA, 12 nt, Human
gugugguggccu

SEQ ID NO: 2886488 - RNA, 13 nt, Human
gugugguggccuc

SEQ ID NO: 2886489 - RNA, 15 nt, Human
gugugguggccucag

SEQ ID NO: 2886490 - RNA, 16 nt, Human
gugugguggccucagc

SEQ ID NO: 2886491 - RNA, 23 nt, Human
gugugguggccucagcugaaugc

SEQ ID NO: 2886492 - RNA, 18 nt, Human
gugugagucaccaagccc

SEQ ID NO: 2886493 - RNA, 13 nt, Human
gugugagucacca

SEQ ID NO: 2886494 - RNA, 21 nt, Human
gugucuugcaauggcagccuu

SEQ ID NO: 2886495 - RNA, 14 nt, Human
gugucuuguucugu

SEQ ID NO: 2886496 - RNA, 18 nt, Human
gugucuuguucugucacu

SEQ ID NO: 2886497 - RNA, 17 nt, Human
guguugaaaauguucag

SEQ ID NO: 2886498 - RNA, 11 nt, Human
guguugacauu

SEQ ID NO: 2886499 - RNA, 19 nt, Human
guguugagccuuuucccuc

SEQ ID NO: 2886500 - RNA, 14 nt, Human
guguuuaagacauu

SEQ ID NO: 2886501 - RNA, 13 nt, Human
guguuuaagacau

SEQ ID NO: 2886502 - RNA, 17 nt, Human
guguuguugcucuagga

SEQ ID NO: 2886503 - RNA, 15 nt, Human
guguuguugcuucuu

SEQ ID NO: 2886504 - RNA, 21 nt, Human
guguuguugcuucuugugaag

SEQ ID NO: 2886505 - RNA, 12 nt, Human
guguuuaaaaaa

SEQ ID NO: 2886506 - RNA, 16 nt, Human
guguguuccaaguuuc

SEQ ID NO: 2886507 - RNA, 16 nt, Human
guguugaaaauguuca

SEQ ID NO: 2886508 - RNA, 23 nt, Human
guguucuguuuguuauuguuuug

SEQ ID NO: 2886509 - RNA, 12 nt, Human
guguugaaaacc

SEQ ID NO: 2886510 - RNA, 13 nt, Human
guguugaaaacca

SEQ ID NO: 2886511 - RNA, 15 nt, Human
guguugaaaaccaaa

SEQ ID NO: 2886512 - RNA, 21 nt, Human
guguugaaaaccaaaaugaca

SEQ ID NO: 2886513 - RNA, 14 nt, Human
guguucuguuuguu

SEQ ID NO: 2886514 - RNA, 21 nt, Human
gugugguguuagggugcagcc

SEQ ID NO: 2886515 - RNA, 13 nt, Human
guguguaauuguu

SEQ ID NO: 2886516 - RNA, 16 nt, Human
guguguaauuguuccu

SEQ ID NO: 2886517 - RNA, 13 nt, Human
guguguguaugug

SEQ ID NO: 2886518 - RNA, 15 nt, Human
gugugugugugugug

SEQ ID NO: 2886519 - RNA, 14 nt, Human
gugugugugugugu

SEQ ID NO: 2886520 - RNA, 15 nt, Human
gugugugugugugua

SEQ ID NO: 2886521 - RNA, 16 nt, Human
guguguguguguaugu

SEQ ID NO: 2886522 - RNA, 13 nt, Human
guguguguguggc

SEQ ID NO: 2886523 - RNA, 12 nt, Human
gugugugugugu

SEQ ID NO: 2886524 - RNA, 11 nt, Human
gugugugugug

SEQ ID NO: 2886525 - RNA, 12 nt, Human
guguguguguga

SEQ ID NO: 2886526 - RNA, 13 nt, Human
gugugugugugca

SEQ ID NO: 2886527 - RNA, 10 nt, Human
gugugugugu

SEQ ID NO: 2886528 - RNA, 12 nt, Human
guguguguguau

SEQ ID NO: 2886529 - RNA, 12 nt, Human
guguguguaugu

SEQ ID NO: 2886530 - RNA, 13 nt, Human
gugugugugaaug

SEQ ID NO: 2886531 - RNA, 9 nt, Human
gugugugug

SEQ ID NO: 2886532 - RNA, 19 nt, Human
guguguguaugcgugugug

SEQ ID NO: 2886533 - RNA, 19 nt, Human
aagacucaaauguucuaag

SEQ ID NO: 2886534 - RNA, 17 nt, Human
aagacucaaauguucua

SEQ ID NO: 2886535 - RNA, 18 nt, Human
aagacucaaauguucuaa

SEQ ID NO: 2886536 - RNA, 15 nt, Human
aagaccccugacuca

SEQ ID NO: 2886537 - RNA, 19 nt, Human
aagacggcacggucuuccc

SEQ ID NO: 2886538 - RNA, 21 nt, Human
aagacggcacggucuucccuc

SEQ ID NO: 2886539 - RNA, 14 nt, Human
aagacucaaauguu

SEQ ID NO: 2886540 - RNA, 16 nt, Human
aagacucaaauguucu

SEQ ID NO: 2886541 - RNA, 12 nt, Human
aagaccagucca

SEQ ID NO: 2886542 - RNA, 17 nt, Human
aagacucauucuucugu

SEQ ID NO: 2886543 - RNA, 21 nt, Human
aagacuggaagguggggacag

SEQ ID NO: 2886544 - RNA, 23 nt, Human
aagacuggaagcuaauuugcauu

SEQ ID NO: 2886545 - RNA, 22 nt, Human
aagacuggaagcuaauuugcau

SEQ ID NO: 2886546 - RNA, 20 nt, Human
aagacuggaagcuaauuugc

SEQ ID NO: 2886547 - RNA, 17 nt, Human
aagacucauucccuaga

SEQ ID NO: 2886548 - RNA, 12 nt, Human
aagagcucuggu

SEQ ID NO: 2886549 - RNA, 13 nt, Human
aagagcucuggug

SEQ ID NO: 2886550 - RNA, 21 nt, Human
aagagccauguagaagcugca

SEQ ID NO: 2886551 - RNA, 16 nt, Human
guggcccgacagccug

SEQ ID NO: 2886552 - RNA, 13 nt, Human
aagagcugcccuc

SEQ ID NO: 2886553 - RNA, 15 nt, Human
aagagauuccugagc

SEQ ID NO: 2886554 - RNA, 14 nt, Human
aagagauugcuaau

SEQ ID NO: 2886555 - RNA, 15 nt, Human
aagagauugcuaauu

SEQ ID NO: 2886556 - RNA, 19 nt, Human
aagagauugcuaauugcug

SEQ ID NO: 2886557 - RNA, 23 nt, Human
gugggggugcagaugagguugcu

SEQ ID NO: 2886558 - RNA, 15 nt, Human
gugggauucagagaa

SEQ ID NO: 2886559 - RNA, 13 nt, Human
gugggggguccuu

SEQ ID NO: 2886560 - RNA, 20 nt, Human
gugguguuuccugcaggcca

SEQ ID NO: 2886561 - RNA, 22 nt, Human
guggugucugccuguugcguga

SEQ ID NO: 2886562 - RNA, 14 nt, Human
guggugugaucuua

SEQ ID NO: 2886563 - RNA, 12 nt, Human
gugguguaauuu

SEQ ID NO: 2886564 - RNA, 11 nt, Human
guggugucacu

SEQ ID NO: 2886565 - RNA, 18 nt, Human
guggugucacugucccuc

SEQ ID NO: 2886566 - RNA, 19 nt, Human
guggugucacugucccucc

SEQ ID NO: 2886567 - RNA, 22 nt, Human
guggugucacugucccuccugg

SEQ ID NO: 2886568 - RNA, 23 nt, Human
guggugucacugucccuccuggu

SEQ ID NO: 2886569 - RNA, 12 nt, Human
gugguggagcca

SEQ ID NO: 2886570 - RNA, 22 nt, Human
gugguggagccaguaaacagag

SEQ ID NO: 2886571 - RNA, 17 nt, Human
gugguggaguggaguga

SEQ ID NO: 2886572 - RNA, 16 nt, Human
gugguggcacaggccc

SEQ ID NO: 2886573 - RNA, 14 nt, Human
gugguggagccagu

SEQ ID NO: 2886574 - RNA, 18 nt, Human
gugguggcccacgccugu

SEQ ID NO: 2886575 - RNA, 13 nt, Human
gugguggccucag

SEQ ID NO: 2886576 - RNA, 14 nt, Human
gugguggccucagc

SEQ ID NO: 2886577 - RNA, 18 nt, Human
gugguggcucacgccugu

SEQ ID NO: 2886578 - RNA, 23 nt, Human
gugguggcauacgccuguagucc

SEQ ID NO: 2886579 - RNA, 17 nt, Human
gugguggcaguggaggu

SEQ ID NO: 2886580 - RNA, 20 nt, Human
guggcuucuuuucuuuguau

SEQ ID NO: 2886581 - RNA, 21 nt, Human
guggcuucccgcucagcccuc

SEQ ID NO: 2886582 - RNA, 22 nt, Human
guggcuugagaaauauggacac

SEQ ID NO: 2886583 - RNA, 20 nt, Human
guggcuuuccuuguggcaga

SEQ ID NO: 2886584 - RNA, 21 nt, Human
guggcuuuccuuguggcagag

SEQ ID NO: 2886585 - RNA, 23 nt, Human
guggcuuuccuuguggcagagga

SEQ ID NO: 2886586 - RNA, 12 nt, Human
guggccucagaa

SEQ ID NO: 2886587 - RNA, 11 nt, Human
guggccucaga

SEQ ID NO: 2886588 - RNA, 13 nt, Human
guggccucagaau

SEQ ID NO: 2886589 - RNA, 11 nt, Human
guggccucagc

SEQ ID NO: 2886590 - RNA, 18 nt, Human
guggccucagcugaaugc

SEQ ID NO: 2886591 - RNA, 23 nt, Human
guggccucagcugaaugccuccu

SEQ ID NO: 2886592 - RNA, 20 nt, Human
gugggaugugguuuucuuaa

SEQ ID NO: 2886593 - RNA, 12 nt, Human
gugggagcagga

SEQ ID NO: 2886594 - RNA, 13 nt, Human
gugggagcaggag

SEQ ID NO: 2886595 - RNA, 14 nt, Human
gugggagcaggaga

SEQ ID NO: 2886596 - RNA, 15 nt, Human
gugggagcaggagau

SEQ ID NO: 2886597 - RNA, 22 nt, Human
gugggagcaggagauugagaag

SEQ ID NO: 2886598 - RNA, 12 nt, Human
gugggaaaacac

SEQ ID NO: 2886599 - RNA, 15 nt, Human
gugggagagcccagc

SEQ ID NO: 2886600 - RNA, 14 nt, Human
gugggagagcccag

SEQ ID NO: 2886601 - RNA, 13 nt, Human
gugggagagccca

SEQ ID NO: 2886602 - RNA, 17 nt, Human
aacagucuucaggcaaa

SEQ ID NO: 2886603 - RNA, 14 nt, Human
aacagguggagaaa

SEQ ID NO: 2886604 - RNA, 18 nt, Human
aacagguguuggugacaa

SEQ ID NO: 2886605 - RNA, 13 nt, Human
aacagguauuuug

SEQ ID NO: 2886606 - RNA, 14 nt, Human
aacagguauuuugu

SEQ ID NO: 2886607 - RNA, 18 nt, Human
aacagguauuuuguuucu

SEQ ID NO: 2886608 - RNA, 21 nt, Human
aacagguauuuuguuucuuuu

SEQ ID NO: 2886609 - RNA, 22 nt, Human
aacagguauuuuguuucuuuua

SEQ ID NO: 2886610 - RNA, 18 nt, Human
aacagauucacacugucu

SEQ ID NO: 2886611 - RNA, 17 nt, Human
aacagauuauuuuggaa

SEQ ID NO: 2886612 - RNA, 20 nt, Human
aacagauuauuuuggaaagu

SEQ ID NO: 2886613 - RNA, 22 nt, Human
aacagauuauuuuggaaaguuu

SEQ ID NO: 2886614 - RNA, 15 nt, Human
aacagauucacacug

SEQ ID NO: 2886615 - RNA, 16 nt, Human
aacagauucacacugu

SEQ ID NO: 2886616 - RNA, 19 nt, Human
guccuaauucuucuguccu

SEQ ID NO: 2886617 - RNA, 21 nt, Human
aacagaugaugagaauuucua

SEQ ID NO: 2886618 - RNA, 19 nt, Human
aacagagugagacccuguc

SEQ ID NO: 2886619 - RNA, 16 nt, Human
aacagaugaauaaacu

SEQ ID NO: 2886620 - RNA, 21 nt, Human
aacagaggccauggcagaaua

SEQ ID NO: 2886621 - RNA, 17 nt, Human
aacagaggccauggcag

SEQ ID NO: 2886622 - RNA, 20 nt, Human
aacagacuggaagcacagcu

SEQ ID NO: 2886623 - RNA, 13 nt, Human
guccuacccaccc

SEQ ID NO: 2886624 - RNA, 20 nt, Human
aacagaggaagaauuuguua

SEQ ID NO: 2886625 - RNA, 16 nt, Human
aacauauguacauaaa

SEQ ID NO: 2886626 - RNA, 19 nt, Human
aacauauguacauaaauug

SEQ ID NO: 2886627 - RNA, 21 nt, Human
aacauauguacauaaauugca

SEQ ID NO: 2886628 - RNA, 19 nt, Human
aacauauucuguaugaacu

SEQ ID NO: 2886629 - RNA, 23 nt, Human
aacauauucuguaugaacuuuau

SEQ ID NO: 2886630 - RNA, 12 nt, Human
aacauaugauuu

SEQ ID NO: 2886631 - RNA, 14 nt, Human
aacauaugauuuca

SEQ ID NO: 2886632 - RNA, 21 nt, Human
aacauaugauuucacuagaaa

SEQ ID NO: 2886633 - RNA, 17 nt, Human
aacauaacccacuuguc

SEQ ID NO: 2886634 - RNA, 20 nt, Human
aacauaacccacuugucacu

SEQ ID NO: 2886635 - RNA, 21 nt, Human
aacauaacccacuugucacug

SEQ ID NO: 2886636 - RNA, 14 nt, Human
aacauaaucuaguu

SEQ ID NO: 2886637 - RNA, 16 nt, Human
aacauaaucuaguuua

SEQ ID NO: 2886638 - RNA, 13 nt, Human
aacagugagccug

SEQ ID NO: 2886639 - RNA, 21 nt, Human
aacagugagccugaauuuugu

SEQ ID NO: 2886640 - RNA, 12 nt, Human
aacauaauuaaa

SEQ ID NO: 2886641 - RNA, 13 nt, Human
aacauagaaaaau

SEQ ID NO: 2886642 - RNA, 12 nt, Human
aacauaaugaaa

SEQ ID NO: 2886643 - RNA, 15 nt, Human
aacauaaugaaaaua

SEQ ID NO: 2886644 - RNA, 14 nt, Human
guccaugcuucuca

SEQ ID NO: 2886645 - RNA, 21 nt, Human
guccaugcagggggcuccugg

SEQ ID NO: 2886646 - RNA, 22 nt, Human
guccaugcagggggcuccuggg

SEQ ID NO: 2886647 - RNA, 22 nt, Human
guccaugcaugacagccucuau

SEQ ID NO: 2886648 - RNA, 18 nt, Human
guagcggaugauucuuca

SEQ ID NO: 2886649 - RNA, 23 nt, Human
guagccuugcccggauucuggga

SEQ ID NO: 2886650 - RNA, 15 nt, Human
guagccuugcccgga

SEQ ID NO: 2886651 - RNA, 21 nt, Human
guagccucgccgucugugaau

SEQ ID NO: 2886652 - RNA, 12 nt, Human
guagccugugca

SEQ ID NO: 2886653 - RNA, 22 nt, Human
guagccuggauauuauucuugu

SEQ ID NO: 2886654 - RNA, 22 nt, Human
guagcguuuuuuaaauguauac

SEQ ID NO: 2886655 - RNA, 18 nt, Human
guagcguuuuuuaaaugu

SEQ ID NO: 2886656 - RNA, 17 nt, Human
guagcguuuuuuaaaug

SEQ ID NO: 2886657 - RNA, 13 nt, Human
guagcguuuuuua

SEQ ID NO: 2886658 - RNA, 18 nt, Human
gucccaccuuggcugcag

SEQ ID NO: 2886659 - RNA, 17 nt, Human
gucccaccuuggcugca

SEQ ID NO: 2886660 - RNA, 19 nt, Human
guccaugugguucuucaaa

SEQ ID NO: 2886661 - RNA, 19 nt, Human
gucccaccuuggcugcagg

SEQ ID NO: 2886662 - RNA, 17 nt, Human
gucccccuauccuuggc

SEQ ID NO: 2886663 - RNA, 18 nt, Human
gucccccuauccuuggca

SEQ ID NO: 2886664 - RNA, 13 nt, Human
gucccccucagca

SEQ ID NO: 2886665 - RNA, 14 nt, Human
gucccccucuggcu

SEQ ID NO: 2886666 - RNA, 12 nt, Human
gucccccucugg

SEQ ID NO: 2886667 - RNA, 21 nt, Human
guccgaaagggacuuggaagc

SEQ ID NO: 2886668 - RNA, 22 nt, Human
guccgaaagggacuuggaagcu

SEQ ID NO: 2886669 - RNA, 15 nt, Human
gucccgaauccacag

SEQ ID NO: 2886670 - RNA, 17 nt, Human
guccguggguugcuaac

SEQ ID NO: 2886671 - RNA, 18 nt, Human
guccguggguugcuaacu

SEQ ID NO: 2886672 - RNA, 20 nt, Human
guccguggguugcuaacuga

SEQ ID NO: 2886673 - RNA, 22 nt, Human
guccguggguugcuaacugaac

SEQ ID NO: 2886674 - RNA, 18 nt, Human
guccuaaggaaccuuccu

SEQ ID NO: 2886675 - RNA, 15 nt, Human
guccuaaggaaccuu

SEQ ID NO: 2886676 - RNA, 16 nt, Human
guccuaacugguauag

SEQ ID NO: 2886677 - RNA, 15 nt, Human
guccuaaaagcaaaa

SEQ ID NO: 2886678 - RNA, 13 nt, Human
guccccgcagccc

SEQ ID NO: 2886679 - RNA, 18 nt, Human
guccccguggccaucccu

SEQ ID NO: 2886680 - RNA, 15 nt, Human
guccccggggcccag

SEQ ID NO: 2886681 - RNA, 16 nt, Human
guccccggggcccagg

SEQ ID NO: 2886682 - RNA, 22 nt, Human
guccccucccagagcuggugga

SEQ ID NO: 2886683 - RNA, 12 nt, Human
guccccucaccu

SEQ ID NO: 2886684 - RNA, 16 nt, Human
gucucaggucccugca

SEQ ID NO: 2886685 - RNA, 23 nt, Human
gucucacaguguugcccaggcug

SEQ ID NO: 2886686 - RNA, 19 nt, Human
gucucacaguguugcccag

SEQ ID NO: 2886687 - RNA, 15 nt, Human
gucucaggucccugc

SEQ ID NO: 2886688 - RNA, 13 nt, Human
gucucaggcuggu

SEQ ID NO: 2886689 - RNA, 17 nt, Human
gucucaggcugguggga

SEQ ID NO: 2886690 - RNA, 19 nt, Human
gucucauuccguugucugu

SEQ ID NO: 2886691 - RNA, 20 nt, Human
gucucauuccguugucugug

SEQ ID NO: 2886692 - RNA, 15 nt, Human
gucucauuuuaaugu

SEQ ID NO: 2886693 - RNA, 16 nt, Human
gucucauuuuaaugua

SEQ ID NO: 2886694 - RNA, 20 nt, Human
gucucauuuuaauguaaaga

SEQ ID NO: 2886695 - RNA, 22 nt, Human
gucucauuuuaauguaaagauu

SEQ ID NO: 2886696 - RNA, 18 nt, Human
gucucaggcuggugggag

SEQ ID NO: 2886697 - RNA, 22 nt, Human
gucucaggcuggugggaggggc

SEQ ID NO: 2886698 - RNA, 17 nt, Human
gucucagggugcagagg

SEQ ID NO: 2886699 - RNA, 18 nt, Human
gucucagggugcagaggu

SEQ ID NO: 2886700 - RNA, 12 nt, Human
gucuccacugug

SEQ ID NO: 2886701 - RNA, 19 nt, Human
gucuccacugugccuuugc

SEQ ID NO: 2886702 - RNA, 17 nt, Human
gucuaucuaaugacaug

SEQ ID NO: 2886703 - RNA, 14 nt, Human
gucuaugggacuca

SEQ ID NO: 2886704 - RNA, 22 nt, Human
gucucaaacucuugaccucagg

SEQ ID NO: 2886705 - RNA, 16 nt, Human
gucucaaacuccugac

SEQ ID NO: 2886706 - RNA, 20 nt, Human
gucucaagagggcacuggug

SEQ ID NO: 2886707 - RNA, 22 nt, Human
gucucaagagggcacugguggc

SEQ ID NO: 2886708 - RNA, 21 nt, Human
gucucaacucuguccccagga

SEQ ID NO: 2886709 - RNA, 23 nt, Human
gucucaacugcucuuuuauacug

SEQ ID NO: 2886710 - RNA, 19 nt, Human
gucucaagggcuagcaucc

SEQ ID NO: 2886711 - RNA, 15 nt, Human
gucucaagagggcac

SEQ ID NO: 2886712 - RNA, 17 nt, Human
gucucaagagggcacug

SEQ ID NO: 2886713 - RNA, 16 nt, Human
gucucaaacuccuggg

SEQ ID NO: 2886714 - RNA, 16 nt, Human
gucucaaaaauacaaa

SEQ ID NO: 2886715 - RNA, 17 nt, Human
gucucaaaaauacaaaa

SEQ ID NO: 2886716 - RNA, 13 nt, Human
gucucaaacaagg

SEQ ID NO: 2886717 - RNA, 20 nt, Human
gucucaaacuccugggcuca

SEQ ID NO: 2886718 - RNA, 21 nt, Human
gucuccaguauccacuuugca

SEQ ID NO: 2886719 - RNA, 17 nt, Human
aacauuuuacccacaca

SEQ ID NO: 2886720 - RNA, 23 nt, Human
aacauuuuagcucuauugauacu

SEQ ID NO: 2886721 - RNA, 15 nt, Human
aacauuuuacccaca

SEQ ID NO: 2886722 - RNA, 18 nt, Human
aaccaaaggacauuaugu

SEQ ID NO: 2886723 - RNA, 15 nt, Human
aacauuuuaaauaaa

SEQ ID NO: 2886724 - RNA, 19 nt, Human
aacauuuuaaauaaaagaa

SEQ ID NO: 2886725 - RNA, 20 nt, Human
aacauuuuaaauaaaagaaa

SEQ ID NO: 2886726 - RNA, 13 nt, Human
aaccacaucuugc

SEQ ID NO: 2886727 - RNA, 21 nt, Human
aaccauccacuuacauauauu

SEQ ID NO: 2886728 - RNA, 20 nt, Human
aaccauccagugacaaacca

SEQ ID NO: 2886729 - RNA, 22 nt, Human
aaccauccagugacaaaccauc

SEQ ID NO: 2886730 - RNA, 18 nt, Human
aaccacagcugcuggaga

SEQ ID NO: 2886731 - RNA, 13 nt, Human
aaccacagcugcu

SEQ ID NO: 2886732 - RNA, 14 nt, Human
aaccacagcugcug

SEQ ID NO: 2886733 - RNA, 15 nt, Human
aaccacagcugcugg

SEQ ID NO: 2886734 - RNA, 16 nt, Human
aaccacagcugcugga

SEQ ID NO: 2886735 - RNA, 21 nt, Human
aaccaacuugguucugcuuca

SEQ ID NO: 2886736 - RNA, 14 nt, Human
aaccaagagauugc

SEQ ID NO: 2886737 - RNA, 15 nt, Human
aaccaagagauugcu

SEQ ID NO: 2886738 - RNA, 16 nt, Human
aaccaagagauugcua

SEQ ID NO: 2886739 - RNA, 18 nt, Human
aaccaagagauugcuaau

SEQ ID NO: 2886740 - RNA, 22 nt, Human
aaccaagagauugcuaauugcu

SEQ ID NO: 2886741 - RNA, 22 nt, Human
aacauuuuaaaaacauagaaaa

SEQ ID NO: 2886742 - RNA, 13 nt, Human
aaccaacacccaa

SEQ ID NO: 2886743 - RNA, 21 nt, Human
aaccaagaucuauaaagcgau

SEQ ID NO: 2886744 - RNA, 19 nt, Human
aaccaagcaggagacgaca

SEQ ID NO: 2886745 - RNA, 22 nt, Human
aaccaagcaucagggggaagaa

SEQ ID NO: 2886746 - RNA, 16 nt, Human
aacauuuugagaacaa

SEQ ID NO: 2886747 - RNA, 20 nt, Human
aacauuuugagaacaaagau

SEQ ID NO: 2886748 - RNA, 11 nt, Human
guccugcucca

SEQ ID NO: 2886749 - RNA, 12 nt, Human
guccugcuccag

SEQ ID NO: 2886750 - RNA, 22 nt, Human
guccugcuccagaauuuggaaa

SEQ ID NO: 2886751 - RNA, 16 nt, Human
guccuugcaccccuca

SEQ ID NO: 2886752 - RNA, 18 nt, Human
guccuugcaccccucacu

SEQ ID NO: 2886753 - RNA, 19 nt, Human
guccuugcaccccucacuc

SEQ ID NO: 2886754 - RNA, 17 nt, Human
guccuuggaaguuucau

SEQ ID NO: 2886755 - RNA, 14 nt, Human
guccuuuaguaccu

SEQ ID NO: 2886756 - RNA, 13 nt, Human
guccuuuaugugg

SEQ ID NO: 2886757 - RNA, 16 nt, Human
guccuuuauguggaaa

SEQ ID NO: 2886758 - RNA, 15 nt, Human
guccugaucugugau

SEQ ID NO: 2886759 - RNA, 21 nt, Human
aacauuauagauuuucauguu

SEQ ID NO: 2886760 - RNA, 17 nt, Human
aacauuaccuuacugug

SEQ ID NO: 2886761 - RNA, 19 nt, Human
aacauuaccuuacugugga

SEQ ID NO: 2886762 - RNA, 15 nt, Human
aacauuaaaaaugga

SEQ ID NO: 2886763 - RNA, 16 nt, Human
aacauuaaaaauggaa

SEQ ID NO: 2886764 - RNA, 19 nt, Human
aacauuaaaaauggaacug

SEQ ID NO: 2886765 - RNA, 21 nt, Human
aacauuaaaaauggaacugug

SEQ ID NO: 2886766 - RNA, 12 nt, Human
aacauuaaaugu

SEQ ID NO: 2886767 - RNA, 14 nt, Human
aacauuaaaugucu

SEQ ID NO: 2886768 - RNA, 15 nt, Human
aacauuaaaugucuu

SEQ ID NO: 2886769 - RNA, 18 nt, Human
aacauuaaaugucuuaua

SEQ ID NO: 2886770 - RNA, 23 nt, Human
aacauuaaaugucuuauauagca

SEQ ID NO: 2886771 - RNA, 20 nt, Human
aacauuacagggaaugccug

SEQ ID NO: 2886772 - RNA, 22 nt, Human
aacauuacagggaaugccugag

SEQ ID NO: 2886773 - RNA, 16 nt, Human
aacauuaccuuacugu

SEQ ID NO: 2886774 - RNA, 23 nt, Human
gucgcccagucuggaaugcagug

SEQ ID NO: 2886775 - RNA, 15 nt, Human
gucgcccucccaggc

SEQ ID NO: 2886776 - RNA, 18 nt, Human
gucuaucaagucaaucau

SEQ ID NO: 2886777 - RNA, 21 nt, Human
gucuauaaucccagcacuuug

SEQ ID NO: 2886778 - RNA, 20 nt, Human
gucuauaaucccagcacuuu

SEQ ID NO: 2886779 - RNA, 17 nt, Human
gucuagaaguuguuugu

SEQ ID NO: 2886780 - RNA, 21 nt, Human
gucuagaaguuguuugucauc

SEQ ID NO: 2886781 - RNA, 14 nt, Human
gucgcccagucugg

SEQ ID NO: 2886782 - RNA, 13 nt, Human
gucgcccagucug

SEQ ID NO: 2886783 - RNA, 13 nt, Human
gucgcccaggaga

SEQ ID NO: 2886784 - RNA, 12 nt, Human
gucgcccaggag

SEQ ID NO: 2886785 - RNA, 14 nt, Human
gucgcccaggcugg

SEQ ID NO: 2886786 - RNA, 15 nt, Human
gucgcccaggcugga

SEQ ID NO: 2886787 - RNA, 20 nt, Human
gucgcccaggcuggagugca

SEQ ID NO: 2886788 - RNA, 14 nt, Human
gucgaggacaggga

SEQ ID NO: 2886789 - RNA, 17 nt, Human
guccuuuuguaccaugg

SEQ ID NO: 2886790 - RNA, 20 nt, Human
guccuuuauguggaaaacag

SEQ ID NO: 2886791 - RNA, 22 nt, Human
guccuuuuguaccaugguguga

SEQ ID NO: 2886792 - RNA, 13 nt, Human
guccuuuugucuu

SEQ ID NO: 2886793 - RNA, 15 nt, Human
guccuuuugucuucu

SEQ ID NO: 2886794 - RNA, 22 nt, Human
guccuuuugucuucucugucuc

SEQ ID NO: 2886795 - RNA, 12 nt, Human
guccuuuuguaa

SEQ ID NO: 2886796 - RNA, 13 nt, Human
guccuuuuguaaa

SEQ ID NO: 2886797 - RNA, 17 nt, Human
gucgaauuaauagcuuu

SEQ ID NO: 2886798 - RNA, 16 nt, Human
gucgaaagcucuagaa

SEQ ID NO: 2886799 - RNA, 19 nt, Human
guccuuuuuuuccaucuuu

SEQ ID NO: 2886800 - RNA, 16 nt, Human
guccuuuuuuuccauc

SEQ ID NO: 2886801 - RNA, 16 nt, Human
gucuucacagcucugu

SEQ ID NO: 2886802 - RNA, 22 nt, Human
gucugguuucaccgaggacaug

SEQ ID NO: 2886803 - RNA, 17 nt, Human
gucugguuucaccgagg

SEQ ID NO: 2886804 - RNA, 13 nt, Human
gucuggugggagg

SEQ ID NO: 2886805 - RNA, 14 nt, Human
gucuucagccucuu

SEQ ID NO: 2886806 - RNA, 12 nt, Human
gucuucacucuu

SEQ ID NO: 2886807 - RNA, 15 nt, Human
gucuucacucuuagg

SEQ ID NO: 2886808 - RNA, 16 nt, Human
gucuucacucuuaggc

SEQ ID NO: 2886809 - RNA, 17 nt, Human
gucuucacagcucugug

SEQ ID NO: 2886810 - RNA, 20 nt, Human
gucuggucacacacaggugu

SEQ ID NO: 2886811 - RNA, 14 nt, Human
gucuggucuauguu

SEQ ID NO: 2886812 - RNA, 23 nt, Human
gucugacaggcaaugcuggcugu

SEQ ID NO: 2886813 - RNA, 22 nt, Human
gucugacaggcaaugcuggcug

SEQ ID NO: 2886814 - RNA, 21 nt, Human
gucugacaggcaaugcuggcu

SEQ ID NO: 2886815 - RNA, 17 nt, Human
gucugaagucacugcac

SEQ ID NO: 2886816 - RNA, 19 nt, Human
gucugaagucacugcacag

SEQ ID NO: 2886817 - RNA, 14 nt, Human
gucuggacugacag

SEQ ID NO: 2886818 - RNA, 15 nt, Human
gucuggacugacagc

SEQ ID NO: 2886819 - RNA, 17 nt, Human
gucuggacugacagcau

SEQ ID NO: 2886820 - RNA, 18 nt, Human
gucuggacugacagcaug

SEQ ID NO: 2886821 - RNA, 16 nt, Human
aaccauggacuuuaua

SEQ ID NO: 2886822 - RNA, 16 nt, Human
gucugaagugguuguu

SEQ ID NO: 2886823 - RNA, 18 nt, Human
gucuggaaugcaguggua

SEQ ID NO: 2886824 - RNA, 12 nt, Human
gucuggaguggg

SEQ ID NO: 2886825 - RNA, 14 nt, Human
gucuggagugggca

SEQ ID NO: 2886826 - RNA, 18 nt, Human
gucuggagugggcagagc

SEQ ID NO: 2886827 - RNA, 19 nt, Human
gucuggagugggcagagcc

SEQ ID NO: 2886828 - RNA, 19 nt, Human
aaccaugcaaaugcuauga

SEQ ID NO: 2886829 - RNA, 13 nt, Human
aaccauggacuuu

SEQ ID NO: 2886830 - RNA, 15 nt, Human
aaccaugaagacagg

SEQ ID NO: 2886831 - RNA, 16 nt, Human
aaccaugaagacagga

SEQ ID NO: 2886832 - RNA, 17 nt, Human
aaccaugaagacaggau

SEQ ID NO: 2886833 - RNA, 13 nt, Human
aaccaucuggccu

SEQ ID NO: 2886834 - RNA, 15 nt, Human
aaccaucuggccugg

SEQ ID NO: 2886835 - RNA, 16 nt, Human
aaccaucuggccuggc

SEQ ID NO: 2886836 - RNA, 17 nt, Human
aaccaucuggccuggcc

SEQ ID NO: 2886837 - RNA, 23 nt, Human
gucucuuuaaugucacaggcagg

SEQ ID NO: 2886838 - RNA, 22 nt, Human
gucucuuuaaugucacaggcag

SEQ ID NO: 2886839 - RNA, 16 nt, Human
gucugaagucacugca

SEQ ID NO: 2886840 - RNA, 20 nt, Human
gucucuuuaaugucacaggc

SEQ ID NO: 2886841 - RNA, 19 nt, Human
gucucuuuaaugucacagg

SEQ ID NO: 2886842 - RNA, 18 nt, Human
gucucuuuaaugucacag

SEQ ID NO: 2886843 - RNA, 17 nt, Human
gucucuuuaagggcaug

SEQ ID NO: 2886844 - RNA, 23 nt, Human
gucucuuuaagggcaugccuugu

SEQ ID NO: 2886845 - RNA, 15 nt, Human
aaccauggacuuuau

SEQ ID NO: 2886846 - RNA, 18 nt, Human
aacuaagaaacuuuugua

SEQ ID NO: 2886847 - RNA, 19 nt, Human
aacuaagaaacuuuuguaa

SEQ ID NO: 2886848 - RNA, 18 nt, Human
aacuaagcagucccugag

SEQ ID NO: 2886849 - RNA, 23 nt, Human
aacuaagcagucccugagaccau

SEQ ID NO: 2886850 - RNA, 20 nt, Human
aacuaacacgugaugugaua

SEQ ID NO: 2886851 - RNA, 22 nt, Human
aacuacuucucuuguuagguaa

SEQ ID NO: 2886852 - RNA, 14 nt, Human
aacuacuugauuuu

SEQ ID NO: 2886853 - RNA, 15 nt, Human
aacuaaggugcuaaa

SEQ ID NO: 2886854 - RNA, 18 nt, Human
aacuaaggugcuaaaucu

SEQ ID NO: 2886855 - RNA, 22 nt, Human
aacuaaggugcuaaaucugcga

SEQ ID NO: 2886856 - RNA, 16 nt, Human
aacuagaaaucugcca

SEQ ID NO: 2886857 - RNA, 18 nt, Human
aacgugggauucagagaa

SEQ ID NO: 2886858 - RNA, 17 nt, Human
aacguuacucagggcuc

SEQ ID NO: 2886859 - RNA, 20 nt, Human
aacguuacucagggcuccuc

SEQ ID NO: 2886860 - RNA, 16 nt, Human
aaccuuagcucccucc

SEQ ID NO: 2886861 - RNA, 16 nt, Human
aaccuuauccugcauu

SEQ ID NO: 2886862 - RNA, 23 nt, Human
aaccuugucucuaugccagcuca

SEQ ID NO: 2886863 - RNA, 19 nt, Human
aaccuugucucuaugccag

SEQ ID NO: 2886864 - RNA, 14 nt, Human
aaccuuucaaauuu

SEQ ID NO: 2886865 - RNA, 15 nt, Human
aaccuuuauucuuuu

SEQ ID NO: 2886866 - RNA, 18 nt, Human
aaccuuucaaauuucaca

SEQ ID NO: 2886867 - RNA, 20 nt, Human
aaccuuucaccuuuguguau

SEQ ID NO: 2886868 - RNA, 14 nt, Human
aaccuuuaagaaaa

SEQ ID NO: 2886869 - RNA, 23 nt, Human
aaccuuuaagaaaagcccugaga

SEQ ID NO: 2886870 - RNA, 12 nt, Human
aaccugauugua

SEQ ID NO: 2886871 - RNA, 15 nt, Human
aaccugauuguaaac

SEQ ID NO: 2886872 - RNA, 16 nt, Human
aaccugauuguaaacu

SEQ ID NO: 2886873 - RNA, 18 nt, Human
aaccugauuguaaacuuc

SEQ ID NO: 2886874 - RNA, 14 nt, Human
aaccugcaaaaaau

SEQ ID NO: 2886875 - RNA, 21 nt, Human
aaccugcaaaaaauacuuuuu

SEQ ID NO: 2886876 - RNA, 16 nt, Human
aaccugcaaaaucugu

SEQ ID NO: 2886877 - RNA, 17 nt, Human
aaccugaugcagucacg

SEQ ID NO: 2886878 - RNA, 17 nt, Human
gucuuuuaaugcuucau

SEQ ID NO: 2886879 - RNA, 22 nt, Human
gucuuuuauaguggaaaaacac

SEQ ID NO: 2886880 - RNA, 23 nt, Human
gucuuuuauaguggaaaaacaca

SEQ ID NO: 2886881 - RNA, 13 nt, Human
gucuuuuauauuu

SEQ ID NO: 2886882 - RNA, 18 nt, Human
gucuuuuauauuuguauc

SEQ ID NO: 2886883 - RNA, 19 nt, Human
gucuuuuauauuuguaucg

SEQ ID NO: 2886884 - RNA, 16 nt, Human
gucuuuucagguuugu

SEQ ID NO: 2886885 - RNA, 18 nt, Human
aaccuguuuuuuuuucau

SEQ ID NO: 2886886 - RNA, 19 nt, Human
aaccuguuuuuuuuucauu

SEQ ID NO: 2886887 - RNA, 17 nt, Human
aaccuuaaacaccccuc

SEQ ID NO: 2886888 - RNA, 13 nt, Human
aaccuuaagaccu

SEQ ID NO: 2886889 - RNA, 21 nt, Human
aaccuguugcuguguuuaauu

SEQ ID NO: 2886890 - RNA, 23 nt, Human
aaccuguugcuguguuuaauuug

SEQ ID NO: 2886891 - RNA, 17 nt, Human
aaccuguucugcuuucc

SEQ ID NO: 2886892 - RNA, 13 nt, Human
aaccuguucugcu

SEQ ID NO: 2886893 - RNA, 12 nt, Human
aaccugugucug

SEQ ID NO: 2886894 - RNA, 15 nt, Human
aaccugugucugcga

SEQ ID NO: 2886895 - RNA, 16 nt, Human
aaccugugucugcgaa

SEQ ID NO: 2886896 - RNA, 21 nt, Human
aaccugugucugcgaaguccu

SEQ ID NO: 2886897 - RNA, 22 nt, Human
aaccugugucugcgaaguccua

SEQ ID NO: 2886898 - RNA, 15 nt, Human
aaccugcaucuuuag

SEQ ID NO: 2886899 - RNA, 11 nt, Human
gucuucauaaa

SEQ ID NO: 2886900 - RNA, 17 nt, Human
gucuuuguaucuuccau

SEQ ID NO: 2886901 - RNA, 23 nt, Human
gucuucagccucuuucugucccu

SEQ ID NO: 2886902 - RNA, 22 nt, Human
gucuucagccucuuucuguccc

SEQ ID NO: 2886903 - RNA, 23 nt, Human
gucuuccagggggaaggccaagg

SEQ ID NO: 2886904 - RNA, 16 nt, Human
gucuucauuucauugu

SEQ ID NO: 2886905 - RNA, 17 nt, Human
gucuucauuucauugua

SEQ ID NO: 2886906 - RNA, 18 nt, Human
gucuucagcauucccucc

SEQ ID NO: 2886907 - RNA, 19 nt, Human
gucuucagcauucccuccc

SEQ ID NO: 2886908 - RNA, 22 nt, Human
aacucugggcugcuacccagaa

SEQ ID NO: 2886909 - RNA, 21 nt, Human
aacucugggcugcuacccaga

SEQ ID NO: 2886910 - RNA, 16 nt, Human
aacucuguggcauuau

SEQ ID NO: 2886911 - RNA, 17 nt, Human
aacugaaauuaaaacua

SEQ ID NO: 2886912 - RNA, 18 nt, Human
aacugaaauuaaaacuau

SEQ ID NO: 2886913 - RNA, 14 nt, Human
gugagucauuuaaa

SEQ ID NO: 2886914 - RNA, 17 nt, Human
gugagucauuuaaaugu

SEQ ID NO: 2886915 - RNA, 22 nt, Human
gugagucauuuaaauguguaca

SEQ ID NO: 2886916 - RNA, 12 nt, Human
aacucugggcuc

SEQ ID NO: 2886917 - RNA, 14 nt, Human
aacucugccagcca

SEQ ID NO: 2886918 - RNA, 16 nt, Human
gugagaggggaacaga

SEQ ID NO: 2886919 - RNA, 13 nt, Human
gugagagcugggu

SEQ ID NO: 2886920 - RNA, 12 nt, Human
gugagaugaggg

SEQ ID NO: 2886921 - RNA, 19 nt, Human
gugagaugagggaugggcc

SEQ ID NO: 2886922 - RNA, 21 nt, Human
gugagaugagggaugggccug

SEQ ID NO: 2886923 - RNA, 14 nt, Human
gugagcacagccua

SEQ ID NO: 2886924 - RNA, 18 nt, Human
gugagacaguccagccug

SEQ ID NO: 2886925 - RNA, 19 nt, Human
gugagacaguccagccugg

SEQ ID NO: 2886926 - RNA, 21 nt, Human
gugagcacuaaggugugcucu

SEQ ID NO: 2886927 - RNA, 20 nt, Human
gugagcagaaguggagcugg

SEQ ID NO: 2886928 - RNA, 17 nt, Human
gugagcaggaaggccug

SEQ ID NO: 2886929 - RNA, 18 nt, Human
gugagcaggaaggccugg

SEQ ID NO: 2886930 - RNA, 19 nt, Human
gugagcaggaaggccuggg

SEQ ID NO: 2886931 - RNA, 20 nt, Human
gugagcaggaaggccugggu

SEQ ID NO: 2886932 - RNA, 19 nt, Human
gugagcagaaguggagcug

SEQ ID NO: 2886933 - RNA, 14 nt, Human
gugagguuucccaa

SEQ ID NO: 2886934 - RNA, 15 nt, Human
gugagguuucccaau

SEQ ID NO: 2886935 - RNA, 17 nt, Human
gugagguuucccaaugg

SEQ ID NO: 2886936 - RNA, 20 nt, Human
gugagguuucccaauggugu

SEQ ID NO: 2886937 - RNA, 22 nt, Human
gugagguuucccaaugguguuu

SEQ ID NO: 2886938 - RNA, 13 nt, Human
gugaguaaauauu

SEQ ID NO: 2886939 - RNA, 15 nt, Human
gugagcaggcuguga

SEQ ID NO: 2886940 - RNA, 12 nt, Human
gugaccccaggu

SEQ ID NO: 2886941 - RNA, 13 nt, Human
gugaccccuccug

SEQ ID NO: 2886942 - RNA, 14 nt, Human
gugaccccuccugg

SEQ ID NO: 2886943 - RNA, 15 nt, Human
gugaccccuccuggg

SEQ ID NO: 2886944 - RNA, 17 nt, Human
gugaccccuccuggggc

SEQ ID NO: 2886945 - RNA, 18 nt, Human
gugaccccuccuggggcc

SEQ ID NO: 2886946 - RNA, 20 nt, Human
gugaccccuccuggggccag

SEQ ID NO: 2886947 - RNA, 21 nt, Human
gugaccccuccuggggccagg

SEQ ID NO: 2886948 - RNA, 23 nt, Human
gugaccccuccuggggccaggcc

SEQ ID NO: 2886949 - RNA, 12 nt, Human
gugagagcuggg

SEQ ID NO: 2886950 - RNA, 17 nt, Human
gugagaauaggcagccc

SEQ ID NO: 2886951 - RNA, 11 nt, Human
gugagaaaccu

SEQ ID NO: 2886952 - RNA, 15 nt, Human
gugagaaaccuguau

SEQ ID NO: 2886953 - RNA, 17 nt, Human
gugagaaaccuguaucu

SEQ ID NO: 2886954 - RNA, 20 nt, Human
gugagaaaccuguaucuuuc

SEQ ID NO: 2886955 - RNA, 23 nt, Human
gugagaaaccuguaucuuucuau

SEQ ID NO: 2886956 - RNA, 20 nt, Human
gugagaaauuucugugaaac

SEQ ID NO: 2886957 - RNA, 22 nt, Human
gugagaaaaagcuccuguccuc

SEQ ID NO: 2886958 - RNA, 17 nt, Human
gugagaaaaagcuccug

SEQ ID NO: 2886959 - RNA, 17 nt, Human
aacuagacaccaaaguu

SEQ ID NO: 2886960 - RNA, 20 nt, Human
aacuagacaccaaaguucua

SEQ ID NO: 2886961 - RNA, 18 nt, Human
aacuauccugacuucuaa

SEQ ID NO: 2886962 - RNA, 23 nt, Human
gugaagaauccuuuuguagaaug

SEQ ID NO: 2886963 - RNA, 13 nt, Human
aacuauauuuucu

SEQ ID NO: 2886964 - RNA, 16 nt, Human
aacuauauuuucuuua

SEQ ID NO: 2886965 - RNA, 21 nt, Human
gugaagagugacuaguacaaa

SEQ ID NO: 2886966 - RNA, 16 nt, Human
gugaagugaaugaaac

SEQ ID NO: 2886967 - RNA, 18 nt, Human
gugaaggcuucucuguuc

SEQ ID NO: 2886968 - RNA, 16 nt, Human
gugaaggugacagcag

SEQ ID NO: 2886969 - RNA, 17 nt, Human
gugaaggugacagcagu

SEQ ID NO: 2886970 - RNA, 19 nt, Human
gugaaguacaauaauucau

SEQ ID NO: 2886971 - RNA, 23 nt, Human
gugaaguacaauaauucauauuc

SEQ ID NO: 2886972 - RNA, 17 nt, Human
gugaagcaccaagcuca

SEQ ID NO: 2886973 - RNA, 18 nt, Human
gugaagcaccaagcucaa

SEQ ID NO: 2886974 - RNA, 19 nt, Human
gugaagaucucacucugcc

SEQ ID NO: 2886975 - RNA, 19 nt, Human
gugaagaugcauuguaguu

SEQ ID NO: 2886976 - RNA, 19 nt, Human
gugacagaggcagccccau

SEQ ID NO: 2886977 - RNA, 18 nt, Human
gugacagaggcagcccca

SEQ ID NO: 2886978 - RNA, 16 nt, Human
gugacagaggcagccc

SEQ ID NO: 2886979 - RNA, 12 nt, Human
gugaagcccugu

SEQ ID NO: 2886980 - RNA, 21 nt, Human
gugaagucaugaccuccaggg

SEQ ID NO: 2886981 - RNA, 12 nt, Human
gugaaguuaggu

SEQ ID NO: 2886982 - RNA, 16 nt, Human
gugaaguuagguucuu

SEQ ID NO: 2886983 - RNA, 20 nt, Human
gugaaguuagguucuuaaaa

SEQ ID NO: 2886984 - RNA, 13 nt, Human
gugaccaacugug

SEQ ID NO: 2886985 - RNA, 15 nt, Human
gugaccaacuguguu

SEQ ID NO: 2886986 - RNA, 19 nt, Human
gugaccaacuguguuguau

SEQ ID NO: 2886987 - RNA, 20 nt, Human
gugaccaacuguguuguauu

SEQ ID NO: 2886988 - RNA, 22 nt, Human
gugaccaacuguguuguauuaa

SEQ ID NO: 2886989 - RNA, 19 nt, Human
gugacauuuuacauuaaau

SEQ ID NO: 2886990 - RNA, 17 nt, Human
gugacauuuuacauuaa

SEQ ID NO: 2886991 - RNA, 21 nt, Human
gugacauuuuacauuaaauuu

SEQ ID NO: 2886992 - RNA, 20 nt, Human
gugacauuuuacauuaaauu

SEQ ID NO: 2886993 - RNA, 15 nt, Human
gugacccacuucuca

SEQ ID NO: 2886994 - RNA, 18 nt, Human
gugacccacuucucauca

SEQ ID NO: 2886995 - RNA, 21 nt, Human
aaugaaaaauagugucuuugu

SEQ ID NO: 2886996 - RNA, 12 nt, Human
aaugaaaaauga

SEQ ID NO: 2886997 - RNA, 13 nt, Human
aaugaaaaaugaa

SEQ ID NO: 2886998 - RNA, 14 nt, Human
aaugaaaaaugaaa

SEQ ID NO: 2886999 - RNA, 16 nt, Human
aaugaaaaaugaaaga

SEQ ID NO: 2887000 - RNA, 18 nt, Human
aaugaaaaaugaaagaug

SEQ ID NO: 2887001 - RNA, 15 nt, Human
aaugaaaaacaacca

SEQ ID NO: 2887002 - RNA, 16 nt, Human
aaugaaaaacaaccaa

SEQ ID NO: 2887003 - RNA, 18 nt, Human
aaucuuuugggggaaacu

SEQ ID NO: 2887004 - RNA, 14 nt, Human
aaugaauaucuauu

SEQ ID NO: 2887005 - RNA, 15 nt, Human
aaugaauaucuauua

SEQ ID NO: 2887006 - RNA, 18 nt, Human
aaugaauaucuauuaaua

SEQ ID NO: 2887007 - RNA, 19 nt, Human
aaugaauaucuauuaauau

SEQ ID NO: 2887008 - RNA, 19 nt, Human
uaaugugaugauguaauug

SEQ ID NO: 2887009 - RNA, 20 nt, Human
uaaugugaugauguaauuga

SEQ ID NO: 2887010 - RNA, 21 nt, Human
uaaugugaugauguaauugac

SEQ ID NO: 2887011 - RNA, 16 nt, Human
uaaugugaccuagcaa

SEQ ID NO: 2887012 - RNA, 22 nt, Human
uaaugugaccuagcaauaggca

SEQ ID NO: 2887013 - RNA, 20 nt, Human
uaaugugaguuuggucugga

SEQ ID NO: 2887014 - RNA, 12 nt, Human
uaaugugaacuu

SEQ ID NO: 2887015 - RNA, 18 nt, Human
uaaugugaacuuguagcu

SEQ ID NO: 2887016 - RNA, 22 nt, Human
uaaugugaacuuguagcuguaa

SEQ ID NO: 2887017 - RNA, 12 nt, Human
aaucuuggaagu

SEQ ID NO: 2887018 - RNA, 23 nt, Human
aaucuuggaaguacaugaauaca

SEQ ID NO: 2887019 - RNA, 23 nt, Human
aaucuuuuacaacugccucgaaa

SEQ ID NO: 2887020 - RNA, 13 nt, Human
aaucuugaaaaug

SEQ ID NO: 2887021 - RNA, 15 nt, Human
uaauguggaagaaaa

SEQ ID NO: 2887022 - RNA, 16 nt, Human
uaauguggaagaaaau

SEQ ID NO: 2887023 - RNA, 17 nt, Human
uaauguggaagaaaaug

SEQ ID NO: 2887024 - RNA, 19 nt, Human
uaauguggaagaaaauggu

SEQ ID NO: 2887025 - RNA, 22 nt, Human
uaauguggaagaaaaugguuua

SEQ ID NO: 2887026 - RNA, 14 nt, Human
aaucuugaaauuaa

SEQ ID NO: 2887027 - RNA, 17 nt, Human
aaucuugaaauuaagaa

SEQ ID NO: 2887028 - RNA, 17 nt, Human
uaauguaauaacuguga

SEQ ID NO: 2887029 - RNA, 20 nt, Human
uaauguauuuguucauguuu

SEQ ID NO: 2887030 - RNA, 21 nt, Human
uaauguauuuguucauguuug

SEQ ID NO: 2887031 - RNA, 15 nt, Human
uaaugucacaggcag

SEQ ID NO: 2887032 - RNA, 17 nt, Human
uaaugucacaggcaggu

SEQ ID NO: 2887033 - RNA, 16 nt, Human
uaaugucacaggcagg

SEQ ID NO: 2887034 - RNA, 16 nt, Human
uaaugaaguaaagcca

SEQ ID NO: 2887035 - RNA, 19 nt, Human
uaauagaaaacugaaaauc

SEQ ID NO: 2887036 - RNA, 20 nt, Human
uaauacuuuuuuauuuuguu

SEQ ID NO: 2887037 - RNA, 15 nt, Human
uaauagaaaacugaa

SEQ ID NO: 2887038 - RNA, 16 nt, Human
uaauagaaaacugaaa

SEQ ID NO: 2887039 - RNA, 18 nt, Human
uaauagaaaacugaaaau

SEQ ID NO: 2887040 - RNA, 18 nt, Human
uaauaccucugugugcuc

SEQ ID NO: 2887041 - RNA, 20 nt, Human
uaauacacuaauuccuuucu

SEQ ID NO: 2887042 - RNA, 13 nt, Human
uaauaccucccuu

SEQ ID NO: 2887043 - RNA, 22 nt, Human
uaauaccauuuuuuaaggaaac

SEQ ID NO: 2887044 - RNA, 11 nt, Human
uaauaccucaa

SEQ ID NO: 2887045 - RNA, 18 nt, Human
uaauaccucaauguuuga

SEQ ID NO: 2887046 - RNA, 13 nt, Human
uaauaccucugug

SEQ ID NO: 2887047 - RNA, 14 nt, Human
uaauaccucugugu

SEQ ID NO: 2887048 - RNA, 15 nt, Human
uaauaccucugugug

SEQ ID NO: 2887049 - RNA, 19 nt, Human
aauacaguuugucacauga

SEQ ID NO: 2887050 - RNA, 22 nt, Human
uaauacacuaauuccuuucuau

SEQ ID NO: 2887051 - RNA, 16 nt, Human
uaauacacuugcccug

SEQ ID NO: 2887052 - RNA, 18 nt, Human
uaauacacuugcccugcu

SEQ ID NO: 2887053 - RNA, 17 nt, Human
aauacaguucugucaua

SEQ ID NO: 2887054 - RNA, 14 nt, Human
aauacauacgguca

SEQ ID NO: 2887055 - RNA, 15 nt, Human
aauacauacggucag

SEQ ID NO: 2887056 - RNA, 21 nt, Human
aauacauacggucagguuuaa

SEQ ID NO: 2887057 - RNA, 23 nt, Human
aauacauacggucagguuuaaca

SEQ ID NO: 2887058 - RNA, 23 nt, Human
uaauauuauuacuguugauaauu

SEQ ID NO: 2887059 - RNA, 14 nt, Human
uaauauucugcuau

SEQ ID NO: 2887060 - RNA, 16 nt, Human
uaauauuguggugcca

SEQ ID NO: 2887061 - RNA, 18 nt, Human
uaauauuguuguauaauu

SEQ ID NO: 2887062 - RNA, 19 nt, Human
uaauauuguuguauaauuu

SEQ ID NO: 2887063 - RNA, 21 nt, Human
uaauauuguuguauaauuucg

SEQ ID NO: 2887064 - RNA, 18 nt, Human
uaaucagugugucuaaau

SEQ ID NO: 2887065 - RNA, 17 nt, Human
uaaucagugugucuaaa

SEQ ID NO: 2887066 - RNA, 22 nt, Human
uaaucagguccucagagaauuu

SEQ ID NO: 2887067 - RNA, 19 nt, Human
uaaucagguccucagagaa

SEQ ID NO: 2887068 - RNA, 15 nt, Human
uaauauuguuuuucu

SEQ ID NO: 2887069 - RNA, 19 nt, Human
uaauauuguuuuucuuucu

SEQ ID NO: 2887070 - RNA, 20 nt, Human
uaauauuguuuuucuuucua

SEQ ID NO: 2887071 - RNA, 23 nt, Human
uaauauuguuuuucuuucuacaa

SEQ ID NO: 2887072 - RNA, 13 nt, Human
uaauauuuaaaca

SEQ ID NO: 2887073 - RNA, 13 nt, Human
uaaucagccucuu

SEQ ID NO: 2887074 - RNA, 12 nt, Human
uaaucagccucu

SEQ ID NO: 2887075 - RNA, 15 nt, Human
uaaucagccucuuaa

SEQ ID NO: 2887076 - RNA, 14 nt, Human
uaaucagccucuua

SEQ ID NO: 2887077 - RNA, 21 nt, Human
uaauauuuaaacagcaguguu

SEQ ID NO: 2887078 - RNA, 17 nt, Human
uaaucaugaaauuacuu

SEQ ID NO: 2887079 - RNA, 21 nt, Human
uaaucaugaaauuacuuauca

SEQ ID NO: 2887080 - RNA, 18 nt, Human
uaaucaugaaauuacuua

SEQ ID NO: 2887081 - RNA, 16 nt, Human
uaaucauuuccccaua

SEQ ID NO: 2887082 - RNA, 17 nt, Human
uaauuuuuuauucaagu

SEQ ID NO: 2887083 - RNA, 15 nt, Human
uaauuuuuugguaca

SEQ ID NO: 2887084 - RNA, 16 nt, Human
uaauuuuuugguacaa

SEQ ID NO: 2887085 - RNA, 17 nt, Human
uaauuuuuugguacaaa

SEQ ID NO: 2887086 - RNA, 18 nt, Human
uaauuuuuugguacaaaa

SEQ ID NO: 2887087 - RNA, 16 nt, Human
uaauuuuuuguaaugu

SEQ ID NO: 2887088 - RNA, 14 nt, Human
uacaagcccccccu

SEQ ID NO: 2887089 - RNA, 15 nt, Human
uacaagcccccccuu

SEQ ID NO: 2887090 - RNA, 21 nt, Human
uacaagccauucuaaggaaau

SEQ ID NO: 2887091 - RNA, 22 nt, Human
uacaagccaaaguggcauguuu

SEQ ID NO: 2887092 - RNA, 18 nt, Human
uacaagccagcuggagaa

SEQ ID NO: 2887093 - RNA, 20 nt, Human
uacaagcgugagccacugca

SEQ ID NO: 2887094 - RNA, 19 nt, Human
uacaagcgugagccacugc

SEQ ID NO: 2887095 - RNA, 18 nt, Human
uacaagcgugagccacug

SEQ ID NO: 2887096 - RNA, 16 nt, Human
uacaagcgugagccac

SEQ ID NO: 2887097 - RNA, 21 nt, Human
uacaagcgugagccacugcac

SEQ ID NO: 2887098 - RNA, 16 nt, Human
uacaagucaguuucua

SEQ ID NO: 2887099 - RNA, 18 nt, Human
uacaagucaguuucuaca

SEQ ID NO: 2887100 - RNA, 18 nt, Human
uaauuucugucagaaugc

SEQ ID NO: 2887101 - RNA, 13 nt, Human
uacaaguguauau

SEQ ID NO: 2887102 - RNA, 19 nt, Human
uacaagcccccccuuccac

SEQ ID NO: 2887103 - RNA, 14 nt, Human
uacaaguguauauc

SEQ ID NO: 2887104 - RNA, 15 nt, Human
uacaaguguauauca

SEQ ID NO: 2887105 - RNA, 20 nt, Human
uacaauaaaaucuugaaaau

SEQ ID NO: 2887106 - RNA, 21 nt, Human
uacaaguguauaucagaaaag

SEQ ID NO: 2887107 - RNA, 13 nt, Human
uacaauaaaaaca

SEQ ID NO: 2887108 - RNA, 17 nt, Human
uaauuucgagauuugua

SEQ ID NO: 2887109 - RNA, 17 nt, Human
uaauuucuaaagauaau

SEQ ID NO: 2887110 - RNA, 22 nt, Human
uaauuucuaaagauaauauuac

SEQ ID NO: 2887111 - RNA, 17 nt, Human
uaauuucccuucuugca

SEQ ID NO: 2887112 - RNA, 13 nt, Human
uaauuucuaaugu

SEQ ID NO: 2887113 - RNA, 14 nt, Human
uaauuuaaugcaug

SEQ ID NO: 2887114 - RNA, 21 nt, Human
uaauuuaaugcauguuaggaa

SEQ ID NO: 2887115 - RNA, 22 nt, Human
uaauucaggggcugacacuuca

SEQ ID NO: 2887116 - RNA, 18 nt, Human
uaauucaguauguuuuac

SEQ ID NO: 2887117 - RNA, 21 nt, Human
uaauucaguauguuuuacacu

SEQ ID NO: 2887118 - RNA, 22 nt, Human
uaauucaguauguuuuacacug

SEQ ID NO: 2887119 - RNA, 20 nt, Human
uaauucaguguauuucaguu

SEQ ID NO: 2887120 - RNA, 15 nt, Human
uaauucauauucuuc

SEQ ID NO: 2887121 - RNA, 22 nt, Human
uaauuugaaaacauaaucugca

SEQ ID NO: 2887122 - RNA, 11 nt, Human
uaauuucuuca

SEQ ID NO: 2887123 - RNA, 15 nt, Human
uaauuucuucaaaau

SEQ ID NO: 2887124 - RNA, 17 nt, Human
uaauuucuucaaaaugu

SEQ ID NO: 2887125 - RNA, 20 nt, Human
uaauuucuucaaaauguaua

SEQ ID NO: 2887126 - RNA, 21 nt, Human
uaauuucuucaaaauguauau

SEQ ID NO: 2887127 - RNA, 22 nt, Human
uaauuucuucaaaauguauaua

SEQ ID NO: 2887128 - RNA, 23 nt, Human
uaauuucuucaaaauguauauau

SEQ ID NO: 2887129 - RNA, 22 nt, Human
uaauuugaggacaaccauucca

SEQ ID NO: 2887130 - RNA, 18 nt, Human
uaauuugaggacaaccau

SEQ ID NO: 2887131 - RNA, 22 nt, Human
uaauuuuuguguuuuuaauaaa

SEQ ID NO: 2887132 - RNA, 21 nt, Human
uaauuuuuguauuuuuaguag

SEQ ID NO: 2887133 - RNA, 13 nt, Human
uaauuuuuuacua

SEQ ID NO: 2887134 - RNA, 12 nt, Human
uaauuugaucuu

SEQ ID NO: 2887135 - RNA, 20 nt, Human
uaauuugcauuaaauucaca

SEQ ID NO: 2887136 - RNA, 14 nt, Human
uaauuugauguuua

SEQ ID NO: 2887137 - RNA, 14 nt, Human
uaauuugauuaaca

SEQ ID NO: 2887138 - RNA, 15 nt, Human
uaauuugauuaacaa

SEQ ID NO: 2887139 - RNA, 16 nt, Human
uaauuugauuaacaaa

SEQ ID NO: 2887140 - RNA, 17 nt, Human
uaauuugauuaacaaau

SEQ ID NO: 2887141 - RNA, 18 nt, Human
uaauuugauuaacaaaua

SEQ ID NO: 2887142 - RNA, 12 nt, Human
uaauuugcauua

SEQ ID NO: 2887143 - RNA, 17 nt, Human
uaauuugcauuaaauuc

SEQ ID NO: 2887144 - RNA, 16 nt, Human
uaauuugcauuaaauu

SEQ ID NO: 2887145 - RNA, 12 nt, Human
uaauucacucaa

SEQ ID NO: 2887146 - RNA, 21 nt, Human
uaauucacucaagcacugaua

SEQ ID NO: 2887147 - RNA, 18 nt, Human
uaauucagccauguacag

SEQ ID NO: 2887148 - RNA, 19 nt, Human
uaauucagccauguacaga

SEQ ID NO: 2887149 - RNA, 22 nt, Human
uaauuaugggaauaauugcuuu

SEQ ID NO: 2887150 - RNA, 14 nt, Human
uaauuaugauuugg

SEQ ID NO: 2887151 - RNA, 16 nt, Human
aaugcaauuugauuga

SEQ ID NO: 2887152 - RNA, 20 nt, Human
uaauuauacccccugcaaag

SEQ ID NO: 2887153 - RNA, 20 nt, Human
aaugaaucguaaugaaguug

SEQ ID NO: 2887154 - RNA, 20 nt, Human
aaugaauaucuauuaauaua

SEQ ID NO: 2887155 - RNA, 13 nt, Human
aaugaauauugaa

SEQ ID NO: 2887156 - RNA, 15 nt, Human
aaugaauauugaagu

SEQ ID NO: 2887157 - RNA, 19 nt, Human
aaugaauauugaaguuuca

SEQ ID NO: 2887158 - RNA, 17 nt, Human
aaugaauauuuugauaa

SEQ ID NO: 2887159 - RNA, 18 nt, Human
aaugaauauuuugauaau

SEQ ID NO: 2887160 - RNA, 22 nt, Human
aaugaccuucauucugagacca

SEQ ID NO: 2887161 - RNA, 14 nt, Human
aaugcaauauuugu

SEQ ID NO: 2887162 - RNA, 24 nt, Human
aaugcaaucuccccuugauuuaaa

SEQ ID NO: 2887163 - RNA, 16 nt, Human
aaugcaauagaagugc

SEQ ID NO: 2887164 - RNA, 17 nt, Human
aaugcaauagaagugcu

SEQ ID NO: 2887165 - RNA, 22 nt, Human
aaugcaauagaagugcuccccu

SEQ ID NO: 2887166 - RNA, 23 nt, Human
aaugcaauagaagugcuccccuc

SEQ ID NO: 2887167 - RNA, 20 nt, Human
aaugcaacuacccaaaacaa

SEQ ID NO: 2887168 - RNA, 19 nt, Human
aaugcaagagugauugcag

SEQ ID NO: 2887169 - RNA, 21 nt, Human
aaugcaagagugauugcagcu

SEQ ID NO: 2887170 - RNA, 22 nt, Human
aaugcaagagugauugcagcuu

SEQ ID NO: 2887171 - RNA, 13 nt, Human
aaugcaaagaauc

SEQ ID NO: 2887172 - RNA, 17 nt, Human
aaugcaaagaaucccua

SEQ ID NO: 2887173 - RNA, 16 nt, Human
aaugcaaaguucugug

SEQ ID NO: 2887174 - RNA, 20 nt, Human
aaugcaaaguucuguguuua

SEQ ID NO: 2887175 - RNA, 23 nt, Human
aaugcaaaguucuguguuuaauu

SEQ ID NO: 2887176 - RNA, 16 nt, Human
aaugguuuauuuugua

SEQ ID NO: 2887177 - RNA, 21 nt, Human
aaugguuuauuuuguauugug

SEQ ID NO: 2887178 - RNA, 22 nt, Human
aaugguuuauuuuguauugugg

SEQ ID NO: 2887179 - RNA, 22 nt, Human
uacaaucgagacugcaauguga

SEQ ID NO: 2887180 - RNA, 15 nt, Human
uacaaucgcaaauca

SEQ ID NO: 2887181 - RNA, 18 nt, Human
uacaaucgcaaaucaaaa

SEQ ID NO: 2887182 - RNA, 14 nt, Human
uacaauacaucuga

SEQ ID NO: 2887183 - RNA, 13 nt, Human
uacaauauauaaa

SEQ ID NO: 2887184 - RNA, 14 nt, Human
uacaauauauaaaa

SEQ ID NO: 2887185 - RNA, 17 nt, Human
uacaauauauaaaaaua

SEQ ID NO: 2887186 - RNA, 18 nt, Human
uacaauauauaaaaauau

SEQ ID NO: 2887187 - RNA, 20 nt, Human
uacaauauauaaaaauauau

SEQ ID NO: 2887188 - RNA, 23 nt, Human
uacaauauauagcuggcaagaau

SEQ ID NO: 2887189 - RNA, 21 nt, Human
uacaauaaaacuuugcugcca

SEQ ID NO: 2887190 - RNA, 13 nt, Human
uacaauaaaagua

SEQ ID NO: 2887191 - RNA, 13 nt, Human
uacaauaacauaa

SEQ ID NO: 2887192 - RNA, 12 nt, Human
uacaauaaugga

SEQ ID NO: 2887193 - RNA, 14 nt, Human
uacaauaauggaaa

SEQ ID NO: 2887194 - RNA, 15 nt, Human
uacaauaauggaaaa

SEQ ID NO: 2887195 - RNA, 16 nt, Human
uacaauaauggaaaaa

SEQ ID NO: 2887196 - RNA, 18 nt, Human
uacaauaauucauauucu

SEQ ID NO: 2887197 - RNA, 12 nt, Human
aauguaaaauga

SEQ ID NO: 2887198 - RNA, 14 nt, Human
aauguaaaaugauu

SEQ ID NO: 2887199 - RNA, 16 nt, Human
aauguaagauuauaga

SEQ ID NO: 2887200 - RNA, 19 nt, Human
aauguaagauuauagauuc

SEQ ID NO: 2887201 - RNA, 20 nt, Human
aauguaagauuauagauucu

SEQ ID NO: 2887202 - RNA, 21 nt, Human
aauguaagauuauagauucua

SEQ ID NO: 2887203 - RNA, 22 nt, Human
aauguaagauuauagauucuaa

SEQ ID NO: 2887204 - RNA, 23 nt, Human
aauguaagauuauagauucuaaa

SEQ ID NO: 2887205 - RNA, 16 nt, Human
aaugguuuuuaaauuu

SEQ ID NO: 2887206 - RNA, 17 nt, Human
aaugguuuuuaaauuuu

SEQ ID NO: 2887207 - RNA, 21 nt, Human
aaugguuuuuaaauuuuguaa

SEQ ID NO: 2887208 - RNA, 12 nt, Human
aauguaaaaaag

SEQ ID NO: 2887209 - RNA, 17 nt, Human
aauguaaaaaagaaaaa

SEQ ID NO: 2887210 - RNA, 19 nt, Human
aauguaaaaaagaaaaaca

SEQ ID NO: 2887211 - RNA, 22 nt, Human
uacagacuuguugugacuuuga

SEQ ID NO: 2887212 - RNA, 17 nt, Human
aauguacaucuggccuu

SEQ ID NO: 2887213 - RNA, 22 nt, Human
aauguacacacugguacuuaga

SEQ ID NO: 2887214 - RNA, 15 nt, Human
aauguacagacauau

SEQ ID NO: 2887215 - RNA, 16 nt, Human
aauguacagacauauu

SEQ ID NO: 2887216 - RNA, 17 nt, Human
aauguacagacauauuu

SEQ ID NO: 2887217 - RNA, 21 nt, Human
aauguacagacauauuuaacu

SEQ ID NO: 2887218 - RNA, 15 nt, Human
uacacgaaagagaga

SEQ ID NO: 2887219 - RNA, 16 nt, Human
uacacgaaagagagag

SEQ ID NO: 2887220 - RNA, 14 nt, Human
uacacgaaagagag

SEQ ID NO: 2887221 - RNA, 14 nt, Human
aaugucacaggcag

SEQ ID NO: 2887222 - RNA, 13 nt, Human
aaugucacaggca

SEQ ID NO: 2887223 - RNA, 13 nt, Human
aauguaucuguga

SEQ ID NO: 2887224 - RNA, 14 nt, Human
aauguaucugugaa

SEQ ID NO: 2887225 - RNA, 17 nt, Human
aauguaucugugaagua

SEQ ID NO: 2887226 - RNA, 22 nt, Human
aauguaucauagaaauguaacu

SEQ ID NO: 2887227 - RNA, 21 nt, Human
aauguaucccuucucacagca

SEQ ID NO: 2887228 - RNA, 22 nt, Human
aauguaucccuucucacagcac

SEQ ID NO: 2887229 - RNA, 16 nt, Human
aauguaucauagaaau

SEQ ID NO: 2887230 - RNA, 19 nt, Human
aauguaucauagaaaugua

SEQ ID NO: 2887231 - RNA, 18 nt, Human
aauguaucauagaaaugu

SEQ ID NO: 2887232 - RNA, 13 nt, Human
uacauacggucag

SEQ ID NO: 2887233 - RNA, 15 nt, Human
uacauacggucaggu

SEQ ID NO: 2887234 - RNA, 17 nt, Human
uacauacggucagguuu

SEQ ID NO: 2887235 - RNA, 22 nt, Human
uacauacggucagguuuaacau

SEQ ID NO: 2887236 - RNA, 23 nt, Human
uacauacggucagguuuaacauu

SEQ ID NO: 2887237 - RNA, 22 nt, Human
uacauacccuggccgcccccug

SEQ ID NO: 2887238 - RNA, 14 nt, Human
uacauacacuugua

SEQ ID NO: 2887239 - RNA, 21 nt, Human
uacauacacuuguauaaaugu

SEQ ID NO: 2887240 - RNA, 22 nt, Human
uacauacacuuguauaaaugua

SEQ ID NO: 2887241 - RNA, 23 nt, Human
uacauacuuucauccugacucug

SEQ ID NO: 2887242 - RNA, 19 nt, Human
aauguacuuguuucucugu

SEQ ID NO: 2887243 - RNA, 18 nt, Human
aauguagcguguuuacau

SEQ ID NO: 2887244 - RNA, 21 nt, Human
aauguagcguguuuacaugug

SEQ ID NO: 2887245 - RNA, 15 nt, Human
aauguaguugaugua

SEQ ID NO: 2887246 - RNA, 16 nt, Human
aauguaguugauguau

SEQ ID NO: 2887247 - RNA, 18 nt, Human
aauguaguugauguaucc

SEQ ID NO: 2887248 - RNA, 19 nt, Human
aauguaguugauguaucca

SEQ ID NO: 2887249 - RNA, 12 nt, Human
uacagucugucu

SEQ ID NO: 2887250 - RNA, 13 nt, Human
uacagucugucuu

SEQ ID NO: 2887251 - RNA, 17 nt, Human
uacagucugucuucugu

SEQ ID NO: 2887252 - RNA, 18 nt, Human
uacagucugucuucugua

SEQ ID NO: 2887253 - RNA, 19 nt, Human
uacagucugucuucuguau

SEQ ID NO: 2887254 - RNA, 20 nt, Human
uacagucugucuucuguaua

SEQ ID NO: 2887255 - RNA, 21 nt, Human
uacagucugucuucuguauau

SEQ ID NO: 2887256 - RNA, 22 nt, Human
uacagucugucuucuguauaua

SEQ ID NO: 2887257 - RNA, 15 nt, Human
uacaguccuucaaaa

SEQ ID NO: 2887258 - RNA, 19 nt, Human
uacaguccuucaaaauccu

SEQ ID NO: 2887259 - RNA, 15 nt, Human
uacaguaugcuugcu

SEQ ID NO: 2887260 - RNA, 16 nt, Human
uacaguaugcuugcuc

SEQ ID NO: 2887261 - RNA, 17 nt, Human
uacauaaguaauucaag

SEQ ID NO: 2887262 - RNA, 16 nt, Human
uacauaaguaauucaa

SEQ ID NO: 2887263 - RNA, 15 nt, Human
uacauaaguaauuca

SEQ ID NO: 2887264 - RNA, 19 nt, Human
uacauaaguaauucaagaa

SEQ ID NO: 2887265 - RNA, 18 nt, Human
uacaguggugccaucauu

SEQ ID NO: 2887266 - RNA, 22 nt, Human
uacaguggugccaucauugcug

SEQ ID NO: 2887267 - RNA, 22 nt, Human
uacauaauacacuugcccugcu

SEQ ID NO: 2887268 - RNA, 23 nt, Human
uacaguggaaccguugccaaccg

SEQ ID NO: 2887269 - RNA, 17 nt, Human
uacagucuugcagcagg

SEQ ID NO: 2887270 - RNA, 18 nt, Human
aauguugagaaucccaaa

SEQ ID NO: 2887271 - RNA, 12 nt, Human
aaugugaagaug

SEQ ID NO: 2887272 - RNA, 15 nt, Human
aaugugaagaugcau

SEQ ID NO: 2887273 - RNA, 16 nt, Human
aaugugaagaugcauu

SEQ ID NO: 2887274 - RNA, 22 nt, Human
aaugugaagaugcauuguaguu

SEQ ID NO: 2887275 - RNA, 15 nt, Human
aaugugaacuuguag

SEQ ID NO: 2887276 - RNA, 17 nt, Human
aaugugaacuuguagcu

SEQ ID NO: 2887277 - RNA, 22 nt, Human
aaugugaacuuguagcuguaaa

SEQ ID NO: 2887278 - RNA, 13 nt, Human
aaugugaaagcac

SEQ ID NO: 2887279 - RNA, 14 nt, Human
aauguauuuuucua

SEQ ID NO: 2887280 - RNA, 15 nt, Human
aaugucaaaauuguu

SEQ ID NO: 2887281 - RNA, 22 nt, Human
aauuaagauacaaauuaauuuu

SEQ ID NO: 2887282 - RNA, 19 nt, Human
aauguugaaccaaaccucc

SEQ ID NO: 2887283 - RNA, 19 nt, Human
uacauguaaaacauuaucu

SEQ ID NO: 2887284 - RNA, 23 nt, Human
uacauuguugagcuauugcuguu

SEQ ID NO: 2887285 - RNA, 13 nt, Human
uacauuguugagc

SEQ ID NO: 2887286 - RNA, 12 nt, Human
uacauguauuau

SEQ ID NO: 2887287 - RNA, 22 nt, Human
uacauguauuauuucauuaugu

SEQ ID NO: 2887288 - RNA, 19 nt, Human
uacauuagcaguuugcuuu

SEQ ID NO: 2887289 - RNA, 20 nt, Human
uacauuagcaguuugcuuug

SEQ ID NO: 2887290 - RNA, 13 nt, Human
uaccccaucccug

SEQ ID NO: 2887291 - RNA, 21 nt, Human
uacccccagguggaaggcaga

SEQ ID NO: 2887292 - RNA, 12 nt, Human
uacccccaaccu

SEQ ID NO: 2887293 - RNA, 16 nt, Human
uacccccaaccucauu

SEQ ID NO: 2887294 - RNA, 15 nt, Human
uaccccccucugucu

SEQ ID NO: 2887295 - RNA, 16 nt, Human
uaccccaguuuuuuga

SEQ ID NO: 2887296 - RNA, 13 nt, Human
uaccauacauuua

SEQ ID NO: 2887297 - RNA, 16 nt, Human
uaccauacucauuucu

SEQ ID NO: 2887298 - RNA, 22 nt, Human
uaccauacucauuucuaaaaga

SEQ ID NO: 2887299 - RNA, 14 nt, Human
uaccauaugaucug

SEQ ID NO: 2887300 - RNA, 15 nt, Human
uaccauauuuaucca

SEQ ID NO: 2887301 - RNA, 22 nt, Human
uaccauauuuauccauuuguaa

SEQ ID NO: 2887302 - RNA, 15 nt, Human
uaccaugaaacaaag

SEQ ID NO: 2887303 - RNA, 17 nt, Human
uaccaucuuacuugagc

SEQ ID NO: 2887304 - RNA, 14 nt, Human
uaccaguuugcuga

SEQ ID NO: 2887305 - RNA, 18 nt, Human
uaccaucagggacaggau

SEQ ID NO: 2887306 - RNA, 14 nt, Human
uaccaugaacagaa

SEQ ID NO: 2887307 - RNA, 20 nt, Human
uaccaugaacagaaaacauu

SEQ ID NO: 2887308 - RNA, 14 nt, Human
uaccagacugcagg

SEQ ID NO: 2887309 - RNA, 15 nt, Human
uaccagacugcaggu

SEQ ID NO: 2887310 - RNA, 21 nt, Human
uaccagacugcagguuggacc

SEQ ID NO: 2887311 - RNA, 23 nt, Human
uaccagacugcagguuggacccc

SEQ ID NO: 2887312 - RNA, 13 nt, Human
uaccagaagggaa

SEQ ID NO: 2887313 - RNA, 12 nt, Human
uacauuuauaau

SEQ ID NO: 2887314 - RNA, 12 nt, Human
uacauuuaugau

SEQ ID NO: 2887315 - RNA, 14 nt, Human
uacauuuaugauuu

SEQ ID NO: 2887316 - RNA, 14 nt, Human
uacauuuauaauug

SEQ ID NO: 2887317 - RNA, 16 nt, Human
uacauuuauaauugca

SEQ ID NO: 2887318 - RNA, 15 nt, Human
uacauuuaaaacuua

SEQ ID NO: 2887319 - RNA, 13 nt, Human
uacauuuaaaauu

SEQ ID NO: 2887320 - RNA, 17 nt, Human
uacauuuaaaauugcua

SEQ ID NO: 2887321 - RNA, 18 nt, Human
uacauuuaaaauugcuau

SEQ ID NO: 2887322 - RNA, 21 nt, Human
uacauuuaaaauugcuauguu

SEQ ID NO: 2887323 - RNA, 11 nt, Human
uacauuuaaag

SEQ ID NO: 2887324 - RNA, 14 nt, Human
uacauuuaaagcau

SEQ ID NO: 2887325 - RNA, 16 nt, Human
uacauuuaaagcauug

SEQ ID NO: 2887326 - RNA, 17 nt, Human
uacauuuaaagcauugc

SEQ ID NO: 2887327 - RNA, 18 nt, Human
uacauuuaaagcauugcu

SEQ ID NO: 2887328 - RNA, 19 nt, Human
uacauuuaaagcauugcug

SEQ ID NO: 2887329 - RNA, 20 nt, Human
uacauuuaaagcauugcugu

SEQ ID NO: 2887330 - RNA, 22 nt, Human
uacauuuaaagcauugcuguua

SEQ ID NO: 2887331 - RNA, 20 nt, Human
uacccugcgauuuugccugu

SEQ ID NO: 2887332 - RNA, 17 nt, Human
uacccugaguucaucca

SEQ ID NO: 2887333 - RNA, 18 nt, Human
uacccuccugcacuguuu

SEQ ID NO: 2887334 - RNA, 13 nt, Human
uacccucucagcu

SEQ ID NO: 2887335 - RNA, 15 nt, Human
uacccucucagcucc

SEQ ID NO: 2887336 - RNA, 16 nt, Human
uacccucucagcucca

SEQ ID NO: 2887337 - RNA, 17 nt, Human
uacccucucagcuccag

SEQ ID NO: 2887338 - RNA, 20 nt, Human
uacccucucagcuccaggug

SEQ ID NO: 2887339 - RNA, 21 nt, Human
uacccucucagcuccaggugg

SEQ ID NO: 2887340 - RNA, 12 nt, Human
uacccucuggag

SEQ ID NO: 2887341 - RNA, 14 nt, Human
uacccucuggaggg

SEQ ID NO: 2887342 - RNA, 22 nt, Human
uacccucuggagggguguggcu

SEQ ID NO: 2887343 - RNA, 14 nt, Human
uacccucccacccc

SEQ ID NO: 2887344 - RNA, 13 nt, Human
uacccucccaccc

SEQ ID NO: 2887345 - RNA, 15 nt, Human
uacccucccaccccc

SEQ ID NO: 2887346 - RNA, 12 nt, Human
uacccuccuggc

SEQ ID NO: 2887347 - RNA, 15 nt, Human
uacccuccuggcucu

SEQ ID NO: 2887348 - RNA, 18 nt, Human
uaccccuuucuggcucuc

SEQ ID NO: 2887349 - RNA, 19 nt, Human
uaccccuuagccucccuga

SEQ ID NO: 2887350 - RNA, 21 nt, Human
uaccccugccuuugggagcag

SEQ ID NO: 2887351 - RNA, 22 nt, Human
uaccccugccuuugggagcagg

SEQ ID NO: 2887352 - RNA, 12 nt, Human
uaccccuggcug

SEQ ID NO: 2887353 - RNA, 13 nt, Human
uaccccuggcugu

SEQ ID NO: 2887354 - RNA, 17 nt, Human
uaccccuggcuguacug

SEQ ID NO: 2887355 - RNA, 18 nt, Human
uaccccuggcuguacugc

SEQ ID NO: 2887356 - RNA, 17 nt, Human
aauugaagagagauaua

SEQ ID NO: 2887357 - RNA, 23 nt, Human
aauugaagagagauauaucugaa

SEQ ID NO: 2887358 - RNA, 14 nt, Human
aauucuuuugaauu

SEQ ID NO: 2887359 - RNA, 17 nt, Human
aauucuuuugaauuguu

SEQ ID NO: 2887360 - RNA, 13 nt, Human
aauucuuuugcca

SEQ ID NO: 2887361 - RNA, 12 nt, Human
aauugaaacacu

SEQ ID NO: 2887362 - RNA, 13 nt, Human
aauugaaacacuu

SEQ ID NO: 2887363 - RNA, 15 nt, Human
aauugaaacacuuuu

SEQ ID NO: 2887364 - RNA, 17 nt, Human
aauugaaaaacucuuua

SEQ ID NO: 2887365 - RNA, 15 nt, Human
aauucuucuguccug

SEQ ID NO: 2887366 - RNA, 21 nt, Human
aauucuugaaagaauuuuccu

SEQ ID NO: 2887367 - RNA, 15 nt, Human
aauucuuggaauacu

SEQ ID NO: 2887368 - RNA, 13 nt, Human
aauucuuggaaua

SEQ ID NO: 2887369 - RNA, 18 nt, Human
aauucuuguaauuuuuau

SEQ ID NO: 2887370 - RNA, 16 nt, Human
aauucuuuauuucugu

SEQ ID NO: 2887371 - RNA, 20 nt, Human
aauucuuuauuucugucauu

SEQ ID NO: 2887372 - RNA, 21 nt, Human
aauucuugaaggaaaaugaua

SEQ ID NO: 2887373 - RNA, 16 nt, Human
aauucuugaaggaaaa

SEQ ID NO: 2887374 - RNA, 15 nt, Human
aauucuugaaggaaa

SEQ ID NO: 2887375 - RNA, 11 nt, Human
aauucuucagu

SEQ ID NO: 2887376 - RNA, 20 nt, Human
aauucuucaguugguugugu

SEQ ID NO: 2887377 - RNA, 22 nt, Human
aauucuuacacugccuguauac

SEQ ID NO: 2887378 - RNA, 23 nt, Human
aauucuuacacugccuguauacu

SEQ ID NO: 2887379 - RNA, 18 nt, Human
aauucuuacccuguacau

SEQ ID NO: 2887380 - RNA, 15 nt, Human
aauucuuaugcuuau

SEQ ID NO: 2887381 - RNA, 12 nt, Human
aauucuuauuuu

SEQ ID NO: 2887382 - RNA, 13 nt, Human
aauucuuauuuug

SEQ ID NO: 2887383 - RNA, 17 nt, Human
aauucuuauuuugugga

SEQ ID NO: 2887384 - RNA, 22 nt, Human
aauucuucaccuaagucucugu

SEQ ID NO: 2887385 - RNA, 23 nt, Human
aauucuucaccuaagucucugug

SEQ ID NO: 2887386 - RNA, 19 nt, Human
aauucuucagcguaaaaug

SEQ ID NO: 2887387 - RNA, 20 nt, Human
aauucuucagcguaaaaugg

SEQ ID NO: 2887388 - RNA, 21 nt, Human
aauucuucagcguaaaauggu

SEQ ID NO: 2887389 - RNA, 15 nt, Human
uacccuuuucugggg

SEQ ID NO: 2887390 - RNA, 17 nt, Human
uacccuuuuucuccagc

SEQ ID NO: 2887391 - RNA, 18 nt, Human
uacccuuuuucuccagcu

SEQ ID NO: 2887392 - RNA, 19 nt, Human
uacccuuuuucuccagcug

SEQ ID NO: 2887393 - RNA, 20 nt, Human
uacccuuggcucaauccucu

SEQ ID NO: 2887394 - RNA, 20 nt, Human
uacccuuuagacuguagccu

SEQ ID NO: 2887395 - RNA, 22 nt, Human
uacccuuuccuccuuuaucaca

SEQ ID NO: 2887396 - RNA, 16 nt, Human
uacccuuuuccuuugu

SEQ ID NO: 2887397 - RNA, 21 nt, Human
uacccuuuuccuuugugguuu

SEQ ID NO: 2887398 - RNA, 14 nt, Human
uacccuucuuuuau

SEQ ID NO: 2887399 - RNA, 20 nt, Human
uacccuucuuuuaugagcag

SEQ ID NO: 2887400 - RNA, 16 nt, Human
uacccuugagcccucc

SEQ ID NO: 2887401 - RNA, 19 nt, Human
uacccuugagcccucccca

SEQ ID NO: 2887402 - RNA, 17 nt, Human
uacccuguacauaugua

SEQ ID NO: 2887403 - RNA, 13 nt, Human
uacccuuaauuac

SEQ ID NO: 2887404 - RNA, 17 nt, Human
uacccuuaauuacuuaa

SEQ ID NO: 2887405 - RNA, 16 nt, Human
uacccuuagaauccac

SEQ ID NO: 2887406 - RNA, 15 nt, Human
uacccuucccugcac

SEQ ID NO: 2887407 - RNA, 16 nt, Human
uacccuucccugcacu

SEQ ID NO: 2887408 - RNA, 17 nt, Human
uacccuucccugcacua

SEQ ID NO: 2887409 - RNA, 18 nt, Human
uacccuggccgcccccug

SEQ ID NO: 2887410 - RNA, 18 nt, Human
uacccugggaaggccucu

SEQ ID NO: 2887411 - RNA, 21 nt, Human
uacccugggaaggccucuugg

SEQ ID NO: 2887412 - RNA, 21 nt, Human
uacccugcgcccaguccuucc

SEQ ID NO: 2887413 - RNA, 23 nt, Human
uacccugcgcccaguccuuccac

SEQ ID NO: 2887414 - RNA, 14 nt, Human
uacucaauggauuu

SEQ ID NO: 2887415 - RNA, 21 nt, Human
uacucugugucagguggggca

SEQ ID NO: 2887416 - RNA, 18 nt, Human
uacucuuauagacaacau

SEQ ID NO: 2887417 - RNA, 22 nt, Human
uacucuucaguuaagccuuugg

SEQ ID NO: 2887418 - RNA, 22 nt, Human
uacugaacuguguguaauuguu

SEQ ID NO: 2887419 - RNA, 15 nt, Human
uacugaacuuucuua

SEQ ID NO: 2887420 - RNA, 16 nt, Human
uacucuugguuuuuau

SEQ ID NO: 2887421 - RNA, 17 nt, Human
uacucuuguugaguucu

SEQ ID NO: 2887422 - RNA, 19 nt, Human
uacucuuuacccuugagcc

SEQ ID NO: 2887423 - RNA, 21 nt, Human
uacucuuuacccuugagcccu

SEQ ID NO: 2887424 - RNA, 18 nt, Human
uacuggucuuguggaauu

SEQ ID NO: 2887425 - RNA, 14 nt, Human
uacgucugacaggc

SEQ ID NO: 2887426 - RNA, 14 nt, Human
uacguuaccaggca

SEQ ID NO: 2887427 - RNA, 18 nt, Human
uacgucaaacaugaagug

SEQ ID NO: 2887428 - RNA, 14 nt, Human
uacuaguacugugu

SEQ ID NO: 2887429 - RNA, 16 nt, Human
uacuaguacuguguac

SEQ ID NO: 2887430 - RNA, 17 nt, Human
uacuaguacuguguacu

SEQ ID NO: 2887431 - RNA, 18 nt, Human
uacuaguacuguguacug

SEQ ID NO: 2887432 - RNA, 21 nt, Human
uacuaguacuguguacuguau

SEQ ID NO: 2887433 - RNA, 13 nt, Human
uacuauaacauau

SEQ ID NO: 2887434 - RNA, 14 nt, Human
uacuauaacauaug

SEQ ID NO: 2887435 - RNA, 14 nt, Human
uacuaguguucugu

SEQ ID NO: 2887436 - RNA, 15 nt, Human
uacuaguguucuguu

SEQ ID NO: 2887437 - RNA, 16 nt, Human
uacuaguguucuguuu

SEQ ID NO: 2887438 - RNA, 19 nt, Human
uacuaguuuuaguuuucuc

SEQ ID NO: 2887439 - RNA, 13 nt, Human
uacuauaaagaga

SEQ ID NO: 2887440 - RNA, 14 nt, Human
uacuauaaagagaa

SEQ ID NO: 2887441 - RNA, 22 nt, Human
uacuauucaguggcgagaaaua

SEQ ID NO: 2887442 - RNA, 22 nt, Human
uacuauuguugcugaaacuugc

SEQ ID NO: 2887443 - RNA, 23 nt, Human
uacuauuguugcugaaacuugcu

SEQ ID NO: 2887444 - RNA, 15 nt, Human
uacucaagcccgcgg

SEQ ID NO: 2887445 - RNA, 23 nt, Human
uacucaauggaguaugucugaug

SEQ ID NO: 2887446 - RNA, 11 nt, Human
uacuauuuaaa

SEQ ID NO: 2887447 - RNA, 18 nt, Human
aauugcucauaagcaaua

SEQ ID NO: 2887448 - RNA, 21 nt, Human
aauugcugaagggcauucuuu

SEQ ID NO: 2887449 - RNA, 23 nt, Human
aauugcugaagggcauucuuucc

SEQ ID NO: 2887450 - RNA, 16 nt, Human
aauugcuguugaaagc

SEQ ID NO: 2887451 - RNA, 18 nt, Human
aauugcuguugaaagcaa

SEQ ID NO: 2887452 - RNA, 19 nt, Human
aauugcuguugaaagcaaa

SEQ ID NO: 2887453 - RNA, 20 nt, Human
aauugcuguugaaagcaaaa

SEQ ID NO: 2887454 - RNA, 21 nt, Human
aauugcuguugaaagcaaaaa

SEQ ID NO: 2887455 - RNA, 14 nt, Human
aauugcguuggucu

SEQ ID NO: 2887456 - RNA, 16 nt, Human
aauugcguuggucucu

SEQ ID NO: 2887457 - RNA, 18 nt, Human
aauugcguuggucucugc

SEQ ID NO: 2887458 - RNA, 20 nt, Human
aauugcguuggucucugcau

SEQ ID NO: 2887459 - RNA, 22 nt, Human
aauugcguuggucucugcauuu

SEQ ID NO: 2887460 - RNA, 19 nt, Human
uacuguaaccuguugcugu

SEQ ID NO: 2887461 - RNA, 13 nt, Human
aauugcuauguua

SEQ ID NO: 2887462 - RNA, 14 nt, Human
aauugcuauguuac

SEQ ID NO: 2887463 - RNA, 19 nt, Human
aauugcuauguuacuauuu

SEQ ID NO: 2887464 - RNA, 20 nt, Human
aauugcuauguuacuauuuu

SEQ ID NO: 2887465 - RNA, 21 nt, Human
aauugcuauguuacuauuuuc

SEQ ID NO: 2887466 - RNA, 14 nt, Human
aauugcuauugugu

SEQ ID NO: 2887467 - RNA, 14 nt, Human
aauugcucaaguuc

SEQ ID NO: 2887468 - RNA, 12 nt, Human
aauugcuccuug

SEQ ID NO: 2887469 - RNA, 20 nt, Human
aauugcuccuaagcuucaaa

SEQ ID NO: 2887470 - RNA, 22 nt, Human
aauuguuuggggaugagaaagg

SEQ ID NO: 2887471 - RNA, 23 nt, Human
aauuguuguuucuuucuaguggu

SEQ ID NO: 2887472 - RNA, 20 nt, Human
aauuguuguuucuuucuagu

SEQ ID NO: 2887473 - RNA, 21 nt, Human
aauuguuguuucuuucuagug

SEQ ID NO: 2887474 - RNA, 23 nt, Human
aauuguugcuaaucuucuuaugc

SEQ ID NO: 2887475 - RNA, 12 nt, Human
aauuguuguuuc

SEQ ID NO: 2887476 - RNA, 13 nt, Human
aauuguuguuucu

SEQ ID NO: 2887477 - RNA, 15 nt, Human
aauuguuguuucuuu

SEQ ID NO: 2887478 - RNA, 17 nt, Human
aauuguuguuucuuucu

SEQ ID NO: 2887479 - RNA, 18 nt, Human
aauuguuguuucuuucua

SEQ ID NO: 2887480 - RNA, 19 nt, Human
aauuguuguuucuuucuag

SEQ ID NO: 2887481 - RNA, 22 nt, Human
aauuuaaaaaugagugugaagg

SEQ ID NO: 2887482 - RNA, 14 nt, Human
aauuuaaaaaauaa

SEQ ID NO: 2887483 - RNA, 18 nt, Human
aauuguuuuaaucugaaa

SEQ ID NO: 2887484 - RNA, 19 nt, Human
aauuguuuuaaucugaaau

SEQ ID NO: 2887485 - RNA, 17 nt, Human
aauuguuuggcuuccuc

SEQ ID NO: 2887486 - RNA, 19 nt, Human
aauuguuuggcuuccuccu

SEQ ID NO: 2887487 - RNA, 20 nt, Human
aauuguuuggcuuccuccug

SEQ ID NO: 2887488 - RNA, 21 nt, Human
aauuguuuggcuuccuccuga

SEQ ID NO: 2887489 - RNA, 15 nt, Human
aauuguuuguccuca

SEQ ID NO: 2887490 - RNA, 14 nt, Human
aauuguuuucuuua

SEQ ID NO: 2887491 - RNA, 15 nt, Human
aauuguuuucuuuaa

SEQ ID NO: 2887492 - RNA, 19 nt, Human
aauuguuuucuuuaaagau

SEQ ID NO: 2887493 - RNA, 13 nt, Human
aauuuaaaaaaua

SEQ ID NO: 2887494 - RNA, 16 nt, Human
aauuguuuugcacuuu

SEQ ID NO: 2887495 - RNA, 17 nt, Human
aauuguuuugcacuuuu

SEQ ID NO: 2887496 - RNA, 20 nt, Human
aauuguuuugcacuuuuuua

SEQ ID NO: 2887497 - RNA, 20 nt, Human
aauuguuuuuauuguuuucu

SEQ ID NO: 2887498 - RNA, 9 nt, Human
aauuuaaac

SEQ ID NO: 2887499 - RNA, 10 nt, Human
aauuuaaaca

SEQ ID NO: 2887500 - RNA, 15 nt, Human
aauuuaaacaccucc

SEQ ID NO: 2887501 - RNA, 19 nt, Human
aauuuaaacaccuccucau

SEQ ID NO: 2887502 - RNA, 13 nt, Human
aauuuaaacauua

SEQ ID NO: 2887503 - RNA, 14 nt, Human
aauuuaaacauuaa

SEQ ID NO: 2887504 - RNA, 22 nt, Human
aauuuaaacauuaaaaauggaa

SEQ ID NO: 2887505 - RNA, 12 nt, Human
aauuuaaagaua

SEQ ID NO: 2887506 - RNA, 13 nt, Human
aauuuaaagauau

SEQ ID NO: 2887507 - RNA, 17 nt, Human
aauuuaaagauauuguu

SEQ ID NO: 2887508 - RNA, 16 nt, Human
aauuuaagugcgugug

SEQ ID NO: 2887509 - RNA, 23 nt, Human
aauuuaagugcguguguagaguu

SEQ ID NO: 2887510 - RNA, 17 nt, Human
aauuuaauaacuuuuua

SEQ ID NO: 2887511 - RNA, 20 nt, Human
aauuuaagugcguguguaga

SEQ ID NO: 2887512 - RNA, 14 nt, Human
aauuuaaugcaugu

SEQ ID NO: 2887513 - RNA, 14 nt, Human
aauuuaaugcugcc

SEQ ID NO: 2887514 - RNA, 15 nt, Human
aauuuaaugcugccu

SEQ ID NO: 2887515 - RNA, 17 nt, Human
aauuuaaugcugccuuu

SEQ ID NO: 2887516 - RNA, 22 nt, Human
aauuucuaaaaaacagaggcca

SEQ ID NO: 2887517 - RNA, 17 nt, Human
aauuucuaaaaagauua

SEQ ID NO: 2887518 - RNA, 22 nt, Human
aauuucuaaaaagauuagcaag

SEQ ID NO: 2887519 - RNA, 13 nt, Human
aauuucuaaagau

SEQ ID NO: 2887520 - RNA, 15 nt, Human
aauuucuaaagauaa

SEQ ID NO: 2887521 - RNA, 16 nt, Human
aauuucuaaagauaau

SEQ ID NO: 2887522 - RNA, 23 nt, Human
aauuucuaaagauaauauuacug

SEQ ID NO: 2887523 - RNA, 18 nt, Human
aauuucuaccauuucaga

SEQ ID NO: 2887524 - RNA, 16 nt, Human
aauuucuaccauuuca

SEQ ID NO: 2887525 - RNA, 20 nt, Human
aauuuaugaguuuuugauag

SEQ ID NO: 2887526 - RNA, 19 nt, Human
aauuuaugcacuuauaagg

SEQ ID NO: 2887527 - RNA, 22 nt, Human
aauuuaugcacuuauaaggugu

SEQ ID NO: 2887528 - RNA, 19 nt, Human
aauuuaugaguuuuugaua

SEQ ID NO: 2887529 - RNA, 16 nt, Human
aauuuaugaguuuuug

SEQ ID NO: 2887530 - RNA, 13 nt, Human
aauuuagaaacua

SEQ ID NO: 2887531 - RNA, 18 nt, Human
aauuuagaaacuaauuga

SEQ ID NO: 2887532 - RNA, 19 nt, Human
aauuuagaaacuaauugac

SEQ ID NO: 2887533 - RNA, 21 nt, Human
aauuuagaaacuaauugacuu

SEQ ID NO: 2887534 - RNA, 22 nt, Human
aauuuagaaacuaauugacuuu

SEQ ID NO: 2887535 - RNA, 23 nt, Human
aauuuauccugaaauuucagauu

SEQ ID NO: 2887536 - RNA, 12 nt, Human
aauuuaucuaaa

SEQ ID NO: 2887537 - RNA, 21 nt, Human
aauuuaucuaaauuaaagccu

SEQ ID NO: 2887538 - RNA, 19 nt, Human
aauuuauccugaaauuuca

SEQ ID NO: 2887539 - RNA, 18 nt, Human
aauuuauccugaaauuuc

SEQ ID NO: 2887540 - RNA, 16 nt, Human
aauuuaggguacuaaa

SEQ ID NO: 2887541 - RNA, 17 nt, Human
aauuuaggguacuaaau

SEQ ID NO: 2887542 - RNA, 18 nt, Human
aauuuaggguacuaaauu

SEQ ID NO: 2887543 - RNA, 21 nt, Human
aauuuaggguacuaaauuuaa

SEQ ID NO: 2887544 - RNA, 22 nt, Human
aauuuaggguacuaaauuuaaa

SEQ ID NO: 2887545 - RNA, 14 nt, Human
aauuuaguaaaugu

SEQ ID NO: 2887546 - RNA, 15 nt, Human
aauuuaguaaauguu

SEQ ID NO: 2887547 - RNA, 16 nt, Human
aauuuaguaaauguua

SEQ ID NO: 2887548 - RNA, 15 nt, Human
aauuuagauuguaaa

SEQ ID NO: 2887549 - RNA, 16 nt, Human
aauuuagauuguaaac

SEQ ID NO: 2887550 - RNA, 20 nt, Human
uacuuauuuuugacaguguu

SEQ ID NO: 2887551 - RNA, 13 nt, Human
aauuugauuaaca

SEQ ID NO: 2887552 - RNA, 15 nt, Human
aauuugauuaacaaa

SEQ ID NO: 2887553 - RNA, 17 nt, Human
aauuugauuaacaaaua

SEQ ID NO: 2887554 - RNA, 14 nt, Human
aauuugaggacaac

SEQ ID NO: 2887555 - RNA, 13 nt, Human
aauuugauacaua

SEQ ID NO: 2887556 - RNA, 14 nt, Human
aauuugauacauaa

SEQ ID NO: 2887557 - RNA, 15 nt, Human
aauuugauacauaau

SEQ ID NO: 2887558 - RNA, 17 nt, Human
aauuugauacauaauaa

SEQ ID NO: 2887559 - RNA, 18 nt, Human
aauuugauacauaauaaa

SEQ ID NO: 2887560 - RNA, 21 nt, Human
aauuugauacauaugugaaua

SEQ ID NO: 2887561 - RNA, 12 nt, Human
aauuugauacuu

SEQ ID NO: 2887562 - RNA, 13 nt, Human
aauuugauacuua

SEQ ID NO: 2887563 - RNA, 15 nt, Human
aauuugauacuuaua

SEQ ID NO: 2887564 - RNA, 16 nt, Human
aauuugauacuuauau

SEQ ID NO: 2887565 - RNA, 18 nt, Human
aauuugauacuuauauuu

SEQ ID NO: 2887566 - RNA, 20 nt, Human
aauuugauacuuauauuuuc

SEQ ID NO: 2887567 - RNA, 20 nt, Human
aauuugauacauaugugaau

SEQ ID NO: 2887568 - RNA, 13 nt, Human
aauuugaggacaa

SEQ ID NO: 2887569 - RNA, 14 nt, Human
aauuucugugaaac

SEQ ID NO: 2887570 - RNA, 16 nt, Human
aauuucugucagaaug

SEQ ID NO: 2887571 - RNA, 18 nt, Human
aauuucugucagaaugcu

SEQ ID NO: 2887572 - RNA, 11 nt, Human
aauuuuuuccu

SEQ ID NO: 2887573 - RNA, 13 nt, Human
aauuuuuuucacc

SEQ ID NO: 2887574 - RNA, 20 nt, Human
aauuuuucagcucucuguau

SEQ ID NO: 2887575 - RNA, 21 nt, Human
aauuuuucagcucucuguaua

SEQ ID NO: 2887576 - RNA, 23 nt, Human
aauuuuucagcucucuguauaaa

SEQ ID NO: 2887577 - RNA, 20 nt, Human
aauuuuucucaguuuguaua

SEQ ID NO: 2887578 - RNA, 15 nt, Human
aauuuuugucucaga

SEQ ID NO: 2887579 - RNA, 17 nt, Human
aauuuuugucucagaag

SEQ ID NO: 2887580 - RNA, 17 nt, Human
aauuuuuuaaaagagac

SEQ ID NO: 2887581 - RNA, 14 nt, Human
aauuuuuguauuuu

SEQ ID NO: 2887582 - RNA, 13 nt, Human
aauuuuuguagua

SEQ ID NO: 2887583 - RNA, 20 nt, Human
acaaaaaaauauauuuaaug

SEQ ID NO: 2887584 - RNA, 21 nt, Human
acaaaaaaauaccucaggaaa

SEQ ID NO: 2887585 - RNA, 23 nt, Human
acaaaaaaauaccucaggaaaga

SEQ ID NO: 2887586 - RNA, 19 nt, Human
acaaaaaaaccacaaaggc

SEQ ID NO: 2887587 - RNA, 17 nt, Human
aauuuuuuugagacaga

SEQ ID NO: 2887588 - RNA, 20 nt, Human
aauuuuuuucaccuagauuu

SEQ ID NO: 2887589 - RNA, 17 nt, Human
acaaaaaaauauauuua

SEQ ID NO: 2887590 - RNA, 13 nt, Human
acaaaaaaauaua

SEQ ID NO: 2887591 - RNA, 23 nt, Human
acaaaaaaaaaaaaagaagaccg

SEQ ID NO: 2887592 - RNA, 22 nt, Human
aauuuuaagguagaaccucacc

SEQ ID NO: 2887593 - RNA, 14 nt, Human
aauuuuaaacaaag

SEQ ID NO: 2887594 - RNA, 17 nt, Human
aauuuuaaacaaagguu

SEQ ID NO: 2887595 - RNA, 20 nt, Human
aauuuuuacccuaaugucuu

SEQ ID NO: 2887596 - RNA, 22 nt, Human
aauuuuuacccuaaugucuuca

SEQ ID NO: 2887597 - RNA, 16 nt, Human
aauuuuuaggaaguuu

SEQ ID NO: 2887598 - RNA, 22 nt, Human
aauuuuuaggaaguuuucugua

SEQ ID NO: 2887599 - RNA, 22 nt, Human
aauuuuuauauuuaauuauuaa

SEQ ID NO: 2887600 - RNA, 20 nt, Human
aauuuguaaaauguucucuu

SEQ ID NO: 2887601 - RNA, 13 nt, Human
aauuuguaaguuu

SEQ ID NO: 2887602 - RNA, 14 nt, Human
aauuuguaaguuuc

SEQ ID NO: 2887603 - RNA, 16 nt, Human
aauuuguaaguuucag

SEQ ID NO: 2887604 - RNA, 18 nt, Human
aauuuguaaguuucaggu

SEQ ID NO: 2887605 - RNA, 19 nt, Human
aauuuguaaguuucaggug

SEQ ID NO: 2887606 - RNA, 23 nt, Human
aauuuguaaguuucaggugacau

SEQ ID NO: 2887607 - RNA, 14 nt, Human
aauuuuaaaaaugg

SEQ ID NO: 2887608 - RNA, 20 nt, Human
aauuuuaaaaaugguggcuu

SEQ ID NO: 2887609 - RNA, 14 nt, Human
aauuuuaaaaauac

SEQ ID NO: 2887610 - RNA, 18 nt, Human
aauuuuaaaaauacauau

SEQ ID NO: 2887611 - RNA, 20 nt, Human
aauuuguacauauguaaaau

SEQ ID NO: 2887612 - RNA, 23 nt, Human
uagaacucuccaucuuauuuuca

SEQ ID NO: 2887613 - RNA, 15 nt, Human
uagaacuuacuauuc

SEQ ID NO: 2887614 - RNA, 18 nt, Human
uagaacuuacuauucauu

SEQ ID NO: 2887615 - RNA, 19 nt, Human
uagaacuguaugucagaca

SEQ ID NO: 2887616 - RNA, 13 nt, Human
uagaacuggguaa

SEQ ID NO: 2887617 - RNA, 18 nt, Human
uagaacuggguaaaugca

SEQ ID NO: 2887618 - RNA, 20 nt, Human
uagaacuggguaaaugcaaa

SEQ ID NO: 2887619 - RNA, 16 nt, Human
uagaacuugacccccu

SEQ ID NO: 2887620 - RNA, 20 nt, Human
uagaacuguaugucagacau

SEQ ID NO: 2887621 - RNA, 23 nt, Human
uagaacuucuccguccucgaugg

SEQ ID NO: 2887622 - RNA, 15 nt, Human
uagaagucacacagu

SEQ ID NO: 2887623 - RNA, 22 nt, Human
uagaagcauuccuucuuugaua

SEQ ID NO: 2887624 - RNA, 23 nt, Human
uagaagcauuccuucuuugauaa

SEQ ID NO: 2887625 - RNA, 14 nt, Human
uagaagcauuccuu

SEQ ID NO: 2887626 - RNA, 20 nt, Human
uagaagcauuccuucuuuga

SEQ ID NO: 2887627 - RNA, 21 nt, Human
uagaagcauuccuucuuugau

SEQ ID NO: 2887628 - RNA, 19 nt, Human
uagaagaggguuuuaggua

SEQ ID NO: 2887629 - RNA, 21 nt, Human
uagaacuugcagcugauguug

SEQ ID NO: 2887630 - RNA, 23 nt, Human
uagaagcaaauuaaacgguaaca

SEQ ID NO: 2887631 - RNA, 20 nt, Human
uacuucacuauacaaacaaa

SEQ ID NO: 2887632 - RNA, 19 nt, Human
uacuucaggggcacuucau

SEQ ID NO: 2887633 - RNA, 22 nt, Human
uacuucaggggcacuucauuga

SEQ ID NO: 2887634 - RNA, 13 nt, Human
uacuucagcaaga

SEQ ID NO: 2887635 - RNA, 14 nt, Human
uacuucagcaagag

SEQ ID NO: 2887636 - RNA, 15 nt, Human
uacuucagcaagaga

SEQ ID NO: 2887637 - RNA, 17 nt, Human
uacuucagcaagagaga

SEQ ID NO: 2887638 - RNA, 21 nt, Human
uacuucagcaagagagaaccu

SEQ ID NO: 2887639 - RNA, 22 nt, Human
uacuucagcaagagagaaccua

SEQ ID NO: 2887640 - RNA, 16 nt, Human
uagaagucacacagua

SEQ ID NO: 2887641 - RNA, 22 nt, Human
uagacaaguccagccuggcaag

SEQ ID NO: 2887642 - RNA, 21 nt, Human
uagacagagucucacuguugc

SEQ ID NO: 2887643 - RNA, 15 nt, Human
uagacaauugaggua

SEQ ID NO: 2887644 - RNA, 14 nt, Human
uagacaauauacaa

SEQ ID NO: 2887645 - RNA, 16 nt, Human
uagacaaucauuguuu

SEQ ID NO: 2887646 - RNA, 17 nt, Human
uagacaaucauuguuuu

SEQ ID NO: 2887647 - RNA, 20 nt, Human
uagacaaucauuguuuugaa

SEQ ID NO: 2887648 - RNA, 23 nt, Human
uagacaaucauuguuuugaauau

SEQ ID NO: 2887649 - RNA, 19 nt, Human
uagacagcuuugacuggag

SEQ ID NO: 2887650 - RNA, 18 nt, Human
uagacaauugagguaagu

SEQ ID NO: 2887651 - RNA, 19 nt, Human
uagaauuggcugaacucau

SEQ ID NO: 2887652 - RNA, 12 nt, Human
uagaauuguuau

SEQ ID NO: 2887653 - RNA, 13 nt, Human
uagaauuguuaua

SEQ ID NO: 2887654 - RNA, 14 nt, Human
uagaauuguuauag

SEQ ID NO: 2887655 - RNA, 13 nt, Human
uagaauugcauug

SEQ ID NO: 2887656 - RNA, 15 nt, Human
uagaauugcauugac

SEQ ID NO: 2887657 - RNA, 14 nt, Human
uagaauugcauuga

SEQ ID NO: 2887658 - RNA, 14 nt, Human
uagacaagauauug

SEQ ID NO: 2887659 - RNA, 17 nt, Human
uagacaagauauuguac

SEQ ID NO: 2887660 - RNA, 19 nt, Human
uagacaagauauuguacau

SEQ ID NO: 2887661 - RNA, 20 nt, Human
uagacaagauauuguacaua

SEQ ID NO: 2887662 - RNA, 21 nt, Human
uagacaagauauuguacauaa

SEQ ID NO: 2887663 - RNA, 19 nt, Human
uagacaaauauuuggaggg

SEQ ID NO: 2887664 - RNA, 18 nt, Human
acaagaaauuugauuucu

SEQ ID NO: 2887665 - RNA, 14 nt, Human
acaagaagaagggc

SEQ ID NO: 2887666 - RNA, 12 nt, Human
acaagaagauga

SEQ ID NO: 2887667 - RNA, 13 nt, Human
acaagaagaugaa

SEQ ID NO: 2887668 - RNA, 23 nt, Human
acaagaaggguuuuccacccugg

SEQ ID NO: 2887669 - RNA, 14 nt, Human
acaagaaguuuauu

SEQ ID NO: 2887670 - RNA, 21 nt, Human
acaagaaguuuauucucauuu

SEQ ID NO: 2887671 - RNA, 15 nt, Human
acaagaacugaaacc

SEQ ID NO: 2887672 - RNA, 17 nt, Human
acaagaaucacuugaac

SEQ ID NO: 2887673 - RNA, 12 nt, Human
acaagaaugcau

SEQ ID NO: 2887674 - RNA, 15 nt, Human
acaagaaugcauuga

SEQ ID NO: 2887675 - RNA, 15 nt, Human
acaacaaccugguca

SEQ ID NO: 2887676 - RNA, 12 nt, Human
acaacacucaca

SEQ ID NO: 2887677 - RNA, 18 nt, Human
acaacaaaggcaaguuaa

SEQ ID NO: 2887678 - RNA, 23 nt, Human
acaacaaaggcaaguuaagagaa

SEQ ID NO: 2887679 - RNA, 13 nt, Human
acaacaagaguuu

SEQ ID NO: 2887680 - RNA, 15 nt, Human
acaacacaaccaacg

SEQ ID NO: 2887681 - RNA, 14 nt, Human
acaacacacacacu

SEQ ID NO: 2887682 - RNA, 22 nt, Human
uagcauuacccccaaccucauu

SEQ ID NO: 2887683 - RNA, 15 nt, Human
uagcauuaugcaauu

SEQ ID NO: 2887684 - RNA, 16 nt, Human
uagcauuaugcaauua

SEQ ID NO: 2887685 - RNA, 22 nt, Human
uagcauuaugcaauuagguuuu

SEQ ID NO: 2887686 - RNA, 15 nt, Human
uagcauucuggcagu

SEQ ID NO: 2887687 - RNA, 17 nt, Human
acaaauucauauucugu

SEQ ID NO: 2887688 - RNA, 21 nt, Human
acaaauucugaauauuuuuug

SEQ ID NO: 2887689 - RNA, 22 nt, Human
acaaauguguaucggaugcuuu

SEQ ID NO: 2887690 - RNA, 14 nt, Human
acaaaugugaagau

SEQ ID NO: 2887691 - RNA, 15 nt, Human
acaaaugugaagaug

SEQ ID NO: 2887692 - RNA, 16 nt, Human
acaaaugugaagaugc

SEQ ID NO: 2887693 - RNA, 17 nt, Human
acaaaugugaagaugca

SEQ ID NO: 2887694 - RNA, 18 nt, Human
acaaaugugaagaugcau

SEQ ID NO: 2887695 - RNA, 21 nt, Human
acaaaugugaagaugcauugu

SEQ ID NO: 2887696 - RNA, 23 nt, Human
acaaaugugaagaugcauuguag

SEQ ID NO: 2887697 - RNA, 14 nt, Human
acaaauuaaaaaga

SEQ ID NO: 2887698 - RNA, 16 nt, Human
acaaauuaaaaagauu

SEQ ID NO: 2887699 - RNA, 17 nt, Human
acaaauuaaaaagauuc

SEQ ID NO: 2887700 - RNA, 21 nt, Human
acaaauuaaaaagauucuuuu

SEQ ID NO: 2887701 - RNA, 13 nt, Human
acaaauuaauuuu

SEQ ID NO: 2887702 - RNA, 16 nt, Human
acaagcaaguucugag

SEQ ID NO: 2887703 - RNA, 15 nt, Human
acaagcaagcuccca

SEQ ID NO: 2887704 - RNA, 13 nt, Human
acaagcaagcucc

SEQ ID NO: 2887705 - RNA, 22 nt, Human
acaagcaauuagacaagaacuu

SEQ ID NO: 2887706 - RNA, 11 nt, Human
acaagcagagg

SEQ ID NO: 2887707 - RNA, 20 nt, Human
acaagcagagugcacagcug

SEQ ID NO: 2887708 - RNA, 21 nt, Human
acaagcagagugcacagcugu

SEQ ID NO: 2887709 - RNA, 22 nt, Human
acaagcagagugcacagcuguc

SEQ ID NO: 2887710 - RNA, 19 nt, Human
acaagcagauacugcugug

SEQ ID NO: 2887711 - RNA, 20 nt, Human
acaagagcagccuguggcau

SEQ ID NO: 2887712 - RNA, 19 nt, Human
acaagagcagccuguggca

SEQ ID NO: 2887713 - RNA, 18 nt, Human
acaagagcagccuguggc

SEQ ID NO: 2887714 - RNA, 16 nt, Human
acaagagcagccugug

SEQ ID NO: 2887715 - RNA, 15 nt, Human
acaagagcagccugu

SEQ ID NO: 2887716 - RNA, 14 nt, Human
acaagagcagccug

SEQ ID NO: 2887717 - RNA, 21 nt, Human
acaagagcacuacauucauuu

SEQ ID NO: 2887718 - RNA, 15 nt, Human
acaagagcacuacau

SEQ ID NO: 2887719 - RNA, 12 nt, Human
acaagccacccc

SEQ ID NO: 2887720 - RNA, 12 nt, Human
acaagccaagaa

SEQ ID NO: 2887721 - RNA, 18 nt, Human
acaagccacaagucuucc

SEQ ID NO: 2887722 - RNA, 20 nt, Human
acaagccacaagucuuccag

SEQ ID NO: 2887723 - RNA, 13 nt, Human
acaagccagcugg

SEQ ID NO: 2887724 - RNA, 15 nt, Human
acaagccagcuggag

SEQ ID NO: 2887725 - RNA, 13 nt, Human
acaagcccacagc

SEQ ID NO: 2887726 - RNA, 15 nt, Human
acaagcccacagcac

SEQ ID NO: 2887727 - RNA, 16 nt, Human
acaagcccacagcaca

SEQ ID NO: 2887728 - RNA, 21 nt, Human
acaagcgugagccacugcacc

SEQ ID NO: 2887729 - RNA, 20 nt, Human
acaagcgugagccacugcac

SEQ ID NO: 2887730 - RNA, 18 nt, Human
acaagcgugagccacugc

SEQ ID NO: 2887731 - RNA, 22 nt, Human
acaagcuaauugggaguccagg

SEQ ID NO: 2887732 - RNA, 23 nt, Human
acaagcuaauugggaguccaggc

SEQ ID NO: 2887733 - RNA, 17 nt, Human
uagcacauaaacuuugg

SEQ ID NO: 2887734 - RNA, 18 nt, Human
uagcacauaaacuuuggg

SEQ ID NO: 2887735 - RNA, 15 nt, Human
uagcacaugcuucaa

SEQ ID NO: 2887736 - RNA, 16 nt, Human
uagcacaugcuucaau

SEQ ID NO: 2887737 - RNA, 19 nt, Human
uagcacaugcuucaauagu

SEQ ID NO: 2887738 - RNA, 16 nt, Human
uagcaccagggaaggg

SEQ ID NO: 2887739 - RNA, 14 nt, Human
uagcacagauuuua

SEQ ID NO: 2887740 - RNA, 15 nt, Human
uagcacagauuuuaa

SEQ ID NO: 2887741 - RNA, 16 nt, Human
uagcacagauuuuaau

SEQ ID NO: 2887742 - RNA, 18 nt, Human
uagcacagauuuuaauug

SEQ ID NO: 2887743 - RNA, 19 nt, Human
uagcacagauuuuaauugu

SEQ ID NO: 2887744 - RNA, 22 nt, Human
uagcacagauuuuaauugucau

SEQ ID NO: 2887745 - RNA, 23 nt, Human
uagcacagauuuuaauugucaug

SEQ ID NO: 2887746 - RNA, 14 nt, Human
uagcaccagggaag

SEQ ID NO: 2887747 - RNA, 13 nt, Human
uagcaccagggaa

SEQ ID NO: 2887748 - RNA, 16 nt, Human
uagauuuuauuuuacu

SEQ ID NO: 2887749 - RNA, 17 nt, Human
uagauuuuauuuuacua

SEQ ID NO: 2887750 - RNA, 14 nt, Human
uagauuuucauguu

SEQ ID NO: 2887751 - RNA, 17 nt, Human
uagauuuucauguucuu

SEQ ID NO: 2887752 - RNA, 14 nt, Human
uagauuuucugguu

SEQ ID NO: 2887753 - RNA, 17 nt, Human
uagauuuucugguucua

SEQ ID NO: 2887754 - RNA, 19 nt, Human
uagauuuucugguucuaac

SEQ ID NO: 2887755 - RNA, 21 nt, Human
uagauuuucugguucuaacau

SEQ ID NO: 2887756 - RNA, 22 nt, Human
uagauuuucugguucuaacauu

SEQ ID NO: 2887757 - RNA, 21 nt, Human
uagaucauaaggcuucaaaau

SEQ ID NO: 2887758 - RNA, 14 nt, Human
uagaucauaaggcu

SEQ ID NO: 2887759 - RNA, 15 nt, Human
uagaucauaaggcuu

SEQ ID NO: 2887760 - RNA, 18 nt, Human
uagaucagaugcuccaag

SEQ ID NO: 2887761 - RNA, 19 nt, Human
uagaucagaugcuccaaga

SEQ ID NO: 2887762 - RNA, 20 nt, Human
uagaucagaugcuccaagau

SEQ ID NO: 2887763 - RNA, 23 nt, Human
uagaucagaugcuccaagauucu

SEQ ID NO: 2887764 - RNA, 12 nt, Human
uagauauuuggc

SEQ ID NO: 2887765 - RNA, 13 nt, Human
uagauauuuggcu

SEQ ID NO: 2887766 - RNA, 14 nt, Human
uagauauuuggcuu

SEQ ID NO: 2887767 - RNA, 17 nt, Human
uagauauuuggcuuaaa

SEQ ID NO: 2887768 - RNA, 18 nt, Human
uagauauuuggcuuaaau

SEQ ID NO: 2887769 - RNA, 19 nt, Human
uagauauuuggcuuaaaua

SEQ ID NO: 2887770 - RNA, 21 nt, Human
uagauauuuggcuuaaauaua

SEQ ID NO: 2887771 - RNA, 12 nt, Human
uagauauuuuca

SEQ ID NO: 2887772 - RNA, 15 nt, Human
uagauauuuucacaa

SEQ ID NO: 2887773 - RNA, 20 nt, Human
uagauauuuucacaauguca

SEQ ID NO: 2887774 - RNA, 24 nt, Human
uagauauuuucacaaugucaguau

SEQ ID NO: 2887775 - RNA, 14 nt, Human
uagaucagaugcuc

SEQ ID NO: 2887776 - RNA, 14 nt, Human
acaaaaagaaaaga

SEQ ID NO: 2887777 - RNA, 15 nt, Human
acaaaaagacaaaca

SEQ ID NO: 2887778 - RNA, 18 nt, Human
acaaaaagaaaagaaaau

SEQ ID NO: 2887779 - RNA, 12 nt, Human
uagagcagccca

SEQ ID NO: 2887780 - RNA, 14 nt, Human
uagagcagcccaaa

SEQ ID NO: 2887781 - RNA, 11 nt, Human
uagagcaggcg

SEQ ID NO: 2887782 - RNA, 20 nt, Human
uagagcaggcguucagcuca

SEQ ID NO: 2887783 - RNA, 22 nt, Human
uagagcaggcguucagcucacu

SEQ ID NO: 2887784 - RNA, 13 nt, Human
uagagccagcuug

SEQ ID NO: 2887785 - RNA, 23 nt, Human
uagagcugacacaaaccugccug

SEQ ID NO: 2887786 - RNA, 17 nt, Human
uagagcaguuucugucc

SEQ ID NO: 2887787 - RNA, 22 nt, Human
uagagcaguuucuguccugcug

SEQ ID NO: 2887788 - RNA, 19 nt, Human
uagagcauugaauuggaga

SEQ ID NO: 2887789 - RNA, 17 nt, Human
uagagcuguucaacauc

SEQ ID NO: 2887790 - RNA, 22 nt, Human
uagagcuguucaacaucacuga

SEQ ID NO: 2887791 - RNA, 15 nt, Human
uagagcuucuggcac

SEQ ID NO: 2887792 - RNA, 18 nt, Human
aauuuuuauuuucacccu

SEQ ID NO: 2887793 - RNA, 20 nt, Human
uauuuauuuuccuaaagaga

SEQ ID NO: 2887794 - RNA, 16 nt, Human
uauuuauuuuccuaaa

SEQ ID NO: 2887795 - RNA, 14 nt, Human
uauuuauuuauuua

SEQ ID NO: 2887796 - RNA, 21 nt, Human
uauuuauuuuccuaaagagag

SEQ ID NO: 2887797 - RNA, 20 nt, Human
uauuuauuuuuuuuaaguau

SEQ ID NO: 2887798 - RNA, 13 nt, Human
uauuuauuuucuu

SEQ ID NO: 2887799 - RNA, 21 nt, Human
uauuuauuuucuuuugaauug

SEQ ID NO: 2887800 - RNA, 12 nt, Human
uauuuauuuugu

SEQ ID NO: 2887801 - RNA, 13 nt, Human
uauuuauuuugua

SEQ ID NO: 2887802 - RNA, 14 nt, Human
uauuuauuuuguaa

SEQ ID NO: 2887803 - RNA, 15 nt, Human
uauuuauuuuguaau

SEQ ID NO: 2887804 - RNA, 16 nt, Human
uauuuauuuuguaauu

SEQ ID NO: 2887805 - RNA, 19 nt, Human
uauuuauuuuguaauuaug

SEQ ID NO: 2887806 - RNA, 20 nt, Human
uauuuauuuuguaauuauga

SEQ ID NO: 2887807 - RNA, 18 nt, Human
uauuuauuuuuacaagaa

SEQ ID NO: 2887808 - RNA, 16 nt, Human
uauuucacuugaugau

SEQ ID NO: 2887809 - RNA, 22 nt, Human
uauuucacacgcuguucuaaug

SEQ ID NO: 2887810 - RNA, 20 nt, Human
uauuucacaaauaauaggug

SEQ ID NO: 2887811 - RNA, 14 nt, Human
uauuuagugcugca

SEQ ID NO: 2887812 - RNA, 20 nt, Human
uauuuagugcugcaucuuau

SEQ ID NO: 2887813 - RNA, 15 nt, Human
uauuuaguuauaguu

SEQ ID NO: 2887814 - RNA, 17 nt, Human
uauuuaguuauaguuuc

SEQ ID NO: 2887815 - RNA, 15 nt, Human
uauuuaggaaguguu

SEQ ID NO: 2887816 - RNA, 22 nt, Human
uauuuagauuguuaaaauaacu

SEQ ID NO: 2887817 - RNA, 11 nt, Human
uauuuauuuac

SEQ ID NO: 2887818 - RNA, 12 nt, Human
uauuuauuuaau

SEQ ID NO: 2887819 - RNA, 19 nt, Human
uauuuauuuaaaagauuca

SEQ ID NO: 2887820 - RNA, 16 nt, Human
uauuuauuuaaagcau

SEQ ID NO: 2887821 - RNA, 17 nt, Human
uauuuauuuaaagcauu

SEQ ID NO: 2887822 - RNA, 11 nt, Human
uauuuauuuau

SEQ ID NO: 2887823 - RNA, 18 nt, Human
uauuuauuuauguacuuu

SEQ ID NO: 2887824 - RNA, 14 nt, Human
uauuuauuuaugua

SEQ ID NO: 2887825 - RNA, 13 nt, Human
uauuuauuuaugu

SEQ ID NO: 2887826 - RNA, 21 nt, Human
uauuuauuuaauaacaauugu

SEQ ID NO: 2887827 - RNA, 14 nt, Human
uauuuauuuaguau

SEQ ID NO: 2887828 - RNA, 19 nt, Human
uauuuacgcuuugauucau

SEQ ID NO: 2887829 - RNA, 15 nt, Human
uauuuacgcuuugau

SEQ ID NO: 2887830 - RNA, 22 nt, Human
uauuuacgcuuugauucauagu

SEQ ID NO: 2887831 - RNA, 14 nt, Human
uauuuacgcuuuga

SEQ ID NO: 2887832 - RNA, 14 nt, Human
uauuuacuaccuua

SEQ ID NO: 2887833 - RNA, 17 nt, Human
uauuuaccugcaggcug

SEQ ID NO: 2887834 - RNA, 21 nt, Human
uauuuagacucaucuuacugu

SEQ ID NO: 2887835 - RNA, 18 nt, Human
uauuuagauauaacacua

SEQ ID NO: 2887836 - RNA, 19 nt, Human
uauuuagauuguuaaaaua

SEQ ID NO: 2887837 - RNA, 17 nt, Human
uauuuagauuguuaaaa

SEQ ID NO: 2887838 - RNA, 20 nt, Human
uauuuagcaccagggaaggg

SEQ ID NO: 2887839 - RNA, 23 nt, Human
uauuuaauuuuuuugagacagag

SEQ ID NO: 2887840 - RNA, 19 nt, Human
uauuuaaugauaaguaaau

SEQ ID NO: 2887841 - RNA, 21 nt, Human
uauuuaaugccgauauacucu

SEQ ID NO: 2887842 - RNA, 17 nt, Human
uauuuaaugcauuaaac

SEQ ID NO: 2887843 - RNA, 21 nt, Human
uauuuaaugcauuaaaccugu

SEQ ID NO: 2887844 - RNA, 22 nt, Human
uauuuaaugcauuaaaccuguc

SEQ ID NO: 2887845 - RNA, 12 nt, Human
uauuuaauguuu

SEQ ID NO: 2887846 - RNA, 13 nt, Human
uauuuaauguuuu

SEQ ID NO: 2887847 - RNA, 15 nt, Human
uauuuaauguuuuaa

SEQ ID NO: 2887848 - RNA, 16 nt, Human
uauuuaauguuuuaaa

SEQ ID NO: 2887849 - RNA, 17 nt, Human
uauuuaauguuuuaaau

SEQ ID NO: 2887850 - RNA, 18 nt, Human
uauuuaauguuuuaaaug

SEQ ID NO: 2887851 - RNA, 20 nt, Human
uauuuaauguuuuaaaugua

SEQ ID NO: 2887852 - RNA, 21 nt, Human
uauuuaauguuuuaaauguac

SEQ ID NO: 2887853 - RNA, 22 nt, Human
uauuuaauguuuuaaauguaca

SEQ ID NO: 2887854 - RNA, 14 nt, Human
uauuuaauuauuaa

SEQ ID NO: 2887855 - RNA, 23 nt, Human
uauuuaauuauuaacuacauuua

SEQ ID NO: 2887856 - RNA, 14 nt, Human
uauugugaacauuu

SEQ ID NO: 2887857 - RNA, 13 nt, Human
uauugugaaugau

SEQ ID NO: 2887858 - RNA, 15 nt, Human
uauuuaacuggugca

SEQ ID NO: 2887859 - RNA, 16 nt, Human
uauuuaacuggugcac

SEQ ID NO: 2887860 - RNA, 22 nt, Human
uauuuaacuggugcacuuugua

SEQ ID NO: 2887861 - RNA, 23 nt, Human
uauuuaacuggugcacuuuguaa

SEQ ID NO: 2887862 - RNA, 15 nt, Human
uauuuaacauuauuu

SEQ ID NO: 2887863 - RNA, 12 nt, Human
uauuuaagcaaa

SEQ ID NO: 2887864 - RNA, 13 nt, Human
uauuuaagcaaau

SEQ ID NO: 2887865 - RNA, 14 nt, Human
uauuuaagcaaaua

SEQ ID NO: 2887866 - RNA, 16 nt, Human
uauuuaagcaaauacu

SEQ ID NO: 2887867 - RNA, 17 nt, Human
uauuuaagcaaauacuu

SEQ ID NO: 2887868 - RNA, 17 nt, Human
uauuuaagcaacaucuu

SEQ ID NO: 2887869 - RNA, 18 nt, Human
uauuuaagcaacaucuuu

SEQ ID NO: 2887870 - RNA, 20 nt, Human
uauuuaagcaacaucuuuuu

SEQ ID NO: 2887871 - RNA, 21 nt, Human
uauuuaagcaacaucuuuuua

SEQ ID NO: 2887872 - RNA, 18 nt, Human
uauuuaagguagcuucag

SEQ ID NO: 2887873 - RNA, 21 nt, Human
uauuuaagguagcuucagcua

SEQ ID NO: 2887874 - RNA, 18 nt, Human
uauuuaagccucauauuu

SEQ ID NO: 2887875 - RNA, 20 nt, Human
uauuuaagccucauauuuaa

SEQ ID NO: 2887876 - RNA, 21 nt, Human
uauuuaagccucauauuuaaa

SEQ ID NO: 2887877 - RNA, 10 nt, Human
uauuuaauaa

SEQ ID NO: 2887878 - RNA, 11 nt, Human
uauuuaauaac

SEQ ID NO: 2887879 - RNA, 17 nt, Human
uauuuaauaacaauugu

SEQ ID NO: 2887880 - RNA, 15 nt, Human
uauuuaauaacauua

SEQ ID NO: 2887881 - RNA, 13 nt, Human
uauuuaauaacau

SEQ ID NO: 2887882 - RNA, 14 nt, Human
uauuuaauaacauu

SEQ ID NO: 2887883 - RNA, 11 nt, Human
uauuguacaua

SEQ ID NO: 2887884 - RNA, 13 nt, Human
uauuguacauaaa

SEQ ID NO: 2887885 - RNA, 14 nt, Human
uauuguacauaaaa

SEQ ID NO: 2887886 - RNA, 15 nt, Human
uauuguacauaaaag

SEQ ID NO: 2887887 - RNA, 16 nt, Human
uauuguacauaaaaga

SEQ ID NO: 2887888 - RNA, 17 nt, Human
uauuguacauaaaagaa

SEQ ID NO: 2887889 - RNA, 22 nt, Human
uauuguacauaaaagaauuuuu

SEQ ID NO: 2887890 - RNA, 20 nt, Human
uauuguacagcuguuuaaga

SEQ ID NO: 2887891 - RNA, 16 nt, Human
uauuguauaaacuauc

SEQ ID NO: 2887892 - RNA, 21 nt, Human
uauuguauaaacuaucaguuu

SEQ ID NO: 2887893 - RNA, 20 nt, Human
acaguucaauucucauuugu

SEQ ID NO: 2887894 - RNA, 20 nt, Human
acaguucaagaaagcuucaa

SEQ ID NO: 2887895 - RNA, 21 nt, Human
acaguucaauaaacuuaacuu

SEQ ID NO: 2887896 - RNA, 23 nt, Human
acaguucaauaaacuuaacuuua

SEQ ID NO: 2887897 - RNA, 12 nt, Human
acaguucaagaa

SEQ ID NO: 2887898 - RNA, 14 nt, Human
acaguuauuuauag

SEQ ID NO: 2887899 - RNA, 18 nt, Human
acaguuauuuauagucau

SEQ ID NO: 2887900 - RNA, 23 nt, Human
acaguuauuuauagucauuuauu

SEQ ID NO: 2887901 - RNA, 15 nt, Human
acaguuauuuugaua

SEQ ID NO: 2887902 - RNA, 20 nt, Human
acaguucauguuugcuucau

SEQ ID NO: 2887903 - RNA, 16 nt, Human
acaguucaagaaagcu

SEQ ID NO: 2887904 - RNA, 14 nt, Human
acaguucacacccu

SEQ ID NO: 2887905 - RNA, 15 nt, Human
acaguucacacccug

SEQ ID NO: 2887906 - RNA, 17 nt, Human
acaguucacacccugca

SEQ ID NO: 2887907 - RNA, 18 nt, Human
acaguucacacccugcaa

SEQ ID NO: 2887908 - RNA, 19 nt, Human
acaguucacacccugcaag

SEQ ID NO: 2887909 - RNA, 20 nt, Human
acaguucacacccugcaagg

SEQ ID NO: 2887910 - RNA, 23 nt, Human
acaguuagcaaacuuuguauguc

SEQ ID NO: 2887911 - RNA, 13 nt, Human
acaguucugucau

SEQ ID NO: 2887912 - RNA, 13 nt, Human
acaguuccuucag

SEQ ID NO: 2887913 - RNA, 13 nt, Human
acaguucugaaga

SEQ ID NO: 2887914 - RNA, 15 nt, Human
acaguucugaagaau

SEQ ID NO: 2887915 - RNA, 16 nt, Human
uauucuguuggccagu

SEQ ID NO: 2887916 - RNA, 22 nt, Human
uauucuuaagggaacuuccaca

SEQ ID NO: 2887917 - RNA, 15 nt, Human
uauucuuauaaaaau

SEQ ID NO: 2887918 - RNA, 21 nt, Human
uauucuguguugcauuauuca

SEQ ID NO: 2887919 - RNA, 22 nt, Human
uauucuguguugcauuauucau

SEQ ID NO: 2887920 - RNA, 15 nt, Human
uauucuguuggaagc

SEQ ID NO: 2887921 - RNA, 13 nt, Human
uauucuuaaaaug

SEQ ID NO: 2887922 - RNA, 15 nt, Human
uauucuuaaaaugca

SEQ ID NO: 2887923 - RNA, 17 nt, Human
uauucuuaaaaugcaau

SEQ ID NO: 2887924 - RNA, 18 nt, Human
uauucuuaaaaugcaaua

SEQ ID NO: 2887925 - RNA, 19 nt, Human
uauucuuaaaaugcaauau

SEQ ID NO: 2887926 - RNA, 21 nt, Human
uauucuuaaaaugcaauauuu

SEQ ID NO: 2887927 - RNA, 17 nt, Human
uauucuucuagaguuca

SEQ ID NO: 2887928 - RNA, 18 nt, Human
uauucuucuagaguucag

SEQ ID NO: 2887929 - RNA, 15 nt, Human
uauucuucauauccu

SEQ ID NO: 2887930 - RNA, 13 nt, Human
uauucuucuagag

SEQ ID NO: 2887931 - RNA, 14 nt, Human
uauucuucuagagu

SEQ ID NO: 2887932 - RNA, 17 nt, Human
uauucugagaaaacaag

SEQ ID NO: 2887933 - RNA, 14 nt, Human
uauucucuuuuauc

SEQ ID NO: 2887934 - RNA, 18 nt, Human
uauucucuuuuaucuguu

SEQ ID NO: 2887935 - RNA, 15 nt, Human
uauucugagaaaaca

SEQ ID NO: 2887936 - RNA, 16 nt, Human
uauucugaagcaacau

SEQ ID NO: 2887937 - RNA, 23 nt, Human
uauucugagcauacucaacaaaa

SEQ ID NO: 2887938 - RNA, 12 nt, Human
uauucuggaguu

SEQ ID NO: 2887939 - RNA, 19 nt, Human
uauucuguagauucugugg

SEQ ID NO: 2887940 - RNA, 22 nt, Human
uauucuguagauucuguggaac

SEQ ID NO: 2887941 - RNA, 16 nt, Human
uauuggggucugaccc

SEQ ID NO: 2887942 - RNA, 17 nt, Human
uauuggggucugacccc

SEQ ID NO: 2887943 - RNA, 13 nt, Human
uauugguggaauc

SEQ ID NO: 2887944 - RNA, 16 nt, Human
uauugguggcuuuccu

SEQ ID NO: 2887945 - RNA, 17 nt, Human
uauugguggcuuuccuu

SEQ ID NO: 2887946 - RNA, 18 nt, Human
uauugguggcuuuccuug

SEQ ID NO: 2887947 - RNA, 18 nt, Human
uauuggugguucucagca

SEQ ID NO: 2887948 - RNA, 15 nt, Human
uauuguaaacaugug

SEQ ID NO: 2887949 - RNA, 16 nt, Human
uauuguaaacaugugu

SEQ ID NO: 2887950 - RNA, 17 nt, Human
uauuguaaacauguguu

SEQ ID NO: 2887951 - RNA, 18 nt, Human
uauuguaaacauguguuu

SEQ ID NO: 2887952 - RNA, 13 nt, Human
uauuguaaauuau

SEQ ID NO: 2887953 - RNA, 17 nt, Human
uauuguaaauuuuagaa

SEQ ID NO: 2887954 - RNA, 14 nt, Human
uauugaguuuguag

SEQ ID NO: 2887955 - RNA, 19 nt, Human
uauugaguuuguagguaaa

SEQ ID NO: 2887956 - RNA, 21 nt, Human
uauugaguuuguagguaaaau

SEQ ID NO: 2887957 - RNA, 14 nt, Human
uauugagucaaaug

SEQ ID NO: 2887958 - RNA, 15 nt, Human
uauugaggcuuugug

SEQ ID NO: 2887959 - RNA, 16 nt, Human
uauugaggcuuugugu

SEQ ID NO: 2887960 - RNA, 19 nt, Human
uauugaggcuuuguguugu

SEQ ID NO: 2887961 - RNA, 20 nt, Human
uauugaggcuuuguguugua

SEQ ID NO: 2887962 - RNA, 23 nt, Human
uauugaggcuuuguguuguaauu

SEQ ID NO: 2887963 - RNA, 17 nt, Human
uauugagauuguccuca

SEQ ID NO: 2887964 - RNA, 14 nt, Human
uauugagauuucuu

SEQ ID NO: 2887965 - RNA, 15 nt, Human
uauugagauuucuua

SEQ ID NO: 2887966 - RNA, 18 nt, Human
uauugagauuucuuaaau

SEQ ID NO: 2887967 - RNA, 19 nt, Human
uauugagauuucuuaaaua

SEQ ID NO: 2887968 - RNA, 19 nt, Human
uauugacuucaaugauagu

SEQ ID NO: 2887969 - RNA, 23 nt, Human
uauugacacagaaaauguugaga

SEQ ID NO: 2887970 - RNA, 14 nt, Human
uauugacauuugua

SEQ ID NO: 2887971 - RNA, 15 nt, Human
uauugacauuuguag

SEQ ID NO: 2887972 - RNA, 16 nt, Human
uauugacauuuguagu

SEQ ID NO: 2887973 - RNA, 17 nt, Human
uauugacauuuguaguu

SEQ ID NO: 2887974 - RNA, 20 nt, Human
uauugacacagaaaauguug

SEQ ID NO: 2887975 - RNA, 18 nt, Human
uauugacacagaaaaugu

SEQ ID NO: 2887976 - RNA, 16 nt, Human
uauugacacagaaaau

SEQ ID NO: 2887977 - RNA, 13 nt, Human
uauugacacagaa

SEQ ID NO: 2887978 - RNA, 15 nt, Human
uauugaauugagaug

SEQ ID NO: 2887979 - RNA, 18 nt, Human
uauugacaauaauuucag

SEQ ID NO: 2887980 - RNA, 17 nt, Human
uauugacaauaauuuca

SEQ ID NO: 2887981 - RNA, 13 nt, Human
uauugacaauaau

SEQ ID NO: 2887982 - RNA, 16 nt, Human
uauugaaucuauuuaa

SEQ ID NO: 2887983 - RNA, 17 nt, Human
uauugaaucuauuuaag

SEQ ID NO: 2887984 - RNA, 12 nt, Human
uauugaauguuu

SEQ ID NO: 2887985 - RNA, 11 nt, Human
uauugaaucua

SEQ ID NO: 2887986 - RNA, 20 nt, Human
uauugaaucaguuuccaauu

SEQ ID NO: 2887987 - RNA, 22 nt, Human
uauugaauauaauauauuugug

SEQ ID NO: 2887988 - RNA, 13 nt, Human
uauugaauauugu

SEQ ID NO: 2887989 - RNA, 14 nt, Human
uauugaauauugug

SEQ ID NO: 2887990 - RNA, 15 nt, Human
uauugaauauugugu

SEQ ID NO: 2887991 - RNA, 20 nt, Human
uauugaauauaauauauuug

SEQ ID NO: 2887992 - RNA, 21 nt, Human
uauugaauauaauauauuugu

SEQ ID NO: 2887993 - RNA, 20 nt, Human
uauugaaggaagccaaauuu

SEQ ID NO: 2887994 - RNA, 21 nt, Human
uauugaaggaagccaaauuua

SEQ ID NO: 2887995 - RNA, 22 nt, Human
uauugaaggaagccaaauuuau

SEQ ID NO: 2887996 - RNA, 16 nt, Human
uauugaaguuucagcu

SEQ ID NO: 2887997 - RNA, 17 nt, Human
uauugaauacuuacauu

SEQ ID NO: 2887998 - RNA, 20 nt, Human
uauugaauacuuacauucuc

SEQ ID NO: 2887999 - RNA, 12 nt, Human
uauucuuuucca

SEQ ID NO: 2888000 - RNA, 13 nt, Human
uauugaacuuuuu

SEQ ID NO: 2888001 - RNA, 14 nt, Human
uauugaacuuuuuu

SEQ ID NO: 2888002 - RNA, 13 nt, Human
uauugaagaaaca

SEQ ID NO: 2888003 - RNA, 14 nt, Human
uauugaagaaacag

SEQ ID NO: 2888004 - RNA, 22 nt, Human
uauugaagaaacagauaccaua

SEQ ID NO: 2888005 - RNA, 14 nt, Human
uauugaagacaauu

SEQ ID NO: 2888006 - RNA, 17 nt, Human
uauugaagacaauuuga

SEQ ID NO: 2888007 - RNA, 20 nt, Human
uauugaagacaauuugauac

SEQ ID NO: 2888008 - RNA, 21 nt, Human
uauugaagacaauuugauaca

SEQ ID NO: 2888009 - RNA, 22 nt, Human
uauugaagacaauuugauacau

SEQ ID NO: 2888010 - RNA, 18 nt, Human
uauucuuuucugcaaaau

SEQ ID NO: 2888011 - RNA, 13 nt, Human
uauucuuuuucca

SEQ ID NO: 2888012 - RNA, 18 nt, Human
uauugaacuuggaaagaa

SEQ ID NO: 2888013 - RNA, 20 nt, Human
uauugaaauuguacauauuu

SEQ ID NO: 2888014 - RNA, 14 nt, Human
uauugaaaaaaaua

SEQ ID NO: 2888015 - RNA, 14 nt, Human
uauucuugaaagaa

SEQ ID NO: 2888016 - RNA, 15 nt, Human
uauucuugaaagaag

SEQ ID NO: 2888017 - RNA, 18 nt, Human
uauucuugaaagaagaau

SEQ ID NO: 2888018 - RNA, 23 nt, Human
uauucuugaaagaagaauguguu

SEQ ID NO: 2888019 - RNA, 13 nt, Human
uauucuugugcuu

SEQ ID NO: 2888020 - RNA, 21 nt, Human
uauucuuucaauucuguaggu

SEQ ID NO: 2888021 - RNA, 16 nt, Human
uauucauauuggaaaa

SEQ ID NO: 2888022 - RNA, 17 nt, Human
uauucauauuggaaaaa

SEQ ID NO: 2888023 - RNA, 16 nt, Human
uauucaggagaguaga

SEQ ID NO: 2888024 - RNA, 14 nt, Human
uauuauaaacugua

SEQ ID NO: 2888025 - RNA, 17 nt, Human
uauucagagaauaucaa

SEQ ID NO: 2888026 - RNA, 19 nt, Human
uauuauaacaagugugucu

SEQ ID NO: 2888027 - RNA, 14 nt, Human
uauucaaccaugga

SEQ ID NO: 2888028 - RNA, 16 nt, Human
uauucaaccauggacu

SEQ ID NO: 2888029 - RNA, 17 nt, Human
uauucaaccauggacuu

SEQ ID NO: 2888030 - RNA, 20 nt, Human
uauucaaguuauuguacagc

SEQ ID NO: 2888031 - RNA, 16 nt, Human
uauucaaguuauugua

SEQ ID NO: 2888032 - RNA, 21 nt, Human
uauucacugaaguucuccuga

SEQ ID NO: 2888033 - RNA, 12 nt, Human
uauucacugggc

SEQ ID NO: 2888034 - RNA, 14 nt, Human
uauucacugggcca

SEQ ID NO: 2888035 - RNA, 12 nt, Human
uauucagaauau

SEQ ID NO: 2888036 - RNA, 15 nt, Human
uauucagaauauuca

SEQ ID NO: 2888037 - RNA, 16 nt, Human
uauucagaaucuuugu

SEQ ID NO: 2888038 - RNA, 18 nt, Human
uauucagaaucuuuguua

SEQ ID NO: 2888039 - RNA, 15 nt, Human
uauucagaauuauga

SEQ ID NO: 2888040 - RNA, 19 nt, Human
uauucagaauuaugaugga

SEQ ID NO: 2888041 - RNA, 20 nt, Human
uauucagaauuaugauggaa

SEQ ID NO: 2888042 - RNA, 22 nt, Human
uauuacccccuccuucagacac

SEQ ID NO: 2888043 - RNA, 21 nt, Human
uauuacccccuccuucagaca

SEQ ID NO: 2888044 - RNA, 22 nt, Human
uauuacccaagaaguaaagaug

SEQ ID NO: 2888045 - RNA, 13 nt, Human
uauuaccagcaag

SEQ ID NO: 2888046 - RNA, 16 nt, Human
uauuaccagcaagaau

SEQ ID NO: 2888047 - RNA, 19 nt, Human
uauuaccagcaagaauaaa

SEQ ID NO: 2888048 - RNA, 20 nt, Human
uauuaccagcaagaauaaaa

SEQ ID NO: 2888049 - RNA, 21 nt, Human
uauuaccagcaagaauaaaaa

SEQ ID NO: 2888050 - RNA, 22 nt, Human
uauuaccaguggcguuguugca

SEQ ID NO: 2888051 - RNA, 16 nt, Human
uauuagagcauugaau

SEQ ID NO: 2888052 - RNA, 17 nt, Human
uauuaccuaaugaaagu

SEQ ID NO: 2888053 - RNA, 11 nt, Human
uauuagaugaa

SEQ ID NO: 2888054 - RNA, 12 nt, Human
uauuagaugaau

SEQ ID NO: 2888055 - RNA, 14 nt, Human
uauuagaugaauua

SEQ ID NO: 2888056 - RNA, 23 nt, Human
uauuagccaggaucaugguguaa

SEQ ID NO: 2888057 - RNA, 13 nt, Human
uauuagccaggau

SEQ ID NO: 2888058 - RNA, 17 nt, Human
uauuagccaggaucaug

SEQ ID NO: 2888059 - RNA, 18 nt, Human
uauuagccaggaucaugg

SEQ ID NO: 2888060 - RNA, 19 nt, Human
uauuagccaggaucauggu

SEQ ID NO: 2888061 - RNA, 13 nt, Human
uauuaguuaauau

SEQ ID NO: 2888062 - RNA, 19 nt, Human
uauuaguuaauggauuaaa

SEQ ID NO: 2888063 - RNA, 22 nt, Human
uauuagugguuuaucagcaaaa

SEQ ID NO: 2888064 - RNA, 21 nt, Human
uauuagugaccucagcuuuga

SEQ ID NO: 2888065 - RNA, 14 nt, Human
uauuagugauauuu

SEQ ID NO: 2888066 - RNA, 18 nt, Human
uauuagugauauuucucu

SEQ ID NO: 2888067 - RNA, 19 nt, Human
uauuagugauauuucucua

SEQ ID NO: 2888068 - RNA, 20 nt, Human
uauuagugauauuucucuag

SEQ ID NO: 2888069 - RNA, 21 nt, Human
uauuagugauauuucucuagu

SEQ ID NO: 2888070 - RNA, 13 nt, Human
uauuauaaauaua

SEQ ID NO: 2888071 - RNA, 15 nt, Human
uauuauaaauauaua

SEQ ID NO: 2888072 - RNA, 20 nt, Human
uauuauaaauauauauaaag

SEQ ID NO: 2888073 - RNA, 22 nt, Human
uauuauaaauauauauaaagaa

SEQ ID NO: 2888074 - RNA, 23 nt, Human
uauuauaaauauauauaaagaau

SEQ ID NO: 2888075 - RNA, 24 nt, Human
uauuauaaaaggggguccguggaa

SEQ ID NO: 2888076 - RNA, 22 nt, Human
uauuaguucccugucucuugaa

SEQ ID NO: 2888077 - RNA, 23 nt, Human
uauuaguucccugucucuugaaa

SEQ ID NO: 2888078 - RNA, 12 nt, Human
uauuaguugcuu

SEQ ID NO: 2888079 - RNA, 13 nt, Human
uauuaguugcuuu

SEQ ID NO: 2888080 - RNA, 14 nt, Human
uauuaguugcuuug

SEQ ID NO: 2888081 - RNA, 19 nt, Human
uauuaaaacauuggauuau

SEQ ID NO: 2888082 - RNA, 16 nt, Human
uauuaaaacucagccu

SEQ ID NO: 2888083 - RNA, 22 nt, Human
uauuaaaacucagccugggaca

SEQ ID NO: 2888084 - RNA, 17 nt, Human
uauuaaaacauuggauu

SEQ ID NO: 2888085 - RNA, 18 nt, Human
uauuaaaacauuggauua

SEQ ID NO: 2888086 - RNA, 20 nt, Human
uauuaaaaauauggaacuuc

SEQ ID NO: 2888087 - RNA, 22 nt, Human
uauuaaaaauauggaacuucua

SEQ ID NO: 2888088 - RNA, 12 nt, Human
uauuaaaacauu

SEQ ID NO: 2888089 - RNA, 17 nt, Human
uauuacauauaucauua

SEQ ID NO: 2888090 - RNA, 22 nt, Human
uauuacauaaaggcuaacuaug

SEQ ID NO: 2888091 - RNA, 14 nt, Human
uauuaaagugcuaa

SEQ ID NO: 2888092 - RNA, 18 nt, Human
uauuaaagugcuaagguu

SEQ ID NO: 2888093 - RNA, 14 nt, Human
uauuaaauaaaauc

SEQ ID NO: 2888094 - RNA, 15 nt, Human
uauuaaauaaaauca

SEQ ID NO: 2888095 - RNA, 22 nt, Human
uauuaaagugcuaagguucuaa

SEQ ID NO: 2888096 - RNA, 24 nt, Human
uauuaaagugcuaagguucuaagg

SEQ ID NO: 2888097 - RNA, 16 nt, Human
uauuaaaguggagaag

SEQ ID NO: 2888098 - RNA, 18 nt, Human
acagcuggguggcacugc

SEQ ID NO: 2888099 - RNA, 19 nt, Human
acagcuggguggcacugcc

SEQ ID NO: 2888100 - RNA, 20 nt, Human
acagcuggguggcacugcca

SEQ ID NO: 2888101 - RNA, 23 nt, Human
acagcuggguggcacugccaugc

SEQ ID NO: 2888102 - RNA, 12 nt, Human
acagcuccuccc

SEQ ID NO: 2888103 - RNA, 14 nt, Human
acagcuccccaagu

SEQ ID NO: 2888104 - RNA, 14 nt, Human
acagcucccugcca

SEQ ID NO: 2888105 - RNA, 15 nt, Human
acagcuggagcucuc

SEQ ID NO: 2888106 - RNA, 11 nt, Human
acagcugcugg

SEQ ID NO: 2888107 - RNA, 16 nt, Human
acagcuggguggcacu

SEQ ID NO: 2888108 - RNA, 19 nt, Human
uauguuuuaagaggcaggg

SEQ ID NO: 2888109 - RNA, 17 nt, Human
uauguuuuaagaggcag

SEQ ID NO: 2888110 - RNA, 20 nt, Human
uauguuugucuuuuaaugcu

SEQ ID NO: 2888111 - RNA, 12 nt, Human
uauguuuuacac

SEQ ID NO: 2888112 - RNA, 15 nt, Human
uauguuuuacacugu

SEQ ID NO: 2888113 - RNA, 17 nt, Human
uauguuuuacacuguac

SEQ ID NO: 2888114 - RNA, 22 nt, Human
acaguccugggagaaccucagg

SEQ ID NO: 2888115 - RNA, 21 nt, Human
acaguccugggagaaccucag

SEQ ID NO: 2888116 - RNA, 23 nt, Human
acaguccugggagaaccucaggc

SEQ ID NO: 2888117 - RNA, 18 nt, Human
acaguccuuaaaaaucac

SEQ ID NO: 2888118 - RNA, 15 nt, Human
acagucuugcagcag

SEQ ID NO: 2888119 - RNA, 23 nt, Human
acaguccuucaaaauccuuccaa

SEQ ID NO: 2888120 - RNA, 11 nt, Human
acagucugucu

SEQ ID NO: 2888121 - RNA, 12 nt, Human
acagucugucuu

SEQ ID NO: 2888122 - RNA, 13 nt, Human
acagucugucuuc

SEQ ID NO: 2888123 - RNA, 15 nt, Human
acagucugucuucug

SEQ ID NO: 2888124 - RNA, 16 nt, Human
acagucugucuucugu

SEQ ID NO: 2888125 - RNA, 17 nt, Human
acagucugucuucugua

SEQ ID NO: 2888126 - RNA, 18 nt, Human
acagucugucuucuguau

SEQ ID NO: 2888127 - RNA, 19 nt, Human
acagucugucuucuguaua

SEQ ID NO: 2888128 - RNA, 20 nt, Human
acagucugucuucuguauau

SEQ ID NO: 2888129 - RNA, 23 nt, Human
acagucugucuucuguauauaaa

SEQ ID NO: 2888130 - RNA, 14 nt, Human
acagugacccuucc

SEQ ID NO: 2888131 - RNA, 16 nt, Human
acagugacccuuccca

SEQ ID NO: 2888132 - RNA, 14 nt, Human
acaguguuaaauga

SEQ ID NO: 2888133 - RNA, 14 nt, Human
acagugagccugaa

SEQ ID NO: 2888134 - RNA, 12 nt, Human
acagugagccug

SEQ ID NO: 2888135 - RNA, 20 nt, Human
acaguguuuacacuuuggac

SEQ ID NO: 2888136 - RNA, 21 nt, Human
acaguguugaaaauguucaga

SEQ ID NO: 2888137 - RNA, 19 nt, Human
acaguguugaaaauguuca

SEQ ID NO: 2888138 - RNA, 17 nt, Human
acaguaugucccauagg

SEQ ID NO: 2888139 - RNA, 18 nt, Human
acaguaugcuugcucuaa

SEQ ID NO: 2888140 - RNA, 22 nt, Human
acaguauaucccaagugcacuu

SEQ ID NO: 2888141 - RNA, 21 nt, Human
acaguaucccacauccaacuc

SEQ ID NO: 2888142 - RNA, 15 nt, Human
acaguaucccacauc

SEQ ID NO: 2888143 - RNA, 10 nt, Human
acaguaacuu

SEQ ID NO: 2888144 - RNA, 17 nt, Human
acaguaacgcaggggaa

SEQ ID NO: 2888145 - RNA, 19 nt, Human
acaguaacgcaggggaaac

SEQ ID NO: 2888146 - RNA, 21 nt, Human
acaguaaauaucccaaacugu

SEQ ID NO: 2888147 - RNA, 23 nt, Human
acaguaaauaucccaaacuguga

SEQ ID NO: 2888148 - RNA, 22 nt, Human
acagggcaugccccggccaccu

SEQ ID NO: 2888149 - RNA, 23 nt, Human
acagggcaugccccggccaccuc

SEQ ID NO: 2888150 - RNA, 24 nt, Human
acagggcaugccccggccaccucu

SEQ ID NO: 2888151 - RNA, 17 nt, Human
acaggcugggcuucagu

SEQ ID NO: 2888152 - RNA, 14 nt, Human
acaggcugggcuuc

SEQ ID NO: 2888153 - RNA, 21 nt, Human
acaggcugggcuucaguggca

SEQ ID NO: 2888154 - RNA, 22 nt, Human
acagggcacaccgggcacucag

SEQ ID NO: 2888155 - RNA, 16 nt, Human
acagggcagagccggg

SEQ ID NO: 2888156 - RNA, 18 nt, Human
acaguccuaacugguaua

SEQ ID NO: 2888157 - RNA, 12 nt, Human
acaguccuggga

SEQ ID NO: 2888158 - RNA, 19 nt, Human
acaguccuaacugguauag

SEQ ID NO: 2888159 - RNA, 19 nt, Human
acaguauuacuucugcuac

SEQ ID NO: 2888160 - RNA, 17 nt, Human
acaguauuacuucugcu

SEQ ID NO: 2888161 - RNA, 16 nt, Human
acaguauuacuucugc

SEQ ID NO: 2888162 - RNA, 15 nt, Human
acaguauuacuucug

SEQ ID NO: 2888163 - RNA, 19 nt, Human
acaguaacccaaaccucaa

SEQ ID NO: 2888164 - RNA, 16 nt, Human
acaguauuuauuuugu

SEQ ID NO: 2888165 - RNA, 18 nt, Human
acaguauuuauuuuguaa

SEQ ID NO: 2888166 - RNA, 15 nt, Human
acaguauuucauugc

SEQ ID NO: 2888167 - RNA, 12 nt, Human
acaguauuucca

SEQ ID NO: 2888168 - RNA, 13 nt, Human
acagucaaaauaa

SEQ ID NO: 2888169 - RNA, 14 nt, Human
acagucaaaauaau

SEQ ID NO: 2888170 - RNA, 16 nt, Human
acagucaaaauaauuc

SEQ ID NO: 2888171 - RNA, 19 nt, Human
acagucaaaauaauucuaa

SEQ ID NO: 2888172 - RNA, 15 nt, Human
acagucaacaagccu

SEQ ID NO: 2888173 - RNA, 17 nt, Human
acagucaaccaacccca

SEQ ID NO: 2888174 - RNA, 12 nt, Human
uaucaccuggcu

SEQ ID NO: 2888175 - RNA, 18 nt, Human
uaucaccuggcuuguuua

SEQ ID NO: 2888176 - RNA, 19 nt, Human
uaucaccuggcuuguuuau

SEQ ID NO: 2888177 - RNA, 22 nt, Human
uaucaauaucuaauauauauga

SEQ ID NO: 2888178 - RNA, 18 nt, Human
uaucaauaucuaauauau

SEQ ID NO: 2888179 - RNA, 21 nt, Human
uaucaauaucuaauauauaug

SEQ ID NO: 2888180 - RNA, 17 nt, Human
uaucaauaucuaauaua

SEQ ID NO: 2888181 - RNA, 14 nt, Human
uaucaauaucuaau

SEQ ID NO: 2888182 - RNA, 17 nt, Human
uaucaagucaaucauuu

SEQ ID NO: 2888183 - RNA, 20 nt, Human
uaucaagucaaucauuucuc

SEQ ID NO: 2888184 - RNA, 17 nt, Human
uaucacacuucugugag

SEQ ID NO: 2888185 - RNA, 13 nt, Human
uaucacacuucug

SEQ ID NO: 2888186 - RNA, 20 nt, Human
acagacucaaaugcucagac

SEQ ID NO: 2888187 - RNA, 16 nt, Human
acagacagacacacac

SEQ ID NO: 2888188 - RNA, 22 nt, Human
acagacucgauucauauugaau

SEQ ID NO: 2888189 - RNA, 15 nt, Human
acagacucauccuga

SEQ ID NO: 2888190 - RNA, 18 nt, Human
acagacucauccugaaca

SEQ ID NO: 2888191 - RNA, 23 nt, Human
acagacucauccugaacagcaug

SEQ ID NO: 2888192 - RNA, 14 nt, Human
acagacuggaagca

SEQ ID NO: 2888193 - RNA, 23 nt, Human
acagacugcgauuugucccaggu

SEQ ID NO: 2888194 - RNA, 11 nt, Human
acagacugcaa

SEQ ID NO: 2888195 - RNA, 23 nt, Human
acagacugcaagaggcuccuguc

SEQ ID NO: 2888196 - RNA, 17 nt, Human
uauauugaagacaauuu

SEQ ID NO: 2888197 - RNA, 18 nt, Human
uauauugaagacaauuug

SEQ ID NO: 2888198 - RNA, 20 nt, Human
uauauugaagacaauuugau

SEQ ID NO: 2888199 - RNA, 14 nt, Human
uauauugaaaaaaa

SEQ ID NO: 2888200 - RNA, 18 nt, Human
uauauugaaauuuauuua

SEQ ID NO: 2888201 - RNA, 22 nt, Human
uauauucuggccagacucgaug

SEQ ID NO: 2888202 - RNA, 15 nt, Human
acacuccccgaaguc

SEQ ID NO: 2888203 - RNA, 23 nt, Human
acagacacaggcccggcuccagg

SEQ ID NO: 2888204 - RNA, 23 nt, Human
acacuccuagagaacgcagcccu

SEQ ID NO: 2888205 - RNA, 14 nt, Human
acacuccuagagaa

SEQ ID NO: 2888206 - RNA, 20 nt, Human
acacuccuagagaacgcagc

SEQ ID NO: 2888207 - RNA, 13 nt, Human
acagacagcccuc

SEQ ID NO: 2888208 - RNA, 18 nt, Human
acagagccgagcaauauu

SEQ ID NO: 2888209 - RNA, 17 nt, Human
acagagccucgcucugu

SEQ ID NO: 2888210 - RNA, 24 nt, Human
acagagagggagagcagagaaaga

SEQ ID NO: 2888211 - RNA, 21 nt, Human
acagagagggcaccaucacaa

SEQ ID NO: 2888212 - RNA, 21 nt, Human
acagagugagacucugucuca

SEQ ID NO: 2888213 - RNA, 21 nt, Human
acagagcgagagucugucuca

SEQ ID NO: 2888214 - RNA, 22 nt, Human
acagagcguggcugugcucuca

SEQ ID NO: 2888215 - RNA, 13 nt, Human
acagaguguagcc

SEQ ID NO: 2888216 - RNA, 20 nt, Human
acagaguguagccagguccc

SEQ ID NO: 2888217 - RNA, 16 nt, Human
acagagugcuuuucug

SEQ ID NO: 2888218 - RNA, 22 nt, Human
acagacuggaagcacagcuuca

SEQ ID NO: 2888219 - RNA, 15 nt, Human
acagacuguuaauua

SEQ ID NO: 2888220 - RNA, 21 nt, Human
uaucuccugacagaaggugcc

SEQ ID NO: 2888221 - RNA, 14 nt, Human
uaucuccugacaga

SEQ ID NO: 2888222 - RNA, 13 nt, Human
uaucuccugacag

SEQ ID NO: 2888223 - RNA, 16 nt, Human
uaucuccuagggcuau

SEQ ID NO: 2888224 - RNA, 11 nt, Human
uaucuccugac

SEQ ID NO: 2888225 - RNA, 13 nt, Human
acagacuucugaa

SEQ ID NO: 2888226 - RNA, 14 nt, Human
acagacuucugaaa

SEQ ID NO: 2888227 - RNA, 14 nt, Human
acagagaccuccug

SEQ ID NO: 2888228 - RNA, 11 nt, Human
acagagaccua

SEQ ID NO: 2888229 - RNA, 19 nt, Human
acagagaccucccuguuca

SEQ ID NO: 2888230 - RNA, 17 nt, Human
uaucccaacagucaugu

SEQ ID NO: 2888231 - RNA, 19 nt, Human
uaucccaacagucauguuu

SEQ ID NO: 2888232 - RNA, 22 nt, Human
uauccauauugagucaaauggu

SEQ ID NO: 2888233 - RNA, 23 nt, Human
uaucagaagaccacaaaaauuga

SEQ ID NO: 2888234 - RNA, 15 nt, Human
uaucagaagagaggg

SEQ ID NO: 2888235 - RNA, 16 nt, Human
uaucagaagagagggg

SEQ ID NO: 2888236 - RNA, 14 nt, Human
uaucagaagaccac

SEQ ID NO: 2888237 - RNA, 14 nt, Human
uaucacuuuuugaa

SEQ ID NO: 2888238 - RNA, 15 nt, Human
uaucacuuuuugaac

SEQ ID NO: 2888239 - RNA, 16 nt, Human
uaucacuuuuugaacu

SEQ ID NO: 2888240 - RNA, 17 nt, Human
uaucacuuuuugaacua

SEQ ID NO: 2888241 - RNA, 18 nt, Human
uaucacuuuuugaacuaa

SEQ ID NO: 2888242 - RNA, 20 nt, Human
uaucacuuuuugaacuaaga

SEQ ID NO: 2888243 - RNA, 22 nt, Human
uaucacuuuuugaacuaagaaa

SEQ ID NO: 2888244 - RNA, 22 nt, Human
uauccaugacaggccugaagau

SEQ ID NO: 2888245 - RNA, 16 nt, Human
uauccaugcaccaaac

SEQ ID NO: 2888246 - RNA, 21 nt, Human
uaucagaagaccacaaaaauu

SEQ ID NO: 2888247 - RNA, 15 nt, Human
uauccauguacuugu

SEQ ID NO: 2888248 - RNA, 20 nt, Human
uauccauguacuuguuugca

SEQ ID NO: 2888249 - RNA, 22 nt, Human
uauggcucugcaccccucugcc

SEQ ID NO: 2888250 - RNA, 16 nt, Human
uauggcugcaguccuc

SEQ ID NO: 2888251 - RNA, 15 nt, Human
uaugggagccccagg

SEQ ID NO: 2888252 - RNA, 15 nt, Human
uaugggcauugacaa

SEQ ID NO: 2888253 - RNA, 16 nt, Human
uaugggcauugacaaa

SEQ ID NO: 2888254 - RNA, 16 nt, Human
uaugggagccccaggg

SEQ ID NO: 2888255 - RNA, 16 nt, Human
uaugggagagugucaa

SEQ ID NO: 2888256 - RNA, 22 nt, Human
uaugggagagugucaaccagac

SEQ ID NO: 2888257 - RNA, 14 nt, Human
acagccuggcacag

SEQ ID NO: 2888258 - RNA, 15 nt, Human
acagccuggcacagg

SEQ ID NO: 2888259 - RNA, 18 nt, Human
acagccugggccccagcu

SEQ ID NO: 2888260 - RNA, 15 nt, Human
acagccugggcccca

SEQ ID NO: 2888261 - RNA, 12 nt, Human
acagccugggcc

SEQ ID NO: 2888262 - RNA, 12 nt, Human
acagccuggcac

SEQ ID NO: 2888263 - RNA, 23 nt, Human
uauggggagaggaacuccuuggc

SEQ ID NO: 2888264 - RNA, 19 nt, Human
acagcgaaguagcuugcuc

SEQ ID NO: 2888265 - RNA, 21 nt, Human
acagcucagcuuuuugucuuu

SEQ ID NO: 2888266 - RNA, 20 nt, Human
acagcuaaucagcauucuca

SEQ ID NO: 2888267 - RNA, 19 nt, Human
acagcucaggaggcgcccu

SEQ ID NO: 2888268 - RNA, 14 nt, Human
acagcucaggaggc

SEQ ID NO: 2888269 - RNA, 23 nt, Human
uauggccucagcugccucacuuc

SEQ ID NO: 2888270 - RNA, 19 nt, Human
uauggccucagcugccuca

SEQ ID NO: 2888271 - RNA, 12 nt, Human
uauggccucagc

SEQ ID NO: 2888272 - RNA, 14 nt, Human
uaugcucuuuuguu

SEQ ID NO: 2888273 - RNA, 16 nt, Human
uaugcucuuuuuuacu

SEQ ID NO: 2888274 - RNA, 20 nt, Human
uaugcucuuuuuuacucauu

SEQ ID NO: 2888275 - RNA, 15 nt, Human
uaugaucgcgccacu

SEQ ID NO: 2888276 - RNA, 15 nt, Human
uaugaucccagcacu

SEQ ID NO: 2888277 - RNA, 17 nt, Human
uaugauguaaucucucu

SEQ ID NO: 2888278 - RNA, 22 nt, Human
uaugauguaaucucucugcagc

SEQ ID NO: 2888279 - RNA, 13 nt, Human
uaugaucaguguu

SEQ ID NO: 2888280 - RNA, 14 nt, Human
uaugaucaguguug

SEQ ID NO: 2888281 - RNA, 17 nt, Human
uaugaucaguguuguug

SEQ ID NO: 2888282 - RNA, 15 nt, Human
uaugaucuguuuugu

SEQ ID NO: 2888283 - RNA, 20 nt, Human
uaugaucuguuuuguaucuu

SEQ ID NO: 2888284 - RNA, 22 nt, Human
uaugaucuugaguauaagaaau

SEQ ID NO: 2888285 - RNA, 21 nt, Human
uaugaugaaaaccuacauauu

SEQ ID NO: 2888286 - RNA, 21 nt, Human
uaugaugacucccuuaaaaua

SEQ ID NO: 2888287 - RNA, 15 nt, Human
uaugauguguuguga

SEQ ID NO: 2888288 - RNA, 17 nt, Human
uaugauguguugugaua

SEQ ID NO: 2888289 - RNA, 18 nt, Human
uaugauguguugugauag

SEQ ID NO: 2888290 - RNA, 21 nt, Human
uaugauggaagacaggaaagu

SEQ ID NO: 2888291 - RNA, 22 nt, Human
uaugaugauacaagauuagaag

SEQ ID NO: 2888292 - RNA, 22 nt, Human
uaugaugaugaaaauuuuacca

SEQ ID NO: 2888293 - RNA, 15 nt, Human
uaugauaauagauuc

SEQ ID NO: 2888294 - RNA, 23 nt, Human
uaugaucacggcucacugcagcc

SEQ ID NO: 2888295 - RNA, 21 nt, Human
uaugaucacggcucacugcag

SEQ ID NO: 2888296 - RNA, 14 nt, Human
uaugaucacggcuc

SEQ ID NO: 2888297 - RNA, 23 nt, Human
uaugaguuuuugauagcuuuauu

SEQ ID NO: 2888298 - RNA, 22 nt, Human
uaugaguuuuugauagcuuuau

SEQ ID NO: 2888299 - RNA, 21 nt, Human
uaugaguuuuugauagcuuua

SEQ ID NO: 2888300 - RNA, 14 nt, Human
uaugaguauacaau

SEQ ID NO: 2888301 - RNA, 15 nt, Human
uaugaguauacaaua

SEQ ID NO: 2888302 - RNA, 16 nt, Human
uaugaguauacaauau

SEQ ID NO: 2888303 - RNA, 20 nt, Human
uaugaguauacaauauauaa

SEQ ID NO: 2888304 - RNA, 23 nt, Human
uaugaguauacaauauauaaaaa

SEQ ID NO: 2888305 - RNA, 18 nt, Human
uaugaguaacuauuauua

SEQ ID NO: 2888306 - RNA, 16 nt, Human
uaugaguacaaaugcc

SEQ ID NO: 2888307 - RNA, 17 nt, Human
uaugaguacaaaugccu

SEQ ID NO: 2888308 - RNA, 20 nt, Human
uaugaguacaaaugccuuaa

SEQ ID NO: 2888309 - RNA, 15 nt, Human
uaugagggaaaauga

SEQ ID NO: 2888310 - RNA, 16 nt, Human
uaugagucuagauguu

SEQ ID NO: 2888311 - RNA, 18 nt, Human
uaugaguggaaaaagcca

SEQ ID NO: 2888312 - RNA, 14 nt, Human
uaugagucuagaug

SEQ ID NO: 2888313 - RNA, 18 nt, Human
uaugagcuuccuucugug

SEQ ID NO: 2888314 - RNA, 19 nt, Human
uaugaggcaaccugauugu

SEQ ID NO: 2888315 - RNA, 22 nt, Human
uaugaggcaaccugauuguaaa

SEQ ID NO: 2888316 - RNA, 21 nt, Human
uaugagcuuccuucugugaaa

SEQ ID NO: 2888317 - RNA, 15 nt, Human
uaugagcuuccaagg

SEQ ID NO: 2888318 - RNA, 22 nt, Human
uaucuugaggugguaguaaaac

SEQ ID NO: 2888319 - RNA, 18 nt, Human
uaugagcuugcucauuaa

SEQ ID NO: 2888320 - RNA, 17 nt, Human
uaugaggaauaauuauu

SEQ ID NO: 2888321 - RNA, 23 nt, Human
uaugaggacuugugucucugugc

SEQ ID NO: 2888322 - RNA, 13 nt, Human
uaugaggaaaggu

SEQ ID NO: 2888323 - RNA, 17 nt, Human
uaugaggacuugugucu

SEQ ID NO: 2888324 - RNA, 11 nt, Human
acagcagccug

SEQ ID NO: 2888325 - RNA, 13 nt, Human
acagcagccugcu

SEQ ID NO: 2888326 - RNA, 18 nt, Human
acagcagccugcuuccca

SEQ ID NO: 2888327 - RNA, 19 nt, Human
acagcagccugcuucccac

SEQ ID NO: 2888328 - RNA, 22 nt, Human
acagauaacauuagguuguccu

SEQ ID NO: 2888329 - RNA, 15 nt, Human
acagcagccuccaac

SEQ ID NO: 2888330 - RNA, 18 nt, Human
acagcagccccugcacaa

SEQ ID NO: 2888331 - RNA, 12 nt, Human
acagcagcuuca

SEQ ID NO: 2888332 - RNA, 22 nt, Human
acagcagcuucaccagagcauu

SEQ ID NO: 2888333 - RNA, 12 nt, Human
acagcaggcagc

SEQ ID NO: 2888334 - RNA, 16 nt, Human
acagcaggcagcgcca

SEQ ID NO: 2888335 - RNA, 13 nt, Human
acagcagcuucac

SEQ ID NO: 2888336 - RNA, 16 nt, Human
acagcagcuucaccag

SEQ ID NO: 2888337 - RNA, 17 nt, Human
acagcagcuucaccaga

SEQ ID NO: 2888338 - RNA, 18 nt, Human
acagcagcuucaccagag

SEQ ID NO: 2888339 - RNA, 18 nt, Human
acagaguuuucacucuua

SEQ ID NO: 2888340 - RNA, 18 nt, Human
acagaguguggacucugg

SEQ ID NO: 2888341 - RNA, 20 nt, Human
acagaguuuucacucuuauu

SEQ ID NO: 2888342 - RNA, 13 nt, Human
acagauaaaaagu

SEQ ID NO: 2888343 - RNA, 22 nt, Human
acagauaaaaaguggaauuucu

SEQ ID NO: 2888344 - RNA, 23 nt, Human
acagccuccucugucugcccuuc

SEQ ID NO: 2888345 - RNA, 12 nt, Human
acagccucuauc

SEQ ID NO: 2888346 - RNA, 12 nt, Human
acagccucugac

SEQ ID NO: 2888347 - RNA, 16 nt, Human
acagccucugaccccu

SEQ ID NO: 2888348 - RNA, 16 nt, Human
acagccccagagcagg

SEQ ID NO: 2888349 - RNA, 12 nt, Human
acagccuccucu

SEQ ID NO: 2888350 - RNA, 13 nt, Human
acagccuccucug

SEQ ID NO: 2888351 - RNA, 15 nt, Human
acagccuccucuguc

SEQ ID NO: 2888352 - RNA, 17 nt, Human
acagccuccucugucug

SEQ ID NO: 2888353 - RNA, 19 nt, Human
acagccuccucugucugcc

SEQ ID NO: 2888354 - RNA, 20 nt, Human
acagccuccucugucugccc

SEQ ID NO: 2888355 - RNA, 22 nt, Human
acagccuccucugucugcccuu

SEQ ID NO: 2888356 - RNA, 16 nt, Human
acagccucccaccccc

SEQ ID NO: 2888357 - RNA, 15 nt, Human
acagccucccacccc

SEQ ID NO: 2888358 - RNA, 13 nt, Human
acagccccagagc

SEQ ID NO: 2888359 - RNA, 14 nt, Human
acagccccagagca

SEQ ID NO: 2888360 - RNA, 15 nt, Human
acagccccagagcag

SEQ ID NO: 2888361 - RNA, 14 nt, Human
acagccucacuugg

SEQ ID NO: 2888362 - RNA, 22 nt, Human
acagccucacuuggucugccag

SEQ ID NO: 2888363 - RNA, 23 nt, Human
acagccucacuuggucugccagg

SEQ ID NO: 2888364 - RNA, 20 nt, Human
uauagccuaggugacagagu

SEQ ID NO: 2888365 - RNA, 16 nt, Human
uauagcaaaacuuuua

SEQ ID NO: 2888366 - RNA, 19 nt, Human
uauagcaaaacuuuuaaac

SEQ ID NO: 2888367 - RNA, 20 nt, Human
uauagcaaaacuuuuaaacu

SEQ ID NO: 2888368 - RNA, 21 nt, Human
uauagcaaaacuuuuaaacua

SEQ ID NO: 2888369 - RNA, 22 nt, Human
uauagcaaaacuuuuaaacuac

SEQ ID NO: 2888370 - RNA, 23 nt, Human
uauagcaaaacuuuuaaacuaca

SEQ ID NO: 2888371 - RNA, 20 nt, Human
uauagccuauggcagaaaaa

SEQ ID NO: 2888372 - RNA, 19 nt, Human
uauagccuauggcagaaaa

SEQ ID NO: 2888373 - RNA, 21 nt, Human
uauagccuauggcagaaaaaa

SEQ ID NO: 2888374 - RNA, 14 nt, Human
uauagcuaaguaca

SEQ ID NO: 2888375 - RNA, 22 nt, Human
uauagcuacaggaagcacccca

SEQ ID NO: 2888376 - RNA, 16 nt, Human
uauagcuacaggaagc

SEQ ID NO: 2888377 - RNA, 11 nt, Human
uauagcuauua

SEQ ID NO: 2888378 - RNA, 14 nt, Human
uauagcuauuacug

SEQ ID NO: 2888379 - RNA, 22 nt, Human
uauagcuauuacugucugguuu

SEQ ID NO: 2888380 - RNA, 15 nt, Human
uauagguugugcaaa

SEQ ID NO: 2888381 - RNA, 22 nt, Human
uauagguugugcaaauuaacag

SEQ ID NO: 2888382 - RNA, 10 nt, Human
uauauauaaa

SEQ ID NO: 2888383 - RNA, 15 nt, Human
uauauauaagaaaga

SEQ ID NO: 2888384 - RNA, 21 nt, Human
uauagguguugguuuuggggg

SEQ ID NO: 2888385 - RNA, 12 nt, Human
uauauauaaaga

SEQ ID NO: 2888386 - RNA, 14 nt, Human
uauauauaaagaau

SEQ ID NO: 2888387 - RNA, 13 nt, Human
uauauauaaagua

SEQ ID NO: 2888388 - RNA, 15 nt, Human
uauauauaaaguaua

SEQ ID NO: 2888389 - RNA, 14 nt, Human
uauauauacauaug

SEQ ID NO: 2888390 - RNA, 15 nt, Human
uauauauacauaugu

SEQ ID NO: 2888391 - RNA, 16 nt, Human
uauauauacauaugua

SEQ ID NO: 2888392 - RNA, 18 nt, Human
uauauauacauauguaga

SEQ ID NO: 2888393 - RNA, 15 nt, Human
uauauauagaaauau

SEQ ID NO: 2888394 - RNA, 13 nt, Human
uauauauagaauc

SEQ ID NO: 2888395 - RNA, 12 nt, Human
uauauauagaau

SEQ ID NO: 2888396 - RNA, 12 nt, Human
uauauauacaua

SEQ ID NO: 2888397 - RNA, 14 nt, Human
uauauauacauaca

SEQ ID NO: 2888398 - RNA, 22 nt, Human
uauauauacauacacuuguaua

SEQ ID NO: 2888399 - RNA, 13 nt, Human
uauauauacauau

SEQ ID NO: 2888400 - RNA, 15 nt, Human
uauauauacacacac

SEQ ID NO: 2888401 - RNA, 16 nt, Human
uauauauacacacaca

SEQ ID NO: 2888402 - RNA, 13 nt, Human
uauauauacagua

SEQ ID NO: 2888403 - RNA, 11 nt, Human
uauauauacau

SEQ ID NO: 2888404 - RNA, 21 nt, Human
acacuccagugccagcaauga

SEQ ID NO: 2888405 - RNA, 16 nt, Human
acacucccacccaguc

SEQ ID NO: 2888406 - RNA, 22 nt, Human
acacucccacccagucucugcu

SEQ ID NO: 2888407 - RNA, 14 nt, Human
acacuccagugcca

SEQ ID NO: 2888408 - RNA, 16 nt, Human
acacuccagugccagc

SEQ ID NO: 2888409 - RNA, 19 nt, Human
acacuccagugccagcaau

SEQ ID NO: 2888410 - RNA, 16 nt, Human
uauauccuuucuaaca

SEQ ID NO: 2888411 - RNA, 14 nt, Human
uauauccugugacu

SEQ ID NO: 2888412 - RNA, 15 nt, Human
uauauccugugacug

SEQ ID NO: 2888413 - RNA, 17 nt, Human
uauauccugugacuguc

SEQ ID NO: 2888414 - RNA, 18 nt, Human
uauauccugugacugucu

SEQ ID NO: 2888415 - RNA, 14 nt, Human
uauaucccagaaau

SEQ ID NO: 2888416 - RNA, 14 nt, Human
uauauccccugcua

SEQ ID NO: 2888417 - RNA, 20 nt, Human
uauaucaugcuuuaaagugu

SEQ ID NO: 2888418 - RNA, 18 nt, Human
uauaucauguaaagaaau

SEQ ID NO: 2888419 - RNA, 19 nt, Human
uauaucauguaaagaaaug

SEQ ID NO: 2888420 - RNA, 13 nt, Human
uauaucaguuuga

SEQ ID NO: 2888421 - RNA, 14 nt, Human
uauaucaguuugau

SEQ ID NO: 2888422 - RNA, 14 nt, Human
uauaucauauguau

SEQ ID NO: 2888423 - RNA, 15 nt, Human
uauaucauauguaua

SEQ ID NO: 2888424 - RNA, 15 nt, Human
uauaucaaaguauuu

SEQ ID NO: 2888425 - RNA, 22 nt, Human
uauaucauuggaacaacugaua

SEQ ID NO: 2888426 - RNA, 22 nt, Human
uauauaucauauugguauucac

SEQ ID NO: 2888427 - RNA, 13 nt, Human
uauauaucaguuu

SEQ ID NO: 2888428 - RNA, 14 nt, Human
uauauaucaguuug

SEQ ID NO: 2888429 - RNA, 15 nt, Human
uauauaucaguuuga

SEQ ID NO: 2888430 - RNA, 16 nt, Human
uauauaucaguuugau

SEQ ID NO: 2888431 - RNA, 17 nt, Human
uauauaucaguuugauc

SEQ ID NO: 2888432 - RNA, 18 nt, Human
uauaucagaaaagggaag

SEQ ID NO: 2888433 - RNA, 22 nt, Human
uauaucaacagauaguuguguu

SEQ ID NO: 2888434 - RNA, 13 nt, Human
uauaucagaaaag

SEQ ID NO: 2888435 - RNA, 15 nt, Human
uauauauauauacuu

SEQ ID NO: 2888436 - RNA, 15 nt, Human
uauauauauauaaag

SEQ ID NO: 2888437 - RNA, 13 nt, Human
uauauauauauaa

SEQ ID NO: 2888438 - RNA, 14 nt, Human
uauauauauauaaa

SEQ ID NO: 2888439 - RNA, 14 nt, Human
uauauauauauaua

SEQ ID NO: 2888440 - RNA, 15 nt, Human
uauauauauauauaa

SEQ ID NO: 2888441 - RNA, 15 nt, Human
uauauauauaucagu

SEQ ID NO: 2888442 - RNA, 15 nt, Human
uauauauauaauaua

SEQ ID NO: 2888443 - RNA, 15 nt, Human
uauauauauacacac

SEQ ID NO: 2888444 - RNA, 11 nt, Human
uauauauauau

SEQ ID NO: 2888445 - RNA, 14 nt, Human
uauauauauaaagu

SEQ ID NO: 2888446 - RNA, 14 nt, Human
uauauauauaaaua

SEQ ID NO: 2888447 - RNA, 11 nt, Human
uauauauauaa

SEQ ID NO: 2888448 - RNA, 12 nt, Human
uauauauauaaa

SEQ ID NO: 2888449 - RNA, 19 nt, Human
uauauauagugcuauauau

SEQ ID NO: 2888450 - RNA, 11 nt, Human
uauauauauca

SEQ ID NO: 2888451 - RNA, 13 nt, Human
uauauauaucagu

SEQ ID NO: 2888452 - RNA, 23 nt, Human
acaccucaguucccuuggccuca

SEQ ID NO: 2888453 - RNA, 22 nt, Human
acaccucaguucccuuggccuc

SEQ ID NO: 2888454 - RNA, 14 nt, Human
uauaacagauacau

SEQ ID NO: 2888455 - RNA, 16 nt, Human
uauaacagauacauuu

SEQ ID NO: 2888456 - RNA, 20 nt, Human
uauaacagauacauuucccu

SEQ ID NO: 2888457 - RNA, 17 nt, Human
uauaacauauguacaua

SEQ ID NO: 2888458 - RNA, 11 nt, Human
uauaacaugaa

SEQ ID NO: 2888459 - RNA, 14 nt, Human
uauaacaugaaaug

SEQ ID NO: 2888460 - RNA, 15 nt, Human
uauaacaugaaauga

SEQ ID NO: 2888461 - RNA, 20 nt, Human
uauaaccacaaagcacaguu

SEQ ID NO: 2888462 - RNA, 21 nt, Human
acaccuagcuuuauucuucag

SEQ ID NO: 2888463 - RNA, 18 nt, Human
acaccuagcuuuauucuu

SEQ ID NO: 2888464 - RNA, 22 nt, Human
acaccuagcuuuauucuucaga

SEQ ID NO: 2888465 - RNA, 17 nt, Human
acaccucacaccucacu

SEQ ID NO: 2888466 - RNA, 19 nt, Human
acaccucacaccucacucu

SEQ ID NO: 2888467 - RNA, 21 nt, Human
acaccucaguucccuuggccu

SEQ ID NO: 2888468 - RNA, 18 nt, Human
acaccucaguucccuugg

SEQ ID NO: 2888469 - RNA, 16 nt, Human
acaccucacucuuuau

SEQ ID NO: 2888470 - RNA, 18 nt, Human
acaccucacucuuuauag

SEQ ID NO: 2888471 - RNA, 16 nt, Human
uauaauuuucugaaag

SEQ ID NO: 2888472 - RNA, 19 nt, Human
uauaauuuucugaaaguua

SEQ ID NO: 2888473 - RNA, 16 nt, Human
uauaagcccacuguua

SEQ ID NO: 2888474 - RNA, 20 nt, Human
uauaagccaguguugccuaa

SEQ ID NO: 2888475 - RNA, 21 nt, Human
uauaagccaguguugccuaag

SEQ ID NO: 2888476 - RNA, 18 nt, Human
uauaagcauugaaauuau

SEQ ID NO: 2888477 - RNA, 19 nt, Human
uauaagcauugaaauuaua

SEQ ID NO: 2888478 - RNA, 17 nt, Human
uauaagaaaugcauaug

SEQ ID NO: 2888479 - RNA, 12 nt, Human
uauaagacucuc

SEQ ID NO: 2888480 - RNA, 16 nt, Human
uauaagagcaugaaau

SEQ ID NO: 2888481 - RNA, 14 nt, Human
uauaagauccuaga

SEQ ID NO: 2888482 - RNA, 18 nt, Human
uauaagauccuagauccu

SEQ ID NO: 2888483 - RNA, 19 nt, Human
uauaagauccuagauccua

SEQ ID NO: 2888484 - RNA, 21 nt, Human
uauaagauccuagauccuaag

SEQ ID NO: 2888485 - RNA, 15 nt, Human
uauaagcaaauuuca

SEQ ID NO: 2888486 - RNA, 22 nt, Human
uauaagcaaauuucaaaagaca

SEQ ID NO: 2888487 - RNA, 23 nt, Human
uauaagcaaauuucaaaagacau

SEQ ID NO: 2888488 - RNA, 15 nt, Human
uauaagcacugaaaa

SEQ ID NO: 2888489 - RNA, 18 nt, Human
uauaagcacugaaaaaca

SEQ ID NO: 2888490 - RNA, 12 nt, Human
uauagauucuaa

SEQ ID NO: 2888491 - RNA, 14 nt, Human
uauaccauuuccuc

SEQ ID NO: 2888492 - RNA, 18 nt, Human
uauaccauuuccucagcu

SEQ ID NO: 2888493 - RNA, 13 nt, Human
uauagauucuaaa

SEQ ID NO: 2888494 - RNA, 14 nt, Human
uauagauucuaaag

SEQ ID NO: 2888495 - RNA, 15 nt, Human
uauagauucuaaaga

SEQ ID NO: 2888496 - RNA, 17 nt, Human
uauagauucuaaagauu

SEQ ID NO: 2888497 - RNA, 22 nt, Human
uauacaguaacuuuauguguaa

SEQ ID NO: 2888498 - RNA, 16 nt, Human
uauacaguucaauaaa

SEQ ID NO: 2888499 - RNA, 20 nt, Human
uauacaguucaauaaacuua

SEQ ID NO: 2888500 - RNA, 16 nt, Human
uauacauuaguaaaug

SEQ ID NO: 2888501 - RNA, 19 nt, Human
uauacauuaguaaaugucu

SEQ ID NO: 2888502 - RNA, 20 nt, Human
uauacauuaguaaaugucuu

SEQ ID NO: 2888503 - RNA, 23 nt, Human
uauacauuaguaaaugucuuugu

SEQ ID NO: 2888504 - RNA, 15 nt, Human
uauacacauauaccu

SEQ ID NO: 2888505 - RNA, 17 nt, Human
uauacacauauaccuau

SEQ ID NO: 2888506 - RNA, 21 nt, Human
uauacaccauauacuguucuu

SEQ ID NO: 2888507 - RNA, 14 nt, Human
uauacagugauaua

SEQ ID NO: 2888508 - RNA, 20 nt, Human
uauacaguaacuuuaugugu

SEQ ID NO: 2888509 - RNA, 21 nt, Human
uauacaguaacuuuaugugua

SEQ ID NO: 2888510 - RNA, 16 nt, Human
uauacaguaacuuuau

SEQ ID NO: 2888511 - RNA, 18 nt, Human
uauacaguaacuuuaugu

SEQ ID NO: 2888512 - RNA, 19 nt, Human
uauacaguaacuuuaugug

SEQ ID NO: 2888513 - RNA, 16 nt, Human
uauaauuucgagauuu

SEQ ID NO: 2888514 - RNA, 20 nt, Human
uauaauuucgagauuuguag

SEQ ID NO: 2888515 - RNA, 21 nt, Human
uauaauuucgagauuuguagg

SEQ ID NO: 2888516 - RNA, 13 nt, Human
uauacacacacac

SEQ ID NO: 2888517 - RNA, 14 nt, Human
uauacacacacaca

SEQ ID NO: 2888518 - RNA, 15 nt, Human
uauacacacacacac

SEQ ID NO: 2888519 - RNA, 21 nt, Human
uauacaacccuggcauuaugu

SEQ ID NO: 2888520 - RNA, 11 nt, Human
uauacacacac

SEQ ID NO: 2888521 - RNA, 12 nt, Human
uauacacacaca

SEQ ID NO: 2888522 - RNA, 22 nt, Human
uauacaacccuggcauuauguc

SEQ ID NO: 2888523 - RNA, 15 nt, Human
uauacaauaacauaa

SEQ ID NO: 2888524 - RNA, 13 nt, Human
uauacaauaaugg

SEQ ID NO: 2888525 - RNA, 15 nt, Human
uauacaauaauggaa

SEQ ID NO: 2888526 - RNA, 20 nt, Human
uauacaauaauggaaaaaaa

SEQ ID NO: 2888527 - RNA, 13 nt, Human
uauacaauauaua

SEQ ID NO: 2888528 - RNA, 14 nt, Human
uauacaauauauaa

SEQ ID NO: 2888529 - RNA, 15 nt, Human
uauacaauauauaaa

SEQ ID NO: 2888530 - RNA, 18 nt, Human
uauacaauauauaaaaau

SEQ ID NO: 2888531 - RNA, 19 nt, Human
uauacaauauauaaaaaua

SEQ ID NO: 2888532 - RNA, 22 nt, Human
uaguucucuugguguuaaaaca

SEQ ID NO: 2888533 - RNA, 16 nt, Human
uaguucuaggcacugu

SEQ ID NO: 2888534 - RNA, 15 nt, Human
uaguucguagcuuuc

SEQ ID NO: 2888535 - RNA, 13 nt, Human
uaguucuaagacu

SEQ ID NO: 2888536 - RNA, 14 nt, Human
uaguucuaagacuc

SEQ ID NO: 2888537 - RNA, 15 nt, Human
uaguucuaagacuca

SEQ ID NO: 2888538 - RNA, 11 nt, Human
uaguucuagac

SEQ ID NO: 2888539 - RNA, 12 nt, Human
uaguucuagaca

SEQ ID NO: 2888540 - RNA, 23 nt, Human
uaguucuagacauggagguucua

SEQ ID NO: 2888541 - RNA, 15 nt, Human
uaguucuaggcacug

SEQ ID NO: 2888542 - RNA, 14 nt, Human
uagugaucacagca

SEQ ID NO: 2888543 - RNA, 15 nt, Human
uagugaucacagcag

SEQ ID NO: 2888544 - RNA, 20 nt, Human
uagugaucacagcagcuucu

SEQ ID NO: 2888545 - RNA, 18 nt, Human
uagugagcagugagcaga

SEQ ID NO: 2888546 - RNA, 13 nt, Human
uagugagcccaga

SEQ ID NO: 2888547 - RNA, 12 nt, Human
uagugauauuuc

SEQ ID NO: 2888548 - RNA, 17 nt, Human
uagugauauuucucuag

SEQ ID NO: 2888549 - RNA, 15 nt, Human
uaguuauaguuucag

SEQ ID NO: 2888550 - RNA, 16 nt, Human
uaguucccucugcuca

SEQ ID NO: 2888551 - RNA, 18 nt, Human
uaguucccucugcucagc

SEQ ID NO: 2888552 - RNA, 19 nt, Human
uaguucccucugcucagcc

SEQ ID NO: 2888553 - RNA, 20 nt, Human
uaguucccucugcucagcca

SEQ ID NO: 2888554 - RNA, 14 nt, Human
uaguuccuaagaag

SEQ ID NO: 2888555 - RNA, 16 nt, Human
uaguuccuaagaagcu

SEQ ID NO: 2888556 - RNA, 19 nt, Human
uaguuccuaagaagcuucu

SEQ ID NO: 2888557 - RNA, 21 nt, Human
uaguuccuaagaagcuucuaa

SEQ ID NO: 2888558 - RNA, 20 nt, Human
uaguuaggauagcauuuuug

SEQ ID NO: 2888559 - RNA, 21 nt, Human
uaguuaggaugcucaguugcu

SEQ ID NO: 2888560 - RNA, 23 nt, Human
uaguuaggaaauaaaaccuuuca

SEQ ID NO: 2888561 - RNA, 15 nt, Human
uaguuaggauagcau

SEQ ID NO: 2888562 - RNA, 22 nt, Human
uaguuaggaaauaaaaccuuuc

SEQ ID NO: 2888563 - RNA, 21 nt, Human
uaguuaggaaauaaaaccuuu

SEQ ID NO: 2888564 - RNA, 18 nt, Human
uaguuaggaaauaaaacc

SEQ ID NO: 2888565 - RNA, 16 nt, Human
uaguuaggaaauaaaa

SEQ ID NO: 2888566 - RNA, 18 nt, Human
uagucugugugaagguga

SEQ ID NO: 2888567 - RNA, 12 nt, Human
uagucucuuuau

SEQ ID NO: 2888568 - RNA, 13 nt, Human
uagucucuuuauu

SEQ ID NO: 2888569 - RNA, 15 nt, Human
uagucucuuuauucc

SEQ ID NO: 2888570 - RNA, 18 nt, Human
uagucucuuuauuccuag

SEQ ID NO: 2888571 - RNA, 19 nt, Human
uagucucuuuauuccuagu

SEQ ID NO: 2888572 - RNA, 12 nt, Human
uagucugcucac

SEQ ID NO: 2888573 - RNA, 21 nt, Human
uaguccaaaaagcuccugggg

SEQ ID NO: 2888574 - RNA, 13 nt, Human
uaguccaaaauua

SEQ ID NO: 2888575 - RNA, 19 nt, Human
uagucagcuagaucauuug

SEQ ID NO: 2888576 - RNA, 11 nt, Human
uagucucaguu

SEQ ID NO: 2888577 - RNA, 19 nt, Human
uagucucaguuuguguguc

SEQ ID NO: 2888578 - RNA, 22 nt, Human
uagucucaguuugugugucuua

SEQ ID NO: 2888579 - RNA, 18 nt, Human
uagucauuccaaauauga

SEQ ID NO: 2888580 - RNA, 13 nt, Human
uagucauuuacua

SEQ ID NO: 2888581 - RNA, 14 nt, Human
uagucauuuacuaa

SEQ ID NO: 2888582 - RNA, 18 nt, Human
uagucauuuacuaaacau

SEQ ID NO: 2888583 - RNA, 19 nt, Human
uagucauuuacuaaacaua

SEQ ID NO: 2888584 - RNA, 13 nt, Human
uagucauuuauuu

SEQ ID NO: 2888585 - RNA, 19 nt, Human
uagucauuuauuuuaaaaa

SEQ ID NO: 2888586 - RNA, 14 nt, Human
acaaggacacgcgc

SEQ ID NO: 2888587 - RNA, 22 nt, Human
acaaggacacgcgccccccucc

SEQ ID NO: 2888588 - RNA, 17 nt, Human
acaaggaaggugguggg

SEQ ID NO: 2888589 - RNA, 22 nt, Human
acaaggaaauacccuucuuuua

SEQ ID NO: 2888590 - RNA, 20 nt, Human
acacaucccuaaugugugcc

SEQ ID NO: 2888591 - RNA, 16 nt, Human
acacauccgccuuuug

SEQ ID NO: 2888592 - RNA, 18 nt, Human
acacauccgccuuuugua

SEQ ID NO: 2888593 - RNA, 19 nt, Human
acacauccgccuuuuguau

SEQ ID NO: 2888594 - RNA, 21 nt, Human
acacauccgccuuuuguauac

SEQ ID NO: 2888595 - RNA, 22 nt, Human
acacauccgccuuuuguauaca

SEQ ID NO: 2888596 - RNA, 23 nt, Human
acacauccgccuuuuguauacau

SEQ ID NO: 2888597 - RNA, 14 nt, Human
acacauccacccca

SEQ ID NO: 2888598 - RNA, 17 nt, Human
acacauccagacaucau

SEQ ID NO: 2888599 - RNA, 20 nt, Human
acacauccagacaucaugaa

SEQ ID NO: 2888600 - RNA, 15 nt, Human
acacaucccagccca

SEQ ID NO: 2888601 - RNA, 16 nt, Human
acacaucccagcccaa

SEQ ID NO: 2888602 - RNA, 11 nt, Human
uauaaaauaau

SEQ ID NO: 2888603 - RNA, 12 nt, Human
uauaaaauaaug

SEQ ID NO: 2888604 - RNA, 17 nt, Human
acacaucccuaaugugu

SEQ ID NO: 2888605 - RNA, 19 nt, Human
acacaucccuaaugugugc

SEQ ID NO: 2888606 - RNA, 21 nt, Human
uaguuuuauuuuauguuuaga

SEQ ID NO: 2888607 - RNA, 13 nt, Human
uaguuuucuuguu

SEQ ID NO: 2888608 - RNA, 13 nt, Human
acacaucuuuccu

SEQ ID NO: 2888609 - RNA, 21 nt, Human
acacccagcccacuucugcca

SEQ ID NO: 2888610 - RNA, 20 nt, Human
acacccagcccacuucugcc

SEQ ID NO: 2888611 - RNA, 19 nt, Human
acacccagcccacuucugc

SEQ ID NO: 2888612 - RNA, 21 nt, Human
acaccaggcuugccugcaggc

SEQ ID NO: 2888613 - RNA, 17 nt, Human
acaccagucacaugacc

SEQ ID NO: 2888614 - RNA, 15 nt, Human
acaccuagcaucuca

SEQ ID NO: 2888615 - RNA, 21 nt, Human
acaccuacucuaucagagaaa

SEQ ID NO: 2888616 - RNA, 21 nt, Human
acaccuaaagguguauuuaaa

SEQ ID NO: 2888617 - RNA, 22 nt, Human
acaccuaaagguguauuuaaac

SEQ ID NO: 2888618 - RNA, 13 nt, Human
acacccuguacug

SEQ ID NO: 2888619 - RNA, 16 nt, Human
acaccgggccuggaga

SEQ ID NO: 2888620 - RNA, 22 nt, Human
acacccuguacuguucuguguc

SEQ ID NO: 2888621 - RNA, 19 nt, Human
acaccgggguggugggaac

SEQ ID NO: 2888622 - RNA, 14 nt, Human
uccucaaacaacac

SEQ ID NO: 2888623 - RNA, 23 nt, Human
acucuuaucucagucaugcauaa

SEQ ID NO: 2888624 - RNA, 14 nt, Human
uccucaaacacugc

SEQ ID NO: 2888625 - RNA, 15 nt, Human
uccucaaacacugca

SEQ ID NO: 2888626 - RNA, 19 nt, Human
acucuuauugcccacgcug

SEQ ID NO: 2888627 - RNA, 16 nt, Human
acucuuauugcccacg

SEQ ID NO: 2888628 - RNA, 16 nt, Human
uccucaaacacugcag

SEQ ID NO: 2888629 - RNA, 20 nt, Human
uccucacaacauggugucug

SEQ ID NO: 2888630 - RNA, 19 nt, Human
uccucacacacccugaggu

SEQ ID NO: 2888631 - RNA, 15 nt, Human
uccucacacuuacug

SEQ ID NO: 2888632 - RNA, 16 nt, Human
uccucacacuuacugu

SEQ ID NO: 2888633 - RNA, 23 nt, Human
uccucacacuuacuguaagacau

SEQ ID NO: 2888634 - RNA, 14 nt, Human
uccucacaguccca

SEQ ID NO: 2888635 - RNA, 19 nt, Human
uccucacagucccacugug

SEQ ID NO: 2888636 - RNA, 12 nt, Human
uccucacauagc

SEQ ID NO: 2888637 - RNA, 19 nt, Human
uccucagaucauccagaag

SEQ ID NO: 2888638 - RNA, 13 nt, Human
uccucagaugcuc

SEQ ID NO: 2888639 - RNA, 19 nt, Human
uccucagcauuucuuuucu

SEQ ID NO: 2888640 - RNA, 20 nt, Human
uccucagagaauuucuacca

SEQ ID NO: 2888641 - RNA, 17 nt, Human
uccucagagaauuucua

SEQ ID NO: 2888642 - RNA, 15 nt, Human
uccucacugcccgca

SEQ ID NO: 2888643 - RNA, 19 nt, Human
uccucacugcccuccccag

SEQ ID NO: 2888644 - RNA, 13 nt, Human
uccucacugcucc

SEQ ID NO: 2888645 - RNA, 15 nt, Human
uccucacugcucccu

SEQ ID NO: 2888646 - RNA, 17 nt, Human
uccucacugcucccuga

SEQ ID NO: 2888647 - RNA, 20 nt, Human
uccucacugcucccugaagc

SEQ ID NO: 2888648 - RNA, 21 nt, Human
uccucacugcucccugaagcc

SEQ ID NO: 2888649 - RNA, 22 nt, Human
uccucacuggccaucccucgug

SEQ ID NO: 2888650 - RNA, 23 nt, Human
uccucacugcucccugaagccag

SEQ ID NO: 2888651 - RNA, 13 nt, Human
uccucacuggcca

SEQ ID NO: 2888652 - RNA, 17 nt, Human
uccucacuggccauccc

SEQ ID NO: 2888653 - RNA, 18 nt, Human
uccucacuggccaucccu

SEQ ID NO: 2888654 - RNA, 17 nt, Human
uccucaccccuguccuc

SEQ ID NO: 2888655 - RNA, 19 nt, Human
uccucaccccuguccucac

SEQ ID NO: 2888656 - RNA, 12 nt, Human
uccucaccccug

SEQ ID NO: 2888657 - RNA, 13 nt, Human
uccucaccccugu

SEQ ID NO: 2888658 - RNA, 14 nt, Human
uccucaccccuguc

SEQ ID NO: 2888659 - RNA, 15 nt, Human
uccucaccccugucc

SEQ ID NO: 2888660 - RNA, 14 nt, Human
uccucaccacaugc

SEQ ID NO: 2888661 - RNA, 20 nt, Human
uccucacccccagcuuugcu

SEQ ID NO: 2888662 - RNA, 16 nt, Human
uccucacccccagcuu

SEQ ID NO: 2888663 - RNA, 13 nt, Human
uccucacccccag

SEQ ID NO: 2888664 - RNA, 12 nt, Human
uccucuccccag

SEQ ID NO: 2888665 - RNA, 15 nt, Human
uccucuccacugccu

SEQ ID NO: 2888666 - RNA, 12 nt, Human
uccucuccacug

SEQ ID NO: 2888667 - RNA, 14 nt, Human
uccucucaguguuu

SEQ ID NO: 2888668 - RNA, 13 nt, Human
uccucuccacugc

SEQ ID NO: 2888669 - RNA, 14 nt, Human
uccucuccacugcc

SEQ ID NO: 2888670 - RNA, 22 nt, Human
uccucacugugguaaaugccac

SEQ ID NO: 2888671 - RNA, 16 nt, Human
uccucaguccauuuau

SEQ ID NO: 2888672 - RNA, 18 nt, Human
uccucaguccauuuauau

SEQ ID NO: 2888673 - RNA, 19 nt, Human
uccucaguccauuuauaua

SEQ ID NO: 2888674 - RNA, 21 nt, Human
uccucaguccauuuauauaug

SEQ ID NO: 2888675 - RNA, 23 nt, Human
uccucaguccauuuauauaugaa

SEQ ID NO: 2888676 - RNA, 16 nt, Human
uccuccccuccuccug

SEQ ID NO: 2888677 - RNA, 20 nt, Human
uccuccccuccuccuggacu

SEQ ID NO: 2888678 - RNA, 18 nt, Human
uccuccccuccuccugga

SEQ ID NO: 2888679 - RNA, 22 nt, Human
uccuccccuccuccuggacucc

SEQ ID NO: 2888680 - RNA, 13 nt, Human
acucuccaucuua

SEQ ID NO: 2888681 - RNA, 12 nt, Human
acucuccccaca

SEQ ID NO: 2888682 - RNA, 11 nt, Human
acucuccccac

SEQ ID NO: 2888683 - RNA, 10 nt, Human
acucucccca

SEQ ID NO: 2888684 - RNA, 15 nt, Human
acucuccccacacua

SEQ ID NO: 2888685 - RNA, 14 nt, Human
acucuccccacacu

SEQ ID NO: 2888686 - RNA, 22 nt, Human
acucggcuuuggagacuuucuu

SEQ ID NO: 2888687 - RNA, 16 nt, Human
acucgggaggcugagg

SEQ ID NO: 2888688 - RNA, 20 nt, Human
acucgggaggcugaggcaca

SEQ ID NO: 2888689 - RNA, 21 nt, Human
acucgggaggcugaggcacaa

SEQ ID NO: 2888690 - RNA, 20 nt, Human
acucgcuucccccauagcca

SEQ ID NO: 2888691 - RNA, 16 nt, Human
acucggcacccugcaa

SEQ ID NO: 2888692 - RNA, 19 nt, Human
uccuagggaaggguggugg

SEQ ID NO: 2888693 - RNA, 22 nt, Human
uccuaggcuccaccccauccag

SEQ ID NO: 2888694 - RNA, 13 nt, Human
uccuaggccacac

SEQ ID NO: 2888695 - RNA, 17 nt, Human
uccuagcacaugcuuca

SEQ ID NO: 2888696 - RNA, 19 nt, Human
uccuagcacaugcuucaau

SEQ ID NO: 2888697 - RNA, 20 nt, Human
uccuaggcuccaccccaucc

SEQ ID NO: 2888698 - RNA, 15 nt, Human
acucgcuucccccau

SEQ ID NO: 2888699 - RNA, 12 nt, Human
acucgcuucccc

SEQ ID NO: 2888700 - RNA, 17 nt, Human
acucgcuugcuagaagu

SEQ ID NO: 2888701 - RNA, 12 nt, Human
acucgcuuguaa

SEQ ID NO: 2888702 - RNA, 13 nt, Human
acucgcuuguaaa

SEQ ID NO: 2888703 - RNA, 14 nt, Human
acucgcuuguaaau

SEQ ID NO: 2888704 - RNA, 15 nt, Human
acucgcuuguaaaua

SEQ ID NO: 2888705 - RNA, 17 nt, Human
acucgcuuguaaauacc

SEQ ID NO: 2888706 - RNA, 18 nt, Human
acucgcuuguaaauacca

SEQ ID NO: 2888707 - RNA, 20 nt, Human
acucugaaacacacugaaag

SEQ ID NO: 2888708 - RNA, 13 nt, Human
acucucuucccuu

SEQ ID NO: 2888709 - RNA, 16 nt, Human
acucucuucccuuucc

SEQ ID NO: 2888710 - RNA, 20 nt, Human
acucucuucccuuuccccag

SEQ ID NO: 2888711 - RNA, 21 nt, Human
acucucuucccuuuccccagc

SEQ ID NO: 2888712 - RNA, 18 nt, Human
acucugaagccucuggga

SEQ ID NO: 2888713 - RNA, 19 nt, Human
acucugaagccucugggaa

SEQ ID NO: 2888714 - RNA, 13 nt, Human
acucugaacuuug

SEQ ID NO: 2888715 - RNA, 16 nt, Human
acucugaacuuuggag

SEQ ID NO: 2888716 - RNA, 17 nt, Human
acucugaacuuuggaga

SEQ ID NO: 2888717 - RNA, 14 nt, Human
acucugaagccucu

SEQ ID NO: 2888718 - RNA, 15 nt, Human
acucugaagccucug

SEQ ID NO: 2888719 - RNA, 16 nt, Human
acucugaagccucugg

SEQ ID NO: 2888720 - RNA, 17 nt, Human
acucugaagccucuggg

SEQ ID NO: 2888721 - RNA, 11 nt, Human
acucugcacau

SEQ ID NO: 2888722 - RNA, 13 nt, Human
acucugcacaugu

SEQ ID NO: 2888723 - RNA, 17 nt, Human
acucugcacaugucuug

SEQ ID NO: 2888724 - RNA, 12 nt, Human
acucuuaucuca

SEQ ID NO: 2888725 - RNA, 13 nt, Human
acucuuaucucag

SEQ ID NO: 2888726 - RNA, 22 nt, Human
acucuuaucucagucaugcaua

SEQ ID NO: 2888727 - RNA, 18 nt, Human
acucugcaucccagcacc

SEQ ID NO: 2888728 - RNA, 21 nt, Human
acucugcaucccagcaccugc

SEQ ID NO: 2888729 - RNA, 17 nt, Human
acucugcagacugcuag

SEQ ID NO: 2888730 - RNA, 24 nt, Human
acucugcagacugcuaguguucug

SEQ ID NO: 2888731 - RNA, 18 nt, Human
acucugcacaugucuugu

SEQ ID NO: 2888732 - RNA, 19 nt, Human
acucugcacaugucuugua

SEQ ID NO: 2888733 - RNA, 21 nt, Human
acucugcacaugucuuguaca

SEQ ID NO: 2888734 - RNA, 22 nt, Human
acucugcacaugucuuguacau

SEQ ID NO: 2888735 - RNA, 18 nt, Human
uccgugaaaacggagcug

SEQ ID NO: 2888736 - RNA, 16 nt, Human
uccguccucgauggga

SEQ ID NO: 2888737 - RNA, 17 nt, Human
uccgucagaaaguguaa

SEQ ID NO: 2888738 - RNA, 18 nt, Human
uccgucaacguuguacug

SEQ ID NO: 2888739 - RNA, 14 nt, Human
ucccuuugucuuuc

SEQ ID NO: 2888740 - RNA, 16 nt, Human
ucccuuugucuuucaa

SEQ ID NO: 2888741 - RNA, 17 nt, Human
ucccuuugucuuucaaa

SEQ ID NO: 2888742 - RNA, 18 nt, Human
ucccuuugucuuucaaac

SEQ ID NO: 2888743 - RNA, 18 nt, Human
ucccuuuuaaacacauuu

SEQ ID NO: 2888744 - RNA, 23 nt, Human
uccuagauccuaagggucgaaag

SEQ ID NO: 2888745 - RNA, 13 nt, Human
uccuagauccuaa

SEQ ID NO: 2888746 - RNA, 14 nt, Human
uccuagauccuaag

SEQ ID NO: 2888747 - RNA, 20 nt, Human
uccuagauuauaucaaagua

SEQ ID NO: 2888748 - RNA, 21 nt, Human
uccguuuauuauaaacuguau

SEQ ID NO: 2888749 - RNA, 15 nt, Human
uccuaaaacaaauag

SEQ ID NO: 2888750 - RNA, 22 nt, Human
uccuaaaacaaaagcucaucca

SEQ ID NO: 2888751 - RNA, 14 nt, Human
uccuaaaagcaaaa

SEQ ID NO: 2888752 - RNA, 16 nt, Human
uccuaaaagcaaaaua

SEQ ID NO: 2888753 - RNA, 22 nt, Human
uccuaaaagcaaaauaaaaacu

SEQ ID NO: 2888754 - RNA, 23 nt, Human
uccuaaaagcaaaauaaaaacua

SEQ ID NO: 2888755 - RNA, 23 nt, Human
uccuaaaauaagggcagagucac

SEQ ID NO: 2888756 - RNA, 17 nt, Human
uccuaaaauaagggcag

SEQ ID NO: 2888757 - RNA, 22 nt, Human
uccuaaaauaagggcagaguca

SEQ ID NO: 2888758 - RNA, 23 nt, Human
acuccugcacacgcuccuuccuc

SEQ ID NO: 2888759 - RNA, 12 nt, Human
ucccugguucug

SEQ ID NO: 2888760 - RNA, 16 nt, Human
ucccugguucugauga

SEQ ID NO: 2888761 - RNA, 17 nt, Human
ucccugguucugaugau

SEQ ID NO: 2888762 - RNA, 21 nt, Human
ucccuguuuaauauuuaaaca

SEQ ID NO: 2888763 - RNA, 22 nt, Human
ucccuguuuaauauuuaaacag

SEQ ID NO: 2888764 - RNA, 14 nt, Human
ucccuguuuaauau

SEQ ID NO: 2888765 - RNA, 15 nt, Human
ucccuguuuaauauu

SEQ ID NO: 2888766 - RNA, 16 nt, Human
ucccuguuuaauauuu

SEQ ID NO: 2888767 - RNA, 18 nt, Human
ucccuguuuaauauuuaa

SEQ ID NO: 2888768 - RNA, 18 nt, Human
ucccuguuggucgguggg

SEQ ID NO: 2888769 - RNA, 11 nt, Human
ucccuguuuaa

SEQ ID NO: 2888770 - RNA, 13 nt, Human
ucccuguuauuuu

SEQ ID NO: 2888771 - RNA, 15 nt, Human
ucccuguuauuuuca

SEQ ID NO: 2888772 - RNA, 16 nt, Human
ucccuguuauuuucaa

SEQ ID NO: 2888773 - RNA, 17 nt, Human
ucccuguuauuuucaag

SEQ ID NO: 2888774 - RNA, 21 nt, Human
ucccuguuauuuucaaguagc

SEQ ID NO: 2888775 - RNA, 23 nt, Human
ucccuguuauuuucaaguagcug

SEQ ID NO: 2888776 - RNA, 14 nt, Human
ucccuguucuuccu

SEQ ID NO: 2888777 - RNA, 15 nt, Human
ucccuguucuuccuc

SEQ ID NO: 2888778 - RNA, 17 nt, Human
ucccuguucuuccucca

SEQ ID NO: 2888779 - RNA, 18 nt, Human
ucccuguucuuccuccag

SEQ ID NO: 2888780 - RNA, 21 nt, Human
ucccuguucuuccuccagcug

SEQ ID NO: 2888781 - RNA, 11 nt, Human
ucccuucaacc

SEQ ID NO: 2888782 - RNA, 21 nt, Human
ucccuucaaccauuccccaug

SEQ ID NO: 2888783 - RNA, 19 nt, Human
ucccuugguggcaagagcc

SEQ ID NO: 2888784 - RNA, 21 nt, Human
ucccuuucacaaaauuuuauu

SEQ ID NO: 2888785 - RNA, 15 nt, Human
ucccuuuccccagca

SEQ ID NO: 2888786 - RNA, 16 nt, Human
ucccuuuccccagcau

SEQ ID NO: 2888787 - RNA, 13 nt, Human
ucccuugugugug

SEQ ID NO: 2888788 - RNA, 16 nt, Human
ucccuuguggcccucu

SEQ ID NO: 2888789 - RNA, 15 nt, Human
ucccuugugugugug

SEQ ID NO: 2888790 - RNA, 16 nt, Human
ucccucagugcccuca

SEQ ID NO: 2888791 - RNA, 15 nt, Human
ucccucaccuucuga

SEQ ID NO: 2888792 - RNA, 14 nt, Human
ucccucaccuucug

SEQ ID NO: 2888793 - RNA, 15 nt, Human
acucaucauaaaaua

SEQ ID NO: 2888794 - RNA, 14 nt, Human
acucaucauaaaau

SEQ ID NO: 2888795 - RNA, 13 nt, Human
acucaucauaaaa

SEQ ID NO: 2888796 - RNA, 12 nt, Human
acucaucauaaa

SEQ ID NO: 2888797 - RNA, 9 nt, Human
acucaucau

SEQ ID NO: 2888798 - RNA, 16 nt, Human
acucaucacuguggcu

SEQ ID NO: 2888799 - RNA, 21 nt, Human
acucauugcugagccucugcu

SEQ ID NO: 2888800 - RNA, 22 nt, Human
acucauugcugagccucugcuc

SEQ ID NO: 2888801 - RNA, 23 nt, Human
acucauugcugagccucugcucc

SEQ ID NO: 2888802 - RNA, 14 nt, Human
acucauuucuaaaa

SEQ ID NO: 2888803 - RNA, 15 nt, Human
acucauuucuaaaag

SEQ ID NO: 2888804 - RNA, 17 nt, Human
acucauuucuaaaagaa

SEQ ID NO: 2888805 - RNA, 18 nt, Human
acucauuucuaaaagaau

SEQ ID NO: 2888806 - RNA, 19 nt, Human
acucauuucuaaaagaaua

SEQ ID NO: 2888807 - RNA, 21 nt, Human
acucauuucuaaaagaauauu

SEQ ID NO: 2888808 - RNA, 18 nt, Human
acucauugcugagccucu

SEQ ID NO: 2888809 - RNA, 20 nt, Human
acucauugcugagccucugc

SEQ ID NO: 2888810 - RNA, 15 nt, Human
acucauugcugagcc

SEQ ID NO: 2888811 - RNA, 18 nt, Human
acucauggccuugucuaa

SEQ ID NO: 2888812 - RNA, 17 nt, Human
acucaucauaaaauaaa

SEQ ID NO: 2888813 - RNA, 13 nt, Human
acucaucauuugu

SEQ ID NO: 2888814 - RNA, 16 nt, Human
acucaucauaaaauaa

SEQ ID NO: 2888815 - RNA, 14 nt, Human
acucaugagaaguu

SEQ ID NO: 2888816 - RNA, 14 nt, Human
acucaugaggaggg

SEQ ID NO: 2888817 - RNA, 19 nt, Human
acucaucccuaaugcugca

SEQ ID NO: 2888818 - RNA, 16 nt, Human
acucauccugaacagc

SEQ ID NO: 2888819 - RNA, 17 nt, Human
acucauccugaacagca

SEQ ID NO: 2888820 - RNA, 18 nt, Human
acucauccugaacagcau

SEQ ID NO: 2888821 - RNA, 22 nt, Human
acucauuuguuaaaauuaucaa

SEQ ID NO: 2888822 - RNA, 17 nt, Human
acuccaagaacaauugu

SEQ ID NO: 2888823 - RNA, 15 nt, Human
acuccaaccuaaccu

SEQ ID NO: 2888824 - RNA, 18 nt, Human
acuccaaccuaaccugug

SEQ ID NO: 2888825 - RNA, 20 nt, Human
acuccaaccuaaccuguguc

SEQ ID NO: 2888826 - RNA, 21 nt, Human
acuccaaccuaaccugugucu

SEQ ID NO: 2888827 - RNA, 23 nt, Human
acuccaaccuaaccugugucugc

SEQ ID NO: 2888828 - RNA, 15 nt, Human
acuccaagguucccu

SEQ ID NO: 2888829 - RNA, 17 nt, Human
acuccaagguucccuug

SEQ ID NO: 2888830 - RNA, 20 nt, Human
acuccaaugucugcugagga

SEQ ID NO: 2888831 - RNA, 21 nt, Human
acuccaaugucugcugaggag

SEQ ID NO: 2888832 - RNA, 18 nt, Human
acuccagccugggcgaca

SEQ ID NO: 2888833 - RNA, 15 nt, Human
acuccagccugggcg

SEQ ID NO: 2888834 - RNA, 23 nt, Human
acuccagccugggcaacagagca

SEQ ID NO: 2888835 - RNA, 18 nt, Human
acuccagccugggcaaca

SEQ ID NO: 2888836 - RNA, 20 nt, Human
acuccagccugggcgacaga

SEQ ID NO: 2888837 - RNA, 20 nt, Human
acuccagcuggguuggaaaa

SEQ ID NO: 2888838 - RNA, 21 nt, Human
acuccuacaugauguuaugua

SEQ ID NO: 2888839 - RNA, 19 nt, Human
acuccuaaaccuuugcccc

SEQ ID NO: 2888840 - RNA, 18 nt, Human
acuccuaaccucaaguga

SEQ ID NO: 2888841 - RNA, 20 nt, Human
acuccuacaagauuuagaaa

SEQ ID NO: 2888842 - RNA, 22 nt, Human
acuccuacaagauuuagaaaaa

SEQ ID NO: 2888843 - RNA, 17 nt, Human
acuccuaccucagccua

SEQ ID NO: 2888844 - RNA, 16 nt, Human
acuccuaccugcccug

SEQ ID NO: 2888845 - RNA, 17 nt, Human
acuccuaccugcccugg

SEQ ID NO: 2888846 - RNA, 18 nt, Human
acuccuaccugcccugga

SEQ ID NO: 2888847 - RNA, 16 nt, Human
acuccuaccucagccu

SEQ ID NO: 2888848 - RNA, 15 nt, Human
acuccuaccucagcc

SEQ ID NO: 2888849 - RNA, 14 nt, Human
acuccuaccucagc

SEQ ID NO: 2888850 - RNA, 14 nt, Human
acuccuaccuggua

SEQ ID NO: 2888851 - RNA, 20 nt, Human
acuccuagagaacgcagccc

SEQ ID NO: 2888852 - RNA, 21 nt, Human
acuccuagagaacgcagcccu

SEQ ID NO: 2888853 - RNA, 22 nt, Human
acuccuagagaacgcagcccua

SEQ ID NO: 2888854 - RNA, 23 nt, Human
acuccuagagaacgcagcccuag

SEQ ID NO: 2888855 - RNA, 15 nt, Human
acuccugaccucaag

SEQ ID NO: 2888856 - RNA, 13 nt, Human
acuccuaggcagg

SEQ ID NO: 2888857 - RNA, 16 nt, Human
acuccuaggcaggaca

SEQ ID NO: 2888858 - RNA, 18 nt, Human
acuccuaggcaggacaug

SEQ ID NO: 2888859 - RNA, 20 nt, Human
acuccuaggcaggacaugcu

SEQ ID NO: 2888860 - RNA, 19 nt, Human
acuccugacgucugaagcu

SEQ ID NO: 2888861 - RNA, 21 nt, Human
acuccugacgucugaagcuug

SEQ ID NO: 2888862 - RNA, 23 nt, Human
acuccugacgucugaagcuugac

SEQ ID NO: 2888863 - RNA, 11 nt, Human
acuccugacuc

SEQ ID NO: 2888864 - RNA, 12 nt, Human
acuccugacucc

SEQ ID NO: 2888865 - RNA, 18 nt, Human
acuccugacuccuaccug

SEQ ID NO: 2888866 - RNA, 13 nt, Human
uccccuucucugu

SEQ ID NO: 2888867 - RNA, 23 nt, Human
uccccuugauuuaaacacacaga

SEQ ID NO: 2888868 - RNA, 16 nt, Human
ucccgaauagcuggga

SEQ ID NO: 2888869 - RNA, 15 nt, Human
ucccgaauagcuggg

SEQ ID NO: 2888870 - RNA, 21 nt, Human
uccccucacagccucugaccc

SEQ ID NO: 2888871 - RNA, 15 nt, Human
uccccucaccuccuc

SEQ ID NO: 2888872 - RNA, 17 nt, Human
uccccucaccuccucua

SEQ ID NO: 2888873 - RNA, 17 nt, Human
uccccucacagccucug

SEQ ID NO: 2888874 - RNA, 18 nt, Human
uccccucacagccucuga

SEQ ID NO: 2888875 - RNA, 19 nt, Human
uccccucacagccucugac

SEQ ID NO: 2888876 - RNA, 20 nt, Human
uccccucacagccucugacc

SEQ ID NO: 2888877 - RNA, 16 nt, Human
uccccucacagccucu

SEQ ID NO: 2888878 - RNA, 19 nt, Human
acucaagaagcaggcuaca

SEQ ID NO: 2888879 - RNA, 23 nt, Human
acucaaccuuaagaccuacuguu

SEQ ID NO: 2888880 - RNA, 20 nt, Human
acucaacugggcucuguccc

SEQ ID NO: 2888881 - RNA, 13 nt, Human
acucaagaagcag

SEQ ID NO: 2888882 - RNA, 14 nt, Human
acucaagaagcagg

SEQ ID NO: 2888883 - RNA, 15 nt, Human
acucaagaagcaggc

SEQ ID NO: 2888884 - RNA, 16 nt, Human
acucaagaagcaggcu

SEQ ID NO: 2888885 - RNA, 14 nt, Human
uccccucccuguca

SEQ ID NO: 2888886 - RNA, 13 nt, Human
uccccucccuguc

SEQ ID NO: 2888887 - RNA, 15 nt, Human
uccccuccacuguca

SEQ ID NO: 2888888 - RNA, 12 nt, Human
uccccuccagcc

SEQ ID NO: 2888889 - RNA, 13 nt, Human
uccccuccagccu

SEQ ID NO: 2888890 - RNA, 21 nt, Human
uccccucccuggcucccauga

SEQ ID NO: 2888891 - RNA, 12 nt, Human
uccccuccacug

SEQ ID NO: 2888892 - RNA, 16 nt, Human
uccccucaggacugca

SEQ ID NO: 2888893 - RNA, 18 nt, Human
ucccgaauagcugggacu

SEQ ID NO: 2888894 - RNA, 20 nt, Human
ucccgaguagcugggacuac

SEQ ID NO: 2888895 - RNA, 20 nt, Human
ucccgaagaauggagaggaa

SEQ ID NO: 2888896 - RNA, 21 nt, Human
ucccgaagaauggagaggaac

SEQ ID NO: 2888897 - RNA, 21 nt, Human
ucccgaguagcugggauuaca

SEQ ID NO: 2888898 - RNA, 12 nt, Human
ucccgagucugg

SEQ ID NO: 2888899 - RNA, 14 nt, Human
ucccgagucuggga

SEQ ID NO: 2888900 - RNA, 15 nt, Human
ucccgagucugggac

SEQ ID NO: 2888901 - RNA, 16 nt, Human
ucccgagucugggaca

SEQ ID NO: 2888902 - RNA, 18 nt, Human
ucccgccagacuguuaga

SEQ ID NO: 2888903 - RNA, 17 nt, Human
ucccgccagagggcuug

SEQ ID NO: 2888904 - RNA, 23 nt, Human
ucccgcaucaaggucagcaugag

SEQ ID NO: 2888905 - RNA, 23 nt, Human
ucccgcggguuccgcaggcagac

SEQ ID NO: 2888906 - RNA, 21 nt, Human
uccccucagccacacccaggc

SEQ ID NO: 2888907 - RNA, 13 nt, Human
ucccgcucagccc

SEQ ID NO: 2888908 - RNA, 21 nt, Human
ucccgccccuucccacucacc

SEQ ID NO: 2888909 - RNA, 14 nt, Human
ucccgcucagcccu

SEQ ID NO: 2888910 - RNA, 15 nt, Human
ucccgcucagcccuc

SEQ ID NO: 2888911 - RNA, 16 nt, Human
ucccgcucagcccucc

SEQ ID NO: 2888912 - RNA, 20 nt, Human
ucccgcucagcccucccugc

SEQ ID NO: 2888913 - RNA, 18 nt, Human
ucccggagguuggguggg

SEQ ID NO: 2888914 - RNA, 13 nt, Human
ucccgcugcugcu

SEQ ID NO: 2888915 - RNA, 15 nt, Human
ucccgcugcugcugc

SEQ ID NO: 2888916 - RNA, 14 nt, Human
ucccggaggaaauc

SEQ ID NO: 2888917 - RNA, 15 nt, Human
ucccggaggaaaucu

SEQ ID NO: 2888918 - RNA, 16 nt, Human
ucccucaaccccacca

SEQ ID NO: 2888919 - RNA, 10 nt, Human
uccccacacu

SEQ ID NO: 2888920 - RNA, 18 nt, Human
uccccaccuucaauuccu

SEQ ID NO: 2888921 - RNA, 13 nt, Human
uccccaccuggga

SEQ ID NO: 2888922 - RNA, 14 nt, Human
uccccaccugggac

SEQ ID NO: 2888923 - RNA, 20 nt, Human
uccccaccuucuucagccac

SEQ ID NO: 2888924 - RNA, 23 nt, Human
uccccaccuucaauuccugggcc

SEQ ID NO: 2888925 - RNA, 22 nt, Human
uccccaccuucaauuccugggc

SEQ ID NO: 2888926 - RNA, 20 nt, Human
uccccaccuucaauuccugg

SEQ ID NO: 2888927 - RNA, 17 nt, Human
acuauagccuaggugac

SEQ ID NO: 2888928 - RNA, 16 nt, Human
acuauaguuuaaaaca

SEQ ID NO: 2888929 - RNA, 20 nt, Human
acuauaguuuaaaacacauu

SEQ ID NO: 2888930 - RNA, 15 nt, Human
acuauacaacaaagg

SEQ ID NO: 2888931 - RNA, 14 nt, Human
acuauacuugaaca

SEQ ID NO: 2888932 - RNA, 15 nt, Human
acuauacuugaacaa

SEQ ID NO: 2888933 - RNA, 16 nt, Human
acuauacuugaacaaa

SEQ ID NO: 2888934 - RNA, 17 nt, Human
acuauacuugaacaaaa

SEQ ID NO: 2888935 - RNA, 18 nt, Human
acuauacuugaacaaaag

SEQ ID NO: 2888936 - RNA, 23 nt, Human
acuauacuugaacaaaaggguca

SEQ ID NO: 2888937 - RNA, 16 nt, Human
acuauauagagauguu

SEQ ID NO: 2888938 - RNA, 17 nt, Human
acuauauagagauguuu

SEQ ID NO: 2888939 - RNA, 13 nt, Human
acuauauacaugu

SEQ ID NO: 2888940 - RNA, 14 nt, Human
acuauauacaugug

SEQ ID NO: 2888941 - RNA, 15 nt, Human
acuauauacaugugu

SEQ ID NO: 2888942 - RNA, 16 nt, Human
acuauauacaugugug

SEQ ID NO: 2888943 - RNA, 17 nt, Human
acuauauacaugugugu

SEQ ID NO: 2888944 - RNA, 18 nt, Human
acuauauacaugugugua

SEQ ID NO: 2888945 - RNA, 21 nt, Human
acuauauacauguguguauau

SEQ ID NO: 2888946 - RNA, 14 nt, Human
acuauauauauaug

SEQ ID NO: 2888947 - RNA, 19 nt, Human
acuauauauauaugccuuu

SEQ ID NO: 2888948 - RNA, 18 nt, Human
acuauauagagauguuuu

SEQ ID NO: 2888949 - RNA, 19 nt, Human
acuauauucauuuccacuc

SEQ ID NO: 2888950 - RNA, 16 nt, Human
acuauauucuggccag

SEQ ID NO: 2888951 - RNA, 18 nt, Human
acuauauugauuguccuu

SEQ ID NO: 2888952 - RNA, 19 nt, Human
acuauauugauuguccuuu

SEQ ID NO: 2888953 - RNA, 13 nt, Human
acuauaugugaau

SEQ ID NO: 2888954 - RNA, 23 nt, Human
acuauguugcccaggcaggucuu

SEQ ID NO: 2888955 - RNA, 18 nt, Human
acuaugaacuucucucag

SEQ ID NO: 2888956 - RNA, 19 nt, Human
acuaugaacuucucucaga

SEQ ID NO: 2888957 - RNA, 21 nt, Human
acuaugaacuucucucagacu

SEQ ID NO: 2888958 - RNA, 20 nt, Human
acuauguugcccaggcaggu

SEQ ID NO: 2888959 - RNA, 19 nt, Human
acuauguugcccaggcagg

SEQ ID NO: 2888960 - RNA, 17 nt, Human
acuauuauaauuuaaug

SEQ ID NO: 2888961 - RNA, 21 nt, Human
acuauuaagaggcagaaaauu

SEQ ID NO: 2888962 - RNA, 22 nt, Human
acuauuaggugcaauuucaagg

SEQ ID NO: 2888963 - RNA, 21 nt, Human
acuauuauaauuuaaugcaug

SEQ ID NO: 2888964 - RNA, 20 nt, Human
acuauuauguuguuagagaa

SEQ ID NO: 2888965 - RNA, 21 nt, Human
acuauuauguuguuagagaaa

SEQ ID NO: 2888966 - RNA, 14 nt, Human
acuauuaagaggca

SEQ ID NO: 2888967 - RNA, 19 nt, Human
acuauuaaggauguagcuu

SEQ ID NO: 2888968 - RNA, 20 nt, Human
acuauuaaggauguagcuuu

SEQ ID NO: 2888969 - RNA, 22 nt, Human
acucaacaaaacccaugcauuu

SEQ ID NO: 2888970 - RNA, 18 nt, Human
acucaaauguucuaaguu

SEQ ID NO: 2888971 - RNA, 22 nt, Human
acucaaauguucuaaguuucua

SEQ ID NO: 2888972 - RNA, 18 nt, Human
acuauguugcccaggcag

SEQ ID NO: 2888973 - RNA, 17 nt, Human
acuauguugcccaggca

SEQ ID NO: 2888974 - RNA, 22 nt, Human
acuaugaacugaaggcagcaug

SEQ ID NO: 2888975 - RNA, 15 nt, Human
acuaugaaaccuuuu

SEQ ID NO: 2888976 - RNA, 20 nt, Human
acuaucagcccaagaugcuu

SEQ ID NO: 2888977 - RNA, 22 nt, Human
acuaucaguuuguccuguagag

SEQ ID NO: 2888978 - RNA, 13 nt, Human
acuaucauaaaau

SEQ ID NO: 2888979 - RNA, 14 nt, Human
acuaucauaaaauc

SEQ ID NO: 2888980 - RNA, 18 nt, Human
acuaucauaguuaacaua

SEQ ID NO: 2888981 - RNA, 22 nt, Human
acuaucaugucaaacgugaaaa

SEQ ID NO: 2888982 - RNA, 17 nt, Human
acuaucccggcugcccu

SEQ ID NO: 2888983 - RNA, 16 nt, Human
acuaucccggcugccc

SEQ ID NO: 2888984 - RNA, 16 nt, Human
acuaucuuggugaauu

SEQ ID NO: 2888985 - RNA, 11 nt, Human
acuaucuugug

SEQ ID NO: 2888986 - RNA, 17 nt, Human
acuaucauuuaauaaua

SEQ ID NO: 2888987 - RNA, 15 nt, Human
acuauccugacuucu

SEQ ID NO: 2888988 - RNA, 18 nt, Human
acuaucccggcugcccuu

SEQ ID NO: 2888989 - RNA, 17 nt, Human
acuauccaugcaccaaa

SEQ ID NO: 2888990 - RNA, 18 nt, Human
acuauccaugcaccaaac

SEQ ID NO: 2888991 - RNA, 20 nt, Human
acuaucccaacagucauguu

SEQ ID NO: 2888992 - RNA, 20 nt, Human
acguuuuuaauauaaagccu

SEQ ID NO: 2888993 - RNA, 13 nt, Human
acguuuuuccuuu

SEQ ID NO: 2888994 - RNA, 14 nt, Human
acguuuuuccuuua

SEQ ID NO: 2888995 - RNA, 15 nt, Human
acuaaaaacaaaccc

SEQ ID NO: 2888996 - RNA, 16 nt, Human
acuaaaaacaaacccu

SEQ ID NO: 2888997 - RNA, 13 nt, Human
acuaaaagacauu

SEQ ID NO: 2888998 - RNA, 15 nt, Human
acuaaaagacauuug

SEQ ID NO: 2888999 - RNA, 17 nt, Human
acuaaaagacauuuguu

SEQ ID NO: 2889000 - RNA, 15 nt, Human
acguuuccugagaag

SEQ ID NO: 2889001 - RNA, 18 nt, Human
acguuuacaagccccccc

SEQ ID NO: 2889002 - RNA, 14 nt, Human
uccagcucaccagc

SEQ ID NO: 2889003 - RNA, 13 nt, Human
uccagccugggag

SEQ ID NO: 2889004 - RNA, 19 nt, Human
uccagccugggaggcacag

SEQ ID NO: 2889005 - RNA, 20 nt, Human
uccagccugggcgacagagc

SEQ ID NO: 2889006 - RNA, 17 nt, Human
uccagccugggcgacag

SEQ ID NO: 2889007 - RNA, 15 nt, Human
acuaaagccagccug

SEQ ID NO: 2889008 - RNA, 16 nt, Human
acuaaagccagccuga

SEQ ID NO: 2889009 - RNA, 14 nt, Human
acuaaaguauguaa

SEQ ID NO: 2889010 - RNA, 22 nt, Human
acuaaaguauguaaaguaugua

SEQ ID NO: 2889011 - RNA, 17 nt, Human
acuaaagguggccacaa

SEQ ID NO: 2889012 - RNA, 22 nt, Human
acuaaagguggccacaaauucu

SEQ ID NO: 2889013 - RNA, 14 nt, Human
acuaaaauaugucu

SEQ ID NO: 2889014 - RNA, 22 nt, Human
acuaaaauuuuaggcacucuua

SEQ ID NO: 2889015 - RNA, 18 nt, Human
acuaaacauaugauuuca

SEQ ID NO: 2889016 - RNA, 19 nt, Human
acuaaacauaugauuucac

SEQ ID NO: 2889017 - RNA, 17 nt, Human
acuaaagcaguagaaau

SEQ ID NO: 2889018 - RNA, 20 nt, Human
acuaaaaguucuucuccaau

SEQ ID NO: 2889019 - RNA, 14 nt, Human
acuaaaauauuuau

SEQ ID NO: 2889020 - RNA, 12 nt, Human
acuaaaauauau

SEQ ID NO: 2889021 - RNA, 14 nt, Human
acuaaaauauauau

SEQ ID NO: 2889022 - RNA, 13 nt, Human
acuaaccacgcug

SEQ ID NO: 2889023 - RNA, 21 nt, Human
acuaaaucagagacaaaauau

SEQ ID NO: 2889024 - RNA, 19 nt, Human
acuaaaucagagacaaaau

SEQ ID NO: 2889025 - RNA, 18 nt, Human
acuaaaucagagacaaaa

SEQ ID NO: 2889026 - RNA, 15 nt, Human
acuaaaucagagaca

SEQ ID NO: 2889027 - RNA, 19 nt, Human
acuaaauaagaaaauaaca

SEQ ID NO: 2889028 - RNA, 18 nt, Human
acuaaauacuugcuccau

SEQ ID NO: 2889029 - RNA, 22 nt, Human
acuaaauaugaacccuuuguuu

SEQ ID NO: 2889030 - RNA, 23 nt, Human
acuacaggugugagucaccaagc

SEQ ID NO: 2889031 - RNA, 17 nt, Human
acuaaaucucuaauaug

SEQ ID NO: 2889032 - RNA, 17 nt, Human
acuaaccccaacgcaca

SEQ ID NO: 2889033 - RNA, 21 nt, Human
acuaaccccaacgcacaggaa

SEQ ID NO: 2889034 - RNA, 23 nt, Human
acuaaccagggaagcugucccuc

SEQ ID NO: 2889035 - RNA, 14 nt, Human
acuaaaucucuaau

SEQ ID NO: 2889036 - RNA, 16 nt, Human
acuaaaucucuaauau

SEQ ID NO: 2889037 - RNA, 15 nt, Human
ucccagugaauucuu

SEQ ID NO: 2889038 - RNA, 16 nt, Human
ucccagucucuggcag

SEQ ID NO: 2889039 - RNA, 23 nt, Human
ucccagguguuaacauuccaaga

SEQ ID NO: 2889040 - RNA, 15 nt, Human
ucccagguguuaaca

SEQ ID NO: 2889041 - RNA, 21 nt, Human
ucccagguguuaacauuccaa

SEQ ID NO: 2889042 - RNA, 22 nt, Human
ucccagguguuaacauuccaag

SEQ ID NO: 2889043 - RNA, 21 nt, Human
ucccagguagcugggauuaca

SEQ ID NO: 2889044 - RNA, 15 nt, Human
ucccaguucaggagu

SEQ ID NO: 2889045 - RNA, 22 nt, Human
ucccaguggcugcugcccaggc

SEQ ID NO: 2889046 - RNA, 23 nt, Human
ucccaguggcugcugcccaggcc

SEQ ID NO: 2889047 - RNA, 15 nt, Human
ucccaguggcugcug

SEQ ID NO: 2889048 - RNA, 16 nt, Human
ucccaguggcugcugc

SEQ ID NO: 2889049 - RNA, 17 nt, Human
ucccaguggcugcugcc

SEQ ID NO: 2889050 - RNA, 18 nt, Human
ucccaguggcugcugccc

SEQ ID NO: 2889051 - RNA, 19 nt, Human
ucccaguggcugcugccca

SEQ ID NO: 2889052 - RNA, 21 nt, Human
ucccaguggcugcugcccagg

SEQ ID NO: 2889053 - RNA, 19 nt, Human
ucccagugagucucugggg

SEQ ID NO: 2889054 - RNA, 20 nt, Human
acuacaugcagcccaugccc

SEQ ID NO: 2889055 - RNA, 15 nt, Human
acuacaugugguuua

SEQ ID NO: 2889056 - RNA, 18 nt, Human
acuacaugugguuuauag

SEQ ID NO: 2889057 - RNA, 18 nt, Human
acuacaucuuuaaacagu

SEQ ID NO: 2889058 - RNA, 20 nt, Human
acuacaugagaacaaacaga

SEQ ID NO: 2889059 - RNA, 21 nt, Human
ucccaggggcccaaggcggcc

SEQ ID NO: 2889060 - RNA, 22 nt, Human
ucccaggggcccaaggcggccc

SEQ ID NO: 2889061 - RNA, 13 nt, Human
acuacauucauuu

SEQ ID NO: 2889062 - RNA, 19 nt, Human
acuacaugugguuuauaga

SEQ ID NO: 2889063 - RNA, 13 nt, Human
ucccaucgcuguc

SEQ ID NO: 2889064 - RNA, 17 nt, Human
ucccaucuaagcugcag

SEQ ID NO: 2889065 - RNA, 18 nt, Human
ucccaucuaagcugcagc

SEQ ID NO: 2889066 - RNA, 19 nt, Human
ucccaucuaagcugcagcu

SEQ ID NO: 2889067 - RNA, 20 nt, Human
ucccaucuaagcugcagcuu

SEQ ID NO: 2889068 - RNA, 22 nt, Human
ucccaucuaagcugcagcuucc

SEQ ID NO: 2889069 - RNA, 23 nt, Human
ucccaucuaagcugcagcuuccu

SEQ ID NO: 2889070 - RNA, 15 nt, Human
ucccauaggcccagu

SEQ ID NO: 2889071 - RNA, 23 nt, Human
ucccaguucaggagucccaagga

SEQ ID NO: 2889072 - RNA, 20 nt, Human
ucccaguucaggagucccaa

SEQ ID NO: 2889073 - RNA, 18 nt, Human
ucccauaaccgcugauuc

SEQ ID NO: 2889074 - RNA, 22 nt, Human
ucccauaaccgcugauucucag

SEQ ID NO: 2889075 - RNA, 14 nt, Human
ucccauaccaccca

SEQ ID NO: 2889076 - RNA, 21 nt, Human
uccccaacccccauucucauc

SEQ ID NO: 2889077 - RNA, 23 nt, Human
uccccaacccccauucucaucug

SEQ ID NO: 2889078 - RNA, 20 nt, Human
uccccaacccuagguucccu

SEQ ID NO: 2889079 - RNA, 22 nt, Human
uccccaacccuagguucccugu

SEQ ID NO: 2889080 - RNA, 15 nt, Human
uccccaagccuggca

SEQ ID NO: 2889081 - RNA, 23 nt, Human
uccccaagugguuuccacaugcu

SEQ ID NO: 2889082 - RNA, 16 nt, Human
uccccaaugagacuug

SEQ ID NO: 2889083 - RNA, 17 nt, Human
uccccaaugagacuugc

SEQ ID NO: 2889084 - RNA, 19 nt, Human
uccccaaugagacuugccu

SEQ ID NO: 2889085 - RNA, 21 nt, Human
uccccaaugagacuugccuuc

SEQ ID NO: 2889086 - RNA, 14 nt, Human
uccccaaaacaaag

SEQ ID NO: 2889087 - RNA, 17 nt, Human
uccccaaaacaaagucu

SEQ ID NO: 2889088 - RNA, 21 nt, Human
uccccaaaacaaagucuuugg

SEQ ID NO: 2889089 - RNA, 23 nt, Human
uccccaacagcgacauagcccau

SEQ ID NO: 2889090 - RNA, 12 nt, Human
uccuucagugca

SEQ ID NO: 2889091 - RNA, 18 nt, Human
uccuucagcuuccauuuc

SEQ ID NO: 2889092 - RNA, 20 nt, Human
uccuucaucuuuuaaagaaa

SEQ ID NO: 2889093 - RNA, 13 nt, Human
uccuuccuacccu

SEQ ID NO: 2889094 - RNA, 16 nt, Human
uccuuccucugaggcu

SEQ ID NO: 2889095 - RNA, 17 nt, Human
uccuuccucugagccuu

SEQ ID NO: 2889096 - RNA, 21 nt, Human
uccuuccucacaccaggcuug

SEQ ID NO: 2889097 - RNA, 14 nt, Human
uccuuccucuccuu

SEQ ID NO: 2889098 - RNA, 16 nt, Human
uccuuccucugagccu

SEQ ID NO: 2889099 - RNA, 16 nt, Human
uccuuccucacaccag

SEQ ID NO: 2889100 - RNA, 20 nt, Human
uccuuccuaauuucccuucu

SEQ ID NO: 2889101 - RNA, 18 nt, Human
uccuuccaaaaauuauua

SEQ ID NO: 2889102 - RNA, 19 nt, Human
uccuuccaaaaauuauuau

SEQ ID NO: 2889103 - RNA, 15 nt, Human
uccuuccaaagaauu

SEQ ID NO: 2889104 - RNA, 19 nt, Human
uccuuccaaagaauucuua

SEQ ID NO: 2889105 - RNA, 20 nt, Human
acuggcacugaauuaaucau

SEQ ID NO: 2889106 - RNA, 14 nt, Human
acuggcagacugug

SEQ ID NO: 2889107 - RNA, 18 nt, Human
acuggcaacauuccaaga

SEQ ID NO: 2889108 - RNA, 16 nt, Human
acuggcacugaauuaa

SEQ ID NO: 2889109 - RNA, 16 nt, Human
acuggccucugcugau

SEQ ID NO: 2889110 - RNA, 13 nt, Human
acuggccugacuu

SEQ ID NO: 2889111 - RNA, 18 nt, Human
acuggccugacuuggggg

SEQ ID NO: 2889112 - RNA, 21 nt, Human
acuggcuagaguccucacucc

SEQ ID NO: 2889113 - RNA, 15 nt, Human
acuggcguggauuaa

SEQ ID NO: 2889114 - RNA, 20 nt, Human
acuggcguggauuaaacuua

SEQ ID NO: 2889115 - RNA, 18 nt, Human
acuggcuagaguccucac

SEQ ID NO: 2889116 - RNA, 16 nt, Human
acuggcauaguuucau

SEQ ID NO: 2889117 - RNA, 17 nt, Human
acuggcauaguuucaua

SEQ ID NO: 2889118 - RNA, 23 nt, Human
acuggccucugcugauccuccca

SEQ ID NO: 2889119 - RNA, 22 nt, Human
acuggcugcaaaggguaucagg

SEQ ID NO: 2889120 - RNA, 16 nt, Human
acuggcuccucugugg

SEQ ID NO: 2889121 - RNA, 19 nt, Human
acuggcuccucuguggugu

SEQ ID NO: 2889122 - RNA, 23 nt, Human
uccuucagacacccucaaccucu

SEQ ID NO: 2889123 - RNA, 17 nt, Human
acuggcuggcugcagug

SEQ ID NO: 2889124 - RNA, 16 nt, Human
acuggcuggcugcagu

SEQ ID NO: 2889125 - RNA, 16 nt, Human
acugcauaccaaccug

SEQ ID NO: 2889126 - RNA, 17 nt, Human
acugcagguuggacccc

SEQ ID NO: 2889127 - RNA, 18 nt, Human
acugcagguuggacccca

SEQ ID NO: 2889128 - RNA, 19 nt, Human
acugcagguuggaccccag

SEQ ID NO: 2889129 - RNA, 20 nt, Human
acugcagguuggaccccaga

SEQ ID NO: 2889130 - RNA, 21 nt, Human
acugcagguuggaccccagag

SEQ ID NO: 2889131 - RNA, 22 nt, Human
acugcagggccaggacugagcc

SEQ ID NO: 2889132 - RNA, 21 nt, Human
acugcagggguuauguggaag

SEQ ID NO: 2889133 - RNA, 13 nt, Human
acugcagaagcaa

SEQ ID NO: 2889134 - RNA, 17 nt, Human
acugcaguccuggagca

SEQ ID NO: 2889135 - RNA, 21 nt, Human
acugccuugaaccugugagua

SEQ ID NO: 2889136 - RNA, 23 nt, Human
acugccuugaaccugugaguaaa

SEQ ID NO: 2889137 - RNA, 18 nt, Human
acugcgcuuuauuuucuu

SEQ ID NO: 2889138 - RNA, 19 nt, Human
acugcgggaugguccuggg

SEQ ID NO: 2889139 - RNA, 20 nt, Human
acugcggaaaaggaaggaaa

SEQ ID NO: 2889140 - RNA, 20 nt, Human
acugccuuuuuauuuauaug

SEQ ID NO: 2889141 - RNA, 22 nt, Human
acugcgggaugguccuggggcu

SEQ ID NO: 2889142 - RNA, 21 nt, Human
acugcgggaugguccuggggc

SEQ ID NO: 2889143 - RNA, 20 nt, Human
acugcgggaugguccugggg

SEQ ID NO: 2889144 - RNA, 15 nt, Human
acugcucaggcugca

SEQ ID NO: 2889145 - RNA, 18 nt, Human
acugcucaggcugcagcu

SEQ ID NO: 2889146 - RNA, 21 nt, Human
acugcucaggcugcagcugga

SEQ ID NO: 2889147 - RNA, 13 nt, Human
acugcuaguguuc

SEQ ID NO: 2889148 - RNA, 15 nt, Human
acugcuaguguucug

SEQ ID NO: 2889149 - RNA, 16 nt, Human
acugcuaguguucugu

SEQ ID NO: 2889150 - RNA, 17 nt, Human
acugcuaguguucuguc

SEQ ID NO: 2889151 - RNA, 19 nt, Human
acugcuaguguucugucua

SEQ ID NO: 2889152 - RNA, 23 nt, Human
acugcucaucauuccuugagaaa

SEQ ID NO: 2889153 - RNA, 19 nt, Human
acugcucaucauuccuuga

SEQ ID NO: 2889154 - RNA, 12 nt, Human
acugcucugaug

SEQ ID NO: 2889155 - RNA, 15 nt, Human
acugcucuuguuucu

SEQ ID NO: 2889156 - RNA, 18 nt, Human
acugcucuuguuucuuuu

SEQ ID NO: 2889157 - RNA, 16 nt, Human
acugcuugaugaagca

SEQ ID NO: 2889158 - RNA, 18 nt, Human
acugcuugaugaagcaag

SEQ ID NO: 2889159 - RNA, 20 nt, Human
acugcuugaugaagcaagga

SEQ ID NO: 2889160 - RNA, 23 nt, Human
acugcuugaugaagcaaggaaga

SEQ ID NO: 2889161 - RNA, 13 nt, Human
acugcuggcugcc

SEQ ID NO: 2889162 - RNA, 21 nt, Human
acugcugcccagccuccaagc

SEQ ID NO: 2889163 - RNA, 16 nt, Human
acugcugcccagccuc

SEQ ID NO: 2889164 - RNA, 18 nt, Human
acugcugcccagccucca

SEQ ID NO: 2889165 - RNA, 12 nt, Human
acugcuggcugc

SEQ ID NO: 2889166 - RNA, 20 nt, Human
acugcuggacgucuuucuuu

SEQ ID NO: 2889167 - RNA, 22 nt, Human
acugcuggacgucuuucuuuuu

SEQ ID NO: 2889168 - RNA, 13 nt, Human
acugcugcugccu

SEQ ID NO: 2889169 - RNA, 14 nt, Human
acugcugcugccug

SEQ ID NO: 2889170 - RNA, 15 nt, Human
acugcugcugccugg

SEQ ID NO: 2889171 - RNA, 18 nt, Human
acugcugcugccuggcca

SEQ ID NO: 2889172 - RNA, 19 nt, Human
acugcugcugccuggccac

SEQ ID NO: 2889173 - RNA, 12 nt, Human
acuguaauuuag

SEQ ID NO: 2889174 - RNA, 21 nt, Human
acuguaagacucauucccuag

SEQ ID NO: 2889175 - RNA, 13 nt, Human
acuguaauaauac

SEQ ID NO: 2889176 - RNA, 16 nt, Human
acuguaauaauaccuc

SEQ ID NO: 2889177 - RNA, 17 nt, Human
acuguaauaauaccuca

SEQ ID NO: 2889178 - RNA, 18 nt, Human
acuguaauaauaccucaa

SEQ ID NO: 2889179 - RNA, 19 nt, Human
acuguaauaauaccucaau

SEQ ID NO: 2889180 - RNA, 23 nt, Human
acuguaauaauaccucaauguuu

SEQ ID NO: 2889181 - RNA, 22 nt, Human
acuguaaucuuauuuaggaagu

SEQ ID NO: 2889182 - RNA, 19 nt, Human
acuguaaucuuauuuagga

SEQ ID NO: 2889183 - RNA, 15 nt, Human
acuguacauaaacaa

SEQ ID NO: 2889184 - RNA, 18 nt, Human
acuguagaaugauuucau

SEQ ID NO: 2889185 - RNA, 20 nt, Human
acuguagaaugauuucaugc

SEQ ID NO: 2889186 - RNA, 19 nt, Human
acuguagaaugauuucaug

SEQ ID NO: 2889187 - RNA, 16 nt, Human
acuguacccaaaugga

SEQ ID NO: 2889188 - RNA, 14 nt, Human
acuguacauuuaaa

SEQ ID NO: 2889189 - RNA, 15 nt, Human
acuguacauuuaaaa

SEQ ID NO: 2889190 - RNA, 16 nt, Human
acuguacauuuaaaau

SEQ ID NO: 2889191 - RNA, 22 nt, Human
acuguacauuuaaaauugcuau

SEQ ID NO: 2889192 - RNA, 19 nt, Human
acuguaccauauagcaaaa

SEQ ID NO: 2889193 - RNA, 17 nt, Human
acuguacccaaauggaa

SEQ ID NO: 2889194 - RNA, 12 nt, Human
acuguacuaauu

SEQ ID NO: 2889195 - RNA, 14 nt, Human
acuguacuaauucu

SEQ ID NO: 2889196 - RNA, 18 nt, Human
acuguacuaauucuuaca

SEQ ID NO: 2889197 - RNA, 22 nt, Human
acuguacuaauucuuacacugc

SEQ ID NO: 2889198 - RNA, 13 nt, Human
acuguacuccucc

SEQ ID NO: 2889199 - RNA, 14 nt, Human
acuguacuccuccc

SEQ ID NO: 2889200 - RNA, 18 nt, Human
acugggcaaugauggcaa

SEQ ID NO: 2889201 - RNA, 13 nt, Human
acugggcaaugau

SEQ ID NO: 2889202 - RNA, 22 nt, Human
acugggaugggaggagaggaca

SEQ ID NO: 2889203 - RNA, 14 nt, Human
acugggaggggaga

SEQ ID NO: 2889204 - RNA, 17 nt, Human
acugggaucacaggugu

SEQ ID NO: 2889205 - RNA, 20 nt, Human
acugggaggccgaggcaggg

SEQ ID NO: 2889206 - RNA, 13 nt, Human
ucgcuccuguguc

SEQ ID NO: 2889207 - RNA, 12 nt, Human
ucgcuccugugu

SEQ ID NO: 2889208 - RNA, 17 nt, Human
ucgcucccucccaggac

SEQ ID NO: 2889209 - RNA, 15 nt, Human
ucgcucccucccagg

SEQ ID NO: 2889210 - RNA, 19 nt, Human
acuggguacuuguggacac

SEQ ID NO: 2889211 - RNA, 18 nt, Human
acuggggaugugggaggg

SEQ ID NO: 2889212 - RNA, 16 nt, Human
acuggggaugugggag

SEQ ID NO: 2889213 - RNA, 17 nt, Human
acuggggaugugggagg

SEQ ID NO: 2889214 - RNA, 21 nt, Human
acuggggagcccgucucagug

SEQ ID NO: 2889215 - RNA, 15 nt, Human
acuggggagucuuug

SEQ ID NO: 2889216 - RNA, 13 nt, Human
acuggggagcccg

SEQ ID NO: 2889217 - RNA, 17 nt, Human
acuggggagcccgucuc

SEQ ID NO: 2889218 - RNA, 16 nt, Human
acugggaugagccgcu

SEQ ID NO: 2889219 - RNA, 19 nt, Human
acuggggaaaacuccaccu

SEQ ID NO: 2889220 - RNA, 23 nt, Human
acuggguacuuguggacacagcu

SEQ ID NO: 2889221 - RNA, 20 nt, Human
acuggguacuuguggacaca

SEQ ID NO: 2889222 - RNA, 13 nt, Human
acuguaagacauu

SEQ ID NO: 2889223 - RNA, 13 nt, Human
ucgaacuggcugc

SEQ ID NO: 2889224 - RNA, 14 nt, Human
ucgaacuggcugca

SEQ ID NO: 2889225 - RNA, 15 nt, Human
ucgaacuggcugcaa

SEQ ID NO: 2889226 - RNA, 23 nt, Human
ucgaagcgcgccacucgcuuccc

SEQ ID NO: 2889227 - RNA, 14 nt, Human
ucgaacuucacaac

SEQ ID NO: 2889228 - RNA, 18 nt, Human
ucgaacuucacaacuagg

SEQ ID NO: 2889229 - RNA, 23 nt, Human
ucgaagccuugccuaaauuuaau

SEQ ID NO: 2889230 - RNA, 22 nt, Human
uccuuucuaacaaaaaaauaua

SEQ ID NO: 2889231 - RNA, 18 nt, Human
uccuuuccccagcccagg

SEQ ID NO: 2889232 - RNA, 13 nt, Human
uccuuucccuucc

SEQ ID NO: 2889233 - RNA, 14 nt, Human
uccuuucccuuccu

SEQ ID NO: 2889234 - RNA, 15 nt, Human
uccuuucccuuccuc

SEQ ID NO: 2889235 - RNA, 16 nt, Human
uccuuucccuuccucu

SEQ ID NO: 2889236 - RNA, 17 nt, Human
uccuuucccuuccucuu

SEQ ID NO: 2889237 - RNA, 18 nt, Human
uccuuucccuuccucuuc

SEQ ID NO: 2889238 - RNA, 16 nt, Human
uccuuuccccagccca

SEQ ID NO: 2889239 - RNA, 17 nt, Human
uccuuuccccagcccag

SEQ ID NO: 2889240 - RNA, 20 nt, Human
uccuuuccccagcccagggu

SEQ ID NO: 2889241 - RNA, 16 nt, Human
uccuuuccccuuccuu

SEQ ID NO: 2889242 - RNA, 13 nt, Human
uccuuucccaagc

SEQ ID NO: 2889243 - RNA, 16 nt, Human
uccuuucccaagccuu

SEQ ID NO: 2889244 - RNA, 21 nt, Human
uccuuucccaagccuucgggc

SEQ ID NO: 2889245 - RNA, 13 nt, Human
uccuuuccccagc

SEQ ID NO: 2889246 - RNA, 14 nt, Human
uccuuuccccagcc

SEQ ID NO: 2889247 - RNA, 15 nt, Human
uccuuuccccagccc

SEQ ID NO: 2889248 - RNA, 17 nt, Human
uccuuuccaaggcuucu

SEQ ID NO: 2889249 - RNA, 18 nt, Human
uccuuuccaaggcuucuc

SEQ ID NO: 2889250 - RNA, 15 nt, Human
uccuuucaccacaug

SEQ ID NO: 2889251 - RNA, 17 nt, Human
uccuuucaccccagggc

SEQ ID NO: 2889252 - RNA, 20 nt, Human
uccuuucacaaccuucugug

SEQ ID NO: 2889253 - RNA, 22 nt, Human
uccuuucagggaauuucaggaa

SEQ ID NO: 2889254 - RNA, 21 nt, Human
uccuuucagggaauuucagga

SEQ ID NO: 2889255 - RNA, 23 nt, Human
uccuuucagggaauuucaggaac

SEQ ID NO: 2889256 - RNA, 21 nt, Human
uccuuucaccccagggccuga

SEQ ID NO: 2889257 - RNA, 19 nt, Human
uccuuucaccccagggccu

SEQ ID NO: 2889258 - RNA, 18 nt, Human
uccuuucaccccagggcc

SEQ ID NO: 2889259 - RNA, 12 nt, Human
uccuuuauagag

SEQ ID NO: 2889260 - RNA, 21 nt, Human
uccuuccuguuagugguugug

SEQ ID NO: 2889261 - RNA, 16 nt, Human
uccuuuauauuuagug

SEQ ID NO: 2889262 - RNA, 21 nt, Human
uccuuuauguggaaaacagaa

SEQ ID NO: 2889263 - RNA, 17 nt, Human
uccuuuauuauuauuuu

SEQ ID NO: 2889264 - RNA, 16 nt, Human
uccuuucacaaccuuc

SEQ ID NO: 2889265 - RNA, 18 nt, Human
uccuuucacaaccuucug

SEQ ID NO: 2889266 - RNA, 19 nt, Human
uccuuucacaaccuucugu

SEQ ID NO: 2889267 - RNA, 13 nt, Human
ucgaggacaggga

SEQ ID NO: 2889268 - RNA, 21 nt, Human
ucgagcaguccugccucagcc

SEQ ID NO: 2889269 - RNA, 17 nt, Human
ucgagcaguccugccuc

SEQ ID NO: 2889270 - RNA, 13 nt, Human
ucgaccugccucg

SEQ ID NO: 2889271 - RNA, 19 nt, Human
ucgacacucaccaugaagc

SEQ ID NO: 2889272 - RNA, 18 nt, Human
ucgacaucacuguucaug

SEQ ID NO: 2889273 - RNA, 14 nt, Human
ucgaccccaaagcc

SEQ ID NO: 2889274 - RNA, 19 nt, Human
ucgaccccaaagccccuug

SEQ ID NO: 2889275 - RNA, 17 nt, Human
ucgaggacagggaggug

SEQ ID NO: 2889276 - RNA, 14 nt, Human
ucgaggacagggag

SEQ ID NO: 2889277 - RNA, 22 nt, Human
ucgagcaguccugccucagccu

SEQ ID NO: 2889278 - RNA, 18 nt, Human
ucgaggcccagcgaccuc

SEQ ID NO: 2889279 - RNA, 22 nt, Human
ucgccuuagcacuaccacuccu

SEQ ID NO: 2889280 - RNA, 18 nt, Human
ucgccuguggagcucagc

SEQ ID NO: 2889281 - RNA, 19 nt, Human
ucgccuguggagcucagcc

SEQ ID NO: 2889282 - RNA, 20 nt, Human
ucgccuguggagcucagccc

SEQ ID NO: 2889283 - RNA, 21 nt, Human
ucgccuguggagcucagcccc

SEQ ID NO: 2889284 - RNA, 14 nt, Human
ucgcucccucccag

SEQ ID NO: 2889285 - RNA, 13 nt, Human
ucgcucccuccca

SEQ ID NO: 2889286 - RNA, 12 nt, Human
uccuggggccag

SEQ ID NO: 2889287 - RNA, 13 nt, Human
uccuggggccagg

SEQ ID NO: 2889288 - RNA, 14 nt, Human
uccuggggccaggc

SEQ ID NO: 2889289 - RNA, 15 nt, Human
uccuggggccaggcc

SEQ ID NO: 2889290 - RNA, 16 nt, Human
uccuggggccaggccg

SEQ ID NO: 2889291 - RNA, 19 nt, Human
uccuggggaaccugacccc

SEQ ID NO: 2889292 - RNA, 18 nt, Human
uccuggggaaccugaccc

SEQ ID NO: 2889293 - RNA, 13 nt, Human
uccugggcucagg

SEQ ID NO: 2889294 - RNA, 12 nt, Human
uccugggcucag

SEQ ID NO: 2889295 - RNA, 15 nt, Human
uccuggggcguccag

SEQ ID NO: 2889296 - RNA, 18 nt, Human
uccuggggcucugugcag

SEQ ID NO: 2889297 - RNA, 16 nt, Human
uccuggggcucugugc

SEQ ID NO: 2889298 - RNA, 15 nt, Human
uccuggggcucugug

SEQ ID NO: 2889299 - RNA, 19 nt, Human
uccuggggcucugugcagg

SEQ ID NO: 2889300 - RNA, 21 nt, Human
uccuggggguucuuucuuccu

SEQ ID NO: 2889301 - RNA, 22 nt, Human
uccuggggguucuuucuuccuc

SEQ ID NO: 2889302 - RNA, 23 nt, Human
uccuggggguucuuucuuccucu

SEQ ID NO: 2889303 - RNA, 15 nt, Human
uccugcacuguuuaa

SEQ ID NO: 2889304 - RNA, 22 nt, Human
uccugucuuucugagcacacuu

SEQ ID NO: 2889305 - RNA, 16 nt, Human
uccugucuuuucaggu

SEQ ID NO: 2889306 - RNA, 19 nt, Human
uccugucuuuaaggaaaaa

SEQ ID NO: 2889307 - RNA, 15 nt, Human
uccugucuuucugag

SEQ ID NO: 2889308 - RNA, 18 nt, Human
uccugucuuuaaggaaaa

SEQ ID NO: 2889309 - RNA, 17 nt, Human
uccugucuuuaaggaaa

SEQ ID NO: 2889310 - RNA, 14 nt, Human
uccuggguaaugag

SEQ ID NO: 2889311 - RNA, 19 nt, Human
uccuggguucaagcgauuu

SEQ ID NO: 2889312 - RNA, 13 nt, Human
uccuguguacugu

SEQ ID NO: 2889313 - RNA, 15 nt, Human
uccuguguacugugu

SEQ ID NO: 2889314 - RNA, 16 nt, Human
uccuguguacuguguc

SEQ ID NO: 2889315 - RNA, 17 nt, Human
uccuguguacuguguca

SEQ ID NO: 2889316 - RNA, 13 nt, Human
uccuguggggaaa

SEQ ID NO: 2889317 - RNA, 15 nt, Human
uccuguggggaaagg

SEQ ID NO: 2889318 - RNA, 11 nt, Human
uccugugagga

SEQ ID NO: 2889319 - RNA, 18 nt, Human
uccugugaggagccccau

SEQ ID NO: 2889320 - RNA, 22 nt, Human
uccugugaggagccccaucugu

SEQ ID NO: 2889321 - RNA, 17 nt, Human
uccugugagguuuccca

SEQ ID NO: 2889322 - RNA, 18 nt, Human
uccugugagguuucccaa

SEQ ID NO: 2889323 - RNA, 19 nt, Human
uccugugagguuucccaau

SEQ ID NO: 2889324 - RNA, 18 nt, Human
uccugugacuucagcucu

SEQ ID NO: 2889325 - RNA, 21 nt, Human
uccugugauccacccaacccu

SEQ ID NO: 2889326 - RNA, 17 nt, Human
uccugugaucuuauuuu

SEQ ID NO: 2889327 - RNA, 12 nt, Human
uccugugcuggg

SEQ ID NO: 2889328 - RNA, 14 nt, Human
uccugugcuggggg

SEQ ID NO: 2889329 - RNA, 17 nt, Human
uccuguggaacccagca

SEQ ID NO: 2889330 - RNA, 18 nt, Human
uccuguggaacccagcag

SEQ ID NO: 2889331 - RNA, 22 nt, Human
uccuguggaacccagcaguucu

SEQ ID NO: 2889332 - RNA, 14 nt, Human
uccugugugugcgc

SEQ ID NO: 2889333 - RNA, 13 nt, Human
uccugugugugcg

SEQ ID NO: 2889334 - RNA, 18 nt, Human
uccugugugugcgccuac

SEQ ID NO: 2889335 - RNA, 24 nt, Human
uccugugucuugcaauggcagccu

SEQ ID NO: 2889336 - RNA, 23 nt, Human
uccugugucuugcaauggcagcc

SEQ ID NO: 2889337 - RNA, 16 nt, Human
uccugugucaauccag

SEQ ID NO: 2889338 - RNA, 15 nt, Human
uccugugugcaguga

SEQ ID NO: 2889339 - RNA, 16 nt, Human
uccuguuagcuccuca

SEQ ID NO: 2889340 - RNA, 23 nt, Human
uccuguuagcuccucacuguggu

SEQ ID NO: 2889341 - RNA, 21 nt, Human
uccuguuaauguauuuguuca

SEQ ID NO: 2889342 - RNA, 21 nt, Human
uccuguuggauuuguuuaaaa

SEQ ID NO: 2889343 - RNA, 20 nt, Human
uccuguuuuauaaugaaccc

SEQ ID NO: 2889344 - RNA, 21 nt, Human
uccuguuucccuucccuucca

SEQ ID NO: 2889345 - RNA, 22 nt, Human
uccuguuucccuucccuuccac

SEQ ID NO: 2889346 - RNA, 13 nt, Human
uccuguuucugaa

SEQ ID NO: 2889347 - RNA, 17 nt, Human
uccuguuucugaaaaga

SEQ ID NO: 2889348 - RNA, 18 nt, Human
uccuguuucugaaaagaa

SEQ ID NO: 2889349 - RNA, 19 nt, Human
uccuguuucugaaaagaaa

SEQ ID NO: 2889350 - RNA, 21 nt, Human
uccuguuucugaaaagaaaua

SEQ ID NO: 2889351 - RNA, 22 nt, Human
uccuguuucugaaaagaaauaa

SEQ ID NO: 2889352 - RNA, 18 nt, Human
uccuguuuauucccaucu

SEQ ID NO: 2889353 - RNA, 23 nt, Human
acugcagccucaaccuccugggc

SEQ ID NO: 2889354 - RNA, 19 nt, Human
acugcagcaaucuuugaaa

SEQ ID NO: 2889355 - RNA, 21 nt, Human
acugcagcaaucuuugaaaga

SEQ ID NO: 2889356 - RNA, 19 nt, Human
acugcaggcaucacagcua

SEQ ID NO: 2889357 - RNA, 15 nt, Human
acugcagcuuuacau

SEQ ID NO: 2889358 - RNA, 16 nt, Human
acugcagggacugcca

SEQ ID NO: 2889359 - RNA, 13 nt, Human
acugcagggccag

SEQ ID NO: 2889360 - RNA, 15 nt, Human
acugcagggccagga

SEQ ID NO: 2889361 - RNA, 16 nt, Human
acugcagggccaggac

SEQ ID NO: 2889362 - RNA, 17 nt, Human
acugcagggccaggacu

SEQ ID NO: 2889363 - RNA, 20 nt, Human
acugcagggccaggacugag

SEQ ID NO: 2889364 - RNA, 17 nt, Human
acugcagggacugccag

SEQ ID NO: 2889365 - RNA, 18 nt, Human
acugcagggacugccagu

SEQ ID NO: 2889366 - RNA, 22 nt, Human
uccuuaaaggcaccaucuaaua

SEQ ID NO: 2889367 - RNA, 16 nt, Human
uccuguuuuucugggu

SEQ ID NO: 2889368 - RNA, 17 nt, Human
uccuguuuuucugggug

SEQ ID NO: 2889369 - RNA, 20 nt, Human
uccuguuuuucuggguggcc

SEQ ID NO: 2889370 - RNA, 18 nt, Human
uccuuaaaauguaagauu

SEQ ID NO: 2889371 - RNA, 12 nt, Human
uccuuaaaaauc

SEQ ID NO: 2889372 - RNA, 18 nt, Human
uccuuaaaaaucacacug

SEQ ID NO: 2889373 - RNA, 19 nt, Human
uccuuaaaaaucacacugu

SEQ ID NO: 2889374 - RNA, 22 nt, Human
acugcagccucaaccuccuggg

SEQ ID NO: 2889375 - RNA, 21 nt, Human
acugcagccucaaccuccugg

SEQ ID NO: 2889376 - RNA, 19 nt, Human
acugcagccucaaccuccu

SEQ ID NO: 2889377 - RNA, 23 nt, Human
uccuuaaaggcaccaucuaauag

SEQ ID NO: 2889378 - RNA, 22 nt, Human
acugagggaccaacugggccca

SEQ ID NO: 2889379 - RNA, 14 nt, Human
acugagggacucug

SEQ ID NO: 2889380 - RNA, 17 nt, Human
acugagggacucugaag

SEQ ID NO: 2889381 - RNA, 18 nt, Human
acugagggacucugaagc

SEQ ID NO: 2889382 - RNA, 21 nt, Human
acugagggaccaacugggccc

SEQ ID NO: 2889383 - RNA, 20 nt, Human
acugagggaccaacugggcc

SEQ ID NO: 2889384 - RNA, 19 nt, Human
acugaggccugagacccag

SEQ ID NO: 2889385 - RNA, 20 nt, Human
acugaggccugagacccagg

SEQ ID NO: 2889386 - RNA, 21 nt, Human
acugaggccugagacccagga

SEQ ID NO: 2889387 - RNA, 20 nt, Human
acugaggaauuuucuuugug

SEQ ID NO: 2889388 - RNA, 19 nt, Human
acugaggacaaaguggagg

SEQ ID NO: 2889389 - RNA, 15 nt, Human
acugaggaccagcca

SEQ ID NO: 2889390 - RNA, 15 nt, Human
uccucuccccagcaa

SEQ ID NO: 2889391 - RNA, 16 nt, Human
acugaggaauuuucuu

SEQ ID NO: 2889392 - RNA, 22 nt, Human
acugcaaccuccgccucuuggg

SEQ ID NO: 2889393 - RNA, 16 nt, Human
acugcaaccuccgccu

SEQ ID NO: 2889394 - RNA, 15 nt, Human
acugcaaccucugcc

SEQ ID NO: 2889395 - RNA, 20 nt, Human
acugcaaccuucgccaccug

SEQ ID NO: 2889396 - RNA, 15 nt, Human
acugcaaucauaugu

SEQ ID NO: 2889397 - RNA, 17 nt, Human
acugcaaucauauguga

SEQ ID NO: 2889398 - RNA, 14 nt, Human
acugcaaccuccgc

SEQ ID NO: 2889399 - RNA, 13 nt, Human
acugcaaccuccg

SEQ ID NO: 2889400 - RNA, 18 nt, Human
acugcaacaggcuugugc

SEQ ID NO: 2889401 - RNA, 22 nt, Human
acugagggacucugaagccucu

SEQ ID NO: 2889402 - RNA, 16 nt, Human
acugagugccuuuugg

SEQ ID NO: 2889403 - RNA, 20 nt, Human
acugaguagcucuccugacu

SEQ ID NO: 2889404 - RNA, 12 nt, Human
uccugcagcaug

SEQ ID NO: 2889405 - RNA, 17 nt, Human
uccugcagcaugguccc

SEQ ID NO: 2889406 - RNA, 22 nt, Human
uccugcagcauggucccugccu

SEQ ID NO: 2889407 - RNA, 23 nt, Human
uccugaugguacaggaaagcuca

SEQ ID NO: 2889408 - RNA, 13 nt, Human
uccugcaaugaaa

SEQ ID NO: 2889409 - RNA, 14 nt, Human
uccugcaaugaaag

SEQ ID NO: 2889410 - RNA, 19 nt, Human
uccugaguagcuggauuac

SEQ ID NO: 2889411 - RNA, 20 nt, Human
uccugaguagcugggauuac

SEQ ID NO: 2889412 - RNA, 22 nt, Human
uccugaggggcaucugccccuc

SEQ ID NO: 2889413 - RNA, 21 nt, Human
uccugaggggcaucugccccu

SEQ ID NO: 2889414 - RNA, 17 nt, Human
uccugaggguccccacc

SEQ ID NO: 2889415 - RNA, 19 nt, Human
uccugaggguccccaccug

SEQ ID NO: 2889416 - RNA, 22 nt, Human
uccugaggguccccaccuggga

SEQ ID NO: 2889417 - RNA, 23 nt, Human
uccugauaugauuuaaaacaugu

SEQ ID NO: 2889418 - RNA, 24 nt, Human
uccugauaugauuuaaaacaugua

SEQ ID NO: 2889419 - RNA, 21 nt, Human
uccugauggcaggauggccug

SEQ ID NO: 2889420 - RNA, 18 nt, Human
uccugaugguacaggaaa

SEQ ID NO: 2889421 - RNA, 16 nt, Human
uccugaguggccaggg

SEQ ID NO: 2889422 - RNA, 17 nt, Human
uccugaguggccaggga

SEQ ID NO: 2889423 - RNA, 21 nt, Human
uccugauaaaacaacagcucg

SEQ ID NO: 2889424 - RNA, 15 nt, Human
uccugauaaagcaca

SEQ ID NO: 2889425 - RNA, 18 nt, Human
uccugauaaagcacagcu

SEQ ID NO: 2889426 - RNA, 20 nt, Human
uccugauaaagcacagcugu

SEQ ID NO: 2889427 - RNA, 21 nt, Human
uccugauaaagcacagcugua

SEQ ID NO: 2889428 - RNA, 16 nt, Human
acugcacagugcaucu

SEQ ID NO: 2889429 - RNA, 20 nt, Human
acugcacagcggccccugca

SEQ ID NO: 2889430 - RNA, 22 nt, Human
acugcacagcggccccugcauc

SEQ ID NO: 2889431 - RNA, 20 nt, Human
uccugaggggcaucugcccc

SEQ ID NO: 2889432 - RNA, 18 nt, Human
acugcacagugcaucuca

SEQ ID NO: 2889433 - RNA, 20 nt, Human
acugcaauccugucuuucug

SEQ ID NO: 2889434 - RNA, 15 nt, Human
acugcaaccuucacc

SEQ ID NO: 2889435 - RNA, 17 nt, Human
acugcaaccucugccuc

SEQ ID NO: 2889436 - RNA, 21 nt, Human
acugcaauccugucuuucuga

SEQ ID NO: 2889437 - RNA, 15 nt, Human
acugcaaugugaucu

SEQ ID NO: 2889438 - RNA, 19 nt, Human
uccugccucagccucccaa

SEQ ID NO: 2889439 - RNA, 20 nt, Human
uccugcaggccaggccagcu

SEQ ID NO: 2889440 - RNA, 19 nt, Human
uccugcaggccaggccagc

SEQ ID NO: 2889441 - RNA, 14 nt, Human
uccugcaggccagg

SEQ ID NO: 2889442 - RNA, 20 nt, Human
uccugccucgaacuggcugc

SEQ ID NO: 2889443 - RNA, 17 nt, Human
uccugccucagccuccg

SEQ ID NO: 2889444 - RNA, 14 nt, Human
uccugccuccgccu

SEQ ID NO: 2889445 - RNA, 18 nt, Human
uccugccucagccucccg

SEQ ID NO: 2889446 - RNA, 21 nt, Human
uccugccucagccucccgagu

SEQ ID NO: 2889447 - RNA, 12 nt, Human
uccugcuccaga

SEQ ID NO: 2889448 - RNA, 13 nt, Human
uccugcuccagaa

SEQ ID NO: 2889449 - RNA, 14 nt, Human
uccugcuccagaau

SEQ ID NO: 2889450 - RNA, 20 nt, Human
uccugcuccagaauuuggaa

SEQ ID NO: 2889451 - RNA, 15 nt, Human
uccagccccuuucca

SEQ ID NO: 2889452 - RNA, 16 nt, Human
uccagccccuuuccaa

SEQ ID NO: 2889453 - RNA, 17 nt, Human
uccagccccuuuccaaa

SEQ ID NO: 2889454 - RNA, 18 nt, Human
uccagccccuuuccaaaa

SEQ ID NO: 2889455 - RNA, 13 nt, Human
uccagcccgggag

SEQ ID NO: 2889456 - RNA, 14 nt, Human
uccagcccgggagc

SEQ ID NO: 2889457 - RNA, 23 nt, Human
uccagaccccuggcuuuucacug

SEQ ID NO: 2889458 - RNA, 11 nt, Human
uccagccuggg

SEQ ID NO: 2889459 - RNA, 23 nt, Human
uccagccugggcagccaggcugc

SEQ ID NO: 2889460 - RNA, 22 nt, Human
uccagccugggcagccaggcug

SEQ ID NO: 2889461 - RNA, 19 nt, Human
uccagccugggcagccagg

SEQ ID NO: 2889462 - RNA, 20 nt, Human
uccagccugggcaacagagc

SEQ ID NO: 2889463 - RNA, 13 nt, Human
uccagccugggca

SEQ ID NO: 2889464 - RNA, 12 nt, Human
uccagccugggc

SEQ ID NO: 2889465 - RNA, 13 nt, Human
uccagccugagca

SEQ ID NO: 2889466 - RNA, 15 nt, Human
uccagaccccuggcu

SEQ ID NO: 2889467 - RNA, 16 nt, Human
uccagaccccuggcuu

SEQ ID NO: 2889468 - RNA, 17 nt, Human
uccagaccccuggcuuu

SEQ ID NO: 2889469 - RNA, 18 nt, Human
uccagaccccuggcuuuu

SEQ ID NO: 2889470 - RNA, 13 nt, Human
accuugaaugcug

SEQ ID NO: 2889471 - RNA, 15 nt, Human
accuugaaugcugcc

SEQ ID NO: 2889472 - RNA, 16 nt, Human
accuugaaugcugcca

SEQ ID NO: 2889473 - RNA, 17 nt, Human
accuugaaugcugccag

SEQ ID NO: 2889474 - RNA, 18 nt, Human
accuugaaugcugccagu

SEQ ID NO: 2889475 - RNA, 17 nt, Human
accuuuguacagcccag

SEQ ID NO: 2889476 - RNA, 18 nt, Human
accuuuguacagcccaga

SEQ ID NO: 2889477 - RNA, 22 nt, Human
accuuuguacagcccagaggcc

SEQ ID NO: 2889478 - RNA, 22 nt, Human
accuuuguagcacucaggcucu

SEQ ID NO: 2889479 - RNA, 13 nt, Human
uccacuacuccgu

SEQ ID NO: 2889480 - RNA, 17 nt, Human
uccacguauuccccuuc

SEQ ID NO: 2889481 - RNA, 18 nt, Human
uccacguauuccccuucc

SEQ ID NO: 2889482 - RNA, 20 nt, Human
uccacguauuccccuuccca

SEQ ID NO: 2889483 - RNA, 18 nt, Human
uccagaaucuaaagccag

SEQ ID NO: 2889484 - RNA, 19 nt, Human
uccagaaucuaaagccagu

SEQ ID NO: 2889485 - RNA, 14 nt, Human
uccagaaucuaaag

SEQ ID NO: 2889486 - RNA, 13 nt, Human
uccagaccccugg

SEQ ID NO: 2889487 - RNA, 16 nt, Human
uccagaaugcuguaca

SEQ ID NO: 2889488 - RNA, 15 nt, Human
uccagaaugcuguac

SEQ ID NO: 2889489 - RNA, 13 nt, Human
uccagaaugcugu

SEQ ID NO: 2889490 - RNA, 17 nt, Human
uccacucugauagaauu

SEQ ID NO: 2889491 - RNA, 18 nt, Human
uccacucugauagaauua

SEQ ID NO: 2889492 - RNA, 19 nt, Human
uccacucugauagaauuau

SEQ ID NO: 2889493 - RNA, 21 nt, Human
accuuaggccuuccucucucc

SEQ ID NO: 2889494 - RNA, 18 nt, Human
accuuaggccuuccucuc

SEQ ID NO: 2889495 - RNA, 20 nt, Human
accuuaggccuuccucucuc

SEQ ID NO: 2889496 - RNA, 14 nt, Human
accuuaggccuucc

SEQ ID NO: 2889497 - RNA, 15 nt, Human
accuuaggccuuccu

SEQ ID NO: 2889498 - RNA, 16 nt, Human
accuuaggccuuccuc

SEQ ID NO: 2889499 - RNA, 17 nt, Human
accuuaggccuuccucu

SEQ ID NO: 2889500 - RNA, 14 nt, Human
accuuagccugccc

SEQ ID NO: 2889501 - RNA, 13 nt, Human
accuuaggccuuc

SEQ ID NO: 2889502 - RNA, 22 nt, Human
accuuaggcccggagcugcccc

SEQ ID NO: 2889503 - RNA, 22 nt, Human
accuuagcuggcauuacagcug

SEQ ID NO: 2889504 - RNA, 21 nt, Human
accuuagcuggcauuacagcu

SEQ ID NO: 2889505 - RNA, 21 nt, Human
accuuagauuuaguaguguaa

SEQ ID NO: 2889506 - RNA, 13 nt, Human
accuuagcucccu

SEQ ID NO: 2889507 - RNA, 19 nt, Human
accuuagcucccucccgca

SEQ ID NO: 2889508 - RNA, 20 nt, Human
accuuagcucccucccgcac

SEQ ID NO: 2889509 - RNA, 23 nt, Human
accuuagcucccucccgcacccc

SEQ ID NO: 2889510 - RNA, 22 nt, Human
accuggucacaggacucugccu

SEQ ID NO: 2889511 - RNA, 23 nt, Human
accuggucacaggacucugccuc

SEQ ID NO: 2889512 - RNA, 15 nt, Human
accuuaccaacuuuc

SEQ ID NO: 2889513 - RNA, 16 nt, Human
accuuaccaacuuucu

SEQ ID NO: 2889514 - RNA, 17 nt, Human
accuuaccaacuuucug

SEQ ID NO: 2889515 - RNA, 18 nt, Human
accuuaccaacuuucugu

SEQ ID NO: 2889516 - RNA, 21 nt, Human
accuuacuguggaggaaggau

SEQ ID NO: 2889517 - RNA, 19 nt, Human
accuuaccaacuuucugua

SEQ ID NO: 2889518 - RNA, 15 nt, Human
accuuacuguggagg

SEQ ID NO: 2889519 - RNA, 20 nt, Human
accuuaccaacuuucuguaa

SEQ ID NO: 2889520 - RNA, 14 nt, Human
accuuaccccuggc

SEQ ID NO: 2889521 - RNA, 22 nt, Human
accuuaccccuggcuguuugga

SEQ ID NO: 2889522 - RNA, 17 nt, Human
accuuacgaucaggcac

SEQ ID NO: 2889523 - RNA, 18 nt, Human
accuuacgaucaggcaca

SEQ ID NO: 2889524 - RNA, 19 nt, Human
accuuacgaucaggcacag

SEQ ID NO: 2889525 - RNA, 20 nt, Human
accuuacgaucaggcacagg

SEQ ID NO: 2889526 - RNA, 21 nt, Human
accuuacgaucaggcacaggu

SEQ ID NO: 2889527 - RNA, 22 nt, Human
accugguuaaacaaaccagaau

SEQ ID NO: 2889528 - RNA, 12 nt, Human
accuuaagaccu

SEQ ID NO: 2889529 - RNA, 22 nt, Human
accuuaagaccuacuguucuaa

SEQ ID NO: 2889530 - RNA, 19 nt, Human
accuuaucacugcauuauu

SEQ ID NO: 2889531 - RNA, 23 nt, Human
accuuaucacugcauuauucucu

SEQ ID NO: 2889532 - RNA, 15 nt, Human
accuuauccugcauu

SEQ ID NO: 2889533 - RNA, 16 nt, Human
accuuauccugcauug

SEQ ID NO: 2889534 - RNA, 18 nt, Human
accuuauccugcauuguu

SEQ ID NO: 2889535 - RNA, 14 nt, Human
accuucccaaacgc

SEQ ID NO: 2889536 - RNA, 19 nt, Human
accuuccauggcucuuuuu

SEQ ID NO: 2889537 - RNA, 17 nt, Human
accuuccagcuccugua

SEQ ID NO: 2889538 - RNA, 14 nt, Human
accuuccaggaccc

SEQ ID NO: 2889539 - RNA, 15 nt, Human
accuuccaggacccc

SEQ ID NO: 2889540 - RNA, 13 nt, Human
accuuccagcucc

SEQ ID NO: 2889541 - RNA, 14 nt, Human
accuuccagcuccu

SEQ ID NO: 2889542 - RNA, 23 nt, Human
accuucucccucauuucaggagc

SEQ ID NO: 2889543 - RNA, 22 nt, Human
accuucuaggacgccacccagc

SEQ ID NO: 2889544 - RNA, 19 nt, Human
accuucccaaacgccuccc

SEQ ID NO: 2889545 - RNA, 21 nt, Human
accuucccaaacgccuccccu

SEQ ID NO: 2889546 - RNA, 22 nt, Human
accuucccaaacgccuccccug

SEQ ID NO: 2889547 - RNA, 12 nt, Human
accuucuguggc

SEQ ID NO: 2889548 - RNA, 13 nt, Human
accuucuguggcu

SEQ ID NO: 2889549 - RNA, 15 nt, Human
accuucuguggcuca

SEQ ID NO: 2889550 - RNA, 20 nt, Human
accuucuucagccaccucuc

SEQ ID NO: 2889551 - RNA, 18 nt, Human
accuucuucaggcugccu

SEQ ID NO: 2889552 - RNA, 19 nt, Human
accuucuucaggcugccua

SEQ ID NO: 2889553 - RNA, 19 nt, Human
accuucuucagccaccucu

SEQ ID NO: 2889554 - RNA, 16 nt, Human
accuucuguggcucac

SEQ ID NO: 2889555 - RNA, 14 nt, Human
accuugacagggca

SEQ ID NO: 2889556 - RNA, 15 nt, Human
accuugacagggcac

SEQ ID NO: 2889557 - RNA, 17 nt, Human
accuucuuucacucugu

SEQ ID NO: 2889558 - RNA, 15 nt, Human
accuucuuauuauau

SEQ ID NO: 2889559 - RNA, 19 nt, Human
accuucuuauuauauauau

SEQ ID NO: 2889560 - RNA, 18 nt, Human
uccaagcuccaucuccac

SEQ ID NO: 2889561 - RNA, 13 nt, Human
uccaaccuuccca

SEQ ID NO: 2889562 - RNA, 12 nt, Human
uccaagcucccu

SEQ ID NO: 2889563 - RNA, 14 nt, Human
uccaagcucccugc

SEQ ID NO: 2889564 - RNA, 15 nt, Human
uccaagcucccugcc

SEQ ID NO: 2889565 - RNA, 18 nt, Human
uccaagcucccugcccca

SEQ ID NO: 2889566 - RNA, 17 nt, Human
uccaagcugagagucua

SEQ ID NO: 2889567 - RNA, 14 nt, Human
uccaaccuucccaa

SEQ ID NO: 2889568 - RNA, 13 nt, Human
uccaacagugagu

SEQ ID NO: 2889569 - RNA, 13 nt, Human
uccaacguuugga

SEQ ID NO: 2889570 - RNA, 15 nt, Human
uccaacguuuggaag

SEQ ID NO: 2889571 - RNA, 21 nt, Human
uccaacguuuggaagauccug

SEQ ID NO: 2889572 - RNA, 21 nt, Human
uccaacaccacagacacacac

SEQ ID NO: 2889573 - RNA, 22 nt, Human
uccaacaccacagacacacaca

SEQ ID NO: 2889574 - RNA, 17 nt, Human
uccaacagaacuaaaug

SEQ ID NO: 2889575 - RNA, 20 nt, Human
uccaacagaacuaaauguuc

SEQ ID NO: 2889576 - RNA, 17 nt, Human
uccaacaccacagacac

SEQ ID NO: 2889577 - RNA, 18 nt, Human
uccaacaccacagacaca

SEQ ID NO: 2889578 - RNA, 19 nt, Human
uccaacaccacagacacac

SEQ ID NO: 2889579 - RNA, 20 nt, Human
uccaacaccacagacacaca

SEQ ID NO: 2889580 - RNA, 16 nt, Human
uccaaaugcaauuuga

SEQ ID NO: 2889581 - RNA, 16 nt, Human
uccaacaccacagaca

SEQ ID NO: 2889582 - RNA, 14 nt, Human
uccaaauaauaaag

SEQ ID NO: 2889583 - RNA, 15 nt, Human
uccaaauaauaaagu

SEQ ID NO: 2889584 - RNA, 16 nt, Human
uccaaauaauaaaguc

SEQ ID NO: 2889585 - RNA, 15 nt, Human
uccaaaugcagcuuu

SEQ ID NO: 2889586 - RNA, 14 nt, Human
uccaaaugcagcuu

SEQ ID NO: 2889587 - RNA, 11 nt, Human
uccaagcuggu

SEQ ID NO: 2889588 - RNA, 14 nt, Human
uccaaguuuccaaa

SEQ ID NO: 2889589 - RNA, 15 nt, Human
uccaaguuuccaaac

SEQ ID NO: 2889590 - RNA, 14 nt, Human
uccacaggucuaga

SEQ ID NO: 2889591 - RNA, 15 nt, Human
uccacaggucuagac

SEQ ID NO: 2889592 - RNA, 16 nt, Human
uccacaggucuagacu

SEQ ID NO: 2889593 - RNA, 17 nt, Human
uccacaggucuagacua

SEQ ID NO: 2889594 - RNA, 23 nt, Human
uccaauaagacacucaaauauga

SEQ ID NO: 2889595 - RNA, 13 nt, Human
uccaauauuucug

SEQ ID NO: 2889596 - RNA, 15 nt, Human
uccaauauuucugcu

SEQ ID NO: 2889597 - RNA, 16 nt, Human
uccaauauuucugcuu

SEQ ID NO: 2889598 - RNA, 23 nt, Human
uccaauauuucugcuuucuuuga

SEQ ID NO: 2889599 - RNA, 20 nt, Human
uccaaucagagaccaggccc

SEQ ID NO: 2889600 - RNA, 21 nt, Human
uccaaucagagaccaggcccu

SEQ ID NO: 2889601 - RNA, 23 nt, Human
uccaaucagagaccaggcccugg

SEQ ID NO: 2889602 - RNA, 20 nt, Human
uccaccagcaucaccugccu

SEQ ID NO: 2889603 - RNA, 22 nt, Human
uccaccagcccauggcccugug

SEQ ID NO: 2889604 - RNA, 19 nt, Human
uccaccagcaucaccugcc

SEQ ID NO: 2889605 - RNA, 12 nt, Human
uccaccagcauc

SEQ ID NO: 2889606 - RNA, 22 nt, Human
uccaccaccucccucaccaaca

SEQ ID NO: 2889607 - RNA, 13 nt, Human
uccaccaccgccc

SEQ ID NO: 2889608 - RNA, 22 nt, Human
uccaccaccgcccgucugugug

SEQ ID NO: 2889609 - RNA, 14 nt, Human
uccaccaccucccu

SEQ ID NO: 2889610 - RNA, 16 nt, Human
uccaccaccucccuca

SEQ ID NO: 2889611 - RNA, 17 nt, Human
uccaccaccucccucac

SEQ ID NO: 2889612 - RNA, 18 nt, Human
uccaccaccucccucacc

SEQ ID NO: 2889613 - RNA, 17 nt, Human
uccaccaagaaagcagg

SEQ ID NO: 2889614 - RNA, 12 nt, Human
uccacaguugcc

SEQ ID NO: 2889615 - RNA, 14 nt, Human
uccacaguugccac

SEQ ID NO: 2889616 - RNA, 16 nt, Human
uccacaguugccacca

SEQ ID NO: 2889617 - RNA, 19 nt, Human
uccacaguugccaccaccu

SEQ ID NO: 2889618 - RNA, 20 nt, Human
uccacaguugccaccaccuc

SEQ ID NO: 2889619 - RNA, 21 nt, Human
uccacaguugccaccaccucu

SEQ ID NO: 2889620 - RNA, 13 nt, Human
uccacauuucuaa

SEQ ID NO: 2889621 - RNA, 14 nt, Human
uccacauuucuaaa

SEQ ID NO: 2889622 - RNA, 16 nt, Human
uccacauuucuaaaau

SEQ ID NO: 2889623 - RNA, 15 nt, Human
uccacauuucuaaaa

SEQ ID NO: 2889624 - RNA, 17 nt, Human
uccaaagucucuaauuc

SEQ ID NO: 2889625 - RNA, 18 nt, Human
uccaaagucucuaauucu

SEQ ID NO: 2889626 - RNA, 13 nt, Human
uccaaagucucua

SEQ ID NO: 2889627 - RNA, 14 nt, Human
uccaaagucucuaa

SEQ ID NO: 2889628 - RNA, 13 nt, Human
ucauuuuccaaua

SEQ ID NO: 2889629 - RNA, 14 nt, Human
ucauuuuccaauac

SEQ ID NO: 2889630 - RNA, 15 nt, Human
ucauuuuccccccac

SEQ ID NO: 2889631 - RNA, 15 nt, Human
ucauuuuauauugaa

SEQ ID NO: 2889632 - RNA, 16 nt, Human
ucauuuuauauugaaa

SEQ ID NO: 2889633 - RNA, 17 nt, Human
ucauuuuauauugaaaa

SEQ ID NO: 2889634 - RNA, 18 nt, Human
ucauuuuauauugaaaaa

SEQ ID NO: 2889635 - RNA, 13 nt, Human
ucauuuuuucuua

SEQ ID NO: 2889636 - RNA, 17 nt, Human
ucauuuuuuuaauuuau

SEQ ID NO: 2889637 - RNA, 21 nt, Human
ucauuugagcagggcucagcg

SEQ ID NO: 2889638 - RNA, 14 nt, Human
ucauuugcugugaa

SEQ ID NO: 2889639 - RNA, 22 nt, Human
ucauuuguuaaaauuaucaaua

SEQ ID NO: 2889640 - RNA, 16 nt, Human
ucauuugugugcucau

SEQ ID NO: 2889641 - RNA, 13 nt, Human
ucauuugugucaa

SEQ ID NO: 2889642 - RNA, 15 nt, Human
ucauuugugucaaug

SEQ ID NO: 2889643 - RNA, 12 nt, Human
ucauuuguguca

SEQ ID NO: 2889644 - RNA, 21 nt, Human
ucauuuguggugauauagaau

SEQ ID NO: 2889645 - RNA, 23 nt, Human
ucauuuguggugauauagaauua

SEQ ID NO: 2889646 - RNA, 18 nt, Human
ucauuugugccagaaugc

SEQ ID NO: 2889647 - RNA, 21 nt, Human
ucauuuguggcagucccuuau

SEQ ID NO: 2889648 - RNA, 18 nt, Human
ucauuuuacccuuggcuc

SEQ ID NO: 2889649 - RNA, 15 nt, Human
ucauuuuaggaaagg

SEQ ID NO: 2889650 - RNA, 15 nt, Human
ucauuuguuuuucuc

SEQ ID NO: 2889651 - RNA, 12 nt, Human
ucauuuuaaugu

SEQ ID NO: 2889652 - RNA, 13 nt, Human
ucauuuuaaugua

SEQ ID NO: 2889653 - RNA, 15 nt, Human
ucauuuuaauguaaa

SEQ ID NO: 2889654 - RNA, 17 nt, Human
ucauuuuaauguaaaga

SEQ ID NO: 2889655 - RNA, 19 nt, Human
ucauuuuaauguaaagauu

SEQ ID NO: 2889656 - RNA, 15 nt, Human
ucauuuguuggaaug

SEQ ID NO: 2889657 - RNA, 12 nt, Human
ucauuuguugug

SEQ ID NO: 2889658 - RNA, 16 nt, Human
ucauuuguugugaugu

SEQ ID NO: 2889659 - RNA, 20 nt, Human
ucauuuguugugaugucuuu

SEQ ID NO: 2889660 - RNA, 22 nt, Human
ucauuuguugugaugucuuuuc

SEQ ID NO: 2889661 - RNA, 22 nt, Human
ucauuuguucugggaguauaaa

SEQ ID NO: 2889662 - RNA, 18 nt, Human
accugcucuccucuugcc

SEQ ID NO: 2889663 - RNA, 17 nt, Human
accugcucuccucuugc

SEQ ID NO: 2889664 - RNA, 19 nt, Human
ucauuugagcagggcucag

SEQ ID NO: 2889665 - RNA, 15 nt, Human
accugcuuugacuga

SEQ ID NO: 2889666 - RNA, 13 nt, Human
accugcuuuuuga

SEQ ID NO: 2889667 - RNA, 15 nt, Human
accugcuuuuugaaa

SEQ ID NO: 2889668 - RNA, 16 nt, Human
accugcuuuuugaaau

SEQ ID NO: 2889669 - RNA, 17 nt, Human
accugcuuuuugaaaug

SEQ ID NO: 2889670 - RNA, 18 nt, Human
accugcuuuuugaaauga

SEQ ID NO: 2889671 - RNA, 21 nt, Human
accugcuuuuugaaaugaaau

SEQ ID NO: 2889672 - RNA, 23 nt, Human
accugcuuuuugaaaugaaauuu

SEQ ID NO: 2889673 - RNA, 17 nt, Human
accuggaaaaauuccag

SEQ ID NO: 2889674 - RNA, 19 nt, Human
accuggaaaaauuccagaa

SEQ ID NO: 2889675 - RNA, 19 nt, Human
accugcucuccucuugcca

SEQ ID NO: 2889676 - RNA, 19 nt, Human
accugcugaagggcagagg

SEQ ID NO: 2889677 - RNA, 23 nt, Human
ucauccacugugccaugugccag

SEQ ID NO: 2889678 - RNA, 21 nt, Human
ucauccacugugccaugugcc

SEQ ID NO: 2889679 - RNA, 19 nt, Human
ucauccacugugccaugug

SEQ ID NO: 2889680 - RNA, 20 nt, Human
ucaugaauucuuaugcuuau

SEQ ID NO: 2889681 - RNA, 22 nt, Human
ucaugaauuuauugcacauugu

SEQ ID NO: 2889682 - RNA, 23 nt, Human
ucaugaauuuauugcacauuguu

SEQ ID NO: 2889683 - RNA, 19 nt, Human
ucaugacauguuauauauu

SEQ ID NO: 2889684 - RNA, 21 nt, Human
ucaugacauguuauauauuuu

SEQ ID NO: 2889685 - RNA, 16 nt, Human
ucaugacaagcauuuu

SEQ ID NO: 2889686 - RNA, 14 nt, Human
ucaugacauguuau

SEQ ID NO: 2889687 - RNA, 17 nt, Human
ucaugacauguuauaua

SEQ ID NO: 2889688 - RNA, 14 nt, Human
accuccucccuguu

SEQ ID NO: 2889689 - RNA, 15 nt, Human
accuccucccuguua

SEQ ID NO: 2889690 - RNA, 13 nt, Human
ucaugaauuuuac

SEQ ID NO: 2889691 - RNA, 14 nt, Human
ucaugaauuuuaca

SEQ ID NO: 2889692 - RNA, 16 nt, Human
ucaugaauuuuacaug

SEQ ID NO: 2889693 - RNA, 19 nt, Human
ucaugaauuuuacauggua

SEQ ID NO: 2889694 - RNA, 14 nt, Human
ucaugucaggccug

SEQ ID NO: 2889695 - RNA, 16 nt, Human
ucaugucaggccugug

SEQ ID NO: 2889696 - RNA, 17 nt, Human
ucaugucaggccugugu

SEQ ID NO: 2889697 - RNA, 19 nt, Human
ucaugucaggccugugugu

SEQ ID NO: 2889698 - RNA, 21 nt, Human
ucaugccagcuacuuccuccu

SEQ ID NO: 2889699 - RNA, 23 nt, Human
ucaugccagcuacuuccuccucc

SEQ ID NO: 2889700 - RNA, 22 nt, Human
ucaugccaccauggccagccaa

SEQ ID NO: 2889701 - RNA, 12 nt, Human
ucaugccagcua

SEQ ID NO: 2889702 - RNA, 19 nt, Human
ucaugccaccauggccagc

SEQ ID NO: 2889703 - RNA, 17 nt, Human
ucaugcaugucaaacau

SEQ ID NO: 2889704 - RNA, 20 nt, Human
ucaugaggaggggccccccu

SEQ ID NO: 2889705 - RNA, 20 nt, Human
ucaugaggaaagcaguugaa

SEQ ID NO: 2889706 - RNA, 20 nt, Human
ucauguuauauuuaaugcau

SEQ ID NO: 2889707 - RNA, 22 nt, Human
ucauguuauauuuaaugcauua

SEQ ID NO: 2889708 - RNA, 14 nt, Human
ucauguguucccuu

SEQ ID NO: 2889709 - RNA, 15 nt, Human
ucauguguucccuuu

SEQ ID NO: 2889710 - RNA, 17 nt, Human
ucauguguucccuuugu

SEQ ID NO: 2889711 - RNA, 13 nt, Human
ucaugucuggcua

SEQ ID NO: 2889712 - RNA, 22 nt, Human
ucauguugcacacccacucagc

SEQ ID NO: 2889713 - RNA, 13 nt, Human
ucauguuggucaa

SEQ ID NO: 2889714 - RNA, 13 nt, Human
ucauguuguuaaa

SEQ ID NO: 2889715 - RNA, 19 nt, Human
ucauguuguuaaaauuaug

SEQ ID NO: 2889716 - RNA, 14 nt, Human
ucauguuuugguga

SEQ ID NO: 2889717 - RNA, 15 nt, Human
ucauguuuuggugaa

SEQ ID NO: 2889718 - RNA, 14 nt, Human
ucauguuuugugac

SEQ ID NO: 2889719 - RNA, 15 nt, Human
ucauguuuugugacu

SEQ ID NO: 2889720 - RNA, 16 nt, Human
ucauguuuugugacua

SEQ ID NO: 2889721 - RNA, 17 nt, Human
ucauguuuugugacuau

SEQ ID NO: 2889722 - RNA, 23 nt, Human
ucauuccuugagaaaaacaauga

SEQ ID NO: 2889723 - RNA, 15 nt, Human
ucauuccuuccacua

SEQ ID NO: 2889724 - RNA, 21 nt, Human
ucauuccuucuuuuuaaaaug

SEQ ID NO: 2889725 - RNA, 19 nt, Human
ucauuaaccgaugcuuuac

SEQ ID NO: 2889726 - RNA, 23 nt, Human
ucauuaaccgaugcuuuaccaaa

SEQ ID NO: 2889727 - RNA, 15 nt, Human
ucauuaaauggggcu

SEQ ID NO: 2889728 - RNA, 14 nt, Human
ucauuaaauguuug

SEQ ID NO: 2889729 - RNA, 15 nt, Human
ucauuaaauguuuga

SEQ ID NO: 2889730 - RNA, 16 nt, Human
ucauuaaauguuugac

SEQ ID NO: 2889731 - RNA, 14 nt, Human
ucauugagaguuuu

SEQ ID NO: 2889732 - RNA, 18 nt, Human
ucauugagaguuuugucu

SEQ ID NO: 2889733 - RNA, 19 nt, Human
ucauugagaguuuugucuu

SEQ ID NO: 2889734 - RNA, 21 nt, Human
ucauugcuuugaagcaguugu

SEQ ID NO: 2889735 - RNA, 14 nt, Human
ucauugcugucugc

SEQ ID NO: 2889736 - RNA, 21 nt, Human
ucauugcugucugcagccuug

SEQ ID NO: 2889737 - RNA, 13 nt, Human
ucauucuccugcc

SEQ ID NO: 2889738 - RNA, 14 nt, Human
ucauucuccugccu

SEQ ID NO: 2889739 - RNA, 15 nt, Human
ucauucuccugccug

SEQ ID NO: 2889740 - RNA, 16 nt, Human
ucauucuccugccugu

SEQ ID NO: 2889741 - RNA, 21 nt, Human
ucauucgcucccacauucuga

SEQ ID NO: 2889742 - RNA, 15 nt, Human
ucauucgggaugauu

SEQ ID NO: 2889743 - RNA, 12 nt, Human
ucauucuccugc

SEQ ID NO: 2889744 - RNA, 15 nt, Human
ucauucuaucaagcc

SEQ ID NO: 2889745 - RNA, 18 nt, Human
ucauucucauaauuccua

SEQ ID NO: 2889746 - RNA, 21 nt, Human
ucauucucauaauuccuacag

SEQ ID NO: 2889747 - RNA, 23 nt, Human
ucauucucauaauuccuacagca

SEQ ID NO: 2889748 - RNA, 15 nt, Human
accucgcaucauugc

SEQ ID NO: 2889749 - RNA, 16 nt, Human
ucauuguaaacaaacu

SEQ ID NO: 2889750 - RNA, 19 nt, Human
ucauuguaaacaaacucuu

SEQ ID NO: 2889751 - RNA, 21 nt, Human
ucauuguaaacaaacucuuga

SEQ ID NO: 2889752 - RNA, 17 nt, Human
ucauuggucuaauuuau

SEQ ID NO: 2889753 - RNA, 14 nt, Human
ucauuguaaacaaa

SEQ ID NO: 2889754 - RNA, 18 nt, Human
ucauuggaacaacugaua

SEQ ID NO: 2889755 - RNA, 23 nt, Human
ucauugcuuugaagcaguugugu

SEQ ID NO: 2889756 - RNA, 19 nt, Human
accucuacccaaacccuag

SEQ ID NO: 2889757 - RNA, 20 nt, Human
accucuacccaaacccuagg

SEQ ID NO: 2889758 - RNA, 21 nt, Human
accucuacccaaacccuaggu

SEQ ID NO: 2889759 - RNA, 14 nt, Human
accucuacuuucca

SEQ ID NO: 2889760 - RNA, 15 nt, Human
accucuacuuuccag

SEQ ID NO: 2889761 - RNA, 23 nt, Human
accucucuccuuugcugaggccu

SEQ ID NO: 2889762 - RNA, 12 nt, Human
accucucugucc

SEQ ID NO: 2889763 - RNA, 14 nt, Human
accucucugucccu

SEQ ID NO: 2889764 - RNA, 15 nt, Human
accucucugucccuu

SEQ ID NO: 2889765 - RNA, 16 nt, Human
accucucugucccuug

SEQ ID NO: 2889766 - RNA, 19 nt, Human
accucucugucccuugcug

SEQ ID NO: 2889767 - RNA, 22 nt, Human
accucucugucccuugcuguau

SEQ ID NO: 2889768 - RNA, 14 nt, Human
accucuccucaugu

SEQ ID NO: 2889769 - RNA, 14 nt, Human
accucucuuuuuca

SEQ ID NO: 2889770 - RNA, 20 nt, Human
accucugaaacccuggacca

SEQ ID NO: 2889771 - RNA, 18 nt, Human
accucaccccgaggcccu

SEQ ID NO: 2889772 - RNA, 19 nt, Human
accucaccccgaggcccug

SEQ ID NO: 2889773 - RNA, 20 nt, Human
accucaccccgaggcccugc

SEQ ID NO: 2889774 - RNA, 21 nt, Human
accucaccccgaggcccugca

SEQ ID NO: 2889775 - RNA, 14 nt, Human
accucacagugacc

SEQ ID NO: 2889776 - RNA, 15 nt, Human
accucacagugaccc

SEQ ID NO: 2889777 - RNA, 19 nt, Human
accucacagugacccuucc

SEQ ID NO: 2889778 - RNA, 20 nt, Human
accucacagugacccuuccc

SEQ ID NO: 2889779 - RNA, 21 nt, Human
accucacagugacccuuccca

SEQ ID NO: 2889780 - RNA, 14 nt, Human
accucaauguuuga

SEQ ID NO: 2889781 - RNA, 17 nt, Human
accucacaccucacucu

SEQ ID NO: 2889782 - RNA, 23 nt, Human
accucaagugaucugcccaccuc

SEQ ID NO: 2889783 - RNA, 20 nt, Human
accucaagugauccucccac

SEQ ID NO: 2889784 - RNA, 19 nt, Human
accucaagugaucugccca

SEQ ID NO: 2889785 - RNA, 18 nt, Human
accucagaguauggagcu

SEQ ID NO: 2889786 - RNA, 10 nt, Human
accucagccu

SEQ ID NO: 2889787 - RNA, 15 nt, Human
accucagccuagacc

SEQ ID NO: 2889788 - RNA, 13 nt, Human
accucagccuaga

SEQ ID NO: 2889789 - RNA, 15 nt, Human
accuccccagccccu

SEQ ID NO: 2889790 - RNA, 16 nt, Human
accuccccagccccua

SEQ ID NO: 2889791 - RNA, 19 nt, Human
accuccccagccccuagcc

SEQ ID NO: 2889792 - RNA, 20 nt, Human
accuccgccucuuggguuca

SEQ ID NO: 2889793 - RNA, 23 nt, Human
accuccccagccccuagcccagg

SEQ ID NO: 2889794 - RNA, 23 nt, Human
accuccuacgucaaacaugaagu

SEQ ID NO: 2889795 - RNA, 12 nt, Human
accuaacuguau

SEQ ID NO: 2889796 - RNA, 15 nt, Human
accuaacuguaucuu

SEQ ID NO: 2889797 - RNA, 16 nt, Human
accuaacuguaucuug

SEQ ID NO: 2889798 - RNA, 16 nt, Human
accuaagucucuguga

SEQ ID NO: 2889799 - RNA, 15 nt, Human
accuaagucucugug

SEQ ID NO: 2889800 - RNA, 18 nt, Human
accuaaguccuuuaugug

SEQ ID NO: 2889801 - RNA, 14 nt, Human
accuaagucucugu

SEQ ID NO: 2889802 - RNA, 13 nt, Human
accuaaguacugu

SEQ ID NO: 2889803 - RNA, 14 nt, Human
accuaaguacugua

SEQ ID NO: 2889804 - RNA, 15 nt, Human
accuaaguacuguaa

SEQ ID NO: 2889805 - RNA, 17 nt, Human
accuaaguacuguaaua

SEQ ID NO: 2889806 - RNA, 23 nt, Human
accuaaguacuguaauaauaccu

SEQ ID NO: 2889807 - RNA, 16 nt, Human
accgccugucucuuua

SEQ ID NO: 2889808 - RNA, 18 nt, Human
accuaagucucugugaau

SEQ ID NO: 2889809 - RNA, 18 nt, Human
accuaagugacauuugua

SEQ ID NO: 2889810 - RNA, 16 nt, Human
accuagagccagacca

SEQ ID NO: 2889811 - RNA, 12 nt, Human
accuagauuuuu

SEQ ID NO: 2889812 - RNA, 13 nt, Human
accuagcaauucc

SEQ ID NO: 2889813 - RNA, 14 nt, Human
accuagcaauucca

SEQ ID NO: 2889814 - RNA, 18 nt, Human
accuagcaauuccaucac

SEQ ID NO: 2889815 - RNA, 12 nt, Human
accuaaccugug

SEQ ID NO: 2889816 - RNA, 13 nt, Human
accuaaccugugu

SEQ ID NO: 2889817 - RNA, 14 nt, Human
accuaaccuguguc

SEQ ID NO: 2889818 - RNA, 15 nt, Human
accuaaccugugucu

SEQ ID NO: 2889819 - RNA, 16 nt, Human
accuaaccugugucug

SEQ ID NO: 2889820 - RNA, 17 nt, Human
accuaaccugugucugc

SEQ ID NO: 2889821 - RNA, 17 nt, Human
accuaaaaaaagagaau

SEQ ID NO: 2889822 - RNA, 19 nt, Human
accuaacgcccuauuuuug

SEQ ID NO: 2889823 - RNA, 13 nt, Human
accuagccuuaga

SEQ ID NO: 2889824 - RNA, 15 nt, Human
accuauaaugugugu

SEQ ID NO: 2889825 - RNA, 16 nt, Human
accuauaaugugugua

SEQ ID NO: 2889826 - RNA, 17 nt, Human
accuauaauguguguau

SEQ ID NO: 2889827 - RNA, 22 nt, Human
accuauaauguguguaugugua

SEQ ID NO: 2889828 - RNA, 14 nt, Human
accuagcugugcaa

SEQ ID NO: 2889829 - RNA, 17 nt, Human
accuauaugauuuauag

SEQ ID NO: 2889830 - RNA, 17 nt, Human
accuaucccaccuccau

SEQ ID NO: 2889831 - RNA, 15 nt, Human
accuauccucacugc

SEQ ID NO: 2889832 - RNA, 14 nt, Human
accuaucccaccuc

SEQ ID NO: 2889833 - RNA, 14 nt, Human
accuaugaagcaau

SEQ ID NO: 2889834 - RNA, 22 nt, Human
accuauagucccagcuacucag

SEQ ID NO: 2889835 - RNA, 13 nt, Human
accuauaugauuu

SEQ ID NO: 2889836 - RNA, 16 nt, Human
accuauagucccagcu

SEQ ID NO: 2889837 - RNA, 15 nt, Human
accuauagucccagc

SEQ ID NO: 2889838 - RNA, 22 nt, Human
accuaugguauaaugguugacu

SEQ ID NO: 2889839 - RNA, 13 nt, Human
accgaugcuuuac

SEQ ID NO: 2889840 - RNA, 15 nt, Human
accgaugcuuuacca

SEQ ID NO: 2889841 - RNA, 22 nt, Human
accgaugguggguggggcugca

SEQ ID NO: 2889842 - RNA, 16 nt, Human
accgauucuuuggagu

SEQ ID NO: 2889843 - RNA, 24 nt, Human
accgauucuuuggaguugucacau

SEQ ID NO: 2889844 - RNA, 20 nt, Human
accgagucucuucuccacug

SEQ ID NO: 2889845 - RNA, 21 nt, Human
accgagucucuucuccacugg

SEQ ID NO: 2889846 - RNA, 24 nt, Human
accgagucucuucuccacuggaug

SEQ ID NO: 2889847 - RNA, 17 nt, Human
accgagcaaagaucaaa

SEQ ID NO: 2889848 - RNA, 19 nt, Human
accgagcaaagaucaaaau

SEQ ID NO: 2889849 - RNA, 12 nt, Human
accgcacagcuc

SEQ ID NO: 2889850 - RNA, 17 nt, Human
accgcugauucucaggg

SEQ ID NO: 2889851 - RNA, 15 nt, Human
accgcuucugccuuu

SEQ ID NO: 2889852 - RNA, 17 nt, Human
accgcuucugccuuuuc

SEQ ID NO: 2889853 - RNA, 18 nt, Human
accgcuuguggggaccca

SEQ ID NO: 2889854 - RNA, 21 nt, Human
accgcuuguggggacccaggc

SEQ ID NO: 2889855 - RNA, 22 nt, Human
accgcuuguggggacccaggcu

SEQ ID NO: 2889856 - RNA, 13 nt, Human
accgcuuuggccu

SEQ ID NO: 2889857 - RNA, 14 nt, Human
accgcuuuggccug

SEQ ID NO: 2889858 - RNA, 16 nt, Human
accgcuuuggccugag

SEQ ID NO: 2889859 - RNA, 17 nt, Human
accgcuuuggccugagu

SEQ ID NO: 2889860 - RNA, 15 nt, Human
accgcuucccuccug

SEQ ID NO: 2889861 - RNA, 19 nt, Human
accgcuucccuccugcccg

SEQ ID NO: 2889862 - RNA, 15 nt, Human
accggaagguuuuua

SEQ ID NO: 2889863 - RNA, 15 nt, Human
accgccuaguuuacu

SEQ ID NO: 2889864 - RNA, 19 nt, Human
accgccuaguuuacuguuu

SEQ ID NO: 2889865 - RNA, 16 nt, Human
accgcucucuuuucug

SEQ ID NO: 2889866 - RNA, 20 nt, Human
accgcucucuuuucuguacu

SEQ ID NO: 2889867 - RNA, 22 nt, Human
accgcucucuuuucuguacuuc

SEQ ID NO: 2889868 - RNA, 20 nt, Human
accgccccaaaguaaaagaa

SEQ ID NO: 2889869 - RNA, 11 nt, Human
accgcccccuc

SEQ ID NO: 2889870 - RNA, 12 nt, Human
accgcccccucc

SEQ ID NO: 2889871 - RNA, 14 nt, Human
accgcccccuccuc

SEQ ID NO: 2889872 - RNA, 11 nt, Human
accgcccgucu

SEQ ID NO: 2889873 - RNA, 13 nt, Human
accgcccgucugu

SEQ ID NO: 2889874 - RNA, 15 nt, Human
accgcccgucugugu

SEQ ID NO: 2889875 - RNA, 19 nt, Human
accgcccccuccucuagcu

SEQ ID NO: 2889876 - RNA, 21 nt, Human
accgaaguggacuggccccug

SEQ ID NO: 2889877 - RNA, 23 nt, Human
accgaaguggacuggccccuggg

SEQ ID NO: 2889878 - RNA, 20 nt, Human
accgaaguggacuggccccu

SEQ ID NO: 2889879 - RNA, 15 nt, Human
accgacaggcccugg

SEQ ID NO: 2889880 - RNA, 23 nt, Human
accgaccugguuuuuaaauagag

SEQ ID NO: 2889881 - RNA, 16 nt, Human
accgacgcgucuccug

SEQ ID NO: 2889882 - RNA, 17 nt, Human
accgacuagccaggaag

SEQ ID NO: 2889883 - RNA, 15 nt, Human
accgagcaaagauca

SEQ ID NO: 2889884 - RNA, 18 nt, Human
accgagucucuucuccac

SEQ ID NO: 2889885 - RNA, 17 nt, Human
accgacgcgucuccugu

SEQ ID NO: 2889886 - RNA, 18 nt, Human
accgacgcgucuccuguu

SEQ ID NO: 2889887 - RNA, 18 nt, Human
ucauauucuaaaaccauu

SEQ ID NO: 2889888 - RNA, 16 nt, Human
ucauauucugucugga

SEQ ID NO: 2889889 - RNA, 16 nt, Human
ucauauucuuucaauu

SEQ ID NO: 2889890 - RNA, 17 nt, Human
acccuuuuccuuugugg

SEQ ID NO: 2889891 - RNA, 19 nt, Human
acccuuuuccuuugugguu

SEQ ID NO: 2889892 - RNA, 12 nt, Human
ucauaugugauc

SEQ ID NO: 2889893 - RNA, 15 nt, Human
ucauaugugaucugu

SEQ ID NO: 2889894 - RNA, 17 nt, Human
ucauaugugaucugucu

SEQ ID NO: 2889895 - RNA, 21 nt, Human
ucauaugugaucugucuugua

SEQ ID NO: 2889896 - RNA, 22 nt, Human
ucauaugugaucugucuuguaa

SEQ ID NO: 2889897 - RNA, 23 nt, Human
ucauaugugaucugucuuguaau

SEQ ID NO: 2889898 - RNA, 14 nt, Human
acccuuuguuucuu

SEQ ID NO: 2889899 - RNA, 17 nt, Human
acccuuuguuucuuguu

SEQ ID NO: 2889900 - RNA, 14 nt, Human
ucagauucccagag

SEQ ID NO: 2889901 - RNA, 14 nt, Human
ucagauguggagcc

SEQ ID NO: 2889902 - RNA, 15 nt, Human
ucagauguggagcca

SEQ ID NO: 2889903 - RNA, 16 nt, Human
ucagauguggagccag

SEQ ID NO: 2889904 - RNA, 17 nt, Human
ucagauguggagccagg

SEQ ID NO: 2889905 - RNA, 18 nt, Human
ucagauguggagccaggc

SEQ ID NO: 2889906 - RNA, 20 nt, Human
ucagauguggagccaggcgu

SEQ ID NO: 2889907 - RNA, 18 nt, Human
ucagauguugaauucuuu

SEQ ID NO: 2889908 - RNA, 17 nt, Human
ucagauguuuuggucaa

SEQ ID NO: 2889909 - RNA, 13 nt, Human
ucagaugagaaca

SEQ ID NO: 2889910 - RNA, 14 nt, Human
ucagaugagaacaa

SEQ ID NO: 2889911 - RNA, 15 nt, Human
ucagaugagaacaaa

SEQ ID NO: 2889912 - RNA, 16 nt, Human
ucagaugagaacaaag

SEQ ID NO: 2889913 - RNA, 17 nt, Human
ucagaugagaacaaagc

SEQ ID NO: 2889914 - RNA, 20 nt, Human
ucagaugagaacaaagcugu

SEQ ID NO: 2889915 - RNA, 21 nt, Human
ucagaugagaacaaagcuguu

SEQ ID NO: 2889916 - RNA, 22 nt, Human
ucagauggauugauaauugcau

SEQ ID NO: 2889917 - RNA, 14 nt, Human
ucagaugcccagag

SEQ ID NO: 2889918 - RNA, 15 nt, Human
ucagaacaguaucuu

SEQ ID NO: 2889919 - RNA, 16 nt, Human
ucagaugcaguuugga

SEQ ID NO: 2889920 - RNA, 20 nt, Human
ucagaugggaggaaagagag

SEQ ID NO: 2889921 - RNA, 22 nt, Human
ucagaugggaggaaagagagca

SEQ ID NO: 2889922 - RNA, 13 nt, Human
ucagauguaaugu

SEQ ID NO: 2889923 - RNA, 14 nt, Human
ucagauguaauguu

SEQ ID NO: 2889924 - RNA, 15 nt, Human
ucagauguaauguuu

SEQ ID NO: 2889925 - RNA, 16 nt, Human
ucagauguaauguuuu

SEQ ID NO: 2889926 - RNA, 17 nt, Human
ucagauguaauguuuuc

SEQ ID NO: 2889927 - RNA, 13 nt, Human
ucagaugucccuu

SEQ ID NO: 2889928 - RNA, 14 nt, Human
ucagaugucccuug

SEQ ID NO: 2889929 - RNA, 23 nt, Human
ucagaugucccuugaugcacaga

SEQ ID NO: 2889930 - RNA, 13 nt, Human
ucagaagacacug

SEQ ID NO: 2889931 - RNA, 13 nt, Human
ucagaucugucug

SEQ ID NO: 2889932 - RNA, 14 nt, Human
ucagaucugucuga

SEQ ID NO: 2889933 - RNA, 21 nt, Human
ucagaugaacucuuagaaaug

SEQ ID NO: 2889934 - RNA, 16 nt, Human
ucagaucuuucuccuu

SEQ ID NO: 2889935 - RNA, 18 nt, Human
ucagaucuuucuccuuga

SEQ ID NO: 2889936 - RNA, 19 nt, Human
ucagaucuuucuccuugaa

SEQ ID NO: 2889937 - RNA, 20 nt, Human
ucagaaccucuuccccagaa

SEQ ID NO: 2889938 - RNA, 18 nt, Human
ucagaaccucuuccccag

SEQ ID NO: 2889939 - RNA, 17 nt, Human
ucagaaccucuucccca

SEQ ID NO: 2889940 - RNA, 16 nt, Human
ucagaaccucuucccc

SEQ ID NO: 2889941 - RNA, 15 nt, Human
ucagaaccucuuccc

SEQ ID NO: 2889942 - RNA, 24 nt, Human
ucagaacccuuggcuugcccacgu

SEQ ID NO: 2889943 - RNA, 20 nt, Human
ucagaacccuuggcuugccc

SEQ ID NO: 2889944 - RNA, 18 nt, Human
ucagaacccuuggcuugc

SEQ ID NO: 2889945 - RNA, 20 nt, Human
ucagaacugucggaggaaag

SEQ ID NO: 2889946 - RNA, 16 nt, Human
ucagccccgagcuguc

SEQ ID NO: 2889947 - RNA, 19 nt, Human
ucagccccgagcugucccc

SEQ ID NO: 2889948 - RNA, 13 nt, Human
ucagcccccagcc

SEQ ID NO: 2889949 - RNA, 16 nt, Human
ucagcccccagccccu

SEQ ID NO: 2889950 - RNA, 18 nt, Human
ucagcccccagccccucc

SEQ ID NO: 2889951 - RNA, 19 nt, Human
ucagcccccagccccuccc

SEQ ID NO: 2889952 - RNA, 20 nt, Human
ucagcccccagccccucccc

SEQ ID NO: 2889953 - RNA, 12 nt, Human
ucagcccagaag

SEQ ID NO: 2889954 - RNA, 13 nt, Human
ucagcccagaaga

SEQ ID NO: 2889955 - RNA, 15 nt, Human
ucagcccagaagaaa

SEQ ID NO: 2889956 - RNA, 16 nt, Human
ucagcccagaagaaaa

SEQ ID NO: 2889957 - RNA, 24 nt, Human
ucagcccagaagaaaauucuccug

SEQ ID NO: 2889958 - RNA, 17 nt, Human
ucagcccucccugcccc

SEQ ID NO: 2889959 - RNA, 19 nt, Human
ucagcccucccugccccuc

SEQ ID NO: 2889960 - RNA, 13 nt, Human
ucagcccugaggu

SEQ ID NO: 2889961 - RNA, 23 nt, Human
ucagcccugaggugaaagggagc

SEQ ID NO: 2889962 - RNA, 13 nt, Human
ucagccccuagga

SEQ ID NO: 2889963 - RNA, 14 nt, Human
ucagccccuaggag

SEQ ID NO: 2889964 - RNA, 16 nt, Human
ucagccccuaggagua

SEQ ID NO: 2889965 - RNA, 22 nt, Human
ucagccccuaggaguauauuuc

SEQ ID NO: 2889966 - RNA, 18 nt, Human
ucagcccucccugccccu

SEQ ID NO: 2889967 - RNA, 14 nt, Human
acccagcuaaauaa

SEQ ID NO: 2889968 - RNA, 18 nt, Human
acccagucaccucugucu

SEQ ID NO: 2889969 - RNA, 13 nt, Human
acccagucgcccu

SEQ ID NO: 2889970 - RNA, 14 nt, Human
acccagucgcccuu

SEQ ID NO: 2889971 - RNA, 19 nt, Human
acccagucgcccuuacuuc

SEQ ID NO: 2889972 - RNA, 18 nt, Human
acccagucucugcuccac

SEQ ID NO: 2889973 - RNA, 16 nt, Human
accccaugccaaagcu

SEQ ID NO: 2889974 - RNA, 17 nt, Human
acccagcugccaccucu

SEQ ID NO: 2889975 - RNA, 23 nt, Human
accccaugaccuuauccuuccuc

SEQ ID NO: 2889976 - RNA, 14 nt, Human
acccccagccugcu

SEQ ID NO: 2889977 - RNA, 15 nt, Human
acccccagccugcua

SEQ ID NO: 2889978 - RNA, 18 nt, Human
accccauuugcuuucuuu

SEQ ID NO: 2889979 - RNA, 21 nt, Human
acccccgcccccugcccuccc

SEQ ID NO: 2889980 - RNA, 15 nt, Human
acccccgcccccugc

SEQ ID NO: 2889981 - RNA, 18 nt, Human
acccccgcccccugcccu

SEQ ID NO: 2889982 - RNA, 19 nt, Human
acccccgcccccugcccuc

SEQ ID NO: 2889983 - RNA, 20 nt, Human
acccccgcccccugcccucc

SEQ ID NO: 2889984 - RNA, 14 nt, Human
acccccgcccccug

SEQ ID NO: 2889985 - RNA, 13 nt, Human
acccccgcccccu

SEQ ID NO: 2889986 - RNA, 13 nt, Human
accccccaccugc

SEQ ID NO: 2889987 - RNA, 12 nt, Human
accccccaccug

SEQ ID NO: 2889988 - RNA, 14 nt, Human
accccccaagcugu

SEQ ID NO: 2889989 - RNA, 17 nt, Human
acccccaucucucccuc

SEQ ID NO: 2889990 - RNA, 15 nt, Human
acccccauucucauc

SEQ ID NO: 2889991 - RNA, 16 nt, Human
acccccauucucaucu

SEQ ID NO: 2889992 - RNA, 16 nt, Human
acccccagcuuugcua

SEQ ID NO: 2889993 - RNA, 14 nt, Human
acccccagcuuugc

SEQ ID NO: 2889994 - RNA, 12 nt, Human
acccccagcuca

SEQ ID NO: 2889995 - RNA, 13 nt, Human
acccccagcucaa

SEQ ID NO: 2889996 - RNA, 20 nt, Human
acccccagcucaauggacug

SEQ ID NO: 2889997 - RNA, 21 nt, Human
acccccagcucaauggacugg

SEQ ID NO: 2889998 - RNA, 20 nt, Human
accccuuccagaucacugcc

SEQ ID NO: 2889999 - RNA, 16 nt, Human
accccuuccagaucac

SEQ ID NO: 2890000 - RNA, 21 nt, Human
accccuuccagaucacugcca

SEQ ID NO: 2890001 - RNA, 15 nt, Human
accccuuccagauca

SEQ ID NO: 2890002 - RNA, 13 nt, Human
accccuuccagau

SEQ ID NO: 2890003 - RNA, 16 nt, Human
accccuuccagaagca

SEQ ID NO: 2890004 - RNA, 18 nt, Human
accccuuagccucccuga

SEQ ID NO: 2890005 - RNA, 17 nt, Human
accccuuagccucccug

SEQ ID NO: 2890006 - RNA, 16 nt, Human
accccuuagccucccu

SEQ ID NO: 2890007 - RNA, 15 nt, Human
accccuuagccuccc

SEQ ID NO: 2890008 - RNA, 14 nt, Human
accccuuagccucc

SEQ ID NO: 2890009 - RNA, 15 nt, Human
accccuggcuguacu

SEQ ID NO: 2890010 - RNA, 21 nt, Human
accccuggcuguacugcucag

SEQ ID NO: 2890011 - RNA, 11 nt, Human
accccuggcug

SEQ ID NO: 2890012 - RNA, 18 nt, Human
accccuuaagcccuggcc

SEQ ID NO: 2890013 - RNA, 19 nt, Human
accccuuaagcccuggccc

SEQ ID NO: 2890014 - RNA, 20 nt, Human
accccuuaagcccuggcccc

SEQ ID NO: 2890015 - RNA, 15 nt, Human
accccuggcuuuuca

SEQ ID NO: 2890016 - RNA, 17 nt, Human
accccucccucugucca

SEQ ID NO: 2890017 - RNA, 18 nt, Human
accccucccucuguccac

SEQ ID NO: 2890018 - RNA, 13 nt, Human
accccuccucacu

SEQ ID NO: 2890019 - RNA, 14 nt, Human
accccuccucacug

SEQ ID NO: 2890020 - RNA, 16 nt, Human
accccuccucacuggc

SEQ ID NO: 2890021 - RNA, 17 nt, Human
accccuccucacuggcc

SEQ ID NO: 2890022 - RNA, 18 nt, Human
accccuccucacuggcca

SEQ ID NO: 2890023 - RNA, 19 nt, Human
accccuccucacuggccau

SEQ ID NO: 2890024 - RNA, 21 nt, Human
accccuccucacuggccaucc

SEQ ID NO: 2890025 - RNA, 23 nt, Human
accccuccucacuggccaucccu

SEQ ID NO: 2890026 - RNA, 12 nt, Human
accccuggcuuu

SEQ ID NO: 2890027 - RNA, 11 nt, Human
accccuccugg

SEQ ID NO: 2890028 - RNA, 12 nt, Human
accccuccuggg

SEQ ID NO: 2890029 - RNA, 14 nt, Human
accccuccuggggc

SEQ ID NO: 2890030 - RNA, 15 nt, Human
accccuccuggggcc

SEQ ID NO: 2890031 - RNA, 17 nt, Human
accccuccuggggccag

SEQ ID NO: 2890032 - RNA, 18 nt, Human
accccuccuggggccagg

SEQ ID NO: 2890033 - RNA, 20 nt, Human
accccuccuggggccaggcc

SEQ ID NO: 2890034 - RNA, 21 nt, Human
accccuccuggggccaggccg

SEQ ID NO: 2890035 - RNA, 17 nt, Human
ucagcggggacagcucc

SEQ ID NO: 2890036 - RNA, 16 nt, Human
ucagcggggacagcuc

SEQ ID NO: 2890037 - RNA, 15 nt, Human
ucagcggggacagcu

SEQ ID NO: 2890038 - RNA, 19 nt, Human
accccauggcugcacaguu

SEQ ID NO: 2890039 - RNA, 23 nt, Human
ucaggccaucaucaguggagcca

SEQ ID NO: 2890040 - RNA, 15 nt, Human
ucaggccauggcucc

SEQ ID NO: 2890041 - RNA, 11 nt, Human
ucaggcccugg

SEQ ID NO: 2890042 - RNA, 13 nt, Human
ucaggcccuggaa

SEQ ID NO: 2890043 - RNA, 19 nt, Human
ucaggccaggugcaguggc

SEQ ID NO: 2890044 - RNA, 18 nt, Human
ucaggccaggugcagugg

SEQ ID NO: 2890045 - RNA, 17 nt, Human
ucaggccaggugcagug

SEQ ID NO: 2890046 - RNA, 16 nt, Human
ucaggccaggugcagu

SEQ ID NO: 2890047 - RNA, 22 nt, Human
ucaggccaucaucaguggagcc

SEQ ID NO: 2890048 - RNA, 21 nt, Human
ucaggccaucaucaguggagc

SEQ ID NO: 2890049 - RNA, 19 nt, Human
accccuucgcuccuguguc

SEQ ID NO: 2890050 - RNA, 16 nt, Human
ucagguaacaggcaga

SEQ ID NO: 2890051 - RNA, 15 nt, Human
ucagguaacaggcag

SEQ ID NO: 2890052 - RNA, 13 nt, Human
ucagguaacaggc

SEQ ID NO: 2890053 - RNA, 15 nt, Human
ucagggucauagcau

SEQ ID NO: 2890054 - RNA, 19 nt, Human
ucaggcccuuauuuucaag

SEQ ID NO: 2890055 - RNA, 20 nt, Human
accccuucgcuccugugucu

SEQ ID NO: 2890056 - RNA, 23 nt, Human
ucaggguuggccccugcccggcu

SEQ ID NO: 2890057 - RNA, 14 nt, Human
ucaggguauugcuu

SEQ ID NO: 2890058 - RNA, 19 nt, Human
ucagccugggacaguuuau

SEQ ID NO: 2890059 - RNA, 18 nt, Human
ucaggguuggugugcuga

SEQ ID NO: 2890060 - RNA, 13 nt, Human
accccuucucugu

SEQ ID NO: 2890061 - RNA, 14 nt, Human
accccuucucugug

SEQ ID NO: 2890062 - RNA, 16 nt, Human
accccuucucugugac

SEQ ID NO: 2890063 - RNA, 17 nt, Human
accccuucucugugacc

SEQ ID NO: 2890064 - RNA, 18 nt, Human
accccuucucugugaccc

SEQ ID NO: 2890065 - RNA, 20 nt, Human
accccuucucugugacccac

SEQ ID NO: 2890066 - RNA, 21 nt, Human
accccuucucugugacccacu

SEQ ID NO: 2890067 - RNA, 17 nt, Human
accccuuucuggcucuc

SEQ ID NO: 2890068 - RNA, 23 nt, Human
acccgaccccccgugggcucccg

SEQ ID NO: 2890069 - RNA, 21 nt, Human
acccgaccccccgugggcucc

SEQ ID NO: 2890070 - RNA, 15 nt, Human
acccgaggguugauu

SEQ ID NO: 2890071 - RNA, 17 nt, Human
acccgaggguugauuaa

SEQ ID NO: 2890072 - RNA, 23 nt, Human
acccgaggguugauuaaggcagu

SEQ ID NO: 2890073 - RNA, 13 nt, Human
acccucccacccc

SEQ ID NO: 2890074 - RNA, 12 nt, Human
acccucccaccc

SEQ ID NO: 2890075 - RNA, 23 nt, Human
acccucccacccccuucucugcu

SEQ ID NO: 2890076 - RNA, 20 nt, Human
acccucccacccccuucucu

SEQ ID NO: 2890077 - RNA, 14 nt, Human
acccucccaccccc

SEQ ID NO: 2890078 - RNA, 14 nt, Human
acccucccuggagu

SEQ ID NO: 2890079 - RNA, 22 nt, Human
acccuccgccuucacuccggug

SEQ ID NO: 2890080 - RNA, 15 nt, Human
acccuccgccuucac

SEQ ID NO: 2890081 - RNA, 15 nt, Human
acccucccuggagug

SEQ ID NO: 2890082 - RNA, 15 nt, Human
acccucccuguucau

SEQ ID NO: 2890083 - RNA, 12 nt, Human
acccucccugga

SEQ ID NO: 2890084 - RNA, 13 nt, Human
acccucccuggag

SEQ ID NO: 2890085 - RNA, 13 nt, Human
acccuccuggcuc

SEQ ID NO: 2890086 - RNA, 11 nt, Human
acccuccuggc

SEQ ID NO: 2890087 - RNA, 15 nt, Human
acccuccuggccuca

SEQ ID NO: 2890088 - RNA, 19 nt, Human
acccuccuggccucagacu

SEQ ID NO: 2890089 - RNA, 22 nt, Human
acccuccuggccucagacugca

SEQ ID NO: 2890090 - RNA, 20 nt, Human
acccucugccaccagagacc

SEQ ID NO: 2890091 - RNA, 15 nt, Human
acccucugcugaaga

SEQ ID NO: 2890092 - RNA, 16 nt, Human
acccucugcugaagac

SEQ ID NO: 2890093 - RNA, 17 nt, Human
acccucugcugaagacu

SEQ ID NO: 2890094 - RNA, 17 nt, Human
acccuuucuugacaaaa

SEQ ID NO: 2890095 - RNA, 21 nt, Human
acccuuucuugacaaaaccua

SEQ ID NO: 2890096 - RNA, 17 nt, Human
acccuuccugagcuuua

SEQ ID NO: 2890097 - RNA, 18 nt, Human
acccuuccugagcuuuau

SEQ ID NO: 2890098 - RNA, 11 nt, Human
acccuuccuuc

SEQ ID NO: 2890099 - RNA, 22 nt, Human
acccuuccccuccuucucccuu

SEQ ID NO: 2890100 - RNA, 13 nt, Human
acccuucccugca

SEQ ID NO: 2890101 - RNA, 15 nt, Human
acccuucccugcacu

SEQ ID NO: 2890102 - RNA, 16 nt, Human
acccuucccugcacua

SEQ ID NO: 2890103 - RNA, 22 nt, Human
acccuucccugcacuaaagcca

SEQ ID NO: 2890104 - RNA, 13 nt, Human
acccuuccuaagu

SEQ ID NO: 2890105 - RNA, 13 nt, Human
acccuucccaauc

SEQ ID NO: 2890106 - RNA, 20 nt, Human
acccuucccaaucagcacug

SEQ ID NO: 2890107 - RNA, 21 nt, Human
acccuucccaaucagcacuga

SEQ ID NO: 2890108 - RNA, 22 nt, Human
acccuucccaaucagcacugaa

SEQ ID NO: 2890109 - RNA, 23 nt, Human
acccuucccaaucagcacugaaa

SEQ ID NO: 2890110 - RNA, 13 nt, Human
acccuuccagaca

SEQ ID NO: 2890111 - RNA, 16 nt, Human
acccuuccagacauac

SEQ ID NO: 2890112 - RNA, 21 nt, Human
acccuucaacguuucuucacu

SEQ ID NO: 2890113 - RNA, 22 nt, Human
acccuucaacguuucuucacuu

SEQ ID NO: 2890114 - RNA, 23 nt, Human
acccucuggagggguguggcucc

SEQ ID NO: 2890115 - RNA, 19 nt, Human
acccucugccaccagagac

SEQ ID NO: 2890116 - RNA, 11 nt, Human
acccucuggcc

SEQ ID NO: 2890117 - RNA, 12 nt, Human
acccucugggaa

SEQ ID NO: 2890118 - RNA, 13 nt, Human
acccucugggaac

SEQ ID NO: 2890119 - RNA, 15 nt, Human
acccucugggaaccu

SEQ ID NO: 2890120 - RNA, 19 nt, Human
acccucugggaaccuccca

SEQ ID NO: 2890121 - RNA, 20 nt, Human
acccucugggaaccucccag

SEQ ID NO: 2890122 - RNA, 21 nt, Human
acccucugggaaccucccaga

SEQ ID NO: 2890123 - RNA, 22 nt, Human
acccucugggaaccucccagag

SEQ ID NO: 2890124 - RNA, 23 nt, Human
acccucugggaaccucccagagg

SEQ ID NO: 2890125 - RNA, 12 nt, Human
acccucuguacc

SEQ ID NO: 2890126 - RNA, 22 nt, Human
acccucuguaccccaugaccuu

SEQ ID NO: 2890127 - RNA, 16 nt, Human
acccucuuccugugau

SEQ ID NO: 2890128 - RNA, 15 nt, Human
acccucuuccuguga

SEQ ID NO: 2890129 - RNA, 20 nt, Human
acccucuuccugugauccac

SEQ ID NO: 2890130 - RNA, 19 nt, Human
acccucuuccugugaucca

SEQ ID NO: 2890131 - RNA, 17 nt, Human
acccucuuccugugauc

SEQ ID NO: 2890132 - RNA, 23 nt, Human
accauuuugggguacccacugcu

SEQ ID NO: 2890133 - RNA, 22 nt, Human
accauuuuuaaaguagaagagg

SEQ ID NO: 2890134 - RNA, 11 nt, Human
accauuuuuca

SEQ ID NO: 2890135 - RNA, 17 nt, Human
accauuuuucauucacu

SEQ ID NO: 2890136 - RNA, 20 nt, Human
accauuuuuuaaggaaacaa

SEQ ID NO: 2890137 - RNA, 22 nt, Human
accauuuuuuaaggaaacaaua

SEQ ID NO: 2890138 - RNA, 22 nt, Human
accauuuugggguacccacugc

SEQ ID NO: 2890139 - RNA, 20 nt, Human
accauuucagagaggccuuu

SEQ ID NO: 2890140 - RNA, 14 nt, Human
accauuuaacaugc

SEQ ID NO: 2890141 - RNA, 14 nt, Human
accauuucagagag

SEQ ID NO: 2890142 - RNA, 11 nt, Human
accauuucaga

SEQ ID NO: 2890143 - RNA, 18 nt, Human
accaugauggccaggcug

SEQ ID NO: 2890144 - RNA, 19 nt, Human
accaugauggccaggcuga

SEQ ID NO: 2890145 - RNA, 24 nt, Human
accaguugaauaaaagugcacacc

SEQ ID NO: 2890146 - RNA, 23 nt, Human
accaugagaauaagagaaagaaa

SEQ ID NO: 2890147 - RNA, 15 nt, Human
accauuccccauggg

SEQ ID NO: 2890148 - RNA, 12 nt, Human
accauuccccau

SEQ ID NO: 2890149 - RNA, 20 nt, Human
acccaacccuaucuccugac

SEQ ID NO: 2890150 - RNA, 18 nt, Human
acccaacccuaucuccug

SEQ ID NO: 2890151 - RNA, 17 nt, Human
acccaacccuaucuccu

SEQ ID NO: 2890152 - RNA, 19 nt, Human
acccaaccccaagccagcc

SEQ ID NO: 2890153 - RNA, 18 nt, Human
acccaaaaacugucuuua

SEQ ID NO: 2890154 - RNA, 15 nt, Human
acccaaaacaagccu

SEQ ID NO: 2890155 - RNA, 21 nt, Human
acccaaaacaagccugguagg

SEQ ID NO: 2890156 - RNA, 14 nt, Human
acccaaaagagaaa

SEQ ID NO: 2890157 - RNA, 15 nt, Human
acccaaaagagaaaa

SEQ ID NO: 2890158 - RNA, 16 nt, Human
acccaaaagagaaaaa

SEQ ID NO: 2890159 - RNA, 14 nt, Human
acccaaacccuagg

SEQ ID NO: 2890160 - RNA, 15 nt, Human
acccaaacccuaggu

SEQ ID NO: 2890161 - RNA, 22 nt, Human
acccaacccuaucuccugacag

SEQ ID NO: 2890162 - RNA, 15 nt, Human
acccaacggcccugc

SEQ ID NO: 2890163 - RNA, 23 nt, Human
acccaacggcccugcagccagcu

SEQ ID NO: 2890164 - RNA, 18 nt, Human
acccagcccacuucugcc

SEQ ID NO: 2890165 - RNA, 22 nt, Human
ucagaaccauccauaguaguau

SEQ ID NO: 2890166 - RNA, 12 nt, Human
ucagaacccagg

SEQ ID NO: 2890167 - RNA, 13 nt, Human
ucagaacccaggg

SEQ ID NO: 2890168 - RNA, 14 nt, Human
ucagaacccagggc

SEQ ID NO: 2890169 - RNA, 16 nt, Human
ucagaacccagggcuc

SEQ ID NO: 2890170 - RNA, 20 nt, Human
ucagaacccagggcucugcc

SEQ ID NO: 2890171 - RNA, 22 nt, Human
ucagaacccagggcucugcccc

SEQ ID NO: 2890172 - RNA, 23 nt, Human
ucagaacccagggcucugcccca

SEQ ID NO: 2890173 - RNA, 16 nt, Human
ucagaacccuuggcuu

SEQ ID NO: 2890174 - RNA, 15 nt, Human
ucagaacccuuggcu

SEQ ID NO: 2890175 - RNA, 17 nt, Human
acccagcccacuucugc

SEQ ID NO: 2890176 - RNA, 16 nt, Human
acccagcccacuucug

SEQ ID NO: 2890177 - RNA, 15 nt, Human
acccacuugucacug

SEQ ID NO: 2890178 - RNA, 19 nt, Human
acccacuugucacugacac

SEQ ID NO: 2890179 - RNA, 22 nt, Human
acccacuugucacugacacaaa

SEQ ID NO: 2890180 - RNA, 23 nt, Human
acccacuugucacugacacaaag

SEQ ID NO: 2890181 - RNA, 12 nt, Human
ucaccugccugu

SEQ ID NO: 2890182 - RNA, 22 nt, Human
accacuuuccuuuucuauuccu

SEQ ID NO: 2890183 - RNA, 14 nt, Human
ucaccugccuguua

SEQ ID NO: 2890184 - RNA, 14 nt, Human
ucacugaauuuaua

SEQ ID NO: 2890185 - RNA, 12 nt, Human
ucacugacacaa

SEQ ID NO: 2890186 - RNA, 18 nt, Human
ucaccuggcuuguuuauu

SEQ ID NO: 2890187 - RNA, 23 nt, Human
ucaccuggcuuguuuauuuugug

SEQ ID NO: 2890188 - RNA, 12 nt, Human
ucacugcagccu

SEQ ID NO: 2890189 - RNA, 15 nt, Human
ucacugcacagugca

SEQ ID NO: 2890190 - RNA, 21 nt, Human
ucacuguagaaugauuucaug

SEQ ID NO: 2890191 - RNA, 20 nt, Human
ucacuguagaaugauuucau

SEQ ID NO: 2890192 - RNA, 14 nt, Human
ucacugacacaaag

SEQ ID NO: 2890193 - RNA, 15 nt, Human
ucacugacacaaagg

SEQ ID NO: 2890194 - RNA, 16 nt, Human
ucacugacacaaagga

SEQ ID NO: 2890195 - RNA, 17 nt, Human
ucacugacacaaaggaa

SEQ ID NO: 2890196 - RNA, 19 nt, Human
ucacugacacaaaggaagu

SEQ ID NO: 2890197 - RNA, 20 nt, Human
ucacugcacagugcaucuca

SEQ ID NO: 2890198 - RNA, 22 nt, Human
ucacugcacagugcaucucagc

SEQ ID NO: 2890199 - RNA, 24 nt, Human
ucacugcacagugcaucucagccc

SEQ ID NO: 2890200 - RNA, 16 nt, Human
ucacuguugcccaggc

SEQ ID NO: 2890201 - RNA, 19 nt, Human
ucacuguccuccaagccag

SEQ ID NO: 2890202 - RNA, 14 nt, Human
ucacugucaaugau

SEQ ID NO: 2890203 - RNA, 23 nt, Human
ucacugucaaugauuauuuucau

SEQ ID NO: 2890204 - RNA, 14 nt, Human
ucacugucccuccu

SEQ ID NO: 2890205 - RNA, 16 nt, Human
ucacugucccuccugg

SEQ ID NO: 2890206 - RNA, 17 nt, Human
ucacugucccuccuggu

SEQ ID NO: 2890207 - RNA, 19 nt, Human
ucacugucccuccuggugu

SEQ ID NO: 2890208 - RNA, 16 nt, Human
ucacuguccuccaagc

SEQ ID NO: 2890209 - RNA, 15 nt, Human
ucacuguccuccaag

SEQ ID NO: 2890210 - RNA, 14 nt, Human
ucacuguauaaaua

SEQ ID NO: 2890211 - RNA, 15 nt, Human
ucacuguauaaauag

SEQ ID NO: 2890212 - RNA, 16 nt, Human
ucacuguauaaauagg

SEQ ID NO: 2890213 - RNA, 17 nt, Human
ucacuguauaaauagga

SEQ ID NO: 2890214 - RNA, 19 nt, Human
ucacuguauaaauaggaga

SEQ ID NO: 2890215 - RNA, 23 nt, Human
ucacuguauaaauaggagaggau

SEQ ID NO: 2890216 - RNA, 24 nt, Human
ucacuguauaaauaggagaggaug

SEQ ID NO: 2890217 - RNA, 21 nt, Human
accaguguagccuugcccgga

SEQ ID NO: 2890218 - RNA, 14 nt, Human
accaguuaauuacu

SEQ ID NO: 2890219 - RNA, 16 nt, Human
accaguguagccuugc

SEQ ID NO: 2890220 - RNA, 13 nt, Human
accaguguagccu

SEQ ID NO: 2890221 - RNA, 17 nt, Human
accaguggucucacaug

SEQ ID NO: 2890222 - RNA, 12 nt, Human
accaguggucuc

SEQ ID NO: 2890223 - RNA, 21 nt, Human
accaguggcguuguugcaugu

SEQ ID NO: 2890224 - RNA, 22 nt, Human
accaguggcguuguugcauguu

SEQ ID NO: 2890225 - RNA, 23 nt, Human
accaguggcguuguugcauguuu

SEQ ID NO: 2890226 - RNA, 13 nt, Human
accagugcaggcu

SEQ ID NO: 2890227 - RNA, 14 nt, Human
accagugcaggcug

SEQ ID NO: 2890228 - RNA, 15 nt, Human
accagugcaggcugg

SEQ ID NO: 2890229 - RNA, 16 nt, Human
accagugcaggcuggc

SEQ ID NO: 2890230 - RNA, 19 nt, Human
accagugcaggcuggccag

SEQ ID NO: 2890231 - RNA, 20 nt, Human
accagugcaggcuggccagc

SEQ ID NO: 2890232 - RNA, 21 nt, Human
accagugcaggcuggccagcc

SEQ ID NO: 2890233 - RNA, 22 nt, Human
accagugcaggcuggccagccg

SEQ ID NO: 2890234 - RNA, 13 nt, Human
accagugccaagg

SEQ ID NO: 2890235 - RNA, 14 nt, Human
accagugccaagga

SEQ ID NO: 2890236 - RNA, 15 nt, Human
accagugccaaggac

SEQ ID NO: 2890237 - RNA, 16 nt, Human
accagugccaaggacc

SEQ ID NO: 2890238 - RNA, 17 nt, Human
accagugccaaggaccu

SEQ ID NO: 2890239 - RNA, 23 nt, Human
accagugcccaaagucuguguga

SEQ ID NO: 2890240 - RNA, 22 nt, Human
accagugcccaaagucugugug

SEQ ID NO: 2890241 - RNA, 18 nt, Human
ucacuguugcccaggcug

SEQ ID NO: 2890242 - RNA, 17 nt, Human
ucacuguugcccaggcu

SEQ ID NO: 2890243 - RNA, 16 nt, Human
accagggccgaggagg

SEQ ID NO: 2890244 - RNA, 21 nt, Human
uauuucaugcugggaaugaga

SEQ ID NO: 2890245 - RNA, 12 nt, Human
uauuucaugugg

SEQ ID NO: 2890246 - RNA, 17 nt, Human
uauuucauguggcugua

SEQ ID NO: 2890247 - RNA, 12 nt, Human
accacagacaca

SEQ ID NO: 2890248 - RNA, 13 nt, Human
accacagacacac

SEQ ID NO: 2890249 - RNA, 14 nt, Human
accacagacacaca

SEQ ID NO: 2890250 - RNA, 15 nt, Human
accacagacacacac

SEQ ID NO: 2890251 - RNA, 21 nt, Human
accacacuggacuccggcccu

SEQ ID NO: 2890252 - RNA, 22 nt, Human
accacacuggacuccggcccuc

SEQ ID NO: 2890253 - RNA, 12 nt, Human
uauuucauugcc

SEQ ID NO: 2890254 - RNA, 22 nt, Human
uauuucaguuccgucagaaagu

SEQ ID NO: 2890255 - RNA, 21 nt, Human
uauuucaguguaguuaauuua

SEQ ID NO: 2890256 - RNA, 22 nt, Human
uauuucaguguaguuaauuuau

SEQ ID NO: 2890257 - RNA, 23 nt, Human
uauuucaguguaguuaauuuauc

SEQ ID NO: 2890258 - RNA, 21 nt, Human
uauuucaguacuucagcaaga

SEQ ID NO: 2890259 - RNA, 13 nt, Human
uauuucagaugua

SEQ ID NO: 2890260 - RNA, 16 nt, Human
uauuucagauguaaug

SEQ ID NO: 2890261 - RNA, 19 nt, Human
uauuucagauguaauguuu

SEQ ID NO: 2890262 - RNA, 20 nt, Human
uauuucagauguaauguuuu

SEQ ID NO: 2890263 - RNA, 21 nt, Human
uauuucagauguaauguuuuc

SEQ ID NO: 2890264 - RNA, 12 nt, Human
uauuucagauuu

SEQ ID NO: 2890265 - RNA, 16 nt, Human
uauuucagauuuugau

SEQ ID NO: 2890266 - RNA, 17 nt, Human
uauuucagauuuugaua

SEQ ID NO: 2890267 - RNA, 18 nt, Human
uauuucagauuuugauaa

SEQ ID NO: 2890268 - RNA, 19 nt, Human
uauuucagauuuugauaac

SEQ ID NO: 2890269 - RNA, 20 nt, Human
uauuucagauuuugauaacu

SEQ ID NO: 2890270 - RNA, 23 nt, Human
uauuucagauuuugauaacuguu

SEQ ID NO: 2890271 - RNA, 14 nt, Human
accacaucuugcuc

SEQ ID NO: 2890272 - RNA, 20 nt, Human
accacauccuccguccagcc

SEQ ID NO: 2890273 - RNA, 14 nt, Human
accacauccuccgu

SEQ ID NO: 2890274 - RNA, 20 nt, Human
accacagacacacacacgca

SEQ ID NO: 2890275 - RNA, 16 nt, Human
accacagacacacaca

SEQ ID NO: 2890276 - RNA, 18 nt, Human
accacagacacacacacg

SEQ ID NO: 2890277 - RNA, 15 nt, Human
accacugcaaguccu

SEQ ID NO: 2890278 - RNA, 17 nt, Human
accacugcaaguccuuu

SEQ ID NO: 2890279 - RNA, 22 nt, Human
accacugcaaguccuuuuguaa

SEQ ID NO: 2890280 - RNA, 13 nt, Human
accacuucacuga

SEQ ID NO: 2890281 - RNA, 16 nt, Human
accacuucacugaaag

SEQ ID NO: 2890282 - RNA, 17 nt, Human
accacuucacugaaaga

SEQ ID NO: 2890283 - RNA, 18 nt, Human
accacuucacugaaagac

SEQ ID NO: 2890284 - RNA, 13 nt, Human
accacuguuucuu

SEQ ID NO: 2890285 - RNA, 16 nt, Human
accacuguuucuugcu

SEQ ID NO: 2890286 - RNA, 17 nt, Human
accacuguuucuugcuu

SEQ ID NO: 2890287 - RNA, 18 nt, Human
accacuguuucuugcuug

SEQ ID NO: 2890288 - RNA, 19 nt, Human
accacuguuucuugcuugu

SEQ ID NO: 2890289 - RNA, 20 nt, Human
accacuguuucuugcuugua

SEQ ID NO: 2890290 - RNA, 22 nt, Human
accacuguuucuugcuuguacc

SEQ ID NO: 2890291 - RNA, 23 nt, Human
accacuguuucuugcuuguaccu

SEQ ID NO: 2890292 - RNA, 24 nt, Human
accacaucuugcucugcugacaga

SEQ ID NO: 2890293 - RNA, 21 nt, Human
accacaucuugcucugcugac

SEQ ID NO: 2890294 - RNA, 20 nt, Human
accacaucuugcucugcuga

SEQ ID NO: 2890295 - RNA, 22 nt, Human
accacauccuccguccagccgc

SEQ ID NO: 2890296 - RNA, 21 nt, Human
accacauccuccguccagccg

SEQ ID NO: 2890297 - RNA, 15 nt, Human
accacagagcuguca

SEQ ID NO: 2890298 - RNA, 17 nt, Human
accacaucuuuaucugu

SEQ ID NO: 2890299 - RNA, 12 nt, Human
accacucagccc

SEQ ID NO: 2890300 - RNA, 13 nt, Human
accacucagcccc

SEQ ID NO: 2890301 - RNA, 14 nt, Human
accacucagccccu

SEQ ID NO: 2890302 - RNA, 15 nt, Human
accacucagccccua

SEQ ID NO: 2890303 - RNA, 16 nt, Human
accacucagccccuag

SEQ ID NO: 2890304 - RNA, 17 nt, Human
accacucagccccuagg

SEQ ID NO: 2890305 - RNA, 18 nt, Human
accacucagccccuagga

SEQ ID NO: 2890306 - RNA, 12 nt, Human
accacuccauuc

SEQ ID NO: 2890307 - RNA, 17 nt, Human
accagacaccuugacag

SEQ ID NO: 2890308 - RNA, 23 nt, Human
accagacaccuugacagggcaca

SEQ ID NO: 2890309 - RNA, 22 nt, Human
accagacaccuugacagggcac

SEQ ID NO: 2890310 - RNA, 18 nt, Human
accagagaccguccucac

SEQ ID NO: 2890311 - RNA, 16 nt, Human
accagagaccguccuc

SEQ ID NO: 2890312 - RNA, 12 nt, Human
accagacagagg

SEQ ID NO: 2890313 - RNA, 13 nt, Human
accagacagaggg

SEQ ID NO: 2890314 - RNA, 16 nt, Human
accagacagaggguca

SEQ ID NO: 2890315 - RNA, 19 nt, Human
accagacagagggucacag

SEQ ID NO: 2890316 - RNA, 22 nt, Human
accagacagagggucacagugu

SEQ ID NO: 2890317 - RNA, 22 nt, Human
accagagcccaccuuggcucaa

SEQ ID NO: 2890318 - RNA, 19 nt, Human
accagagcccaccuuggcu

SEQ ID NO: 2890319 - RNA, 16 nt, Human
accagagcagaugcag

SEQ ID NO: 2890320 - RNA, 17 nt, Human
accagagcagaugcaga

SEQ ID NO: 2890321 - RNA, 22 nt, Human
accagagcagaugcagagagcc

SEQ ID NO: 2890322 - RNA, 20 nt, Human
accagagcauuuccaacacc

SEQ ID NO: 2890323 - RNA, 15 nt, Human
accagagcagaugca

SEQ ID NO: 2890324 - RNA, 19 nt, Human
accagagcaaccucucacu

SEQ ID NO: 2890325 - RNA, 20 nt, Human
accagagcaaccucucacuc

SEQ ID NO: 2890326 - RNA, 12 nt, Human
accagagcagau

SEQ ID NO: 2890327 - RNA, 17 nt, Human
accagagcccaccuugg

SEQ ID NO: 2890328 - RNA, 12 nt, Human
accagccuggcc

SEQ ID NO: 2890329 - RNA, 11 nt, Human
accagccuggc

SEQ ID NO: 2890330 - RNA, 20 nt, Human
accagccuggccaacauggu

SEQ ID NO: 2890331 - RNA, 15 nt, Human
accagccuggccaac

SEQ ID NO: 2890332 - RNA, 17 nt, Human
accagccuggccaacau

SEQ ID NO: 2890333 - RNA, 13 nt, Human
accagccugggca

SEQ ID NO: 2890334 - RNA, 14 nt, Human
accagccugggcag

SEQ ID NO: 2890335 - RNA, 16 nt, Human
accaggacucccuccu

SEQ ID NO: 2890336 - RNA, 20 nt, Human
accaggagaaccacuacaug

SEQ ID NO: 2890337 - RNA, 19 nt, Human
accaggagaaccacuacau

SEQ ID NO: 2890338 - RNA, 18 nt, Human
accaggagaaccacuaca

SEQ ID NO: 2890339 - RNA, 14 nt, Human
accaggagaaccac

SEQ ID NO: 2890340 - RNA, 21 nt, Human
accaggacucccuccucaccu

SEQ ID NO: 2890341 - RNA, 18 nt, Human
accaggacucccuccuca

SEQ ID NO: 2890342 - RNA, 17 nt, Human
accaggacucccuccuc

SEQ ID NO: 2890343 - RNA, 11 nt, Human
accaggcaggg

SEQ ID NO: 2890344 - RNA, 19 nt, Human
accaggcaacuugggaacu

SEQ ID NO: 2890345 - RNA, 14 nt, Human
accaggauuucuaa

SEQ ID NO: 2890346 - RNA, 15 nt, Human
accaggauuucuaau

SEQ ID NO: 2890347 - RNA, 13 nt, Human
accaggauuuuuu

SEQ ID NO: 2890348 - RNA, 19 nt, Human
accaggauccagccucacu

SEQ ID NO: 2890349 - RNA, 23 nt, Human
ucaccugaagacucauucuucug

SEQ ID NO: 2890350 - RNA, 22 nt, Human
ucaccugagcaggaccucugaa

SEQ ID NO: 2890351 - RNA, 19 nt, Human
ucaccugaagacucauucu

SEQ ID NO: 2890352 - RNA, 16 nt, Human
ucaccugaagacucau

SEQ ID NO: 2890353 - RNA, 15 nt, Human
accaggccauucugc

SEQ ID NO: 2890354 - RNA, 12 nt, Human
accaggcccugg

SEQ ID NO: 2890355 - RNA, 15 nt, Human
accaggcccuggcua

SEQ ID NO: 2890356 - RNA, 15 nt, Human
ucaccucccccaucu

SEQ ID NO: 2890357 - RNA, 13 nt, Human
ucaccucccccau

SEQ ID NO: 2890358 - RNA, 12 nt, Human
ucaccuccucua

SEQ ID NO: 2890359 - RNA, 22 nt, Human
ucaccuccucuaagguugggca

SEQ ID NO: 2890360 - RNA, 12 nt, Human
agcaccacccua

SEQ ID NO: 2890361 - RNA, 23 nt, Human
agcacaucugcauuuucacccca

SEQ ID NO: 2890362 - RNA, 16 nt, Human
agcacaucugcauuuu

SEQ ID NO: 2890363 - RNA, 15 nt, Human
agcacaucugcauuu

SEQ ID NO: 2890364 - RNA, 22 nt, Human
agcaccaaaagcuuaccaaggg

SEQ ID NO: 2890365 - RNA, 12 nt, Human
agcacagccuag

SEQ ID NO: 2890366 - RNA, 21 nt, Human
agcacagcucaggaacuagac

SEQ ID NO: 2890367 - RNA, 15 nt, Human
agcacagcucccugc

SEQ ID NO: 2890368 - RNA, 17 nt, Human
agcacagcucccugcca

SEQ ID NO: 2890369 - RNA, 18 nt, Human
agcacagcucccugccaa

SEQ ID NO: 2890370 - RNA, 16 nt, Human
agcacagcuucauuuc

SEQ ID NO: 2890371 - RNA, 21 nt, Human
agcacaggugggcuucccagu

SEQ ID NO: 2890372 - RNA, 19 nt, Human
agcacaggugggcuuccca

SEQ ID NO: 2890373 - RNA, 17 nt, Human
agcacauauuuucuguu

SEQ ID NO: 2890374 - RNA, 17 nt, Human
agcacaguuugaacaaa

SEQ ID NO: 2890375 - RNA, 12 nt, Human
agcacaguuugu

SEQ ID NO: 2890376 - RNA, 19 nt, Human
agcacaguguuaaaugaaa

SEQ ID NO: 2890377 - RNA, 22 nt, Human
agcacaguguuaaaugaaauug

SEQ ID NO: 2890378 - RNA, 12 nt, Human
agcacaguuuga

SEQ ID NO: 2890379 - RNA, 14 nt, Human
agcacaguuugaac

SEQ ID NO: 2890380 - RNA, 16 nt, Human
agcacaguguuaaaug

SEQ ID NO: 2890381 - RNA, 18 nt, Human
agcacaguguuaaaugaa

SEQ ID NO: 2890382 - RNA, 12 nt, Human
ugagccaccacg

SEQ ID NO: 2890383 - RNA, 21 nt, Human
ugagccaggcuagcuggagcc

SEQ ID NO: 2890384 - RNA, 22 nt, Human
ugagccaggcuagcuggagccu

SEQ ID NO: 2890385 - RNA, 23 nt, Human
ugagccaggcuagcuggagccug

SEQ ID NO: 2890386 - RNA, 13 nt, Human
agcaagugagagc

SEQ ID NO: 2890387 - RNA, 17 nt, Human
agcaagugagagagaug

SEQ ID NO: 2890388 - RNA, 18 nt, Human
agcaagugagagagaugg

SEQ ID NO: 2890389 - RNA, 24 nt, Human
agcaagugagagagaugggagcuc

SEQ ID NO: 2890390 - RNA, 21 nt, Human
ugagccagugcuuuaauggca

SEQ ID NO: 2890391 - RNA, 14 nt, Human
agcaagugagagcu

SEQ ID NO: 2890392 - RNA, 18 nt, Human
agcaagugagagcugggu

SEQ ID NO: 2890393 - RNA, 22 nt, Human
agcaagugagagcuggguguca

SEQ ID NO: 2890394 - RNA, 21 nt, Human
agcaagugauugggacagagg

SEQ ID NO: 2890395 - RNA, 20 nt, Human
agcaaguucugagagccagg

SEQ ID NO: 2890396 - RNA, 15 nt, Human
agcaaguuuucuucc

SEQ ID NO: 2890397 - RNA, 15 nt, Human
agcaauaaaauuuuu

SEQ ID NO: 2890398 - RNA, 22 nt, Human
agcacagauuuuaauugucaug

SEQ ID NO: 2890399 - RNA, 23 nt, Human
agcacagauuuuaauugucaugg

SEQ ID NO: 2890400 - RNA, 21 nt, Human
agcacagcagccccugcacaa

SEQ ID NO: 2890401 - RNA, 19 nt, Human
agcaaccuuucaccuuugu

SEQ ID NO: 2890402 - RNA, 22 nt, Human
agcaaccuuucaccuuugugua

SEQ ID NO: 2890403 - RNA, 23 nt, Human
agcaaccuuucaccuuuguguau

SEQ ID NO: 2890404 - RNA, 13 nt, Human
agcaaccucccaa

SEQ ID NO: 2890405 - RNA, 19 nt, Human
agcaaccgccucaaaaugu

SEQ ID NO: 2890406 - RNA, 20 nt, Human
agcaaccgccucaaaaugug

SEQ ID NO: 2890407 - RNA, 21 nt, Human
agcaaccgccucaaaaugugu

SEQ ID NO: 2890408 - RNA, 18 nt, Human
agcaaccgguggauccuc

SEQ ID NO: 2890409 - RNA, 15 nt, Human
ugagcaaauguggcu

SEQ ID NO: 2890410 - RNA, 18 nt, Human
ugagcaacucuugauuau

SEQ ID NO: 2890411 - RNA, 16 nt, Human
ugagcaacucuugauu

SEQ ID NO: 2890412 - RNA, 16 nt, Human
ugagcaaauguggcuc

SEQ ID NO: 2890413 - RNA, 18 nt, Human
ugagcaaauguggcuccu

SEQ ID NO: 2890414 - RNA, 19 nt, Human
ugagcaaauguggcuccug

SEQ ID NO: 2890415 - RNA, 23 nt, Human
ugagcacuaaggugugcucugau

SEQ ID NO: 2890416 - RNA, 22 nt, Human
ugagcacuaaggugugcucuga

SEQ ID NO: 2890417 - RNA, 21 nt, Human
ugagcacuaaggugugcucug

SEQ ID NO: 2890418 - RNA, 20 nt, Human
ugagcacuaaggugugcucu

SEQ ID NO: 2890419 - RNA, 21 nt, Human
ugagcaaggagcacaagccac

SEQ ID NO: 2890420 - RNA, 23 nt, Human
ugagcaaggagcacaagccacaa

SEQ ID NO: 2890421 - RNA, 20 nt, Human
ugagcacacuuuaguggccg

SEQ ID NO: 2890422 - RNA, 13 nt, Human
ugagcacagagug

SEQ ID NO: 2890423 - RNA, 17 nt, Human
ugagcacagccuagggc

SEQ ID NO: 2890424 - RNA, 13 nt, Human
ugagcacacuuua

SEQ ID NO: 2890425 - RNA, 23 nt, Human
ugagccacugcaccgggccacag

SEQ ID NO: 2890426 - RNA, 18 nt, Human
ugagccacugcaccgggc

SEQ ID NO: 2890427 - RNA, 21 nt, Human
ugagccacugcaccgggccac

SEQ ID NO: 2890428 - RNA, 21 nt, Human
ugagccaccgugccuggccac

SEQ ID NO: 2890429 - RNA, 20 nt, Human
ugagccaccgugccuggcca

SEQ ID NO: 2890430 - RNA, 19 nt, Human
ugagccaccgugccuggcc

SEQ ID NO: 2890431 - RNA, 18 nt, Human
ugagccaccgugccuggc

SEQ ID NO: 2890432 - RNA, 14 nt, Human
ugagcauccugagc

SEQ ID NO: 2890433 - RNA, 15 nt, Human
ugagcauccugagcc

SEQ ID NO: 2890434 - RNA, 16 nt, Human
ugagcauccugagccc

SEQ ID NO: 2890435 - RNA, 17 nt, Human
ugagcauccugagcccc

SEQ ID NO: 2890436 - RNA, 18 nt, Human
ugagcauccugagccccg

SEQ ID NO: 2890437 - RNA, 19 nt, Human
ugagcauccugagccccgc

SEQ ID NO: 2890438 - RNA, 23 nt, Human
ugagcauccugagccccgcccuc

SEQ ID NO: 2890439 - RNA, 16 nt, Human
ugagccaccacaccug

SEQ ID NO: 2890440 - RNA, 14 nt, Human
ugagccaccgugcc

SEQ ID NO: 2890441 - RNA, 15 nt, Human
ugagccaccacgccc

SEQ ID NO: 2890442 - RNA, 13 nt, Human
ugagcagaaggaa

SEQ ID NO: 2890443 - RNA, 14 nt, Human
ugagcagaaggaaa

SEQ ID NO: 2890444 - RNA, 18 nt, Human
ugagcagaaggaaacaaa

SEQ ID NO: 2890445 - RNA, 14 nt, Human
agcagaagaaagga

SEQ ID NO: 2890446 - RNA, 13 nt, Human
agcagaagacaaa

SEQ ID NO: 2890447 - RNA, 14 nt, Human
agcagaaggaaaca

SEQ ID NO: 2890448 - RNA, 21 nt, Human
agcagaacggagccccaggcc

SEQ ID NO: 2890449 - RNA, 16 nt, Human
agcagaaccuuaaaca

SEQ ID NO: 2890450 - RNA, 15 nt, Human
ugagccacugcgccc

SEQ ID NO: 2890451 - RNA, 20 nt, Human
agcagaacagaucuuuuacu

SEQ ID NO: 2890452 - RNA, 16 nt, Human
agcagaaggauuuuuu

SEQ ID NO: 2890453 - RNA, 18 nt, Human
agcagaaggauuuuuuaa

SEQ ID NO: 2890454 - RNA, 16 nt, Human
agcagaaguggagcug

SEQ ID NO: 2890455 - RNA, 22 nt, Human
agcacuuugggaggcugaggcg

SEQ ID NO: 2890456 - RNA, 21 nt, Human
agcacuuugggaggcugaggc

SEQ ID NO: 2890457 - RNA, 23 nt, Human
agcagaaaaaggcugugcugccc

SEQ ID NO: 2890458 - RNA, 22 nt, Human
agcagaaaacuggcccugcccu

SEQ ID NO: 2890459 - RNA, 18 nt, Human
agcagaaaauaaaggaag

SEQ ID NO: 2890460 - RNA, 18 nt, Human
agcagaaagcugugaaca

SEQ ID NO: 2890461 - RNA, 12 nt, Human
agcacuuuggga

SEQ ID NO: 2890462 - RNA, 17 nt, Human
agcacuuugaaauaccu

SEQ ID NO: 2890463 - RNA, 18 nt, Human
agcacuuugaaauaccuc

SEQ ID NO: 2890464 - RNA, 19 nt, Human
agcacuuugaaauaccuca

SEQ ID NO: 2890465 - RNA, 20 nt, Human
agcacuuugaaauaccucau

SEQ ID NO: 2890466 - RNA, 21 nt, Human
agcacuuugaaauaccucaug

SEQ ID NO: 2890467 - RNA, 15 nt, Human
agcacuuugcaagga

SEQ ID NO: 2890468 - RNA, 19 nt, Human
agcacuuugcaaggaaugu

SEQ ID NO: 2890469 - RNA, 19 nt, Human
agcacuugucucauuuuaa

SEQ ID NO: 2890470 - RNA, 22 nt, Human
agcacuugucucauuuuaaugu

SEQ ID NO: 2890471 - RNA, 13 nt, Human
agcacuuguauau

SEQ ID NO: 2890472 - RNA, 12 nt, Human
agcacuuguaua

SEQ ID NO: 2890473 - RNA, 22 nt, Human
agcaccugucuccuuucacccc

SEQ ID NO: 2890474 - RNA, 14 nt, Human
agcaccuguaagaa

SEQ ID NO: 2890475 - RNA, 19 nt, Human
agcaccuuugcacaggaug

SEQ ID NO: 2890476 - RNA, 18 nt, Human
agcaccugccuccucguu

SEQ ID NO: 2890477 - RNA, 21 nt, Human
agcaccugccuccucguuccu

SEQ ID NO: 2890478 - RNA, 13 nt, Human
agcaccagggaag

SEQ ID NO: 2890479 - RNA, 12 nt, Human
agcaccagggaa

SEQ ID NO: 2890480 - RNA, 10 nt, Human
agcaccaggg

SEQ ID NO: 2890481 - RNA, 23 nt, Human
agcaccacccuagucccuucccc

SEQ ID NO: 2890482 - RNA, 17 nt, Human
agcaccaagcucaaagc

SEQ ID NO: 2890483 - RNA, 18 nt, Human
agcaccaagcucaaagcg

SEQ ID NO: 2890484 - RNA, 14 nt, Human
ugagccuucagucu

SEQ ID NO: 2890485 - RNA, 18 nt, Human
ugagccuucgugcccccc

SEQ ID NO: 2890486 - RNA, 19 nt, Human
ugagccuucgugccccccc

SEQ ID NO: 2890487 - RNA, 13 nt, Human
ugagccuucaguc

SEQ ID NO: 2890488 - RNA, 16 nt, Human
ugagccuggccagccu

SEQ ID NO: 2890489 - RNA, 22 nt, Human
ugagccuggcccauagaaacau

SEQ ID NO: 2890490 - RNA, 13 nt, Human
ugagccuggcucu

SEQ ID NO: 2890491 - RNA, 18 nt, Human
ugagccuggcucuugugc

SEQ ID NO: 2890492 - RNA, 12 nt, Human
ugagccuggcca

SEQ ID NO: 2890493 - RNA, 11 nt, Human
ugagccuggcc

SEQ ID NO: 2890494 - RNA, 21 nt, Human
agcagagaaugaaagggccca

SEQ ID NO: 2890495 - RNA, 22 nt, Human
agcagaccaccccgccugcccu

SEQ ID NO: 2890496 - RNA, 21 nt, Human
agcagaauggugaucacucca

SEQ ID NO: 2890497 - RNA, 23 nt, Human
agcagagaaugaaagggcccaga

SEQ ID NO: 2890498 - RNA, 22 nt, Human
agcagagaaugaaagggcccag

SEQ ID NO: 2890499 - RNA, 13 nt, Human
agcagagaagggc

SEQ ID NO: 2890500 - RNA, 16 nt, Human
agcagagaauauaaca

SEQ ID NO: 2890501 - RNA, 20 nt, Human
agcagagaauauaacaugaa

SEQ ID NO: 2890502 - RNA, 24 nt, Human
agcagagaauauaacaugaaauga

SEQ ID NO: 2890503 - RNA, 13 nt, Human
ugaggucagagcc

SEQ ID NO: 2890504 - RNA, 16 nt, Human
ugaggucagagccugc

SEQ ID NO: 2890505 - RNA, 14 nt, Human
ugaggucagagccu

SEQ ID NO: 2890506 - RNA, 21 nt, Human
ugagggugcuuguucccucuc

SEQ ID NO: 2890507 - RNA, 14 nt, Human
ugaggguguuucuu

SEQ ID NO: 2890508 - RNA, 15 nt, Human
ugagguaaguuuuuu

SEQ ID NO: 2890509 - RNA, 20 nt, Human
ugaggguugggcugguguca

SEQ ID NO: 2890510 - RNA, 17 nt, Human
ugaggucagagccugca

SEQ ID NO: 2890511 - RNA, 15 nt, Human
agcagagcaggggca

SEQ ID NO: 2890512 - RNA, 14 nt, Human
agcagagcaggggc

SEQ ID NO: 2890513 - RNA, 15 nt, Human
agcagagagaugcgg

SEQ ID NO: 2890514 - RNA, 14 nt, Human
ugagguaaagauau

SEQ ID NO: 2890515 - RNA, 22 nt, Human
ugagguagaccaggauuucuaa

SEQ ID NO: 2890516 - RNA, 19 nt, Human
ugagguacaaccuguucug

SEQ ID NO: 2890517 - RNA, 21 nt, Human
agcagauggaaugcuguguua

SEQ ID NO: 2890518 - RNA, 19 nt, Human
agcagaugcaaugacucag

SEQ ID NO: 2890519 - RNA, 12 nt, Human
agcagaugcaga

SEQ ID NO: 2890520 - RNA, 13 nt, Human
agcagaugcagag

SEQ ID NO: 2890521 - RNA, 16 nt, Human
agcagaugcagagagc

SEQ ID NO: 2890522 - RNA, 17 nt, Human
agcagaugcagagagcc

SEQ ID NO: 2890523 - RNA, 18 nt, Human
agcagaugcagagagcca

SEQ ID NO: 2890524 - RNA, 22 nt, Human
agcagauuguuuccucuuccaa

SEQ ID NO: 2890525 - RNA, 21 nt, Human
agcagaugcagagagccauuu

SEQ ID NO: 2890526 - RNA, 13 nt, Human
agcagauuggaag

SEQ ID NO: 2890527 - RNA, 14 nt, Human
agcagauuggaagg

SEQ ID NO: 2890528 - RNA, 15 nt, Human
agcagauuggaagga

SEQ ID NO: 2890529 - RNA, 17 nt, Human
agcagauuggaaggaga

SEQ ID NO: 2890530 - RNA, 18 nt, Human
agcagauuggaaggagac

SEQ ID NO: 2890531 - RNA, 19 nt, Human
agcagauuggaaggagaca

SEQ ID NO: 2890532 - RNA, 21 nt, Human
agcagauuggaaggagacaca

SEQ ID NO: 2890533 - RNA, 22 nt, Human
agcagauuggaaggagacacag

SEQ ID NO: 2890534 - RNA, 23 nt, Human
agcagauuggaaggagacacaga

SEQ ID NO: 2890535 - RNA, 15 nt, Human
agcagcaaaaauaua

SEQ ID NO: 2890536 - RNA, 16 nt, Human
agcagcaaaaauauaa

SEQ ID NO: 2890537 - RNA, 17 nt, Human
agcagcaaaaauauaaa

SEQ ID NO: 2890538 - RNA, 20 nt, Human
agcagcaaaaauauaaaaua

SEQ ID NO: 2890539 - RNA, 13 nt, Human
agcagcaagaaaa

SEQ ID NO: 2890540 - RNA, 15 nt, Human
agcagcaagaaaaaa

SEQ ID NO: 2890541 - RNA, 16 nt, Human
agcagcaagaaaaaaa

SEQ ID NO: 2890542 - RNA, 20 nt, Human
agcagcaagaaaaaaaaaug

SEQ ID NO: 2890543 - RNA, 21 nt, Human
agcagcaagaaaaaaaaaugc

SEQ ID NO: 2890544 - RNA, 23 nt, Human
agcagcaagaaaaaaaaaugcca

SEQ ID NO: 2890545 - RNA, 16 nt, Human
agcagagugcacagcu

SEQ ID NO: 2890546 - RNA, 17 nt, Human
agcagagugcacagcug

SEQ ID NO: 2890547 - RNA, 18 nt, Human
agcagagugcacagcugu

SEQ ID NO: 2890548 - RNA, 19 nt, Human
agcagagugcacagcuguc

SEQ ID NO: 2890549 - RNA, 23 nt, Human
agcagagugcacagcuguccacu

SEQ ID NO: 2890550 - RNA, 13 nt, Human
agcagaggcagcg

SEQ ID NO: 2890551 - RNA, 23 nt, Human
agcagagguggccagagcuggga

SEQ ID NO: 2890552 - RNA, 19 nt, Human
agcagauaccucacccugc

SEQ ID NO: 2890553 - RNA, 15 nt, Human
agcagauacugcugu

SEQ ID NO: 2890554 - RNA, 18 nt, Human
agcagauaccucacccug

SEQ ID NO: 2890555 - RNA, 14 nt, Human
ugaggggcuccugg

SEQ ID NO: 2890556 - RNA, 20 nt, Human
ugagggguauaucugggcug

SEQ ID NO: 2890557 - RNA, 15 nt, Human
ugaggggcuccugga

SEQ ID NO: 2890558 - RNA, 18 nt, Human
ugaggguaucaaauaaaa

SEQ ID NO: 2890559 - RNA, 15 nt, Human
ugaggguccccaccu

SEQ ID NO: 2890560 - RNA, 19 nt, Human
ugaggguccccaccuggga

SEQ ID NO: 2890561 - RNA, 17 nt, Human
ugaggggcaucugcccc

SEQ ID NO: 2890562 - RNA, 22 nt, Human
ugaggggcaucugccccucccc

SEQ ID NO: 2890563 - RNA, 11 nt, Human
ugaggggagga

SEQ ID NO: 2890564 - RNA, 22 nt, Human
ugaggggaggaucacuggagcc

SEQ ID NO: 2890565 - RNA, 21 nt, Human
ugaggggaggaucacuggagc

SEQ ID NO: 2890566 - RNA, 12 nt, Human
ugagggcccaga

SEQ ID NO: 2890567 - RNA, 13 nt, Human
ugagggcccagag

SEQ ID NO: 2890568 - RNA, 14 nt, Human
ugagggcccagagc

SEQ ID NO: 2890569 - RNA, 15 nt, Human
ugagggcccagagca

SEQ ID NO: 2890570 - RNA, 16 nt, Human
ugagggcccagagcag

SEQ ID NO: 2890571 - RNA, 17 nt, Human
ugagggcccagagcagg

SEQ ID NO: 2890572 - RNA, 18 nt, Human
ugagggcccagagcagga

SEQ ID NO: 2890573 - RNA, 19 nt, Human
ugagggcccagagcaggaa

SEQ ID NO: 2890574 - RNA, 20 nt, Human
ugagggcccagagcaggaag

SEQ ID NO: 2890575 - RNA, 21 nt, Human
ugagggcccagagcaggaagc

SEQ ID NO: 2890576 - RNA, 21 nt, Human
ugaggccccuucuagguggca

SEQ ID NO: 2890577 - RNA, 17 nt, Human
ugagggaugggccuggc

SEQ ID NO: 2890578 - RNA, 19 nt, Human
ugagggaugggccuggcau

SEQ ID NO: 2890579 - RNA, 12 nt, Human
ugagggcaaauc

SEQ ID NO: 2890580 - RNA, 15 nt, Human
ugagggauuaucuuu

SEQ ID NO: 2890581 - RNA, 14 nt, Human
ugaggcccugccca

SEQ ID NO: 2890582 - RNA, 22 nt, Human
ugaggccuccagcuucaggcag

SEQ ID NO: 2890583 - RNA, 14 nt, Human
ugaggccugagacc

SEQ ID NO: 2890584 - RNA, 16 nt, Human
ugaggccugagaccca

SEQ ID NO: 2890585 - RNA, 18 nt, Human
ugaggccugagacccagg

SEQ ID NO: 2890586 - RNA, 19 nt, Human
ugaggccugagacccagga

SEQ ID NO: 2890587 - RNA, 20 nt, Human
ugaggccugagacccaggac

SEQ ID NO: 2890588 - RNA, 21 nt, Human
ugaggccugagacccaggacu

SEQ ID NO: 2890589 - RNA, 23 nt, Human
ugaggccugagacccaggacucc

SEQ ID NO: 2890590 - RNA, 21 nt, Human
ugaggacacuaaccacgcugg

SEQ ID NO: 2890591 - RNA, 23 nt, Human
ugaggccaccaguaaaagacauu

SEQ ID NO: 2890592 - RNA, 20 nt, Human
ugaggacaaccauuccagac

SEQ ID NO: 2890593 - RNA, 19 nt, Human
ugaggacaaccauuccaga

SEQ ID NO: 2890594 - RNA, 18 nt, Human
ugaggaauuuucuuugug

SEQ ID NO: 2890595 - RNA, 22 nt, Human
ugaggacaaaguggaggagggc

SEQ ID NO: 2890596 - RNA, 16 nt, Human
ugaggacaaauugaga

SEQ ID NO: 2890597 - RNA, 20 nt, Human
ugaggacaaauugagacagu

SEQ ID NO: 2890598 - RNA, 14 nt, Human
ugaggaauuuucuu

SEQ ID NO: 2890599 - RNA, 13 nt, Human
ugaggaauuuucu

SEQ ID NO: 2890600 - RNA, 22 nt, Human
ugaggaauccagacccggcugc

SEQ ID NO: 2890601 - RNA, 21 nt, Human
ugaggaauccagacccggcug

SEQ ID NO: 2890602 - RNA, 13 nt, Human
ugaggccaggagu

SEQ ID NO: 2890603 - RNA, 12 nt, Human
ugaggccaggag

SEQ ID NO: 2890604 - RNA, 18 nt, Human
ugagcgccuggauuucug

SEQ ID NO: 2890605 - RNA, 18 nt, Human
ugagcgccugugcacaca

SEQ ID NO: 2890606 - RNA, 20 nt, Human
ugagcgccugugcacacaca

SEQ ID NO: 2890607 - RNA, 22 nt, Human
agcagacgauaguuaucuguuc

SEQ ID NO: 2890608 - RNA, 16 nt, Human
ugagccuuuucccucu

SEQ ID NO: 2890609 - RNA, 17 nt, Human
ugagcguccagaaaugg

SEQ ID NO: 2890610 - RNA, 12 nt, Human
ugagcgggaggc

SEQ ID NO: 2890611 - RNA, 13 nt, Human
ugagcgggaggca

SEQ ID NO: 2890612 - RNA, 14 nt, Human
ugagcgggaggcag

SEQ ID NO: 2890613 - RNA, 15 nt, Human
ugagcgggaggcaga

SEQ ID NO: 2890614 - RNA, 16 nt, Human
ugagcgggaggcagag

SEQ ID NO: 2890615 - RNA, 21 nt, Human
ugaggaacuguagaugaugua

SEQ ID NO: 2890616 - RNA, 19 nt, Human
ugaggaacuguagaugaug

SEQ ID NO: 2890617 - RNA, 15 nt, Human
ugaggaacuguacag

SEQ ID NO: 2890618 - RNA, 17 nt, Human
ugaggaacuguacagaa

SEQ ID NO: 2890619 - RNA, 19 nt, Human
ugaggaacuguacagaaaa

SEQ ID NO: 2890620 - RNA, 16 nt, Human
ugaggaaacaacagcu

SEQ ID NO: 2890621 - RNA, 16 nt, Human
ugaggaaaauaaugua

SEQ ID NO: 2890622 - RNA, 14 nt, Human
ugaggaaagcacac

SEQ ID NO: 2890623 - RNA, 17 nt, Human
ugaggaaagcacacagu

SEQ ID NO: 2890624 - RNA, 14 nt, Human
ugaggaagagucuu

SEQ ID NO: 2890625 - RNA, 23 nt, Human
ugaggaaggaggggaagcugcag

SEQ ID NO: 2890626 - RNA, 17 nt, Human
ugaggaauaauuauuua

SEQ ID NO: 2890627 - RNA, 19 nt, Human
ugaggaauaauuauuuauu

SEQ ID NO: 2890628 - RNA, 14 nt, Human
agagucuagauucu

SEQ ID NO: 2890629 - RNA, 16 nt, Human
agagugagacucuguc

SEQ ID NO: 2890630 - RNA, 15 nt, Human
agagugagacucugu

SEQ ID NO: 2890631 - RNA, 22 nt, Human
agagucucacuguugcccaggc

SEQ ID NO: 2890632 - RNA, 20 nt, Human
agagucucacuguugcccag

SEQ ID NO: 2890633 - RNA, 15 nt, Human
agagucuagauucaa

SEQ ID NO: 2890634 - RNA, 17 nt, Human
agagucuagauucaaag

SEQ ID NO: 2890635 - RNA, 19 nt, Human
agagucuagauucaaaggu

SEQ ID NO: 2890636 - RNA, 21 nt, Human
agagucuagauucaaagguuc

SEQ ID NO: 2890637 - RNA, 22 nt, Human
agagucuagauucaaagguucu

SEQ ID NO: 2890638 - RNA, 23 nt, Human
agagucuagauucaaagguucua

SEQ ID NO: 2890639 - RNA, 15 nt, Human
agagucuagauucuc

SEQ ID NO: 2890640 - RNA, 17 nt, Human
agagucuagcacucauu

SEQ ID NO: 2890641 - RNA, 15 nt, Human
ugaauguauuuauuu

SEQ ID NO: 2890642 - RNA, 17 nt, Human
ugaauguauuuauuugg

SEQ ID NO: 2890643 - RNA, 11 nt, Human
agagucuagau

SEQ ID NO: 2890644 - RNA, 12 nt, Human
agagucuagauu

SEQ ID NO: 2890645 - RNA, 13 nt, Human
agagucuagauuc

SEQ ID NO: 2890646 - RNA, 14 nt, Human
agagucuaaagaug

SEQ ID NO: 2890647 - RNA, 17 nt, Human
agagucuaaagauggag

SEQ ID NO: 2890648 - RNA, 22 nt, Human
agagucuaaagauggaguuucu

SEQ ID NO: 2890649 - RNA, 23 nt, Human
agagucuaaagauggaguuucua

SEQ ID NO: 2890650 - RNA, 12 nt, Human
agagucuaaaga

SEQ ID NO: 2890651 - RNA, 13 nt, Human
agagucuaaagau

SEQ ID NO: 2890652 - RNA, 19 nt, Human
ugaauguauuuauuuggga

SEQ ID NO: 2890653 - RNA, 23 nt, Human
ugaauguauuuauuugggagacc

SEQ ID NO: 2890654 - RNA, 13 nt, Human
agaguccucugaa

SEQ ID NO: 2890655 - RNA, 12 nt, Human
agaguccucuga

SEQ ID NO: 2890656 - RNA, 14 nt, Human
agaguccucugaau

SEQ ID NO: 2890657 - RNA, 14 nt, Human
agaguccucacucc

SEQ ID NO: 2890658 - RNA, 17 nt, Human
agaguccugugcugaau

SEQ ID NO: 2890659 - RNA, 14 nt, Human
ugaauauauggcau

SEQ ID NO: 2890660 - RNA, 15 nt, Human
ugaauauauggcauu

SEQ ID NO: 2890661 - RNA, 16 nt, Human
ugaauauauggcauuu

SEQ ID NO: 2890662 - RNA, 20 nt, Human
ugaauauauggcauuugcag

SEQ ID NO: 2890663 - RNA, 21 nt, Human
ugaauauauggcauuugcaga

SEQ ID NO: 2890664 - RNA, 21 nt, Human
ugaauauacagcaggugcuca

SEQ ID NO: 2890665 - RNA, 21 nt, Human
ugaauauaauauauuugugua

SEQ ID NO: 2890666 - RNA, 22 nt, Human
ugaauauaauauauuuguguau

SEQ ID NO: 2890667 - RNA, 14 nt, Human
ugaagcuugacucc

SEQ ID NO: 2890668 - RNA, 15 nt, Human
ugaagcuugacuccc

SEQ ID NO: 2890669 - RNA, 18 nt, Human
ugaagcuugacucccaag

SEQ ID NO: 2890670 - RNA, 15 nt, Human
ugaaggugacagcag

SEQ ID NO: 2890671 - RNA, 18 nt, Human
ugaaugccagugugcuga

SEQ ID NO: 2890672 - RNA, 21 nt, Human
ugaaugccauagucaaagaga

SEQ ID NO: 2890673 - RNA, 14 nt, Human
ugaaugcauaaaau

SEQ ID NO: 2890674 - RNA, 21 nt, Human
ugaaugcuuauagguggccuc

SEQ ID NO: 2890675 - RNA, 23 nt, Human
ugaaugcuuuuugaauguuauuu

SEQ ID NO: 2890676 - RNA, 18 nt, Human
ugaaugcuuuuugaaugu

SEQ ID NO: 2890677 - RNA, 19 nt, Human
ugaaugcuuuuugaauguu

SEQ ID NO: 2890678 - RNA, 12 nt, Human
ugaaugcuuuuu

SEQ ID NO: 2890679 - RNA, 14 nt, Human
ugaaugcuuugcau

SEQ ID NO: 2890680 - RNA, 21 nt, Human
ugaaugcuuugcauuuggaau

SEQ ID NO: 2890681 - RNA, 21 nt, Human
ugaauggccugccuugaagcc

SEQ ID NO: 2890682 - RNA, 17 nt, Human
ugaauggccugccuuga

SEQ ID NO: 2890683 - RNA, 15 nt, Human
ugaauggccugccuu

SEQ ID NO: 2890684 - RNA, 12 nt, Human
ugaauggccugc

SEQ ID NO: 2890685 - RNA, 14 nt, Human
ugaauggauuggau

SEQ ID NO: 2890686 - RNA, 15 nt, Human
ugaauggauuggauu

SEQ ID NO: 2890687 - RNA, 17 nt, Human
ugaauggauuggauuau

SEQ ID NO: 2890688 - RNA, 20 nt, Human
ugaauggauuggauuauuua

SEQ ID NO: 2890689 - RNA, 21 nt, Human
ugaauggauuggauuauuuaa

SEQ ID NO: 2890690 - RNA, 22 nt, Human
ugaauggauuggauuauuuaau

SEQ ID NO: 2890691 - RNA, 23 nt, Human
ugaauggauuggauuauuuaaua

SEQ ID NO: 2890692 - RNA, 14 nt, Human
ugaauaucuauuaa

SEQ ID NO: 2890693 - RNA, 22 nt, Human
ugaauauauuuaagcaacaucu

SEQ ID NO: 2890694 - RNA, 23 nt, Human
ugaauauauuuaagcaacaucuu

SEQ ID NO: 2890695 - RNA, 15 nt, Human
ugaaugcauaaaaug

SEQ ID NO: 2890696 - RNA, 16 nt, Human
ugaaugcauaaaaugu

SEQ ID NO: 2890697 - RNA, 16 nt, Human
ugaauaucuauuaaua

SEQ ID NO: 2890698 - RNA, 17 nt, Human
ugaauaucuauuaauau

SEQ ID NO: 2890699 - RNA, 21 nt, Human
agaucaaccccuucgcuccug

SEQ ID NO: 2890700 - RNA, 14 nt, Human
agaucacugccaca

SEQ ID NO: 2890701 - RNA, 18 nt, Human
agaucacugaauuuauaa

SEQ ID NO: 2890702 - RNA, 22 nt, Human
agaucacugcaaccucugccuc

SEQ ID NO: 2890703 - RNA, 19 nt, Human
agaucaaccccuucgcucc

SEQ ID NO: 2890704 - RNA, 14 nt, Human
agaucaaccccuuc

SEQ ID NO: 2890705 - RNA, 19 nt, Human
agauacaggaaaagcugcu

SEQ ID NO: 2890706 - RNA, 15 nt, Human
agauacaauguauuu

SEQ ID NO: 2890707 - RNA, 16 nt, Human
agauacaauguauuua

SEQ ID NO: 2890708 - RNA, 13 nt, Human
agauacaauguau

SEQ ID NO: 2890709 - RNA, 13 nt, Human
agauacaucacug

SEQ ID NO: 2890710 - RNA, 16 nt, Human
agauacaucacugcuu

SEQ ID NO: 2890711 - RNA, 20 nt, Human
agauacaucacugcuugaug

SEQ ID NO: 2890712 - RNA, 23 nt, Human
agauacaauguauuuauuuaaaa

SEQ ID NO: 2890713 - RNA, 17 nt, Human
agauauuuugggcaugu

SEQ ID NO: 2890714 - RNA, 19 nt, Human
agauauuuugggcaugugg

SEQ ID NO: 2890715 - RNA, 13 nt, Human
agauaccucaccc

SEQ ID NO: 2890716 - RNA, 14 nt, Human
agauaccucacccu

SEQ ID NO: 2890717 - RNA, 17 nt, Human
agauaccucacccugcu

SEQ ID NO: 2890718 - RNA, 16 nt, Human
agauaccauacucauu

SEQ ID NO: 2890719 - RNA, 19 nt, Human
agauaccauacucauuucu

SEQ ID NO: 2890720 - RNA, 14 nt, Human
agauaccuaaaaca

SEQ ID NO: 2890721 - RNA, 19 nt, Human
agagugagacucugucuca

SEQ ID NO: 2890722 - RNA, 15 nt, Human
agagugagacccugu

SEQ ID NO: 2890723 - RNA, 19 nt, Human
agagugacuaguacaaauu

SEQ ID NO: 2890724 - RNA, 16 nt, Human
agagugacuccaagaa

SEQ ID NO: 2890725 - RNA, 18 nt, Human
agagugacuccaagaaca

SEQ ID NO: 2890726 - RNA, 13 nt, Human
agaguuuugucuu

SEQ ID NO: 2890727 - RNA, 14 nt, Human
agaguuuugucuug

SEQ ID NO: 2890728 - RNA, 16 nt, Human
agagugagcuacagag

SEQ ID NO: 2890729 - RNA, 22 nt, Human
agagugagcuacagagccgagc

SEQ ID NO: 2890730 - RNA, 16 nt, Human
agaguuuugucuugaa

SEQ ID NO: 2890731 - RNA, 19 nt, Human
agaguuuugucuugaaugu

SEQ ID NO: 2890732 - RNA, 17 nt, Human
agaguuuuuaauagaac

SEQ ID NO: 2890733 - RNA, 13 nt, Human
agauaaaaagugg

SEQ ID NO: 2890734 - RNA, 16 nt, Human
agauaaaaaguggaau

SEQ ID NO: 2890735 - RNA, 17 nt, Human
agauaaaaaguggaauu

SEQ ID NO: 2890736 - RNA, 21 nt, Human
agauaaaaaguggaauuucuu

SEQ ID NO: 2890737 - RNA, 18 nt, Human
agauaaaagcugaaguua

SEQ ID NO: 2890738 - RNA, 19 nt, Human
agauaaucagugugucuaa

SEQ ID NO: 2890739 - RNA, 17 nt, Human
agauaaucagccucuua

SEQ ID NO: 2890740 - RNA, 16 nt, Human
agauaaucagccucuu

SEQ ID NO: 2890741 - RNA, 15 nt, Human
agauaaucagccucu

SEQ ID NO: 2890742 - RNA, 22 nt, Human
agauaauaauggguuucuuuca

SEQ ID NO: 2890743 - RNA, 14 nt, Human
agauaaucagccuc

SEQ ID NO: 2890744 - RNA, 15 nt, Human
agauaauuaaaaaga

SEQ ID NO: 2890745 - RNA, 22 nt, Human
agauaauuaaaaagaugguugc

SEQ ID NO: 2890746 - RNA, 14 nt, Human
agauacaaauuaau

SEQ ID NO: 2890747 - RNA, 18 nt, Human
agauacaaauuaauuuua

SEQ ID NO: 2890748 - RNA, 14 nt, Human
agauaauugcuauu

SEQ ID NO: 2890749 - RNA, 18 nt, Human
agauaauugcuauuuauu

SEQ ID NO: 2890750 - RNA, 17 nt, Human
agauaauuguugaaauu

SEQ ID NO: 2890751 - RNA, 18 nt, Human
agauaauuguugaaauuu

SEQ ID NO: 2890752 - RNA, 22 nt, Human
agauaauuguugaaauuuugca

SEQ ID NO: 2890753 - RNA, 18 nt, Human
agauaauucuagcuuuga

SEQ ID NO: 2890754 - RNA, 16 nt, Human
agauaaucuagaacac

SEQ ID NO: 2890755 - RNA, 23 nt, Human
agauaaucuagaacacaggcaaa

SEQ ID NO: 2890756 - RNA, 15 nt, Human
ugaagauguugagaa

SEQ ID NO: 2890757 - RNA, 16 nt, Human
ugaagauguugagaaa

SEQ ID NO: 2890758 - RNA, 17 nt, Human
ugaagcagcuuuaaaca

SEQ ID NO: 2890759 - RNA, 19 nt, Human
ugaagcagcuuuaaacaaa

SEQ ID NO: 2890760 - RNA, 17 nt, Human
agaggugggagggcccu

SEQ ID NO: 2890761 - RNA, 18 nt, Human
agagguggccagagcugg

SEQ ID NO: 2890762 - RNA, 14 nt, Human
agaggugggagggc

SEQ ID NO: 2890763 - RNA, 13 nt, Human
agagguggccaga

SEQ ID NO: 2890764 - RNA, 13 nt, Human
agaggugcuucac

SEQ ID NO: 2890765 - RNA, 16 nt, Human
agaggugcuucacccu

SEQ ID NO: 2890766 - RNA, 16 nt, Human
ugaagcauguuucaug

SEQ ID NO: 2890767 - RNA, 14 nt, Human
ugaagcauguuuca

SEQ ID NO: 2890768 - RNA, 19 nt, Human
ugaagccacugaagcuggg

SEQ ID NO: 2890769 - RNA, 20 nt, Human
ugaagcauguuucauguuuu

SEQ ID NO: 2890770 - RNA, 18 nt, Human
ugaagcauucuccccagu

SEQ ID NO: 2890771 - RNA, 21 nt, Human
ugaagcauucuccccagugua

SEQ ID NO: 2890772 - RNA, 14 nt, Human
ugaagcaguugugu

SEQ ID NO: 2890773 - RNA, 17 nt, Human
ugaagcaguugugucag

SEQ ID NO: 2890774 - RNA, 20 nt, Human
ugaagccacugaagcuggga

SEQ ID NO: 2890775 - RNA, 19 nt, Human
ugaagcauguuucauguuu

SEQ ID NO: 2890776 - RNA, 12 nt, Human
ugaagccagccu

SEQ ID NO: 2890777 - RNA, 13 nt, Human
ugaagccagccuu

SEQ ID NO: 2890778 - RNA, 14 nt, Human
ugaagccagccuuc

SEQ ID NO: 2890779 - RNA, 21 nt, Human
ugaagccagccuucuuccauc

SEQ ID NO: 2890780 - RNA, 11 nt, Human
ugaagccagcu

SEQ ID NO: 2890781 - RNA, 23 nt, Human
ugaagccagcucacagugcugug

SEQ ID NO: 2890782 - RNA, 17 nt, Human
ugaagcccauuucuccg

SEQ ID NO: 2890783 - RNA, 16 nt, Human
ugaagcccaagugaaa

SEQ ID NO: 2890784 - RNA, 16 nt, Human
ugaagccagccuucuu

SEQ ID NO: 2890785 - RNA, 22 nt, Human
ugaagcuucacucacugucaau

SEQ ID NO: 2890786 - RNA, 13 nt, Human
ugaagccugugga

SEQ ID NO: 2890787 - RNA, 13 nt, Human
ugaagcugaaaau

SEQ ID NO: 2890788 - RNA, 14 nt, Human
ugaagcugaaaaua

SEQ ID NO: 2890789 - RNA, 15 nt, Human
ugaagcugaaaauau

SEQ ID NO: 2890790 - RNA, 14 nt, Human
ugaagccucuggga

SEQ ID NO: 2890791 - RNA, 15 nt, Human
ugaagcccucccagg

SEQ ID NO: 2890792 - RNA, 13 nt, Human
ugaagccucuggg

SEQ ID NO: 2890793 - RNA, 22 nt, Human
ugaagccugcguugguccagag

SEQ ID NO: 2890794 - RNA, 23 nt, Human
ugaagccugcguugguccagagc

SEQ ID NO: 2890795 - RNA, 19 nt, Human
agagggaccucucccaggg

SEQ ID NO: 2890796 - RNA, 16 nt, Human
agagggaccucuccca

SEQ ID NO: 2890797 - RNA, 15 nt, Human
agagggaccucuccc

SEQ ID NO: 2890798 - RNA, 14 nt, Human
agagggaccaugug

SEQ ID NO: 2890799 - RNA, 17 nt, Human
agagggaccauguguca

SEQ ID NO: 2890800 - RNA, 19 nt, Human
agaggccuuuuggaaugug

SEQ ID NO: 2890801 - RNA, 18 nt, Human
agaggcagaaaauugcac

SEQ ID NO: 2890802 - RNA, 20 nt, Human
agaggcagaaaauugcacaa

SEQ ID NO: 2890803 - RNA, 19 nt, Human
agaggaaauauugcugggg

SEQ ID NO: 2890804 - RNA, 20 nt, Human
agaggaaauauugcuggggu

SEQ ID NO: 2890805 - RNA, 11 nt, Human
ugaacuuucuc

SEQ ID NO: 2890806 - RNA, 22 nt, Human
ugaacuuucucuucauacuuuu

SEQ ID NO: 2890807 - RNA, 13 nt, Human
ugaacuuugaaga

SEQ ID NO: 2890808 - RNA, 14 nt, Human
ugaacuuguagcug

SEQ ID NO: 2890809 - RNA, 15 nt, Human
ugaacuuguagcugu

SEQ ID NO: 2890810 - RNA, 16 nt, Human
ugaacuuguagcugua

SEQ ID NO: 2890811 - RNA, 17 nt, Human
ugaacuuguagcuguaa

SEQ ID NO: 2890812 - RNA, 18 nt, Human
ugaacuuguagcuguaaa

SEQ ID NO: 2890813 - RNA, 19 nt, Human
ugaacuuguagcuguaaaa

SEQ ID NO: 2890814 - RNA, 21 nt, Human
ugaacuuguagcuguaaaacg

SEQ ID NO: 2890815 - RNA, 13 nt, Human
ugaacuuuccugg

SEQ ID NO: 2890816 - RNA, 21 nt, Human
ugaacuuuccuggaugucuga

SEQ ID NO: 2890817 - RNA, 23 nt, Human
ucuuuguaagaguguagaagcau

SEQ ID NO: 2890818 - RNA, 24 nt, Human
ucuuuguaagaguguagaagcauu

SEQ ID NO: 2890819 - RNA, 12 nt, Human
ucuuuguaaguc

SEQ ID NO: 2890820 - RNA, 17 nt, Human
ucuuuguaagucagugu

SEQ ID NO: 2890821 - RNA, 21 nt, Human
ucuuuguaagucaguguugag

SEQ ID NO: 2890822 - RNA, 22 nt, Human
ucuuuguaagucaguguugaga

SEQ ID NO: 2890823 - RNA, 19 nt, Human
ucuuuguaagaguguagaa

SEQ ID NO: 2890824 - RNA, 21 nt, Human
ucuuuguaagaguguagaagc

SEQ ID NO: 2890825 - RNA, 22 nt, Human
ucuuuguaagaguguagaagca

SEQ ID NO: 2890826 - RNA, 19 nt, Human
agagcugggugucaagagg

SEQ ID NO: 2890827 - RNA, 13 nt, Human
agagcuggugccc

SEQ ID NO: 2890828 - RNA, 21 nt, Human
ugaacuuucucuucauacuuu

SEQ ID NO: 2890829 - RNA, 12 nt, Human
agagcugggagg

SEQ ID NO: 2890830 - RNA, 22 nt, Human
agagcugggaggcauggcccug

SEQ ID NO: 2890831 - RNA, 23 nt, Human
agagcugggaggcauggcccugg

SEQ ID NO: 2890832 - RNA, 15 nt, Human
agagcuggugcccgg

SEQ ID NO: 2890833 - RNA, 15 nt, Human
agagcuucuggcacu

SEQ ID NO: 2890834 - RNA, 21 nt, Human
agagcuucuguugcugccuca

SEQ ID NO: 2890835 - RNA, 20 nt, Human
agagcuucuguugcugccuc

SEQ ID NO: 2890836 - RNA, 19 nt, Human
agagcuucuguugcugccu

SEQ ID NO: 2890837 - RNA, 20 nt, Human
agaugcuagcgcguugccug

SEQ ID NO: 2890838 - RNA, 21 nt, Human
agaugcuagcgcguugccugu

SEQ ID NO: 2890839 - RNA, 10 nt, Human
agaugcucaa

SEQ ID NO: 2890840 - RNA, 15 nt, Human
agaugcucaaaguug

SEQ ID NO: 2890841 - RNA, 20 nt, Human
agaugcucaaaguuguuuuu

SEQ ID NO: 2890842 - RNA, 13 nt, Human
agaugcuccaaga

SEQ ID NO: 2890843 - RNA, 15 nt, Human
agaugcuccaagauu

SEQ ID NO: 2890844 - RNA, 18 nt, Human
agaugcuccaagauucua

SEQ ID NO: 2890845 - RNA, 19 nt, Human
agaugcuccaagauucuag

SEQ ID NO: 2890846 - RNA, 20 nt, Human
agaugcuccaagauucuaga

SEQ ID NO: 2890847 - RNA, 21 nt, Human
agaugcuccaagauucuagau

SEQ ID NO: 2890848 - RNA, 22 nt, Human
agaugcuccaagauucuagaug

SEQ ID NO: 2890849 - RNA, 23 nt, Human
agaugcuccaagauucuagauga

SEQ ID NO: 2890850 - RNA, 19 nt, Human
agaugcuuuccuaaaucag

SEQ ID NO: 2890851 - RNA, 12 nt, Human
agaugucccuug

SEQ ID NO: 2890852 - RNA, 16 nt, Human
agaugucccuugaugc

SEQ ID NO: 2890853 - RNA, 21 nt, Human
agaugucccuugaugcacaga

SEQ ID NO: 2890854 - RNA, 22 nt, Human
agaugucccuugaugcacagag

SEQ ID NO: 2890855 - RNA, 23 nt, Human
agaugucccuugaugcacagaga

SEQ ID NO: 2890856 - RNA, 24 nt, Human
agaugucccuugaugcacagagaa

SEQ ID NO: 2890857 - RNA, 18 nt, Human
agaugucagacuggcugg

SEQ ID NO: 2890858 - RNA, 13 nt, Human
agaugucaucaga

SEQ ID NO: 2890859 - RNA, 15 nt, Human
agaugucaucagagc

SEQ ID NO: 2890860 - RNA, 22 nt, Human
agaugucaucagagcuccucug

SEQ ID NO: 2890861 - RNA, 15 nt, Human
agaugucugucucug

SEQ ID NO: 2890862 - RNA, 11 nt, Human
agaugucuguu

SEQ ID NO: 2890863 - RNA, 16 nt, Human
agauggcaaaugacca

SEQ ID NO: 2890864 - RNA, 15 nt, Human
agaugucagacuggc

SEQ ID NO: 2890865 - RNA, 18 nt, Human
agauggaguuucuaaggu

SEQ ID NO: 2890866 - RNA, 16 nt, Human
agauggaguuucuaag

SEQ ID NO: 2890867 - RNA, 17 nt, Human
agauggaguuucuaagg

SEQ ID NO: 2890868 - RNA, 17 nt, Human
agauggaguucuugugc

SEQ ID NO: 2890869 - RNA, 19 nt, Human
agauggaguucuugugcca

SEQ ID NO: 2890870 - RNA, 13 nt, Human
agauggaguuucu

SEQ ID NO: 2890871 - RNA, 17 nt, Human
agauggaaaaacuugug

SEQ ID NO: 2890872 - RNA, 14 nt, Human
agauggaguuucua

SEQ ID NO: 2890873 - RNA, 15 nt, Human
agauggaguuucuaa

SEQ ID NO: 2890874 - RNA, 13 nt, Human
ugaccucugccug

SEQ ID NO: 2890875 - RNA, 20 nt, Human
ugaccccucauagcccucac

SEQ ID NO: 2890876 - RNA, 19 nt, Human
ugaccccucauagcccuca

SEQ ID NO: 2890877 - RNA, 22 nt, Human
ugacccccaaccaaguggcucc

SEQ ID NO: 2890878 - RNA, 13 nt, Human
ugacccagugaga

SEQ ID NO: 2890879 - RNA, 17 nt, Human
ugaccccucauagcccu

SEQ ID NO: 2890880 - RNA, 12 nt, Human
ugaccucuugcu

SEQ ID NO: 2890881 - RNA, 13 nt, Human
ugaccucuugcug

SEQ ID NO: 2890882 - RNA, 14 nt, Human
ugaccucuugcugu

SEQ ID NO: 2890883 - RNA, 15 nt, Human
ugaccucuugcuguc

SEQ ID NO: 2890884 - RNA, 16 nt, Human
ugaccucuugcugucu

SEQ ID NO: 2890885 - RNA, 17 nt, Human
ugaccucuugcugucuc

SEQ ID NO: 2890886 - RNA, 18 nt, Human
ugaccucuugcugucucu

SEQ ID NO: 2890887 - RNA, 19 nt, Human
ugaccucuugcugucucug

SEQ ID NO: 2890888 - RNA, 21 nt, Human
ugaccucuugcugucucugcu

SEQ ID NO: 2890889 - RNA, 22 nt, Human
ugaccucuugcugucucugcuc

SEQ ID NO: 2890890 - RNA, 23 nt, Human
ugaccucuugcugucucugcucg

SEQ ID NO: 2890891 - RNA, 14 nt, Human
ugaccucugccuga

SEQ ID NO: 2890892 - RNA, 23 nt, Human
ugaccccgguggcggccccagca

SEQ ID NO: 2890893 - RNA, 17 nt, Human
ugaccucuguccucccu

SEQ ID NO: 2890894 - RNA, 19 nt, Human
agauguguggacuguggca

SEQ ID NO: 2890895 - RNA, 16 nt, Human
agaugugucuauggcu

SEQ ID NO: 2890896 - RNA, 13 nt, Human
ugacccaggcugg

SEQ ID NO: 2890897 - RNA, 12 nt, Human
ugacccaggcug

SEQ ID NO: 2890898 - RNA, 14 nt, Human
ugacccaggcuggg

SEQ ID NO: 2890899 - RNA, 15 nt, Human
ugacccaggcugggc

SEQ ID NO: 2890900 - RNA, 17 nt, Human
ugacccaggcugggcaa

SEQ ID NO: 2890901 - RNA, 19 nt, Human
ugacccaggcugggcaagg

SEQ ID NO: 2890902 - RNA, 16 nt, Human
agaugauggaugccaa

SEQ ID NO: 2890903 - RNA, 12 nt, Human
agaugauguauu

SEQ ID NO: 2890904 - RNA, 14 nt, Human
agaugauuaaaaug

SEQ ID NO: 2890905 - RNA, 19 nt, Human
agaugauggaugccaauau

SEQ ID NO: 2890906 - RNA, 18 nt, Human
agaugauuaaauaagauu

SEQ ID NO: 2890907 - RNA, 19 nt, Human
agaugauuaaauaagauuc

SEQ ID NO: 2890908 - RNA, 20 nt, Human
agaugauuaaauaagauucu

SEQ ID NO: 2890909 - RNA, 21 nt, Human
agaugauuaaauaagauucua

SEQ ID NO: 2890910 - RNA, 22 nt, Human
agaugauuaaauaagauucuaa

SEQ ID NO: 2890911 - RNA, 12 nt, Human
agaugauucugg

SEQ ID NO: 2890912 - RNA, 21 nt, Human
agaugauucuggcugaaaaag

SEQ ID NO: 2890913 - RNA, 14 nt, Human
agaugauuugcaau

SEQ ID NO: 2890914 - RNA, 14 nt, Human
agauccuuguuuca

SEQ ID NO: 2890915 - RNA, 15 nt, Human
agauccuuguuucaa

SEQ ID NO: 2890916 - RNA, 21 nt, Human
agauccugucuuuaaggaaaa

SEQ ID NO: 2890917 - RNA, 13 nt, Human
agauccugugagg

SEQ ID NO: 2890918 - RNA, 15 nt, Human
agauccugugaggag

SEQ ID NO: 2890919 - RNA, 23 nt, Human
agauccugugaggagccccaucu

SEQ ID NO: 2890920 - RNA, 20 nt, Human
agauccuuuaaauccuucca

SEQ ID NO: 2890921 - RNA, 18 nt, Human
agauccuuguuucaaaca

SEQ ID NO: 2890922 - RNA, 20 nt, Human
agauccuuguuucaaacaca

SEQ ID NO: 2890923 - RNA, 16 nt, Human
agaucauuuguucugg

SEQ ID NO: 2890924 - RNA, 15 nt, Human
ugaccaauugugcug

SEQ ID NO: 2890925 - RNA, 16 nt, Human
ugaccaauugugcugc

SEQ ID NO: 2890926 - RNA, 17 nt, Human
ugaccaauugugcugcc

SEQ ID NO: 2890927 - RNA, 18 nt, Human
ugaccaauugugcugcca

SEQ ID NO: 2890928 - RNA, 19 nt, Human
ugaccaauugugcugccau

SEQ ID NO: 2890929 - RNA, 17 nt, Human
ugaccaacaguuccuuc

SEQ ID NO: 2890930 - RNA, 18 nt, Human
ugaccaacaggcuguucu

SEQ ID NO: 2890931 - RNA, 23 nt, Human
ugaccaacaggcuguucugcacu

SEQ ID NO: 2890932 - RNA, 20 nt, Human
ugaccacacuccagcuggga

SEQ ID NO: 2890933 - RNA, 19 nt, Human
ugaccacacuccagcuggg

SEQ ID NO: 2890934 - RNA, 17 nt, Human
ugaccacacuccagcug

SEQ ID NO: 2890935 - RNA, 12 nt, Human
ugaccacacucc

SEQ ID NO: 2890936 - RNA, 20 nt, Human
ugaauuuauugcacauuguu

SEQ ID NO: 2890937 - RNA, 11 nt, Human
ugacagucauc

SEQ ID NO: 2890938 - RNA, 13 nt, Human
ugacagucaucau

SEQ ID NO: 2890939 - RNA, 14 nt, Human
ugacagucaucauc

SEQ ID NO: 2890940 - RNA, 17 nt, Human
ugacagucaucaucagg

SEQ ID NO: 2890941 - RNA, 18 nt, Human
ugacagucaucaucaggg

SEQ ID NO: 2890942 - RNA, 19 nt, Human
ugacagucaucaucagggc

SEQ ID NO: 2890943 - RNA, 20 nt, Human
ugacagucaucaucagggcc

SEQ ID NO: 2890944 - RNA, 21 nt, Human
ugacagucaucaucagggccu

SEQ ID NO: 2890945 - RNA, 22 nt, Human
ugacagucaucaucagggccug

SEQ ID NO: 2890946 - RNA, 23 nt, Human
ugacagucaucaucagggccugg

SEQ ID NO: 2890947 - RNA, 18 nt, Human
agaucagaugcuccaaga

SEQ ID NO: 2890948 - RNA, 22 nt, Human
agaucagaugcuccaagauucu

SEQ ID NO: 2890949 - RNA, 23 nt, Human
agaucagaugcuccaagauucua

SEQ ID NO: 2890950 - RNA, 20 nt, Human
agaucagaaaaauggagcaa

SEQ ID NO: 2890951 - RNA, 21 nt, Human
agaucagaaaaauggagcaaa

SEQ ID NO: 2890952 - RNA, 19 nt, Human
ugaauuuagugagauuuac

SEQ ID NO: 2890953 - RNA, 20 nt, Human
ugaauuuagugagauuuacc

SEQ ID NO: 2890954 - RNA, 15 nt, Human
ugaauuuaaauauaa

SEQ ID NO: 2890955 - RNA, 14 nt, Human
ugaauuuaaauaua

SEQ ID NO: 2890956 - RNA, 16 nt, Human
ugaauuuaaauauaau

SEQ ID NO: 2890957 - RNA, 19 nt, Human
ugaauuuaaauauaauucu

SEQ ID NO: 2890958 - RNA, 20 nt, Human
ugaauuuaaauauaauucug

SEQ ID NO: 2890959 - RNA, 17 nt, Human
ugaauuuauaaaguacc

SEQ ID NO: 2890960 - RNA, 21 nt, Human
ugaauuuauaccuaccugugu

SEQ ID NO: 2890961 - RNA, 16 nt, Human
ugaccaaaguccuuuu

SEQ ID NO: 2890962 - RNA, 14 nt, Human
ugaccaaaguccuu

SEQ ID NO: 2890963 - RNA, 16 nt, Human
ugacauuuuacauuaa

SEQ ID NO: 2890964 - RNA, 15 nt, Human
ugacauuuuacauua

SEQ ID NO: 2890965 - RNA, 18 nt, Human
ugacauuguagagcuucu

SEQ ID NO: 2890966 - RNA, 14 nt, Human
ugacauugccaaaa

SEQ ID NO: 2890967 - RNA, 18 nt, Human
ugacauugccaaaaagga

SEQ ID NO: 2890968 - RNA, 19 nt, Human
ugacauugccaaaaaggau

SEQ ID NO: 2890969 - RNA, 14 nt, Human
ugacauuuuacauu

SEQ ID NO: 2890970 - RNA, 12 nt, Human
ugacauuuuaca

SEQ ID NO: 2890971 - RNA, 15 nt, Human
ugacagucuugugcu

SEQ ID NO: 2890972 - RNA, 23 nt, Human
ugacagucuugugcuuuuccuau

SEQ ID NO: 2890973 - RNA, 19 nt, Human
ugacauugcguuugaccuu

SEQ ID NO: 2890974 - RNA, 15 nt, Human
ugacauugcguuuga

SEQ ID NO: 2890975 - RNA, 24 nt, Human
ugacuguucaagagcacacuuggc

SEQ ID NO: 2890976 - RNA, 15 nt, Human
ugacuguugauguac

SEQ ID NO: 2890977 - RNA, 16 nt, Human
ugacugugcuacuguc

SEQ ID NO: 2890978 - RNA, 18 nt, Human
ugacuguucaagagcaca

SEQ ID NO: 2890979 - RNA, 17 nt, Human
ugacuucaaugauagua

SEQ ID NO: 2890980 - RNA, 16 nt, Human
ugacuguaucugugua

SEQ ID NO: 2890981 - RNA, 18 nt, Human
ugacuguaucuguguaga

SEQ ID NO: 2890982 - RNA, 17 nt, Human
ugacuguaucuguguag

SEQ ID NO: 2890983 - RNA, 19 nt, Human
ugacuccaagaacaauugu

SEQ ID NO: 2890984 - RNA, 19 nt, Human
ugacuccacgauccugcca

SEQ ID NO: 2890985 - RNA, 20 nt, Human
ugacuccacgauccugccac

SEQ ID NO: 2890986 - RNA, 21 nt, Human
ugacuccacgauccugccacc

SEQ ID NO: 2890987 - RNA, 22 nt, Human
ugacuccacgauccugccaccc

SEQ ID NO: 2890988 - RNA, 17 nt, Human
ugacugucacuguuccu

SEQ ID NO: 2890989 - RNA, 24 nt, Human
ugacuguccucuccccuccagccu

SEQ ID NO: 2890990 - RNA, 19 nt, Human
ugacuguaucuguguagac

SEQ ID NO: 2890991 - RNA, 16 nt, Human
ugacugucacuguucc

SEQ ID NO: 2890992 - RNA, 13 nt, Human
ugacugucacugu

SEQ ID NO: 2890993 - RNA, 15 nt, Human
ugacucaucauuugu

SEQ ID NO: 2890994 - RNA, 22 nt, Human
ugaccugacuugccuccguguc

SEQ ID NO: 2890995 - RNA, 23 nt, Human
ugacucaggauuuaaaaacugga

SEQ ID NO: 2890996 - RNA, 14 nt, Human
agauucaaagguuc

SEQ ID NO: 2890997 - RNA, 15 nt, Human
agauucaaagguucu

SEQ ID NO: 2890998 - RNA, 16 nt, Human
agauuauuuuauuaug

SEQ ID NO: 2890999 - RNA, 13 nt, Human
agauuauuuugga

SEQ ID NO: 2891000 - RNA, 14 nt, Human
agauuauuuuggaa

SEQ ID NO: 2891001 - RNA, 17 nt, Human
agauuauuuuggaaagu

SEQ ID NO: 2891002 - RNA, 20 nt, Human
agauuauuuuggaaaguuuu

SEQ ID NO: 2891003 - RNA, 16 nt, Human
agauucaaagguucua

SEQ ID NO: 2891004 - RNA, 17 nt, Human
agauucaaagguucuag

SEQ ID NO: 2891005 - RNA, 18 nt, Human
agauucaaagguucuagg

SEQ ID NO: 2891006 - RNA, 19 nt, Human
agauucaaagguucuaggu

SEQ ID NO: 2891007 - RNA, 16 nt, Human
agauucaaucccagga

SEQ ID NO: 2891008 - RNA, 21 nt, Human
agauucaaagguucuagguuu

SEQ ID NO: 2891009 - RNA, 14 nt, Human
agauucaaggcccc

SEQ ID NO: 2891010 - RNA, 20 nt, Human
agauuauaggcaccuaccac

SEQ ID NO: 2891011 - RNA, 15 nt, Human
agauuauaucaaagu

SEQ ID NO: 2891012 - RNA, 16 nt, Human
agauuauaucaaagua

SEQ ID NO: 2891013 - RNA, 18 nt, Human
agauuauaucaaaguauu

SEQ ID NO: 2891014 - RNA, 21 nt, Human
agauuauagauucuaaagauu

SEQ ID NO: 2891015 - RNA, 23 nt, Human
agauuauagauucuaaagauucu

SEQ ID NO: 2891016 - RNA, 15 nt, Human
agauuaucuauuugu

SEQ ID NO: 2891017 - RNA, 18 nt, Human
ugacuuuauauggaugau

SEQ ID NO: 2891018 - RNA, 20 nt, Human
ugacuuuagaaagcugacau

SEQ ID NO: 2891019 - RNA, 21 nt, Human
ugacuuuagaaagcugacauu

SEQ ID NO: 2891020 - RNA, 12 nt, Human
ugacuuucaggu

SEQ ID NO: 2891021 - RNA, 14 nt, Human
ugacuucuccaggu

SEQ ID NO: 2891022 - RNA, 17 nt, Human
ugacuucuaauaucauu

SEQ ID NO: 2891023 - RNA, 20 nt, Human
ugacuucuaauaucauucac

SEQ ID NO: 2891024 - RNA, 23 nt, Human
ugacuucuccaggucucacgggc

SEQ ID NO: 2891025 - RNA, 15 nt, Human
ugacuucuccagguc

SEQ ID NO: 2891026 - RNA, 16 nt, Human
ugacuucuccaggucu

SEQ ID NO: 2891027 - RNA, 14 nt, Human
ugacuuccacaccu

SEQ ID NO: 2891028 - RNA, 19 nt, Human
ugacuuccucgccucuccc

SEQ ID NO: 2891029 - RNA, 21 nt, Human
ugacuuccucgccucucccac

SEQ ID NO: 2891030 - RNA, 13 nt, Human
ugacuucauggaa

SEQ ID NO: 2891031 - RNA, 19 nt, Human
ugacuucauggaauggaca

SEQ ID NO: 2891032 - RNA, 21 nt, Human
ugacuucauggaauggacauc

SEQ ID NO: 2891033 - RNA, 23 nt, Human
ugacuucaaugauaguaagaaaa

SEQ ID NO: 2891034 - RNA, 21 nt, Human
ugacuucugcuggcaucaaga

SEQ ID NO: 2891035 - RNA, 13 nt, Human
ugacuucugugag

SEQ ID NO: 2891036 - RNA, 16 nt, Human
ugacuugcaugaagag

SEQ ID NO: 2891037 - RNA, 17 nt, Human
ugacuugcaugaagaga

SEQ ID NO: 2891038 - RNA, 19 nt, Human
ugacuugcaugaagagaag

SEQ ID NO: 2891039 - RNA, 23 nt, Human
ugacuugcaugaagagaagcaau

SEQ ID NO: 2891040 - RNA, 18 nt, Human
ugacuuggggagauggag

SEQ ID NO: 2891041 - RNA, 19 nt, Human
ugacuuggggagauggagu

SEQ ID NO: 2891042 - RNA, 12 nt, Human
ugacuuggggga

SEQ ID NO: 2891043 - RNA, 19 nt, Human
ugacuugugguugaauuaa

SEQ ID NO: 2891044 - RNA, 15 nt, Human
ugacuuguuugucuu

SEQ ID NO: 2891045 - RNA, 18 nt, Human
ugacuuguuugucuucca

SEQ ID NO: 2891046 - RNA, 19 nt, Human
ugacuuguuugucuuccau

SEQ ID NO: 2891047 - RNA, 16 nt, Human
ugacuuuaauuuaugu

SEQ ID NO: 2891048 - RNA, 17 nt, Human
ugacuuuaauuuaugua

SEQ ID NO: 2891049 - RNA, 19 nt, Human
agauuuaagcacaaacuuu

SEQ ID NO: 2891050 - RNA, 20 nt, Human
agauuuaagcacaaacuuua

SEQ ID NO: 2891051 - RNA, 11 nt, Human
agauuguaaac

SEQ ID NO: 2891052 - RNA, 22 nt, Human
agauuguaaaccgcuuuggccu

SEQ ID NO: 2891053 - RNA, 23 nt, Human
agauuguaaaccgcuuuggccug

SEQ ID NO: 2891054 - RNA, 14 nt, Human
agauuguauugcug

SEQ ID NO: 2891055 - RNA, 15 nt, Human
agauuguauugcugu

SEQ ID NO: 2891056 - RNA, 21 nt, Human
agauuguccagugcaaccaca

SEQ ID NO: 2891057 - RNA, 21 nt, Human
agauuggugggauuuuuuguu

SEQ ID NO: 2891058 - RNA, 17 nt, Human
agauucacacugucugg

SEQ ID NO: 2891059 - RNA, 16 nt, Human
agauucaccuaagaga

SEQ ID NO: 2891060 - RNA, 17 nt, Human
agauucaccuaagagau

SEQ ID NO: 2891061 - RNA, 18 nt, Human
agauucaccuaagagauu

SEQ ID NO: 2891062 - RNA, 20 nt, Human
agauucaccuaagagauucu

SEQ ID NO: 2891063 - RNA, 13 nt, Human
agauucacacugu

SEQ ID NO: 2891064 - RNA, 20 nt, Human
agauugugccacugcucucc

SEQ ID NO: 2891065 - RNA, 17 nt, Human
agauugucuuaauuucu

SEQ ID NO: 2891066 - RNA, 12 nt, Human
agauuuagugua

SEQ ID NO: 2891067 - RNA, 19 nt, Human
agauuuaguguaauaagac

SEQ ID NO: 2891068 - RNA, 15 nt, Human
agauuuauauaaaug

SEQ ID NO: 2891069 - RNA, 17 nt, Human
agauuuauauaaaugua

SEQ ID NO: 2891070 - RNA, 17 nt, Human
agauuucaagaaaaaau

SEQ ID NO: 2891071 - RNA, 18 nt, Human
agauuucaagaaaaaaua

SEQ ID NO: 2891072 - RNA, 19 nt, Human
agauuucaagaaaaaauaa

SEQ ID NO: 2891073 - RNA, 18 nt, Human
agauuuauuuuucaguuc

SEQ ID NO: 2891074 - RNA, 20 nt, Human
agauuuauuuuucaguucca

SEQ ID NO: 2891075 - RNA, 21 nt, Human
agauuuauuuuucaguuccaa

SEQ ID NO: 2891076 - RNA, 13 nt, Human
agauuuaucaaau

SEQ ID NO: 2891077 - RNA, 17 nt, Human
agauuuaucaaaucagu

SEQ ID NO: 2891078 - RNA, 15 nt, Human
agauuuaucaaauca

SEQ ID NO: 2891079 - RNA, 16 nt, Human
agauuuaucaaaucag

SEQ ID NO: 2891080 - RNA, 12 nt, Human
agauuugaccuc

SEQ ID NO: 2891081 - RNA, 13 nt, Human
agauuugaccucc

SEQ ID NO: 2891082 - RNA, 15 nt, Human
agauuugaccuccuc

SEQ ID NO: 2891083 - RNA, 19 nt, Human
agauuugaccuccucccug

SEQ ID NO: 2891084 - RNA, 22 nt, Human
agauuugaccuccucccuguua

SEQ ID NO: 2891085 - RNA, 12 nt, Human
agauuucaagau

SEQ ID NO: 2891086 - RNA, 12 nt, Human
agauuuggaaua

SEQ ID NO: 2891087 - RNA, 22 nt, Human
agauuuggaauaggaauaagcu

SEQ ID NO: 2891088 - RNA, 13 nt, Human
agauuugggcugg

SEQ ID NO: 2891089 - RNA, 20 nt, Human
agauuuaccagggauguaga

SEQ ID NO: 2891090 - RNA, 14 nt, Human
agauuugggcugga

SEQ ID NO: 2891091 - RNA, 17 nt, Human
agauuugggcuggaaca

SEQ ID NO: 2891092 - RNA, 22 nt, Human
agauuuguaggaaggucucauu

SEQ ID NO: 2891093 - RNA, 23 nt, Human
agauuuguaggaaggucucauuc

SEQ ID NO: 2891094 - RNA, 15 nt, Human
agauuugucuaauug

SEQ ID NO: 2891095 - RNA, 12 nt, Human
agauuuucagaa

SEQ ID NO: 2891096 - RNA, 17 nt, Human
agauuuucagaaaauau

SEQ ID NO: 2891097 - RNA, 14 nt, Human
agauuuucagucua

SEQ ID NO: 2891098 - RNA, 14 nt, Human
agauuuuauuuuac

SEQ ID NO: 2891099 - RNA, 15 nt, Human
agauuuuauuuuacu

SEQ ID NO: 2891100 - RNA, 12 nt, Human
agcaaaaagugg

SEQ ID NO: 2891101 - RNA, 17 nt, Human
agcaaaaaguggggcag

SEQ ID NO: 2891102 - RNA, 22 nt, Human
agcaaaaaguggggcagagccu

SEQ ID NO: 2891103 - RNA, 16 nt, Human
agcaaaaauauaaaau

SEQ ID NO: 2891104 - RNA, 11 nt, Human
agcaaaaaugc

SEQ ID NO: 2891105 - RNA, 13 nt, Human
agcaaaaaugcua

SEQ ID NO: 2891106 - RNA, 14 nt, Human
agcaaaaaugcuaa

SEQ ID NO: 2891107 - RNA, 15 nt, Human
agcaaaaaugcuaau

SEQ ID NO: 2891108 - RNA, 16 nt, Human
agcaaaaaugcuaaua

SEQ ID NO: 2891109 - RNA, 17 nt, Human
agcaaaaaugcuaauau

SEQ ID NO: 2891110 - RNA, 20 nt, Human
agcaaaaaugcuaauauuaa

SEQ ID NO: 2891111 - RNA, 21 nt, Human
agcaaaaaugcuaauauuaaa

SEQ ID NO: 2891112 - RNA, 18 nt, Human
agcaacacagccugggcc

SEQ ID NO: 2891113 - RNA, 17 nt, Human
agcaacacagccugggc

SEQ ID NO: 2891114 - RNA, 15 nt, Human
agcaacacagccugg

SEQ ID NO: 2891115 - RNA, 13 nt, Human
agcaacacagccu

SEQ ID NO: 2891116 - RNA, 11 nt, Human
agcaacacaga

SEQ ID NO: 2891117 - RNA, 15 nt, Human
agcaacacagaggaa

SEQ ID NO: 2891118 - RNA, 22 nt, Human
agcaacacagaggaauuuauac

SEQ ID NO: 2891119 - RNA, 21 nt, Human
agcaacacagccugggcccca

SEQ ID NO: 2891120 - RNA, 20 nt, Human
agcaacagagugagacccug

SEQ ID NO: 2891121 - RNA, 23 nt, Human
agcaacagagugagacccugucu

SEQ ID NO: 2891122 - RNA, 14 nt, Human
agcaacaggaaaaa

SEQ ID NO: 2891123 - RNA, 22 nt, Human
agcaacagagugagacccuguc

SEQ ID NO: 2891124 - RNA, 20 nt, Human
agcaacauuuuacccacaca

SEQ ID NO: 2891125 - RNA, 21 nt, Human
agcaacaggaaucaagagcug

SEQ ID NO: 2891126 - RNA, 22 nt, Human
agcaacaggaaucaagagcugc

SEQ ID NO: 2891127 - RNA, 23 nt, Human
agcaacaggaaucaagagcugcc

SEQ ID NO: 2891128 - RNA, 22 nt, Human
agcaacauuuuacccacacaca

SEQ ID NO: 2891129 - RNA, 19 nt, Human
ucucugcuccaccacaucc

SEQ ID NO: 2891130 - RNA, 17 nt, Human
ucucugcucgcccuccu

SEQ ID NO: 2891131 - RNA, 22 nt, Human
ucucugcucgcccuccuuucug

SEQ ID NO: 2891132 - RNA, 17 nt, Human
ucucugcuccaccacau

SEQ ID NO: 2891133 - RNA, 15 nt, Human
ucucugcuccaccac

SEQ ID NO: 2891134 - RNA, 14 nt, Human
ucucugcuccacca

SEQ ID NO: 2891135 - RNA, 13 nt, Human
ucucugcuccacc

SEQ ID NO: 2891136 - RNA, 12 nt, Human
ucucugcuccac

SEQ ID NO: 2891137 - RNA, 11 nt, Human
ucucugcucca

SEQ ID NO: 2891138 - RNA, 12 nt, Human
ucucugccuugc

SEQ ID NO: 2891139 - RNA, 14 nt, Human
ucucugccuugccu

SEQ ID NO: 2891140 - RNA, 15 nt, Human
ucucugccuugccuu

SEQ ID NO: 2891141 - RNA, 16 nt, Human
ucucugccuugccuuu

SEQ ID NO: 2891142 - RNA, 17 nt, Human
ucucugccuugccuuua

SEQ ID NO: 2891143 - RNA, 19 nt, Human
ucucugccuuugacauuua

SEQ ID NO: 2891144 - RNA, 21 nt, Human
ucucugccuuugacauuuaau

SEQ ID NO: 2891145 - RNA, 11 nt, Human
ucucugcccua

SEQ ID NO: 2891146 - RNA, 22 nt, Human
ucucugcccuaaugcgcaggcu

SEQ ID NO: 2891147 - RNA, 16 nt, Human
ucucugccgcuaccuc

SEQ ID NO: 2891148 - RNA, 22 nt, Human
ucucugccgcuaccucccuccc

SEQ ID NO: 2891149 - RNA, 19 nt, Human
ucucuucugcuccacccuu

SEQ ID NO: 2891150 - RNA, 21 nt, Human
ucucuucuggguuccuuccuc

SEQ ID NO: 2891151 - RNA, 14 nt, Human
ucucuucugcucca

SEQ ID NO: 2891152 - RNA, 13 nt, Human
ucucuucugcucc

SEQ ID NO: 2891153 - RNA, 17 nt, Human
ucucuucugcuccaccc

SEQ ID NO: 2891154 - RNA, 16 nt, Human
ucucuucugcuccacc

SEQ ID NO: 2891155 - RNA, 18 nt, Human
ucucuucuggguuccuuc

SEQ ID NO: 2891156 - RNA, 20 nt, Human
ucucuucuggguuccuuccu

SEQ ID NO: 2891157 - RNA, 19 nt, Human
ucucuucuggguuccuucc

SEQ ID NO: 2891158 - RNA, 17 nt, Human
acuuuuuuuuguauguu

SEQ ID NO: 2891159 - RNA, 20 nt, Human
agaaaaaaaaaaacuuacac

SEQ ID NO: 2891160 - RNA, 13 nt, Human
agaaaaaaaaaag

SEQ ID NO: 2891161 - RNA, 14 nt, Human
agaaaaaaaaaaga

SEQ ID NO: 2891162 - RNA, 15 nt, Human
agaaaaaaaaaagaa

SEQ ID NO: 2891163 - RNA, 16 nt, Human
agaaaaaaaaaagaag

SEQ ID NO: 2891164 - RNA, 17 nt, Human
agaaaaaaaaaagaaga

SEQ ID NO: 2891165 - RNA, 18 nt, Human
agaaaaaaaaaagaagaa

SEQ ID NO: 2891166 - RNA, 19 nt, Human
agaaaaaaaaaagaagaag

SEQ ID NO: 2891167 - RNA, 20 nt, Human
agaaaaaaaaaagaagaaga

SEQ ID NO: 2891168 - RNA, 13 nt, Human
ucucuccagaugu

SEQ ID NO: 2891169 - RNA, 16 nt, Human
ucucuccagauguuuc

SEQ ID NO: 2891170 - RNA, 20 nt, Human
ucucugcauuuuucugcaga

SEQ ID NO: 2891171 - RNA, 21 nt, Human
ucucugcauuuuucugcagaa

SEQ ID NO: 2891172 - RNA, 18 nt, Human
ucucugccauaucaguga

SEQ ID NO: 2891173 - RNA, 18 nt, Human
acuuuuuuucuucuacuu

SEQ ID NO: 2891174 - RNA, 10 nt, Human
ucucuccuuu

SEQ ID NO: 2891175 - RNA, 12 nt, Human
agaaaccuguau

SEQ ID NO: 2891176 - RNA, 13 nt, Human
agaaaccuguauc

SEQ ID NO: 2891177 - RNA, 14 nt, Human
agaaaccuguaucu

SEQ ID NO: 2891178 - RNA, 15 nt, Human
agaaaccuguaucuu

SEQ ID NO: 2891179 - RNA, 16 nt, Human
agaaaccuguaucuuu

SEQ ID NO: 2891180 - RNA, 17 nt, Human
agaaaccuguaucuuuc

SEQ ID NO: 2891181 - RNA, 19 nt, Human
agaaaccuguaucuuucua

SEQ ID NO: 2891182 - RNA, 20 nt, Human
agaaaccuguaucuuucuau

SEQ ID NO: 2891183 - RNA, 16 nt, Human
agaaacugaggaauuu

SEQ ID NO: 2891184 - RNA, 13 nt, Human
agaaacugaggaa

SEQ ID NO: 2891185 - RNA, 18 nt, Human
agaaacugaggaauuuuc

SEQ ID NO: 2891186 - RNA, 12 nt, Human
agaaagaaaguu

SEQ ID NO: 2891187 - RNA, 16 nt, Human
agaaagaaaaugaaga

SEQ ID NO: 2891188 - RNA, 14 nt, Human
agaaagaaggaagu

SEQ ID NO: 2891189 - RNA, 13 nt, Human
agaaagaaggaag

SEQ ID NO: 2891190 - RNA, 12 nt, Human
agaaagaaggaa

SEQ ID NO: 2891191 - RNA, 18 nt, Human
agaaaccacuucugguca

SEQ ID NO: 2891192 - RNA, 15 nt, Human
agaaacccaagcucc

SEQ ID NO: 2891193 - RNA, 16 nt, Human
agaaacccaagcuccu

SEQ ID NO: 2891194 - RNA, 17 nt, Human
agaaacccaagcuccuc

SEQ ID NO: 2891195 - RNA, 18 nt, Human
agaaacccaagcuccucc

SEQ ID NO: 2891196 - RNA, 19 nt, Human
agaaacccaagcuccuccu

SEQ ID NO: 2891197 - RNA, 20 nt, Human
agaaacccaagcuccuccuc

SEQ ID NO: 2891198 - RNA, 15 nt, Human
agaaaacugaaaauc

SEQ ID NO: 2891199 - RNA, 16 nt, Human
agaaaacugaaaaucu

SEQ ID NO: 2891200 - RNA, 13 nt, Human
agaaaaccacccc

SEQ ID NO: 2891201 - RNA, 15 nt, Human
agaaaaccaccccuu

SEQ ID NO: 2891202 - RNA, 13 nt, Human
agaaaacauuuuu

SEQ ID NO: 2891203 - RNA, 23 nt, Human
agaaaacauuuuuuuuuuaaauc

SEQ ID NO: 2891204 - RNA, 17 nt, Human
agaaaaccaaaaugaua

SEQ ID NO: 2891205 - RNA, 12 nt, Human
agaaaaaucuug

SEQ ID NO: 2891206 - RNA, 21 nt, Human
agaaaaaucuugugcuagaau

SEQ ID NO: 2891207 - RNA, 23 nt, Human
agaaaaaucuugugcuagaauac

SEQ ID NO: 2891208 - RNA, 21 nt, Human
agaaaaaugagcauacaucuu

SEQ ID NO: 2891209 - RNA, 15 nt, Human
agaaaacaucacuga

SEQ ID NO: 2891210 - RNA, 13 nt, Human
agaaaaaggguca

SEQ ID NO: 2891211 - RNA, 14 nt, Human
agaaaaagggucaa

SEQ ID NO: 2891212 - RNA, 17 nt, Human
agaaaaauauauacuaa

SEQ ID NO: 2891213 - RNA, 19 nt, Human
agaaaaauaugaccacacu

SEQ ID NO: 2891214 - RNA, 22 nt, Human
ucucuuuaaugucacaggcagg

SEQ ID NO: 2891215 - RNA, 18 nt, Human
ucucuucuuuuggcuucc

SEQ ID NO: 2891216 - RNA, 16 nt, Human
ucucuucuuuuggcuu

SEQ ID NO: 2891217 - RNA, 13 nt, Human
ucucuuuauuccu

SEQ ID NO: 2891218 - RNA, 14 nt, Human
ucucuuuauuccua

SEQ ID NO: 2891219 - RNA, 15 nt, Human
ucucuuuauuccuag

SEQ ID NO: 2891220 - RNA, 22 nt, Human
ucucuuucacauuguuugcugc

SEQ ID NO: 2891221 - RNA, 13 nt, Human
ucucuuucucucu

SEQ ID NO: 2891222 - RNA, 14 nt, Human
ucucuuucucucuu

SEQ ID NO: 2891223 - RNA, 15 nt, Human
ucucuuucucucuuc

SEQ ID NO: 2891224 - RNA, 17 nt, Human
ucucuuucucucuuccc

SEQ ID NO: 2891225 - RNA, 19 nt, Human
ucucuuucucucuucccuc

SEQ ID NO: 2891226 - RNA, 17 nt, Human
ucucuuucuuccuuuac

SEQ ID NO: 2891227 - RNA, 20 nt, Human
ucucuuucuuccuuuacuuu

SEQ ID NO: 2891228 - RNA, 12 nt, Human
ucucuucuuguu

SEQ ID NO: 2891229 - RNA, 15 nt, Human
ucucuucuuguuucu

SEQ ID NO: 2891230 - RNA, 12 nt, Human
ucucuucuucau

SEQ ID NO: 2891231 - RNA, 12 nt, Human
acuuuuguaaga

SEQ ID NO: 2891232 - RNA, 17 nt, Human
acuuuuguaagacaaag

SEQ ID NO: 2891233 - RNA, 13 nt, Human
acuuuuguacauc

SEQ ID NO: 2891234 - RNA, 14 nt, Human
acuuuuguacaucu

SEQ ID NO: 2891235 - RNA, 20 nt, Human
acuuuuguacaucuggcuua

SEQ ID NO: 2891236 - RNA, 18 nt, Human
acuuuuguguaaugaaaa

SEQ ID NO: 2891237 - RNA, 19 nt, Human
acuuugguacauggccagu

SEQ ID NO: 2891238 - RNA, 15 nt, Human
acuuuggggaaggga

SEQ ID NO: 2891239 - RNA, 19 nt, Human
acuuugggaggcugaggcg

SEQ ID NO: 2891240 - RNA, 17 nt, Human
acuuuuguaaagaaauu

SEQ ID NO: 2891241 - RNA, 21 nt, Human
acuuuuguaaagaaauuuacu

SEQ ID NO: 2891242 - RNA, 13 nt, Human
acuuuuuuucaau

SEQ ID NO: 2891243 - RNA, 14 nt, Human
acuuuuuuucaaug

SEQ ID NO: 2891244 - RNA, 15 nt, Human
acuuuuuuucaaugu

SEQ ID NO: 2891245 - RNA, 16 nt, Human
acuuuuuuucaaugug

SEQ ID NO: 2891246 - RNA, 21 nt, Human
acuuuuuucuaguacacuuuu

SEQ ID NO: 2891247 - RNA, 13 nt, Human
acuuuuugugaag

SEQ ID NO: 2891248 - RNA, 15 nt, Human
acuuuuugugaagac

SEQ ID NO: 2891249 - RNA, 18 nt, Human
acuuuuugugaagacggc

SEQ ID NO: 2891250 - RNA, 23 nt, Human
acuuuuugugaagacggcacggu

SEQ ID NO: 2891251 - RNA, 13 nt, Human
acuuuuuuaaaua

SEQ ID NO: 2891252 - RNA, 14 nt, Human
acuuuuuuaaauaa

SEQ ID NO: 2891253 - RNA, 15 nt, Human
acuuuuuuaaauaaa

SEQ ID NO: 2891254 - RNA, 17 nt, Human
acuuuuuuaaauaaacu

SEQ ID NO: 2891255 - RNA, 18 nt, Human
acuuuuuuaaauaaacuu

SEQ ID NO: 2891256 - RNA, 19 nt, Human
acuuuuuuaaauaaacuuu

SEQ ID NO: 2891257 - RNA, 20 nt, Human
acuuuuuuaaauaaacuuuu

SEQ ID NO: 2891258 - RNA, 21 nt, Human
acuuuuuuaaauaaacuuuuu

SEQ ID NO: 2891259 - RNA, 14 nt, Human
acuuuuucuuuugu

SEQ ID NO: 2891260 - RNA, 17 nt, Human
acuuuuucuuuuguaag

SEQ ID NO: 2891261 - RNA, 18 nt, Human
acuuuuucuuuuguaagu

SEQ ID NO: 2891262 - RNA, 17 nt, Human
acuuuuugaacuaagaa

SEQ ID NO: 2891263 - RNA, 20 nt, Human
acuuuuugaacuaagaaacu

SEQ ID NO: 2891264 - RNA, 21 nt, Human
acuuuuugaacuaagaaacuu

SEQ ID NO: 2891265 - RNA, 17 nt, Human
acuuugggaggccaagg

SEQ ID NO: 2891266 - RNA, 19 nt, Human
acuuguuucucuguuguaa

SEQ ID NO: 2891267 - RNA, 16 nt, Human
acuuguuugucuucca

SEQ ID NO: 2891268 - RNA, 17 nt, Human
acuuguuugucuuccau

SEQ ID NO: 2891269 - RNA, 17 nt, Human
acuuguuuuaugcucag

SEQ ID NO: 2891270 - RNA, 22 nt, Human
acuuugacgagucaccuuccag

SEQ ID NO: 2891271 - RNA, 23 nt, Human
acuuugacgagucaccuuccagg

SEQ ID NO: 2891272 - RNA, 21 nt, Human
acuuguugauuaauggaaaug

SEQ ID NO: 2891273 - RNA, 19 nt, Human
acuuguugauuaauggaaa

SEQ ID NO: 2891274 - RNA, 14 nt, Human
acuugugucucugu

SEQ ID NO: 2891275 - RNA, 21 nt, Human
acuugugucucugugcuuuua

SEQ ID NO: 2891276 - RNA, 16 nt, Human
acuugugucucugugc

SEQ ID NO: 2891277 - RNA, 17 nt, Human
acuuguuccagcucuuu

SEQ ID NO: 2891278 - RNA, 22 nt, Human
acuugugucucugugcuuuuaa

SEQ ID NO: 2891279 - RNA, 22 nt, Human
ucucccuucgguggaagagcuc

SEQ ID NO: 2891280 - RNA, 18 nt, Human
ucucccaaagugcuggga

SEQ ID NO: 2891281 - RNA, 22 nt, Human
ucucccaagcuaucuaaaguuu

SEQ ID NO: 2891282 - RNA, 12 nt, Human
acuguauaaaua

SEQ ID NO: 2891283 - RNA, 13 nt, Human
acuguauaaauag

SEQ ID NO: 2891284 - RNA, 14 nt, Human
acuguauaaauagg

SEQ ID NO: 2891285 - RNA, 15 nt, Human
acuguauaaauagga

SEQ ID NO: 2891286 - RNA, 17 nt, Human
acuguauaaauaggaga

SEQ ID NO: 2891287 - RNA, 20 nt, Human
acuguauaaauaggagagga

SEQ ID NO: 2891288 - RNA, 21 nt, Human
acuguauaaauaggagaggau

SEQ ID NO: 2891289 - RNA, 22 nt, Human
acuguauaaauaggagaggaug

SEQ ID NO: 2891290 - RNA, 23 nt, Human
acuguauaaauaggagaggauga

SEQ ID NO: 2891291 - RNA, 15 nt, Human
acuguauagacaguu

SEQ ID NO: 2891292 - RNA, 16 nt, Human
acuguauagacaguuu

SEQ ID NO: 2891293 - RNA, 17 nt, Human
acuguauagacaguuug

SEQ ID NO: 2891294 - RNA, 18 nt, Human
acuguauagacaguuugu

SEQ ID NO: 2891295 - RNA, 21 nt, Human
acuguauagacaguuuguaaa

SEQ ID NO: 2891296 - RNA, 22 nt, Human
acuguauagacaguuuguaaau

SEQ ID NO: 2891297 - RNA, 17 nt, Human
acuguagccuggauauu

SEQ ID NO: 2891298 - RNA, 18 nt, Human
acuguagcuuugugaaau

SEQ ID NO: 2891299 - RNA, 13 nt, Human
acuguagaugaug

SEQ ID NO: 2891300 - RNA, 15 nt, Human
acuguagaugaugua

SEQ ID NO: 2891301 - RNA, 22 nt, Human
acuguagccucgccgucuguga

SEQ ID NO: 2891302 - RNA, 16 nt, Human
acuguaguucuaagac

SEQ ID NO: 2891303 - RNA, 17 nt, Human
acuguaguucuaagacu

SEQ ID NO: 2891304 - RNA, 13 nt, Human
acuguaguucuaa

SEQ ID NO: 2891305 - RNA, 15 nt, Human
acuguaguucuaaga

SEQ ID NO: 2891306 - RNA, 20 nt, Human
ucuggaaaccucuacauauu

SEQ ID NO: 2891307 - RNA, 19 nt, Human
ucuggaaaagaacuguuua

SEQ ID NO: 2891308 - RNA, 22 nt, Human
ucuggaguuuuuguuuggagag

SEQ ID NO: 2891309 - RNA, 24 nt, Human
ucuggaguuuuuguuuggagagca

SEQ ID NO: 2891310 - RNA, 13 nt, Human
ucuggagugggca

SEQ ID NO: 2891311 - RNA, 14 nt, Human
ucuggagugggcag

SEQ ID NO: 2891312 - RNA, 14 nt, Human
ucuggauaggagcc

SEQ ID NO: 2891313 - RNA, 16 nt, Human
ucuggauaggagccug

SEQ ID NO: 2891314 - RNA, 20 nt, Human
ucuggauaggagccugcugg

SEQ ID NO: 2891315 - RNA, 21 nt, Human
ucuggauaggagccugcuggu

SEQ ID NO: 2891316 - RNA, 22 nt, Human
ucuggaugccugauugccaagc

SEQ ID NO: 2891317 - RNA, 17 nt, Human
ucuggauuaggucucug

SEQ ID NO: 2891318 - RNA, 18 nt, Human
ucuggcauuagaauuauu

SEQ ID NO: 2891319 - RNA, 18 nt, Human
ucuggcaguucuggaaug

SEQ ID NO: 2891320 - RNA, 23 nt, Human
ucuggcaguuuugacaucagcca

SEQ ID NO: 2891321 - RNA, 21 nt, Human
ucuggccauauuuacuaccuu

SEQ ID NO: 2891322 - RNA, 18 nt, Human
agaagccuucagcuccag

SEQ ID NO: 2891323 - RNA, 17 nt, Human
agaagccuucagcucca

SEQ ID NO: 2891324 - RNA, 14 nt, Human
agaagccuucagcu

SEQ ID NO: 2891325 - RNA, 13 nt, Human
agaagccuucagc

SEQ ID NO: 2891326 - RNA, 12 nt, Human
agaagccuucag

SEQ ID NO: 2891327 - RNA, 19 nt, Human
agaagccuucagcuccagg

SEQ ID NO: 2891328 - RNA, 16 nt, Human
agaagcggauuuccag

SEQ ID NO: 2891329 - RNA, 21 nt, Human
agaagcuaugucaagaggcug

SEQ ID NO: 2891330 - RNA, 19 nt, Human
agaagcugcauccagaggc

SEQ ID NO: 2891331 - RNA, 11 nt, Human
agaagcugcug

SEQ ID NO: 2891332 - RNA, 13 nt, Human
agaagcugcugac

SEQ ID NO: 2891333 - RNA, 14 nt, Human
agaagcugcugacc

SEQ ID NO: 2891334 - RNA, 16 nt, Human
agaagcugcugaccaa

SEQ ID NO: 2891335 - RNA, 13 nt, Human
agaagcugcucca

SEQ ID NO: 2891336 - RNA, 18 nt, Human
agaagcugcuccaggccu

SEQ ID NO: 2891337 - RNA, 19 nt, Human
agaagcugcuccaggccug

SEQ ID NO: 2891338 - RNA, 20 nt, Human
agaagcugcuccaggccugc

SEQ ID NO: 2891339 - RNA, 22 nt, Human
agaagcugcuccaggccugcag

SEQ ID NO: 2891340 - RNA, 23 nt, Human
agaagcugcuccaggccugcagc

SEQ ID NO: 2891341 - RNA, 13 nt, Human
agaagcuguagua

SEQ ID NO: 2891342 - RNA, 14 nt, Human
agaagcuguuguac

SEQ ID NO: 2891343 - RNA, 16 nt, Human
agaagcuguuguacau

SEQ ID NO: 2891344 - RNA, 18 nt, Human
agaagcuguuguacauuu

SEQ ID NO: 2891345 - RNA, 19 nt, Human
agaagcuguuguacauuua

SEQ ID NO: 2891346 - RNA, 20 nt, Human
agaagcuguuguacauuuau

SEQ ID NO: 2891347 - RNA, 21 nt, Human
agaagcuguuguacauuuaug

SEQ ID NO: 2891348 - RNA, 22 nt, Human
agaagcuguuguacauuuauga

SEQ ID NO: 2891349 - RNA, 12 nt, Human
ucugcuucaaua

SEQ ID NO: 2891350 - RNA, 18 nt, Human
ucugcuucaauaaaucuu

SEQ ID NO: 2891351 - RNA, 19 nt, Human
ucugcuucaauaaaucuuu

SEQ ID NO: 2891352 - RNA, 15 nt, Human
ucugcuguccccuug

SEQ ID NO: 2891353 - RNA, 17 nt, Human
ucugcuguccccuuggc

SEQ ID NO: 2891354 - RNA, 22 nt, Human
ucugcuguccccuuggcagguc

SEQ ID NO: 2891355 - RNA, 16 nt, Human
ucugcucacauaucug

SEQ ID NO: 2891356 - RNA, 17 nt, Human
ucugcggaccccagcug

SEQ ID NO: 2891357 - RNA, 22 nt, Human
ucugcggaccccagcugugagc

SEQ ID NO: 2891358 - RNA, 14 nt, Human
ucugcggaccccag

SEQ ID NO: 2891359 - RNA, 15 nt, Human
ucugcggaccccagc

SEQ ID NO: 2891360 - RNA, 16 nt, Human
ucugcggaccccagcu

SEQ ID NO: 2891361 - RNA, 21 nt, Human
ucugccuucgaggucagagga

SEQ ID NO: 2891362 - RNA, 11 nt, Human
ucugccuuuuc

SEQ ID NO: 2891363 - RNA, 14 nt, Human
ucugcgaaguccua

SEQ ID NO: 2891364 - RNA, 22 nt, Human
ucugcgaaguccuauggaaacc

SEQ ID NO: 2891365 - RNA, 13 nt, Human
ucugcgccucagg

SEQ ID NO: 2891366 - RNA, 14 nt, Human
ucugcgccucaggc

SEQ ID NO: 2891367 - RNA, 17 nt, Human
ucugcucacaguaaccc

SEQ ID NO: 2891368 - RNA, 12 nt, Human
ucugcucagcca

SEQ ID NO: 2891369 - RNA, 13 nt, Human
ucugcucagccaa

SEQ ID NO: 2891370 - RNA, 15 nt, Human
ucugcucagccaagc

SEQ ID NO: 2891371 - RNA, 16 nt, Human
ucugcucagccaagcu

SEQ ID NO: 2891372 - RNA, 17 nt, Human
ucugcucagccaagcuu

SEQ ID NO: 2891373 - RNA, 22 nt, Human
ucugcucaguaauuugaggaca

SEQ ID NO: 2891374 - RNA, 21 nt, Human
agaagaacuugcauggagcag

SEQ ID NO: 2891375 - RNA, 10 nt, Human
agaagaagaa

SEQ ID NO: 2891376 - RNA, 11 nt, Human
agaagaagaaa

SEQ ID NO: 2891377 - RNA, 13 nt, Human
agaagaagaaaaa

SEQ ID NO: 2891378 - RNA, 14 nt, Human
agaagaagaaaaaa

SEQ ID NO: 2891379 - RNA, 15 nt, Human
agaagaagaaaaaaa

SEQ ID NO: 2891380 - RNA, 13 nt, Human
agaagaagaaaag

SEQ ID NO: 2891381 - RNA, 14 nt, Human
agaagaagaaaaga

SEQ ID NO: 2891382 - RNA, 15 nt, Human
agaagaagaaaagag

SEQ ID NO: 2891383 - RNA, 14 nt, Human
agaagaagaagaaa

SEQ ID NO: 2891384 - RNA, 15 nt, Human
agaagaagaagaaaa

SEQ ID NO: 2891385 - RNA, 15 nt, Human
agaagaagaagaaga

SEQ ID NO: 2891386 - RNA, 16 nt, Human
agaagaagagaagcug

SEQ ID NO: 2891387 - RNA, 18 nt, Human
agaagaagagaagcugcu

SEQ ID NO: 2891388 - RNA, 20 nt, Human
agaagaagagaagcugcuga

SEQ ID NO: 2891389 - RNA, 12 nt, Human
agaagaaaauuc

SEQ ID NO: 2891390 - RNA, 16 nt, Human
agaagaaaauucuccu

SEQ ID NO: 2891391 - RNA, 17 nt, Human
agaagaaaauucuccug

SEQ ID NO: 2891392 - RNA, 14 nt, Human
ucugccccuccccc

SEQ ID NO: 2891393 - RNA, 13 nt, Human
ucugccccucccc

SEQ ID NO: 2891394 - RNA, 22 nt, Human
ucugccccucccccaaccccca

SEQ ID NO: 2891395 - RNA, 18 nt, Human
ucugccccucccccaacc

SEQ ID NO: 2891396 - RNA, 16 nt, Human
ucugccccucccccaa

SEQ ID NO: 2891397 - RNA, 15 nt, Human
ucugccccuccccca

SEQ ID NO: 2891398 - RNA, 17 nt, Human
ucugcccgccugcccac

SEQ ID NO: 2891399 - RNA, 19 nt, Human
ucugcccgccugcccaccu

SEQ ID NO: 2891400 - RNA, 20 nt, Human
ucugcccgccugcccaccug

SEQ ID NO: 2891401 - RNA, 21 nt, Human
ucugcccgccugcccaccugc

SEQ ID NO: 2891402 - RNA, 22 nt, Human
ucugcccgccugcccaccugcc

SEQ ID NO: 2891403 - RNA, 23 nt, Human
ucugcccgccugcccaccugccu

SEQ ID NO: 2891404 - RNA, 16 nt, Human
ucugccgucucuggag

SEQ ID NO: 2891405 - RNA, 15 nt, Human
ucugccgucucugga

SEQ ID NO: 2891406 - RNA, 10 nt, Human
ucugccuuug

SEQ ID NO: 2891407 - RNA, 14 nt, Human
ucugccuuugacau

SEQ ID NO: 2891408 - RNA, 16 nt, Human
ucugccuuugacauuu

SEQ ID NO: 2891409 - RNA, 20 nt, Human
ucugccuuugacauuuaauu

SEQ ID NO: 2891410 - RNA, 23 nt, Human
ucugccuuugacauuuaauuuag

SEQ ID NO: 2891411 - RNA, 12 nt, Human
ucugccuugccu

SEQ ID NO: 2891412 - RNA, 13 nt, Human
ucugccuugccuu

SEQ ID NO: 2891413 - RNA, 14 nt, Human
ucugccgucucugg

SEQ ID NO: 2891414 - RNA, 18 nt, Human
ucugccgcccccuccuga

SEQ ID NO: 2891415 - RNA, 15 nt, Human
ucugccgcuaccucc

SEQ ID NO: 2891416 - RNA, 18 nt, Human
ucugccgcuaccucccuc

SEQ ID NO: 2891417 - RNA, 19 nt, Human
ucugccgcuaccucccucc

SEQ ID NO: 2891418 - RNA, 20 nt, Human
ucugccgcuaccucccuccc

SEQ ID NO: 2891419 - RNA, 23 nt, Human
ucugcccgggaaggucaccagca

SEQ ID NO: 2891420 - RNA, 18 nt, Human
ucugcccucauuacuggg

SEQ ID NO: 2891421 - RNA, 21 nt, Human
ucugcccucauuacugggccu

SEQ ID NO: 2891422 - RNA, 14 nt, Human
agaagaaagacucu

SEQ ID NO: 2891423 - RNA, 10 nt, Human
ucugcccggg

SEQ ID NO: 2891424 - RNA, 11 nt, Human
agaacuccuga

SEQ ID NO: 2891425 - RNA, 13 nt, Human
agaacuccugacu

SEQ ID NO: 2891426 - RNA, 14 nt, Human
agaacuccugacug

SEQ ID NO: 2891427 - RNA, 15 nt, Human
agaacuccugacugu

SEQ ID NO: 2891428 - RNA, 14 nt, Human
agaacucugggcug

SEQ ID NO: 2891429 - RNA, 23 nt, Human
agaacucuccaucuuauuuucau

SEQ ID NO: 2891430 - RNA, 12 nt, Human
agaacugaaaag

SEQ ID NO: 2891431 - RNA, 13 nt, Human
agaacugaaaaga

SEQ ID NO: 2891432 - RNA, 14 nt, Human
agaacugaaaagag

SEQ ID NO: 2891433 - RNA, 15 nt, Human
agaacugaaaagaga

SEQ ID NO: 2891434 - RNA, 17 nt, Human
agaacugaaaagagagc

SEQ ID NO: 2891435 - RNA, 20 nt, Human
agaacucugggcugcuaccc

SEQ ID NO: 2891436 - RNA, 10 nt, Human
agaacugaaa

SEQ ID NO: 2891437 - RNA, 12 nt, Human
agaagaaaagag

SEQ ID NO: 2891438 - RNA, 13 nt, Human
agaagaaaagaga

SEQ ID NO: 2891439 - RNA, 15 nt, Human
agaagaaaagagaag

SEQ ID NO: 2891440 - RNA, 17 nt, Human
agaagaaaagagaagaa

SEQ ID NO: 2891441 - RNA, 18 nt, Human
agaagaaaagagaagaag

SEQ ID NO: 2891442 - RNA, 20 nt, Human
agaagaaaagagaagaagaa

SEQ ID NO: 2891443 - RNA, 23 nt, Human
agaacuuuuuuaaauaaacuuuu

SEQ ID NO: 2891444 - RNA, 11 nt, Human
agaagaaaaaa

SEQ ID NO: 2891445 - RNA, 13 nt, Human
agaagaaaaaaac

SEQ ID NO: 2891446 - RNA, 14 nt, Human
agaagaaaaaaacg

SEQ ID NO: 2891447 - RNA, 21 nt, Human
agaagaaaaaaacgaaaacag

SEQ ID NO: 2891448 - RNA, 14 nt, Human
agaaccucuucccc

SEQ ID NO: 2891449 - RNA, 13 nt, Human
agaaccucuuccc

SEQ ID NO: 2891450 - RNA, 21 nt, Human
agaaccucaggcuuccuuggc

SEQ ID NO: 2891451 - RNA, 19 nt, Human
agaaccucaggcuuccuug

SEQ ID NO: 2891452 - RNA, 12 nt, Human
agaaccucaggc

SEQ ID NO: 2891453 - RNA, 20 nt, Human
agaacguauuuuaaaagcca

SEQ ID NO: 2891454 - RNA, 23 nt, Human
agaacguauuuuaaaagccacau

SEQ ID NO: 2891455 - RNA, 17 nt, Human
agaacguaaagaacuuu

SEQ ID NO: 2891456 - RNA, 21 nt, Human
agaacggagccccaggccucu

SEQ ID NO: 2891457 - RNA, 15 nt, Human
agaaccucuucccca

SEQ ID NO: 2891458 - RNA, 18 nt, Human
agaacuaaagguggccac

SEQ ID NO: 2891459 - RNA, 20 nt, Human
agaacuaaagguggccacaa

SEQ ID NO: 2891460 - RNA, 11 nt, Human
agaacuaaaug

SEQ ID NO: 2891461 - RNA, 12 nt, Human
agaacuaaaugu

SEQ ID NO: 2891462 - RNA, 13 nt, Human
agaacuaaauguu

SEQ ID NO: 2891463 - RNA, 15 nt, Human
agaacuaaauguucu

SEQ ID NO: 2891464 - RNA, 16 nt, Human
agaacuaaauguucua

SEQ ID NO: 2891465 - RNA, 19 nt, Human
agaacucacuggggccuac

SEQ ID NO: 2891466 - RNA, 15 nt, Human
agaacucaucacugu

SEQ ID NO: 2891467 - RNA, 19 nt, Human
agaacucaucacuguggcu

SEQ ID NO: 2891468 - RNA, 23 nt, Human
agaacucaucacuguggcugucu

SEQ ID NO: 2891469 - RNA, 16 nt, Human
agaacucacuggggcc

SEQ ID NO: 2891470 - RNA, 23 nt, Human
agaacucaucccuaaugcugcag

SEQ ID NO: 2891471 - RNA, 15 nt, Human
ucugcagaaacagaa

SEQ ID NO: 2891472 - RNA, 15 nt, Human
ucugcagaagaggag

SEQ ID NO: 2891473 - RNA, 19 nt, Human
ucugcagacacgccuuccc

SEQ ID NO: 2891474 - RNA, 23 nt, Human
ucugcagacacgccuuccccuca

SEQ ID NO: 2891475 - RNA, 15 nt, Human
ucugcagacugcuag

SEQ ID NO: 2891476 - RNA, 23 nt, Human
ucugcagacugcuaguguucugu

SEQ ID NO: 2891477 - RNA, 12 nt, Human
ucugcagagcag

SEQ ID NO: 2891478 - RNA, 10 nt, Human
agaaauguag

SEQ ID NO: 2891479 - RNA, 15 nt, Human
agaaauguaguugau

SEQ ID NO: 2891480 - RNA, 16 nt, Human
agaaaugucuuaauuu

SEQ ID NO: 2891481 - RNA, 21 nt, Human
agaaaugucuuaauuuuugaa

SEQ ID NO: 2891482 - RNA, 12 nt, Human
ucugauagaauu

SEQ ID NO: 2891483 - RNA, 20 nt, Human
agaaaugucuaaaugcugaa

SEQ ID NO: 2891484 - RNA, 14 nt, Human
agaaauuggcugga

SEQ ID NO: 2891485 - RNA, 19 nt, Human
agaaauuggaacagaaugu

SEQ ID NO: 2891486 - RNA, 20 nt, Human
agaaauugccuauccugcug

SEQ ID NO: 2891487 - RNA, 15 nt, Human
agaaauuggcuggau

SEQ ID NO: 2891488 - RNA, 22 nt, Human
agaaauuggaacagaauguuuu

SEQ ID NO: 2891489 - RNA, 14 nt, Human
agaaauuuuuauca

SEQ ID NO: 2891490 - RNA, 15 nt, Human
agaaauuuuuaucag

SEQ ID NO: 2891491 - RNA, 16 nt, Human
agaaauuuuuaucagu

SEQ ID NO: 2891492 - RNA, 17 nt, Human
agaaauuuuuaucaguu

SEQ ID NO: 2891493 - RNA, 20 nt, Human
agaaauuugauuucuauuca

SEQ ID NO: 2891494 - RNA, 13 nt, Human
agaaauuuacuau

SEQ ID NO: 2891495 - RNA, 14 nt, Human
agaaauuuacuaua

SEQ ID NO: 2891496 - RNA, 15 nt, Human
agaaauuuacuauau

SEQ ID NO: 2891497 - RNA, 16 nt, Human
agaaauuuacuauaua

SEQ ID NO: 2891498 - RNA, 17 nt, Human
agaaauuuacuauauau

SEQ ID NO: 2891499 - RNA, 19 nt, Human
agaaauuuacuauauauau

SEQ ID NO: 2891500 - RNA, 15 nt, Human
agaaccuaacuguau

SEQ ID NO: 2891501 - RNA, 16 nt, Human
agaaccuaacuguauc

SEQ ID NO: 2891502 - RNA, 17 nt, Human
agaaccuaacuguaucu

SEQ ID NO: 2891503 - RNA, 18 nt, Human
agaaccuaacuguaucuu

SEQ ID NO: 2891504 - RNA, 19 nt, Human
agaaccuaacuguaucuug

SEQ ID NO: 2891505 - RNA, 20 nt, Human
agaaccuaacuguaucuuga

SEQ ID NO: 2891506 - RNA, 21 nt, Human
agaaccuaacuguaucuugag

SEQ ID NO: 2891507 - RNA, 16 nt, Human
agaacaaagugagaca

SEQ ID NO: 2891508 - RNA, 18 nt, Human
agaaccgagcaaagauca

SEQ ID NO: 2891509 - RNA, 22 nt, Human
agaaccgagcaaagaucaaaau

SEQ ID NO: 2891510 - RNA, 20 nt, Human
agaaccgagcaaagaucaaa

SEQ ID NO: 2891511 - RNA, 21 nt, Human
agaaccgagcaaagaucaaaa

SEQ ID NO: 2891512 - RNA, 13 nt, Human
agaacaaagcugu

SEQ ID NO: 2891513 - RNA, 14 nt, Human
agaacaaagcuguu

SEQ ID NO: 2891514 - RNA, 15 nt, Human
agaacaaagcuguua

SEQ ID NO: 2891515 - RNA, 16 nt, Human
agaacaaagcuguuaa

SEQ ID NO: 2891516 - RNA, 17 nt, Human
agaacaaagcuguuaaa

SEQ ID NO: 2891517 - RNA, 18 nt, Human
agaacaaagcuguuaaac

SEQ ID NO: 2891518 - RNA, 19 nt, Human
agaacaaagcuguuaaacu

SEQ ID NO: 2891519 - RNA, 20 nt, Human
agaacaaagcuguuaaacug

SEQ ID NO: 2891520 - RNA, 21 nt, Human
agaacaaagcuguuaaacugu

SEQ ID NO: 2891521 - RNA, 22 nt, Human
agaacaaagcuguuaaacuguu

SEQ ID NO: 2891522 - RNA, 14 nt, Human
agaacaaaggacag

SEQ ID NO: 2891523 - RNA, 21 nt, Human
agaacaaaggacagaguauga

SEQ ID NO: 2891524 - RNA, 22 nt, Human
agaacaaaggacagaguaugaa

SEQ ID NO: 2891525 - RNA, 12 nt, Human
ucugagaaaaca

SEQ ID NO: 2891526 - RNA, 9 nt, Human
ucugagaaa

SEQ ID NO: 2891527 - RNA, 14 nt, Human
ucugagaaaacaag

SEQ ID NO: 2891528 - RNA, 22 nt, Human
ucugagaaaagaacguauuuua

SEQ ID NO: 2891529 - RNA, 16 nt, Human
ucugagggaaagugca

SEQ ID NO: 2891530 - RNA, 12 nt, Human
ucugcacugaaa

SEQ ID NO: 2891531 - RNA, 13 nt, Human
ucugcacugaaaa

SEQ ID NO: 2891532 - RNA, 16 nt, Human
ucugcacugaaaaggu

SEQ ID NO: 2891533 - RNA, 21 nt, Human
ucugauucccaagcucugcuc

SEQ ID NO: 2891534 - RNA, 20 nt, Human
ucugauucccaagcucugcu

SEQ ID NO: 2891535 - RNA, 19 nt, Human
ucugauucccaagcucugc

SEQ ID NO: 2891536 - RNA, 23 nt, Human
ucugauaggaaugugaaagcacg

SEQ ID NO: 2891537 - RNA, 18 nt, Human
ucugauucccaagcucug

SEQ ID NO: 2891538 - RNA, 20 nt, Human
ucugauaucuauaguagaca

SEQ ID NO: 2891539 - RNA, 13 nt, Human
ucugauaugggac

SEQ ID NO: 2891540 - RNA, 14 nt, Human
ucugauaugggacu

SEQ ID NO: 2891541 - RNA, 15 nt, Human
ucugauaugggacug

SEQ ID NO: 2891542 - RNA, 21 nt, Human
ucugauaugggacugagccug

SEQ ID NO: 2891543 - RNA, 19 nt, Human
ucugacuuaagcaaaagaa

SEQ ID NO: 2891544 - RNA, 20 nt, Human
ucugacuuaagcaaaagaaa

SEQ ID NO: 2891545 - RNA, 23 nt, Human
ucugacuuaagcaaaagaaaaag

SEQ ID NO: 2891546 - RNA, 14 nt, Human
ucugaccugcaggc

SEQ ID NO: 2891547 - RNA, 14 nt, Human
ucugacuuuacacu

SEQ ID NO: 2891548 - RNA, 18 nt, Human
ucugacuuuacacucggc

SEQ ID NO: 2891549 - RNA, 18 nt, Human
agaaagaaggaagugaag

SEQ ID NO: 2891550 - RNA, 13 nt, Human
ucugaccccuccu

SEQ ID NO: 2891551 - RNA, 15 nt, Human
ucugaccccuccuca

SEQ ID NO: 2891552 - RNA, 18 nt, Human
ucugaccccuccucacug

SEQ ID NO: 2891553 - RNA, 21 nt, Human
ucugacccuagcucuuuccuu

SEQ ID NO: 2891554 - RNA, 16 nt, Human
ucugaccccuccucac

SEQ ID NO: 2891555 - RNA, 17 nt, Human
ucugaccccuccucacu

SEQ ID NO: 2891556 - RNA, 12 nt, Human
ucugaccugcag

SEQ ID NO: 2891557 - RNA, 18 nt, Human
ucugaccugcacugggga

SEQ ID NO: 2891558 - RNA, 17 nt, Human
agacucauucuucugua

SEQ ID NO: 2891559 - RNA, 18 nt, Human
agacucauucuucuguac

SEQ ID NO: 2891560 - RNA, 12 nt, Human
agaccugccccu

SEQ ID NO: 2891561 - RNA, 15 nt, Human
agaccugaauucuuu

SEQ ID NO: 2891562 - RNA, 18 nt, Human
agaccuacuguucuaaag

SEQ ID NO: 2891563 - RNA, 19 nt, Human
agaccuacuguucuaaagc

SEQ ID NO: 2891564 - RNA, 17 nt, Human
ucuugcaagcaugcuug

SEQ ID NO: 2891565 - RNA, 16 nt, Human
ucuugcaagcaugcuu

SEQ ID NO: 2891566 - RNA, 12 nt, Human
ucuugaugacca

SEQ ID NO: 2891567 - RNA, 16 nt, Human
ucuugcaauggcagcc

SEQ ID NO: 2891568 - RNA, 13 nt, Human
ucuugcaauggca

SEQ ID NO: 2891569 - RNA, 17 nt, Human
ucuugcaauggcagccu

SEQ ID NO: 2891570 - RNA, 14 nt, Human
ucuugcuuguaccu

SEQ ID NO: 2891571 - RNA, 15 nt, Human
ucuugcuuguaccuc

SEQ ID NO: 2891572 - RNA, 17 nt, Human
ucuugcuuguaccucug

SEQ ID NO: 2891573 - RNA, 18 nt, Human
ucuugcuuguaccucugg

SEQ ID NO: 2891574 - RNA, 22 nt, Human
ucuugcuuguaccucuggcuga

SEQ ID NO: 2891575 - RNA, 13 nt, Human
ucuugcuuucuau

SEQ ID NO: 2891576 - RNA, 16 nt, Human
ucuuggacacuguaca

SEQ ID NO: 2891577 - RNA, 19 nt, Human
agacccucgcccaacucca

SEQ ID NO: 2891578 - RNA, 18 nt, Human
ucuuggaaguacaugaau

SEQ ID NO: 2891579 - RNA, 17 nt, Human
ucuuggacacuguacaa

SEQ ID NO: 2891580 - RNA, 12 nt, Human
agacaugguggc

SEQ ID NO: 2891581 - RNA, 21 nt, Human
ucuuccucacagucccacugu

SEQ ID NO: 2891582 - RNA, 22 nt, Human
ucuuccucacagucccacugug

SEQ ID NO: 2891583 - RNA, 21 nt, Human
ucuuccuauuugccaugggcu

SEQ ID NO: 2891584 - RNA, 23 nt, Human
ucuuccuaguuuucuccucccag

SEQ ID NO: 2891585 - RNA, 21 nt, Human
ucuuccuaguuuucuccuccc

SEQ ID NO: 2891586 - RNA, 19 nt, Human
ucuuccuaguuuucuccuc

SEQ ID NO: 2891587 - RNA, 17 nt, Human
ucuuccuaccuauccca

SEQ ID NO: 2891588 - RNA, 15 nt, Human
agacaugugucaaca

SEQ ID NO: 2891589 - RNA, 17 nt, Human
agacauguuguaaauua

SEQ ID NO: 2891590 - RNA, 20 nt, Human
agacccugcaaacagaacag

SEQ ID NO: 2891591 - RNA, 21 nt, Human
agacccugcaaacagaacagg

SEQ ID NO: 2891592 - RNA, 22 nt, Human
agacccugcaaacagaacaggg

SEQ ID NO: 2891593 - RNA, 15 nt, Human
agacccucugccacc

SEQ ID NO: 2891594 - RNA, 16 nt, Human
agacccucugccacca

SEQ ID NO: 2891595 - RNA, 17 nt, Human
agacccucugccaccag

SEQ ID NO: 2891596 - RNA, 20 nt, Human
agaccguuauaaagugugcc

SEQ ID NO: 2891597 - RNA, 18 nt, Human
agaccguuuaccuagaag

SEQ ID NO: 2891598 - RNA, 21 nt, Human
agaccguuuaccuagaagaag

SEQ ID NO: 2891599 - RNA, 15 nt, Human
agaccuacuguucua

SEQ ID NO: 2891600 - RNA, 16 nt, Human
agaccuacuguucuaa

SEQ ID NO: 2891601 - RNA, 17 nt, Human
agaccuacuguucuaaa

SEQ ID NO: 2891602 - RNA, 20 nt, Human
agacccucugccaccagaga

SEQ ID NO: 2891603 - RNA, 21 nt, Human
agacccucugccaccagagac

SEQ ID NO: 2891604 - RNA, 14 nt, Human
agacccuggugccu

SEQ ID NO: 2891605 - RNA, 18 nt, Human
agacccuggugccuggcu

SEQ ID NO: 2891606 - RNA, 19 nt, Human
agacccuggugccuggcuc

SEQ ID NO: 2891607 - RNA, 13 nt, Human
agacccugucucu

SEQ ID NO: 2891608 - RNA, 13 nt, Human
ucuuuaaagaugu

SEQ ID NO: 2891609 - RNA, 14 nt, Human
ucuuuaaaggccca

SEQ ID NO: 2891610 - RNA, 15 nt, Human
ucuuuaaaggcccag

SEQ ID NO: 2891611 - RNA, 18 nt, Human
ucuuuaaaggcccagccc

SEQ ID NO: 2891612 - RNA, 21 nt, Human
ucuuuaaaggcccagccccua

SEQ ID NO: 2891613 - RNA, 22 nt, Human
ucuuuaaaggcccagccccuag

SEQ ID NO: 2891614 - RNA, 23 nt, Human
ucuuuaaaggcccagccccuaga

SEQ ID NO: 2891615 - RNA, 21 nt, Human
ucuuuaaaauuuaaguaucuu

SEQ ID NO: 2891616 - RNA, 23 nt, Human
ucuuuaaacaguauuucauugcc

SEQ ID NO: 2891617 - RNA, 22 nt, Human
ucuuggcacauuuaagagacag

SEQ ID NO: 2891618 - RNA, 21 nt, Human
ucuuggcacauuuaagagaca

SEQ ID NO: 2891619 - RNA, 15 nt, Human
ucuuggaguuuuuca

SEQ ID NO: 2891620 - RNA, 17 nt, Human
ucuuggcaaaagccuug

SEQ ID NO: 2891621 - RNA, 20 nt, Human
ucuuggcaaaagccuugugu

SEQ ID NO: 2891622 - RNA, 21 nt, Human
ucuuggcaaaagccuugugua

SEQ ID NO: 2891623 - RNA, 22 nt, Human
ucuuggcaaaagccuuguguau

SEQ ID NO: 2891624 - RNA, 17 nt, Human
ucuuggagacccugcaa

SEQ ID NO: 2891625 - RNA, 17 nt, Human
ucuuggagaccuuaccc

SEQ ID NO: 2891626 - RNA, 16 nt, Human
ucuuuacccuugagcc

SEQ ID NO: 2891627 - RNA, 16 nt, Human
ucuuuacucccaagac

SEQ ID NO: 2891628 - RNA, 23 nt, Human
ucuuuacuccucacacuuacugu

SEQ ID NO: 2891629 - RNA, 12 nt, Human
ucuuuacuuuua

SEQ ID NO: 2891630 - RNA, 13 nt, Human
ucuuuagagaacu

SEQ ID NO: 2891631 - RNA, 14 nt, Human
ucuuuagagaacug

SEQ ID NO: 2891632 - RNA, 16 nt, Human
ucuuuagagaacugaa

SEQ ID NO: 2891633 - RNA, 17 nt, Human
ucuuuagagaacugaaa

SEQ ID NO: 2891634 - RNA, 19 nt, Human
ucuuuagagaacugaaaag

SEQ ID NO: 2891635 - RNA, 20 nt, Human
ucuuuagagaacugaaaaga

SEQ ID NO: 2891636 - RNA, 22 nt, Human
ucuuuagagaacugaaaagaga

SEQ ID NO: 2891637 - RNA, 17 nt, Human
agacucuacagaggcca

SEQ ID NO: 2891638 - RNA, 19 nt, Human
agacucuacagaggccaug

SEQ ID NO: 2891639 - RNA, 19 nt, Human
agagaccaggcaaagcaag

SEQ ID NO: 2891640 - RNA, 16 nt, Human
agagaccaggcccugg

SEQ ID NO: 2891641 - RNA, 20 nt, Human
ucuuuggggagguguucacu

SEQ ID NO: 2891642 - RNA, 10 nt, Human
ucuuuggggu

SEQ ID NO: 2891643 - RNA, 17 nt, Human
ucuuuggggucuacacu

SEQ ID NO: 2891644 - RNA, 23 nt, Human
ucuuuggggucuacacugcaauc

SEQ ID NO: 2891645 - RNA, 16 nt, Human
ucuuuggggugccccu

SEQ ID NO: 2891646 - RNA, 15 nt, Human
agagaaucauacuua

SEQ ID NO: 2891647 - RNA, 22 nt, Human
agacuguguaaaauguaaugca

SEQ ID NO: 2891648 - RNA, 14 nt, Human
agagaaugcacaga

SEQ ID NO: 2891649 - RNA, 19 nt, Human
agagaaugcacagauauac

SEQ ID NO: 2891650 - RNA, 20 nt, Human
agagaaugcacagauauacu

SEQ ID NO: 2891651 - RNA, 16 nt, Human
agagaaugcugaccug

SEQ ID NO: 2891652 - RNA, 18 nt, Human
agagaaugaaagggccca

SEQ ID NO: 2891653 - RNA, 18 nt, Human
agacugugacaacugucu

SEQ ID NO: 2891654 - RNA, 14 nt, Human
agacugucucaaga

SEQ ID NO: 2891655 - RNA, 17 nt, Human
ucuuggcaauauuccuu

SEQ ID NO: 2891656 - RNA, 22 nt, Human
agacugugucucucugauaccu

SEQ ID NO: 2891657 - RNA, 19 nt, Human
agacuuggcaacagaagca

SEQ ID NO: 2891658 - RNA, 21 nt, Human
agacuuucuuucuguaggugg

SEQ ID NO: 2891659 - RNA, 17 nt, Human
agacuuggcaacagaag

SEQ ID NO: 2891660 - RNA, 18 nt, Human
agacuuggcaacagaagc

SEQ ID NO: 2891661 - RNA, 16 nt, Human
agacuugccagagccg

SEQ ID NO: 2891662 - RNA, 15 nt, Human
agacuugccauguga

SEQ ID NO: 2891663 - RNA, 17 nt, Human
agacuugccaugugacu

SEQ ID NO: 2891664 - RNA, 11 nt, Human
agacuugccuu

SEQ ID NO: 2891665 - RNA, 13 nt, Human
agacuugccuucc

SEQ ID NO: 2891666 - RNA, 16 nt, Human
agacuugccuuccuaa

SEQ ID NO: 2891667 - RNA, 22 nt, Human
agacuugccuuccuaagccugu

SEQ ID NO: 2891668 - RNA, 12 nt, Human
agacuugccaac

SEQ ID NO: 2891669 - RNA, 23 nt, Human
agacuugccaacaccacagaaau

SEQ ID NO: 2891670 - RNA, 14 nt, Human
ucuuagacuacauu

SEQ ID NO: 2891671 - RNA, 20 nt, Human
ucuuagacuacauuuagaga

SEQ ID NO: 2891672 - RNA, 15 nt, Human
ucuuagaaaugaagg

SEQ ID NO: 2891673 - RNA, 14 nt, Human
ucuuaauuaauuug

SEQ ID NO: 2891674 - RNA, 15 nt, Human
ucuuaauuaauuuga

SEQ ID NO: 2891675 - RNA, 23 nt, Human
ucuuaauuaauuugauuaacaaa

SEQ ID NO: 2891676 - RNA, 14 nt, Human
ucuuagaaaugaag

SEQ ID NO: 2891677 - RNA, 12 nt, Human
ucuuaauuauua

SEQ ID NO: 2891678 - RNA, 22 nt, Human
ucuuauugcccacgcuggagug

SEQ ID NO: 2891679 - RNA, 18 nt, Human
ucuuauugcccacgcugg

SEQ ID NO: 2891680 - RNA, 14 nt, Human
ucuuauugcccacg

SEQ ID NO: 2891681 - RNA, 14 nt, Human
ucuuccagggggaa

SEQ ID NO: 2891682 - RNA, 18 nt, Human
ucuuccaggugcccagcu

SEQ ID NO: 2891683 - RNA, 15 nt, Human
ucuuccaggugccca

SEQ ID NO: 2891684 - RNA, 17 nt, Human
ucuucccuuuccccagc

SEQ ID NO: 2891685 - RNA, 19 nt, Human
ucuucccuuuccccagcau

SEQ ID NO: 2891686 - RNA, 15 nt, Human
ucuuccgccccugcc

SEQ ID NO: 2891687 - RNA, 16 nt, Human
ucuuccgccccugccu

SEQ ID NO: 2891688 - RNA, 17 nt, Human
ucuuccgccccugccug

SEQ ID NO: 2891689 - RNA, 18 nt, Human
ucuuccgccccugccugc

SEQ ID NO: 2891690 - RNA, 19 nt, Human
ucuuccgccccugccugcc

SEQ ID NO: 2891691 - RNA, 21 nt, Human
ucuuccgccccugccugccau

SEQ ID NO: 2891692 - RNA, 23 nt, Human
ucuuccgccccugccugccaugu

SEQ ID NO: 2891693 - RNA, 21 nt, Human
ucuucccuaccucaggcagga

SEQ ID NO: 2891694 - RNA, 14 nt, Human
ucuucccuaccuca

SEQ ID NO: 2891695 - RNA, 13 nt, Human
ucuucccuaccuc

SEQ ID NO: 2891696 - RNA, 15 nt, Human
ucuuaauauauuuga

SEQ ID NO: 2891697 - RNA, 23 nt, Human
ucuucaccuaagucucugugaau

SEQ ID NO: 2891698 - RNA, 19 nt, Human
ucuucaccuaagucucugu

SEQ ID NO: 2891699 - RNA, 14 nt, Human
ucuucacucccccu

SEQ ID NO: 2891700 - RNA, 14 nt, Human
ucuucacucuuagg

SEQ ID NO: 2891701 - RNA, 15 nt, Human
ucuucacucuuaggc

SEQ ID NO: 2891702 - RNA, 21 nt, Human
ucuucacucuuaggcacuuug

SEQ ID NO: 2891703 - RNA, 15 nt, Human
ucuucacuuuugcaa

SEQ ID NO: 2891704 - RNA, 16 nt, Human
ucuucacuuuugcaag

SEQ ID NO: 2891705 - RNA, 18 nt, Human
ucuucagacucucagccc

SEQ ID NO: 2891706 - RNA, 20 nt, Human
ucuucagacucucagcccag

SEQ ID NO: 2891707 - RNA, 22 nt, Human
ucuucagacucucagcccagaa

SEQ ID NO: 2891708 - RNA, 23 nt, Human
ucuucagacucucagcccagaag

SEQ ID NO: 2891709 - RNA, 18 nt, Human
ucuucacagcucuguguu

SEQ ID NO: 2891710 - RNA, 17 nt, Human
ucuucaacauccugcca

SEQ ID NO: 2891711 - RNA, 18 nt, Human
ucuucaacauccugccag

SEQ ID NO: 2891712 - RNA, 19 nt, Human
ucuucaacauccugccagc

SEQ ID NO: 2891713 - RNA, 21 nt, Human
ucuucaacauccugccagccc

SEQ ID NO: 2891714 - RNA, 22 nt, Human
ucuucaacauccugccagcccc

SEQ ID NO: 2891715 - RNA, 19 nt, Human
ucuucacccaggccuaugu

SEQ ID NO: 2891716 - RNA, 23 nt, Human
ucuucacccaggccuauguugau

SEQ ID NO: 2891717 - RNA, 11 nt, Human
ucuucaccccg

SEQ ID NO: 2891718 - RNA, 15 nt, Human
ucuucaccccggcag

SEQ ID NO: 2891719 - RNA, 17 nt, Human
ucuucaccccggcaggc

SEQ ID NO: 2891720 - RNA, 18 nt, Human
ucuucaccccggcaggcc

SEQ ID NO: 2891721 - RNA, 20 nt, Human
ucuucaccccggcaggcccu

SEQ ID NO: 2891722 - RNA, 21 nt, Human
ucuucaccccggcaggcccug

SEQ ID NO: 2891723 - RNA, 22 nt, Human
ucuucaccccggcaggcccugc

SEQ ID NO: 2891724 - RNA, 23 nt, Human
ucuucaccccggcaggcccugca

SEQ ID NO: 2891725 - RNA, 22 nt, Human
ucuucaacauaacccacuuguc

SEQ ID NO: 2891726 - RNA, 13 nt, Human
ucuucaaauccuu

SEQ ID NO: 2891727 - RNA, 17 nt, Human
ucuucaaauccuuccaa

SEQ ID NO: 2891728 - RNA, 19 nt, Human
ucuucaaauccuuccaaaa

SEQ ID NO: 2891729 - RNA, 22 nt, Human
ucuucaaauccuuccaaaaauu

SEQ ID NO: 2891730 - RNA, 14 nt, Human
ucuucaaaauguau

SEQ ID NO: 2891731 - RNA, 17 nt, Human
ucuucaaaauguauaua

SEQ ID NO: 2891732 - RNA, 19 nt, Human
ucuucaaaauguauauauu

SEQ ID NO: 2891733 - RNA, 20 nt, Human
ucuucaaaauguauauauuu

SEQ ID NO: 2891734 - RNA, 14 nt, Human
ucuucaaacuguga

SEQ ID NO: 2891735 - RNA, 16 nt, Human
ucuuauugcgcugcua

SEQ ID NO: 2891736 - RNA, 17 nt, Human
ucuuauugcgcugcuac

SEQ ID NO: 2891737 - RNA, 16 nt, Human
ucuuauuuuucuaaac

SEQ ID NO: 2891738 - RNA, 18 nt, Human
ucuuauuuuucuaaacgu

SEQ ID NO: 2891739 - RNA, 17 nt, Human
ucuucaaaaugagcccu

SEQ ID NO: 2891740 - RNA, 15 nt, Human
ucuucaaaaacuguu

SEQ ID NO: 2891741 - RNA, 16 nt, Human
ucuucaaaaacuguuu

SEQ ID NO: 2891742 - RNA, 16 nt, Human
ucuucaaaaguaaugc

SEQ ID NO: 2891743 - RNA, 20 nt, Human
ucuucaaaaguaaugccucu

SEQ ID NO: 2891744 - RNA, 21 nt, Human
ucuucaaaaguaaugccucug

SEQ ID NO: 2891745 - RNA, 22 nt, Human
ucuucaaaaguaaugccucugu

SEQ ID NO: 2891746 - RNA, 13 nt, Human
agacaccagagca

SEQ ID NO: 2891747 - RNA, 15 nt, Human
agacaccagagcaga

SEQ ID NO: 2891748 - RNA, 17 nt, Human
agacaccaaaguucuaa

SEQ ID NO: 2891749 - RNA, 18 nt, Human
agacaccaaaguucuaau

SEQ ID NO: 2891750 - RNA, 13 nt, Human
agacaccaaaguu

SEQ ID NO: 2891751 - RNA, 14 nt, Human
agacaccaaaguuc

SEQ ID NO: 2891752 - RNA, 15 nt, Human
agacaccaaaguucu

SEQ ID NO: 2891753 - RNA, 16 nt, Human
agacaccaaaguucua

SEQ ID NO: 2891754 - RNA, 21 nt, Human
agacacccucaaccucuucug

SEQ ID NO: 2891755 - RNA, 14 nt, Human
agacacccuggcag

SEQ ID NO: 2891756 - RNA, 15 nt, Human
agacacccuggcagc

SEQ ID NO: 2891757 - RNA, 21 nt, Human
agacacggagcccagcccucc

SEQ ID NO: 2891758 - RNA, 16 nt, Human
agacacucaaauauga

SEQ ID NO: 2891759 - RNA, 20 nt, Human
agacacuccccgaagucuuu

SEQ ID NO: 2891760 - RNA, 19 nt, Human
agacacccucaaccucuuc

SEQ ID NO: 2891761 - RNA, 15 nt, Human
ucuguucuaacaugu

SEQ ID NO: 2891762 - RNA, 20 nt, Human
agacaccagagcagaugcag

SEQ ID NO: 2891763 - RNA, 14 nt, Human
agacaccagccacu

SEQ ID NO: 2891764 - RNA, 22 nt, Human
agacagagacccucugccacca

SEQ ID NO: 2891765 - RNA, 22 nt, Human
agacagcuucucauccugcagg

SEQ ID NO: 2891766 - RNA, 23 nt, Human
agacagcuucucauccugcaggc

SEQ ID NO: 2891767 - RNA, 14 nt, Human
agacagacacacac

SEQ ID NO: 2891768 - RNA, 14 nt, Human
agacagaauguauc

SEQ ID NO: 2891769 - RNA, 15 nt, Human
agacagaauguaucu

SEQ ID NO: 2891770 - RNA, 17 nt, Human
agacagaauguaucugu

SEQ ID NO: 2891771 - RNA, 18 nt, Human
agacagaauguaucugug

SEQ ID NO: 2891772 - RNA, 19 nt, Human
agacagaauguaucuguga

SEQ ID NO: 2891773 - RNA, 20 nt, Human
agacagaauguaucugugaa

SEQ ID NO: 2891774 - RNA, 21 nt, Human
agacagaauguaucugugaag

SEQ ID NO: 2891775 - RNA, 15 nt, Human
agacagacacacaca

SEQ ID NO: 2891776 - RNA, 16 nt, Human
agacagacacacacac

SEQ ID NO: 2891777 - RNA, 17 nt, Human
agacagacccugaaaag

SEQ ID NO: 2891778 - RNA, 12 nt, Human
agacagaaucuc

SEQ ID NO: 2891779 - RNA, 19 nt, Human
agacagagacccucugcca

SEQ ID NO: 2891780 - RNA, 18 nt, Human
agacagagaauaugucug

SEQ ID NO: 2891781 - RNA, 19 nt, Human
agacagagaauaugucugc

SEQ ID NO: 2891782 - RNA, 21 nt, Human
agacagagaauaugucugcuc

SEQ ID NO: 2891783 - RNA, 23 nt, Human
agacagagaauaugucugcuccu

SEQ ID NO: 2891784 - RNA, 16 nt, Human
agacagaagucuccuc

SEQ ID NO: 2891785 - RNA, 17 nt, Human
agacagaagucuccuca

SEQ ID NO: 2891786 - RNA, 22 nt, Human
agacagaaucucgcucugucgc

SEQ ID NO: 2891787 - RNA, 18 nt, Human
agacagaaucucgcucug

SEQ ID NO: 2891788 - RNA, 23 nt, Human
agacacuccccgaagucuuuugu

SEQ ID NO: 2891789 - RNA, 22 nt, Human
agacacuccccgaagucuuuug

SEQ ID NO: 2891790 - RNA, 21 nt, Human
agacaggguuuugccauguug

SEQ ID NO: 2891791 - RNA, 23 nt, Human
agacaggguuucaccauguugcc

SEQ ID NO: 2891792 - RNA, 22 nt, Human
agacaggucccuccccuucucu

SEQ ID NO: 2891793 - RNA, 19 nt, Human
agacaggguuucaccaugu

SEQ ID NO: 2891794 - RNA, 22 nt, Human
agacaggcaagcaccuccugcc

SEQ ID NO: 2891795 - RNA, 23 nt, Human
agacaggcaagcaccuccugccu

SEQ ID NO: 2891796 - RNA, 21 nt, Human
agacaggacagugcuucagcc

SEQ ID NO: 2891797 - RNA, 19 nt, Human
agacaggaaaguucagagu

SEQ ID NO: 2891798 - RNA, 18 nt, Human
agacagguuuucacauaa

SEQ ID NO: 2891799 - RNA, 21 nt, Human
agacagguuuucacauaaaug

SEQ ID NO: 2891800 - RNA, 22 nt, Human
agacagguuuucacauaaaugc

SEQ ID NO: 2891801 - RNA, 12 nt, Human
ucuuaagcuucc

SEQ ID NO: 2891802 - RNA, 18 nt, Human
ucuuaaggugaggccugu

SEQ ID NO: 2891803 - RNA, 23 nt, Human
ucuuaaggugaggccugucugug

SEQ ID NO: 2891804 - RNA, 13 nt, Human
ucuguuuguuauu

SEQ ID NO: 2891805 - RNA, 13 nt, Human
ucuguuuguuuca

SEQ ID NO: 2891806 - RNA, 21 nt, Human
ucuguuuguuucaagaaccug

SEQ ID NO: 2891807 - RNA, 19 nt, Human
ucuguuuggacugcagaag

SEQ ID NO: 2891808 - RNA, 21 nt, Human
ucuguuuggacugcagaagca

SEQ ID NO: 2891809 - RNA, 12 nt, Human
ucuguuuccugu

SEQ ID NO: 2891810 - RNA, 11 nt, Human
ucuguuguaac

SEQ ID NO: 2891811 - RNA, 12 nt, Human
ucuguuguaacu

SEQ ID NO: 2891812 - RNA, 13 nt, Human
ucuguuguaacuu

SEQ ID NO: 2891813 - RNA, 14 nt, Human
ucuguuguaacuua

SEQ ID NO: 2891814 - RNA, 15 nt, Human
ucuguuguaacuuau

SEQ ID NO: 2891815 - RNA, 16 nt, Human
ucuguuguaacuuaug

SEQ ID NO: 2891816 - RNA, 21 nt, Human
ucuguuguaacuuauguagau

SEQ ID NO: 2891817 - RNA, 13 nt, Human
ucuguuugauucu

SEQ ID NO: 2891818 - RNA, 14 nt, Human
ucuguuugauucuu

SEQ ID NO: 2891819 - RNA, 16 nt, Human
ucuguuugauucuuuu

SEQ ID NO: 2891820 - RNA, 23 nt, Human
agaauugcugaagggcauucuuu

SEQ ID NO: 2891821 - RNA, 18 nt, Human
ucuguuuuagguuaaaaa

SEQ ID NO: 2891822 - RNA, 13 nt, Human
agaauuggcucaa

SEQ ID NO: 2891823 - RNA, 16 nt, Human
agaauuggcucaauaa

SEQ ID NO: 2891824 - RNA, 18 nt, Human
agaauuggcugaacucau

SEQ ID NO: 2891825 - RNA, 21 nt, Human
agaauuggcugaacucaugag

SEQ ID NO: 2891826 - RNA, 22 nt, Human
agaauuggcugaacucaugaga

SEQ ID NO: 2891827 - RNA, 13 nt, Human
agaauugggcggc

SEQ ID NO: 2891828 - RNA, 18 nt, Human
agaauugugcaaauggaa

SEQ ID NO: 2891829 - RNA, 23 nt, Human
agaauugugcaaauggaagacaa

SEQ ID NO: 2891830 - RNA, 11 nt, Human
agaauuguuau

SEQ ID NO: 2891831 - RNA, 17 nt, Human
agaauuucuaaaaagau

SEQ ID NO: 2891832 - RNA, 22 nt, Human
agaauuucuaaaaagauuagca

SEQ ID NO: 2891833 - RNA, 23 nt, Human
agaauuucuaaaaagauuagcaa

SEQ ID NO: 2891834 - RNA, 20 nt, Human
agaauuucuaccauuucaga

SEQ ID NO: 2891835 - RNA, 16 nt, Human
agaauuucuaccauuu

SEQ ID NO: 2891836 - RNA, 22 nt, Human
agaauuucuugguaagaagccg

SEQ ID NO: 2891837 - RNA, 21 nt, Human
agaauuucuugguaagaagcc

SEQ ID NO: 2891838 - RNA, 13 nt, Human
agaauuucuuggu

SEQ ID NO: 2891839 - RNA, 21 nt, Human
agaauuucuaccauuucagag

SEQ ID NO: 2891840 - RNA, 21 nt, Human
agaauuuaucacacuucugug

SEQ ID NO: 2891841 - RNA, 24 nt, Human
ucuguccaggcacugcugcccagc

SEQ ID NO: 2891842 - RNA, 14 nt, Human
ucugucuuguaaua

SEQ ID NO: 2891843 - RNA, 19 nt, Human
ucugucuuguaauauuuug

SEQ ID NO: 2891844 - RNA, 20 nt, Human
ucugucuuguaauauuuugu

SEQ ID NO: 2891845 - RNA, 18 nt, Human
ucugugccuucuuuugau

SEQ ID NO: 2891846 - RNA, 22 nt, Human
ucugugccuucuuuugauuaug

SEQ ID NO: 2891847 - RNA, 22 nt, Human
ucugugccccaugccuguccag

SEQ ID NO: 2891848 - RNA, 14 nt, Human
ucuguccaccagcc

SEQ ID NO: 2891849 - RNA, 13 nt, Human
ucugugaaaccug

SEQ ID NO: 2891850 - RNA, 14 nt, Human
ucugugaaaccugu

SEQ ID NO: 2891851 - RNA, 22 nt, Human
ucugugaaaccugugaagcuga

SEQ ID NO: 2891852 - RNA, 17 nt, Human
ucugugccccaugccug

SEQ ID NO: 2891853 - RNA, 20 nt, Human
ucuguuggccagugugacaa

SEQ ID NO: 2891854 - RNA, 19 nt, Human
ucuguuggccagugugaca

SEQ ID NO: 2891855 - RNA, 18 nt, Human
ucuguuggccagugugac

SEQ ID NO: 2891856 - RNA, 14 nt, Human
ucuguucuacccgu

SEQ ID NO: 2891857 - RNA, 21 nt, Human
ucuguucuacccguuccaaaa

SEQ ID NO: 2891858 - RNA, 13 nt, Human
ucugugcucagga

SEQ ID NO: 2891859 - RNA, 14 nt, Human
ucugugcuccuccu

SEQ ID NO: 2891860 - RNA, 14 nt, Human
ucugugcugacaug

SEQ ID NO: 2891861 - RNA, 21 nt, Human
ucugucagcgcagguuuaguu

SEQ ID NO: 2891862 - RNA, 14 nt, Human
ucuguauauaaaug

SEQ ID NO: 2891863 - RNA, 15 nt, Human
ucuguauauaaaugg

SEQ ID NO: 2891864 - RNA, 16 nt, Human
ucuguauauaaauggg

SEQ ID NO: 2891865 - RNA, 17 nt, Human
ucuguauauaaauggga

SEQ ID NO: 2891866 - RNA, 23 nt, Human
ucuguauauaaaugggaacauuu

SEQ ID NO: 2891867 - RNA, 15 nt, Human
ucugucauuugagca

SEQ ID NO: 2891868 - RNA, 23 nt, Human
ucugucauuugagcagggcucag

SEQ ID NO: 2891869 - RNA, 20 nt, Human
ucugucauuugagcagggcu

SEQ ID NO: 2891870 - RNA, 13 nt, Human
ucugucauuuguu

SEQ ID NO: 2891871 - RNA, 23 nt, Human
ucuguccaaaggaggcuggcagg

SEQ ID NO: 2891872 - RNA, 22 nt, Human
ucuguccaaaggaggcuggcag

SEQ ID NO: 2891873 - RNA, 19 nt, Human
ucuguccaaaggaggcugg

SEQ ID NO: 2891874 - RNA, 17 nt, Human
ucuguccaaaggaggcu

SEQ ID NO: 2891875 - RNA, 16 nt, Human
ucuguccaaaggaggc

SEQ ID NO: 2891876 - RNA, 15 nt, Human
ucuguccaaaggagg

SEQ ID NO: 2891877 - RNA, 17 nt, Human
ucugucauuguacccuu

SEQ ID NO: 2891878 - RNA, 14 nt, Human
ucuguauacugugg

SEQ ID NO: 2891879 - RNA, 15 nt, Human
ucuguauacaacccu

SEQ ID NO: 2891880 - RNA, 15 nt, Human
ucuguagucauuuac

SEQ ID NO: 2891881 - RNA, 18 nt, Human
ucuguagucauuuacuaa

SEQ ID NO: 2891882 - RNA, 19 nt, Human
ucuguagucauuuacuaaa

SEQ ID NO: 2891883 - RNA, 21 nt, Human
ucuguauaaacauuaaauguc

SEQ ID NO: 2891884 - RNA, 22 nt, Human
ucuguauaaacauuaaaugucu

SEQ ID NO: 2891885 - RNA, 23 nt, Human
ucuguauaaacauuaaaugucuu

SEQ ID NO: 2891886 - RNA, 18 nt, Human
ucuguagagccuucugau

SEQ ID NO: 2891887 - RNA, 16 nt, Human
ucuguagauucugugg

SEQ ID NO: 2891888 - RNA, 19 nt, Human
ucuguagauucuguggaac

SEQ ID NO: 2891889 - RNA, 23 nt, Human
ucuguagauucuguggaacaagc

SEQ ID NO: 2891890 - RNA, 15 nt, Human
ucuguagccacuagu

SEQ ID NO: 2891891 - RNA, 16 nt, Human
ucuguagguuaaaaaa

SEQ ID NO: 2891892 - RNA, 13 nt, Human
ucuggguggccuc

SEQ ID NO: 2891893 - RNA, 16 nt, Human
ucuggguuccuuccuc

SEQ ID NO: 2891894 - RNA, 18 nt, Human
ucugguccggacacuccu

SEQ ID NO: 2891895 - RNA, 14 nt, Human
ucuggggcucuagg

SEQ ID NO: 2891896 - RNA, 23 nt, Human
ucuggucaaagaaagaaaguuua

SEQ ID NO: 2891897 - RNA, 14 nt, Human
ucuggucccuugca

SEQ ID NO: 2891898 - RNA, 13 nt, Human
ucuggucccuugc

SEQ ID NO: 2891899 - RNA, 16 nt, Human
ucuggguucacugcaa

SEQ ID NO: 2891900 - RNA, 14 nt, Human
ucuggguucacugc

SEQ ID NO: 2891901 - RNA, 13 nt, Human
ucugggucuuuug

SEQ ID NO: 2891902 - RNA, 20 nt, Human
ucuggggcaggcugggccau

SEQ ID NO: 2891903 - RNA, 19 nt, Human
ucuggggcaggcugggcca

SEQ ID NO: 2891904 - RNA, 18 nt, Human
ucuggggcaggcugggcc

SEQ ID NO: 2891905 - RNA, 17 nt, Human
ucuggggcaggcugggc

SEQ ID NO: 2891906 - RNA, 21 nt, Human
ucuggggcaggcugggccaug

SEQ ID NO: 2891907 - RNA, 17 nt, Human
agaaggaagugaagagg

SEQ ID NO: 2891908 - RNA, 17 nt, Human
agaagcuucagaaguuu

SEQ ID NO: 2891909 - RNA, 16 nt, Human
agaagcuucagaaguu

SEQ ID NO: 2891910 - RNA, 12 nt, Human
agaagcuucuaa

SEQ ID NO: 2891911 - RNA, 16 nt, Human
agaagcuucuaauaaa

SEQ ID NO: 2891912 - RNA, 18 nt, Human
agaagcuucuaauaaauu

SEQ ID NO: 2891913 - RNA, 22 nt, Human
agaagcuucuaauaaauuauac

SEQ ID NO: 2891914 - RNA, 23 nt, Human
agaagcuguuguacauuuaugau

SEQ ID NO: 2891915 - RNA, 23 nt, Human
agaaggaaagcuuuggcaguguu

SEQ ID NO: 2891916 - RNA, 9 nt, Human
agaaggaag

SEQ ID NO: 2891917 - RNA, 14 nt, Human
agcuacucagaagc

SEQ ID NO: 2891918 - RNA, 20 nt, Human
agcuacucagaagccugagg

SEQ ID NO: 2891919 - RNA, 19 nt, Human
agcuacucagaagccugag

SEQ ID NO: 2891920 - RNA, 18 nt, Human
agcuacucagaagccuga

SEQ ID NO: 2891921 - RNA, 15 nt, Human
agcuacucagaagcc

SEQ ID NO: 2891922 - RNA, 23 nt, Human
agcgugucuguauuuauguguga

SEQ ID NO: 2891923 - RNA, 17 nt, Human
agcguggcugugcucuc

SEQ ID NO: 2891924 - RNA, 15 nt, Human
agcguggacaggugu

SEQ ID NO: 2891925 - RNA, 17 nt, Human
agcgugagccacugcac

SEQ ID NO: 2891926 - RNA, 16 nt, Human
agcgugagccacugca

SEQ ID NO: 2891927 - RNA, 21 nt, Human
ugccauauucuguuggccagu

SEQ ID NO: 2891928 - RNA, 20 nt, Human
ugccauauucuguuggccag

SEQ ID NO: 2891929 - RNA, 15 nt, Human
agcggggacagcucc

SEQ ID NO: 2891930 - RNA, 17 nt, Human
agcggggacagcuccuu

SEQ ID NO: 2891931 - RNA, 16 nt, Human
agcggggacagcuccu

SEQ ID NO: 2891932 - RNA, 15 nt, Human
agcgugagccacugc

SEQ ID NO: 2891933 - RNA, 13 nt, Human
agcgugagccacu

SEQ ID NO: 2891934 - RNA, 13 nt, Human
agcgggcgccugu

SEQ ID NO: 2891935 - RNA, 15 nt, Human
agcgggaggcagagu

SEQ ID NO: 2891936 - RNA, 21 nt, Human
agcgggaggcagaguuugccu

SEQ ID NO: 2891937 - RNA, 19 nt, Human
agcgggcagguucugccug

SEQ ID NO: 2891938 - RNA, 23 nt, Human
agcgggcagguucugccugcuuu

SEQ ID NO: 2891939 - RNA, 19 nt, Human
ugccacuugaacaaaaucu

SEQ ID NO: 2891940 - RNA, 21 nt, Human
ugccacuugaacaaaaucugu

SEQ ID NO: 2891941 - RNA, 22 nt, Human
ugccacuugaacaaaaucuguu

SEQ ID NO: 2891942 - RNA, 18 nt, Human
ugccacacucuccaucac

SEQ ID NO: 2891943 - RNA, 19 nt, Human
ugccacuggggaaaacucc

SEQ ID NO: 2891944 - RNA, 23 nt, Human
ugccacugccucuuccucccuca

SEQ ID NO: 2891945 - RNA, 12 nt, Human
ugccacacuuca

SEQ ID NO: 2891946 - RNA, 15 nt, Human
ugccauauucuguug

SEQ ID NO: 2891947 - RNA, 18 nt, Human
ugccauagucacauggcc

SEQ ID NO: 2891948 - RNA, 19 nt, Human
ugccauagucacauggccu

SEQ ID NO: 2891949 - RNA, 13 nt, Human
agcggauuuccag

SEQ ID NO: 2891950 - RNA, 21 nt, Human
ugccauauauaacagauacau

SEQ ID NO: 2891951 - RNA, 17 nt, Human
ugccauauucuguuggc

SEQ ID NO: 2891952 - RNA, 16 nt, Human
ugccauauucuguugg

SEQ ID NO: 2891953 - RNA, 22 nt, Human
ugccacuuuacccaccuagaac

SEQ ID NO: 2891954 - RNA, 21 nt, Human
ugccacuuuacccaccuagaa

SEQ ID NO: 2891955 - RNA, 17 nt, Human
ugccauagucacauggc

SEQ ID NO: 2891956 - RNA, 19 nt, Human
ugccagucccccugcccca

SEQ ID NO: 2891957 - RNA, 20 nt, Human
ugccacuucacuccagccug

SEQ ID NO: 2891958 - RNA, 20 nt, Human
ugccacuuuacccaccuaga

SEQ ID NO: 2891959 - RNA, 17 nt, Human
ugccagucccccugccc

SEQ ID NO: 2891960 - RNA, 15 nt, Human
ugccaauauguauug

SEQ ID NO: 2891961 - RNA, 14 nt, Human
ugccacacucucca

SEQ ID NO: 2891962 - RNA, 14 nt, Human
ugccacacccuccc

SEQ ID NO: 2891963 - RNA, 22 nt, Human
ugccacacccucccccgccacu

SEQ ID NO: 2891964 - RNA, 13 nt, Human
ugccacacccucc

SEQ ID NO: 2891965 - RNA, 18 nt, Human
ugccaauauuaaaucugc

SEQ ID NO: 2891966 - RNA, 16 nt, Human
ugccaauauguauugu

SEQ ID NO: 2891967 - RNA, 19 nt, Human
ugccaauauguauuguaaa

SEQ ID NO: 2891968 - RNA, 13 nt, Human
ugcauuuccugac

SEQ ID NO: 2891969 - RNA, 21 nt, Human
ugcauugaacacaaacuguaa

SEQ ID NO: 2891970 - RNA, 19 nt, Human
ugcauugaacacaaacugu

SEQ ID NO: 2891971 - RNA, 14 nt, Human
ugcauuuccugaca

SEQ ID NO: 2891972 - RNA, 18 nt, Human
ugcauuucugaauagaaa

SEQ ID NO: 2891973 - RNA, 19 nt, Human
ugcauuucugaauagaaau

SEQ ID NO: 2891974 - RNA, 20 nt, Human
ugcauucuugguuggcuggc

SEQ ID NO: 2891975 - RNA, 18 nt, Human
ugcauugaacacaaacug

SEQ ID NO: 2891976 - RNA, 17 nt, Human
ugcauugaacacaaacu

SEQ ID NO: 2891977 - RNA, 15 nt, Human
ugcauugaacacaaa

SEQ ID NO: 2891978 - RNA, 14 nt, Human
ugcauugaacacaa

SEQ ID NO: 2891979 - RNA, 13 nt, Human
ugcauugaacaca

SEQ ID NO: 2891980 - RNA, 22 nt, Human
agcgcccaguuggguggaugcc

SEQ ID NO: 2891981 - RNA, 14 nt, Human
agcgcccaguuggg

SEQ ID NO: 2891982 - RNA, 18 nt, Human
agcgccagccugucccau

SEQ ID NO: 2891983 - RNA, 20 nt, Human
agcgcccacuagacccacug

SEQ ID NO: 2891984 - RNA, 22 nt, Human
agcgccaguguaaucccccagg

SEQ ID NO: 2891985 - RNA, 21 nt, Human
agccugcguugguccagagcg

SEQ ID NO: 2891986 - RNA, 15 nt, Human
agccugccuggagcg

SEQ ID NO: 2891987 - RNA, 14 nt, Human
agccugccuggagc

SEQ ID NO: 2891988 - RNA, 13 nt, Human
agccugccuggag

SEQ ID NO: 2891989 - RNA, 21 nt, Human
agccugcaucccaggaugcug

SEQ ID NO: 2891990 - RNA, 22 nt, Human
agcgcgccacucgcuuccccca

SEQ ID NO: 2891991 - RNA, 20 nt, Human
agcgcgccacucgcuucccc

SEQ ID NO: 2891992 - RNA, 19 nt, Human
agcgcgccacucgcuuccc

SEQ ID NO: 2891993 - RNA, 12 nt, Human
agcgcgccacuc

SEQ ID NO: 2891994 - RNA, 15 nt, Human
agcgcguugccuguc

SEQ ID NO: 2891995 - RNA, 17 nt, Human
agcgcuaucuucacaua

SEQ ID NO: 2891996 - RNA, 18 nt, Human
agcgcuaucuucacauag

SEQ ID NO: 2891997 - RNA, 22 nt, Human
agcgcucagaacaguaucuuug

SEQ ID NO: 2891998 - RNA, 17 nt, Human
agcggagucuguccugu

SEQ ID NO: 2891999 - RNA, 18 nt, Human
agcggaugauucuucaag

SEQ ID NO: 2892000 - RNA, 12 nt, Human
agcgcucugccu

SEQ ID NO: 2892001 - RNA, 15 nt, Human
agcggcgaccgcccu

SEQ ID NO: 2892002 - RNA, 18 nt, Human
agcggcgaccgcccuccg

SEQ ID NO: 2892003 - RNA, 17 nt, Human
agcggcccuaagggagu

SEQ ID NO: 2892004 - RNA, 16 nt, Human
ugcccuagaugagccc

SEQ ID NO: 2892005 - RNA, 17 nt, Human
ugcccucauggccccuc

SEQ ID NO: 2892006 - RNA, 19 nt, Human
ugcccucauggccccucug

SEQ ID NO: 2892007 - RNA, 23 nt, Human
ugcccucauggccccucugaccu

SEQ ID NO: 2892008 - RNA, 18 nt, Human
ugcccucauuacugggcc

SEQ ID NO: 2892009 - RNA, 19 nt, Human
ugcccucauuacugggccu

SEQ ID NO: 2892010 - RNA, 23 nt, Human
ugcccucauuacugggccuuagu

SEQ ID NO: 2892011 - RNA, 22 nt, Human
ugcccccugguggacaguccug

SEQ ID NO: 2892012 - RNA, 14 nt, Human
ugccccgucucugu

SEQ ID NO: 2892013 - RNA, 17 nt, Human
ugccccgucucuguucc

SEQ ID NO: 2892014 - RNA, 18 nt, Human
ugccccgucccccucugg

SEQ ID NO: 2892015 - RNA, 16 nt, Human
ugccccgucccccucu

SEQ ID NO: 2892016 - RNA, 21 nt, Human
ugcccccugguggacaguccu

SEQ ID NO: 2892017 - RNA, 13 nt, Human
ugcccccuggugg

SEQ ID NO: 2892018 - RNA, 12 nt, Human
ugcccccuggug

SEQ ID NO: 2892019 - RNA, 16 nt, Human
ugcccccugcuggcuc

SEQ ID NO: 2892020 - RNA, 22 nt, Human
ugcccccugcuggcucuucugc

SEQ ID NO: 2892021 - RNA, 13 nt, Human
ugcccccugcugg

SEQ ID NO: 2892022 - RNA, 14 nt, Human
ugcccccugcuggc

SEQ ID NO: 2892023 - RNA, 14 nt, Human
ugccccccagccuc

SEQ ID NO: 2892024 - RNA, 15 nt, Human
ugccccccagccucu

SEQ ID NO: 2892025 - RNA, 19 nt, Human
ugccccccagccucuggca

SEQ ID NO: 2892026 - RNA, 20 nt, Human
ugccccccagccucuggcau

SEQ ID NO: 2892027 - RNA, 12 nt, Human
ugccccccagcc

SEQ ID NO: 2892028 - RNA, 11 nt, Human
ugcccaggccc

SEQ ID NO: 2892029 - RNA, 20 nt, Human
ugcccaggcaggucuugaac

SEQ ID NO: 2892030 - RNA, 17 nt, Human
ugcccaggcaggucuug

SEQ ID NO: 2892031 - RNA, 16 nt, Human
ugcccaggcaggucuu

SEQ ID NO: 2892032 - RNA, 15 nt, Human
ugcccaggcaggucu

SEQ ID NO: 2892033 - RNA, 14 nt, Human
ugcccacaggauca

SEQ ID NO: 2892034 - RNA, 14 nt, Human
ugcccaagggaaag

SEQ ID NO: 2892035 - RNA, 15 nt, Human
ugcccaauuggagga

SEQ ID NO: 2892036 - RNA, 21 nt, Human
ugcccaaugagacucuagggu

SEQ ID NO: 2892037 - RNA, 20 nt, Human
ugcccaaugagacucuaggg

SEQ ID NO: 2892038 - RNA, 22 nt, Human
ugcccaggccccugccacccug

SEQ ID NO: 2892039 - RNA, 20 nt, Human
ugcccaggccccugccaccc

SEQ ID NO: 2892040 - RNA, 12 nt, Human
ugcccaggcccc

SEQ ID NO: 2892041 - RNA, 16 nt, Human
ugcccaauuggaggaa

SEQ ID NO: 2892042 - RNA, 21 nt, Human
ugcccaauuggaggaaagcaa

SEQ ID NO: 2892043 - RNA, 14 nt, Human
ugcccccagcccaa

SEQ ID NO: 2892044 - RNA, 17 nt, Human
ugcccccagcccaaagg

SEQ ID NO: 2892045 - RNA, 15 nt, Human
ugcccaggcccagac

SEQ ID NO: 2892046 - RNA, 17 nt, Human
ugcccaggccugccugu

SEQ ID NO: 2892047 - RNA, 14 nt, Human
ugcccaggcccaga

SEQ ID NO: 2892048 - RNA, 15 nt, Human
ugcccaggccggcca

SEQ ID NO: 2892049 - RNA, 20 nt, Human
ugcccaggccggccagccuc

SEQ ID NO: 2892050 - RNA, 21 nt, Human
ugcccaggccggccagccuca

SEQ ID NO: 2892051 - RNA, 22 nt, Human
ugcccaggccggccagccucac

SEQ ID NO: 2892052 - RNA, 15 nt, Human
ugcccaggccugccu

SEQ ID NO: 2892053 - RNA, 19 nt, Human
ugccauguuggccaggcug

SEQ ID NO: 2892054 - RNA, 18 nt, Human
ugccauguuggccaggcu

SEQ ID NO: 2892055 - RNA, 17 nt, Human
ugccauguuggccaggc

SEQ ID NO: 2892056 - RNA, 20 nt, Human
ugccauguuggccaggcugg

SEQ ID NO: 2892057 - RNA, 21 nt, Human
ugccauguuggccaggcuggu

SEQ ID NO: 2892058 - RNA, 16 nt, Human
ugccauuaucccugaa

SEQ ID NO: 2892059 - RNA, 16 nt, Human
ugccauucauagagag

SEQ ID NO: 2892060 - RNA, 18 nt, Human
ugccauucauagagagcc

SEQ ID NO: 2892061 - RNA, 14 nt, Human
ugcccaagcccagg

SEQ ID NO: 2892062 - RNA, 18 nt, Human
ugcccaagcccaggccac

SEQ ID NO: 2892063 - RNA, 21 nt, Human
ugcccaagcccaggccacccu

SEQ ID NO: 2892064 - RNA, 22 nt, Human
ugcccaacuacuaucucagaga

SEQ ID NO: 2892065 - RNA, 18 nt, Human
ugcccaacuguguagcau

SEQ ID NO: 2892066 - RNA, 23 nt, Human
ugcccaaccugcucuccucuugc

SEQ ID NO: 2892067 - RNA, 24 nt, Human
ugcccaaccugcucuccucuugcc

SEQ ID NO: 2892068 - RNA, 15 nt, Human
ugccauugcacucca

SEQ ID NO: 2892069 - RNA, 23 nt, Human
ugccauuaucccugaaucccccu

SEQ ID NO: 2892070 - RNA, 18 nt, Human
ugccauuauuuucuguca

SEQ ID NO: 2892071 - RNA, 19 nt, Human
ugccauuauuuucugucag

SEQ ID NO: 2892072 - RNA, 20 nt, Human
ugccauuauuuucugucaga

SEQ ID NO: 2892073 - RNA, 21 nt, Human
ugccauuauuuucugucagau

SEQ ID NO: 2892074 - RNA, 18 nt, Human
ugcccaaccugcucuccu

SEQ ID NO: 2892075 - RNA, 22 nt, Human
ugcccaaccugcucuccucuug

SEQ ID NO: 2892076 - RNA, 14 nt, Human
agcuauuccuuucc

SEQ ID NO: 2892077 - RNA, 16 nt, Human
agcuauuccuuucccu

SEQ ID NO: 2892078 - RNA, 18 nt, Human
agcuauuccuuucccuuc

SEQ ID NO: 2892079 - RNA, 19 nt, Human
agcuauuccuuucccuucc

SEQ ID NO: 2892080 - RNA, 20 nt, Human
agcuauuccuuucccuuccu

SEQ ID NO: 2892081 - RNA, 21 nt, Human
agcuauuccuuucccuuccuc

SEQ ID NO: 2892082 - RNA, 22 nt, Human
agcuauuccuuucccuuccucu

SEQ ID NO: 2892083 - RNA, 17 nt, Human
agcuaugggagccccag

SEQ ID NO: 2892084 - RNA, 23 nt, Human
agcuaugcugguaggcuccugcc

SEQ ID NO: 2892085 - RNA, 19 nt, Human
agcuaugggagccccaggg

SEQ ID NO: 2892086 - RNA, 18 nt, Human
agcuaugggagccccagg

SEQ ID NO: 2892087 - RNA, 22 nt, Human
agcuaugggagccccagggucu

SEQ ID NO: 2892088 - RNA, 13 nt, Human
agcuaugaagaaa

SEQ ID NO: 2892089 - RNA, 17 nt, Human
agcuauaccugugccuc

SEQ ID NO: 2892090 - RNA, 12 nt, Human
agcuaguuuucu

SEQ ID NO: 2892091 - RNA, 16 nt, Human
agcuauaccugugccu

SEQ ID NO: 2892092 - RNA, 15 nt, Human
agcuauaccugugcc

SEQ ID NO: 2892093 - RNA, 21 nt, Human
agcuacuuccuccuccccacu

SEQ ID NO: 2892094 - RNA, 23 nt, Human
agcuacugugugugugaaugaac

SEQ ID NO: 2892095 - RNA, 15 nt, Human
agcuacuuaagagaa

SEQ ID NO: 2892096 - RNA, 17 nt, Human
agcuacuuaagagaaau

SEQ ID NO: 2892097 - RNA, 18 nt, Human
agcuacuuaagagaaaug

SEQ ID NO: 2892098 - RNA, 19 nt, Human
agcuacuuaagagaaaugg

SEQ ID NO: 2892099 - RNA, 21 nt, Human
agcuacuuaagagaaauggca

SEQ ID NO: 2892100 - RNA, 15 nt, Human
agcuacuuccuccuc

SEQ ID NO: 2892101 - RNA, 16 nt, Human
agcuacuuccuccucc

SEQ ID NO: 2892102 - RNA, 22 nt, Human
agcuacucgggaggcugaggca

SEQ ID NO: 2892103 - RNA, 23 nt, Human
agcuacucgggaggcugaggcac

SEQ ID NO: 2892104 - RNA, 21 nt, Human
agcuacucagaagccugaggc

SEQ ID NO: 2892105 - RNA, 20 nt, Human
agcuacugugugugugaaug

SEQ ID NO: 2892106 - RNA, 19 nt, Human
agcuacugugugugugaau

SEQ ID NO: 2892107 - RNA, 15 nt, Human
agcuacugugugugu

SEQ ID NO: 2892108 - RNA, 19 nt, Human
agcuacugcggaaaaggaa

SEQ ID NO: 2892109 - RNA, 18 nt, Human
agcuacugcggaaaagga

SEQ ID NO: 2892110 - RNA, 16 nt, Human
agcuacugauuuuugu

SEQ ID NO: 2892111 - RNA, 18 nt, Human
agcccuuaucugugcuca

SEQ ID NO: 2892112 - RNA, 13 nt, Human
agcccuugaggga

SEQ ID NO: 2892113 - RNA, 20 nt, Human
agcccuugagggagaacuua

SEQ ID NO: 2892114 - RNA, 19 nt, Human
agccguuuguuccccaaga

SEQ ID NO: 2892115 - RNA, 23 nt, Human
agccguuuguuccccaagacauu

SEQ ID NO: 2892116 - RNA, 22 nt, Human
agccuaaaugccuuagaaaugu

SEQ ID NO: 2892117 - RNA, 15 nt, Human
agccuaauacaacau

SEQ ID NO: 2892118 - RNA, 23 nt, Human
agccuaggaccacucagccccua

SEQ ID NO: 2892119 - RNA, 17 nt, Human
agccuaggugacagagu

SEQ ID NO: 2892120 - RNA, 15 nt, Human
agccuaggugacaga

SEQ ID NO: 2892121 - RNA, 15 nt, Human
agccuaguggcuugu

SEQ ID NO: 2892122 - RNA, 18 nt, Human
agccuaguggcuuguccu

SEQ ID NO: 2892123 - RNA, 19 nt, Human
agccuaguggcuuguccuc

SEQ ID NO: 2892124 - RNA, 19 nt, Human
agccuaguuuuuaauagcu

SEQ ID NO: 2892125 - RNA, 15 nt, Human
agccucaaccuccug

SEQ ID NO: 2892126 - RNA, 19 nt, Human
agccuauggcagaaaaaau

SEQ ID NO: 2892127 - RNA, 16 nt, Human
agccuauggcagaaaa

SEQ ID NO: 2892128 - RNA, 13 nt, Human
agccuauguugug

SEQ ID NO: 2892129 - RNA, 16 nt, Human
agccuauguugugguc

SEQ ID NO: 2892130 - RNA, 13 nt, Human
agccuauuccuga

SEQ ID NO: 2892131 - RNA, 15 nt, Human
agccuauuuaccugc

SEQ ID NO: 2892132 - RNA, 16 nt, Human
agccuauuuaccugca

SEQ ID NO: 2892133 - RNA, 20 nt, Human
agccuauuuaccugcaggcu

SEQ ID NO: 2892134 - RNA, 21 nt, Human
agccuauuuaccugcaggcug

SEQ ID NO: 2892135 - RNA, 14 nt, Human
agccuauggcagaa

SEQ ID NO: 2892136 - RNA, 16 nt, Human
agccuaugagcauccu

SEQ ID NO: 2892137 - RNA, 17 nt, Human
agccuaugagcauccug

SEQ ID NO: 2892138 - RNA, 18 nt, Human
agccuaugagcauccuga

SEQ ID NO: 2892139 - RNA, 19 nt, Human
agccuaugagcauccugag

SEQ ID NO: 2892140 - RNA, 21 nt, Human
agccuaugagcauccugagcc

SEQ ID NO: 2892141 - RNA, 23 nt, Human
agccuaugagcauccugagcccc

SEQ ID NO: 2892142 - RNA, 23 nt, Human
agcccuuccaugucgccucugca

SEQ ID NO: 2892143 - RNA, 19 nt, Human
agcccuuccaugucgccuc

SEQ ID NO: 2892144 - RNA, 22 nt, Human
agcccuuccaugucgccucugc

SEQ ID NO: 2892145 - RNA, 23 nt, Human
ugcagagagccauuuugugaaug

SEQ ID NO: 2892146 - RNA, 21 nt, Human
ugcagagagccauuuugugaa

SEQ ID NO: 2892147 - RNA, 22 nt, Human
ugcagagagccauuuugugaau

SEQ ID NO: 2892148 - RNA, 13 nt, Human
agcccuucauuug

SEQ ID NO: 2892149 - RNA, 14 nt, Human
agcccuucauuugg

SEQ ID NO: 2892150 - RNA, 15 nt, Human
ugcagagagccauuu

SEQ ID NO: 2892151 - RNA, 16 nt, Human
ugcagagagccauuuu

SEQ ID NO: 2892152 - RNA, 17 nt, Human
ugcagagagccauuuug

SEQ ID NO: 2892153 - RNA, 18 nt, Human
ugcagagagccauuuugu

SEQ ID NO: 2892154 - RNA, 22 nt, Human
ugcagacucuacagaggccaug

SEQ ID NO: 2892155 - RNA, 12 nt, Human
ugcagacugcua

SEQ ID NO: 2892156 - RNA, 22 nt, Human
ugcagacugcuaguguucuguc

SEQ ID NO: 2892157 - RNA, 18 nt, Human
ugcagacucuacagaggc

SEQ ID NO: 2892158 - RNA, 20 nt, Human
ugcagacucuacagaggcca

SEQ ID NO: 2892159 - RNA, 19 nt, Human
ugcagacucuacagaggcc

SEQ ID NO: 2892160 - RNA, 19 nt, Human
ugcacuccagccugggcga

SEQ ID NO: 2892161 - RNA, 18 nt, Human
ugcacuaaaucagagaca

SEQ ID NO: 2892162 - RNA, 21 nt, Human
ugcacguggagagcuggugcc

SEQ ID NO: 2892163 - RNA, 15 nt, Human
ugcacguugcuucag

SEQ ID NO: 2892164 - RNA, 18 nt, Human
ugcacuaaaguauguaaa

SEQ ID NO: 2892165 - RNA, 13 nt, Human
ugcacuaaauaug

SEQ ID NO: 2892166 - RNA, 17 nt, Human
ugcacuaaagccagccu

SEQ ID NO: 2892167 - RNA, 18 nt, Human
ugcacuaaagccagccug

SEQ ID NO: 2892168 - RNA, 19 nt, Human
ugcacuaaagccagccuga

SEQ ID NO: 2892169 - RNA, 20 nt, Human
ugcacuaaagccagccugac

SEQ ID NO: 2892170 - RNA, 22 nt, Human
ugcacuaaagccagccugaccu

SEQ ID NO: 2892171 - RNA, 19 nt, Human
ugcacguacacacacauac

SEQ ID NO: 2892172 - RNA, 12 nt, Human
ugcacguggaga

SEQ ID NO: 2892173 - RNA, 20 nt, Human
ugcacguggagagcuggugc

SEQ ID NO: 2892174 - RNA, 18 nt, Human
ugcacguggagagcuggu

SEQ ID NO: 2892175 - RNA, 17 nt, Human
ugcacguggagagcugg

SEQ ID NO: 2892176 - RNA, 16 nt, Human
ugcacguggagagcug

SEQ ID NO: 2892177 - RNA, 19 nt, Human
ugcacaugucuuguacaug

SEQ ID NO: 2892178 - RNA, 15 nt, Human
ugcacaugucuugua

SEQ ID NO: 2892179 - RNA, 14 nt, Human
ugcacaacauuaca

SEQ ID NO: 2892180 - RNA, 19 nt, Human
agcagaugguuuccacauu

SEQ ID NO: 2892181 - RNA, 15 nt, Human
ugcacacaccagagc

SEQ ID NO: 2892182 - RNA, 17 nt, Human
ugcacaauauugaacuu

SEQ ID NO: 2892183 - RNA, 19 nt, Human
ugcacaauauugaacuuuu

SEQ ID NO: 2892184 - RNA, 18 nt, Human
ugcacaaggauugaaaau

SEQ ID NO: 2892185 - RNA, 19 nt, Human
ugcacaaggauugaaaauu

SEQ ID NO: 2892186 - RNA, 20 nt, Human
ugcacacaagcccacagcac

SEQ ID NO: 2892187 - RNA, 18 nt, Human
ugcacacacacacacaug

SEQ ID NO: 2892188 - RNA, 21 nt, Human
ugcacacacacacacaugcac

SEQ ID NO: 2892189 - RNA, 22 nt, Human
ugcacacacacacacaugcaca

SEQ ID NO: 2892190 - RNA, 23 nt, Human
ugcacaugaaucccacccacaug

SEQ ID NO: 2892191 - RNA, 14 nt, Human
ugcacaugaagaaa

SEQ ID NO: 2892192 - RNA, 15 nt, Human
ugcacaugaagaaau

SEQ ID NO: 2892193 - RNA, 16 nt, Human
ugcacaugaagaaaua

SEQ ID NO: 2892194 - RNA, 21 nt, Human
ugcacaugaagaaauacugca

SEQ ID NO: 2892195 - RNA, 23 nt, Human
ugcacaugaagaaauacugcacu

SEQ ID NO: 2892196 - RNA, 24 nt, Human
ugcacaucuuggcuauguaauucu

SEQ ID NO: 2892197 - RNA, 14 nt, Human
ugcacaugaacugu

SEQ ID NO: 2892198 - RNA, 21 nt, Human
agccugagcaacucuugauua

SEQ ID NO: 2892199 - RNA, 16 nt, Human
agccugagcaacucuu

SEQ ID NO: 2892200 - RNA, 16 nt, Human
agccugaccuuccuuc

SEQ ID NO: 2892201 - RNA, 19 nt, Human
agccugaccuuccuuccug

SEQ ID NO: 2892202 - RNA, 21 nt, Human
agccugaccuuccuuccuguu

SEQ ID NO: 2892203 - RNA, 15 nt, Human
agccucagcauccug

SEQ ID NO: 2892204 - RNA, 14 nt, Human
agccucagcauccu

SEQ ID NO: 2892205 - RNA, 13 nt, Human
agccucagcaucc

SEQ ID NO: 2892206 - RNA, 18 nt, Human
agccucaaccuccugggc

SEQ ID NO: 2892207 - RNA, 17 nt, Human
agccucaaccuccuggg

SEQ ID NO: 2892208 - RNA, 12 nt, Human
ugcagcuggaca

SEQ ID NO: 2892209 - RNA, 13 nt, Human
ugcagcuggacag

SEQ ID NO: 2892210 - RNA, 14 nt, Human
ugcagcuggacaga

SEQ ID NO: 2892211 - RNA, 15 nt, Human
ugcagcuggacagag

SEQ ID NO: 2892212 - RNA, 16 nt, Human
ugcagcuggacagagg

SEQ ID NO: 2892213 - RNA, 18 nt, Human
ugcagcuggacagagggg

SEQ ID NO: 2892214 - RNA, 11 nt, Human
ugcagcuuccu

SEQ ID NO: 2892215 - RNA, 13 nt, Human
ugcagcuuccugu

SEQ ID NO: 2892216 - RNA, 15 nt, Human
ugcagcuuccuguca

SEQ ID NO: 2892217 - RNA, 18 nt, Human
ugcagcuuccugucaaca

SEQ ID NO: 2892218 - RNA, 16 nt, Human
ugcagcugauguugga

SEQ ID NO: 2892219 - RNA, 19 nt, Human
ugcagccucaaccuccugg

SEQ ID NO: 2892220 - RNA, 18 nt, Human
ugcagccucaaccuccug

SEQ ID NO: 2892221 - RNA, 15 nt, Human
ugcagccgccuuccu

SEQ ID NO: 2892222 - RNA, 16 nt, Human
ugcagccgccuuccuu

SEQ ID NO: 2892223 - RNA, 17 nt, Human
ugcagccgccuuccuug

SEQ ID NO: 2892224 - RNA, 19 nt, Human
ugcagugacgugcaccugu

SEQ ID NO: 2892225 - RNA, 18 nt, Human
ugcagugacgugcaccug

SEQ ID NO: 2892226 - RNA, 16 nt, Human
ugcagcuugggagagc

SEQ ID NO: 2892227 - RNA, 18 nt, Human
ugcagcuugggagagccc

SEQ ID NO: 2892228 - RNA, 22 nt, Human
ugcagcuugggagagccccugg

SEQ ID NO: 2892229 - RNA, 23 nt, Human
ugcagcuugggagagccccuggg

SEQ ID NO: 2892230 - RNA, 22 nt, Human
ugcagugacgugcaccuguacu

SEQ ID NO: 2892231 - RNA, 14 nt, Human
ugcaguuuuucagg

SEQ ID NO: 2892232 - RNA, 15 nt, Human
ugcaguuuuucagga

SEQ ID NO: 2892233 - RNA, 12 nt, Human
ugcauaaauaug

SEQ ID NO: 2892234 - RNA, 13 nt, Human
ugcauaaauaugc

SEQ ID NO: 2892235 - RNA, 11 nt, Human
ugcauaaaaug

SEQ ID NO: 2892236 - RNA, 12 nt, Human
ugcaguuuuccu

SEQ ID NO: 2892237 - RNA, 18 nt, Human
ugcaguuuugguguguaa

SEQ ID NO: 2892238 - RNA, 14 nt, Human
ugcauaaauaugca

SEQ ID NO: 2892239 - RNA, 15 nt, Human
ugcauaaauaugcag

SEQ ID NO: 2892240 - RNA, 19 nt, Human
ugcauaaauaugcagugau

SEQ ID NO: 2892241 - RNA, 18 nt, Human
ugcauaacaaauucugaa

SEQ ID NO: 2892242 - RNA, 21 nt, Human
agccugcaauuucauaugcug

SEQ ID NO: 2892243 - RNA, 19 nt, Human
agccugaucaccugcccug

SEQ ID NO: 2892244 - RNA, 19 nt, Human
agccugcaauuucauaugc

SEQ ID NO: 2892245 - RNA, 13 nt, Human
agccugaucucuu

SEQ ID NO: 2892246 - RNA, 15 nt, Human
agccugaucucuucc

SEQ ID NO: 2892247 - RNA, 16 nt, Human
agccugaucucuuccu

SEQ ID NO: 2892248 - RNA, 17 nt, Human
agccugaucucuuccug

SEQ ID NO: 2892249 - RNA, 18 nt, Human
agccugaucucuuccugu

SEQ ID NO: 2892250 - RNA, 20 nt, Human
agccugaucucuuccuguuu

SEQ ID NO: 2892251 - RNA, 18 nt, Human
agccugaucaccugcccu

SEQ ID NO: 2892252 - RNA, 12 nt, Human
agccugcccucc

SEQ ID NO: 2892253 - RNA, 21 nt, Human
agccugcccaagcccaggcca

SEQ ID NO: 2892254 - RNA, 22 nt, Human
agccugcccaagcccaggccac

SEQ ID NO: 2892255 - RNA, 23 nt, Human
agccugcaguuauuaacacuaac

SEQ ID NO: 2892256 - RNA, 14 nt, Human
agccugcacuuuga

SEQ ID NO: 2892257 - RNA, 16 nt, Human
agccugcacuuugaug

SEQ ID NO: 2892258 - RNA, 17 nt, Human
agccugcacuuugaugu

SEQ ID NO: 2892259 - RNA, 23 nt, Human
agccugcacuuugaugucaugug

SEQ ID NO: 2892260 - RNA, 15 nt, Human
ugcaugagcuuuuau

SEQ ID NO: 2892261 - RNA, 19 nt, Human
ugcaugaauaucauacaaa

SEQ ID NO: 2892262 - RNA, 15 nt, Human
ugcaugacagccucu

SEQ ID NO: 2892263 - RNA, 15 nt, Human
ugcaugacuuguagc

SEQ ID NO: 2892264 - RNA, 22 nt, Human
ugcaucugaaauaggaaacaag

SEQ ID NO: 2892265 - RNA, 15 nt, Human
ugcaucucagcccac

SEQ ID NO: 2892266 - RNA, 12 nt, Human
agcuggacagag

SEQ ID NO: 2892267 - RNA, 13 nt, Human
agcuggacagagg

SEQ ID NO: 2892268 - RNA, 17 nt, Human
agcuggacagaggggac

SEQ ID NO: 2892269 - RNA, 18 nt, Human
agcuggacagaggggacu

SEQ ID NO: 2892270 - RNA, 21 nt, Human
agcuggacagaggggacucug

SEQ ID NO: 2892271 - RNA, 22 nt, Human
agcuggacagaggggacucugg

SEQ ID NO: 2892272 - RNA, 23 nt, Human
agcuggacagaggggacucuggg

SEQ ID NO: 2892273 - RNA, 17 nt, Human
agcuggagaaauauggu

SEQ ID NO: 2892274 - RNA, 16 nt, Human
agcuggacucugcauc

SEQ ID NO: 2892275 - RNA, 19 nt, Human
agcuggacucugcauccca

SEQ ID NO: 2892276 - RNA, 15 nt, Human
agcuggaccaguggu

SEQ ID NO: 2892277 - RNA, 22 nt, Human
ugccucugacacacagcucugu

SEQ ID NO: 2892278 - RNA, 12 nt, Human
ugccucucuagg

SEQ ID NO: 2892279 - RNA, 15 nt, Human
ugccucucuaggacc

SEQ ID NO: 2892280 - RNA, 15 nt, Human
agcugggcucugcaa

SEQ ID NO: 2892281 - RNA, 16 nt, Human
agcugggcuggggagg

SEQ ID NO: 2892282 - RNA, 20 nt, Human
agcugggcuggggaggaccu

SEQ ID NO: 2892283 - RNA, 14 nt, Human
agcuggggaccugg

SEQ ID NO: 2892284 - RNA, 18 nt, Human
agcuggggaggagcuuug

SEQ ID NO: 2892285 - RNA, 23 nt, Human
agcugggauuacaggcuccugcc

SEQ ID NO: 2892286 - RNA, 22 nt, Human
agcugggauuacaggcuccugc

SEQ ID NO: 2892287 - RNA, 15 nt, Human
agcugggauuuuaaa

SEQ ID NO: 2892288 - RNA, 16 nt, Human
agcugggauuuuaaac

SEQ ID NO: 2892289 - RNA, 17 nt, Human
agcugggcaugguacca

SEQ ID NO: 2892290 - RNA, 21 nt, Human
agcugggcaugguaccagccc

SEQ ID NO: 2892291 - RNA, 22 nt, Human
agcugggcaugguaccagcccu

SEQ ID NO: 2892292 - RNA, 19 nt, Human
agcugggacuacaggugug

SEQ ID NO: 2892293 - RNA, 17 nt, Human
agcugggacuacaggug

SEQ ID NO: 2892294 - RNA, 15 nt, Human
agcuggagaagaccc

SEQ ID NO: 2892295 - RNA, 21 nt, Human
agcugggauuacaggcuccug

SEQ ID NO: 2892296 - RNA, 18 nt, Human
agcugggauuacaggcuc

SEQ ID NO: 2892297 - RNA, 21 nt, Human
agcugggaggcauggcccugg

SEQ ID NO: 2892298 - RNA, 22 nt, Human
agcugggaggcauggcccuggg

SEQ ID NO: 2892299 - RNA, 22 nt, Human
agcugggaucacauguggacuu

SEQ ID NO: 2892300 - RNA, 14 nt, Human
agcugggaggcaug

SEQ ID NO: 2892301 - RNA, 16 nt, Human
agcugggaggcauggc

SEQ ID NO: 2892302 - RNA, 19 nt, Human
agcugggaggcauggcccu

SEQ ID NO: 2892303 - RNA, 20 nt, Human
agcugggaggcauggcccug

SEQ ID NO: 2892304 - RNA, 21 nt, Human
ugccuuuuuauuuauauguac

SEQ ID NO: 2892305 - RNA, 19 nt, Human
ugccuuuuuauuuauaugu

SEQ ID NO: 2892306 - RNA, 15 nt, Human
ugccuuuuuauuuau

SEQ ID NO: 2892307 - RNA, 13 nt, Human
ugccuuuuuauuu

SEQ ID NO: 2892308 - RNA, 12 nt, Human
ugccuuucaaau

SEQ ID NO: 2892309 - RNA, 13 nt, Human
ugccuuucaaauu

SEQ ID NO: 2892310 - RNA, 17 nt, Human
ugccuuucaaauuuaga

SEQ ID NO: 2892311 - RNA, 20 nt, Human
ugccuuuagccccucccaag

SEQ ID NO: 2892312 - RNA, 21 nt, Human
ugccuuuagccccucccaagc

SEQ ID NO: 2892313 - RNA, 14 nt, Human
ugccuuguuuggau

SEQ ID NO: 2892314 - RNA, 19 nt, Human
ugccuuuuucauuuuccaa

SEQ ID NO: 2892315 - RNA, 20 nt, Human
ugccuuuuucauuuuccaau

SEQ ID NO: 2892316 - RNA, 21 nt, Human
ugccuuuuucauuuuccaaua

SEQ ID NO: 2892317 - RNA, 13 nt, Human
ugccuuuuuccua

SEQ ID NO: 2892318 - RNA, 16 nt, Human
ugcgaaggggcccugg

SEQ ID NO: 2892319 - RNA, 19 nt, Human
ugccuuuuuuguaguuuuu

SEQ ID NO: 2892320 - RNA, 19 nt, Human
ugcgaacuagagaugugca

SEQ ID NO: 2892321 - RNA, 18 nt, Human
ugcgaaggggcccugguc

SEQ ID NO: 2892322 - RNA, 21 nt, Human
ugcgaaggggcccugguccuu

SEQ ID NO: 2892323 - RNA, 12 nt, Human
ugcgaaguccua

SEQ ID NO: 2892324 - RNA, 16 nt, Human
ugcgaaguccuaugga

SEQ ID NO: 2892325 - RNA, 18 nt, Human
ugcgaaguccuauggaaa

SEQ ID NO: 2892326 - RNA, 18 nt, Human
ugcgaauccaagcucccu

SEQ ID NO: 2892327 - RNA, 22 nt, Human
ugcgaauccaagcucccugccc

SEQ ID NO: 2892328 - RNA, 21 nt, Human
ugcgaauggacuuuggaagca

SEQ ID NO: 2892329 - RNA, 22 nt, Human
ugcgaauggacuuuggaagcag

SEQ ID NO: 2892330 - RNA, 17 nt, Human
ugcggacagccacggcc

SEQ ID NO: 2892331 - RNA, 21 nt, Human
ugcgagcgcuaucuucacaua

SEQ ID NO: 2892332 - RNA, 18 nt, Human
ugcggacagccacggcca

SEQ ID NO: 2892333 - RNA, 16 nt, Human
ugccuguucagcucca

SEQ ID NO: 2892334 - RNA, 15 nt, Human
ugccuguucagcucc

SEQ ID NO: 2892335 - RNA, 14 nt, Human
ugccugugucuucu

SEQ ID NO: 2892336 - RNA, 15 nt, Human
ugccuugugcuguua

SEQ ID NO: 2892337 - RNA, 21 nt, Human
ugccuuagaaccuuucuuaca

SEQ ID NO: 2892338 - RNA, 20 nt, Human
ugccuuagaaauguaaacug

SEQ ID NO: 2892339 - RNA, 22 nt, Human
ugccuuagaaauguaaacugcc

SEQ ID NO: 2892340 - RNA, 23 nt, Human
ugccuuagaaauguaaacugcca

SEQ ID NO: 2892341 - RNA, 14 nt, Human
ugccuuagaaccuu

SEQ ID NO: 2892342 - RNA, 17 nt, Human
ugccuuagaaccuuucu

SEQ ID NO: 2892343 - RNA, 18 nt, Human
agcugugagccuuggcug

SEQ ID NO: 2892344 - RNA, 12 nt, Human
agcugugauuuu

SEQ ID NO: 2892345 - RNA, 15 nt, Human
agcugugagccuugg

SEQ ID NO: 2892346 - RNA, 16 nt, Human
agcugugagccuuggc

SEQ ID NO: 2892347 - RNA, 17 nt, Human
agcugugagccuuggcu

SEQ ID NO: 2892348 - RNA, 18 nt, Human
agcugugacuucuccagg

SEQ ID NO: 2892349 - RNA, 15 nt, Human
agcugugaacaggcu

SEQ ID NO: 2892350 - RNA, 15 nt, Human
agcucucaucugagg

SEQ ID NO: 2892351 - RNA, 23 nt, Human
agcucucaucugaggcauccagc

SEQ ID NO: 2892352 - RNA, 15 nt, Human
agcucuccccucaga

SEQ ID NO: 2892353 - RNA, 18 nt, Human
agcucuauugauacucuu

SEQ ID NO: 2892354 - RNA, 17 nt, Human
agcucuaucaccaagga

SEQ ID NO: 2892355 - RNA, 22 nt, Human
agcucuaucaccaaggagccaa

SEQ ID NO: 2892356 - RNA, 21 nt, Human
ugcccuccacagccgcagccu

SEQ ID NO: 2892357 - RNA, 18 nt, Human
ugcccuccacagccgcag

SEQ ID NO: 2892358 - RNA, 18 nt, Human
ugcccucauuuuauguca

SEQ ID NO: 2892359 - RNA, 21 nt, Human
ugcccucauggccccucugac

SEQ ID NO: 2892360 - RNA, 18 nt, Human
agcucuccggucucucuc

SEQ ID NO: 2892361 - RNA, 14 nt, Human
agcucuccugacuu

SEQ ID NO: 2892362 - RNA, 17 nt, Human
agcucuccugacuuuua

SEQ ID NO: 2892363 - RNA, 22 nt, Human
agcucugcuccucuccccagca

SEQ ID NO: 2892364 - RNA, 12 nt, Human
agcucugcuccu

SEQ ID NO: 2892365 - RNA, 20 nt, Human
agcucugccgucucuggagc

SEQ ID NO: 2892366 - RNA, 19 nt, Human
agcucugccgucucuggag

SEQ ID NO: 2892367 - RNA, 18 nt, Human
agcucugccgucucugga

SEQ ID NO: 2892368 - RNA, 17 nt, Human
agcucugccgucucugg

SEQ ID NO: 2892369 - RNA, 14 nt, Human
agcucugccgucuc

SEQ ID NO: 2892370 - RNA, 12 nt, Human
agcucuguccug

SEQ ID NO: 2892371 - RNA, 17 nt, Human
agcucuucuccaggcug

SEQ ID NO: 2892372 - RNA, 18 nt, Human
agcucuucuccaggcugu

SEQ ID NO: 2892373 - RNA, 22 nt, Human
agcugaucugcggaucucagcu

SEQ ID NO: 2892374 - RNA, 11 nt, Human
agcugaugaaa

SEQ ID NO: 2892375 - RNA, 12 nt, Human
agcugaugaaac

SEQ ID NO: 2892376 - RNA, 13 nt, Human
agcugaugaaacu

SEQ ID NO: 2892377 - RNA, 22 nt, Human
agcugaugaaacucacaaauga

SEQ ID NO: 2892378 - RNA, 23 nt, Human
agcugaugaaacucacaaaugau

SEQ ID NO: 2892379 - RNA, 20 nt, Human
agcugaugaacuuauucugu

SEQ ID NO: 2892380 - RNA, 22 nt, Human
agcugaugaacuuauucuguag

SEQ ID NO: 2892381 - RNA, 17 nt, Human
agcugauguuggaagag

SEQ ID NO: 2892382 - RNA, 23 nt, Human
agcugccaccucuccauccugcu

SEQ ID NO: 2892383 - RNA, 13 nt, Human
ugcccuugggcca

SEQ ID NO: 2892384 - RNA, 20 nt, Human
agcugauguuggaagagaaa

SEQ ID NO: 2892385 - RNA, 21 nt, Human
agcugauguuggaagagaaag

SEQ ID NO: 2892386 - RNA, 16 nt, Human
agcugcaccugccagc

SEQ ID NO: 2892387 - RNA, 23 nt, Human
agcugcauguggcuuuuuuaaaa

SEQ ID NO: 2892388 - RNA, 21 nt, Human
agcugcaccugccagccuggc

SEQ ID NO: 2892389 - RNA, 18 nt, Human
agcugcaccugccagccu

SEQ ID NO: 2892390 - RNA, 22 nt, Human
agcugcaccugccagccuggcu

SEQ ID NO: 2892391 - RNA, 14 nt, Human
ugccggagaggaag

SEQ ID NO: 2892392 - RNA, 15 nt, Human
ugccggagaggaaga

SEQ ID NO: 2892393 - RNA, 21 nt, Human
ugccggagaggaagagacacu

SEQ ID NO: 2892394 - RNA, 20 nt, Human
ugccgcgucgcccucccagg

SEQ ID NO: 2892395 - RNA, 14 nt, Human
ugccgggccugauu

SEQ ID NO: 2892396 - RNA, 21 nt, Human
ugccucauuuuagaaccacca

SEQ ID NO: 2892397 - RNA, 21 nt, Human
ugccucaguauauuuaaacuc

SEQ ID NO: 2892398 - RNA, 16 nt, Human
ugccgccugcacuccu

SEQ ID NO: 2892399 - RNA, 18 nt, Human
ugccgccucccagccugg

SEQ ID NO: 2892400 - RNA, 17 nt, Human
ugccgccucccagccug

SEQ ID NO: 2892401 - RNA, 16 nt, Human
ugccgccucccagccu

SEQ ID NO: 2892402 - RNA, 20 nt, Human
ugccgccugcacuccucagg

SEQ ID NO: 2892403 - RNA, 16 nt, Human
ugccgcgucgcccucc

SEQ ID NO: 2892404 - RNA, 21 nt, Human
ugccgcgucgcccucccaggc

SEQ ID NO: 2892405 - RNA, 13 nt, Human
ugccgcuaccucc

SEQ ID NO: 2892406 - RNA, 15 nt, Human
ugccgcuaccucccu

SEQ ID NO: 2892407 - RNA, 16 nt, Human
ugccgcuaccucccuc

SEQ ID NO: 2892408 - RNA, 17 nt, Human
ugccgcuaccucccucc

SEQ ID NO: 2892409 - RNA, 18 nt, Human
ugccgcuaccucccuccc

SEQ ID NO: 2892410 - RNA, 15 nt, Human
ugcccuuucugggca

SEQ ID NO: 2892411 - RNA, 21 nt, Human
ugccucugacacacagcucug

SEQ ID NO: 2892412 - RNA, 20 nt, Human
ugccucugacacacagcucu

SEQ ID NO: 2892413 - RNA, 15 nt, Human
aggaaagacaacaca

SEQ ID NO: 2892414 - RNA, 12 nt, Human
aggaaagagagc

SEQ ID NO: 2892415 - RNA, 17 nt, Human
aggaaagagucuucaac

SEQ ID NO: 2892416 - RNA, 12 nt, Human
ugcuaguauuug

SEQ ID NO: 2892417 - RNA, 13 nt, Human
ugcuaguauuuga

SEQ ID NO: 2892418 - RNA, 14 nt, Human
ugcuaguauuugaa

SEQ ID NO: 2892419 - RNA, 15 nt, Human
ugcuaguauuugaau

SEQ ID NO: 2892420 - RNA, 16 nt, Human
ugcuaguauuugaauu

SEQ ID NO: 2892421 - RNA, 17 nt, Human
ugcuaguauuugaauua

SEQ ID NO: 2892422 - RNA, 18 nt, Human
ugcuaguauuugaauuaa

SEQ ID NO: 2892423 - RNA, 20 nt, Human
ugcuaguauuugaauuaaaa

SEQ ID NO: 2892424 - RNA, 22 nt, Human
ugcuaguauuugaauuaaaacu

SEQ ID NO: 2892425 - RNA, 23 nt, Human
ugcuaguauuugaauuaaaacuu

SEQ ID NO: 2892426 - RNA, 15 nt, Human
ugcuaguguucuguc

SEQ ID NO: 2892427 - RNA, 20 nt, Human
ugcuauaaagcuagaugcuu

SEQ ID NO: 2892428 - RNA, 13 nt, Human
ugcuagugagcug

SEQ ID NO: 2892429 - RNA, 16 nt, Human
ugcuagugagcugggc

SEQ ID NO: 2892430 - RNA, 18 nt, Human
ugcuagugagcugggcau

SEQ ID NO: 2892431 - RNA, 19 nt, Human
ugcuagugagcugggcaug

SEQ ID NO: 2892432 - RNA, 16 nt, Human
ugcuaguggugggcag

SEQ ID NO: 2892433 - RNA, 21 nt, Human
ugcuauaacuauguugauaaa

SEQ ID NO: 2892434 - RNA, 12 nt, Human
aggaaagaauag

SEQ ID NO: 2892435 - RNA, 20 nt, Human
aggaaacuccugacagucuu

SEQ ID NO: 2892436 - RNA, 16 nt, Human
aggaaacgcuaccucu

SEQ ID NO: 2892437 - RNA, 18 nt, Human
aggaaacucuuaucucag

SEQ ID NO: 2892438 - RNA, 22 nt, Human
aggaaacucuuaucucagucau

SEQ ID NO: 2892439 - RNA, 17 nt, Human
aggaaagaaagaaggaa

SEQ ID NO: 2892440 - RNA, 15 nt, Human
aggaaacuuuuaacu

SEQ ID NO: 2892441 - RNA, 12 nt, Human
aggaaacucuua

SEQ ID NO: 2892442 - RNA, 13 nt, Human
aggaaacucuuau

SEQ ID NO: 2892443 - RNA, 17 nt, Human
aggaaacucuuaucuca

SEQ ID NO: 2892444 - RNA, 14 nt, Human
aggaaaauaaugua

SEQ ID NO: 2892445 - RNA, 22 nt, Human
aggaaaauaauguaauuguaau

SEQ ID NO: 2892446 - RNA, 16 nt, Human
aggaaaccgccuaguu

SEQ ID NO: 2892447 - RNA, 20 nt, Human
aggaaaccgccuaguuuacu

SEQ ID NO: 2892448 - RNA, 21 nt, Human
aggaaaccgccuaguuuacug

SEQ ID NO: 2892449 - RNA, 22 nt, Human
aggaaaccgccuaguuuacugu

SEQ ID NO: 2892450 - RNA, 18 nt, Human
agcuuauccauaaaaaaa

SEQ ID NO: 2892451 - RNA, 11 nt, Human
agcuuaucucu

SEQ ID NO: 2892452 - RNA, 13 nt, Human
agcuuaucucuuu

SEQ ID NO: 2892453 - RNA, 14 nt, Human
agcuuaucucuuuu

SEQ ID NO: 2892454 - RNA, 17 nt, Human
agcuuaucucuuuuaua

SEQ ID NO: 2892455 - RNA, 19 nt, Human
agcuuaucucuuuuauauu

SEQ ID NO: 2892456 - RNA, 22 nt, Human
agcuuaucucuuuuauauuugu

SEQ ID NO: 2892457 - RNA, 23 nt, Human
agcuuaucucuuuuauauuugua

SEQ ID NO: 2892458 - RNA, 21 nt, Human
agcuugcuugcuuucuuuuuu

SEQ ID NO: 2892459 - RNA, 23 nt, Human
agcuugcuugcuuucuuuuuuaa

SEQ ID NO: 2892460 - RNA, 12 nt, Human
agcuugcuuuga

SEQ ID NO: 2892461 - RNA, 18 nt, Human
agcuugcuuugauuuaca

SEQ ID NO: 2892462 - RNA, 22 nt, Human
agcuugcuuugauuuacagcaa

SEQ ID NO: 2892463 - RNA, 22 nt, Human
agcuuauucaucuguuuuucuu

SEQ ID NO: 2892464 - RNA, 21 nt, Human
agcuuguaaauagcucaggug

SEQ ID NO: 2892465 - RNA, 20 nt, Human
agcuuguaaauagcucaggu

SEQ ID NO: 2892466 - RNA, 19 nt, Human
agcuuguaaauagcucagg

SEQ ID NO: 2892467 - RNA, 17 nt, Human
agcuuggcccuuuccuu

SEQ ID NO: 2892468 - RNA, 14 nt, Human
agcuugggaaugga

SEQ ID NO: 2892469 - RNA, 12 nt, Human
agcuugggaaug

SEQ ID NO: 2892470 - RNA, 18 nt, Human
agcuuguaaauagcucag

SEQ ID NO: 2892471 - RNA, 15 nt, Human
agcuugggagagccc

SEQ ID NO: 2892472 - RNA, 18 nt, Human
agcuugggagagccccug

SEQ ID NO: 2892473 - RNA, 19 nt, Human
agcuugggagagccccugg

SEQ ID NO: 2892474 - RNA, 22 nt, Human
agcuuucuagaaguuucccuuc

SEQ ID NO: 2892475 - RNA, 23 nt, Human
agcuuucuagaaguuucccuucc

SEQ ID NO: 2892476 - RNA, 13 nt, Human
agcuuucuccccg

SEQ ID NO: 2892477 - RNA, 16 nt, Human
agcuuucuugcucccu

SEQ ID NO: 2892478 - RNA, 17 nt, Human
agcuuucuugcucccuu

SEQ ID NO: 2892479 - RNA, 19 nt, Human
agcuuucugaccuucagcu

SEQ ID NO: 2892480 - RNA, 20 nt, Human
agcuuucugaccuucagcuc

SEQ ID NO: 2892481 - RNA, 15 nt, Human
ugcuaccguugacuu

SEQ ID NO: 2892482 - RNA, 18 nt, Human
ugcuaccguugacuucca

SEQ ID NO: 2892483 - RNA, 21 nt, Human
ugcggacagccacggccaggc

SEQ ID NO: 2892484 - RNA, 20 nt, Human
ugcggacagccacggccagg

SEQ ID NO: 2892485 - RNA, 20 nt, Human
ugcuacgccugcauguaaac

SEQ ID NO: 2892486 - RNA, 16 nt, Human
ugcuacgccugcaugu

SEQ ID NO: 2892487 - RNA, 13 nt, Human
ugcuacgccugca

SEQ ID NO: 2892488 - RNA, 14 nt, Human
agcuguuuucuucu

SEQ ID NO: 2892489 - RNA, 20 nt, Human
agcuuaaaauaaacaguugu

SEQ ID NO: 2892490 - RNA, 23 nt, Human
agcuuaaaauaaacaguugugaa

SEQ ID NO: 2892491 - RNA, 23 nt, Human
aggaaugaaauccugcuucagug

SEQ ID NO: 2892492 - RNA, 13 nt, Human
aggaaugagaagu

SEQ ID NO: 2892493 - RNA, 14 nt, Human
aggaaugagaagua

SEQ ID NO: 2892494 - RNA, 23 nt, Human
aggaauccagacccggcugcgug

SEQ ID NO: 2892495 - RNA, 20 nt, Human
aggaauccuggcagcccaga

SEQ ID NO: 2892496 - RNA, 19 nt, Human
aggaauccuggcagcccag

SEQ ID NO: 2892497 - RNA, 18 nt, Human
aggaauccuggcagccca

SEQ ID NO: 2892498 - RNA, 16 nt, Human
aggaauccuggcagcc

SEQ ID NO: 2892499 - RNA, 15 nt, Human
aggaauccuggcagc

SEQ ID NO: 2892500 - RNA, 14 nt, Human
aggaauccuggcag

SEQ ID NO: 2892501 - RNA, 13 nt, Human
aggaauccuggca

SEQ ID NO: 2892502 - RNA, 15 nt, Human
aggaagcuccacugu

SEQ ID NO: 2892503 - RNA, 15 nt, Human
aggaauccaugaaga

SEQ ID NO: 2892504 - RNA, 13 nt, Human
aggaaucuuuaag

SEQ ID NO: 2892505 - RNA, 16 nt, Human
aggaaucuuuaagcag

SEQ ID NO: 2892506 - RNA, 14 nt, Human
aggaagagacacuc

SEQ ID NO: 2892507 - RNA, 16 nt, Human
aggaauuuucuuugug

SEQ ID NO: 2892508 - RNA, 14 nt, Human
aggaauuuucuuug

SEQ ID NO: 2892509 - RNA, 14 nt, Human
aggacaaccauucc

SEQ ID NO: 2892510 - RNA, 12 nt, Human
aggacaaaacuu

SEQ ID NO: 2892511 - RNA, 13 nt, Human
aggacaaaacuuc

SEQ ID NO: 2892512 - RNA, 14 nt, Human
aggacaaaacuucu

SEQ ID NO: 2892513 - RNA, 15 nt, Human
aggacaaaacuucuu

SEQ ID NO: 2892514 - RNA, 16 nt, Human
aggacaaaacuucuug

SEQ ID NO: 2892515 - RNA, 17 nt, Human
aggacaaaacuucuugu

SEQ ID NO: 2892516 - RNA, 20 nt, Human
aggacaaaacuucuugucag

SEQ ID NO: 2892517 - RNA, 21 nt, Human
aggacaaaacuucuugucaga

SEQ ID NO: 2892518 - RNA, 22 nt, Human
aggacaaaacuucuugucagac

SEQ ID NO: 2892519 - RNA, 23 nt, Human
aggacaaaacuucuugucagaca

SEQ ID NO: 2892520 - RNA, 15 nt, Human
ugcugccacacuuca

SEQ ID NO: 2892521 - RNA, 16 nt, Human
ugcugccacacuucag

SEQ ID NO: 2892522 - RNA, 19 nt, Human
ugcugccacacuucaggcu

SEQ ID NO: 2892523 - RNA, 11 nt, Human
ugcugccaucc

SEQ ID NO: 2892524 - RNA, 22 nt, Human
ugcugccacacuucaggcucuu

SEQ ID NO: 2892525 - RNA, 14 nt, Human
ugcugccacuuuuu

SEQ ID NO: 2892526 - RNA, 15 nt, Human
ugcugccauccaggu

SEQ ID NO: 2892527 - RNA, 14 nt, Human
ugcugccauccagg

SEQ ID NO: 2892528 - RNA, 13 nt, Human
ugcugccauccag

SEQ ID NO: 2892529 - RNA, 12 nt, Human
ugcugccaucca

SEQ ID NO: 2892530 - RNA, 22 nt, Human
ugcugccauccagguucagcuu

SEQ ID NO: 2892531 - RNA, 21 nt, Human
ugcugccauccagguucagcu

SEQ ID NO: 2892532 - RNA, 20 nt, Human
ugcugccauuugauuuuucu

SEQ ID NO: 2892533 - RNA, 21 nt, Human
ugcugccauuugauuuuucua

SEQ ID NO: 2892534 - RNA, 16 nt, Human
ugcugcccaggcccag

SEQ ID NO: 2892535 - RNA, 16 nt, Human
ugcugcccagccucca

SEQ ID NO: 2892536 - RNA, 14 nt, Human
ugcugcccagccuc

SEQ ID NO: 2892537 - RNA, 16 nt, Human
aggacaaauugagaca

SEQ ID NO: 2892538 - RNA, 18 nt, Human
aggacaaauugagacagu

SEQ ID NO: 2892539 - RNA, 23 nt, Human
aggacaaauugagacagugcaca

SEQ ID NO: 2892540 - RNA, 20 nt, Human
aggaaagccccagcacuaac

SEQ ID NO: 2892541 - RNA, 16 nt, Human
aggaaagccucacuga

SEQ ID NO: 2892542 - RNA, 20 nt, Human
aggaaagccucacugauaua

SEQ ID NO: 2892543 - RNA, 19 nt, Human
aggaaagccccagcacuaa

SEQ ID NO: 2892544 - RNA, 22 nt, Human
aggaaagcuuuggcaguguuuu

SEQ ID NO: 2892545 - RNA, 12 nt, Human
ugcucuuagcug

SEQ ID NO: 2892546 - RNA, 24 nt, Human
ugcugaguagaugcgcagccccau

SEQ ID NO: 2892547 - RNA, 12 nt, Human
ugcugagggugu

SEQ ID NO: 2892548 - RNA, 22 nt, Human
ugcugaggguguuucuuccugc

SEQ ID NO: 2892549 - RNA, 23 nt, Human
ugcugaggguguuucuuccugca

SEQ ID NO: 2892550 - RNA, 23 nt, Human
ugcuaucaugauggaauuucaua

SEQ ID NO: 2892551 - RNA, 19 nt, Human
aggaaagcaguugaaauga

SEQ ID NO: 2892552 - RNA, 22 nt, Human
ugcugagucccaggcugagccu

SEQ ID NO: 2892553 - RNA, 18 nt, Human
ugcugagucccaggcuga

SEQ ID NO: 2892554 - RNA, 15 nt, Human
ugcugagucccaggc

SEQ ID NO: 2892555 - RNA, 17 nt, Human
ugcucuggacaggcaug

SEQ ID NO: 2892556 - RNA, 15 nt, Human
ugcucuuaagccuaa

SEQ ID NO: 2892557 - RNA, 19 nt, Human
ugcucuuacuacacugagg

SEQ ID NO: 2892558 - RNA, 20 nt, Human
ugcucuuacuacacugagga

SEQ ID NO: 2892559 - RNA, 21 nt, Human
ugcucuuacuacacugaggag

SEQ ID NO: 2892560 - RNA, 20 nt, Human
ugcucuguaggagcuacccu

SEQ ID NO: 2892561 - RNA, 22 nt, Human
ugcucugaucauccacugugcc

SEQ ID NO: 2892562 - RNA, 15 nt, Human
ugcucugcaaaagga

SEQ ID NO: 2892563 - RNA, 19 nt, Human
ugcucugaugaagaggagu

SEQ ID NO: 2892564 - RNA, 18 nt, Human
ugcucugaugaagaggag

SEQ ID NO: 2892565 - RNA, 19 nt, Human
ugcucugaucauccacugu

SEQ ID NO: 2892566 - RNA, 12 nt, Human
ugcuauauauau

SEQ ID NO: 2892567 - RNA, 15 nt, Human
ugcuauauauauaaa

SEQ ID NO: 2892568 - RNA, 16 nt, Human
ugcuauauauauaaau

SEQ ID NO: 2892569 - RNA, 17 nt, Human
ugcuauauauauaaaua

SEQ ID NO: 2892570 - RNA, 16 nt, Human
ugcuauauugcccagg

SEQ ID NO: 2892571 - RNA, 17 nt, Human
ugcuauauugcccaggc

SEQ ID NO: 2892572 - RNA, 13 nt, Human
ugcuauaguauuu

SEQ ID NO: 2892573 - RNA, 14 nt, Human
ugcuauaguauuug

SEQ ID NO: 2892574 - RNA, 15 nt, Human
ugcuauaguauuuga

SEQ ID NO: 2892575 - RNA, 20 nt, Human
ugcuauaguauuugauucaa

SEQ ID NO: 2892576 - RNA, 21 nt, Human
ugcuauaguauuugauucaaa

SEQ ID NO: 2892577 - RNA, 22 nt, Human
ugcuauaguauuugauucaaaa

SEQ ID NO: 2892578 - RNA, 12 nt, Human
uggagaagagag

SEQ ID NO: 2892579 - RNA, 17 nt, Human
uggagaagacccucccc

SEQ ID NO: 2892580 - RNA, 14 nt, Human
uggagaagagagga

SEQ ID NO: 2892581 - RNA, 19 nt, Human
uggagaagagaggagagga

SEQ ID NO: 2892582 - RNA, 14 nt, Human
uggagaagcacacu

SEQ ID NO: 2892583 - RNA, 22 nt, Human
uggagaagcacacucuggucuu

SEQ ID NO: 2892584 - RNA, 16 nt, Human
uggagaagagaggaga

SEQ ID NO: 2892585 - RNA, 16 nt, Human
uggacaagagguacag

SEQ ID NO: 2892586 - RNA, 14 nt, Human
uggagccuggcaca

SEQ ID NO: 2892587 - RNA, 18 nt, Human
uggagccuggcacaggac

SEQ ID NO: 2892588 - RNA, 19 nt, Human
uggagccuggcacaggacu

SEQ ID NO: 2892589 - RNA, 21 nt, Human
uggagccuggcacaggacuga

SEQ ID NO: 2892590 - RNA, 13 nt, Human
uggagccuggugc

SEQ ID NO: 2892591 - RNA, 21 nt, Human
uggagccugagucagggccca

SEQ ID NO: 2892592 - RNA, 22 nt, Human
uggagccugagucagggcccag

SEQ ID NO: 2892593 - RNA, 13 nt, Human
uggagcugccuga

SEQ ID NO: 2892594 - RNA, 15 nt, Human
uggagcugccugaua

SEQ ID NO: 2892595 - RNA, 14 nt, Human
uggagccuggugcc

SEQ ID NO: 2892596 - RNA, 15 nt, Human
uggagcccuuggguu

SEQ ID NO: 2892597 - RNA, 13 nt, Human
uggagcccaggcg

SEQ ID NO: 2892598 - RNA, 23 nt, Human
aggcaaugucaggaacagaagga

SEQ ID NO: 2892599 - RNA, 22 nt, Human
aggcaaugucaggaacagaagg

SEQ ID NO: 2892600 - RNA, 14 nt, Human
aggcaauucuccug

SEQ ID NO: 2892601 - RNA, 19 nt, Human
aggcaauucuccugccuuu

SEQ ID NO: 2892602 - RNA, 13 nt, Human
aggcaccagaaga

SEQ ID NO: 2892603 - RNA, 14 nt, Human
aggcaccagaagaa

SEQ ID NO: 2892604 - RNA, 19 nt, Human
aggcaccagaagaacagua

SEQ ID NO: 2892605 - RNA, 15 nt, Human
aggcacagggagaag

SEQ ID NO: 2892606 - RNA, 22 nt, Human
aggcacaggucaggggugacac

SEQ ID NO: 2892607 - RNA, 16 nt, Human
aggcaaugcuggcugu

SEQ ID NO: 2892608 - RNA, 19 nt, Human
aggcaaugucaggaacaga

SEQ ID NO: 2892609 - RNA, 17 nt, Human
aggcaaugucaggaaca

SEQ ID NO: 2892610 - RNA, 13 nt, Human
uggaggaaagcaa

SEQ ID NO: 2892611 - RNA, 15 nt, Human
aggcaaugcuggcug

SEQ ID NO: 2892612 - RNA, 21 nt, Human
uggaggaaaaccaagccgugg

SEQ ID NO: 2892613 - RNA, 23 nt, Human
uggaggaaaaccaagccguggcu

SEQ ID NO: 2892614 - RNA, 21 nt, Human
aggcagggucucacucugucg

SEQ ID NO: 2892615 - RNA, 20 nt, Human
aggcagggucucacucuguc

SEQ ID NO: 2892616 - RNA, 18 nt, Human
aggcagggucucacucug

SEQ ID NO: 2892617 - RNA, 19 nt, Human
aggcagggucucacucugu

SEQ ID NO: 2892618 - RNA, 14 nt, Human
aggcagguccaggg

SEQ ID NO: 2892619 - RNA, 14 nt, Human
aggcagguagccag

SEQ ID NO: 2892620 - RNA, 15 nt, Human
aggcagguagccagg

SEQ ID NO: 2892621 - RNA, 22 nt, Human
aggcagggucucacucugucgc

SEQ ID NO: 2892622 - RNA, 21 nt, Human
aggcaggucuugaacuccugg

SEQ ID NO: 2892623 - RNA, 16 nt, Human
aggcagguagccaggg

SEQ ID NO: 2892624 - RNA, 16 nt, Human
aggcaguuuagugcau

SEQ ID NO: 2892625 - RNA, 19 nt, Human
aggcaguuuagugcaucuu

SEQ ID NO: 2892626 - RNA, 13 nt, Human
aggcagugucauu

SEQ ID NO: 2892627 - RNA, 14 nt, Human
aggcagugucauuu

SEQ ID NO: 2892628 - RNA, 15 nt, Human
aggcagugucauuug

SEQ ID NO: 2892629 - RNA, 19 nt, Human
aggcagugucauuugcucu

SEQ ID NO: 2892630 - RNA, 21 nt, Human
aggcagugucauuugcucugc

SEQ ID NO: 2892631 - RNA, 11 nt, Human
aggcagucucu

SEQ ID NO: 2892632 - RNA, 16 nt, Human
aggcagucucucucuu

SEQ ID NO: 2892633 - RNA, 15 nt, Human
aggcaguaggccggu

SEQ ID NO: 2892634 - RNA, 22 nt, Human
aggcaguaggccggugugccug

SEQ ID NO: 2892635 - RNA, 19 nt, Human
aggcagcgccaagugcgug

SEQ ID NO: 2892636 - RNA, 21 nt, Human
aggcagcgccaagugcgugcc

SEQ ID NO: 2892637 - RNA, 21 nt, Human
aggcaggacaugcugaagcca

SEQ ID NO: 2892638 - RNA, 23 nt, Human
aggcaggacaugcugaagccaaa

SEQ ID NO: 2892639 - RNA, 15 nt, Human
aggcagcccugccau

SEQ ID NO: 2892640 - RNA, 16 nt, Human
aggcagggagggccug

SEQ ID NO: 2892641 - RNA, 16 nt, Human
aggcagggcaaaugac

SEQ ID NO: 2892642 - RNA, 18 nt, Human
aggcagggcaaaugacau

SEQ ID NO: 2892643 - RNA, 24 nt, Human
aggcagggcaaaugacaugcacug

SEQ ID NO: 2892644 - RNA, 21 nt, Human
aggcagccccauucugccugc

SEQ ID NO: 2892645 - RNA, 20 nt, Human
aggcagccccauucugccug

SEQ ID NO: 2892646 - RNA, 19 nt, Human
aggcagccccauucugccu

SEQ ID NO: 2892647 - RNA, 15 nt, Human
aggcaccagucccug

SEQ ID NO: 2892648 - RNA, 22 nt, Human
aggcagccccauucugccugcc

SEQ ID NO: 2892649 - RNA, 13 nt, Human
aggcagccgcccu

SEQ ID NO: 2892650 - RNA, 14 nt, Human
aggcaccaucuccc

SEQ ID NO: 2892651 - RNA, 16 nt, Human
aggcaccagucccugu

SEQ ID NO: 2892652 - RNA, 13 nt, Human
aggcagccuccag

SEQ ID NO: 2892653 - RNA, 16 nt, Human
aggcagccuccagccu

SEQ ID NO: 2892654 - RNA, 21 nt, Human
aggcagccuccagccugccca

SEQ ID NO: 2892655 - RNA, 13 nt, Human
uggaauuuguuca

SEQ ID NO: 2892656 - RNA, 15 nt, Human
uggaauuuguucaag

SEQ ID NO: 2892657 - RNA, 13 nt, Human
uggaauuucuugu

SEQ ID NO: 2892658 - RNA, 14 nt, Human
uggaauuucuuguu

SEQ ID NO: 2892659 - RNA, 15 nt, Human
uggaauuucuuguuu

SEQ ID NO: 2892660 - RNA, 17 nt, Human
uggaauuucuuguuucu

SEQ ID NO: 2892661 - RNA, 22 nt, Human
uggaauuucuuguuucuccaga

SEQ ID NO: 2892662 - RNA, 16 nt, Human
aggcaacuugggaacu

SEQ ID NO: 2892663 - RNA, 14 nt, Human
aggcaagcaccucc

SEQ ID NO: 2892664 - RNA, 17 nt, Human
aggcaacuucaguccug

SEQ ID NO: 2892665 - RNA, 19 nt, Human
aggcaacuucaguccuggg

SEQ ID NO: 2892666 - RNA, 22 nt, Human
aggcaacuucaguccugggaga

SEQ ID NO: 2892667 - RNA, 14 nt, Human
aggauugcuaucug

SEQ ID NO: 2892668 - RNA, 18 nt, Human
aggcaagcaagcucucuu

SEQ ID NO: 2892669 - RNA, 16 nt, Human
uggacaaacuggaguc

SEQ ID NO: 2892670 - RNA, 18 nt, Human
uggacaaacuggagucug

SEQ ID NO: 2892671 - RNA, 20 nt, Human
uggacaaacuggagucugga

SEQ ID NO: 2892672 - RNA, 22 nt, Human
uggacaaacuggagucuggagu

SEQ ID NO: 2892673 - RNA, 13 nt, Human
uggacaaauguga

SEQ ID NO: 2892674 - RNA, 15 nt, Human
uggacaaaugugaag

SEQ ID NO: 2892675 - RNA, 18 nt, Human
uggacaaaugugaagaug

SEQ ID NO: 2892676 - RNA, 19 nt, Human
uggacaaaugugaagaugc

SEQ ID NO: 2892677 - RNA, 20 nt, Human
uggacaaaugugaagaugca

SEQ ID NO: 2892678 - RNA, 21 nt, Human
uggacaaaugugaagaugcau

SEQ ID NO: 2892679 - RNA, 19 nt, Human
uggaauuuuugcuugacuu

SEQ ID NO: 2892680 - RNA, 21 nt, Human
uggaauuuuugcuugacuuca

SEQ ID NO: 2892681 - RNA, 14 nt, Human
aggaugcucaguug

SEQ ID NO: 2892682 - RNA, 21 nt, Human
aggaugcucaguugcuaaaca

SEQ ID NO: 2892683 - RNA, 12 nt, Human
aggaugcuggcc

SEQ ID NO: 2892684 - RNA, 13 nt, Human
aggaugcugggug

SEQ ID NO: 2892685 - RNA, 14 nt, Human
aggaugcugggugg

SEQ ID NO: 2892686 - RNA, 15 nt, Human
aggaugcuggguggc

SEQ ID NO: 2892687 - RNA, 18 nt, Human
aggaugcuguguugucaa

SEQ ID NO: 2892688 - RNA, 21 nt, Human
aggaugcuugauuccaguggu

SEQ ID NO: 2892689 - RNA, 12 nt, Human
aggaucagucug

SEQ ID NO: 2892690 - RNA, 13 nt, Human
aggaucagccagg

SEQ ID NO: 2892691 - RNA, 14 nt, Human
aggaucuaaggcug

SEQ ID NO: 2892692 - RNA, 16 nt, Human
aggaucuaaggcuguu

SEQ ID NO: 2892693 - RNA, 14 nt, Human
aggaucuagagggg

SEQ ID NO: 2892694 - RNA, 22 nt, Human
aggauugcuacuguccuaccca

SEQ ID NO: 2892695 - RNA, 20 nt, Human
aggauugcuugagcccagga

SEQ ID NO: 2892696 - RNA, 19 nt, Human
aggauugcuugagcccagg

SEQ ID NO: 2892697 - RNA, 18 nt, Human
aggauugcuugagcccag

SEQ ID NO: 2892698 - RNA, 17 nt, Human
aggauugcuugagccca

SEQ ID NO: 2892699 - RNA, 22 nt, Human
aggauugcuugagcccaggagu

SEQ ID NO: 2892700 - RNA, 21 nt, Human
aggauugcuugagcccaggag

SEQ ID NO: 2892701 - RNA, 13 nt, Human
aggauuguaaaaa

SEQ ID NO: 2892702 - RNA, 22 nt, Human
aggauuuuagcuaggauuugaa

SEQ ID NO: 2892703 - RNA, 13 nt, Human
aggauuuuauacc

SEQ ID NO: 2892704 - RNA, 18 nt, Human
aggauuucuaaucaaaag

SEQ ID NO: 2892705 - RNA, 23 nt, Human
aggauuugcacagaagcacaugc

SEQ ID NO: 2892706 - RNA, 16 nt, Human
aggauuugcugggaga

SEQ ID NO: 2892707 - RNA, 20 nt, Human
aggauuguugaaucuauuuc

SEQ ID NO: 2892708 - RNA, 15 nt, Human
aggauuuaaaaacug

SEQ ID NO: 2892709 - RNA, 16 nt, Human
aggauuuaaaaacugg

SEQ ID NO: 2892710 - RNA, 18 nt, Human
aggauuuaaaaacuggaa

SEQ ID NO: 2892711 - RNA, 19 nt, Human
aggauuuaaaaacuggaac

SEQ ID NO: 2892712 - RNA, 19 nt, Human
aggauuguaaaaaaaaaug

SEQ ID NO: 2892713 - RNA, 23 nt, Human
aggauuguaaaaaaaaaugccuu

SEQ ID NO: 2892714 - RNA, 13 nt, Human
aggauuuagaagu

SEQ ID NO: 2892715 - RNA, 24 nt, Human
aggaguuugaggcugcagcgagcu

SEQ ID NO: 2892716 - RNA, 19 nt, Human
aggauauuuugucaccaga

SEQ ID NO: 2892717 - RNA, 22 nt, Human
aggaucacuggagcccaggagu

SEQ ID NO: 2892718 - RNA, 20 nt, Human
aggaucacuggagcccagga

SEQ ID NO: 2892719 - RNA, 19 nt, Human
aggaucacuggagcccagg

SEQ ID NO: 2892720 - RNA, 18 nt, Human
aggaucacuggagcccag

SEQ ID NO: 2892721 - RNA, 16 nt, Human
aggaucacuggagccc

SEQ ID NO: 2892722 - RNA, 15 nt, Human
aggaucacuggagcc

SEQ ID NO: 2892723 - RNA, 14 nt, Human
aggaucacuggagc

SEQ ID NO: 2892724 - RNA, 20 nt, Human
aggaguuugaggcugcagcg

SEQ ID NO: 2892725 - RNA, 19 nt, Human
aggaguuugaggcugcagc

SEQ ID NO: 2892726 - RNA, 19 nt, Human
aggaguuugagaccagccu

SEQ ID NO: 2892727 - RNA, 16 nt, Human
aggaguuugagaccag

SEQ ID NO: 2892728 - RNA, 15 nt, Human
aggaggccuccaucu

SEQ ID NO: 2892729 - RNA, 17 nt, Human
aggaggccuccaucuca

SEQ ID NO: 2892730 - RNA, 12 nt, Human
aggaggccucca

SEQ ID NO: 2892731 - RNA, 22 nt, Human
aggaggccaggccggcgagccc

SEQ ID NO: 2892732 - RNA, 13 nt, Human
aggaggccaggcc

SEQ ID NO: 2892733 - RNA, 14 nt, Human
aggaggccacguga

SEQ ID NO: 2892734 - RNA, 19 nt, Human
aggaggccacgugaugugg

SEQ ID NO: 2892735 - RNA, 22 nt, Human
ugcugcccugaagaauggcgcc

SEQ ID NO: 2892736 - RNA, 15 nt, Human
ugcugcccugaagaa

SEQ ID NO: 2892737 - RNA, 20 nt, Human
ugcugccacaaccagccagg

SEQ ID NO: 2892738 - RNA, 19 nt, Human
uggaacacaaacacauugu

SEQ ID NO: 2892739 - RNA, 20 nt, Human
uggaacacaaacacauuguu

SEQ ID NO: 2892740 - RNA, 17 nt, Human
uggaagcuaauuugcau

SEQ ID NO: 2892741 - RNA, 16 nt, Human
uggaagcuaauuugca

SEQ ID NO: 2892742 - RNA, 13 nt, Human
uggaagcuccgcu

SEQ ID NO: 2892743 - RNA, 18 nt, Human
uggaagcuaauuugcauu

SEQ ID NO: 2892744 - RNA, 18 nt, Human
uggaagcugcccugccca

SEQ ID NO: 2892745 - RNA, 17 nt, Human
uggaagcugcccugccc

SEQ ID NO: 2892746 - RNA, 17 nt, Human
uggaaguccaauguggc

SEQ ID NO: 2892747 - RNA, 22 nt, Human
aggcuccaccccauccaguuca

SEQ ID NO: 2892748 - RNA, 11 nt, Human
aggcucagaga

SEQ ID NO: 2892749 - RNA, 13 nt, Human
aggcucagagaug

SEQ ID NO: 2892750 - RNA, 14 nt, Human
aggcucagagaugu

SEQ ID NO: 2892751 - RNA, 15 nt, Human
aggcucaacaauaaa

SEQ ID NO: 2892752 - RNA, 17 nt, Human
aggcucaacaauaaaac

SEQ ID NO: 2892753 - RNA, 19 nt, Human
aggcucaacaauaaaacau

SEQ ID NO: 2892754 - RNA, 18 nt, Human
aggcucagcggcgaccgc

SEQ ID NO: 2892755 - RNA, 21 nt, Human
aggcucagagaugugcaccca

SEQ ID NO: 2892756 - RNA, 24 nt, Human
aggcucagagaugugcacccaugg

SEQ ID NO: 2892757 - RNA, 13 nt, Human
aggcucaggccau

SEQ ID NO: 2892758 - RNA, 23 nt, Human
aggcucagucucaggagcauggg

SEQ ID NO: 2892759 - RNA, 19 nt, Human
aggcucagucucaggagca

SEQ ID NO: 2892760 - RNA, 18 nt, Human
aggcucagucucaggagc

SEQ ID NO: 2892761 - RNA, 17 nt, Human
aggcucagucucaggag

SEQ ID NO: 2892762 - RNA, 16 nt, Human
aggcucagucucagga

SEQ ID NO: 2892763 - RNA, 18 nt, Human
aggccuucucugaaggac

SEQ ID NO: 2892764 - RNA, 17 nt, Human
aggccuucucugaagga

SEQ ID NO: 2892765 - RNA, 12 nt, Human
uggccugugugg

SEQ ID NO: 2892766 - RNA, 20 nt, Human
uggccuguguggccacuucu

SEQ ID NO: 2892767 - RNA, 22 nt, Human
uggccuguguggccacuucugu

SEQ ID NO: 2892768 - RNA, 16 nt, Human
aggccuuuuggaaugu

SEQ ID NO: 2892769 - RNA, 19 nt, Human
aggcgagagaggagccaga

SEQ ID NO: 2892770 - RNA, 23 nt, Human
aggcgagagaggagccagacaga

SEQ ID NO: 2892771 - RNA, 16 nt, Human
aggccuuuuaacauuu

SEQ ID NO: 2892772 - RNA, 17 nt, Human
aggccuuuuaacauuuu

SEQ ID NO: 2892773 - RNA, 18 nt, Human
aggccuuuuaacauuuug

SEQ ID NO: 2892774 - RNA, 14 nt, Human
aggcgccccuuccc

SEQ ID NO: 2892775 - RNA, 23 nt, Human
aggcgauccaccugucucagccu

SEQ ID NO: 2892776 - RNA, 21 nt, Human
aggcuauuguccccuaaacca

SEQ ID NO: 2892777 - RNA, 19 nt, Human
aggcuauuauuuucacugu

SEQ ID NO: 2892778 - RNA, 23 nt, Human
aggcggcacuccaaccuaaccug

SEQ ID NO: 2892779 - RNA, 14 nt, Human
aggcuaugugauua

SEQ ID NO: 2892780 - RNA, 12 nt, Human
aggcggccccuc

SEQ ID NO: 2892781 - RNA, 17 nt, Human
aggcuaugugauuacaa

SEQ ID NO: 2892782 - RNA, 18 nt, Human
aggcuauuauuuucacug

SEQ ID NO: 2892783 - RNA, 16 nt, Human
aggcuauuauuuucac

SEQ ID NO: 2892784 - RNA, 21 nt, Human
uggcccucccaguaccuccug

SEQ ID NO: 2892785 - RNA, 18 nt, Human
uggcccucucccuuaccc

SEQ ID NO: 2892786 - RNA, 12 nt, Human
uggcccugcccu

SEQ ID NO: 2892787 - RNA, 22 nt, Human
uggcccagccaaacccugucug

SEQ ID NO: 2892788 - RNA, 18 nt, Human
uggcauuauguccacugu

SEQ ID NO: 2892789 - RNA, 20 nt, Human
uggcccacgccuguaauccc

SEQ ID NO: 2892790 - RNA, 23 nt, Human
uggcauuauguccacuguguaua

SEQ ID NO: 2892791 - RNA, 15 nt, Human
uggcauucuuguaca

SEQ ID NO: 2892792 - RNA, 17 nt, Human
uggcauucuuguacagu

SEQ ID NO: 2892793 - RNA, 13 nt, Human
uggcauuaugucc

SEQ ID NO: 2892794 - RNA, 17 nt, Human
uggcauuagaauuauuu

SEQ ID NO: 2892795 - RNA, 19 nt, Human
uggcauuacagcuggagaa

SEQ ID NO: 2892796 - RNA, 20 nt, Human
uggcauguuuugugcauuug

SEQ ID NO: 2892797 - RNA, 22 nt, Human
uggcauguuuugugcauuugua

SEQ ID NO: 2892798 - RNA, 20 nt, Human
uggccgaggguccuggcucc

SEQ ID NO: 2892799 - RNA, 19 nt, Human
uggccgaggguccuggcuc

SEQ ID NO: 2892800 - RNA, 21 nt, Human
uggccucugcugauccuccca

SEQ ID NO: 2892801 - RNA, 22 nt, Human
uggcccuugcaguucagcacca

SEQ ID NO: 2892802 - RNA, 23 nt, Human
uggcccuugcaguucagcaccac

SEQ ID NO: 2892803 - RNA, 13 nt, Human
uggcccuuuccuu

SEQ ID NO: 2892804 - RNA, 18 nt, Human
uggccgaggguccuggcu

SEQ ID NO: 2892805 - RNA, 18 nt, Human
uggcccuuuccuuccaga

SEQ ID NO: 2892806 - RNA, 13 nt, Human
uggcccuuuuaua

SEQ ID NO: 2892807 - RNA, 16 nt, Human
uggccgaggacuuuga

SEQ ID NO: 2892808 - RNA, 15 nt, Human
uggcccugucccucc

SEQ ID NO: 2892809 - RNA, 17 nt, Human
uggcccugucccuccca

SEQ ID NO: 2892810 - RNA, 18 nt, Human
uggcccugcccucuccuu

SEQ ID NO: 2892811 - RNA, 21 nt, Human
uggcccugcccucuccuuccu

SEQ ID NO: 2892812 - RNA, 19 nt, Human
uggcccugucccucccacc

SEQ ID NO: 2892813 - RNA, 20 nt, Human
uggcccugucccucccaccu

SEQ ID NO: 2892814 - RNA, 18 nt, Human
uggcccuuccuccuccac

SEQ ID NO: 2892815 - RNA, 20 nt, Human
uggcccuuccuccuccacca

SEQ ID NO: 2892816 - RNA, 21 nt, Human
uggcccuuccuccuccaccac

SEQ ID NO: 2892817 - RNA, 21 nt, Human
uggcccugucccucccaccuc

SEQ ID NO: 2892818 - RNA, 22 nt, Human
uggcccugucccucccaccucu

SEQ ID NO: 2892819 - RNA, 23 nt, Human
uggcccugucccucccaccucug

SEQ ID NO: 2892820 - RNA, 13 nt, Human
uggcccugugcua

SEQ ID NO: 2892821 - RNA, 16 nt, Human
uggccucuggcucuca

SEQ ID NO: 2892822 - RNA, 18 nt, Human
uggccugccuugaagcca

SEQ ID NO: 2892823 - RNA, 16 nt, Human
uggccugcacuaauuu

SEQ ID NO: 2892824 - RNA, 14 nt, Human
uggccugcacuaau

SEQ ID NO: 2892825 - RNA, 24 nt, Human
uggccugucucauccccagggguc

SEQ ID NO: 2892826 - RNA, 20 nt, Human
uggccugucucauccccagg

SEQ ID NO: 2892827 - RNA, 18 nt, Human
uggccugucucaucccca

SEQ ID NO: 2892828 - RNA, 16 nt, Human
uggccugucucauccc

SEQ ID NO: 2892829 - RNA, 14 nt, Human
uggccugucucauc

SEQ ID NO: 2892830 - RNA, 17 nt, Human
uggccugggccuccuca

SEQ ID NO: 2892831 - RNA, 21 nt, Human
uggccugguauggcugcaguc

SEQ ID NO: 2892832 - RNA, 19 nt, Human
uggccuguagaauagccug

SEQ ID NO: 2892833 - RNA, 21 nt, Human
uggccuguagaauagccugug

SEQ ID NO: 2892834 - RNA, 23 nt, Human
uggccuguagaauagccuguggc

SEQ ID NO: 2892835 - RNA, 12 nt, Human
uggccugucuca

SEQ ID NO: 2892836 - RNA, 14 nt, Human
uggccugggccucc

SEQ ID NO: 2892837 - RNA, 11 nt, Human
uggccuggaca

SEQ ID NO: 2892838 - RNA, 13 nt, Human
uggccuggacugu

SEQ ID NO: 2892839 - RNA, 15 nt, Human
uggccuggacaguau

SEQ ID NO: 2892840 - RNA, 11 nt, Human
uggccugggca

SEQ ID NO: 2892841 - RNA, 21 nt, Human
aggccccugccacccugggga

SEQ ID NO: 2892842 - RNA, 12 nt, Human
aggccccugcca

SEQ ID NO: 2892843 - RNA, 18 nt, Human
aggccccugccacccugg

SEQ ID NO: 2892844 - RNA, 17 nt, Human
aggccccugccacccug

SEQ ID NO: 2892845 - RNA, 15 nt, Human
aggccccugccaccc

SEQ ID NO: 2892846 - RNA, 13 nt, Human
aggccccugccac

SEQ ID NO: 2892847 - RNA, 16 nt, Human
aggcccggcuccaggc

SEQ ID NO: 2892848 - RNA, 15 nt, Human
aggcccggcuccagg

SEQ ID NO: 2892849 - RNA, 14 nt, Human
aggcccggcuccag

SEQ ID NO: 2892850 - RNA, 17 nt, Human
aggccccuggacaagca

SEQ ID NO: 2892851 - RNA, 18 nt, Human
aggccccuucucucccug

SEQ ID NO: 2892852 - RNA, 19 nt, Human
aggccccuucucucccugc

SEQ ID NO: 2892853 - RNA, 20 nt, Human
aggccccuucucucccugcc

SEQ ID NO: 2892854 - RNA, 14 nt, Human
aggccggugugccu

SEQ ID NO: 2892855 - RNA, 21 nt, Human
aggccgggccgaauccccucc

SEQ ID NO: 2892856 - RNA, 15 nt, Human
aggccgggccuguac

SEQ ID NO: 2892857 - RNA, 17 nt, Human
aggccgggccuguacag

SEQ ID NO: 2892858 - RNA, 18 nt, Human
aggccgggccuguacagu

SEQ ID NO: 2892859 - RNA, 20 nt, Human
aggccgggccuguacagucu

SEQ ID NO: 2892860 - RNA, 22 nt, Human
aggccgggccuguacagucugu

SEQ ID NO: 2892861 - RNA, 12 nt, Human
aggccuggccag

SEQ ID NO: 2892862 - RNA, 13 nt, Human
aggccuggccaga

SEQ ID NO: 2892863 - RNA, 14 nt, Human
uggcaucagcuggc

SEQ ID NO: 2892864 - RNA, 20 nt, Human
uggcaucacagggcagagcc

SEQ ID NO: 2892865 - RNA, 18 nt, Human
uggcaucacagggcagag

SEQ ID NO: 2892866 - RNA, 15 nt, Human
uggcaucacagggca

SEQ ID NO: 2892867 - RNA, 15 nt, Human
uggcaucagcuggcg

SEQ ID NO: 2892868 - RNA, 18 nt, Human
uggcaucagcuggcguca

SEQ ID NO: 2892869 - RNA, 19 nt, Human
aggccuaaucucauaccuc

SEQ ID NO: 2892870 - RNA, 22 nt, Human
aggccuaaucucauaccucuga

SEQ ID NO: 2892871 - RNA, 16 nt, Human
aggccuauaaccccag

SEQ ID NO: 2892872 - RNA, 14 nt, Human
aggccucugugucc

SEQ ID NO: 2892873 - RNA, 15 nt, Human
aggccucuguguccu

SEQ ID NO: 2892874 - RNA, 16 nt, Human
aggccucuguguccuu

SEQ ID NO: 2892875 - RNA, 20 nt, Human
aggccucuguguccuucccu

SEQ ID NO: 2892876 - RNA, 15 nt, Human
aggccuaggauucua

SEQ ID NO: 2892877 - RNA, 16 nt, Human
aggccuaggauucuaa

SEQ ID NO: 2892878 - RNA, 17 nt, Human
aggccuaggauucuaaa

SEQ ID NO: 2892879 - RNA, 18 nt, Human
aggccugaaaggagcccu

SEQ ID NO: 2892880 - RNA, 22 nt, Human
aggccucuguguccuucccugc

SEQ ID NO: 2892881 - RNA, 23 nt, Human
aggccucuguguccuucccugca

SEQ ID NO: 2892882 - RNA, 15 nt, Human
aggccucuuggagac

SEQ ID NO: 2892883 - RNA, 17 nt, Human
aggccucuuggagaccu

SEQ ID NO: 2892884 - RNA, 21 nt, Human
uggcagauaaucagccucuua

SEQ ID NO: 2892885 - RNA, 23 nt, Human
uggcagaugacaagaugguacaa

SEQ ID NO: 2892886 - RNA, 18 nt, Human
uggcagcaccugucuccu

SEQ ID NO: 2892887 - RNA, 20 nt, Human
uggcagcagaaaacuugugu

SEQ ID NO: 2892888 - RNA, 14 nt, Human
uggcagauucaaau

SEQ ID NO: 2892889 - RNA, 14 nt, Human
uggcagcaggcagc

SEQ ID NO: 2892890 - RNA, 17 nt, Human
uggcagccgugccuuca

SEQ ID NO: 2892891 - RNA, 20 nt, Human
aggcauccuuccucacacca

SEQ ID NO: 2892892 - RNA, 18 nt, Human
aggcauccuuccucacac

SEQ ID NO: 2892893 - RNA, 18 nt, Human
aggcauaucaugcuuuga

SEQ ID NO: 2892894 - RNA, 14 nt, Human
aggcaucacagcua

SEQ ID NO: 2892895 - RNA, 19 nt, Human
aggcaucagucccuaugua

SEQ ID NO: 2892896 - RNA, 20 nt, Human
aggcaucagucccuauguau

SEQ ID NO: 2892897 - RNA, 16 nt, Human
aggcaucaugcagagu

SEQ ID NO: 2892898 - RNA, 20 nt, Human
aggcauccagcagucucugc

SEQ ID NO: 2892899 - RNA, 23 nt, Human
aggcauccagcagucucugccuu

SEQ ID NO: 2892900 - RNA, 13 nt, Human
uggcacaggacug

SEQ ID NO: 2892901 - RNA, 14 nt, Human
uggcacaggacuga

SEQ ID NO: 2892902 - RNA, 15 nt, Human
uggcacaggacugau

SEQ ID NO: 2892903 - RNA, 15 nt, Human
uggcacagggcagug

SEQ ID NO: 2892904 - RNA, 16 nt, Human
uggcacaggcccccuu

SEQ ID NO: 2892905 - RNA, 18 nt, Human
uggcagccgugccuucag

SEQ ID NO: 2892906 - RNA, 19 nt, Human
uggcagccgugccuucagc

SEQ ID NO: 2892907 - RNA, 20 nt, Human
uggcagccgugccuucagcu

SEQ ID NO: 2892908 - RNA, 21 nt, Human
uggcagccgugccuucagcuc

SEQ ID NO: 2892909 - RNA, 16 nt, Human
uggcagccgugccuuc

SEQ ID NO: 2892910 - RNA, 18 nt, Human
aggccaugggccuccugu

SEQ ID NO: 2892911 - RNA, 16 nt, Human
aggccauucugccgcc

SEQ ID NO: 2892912 - RNA, 20 nt, Human
aggccauuccccgucucugg

SEQ ID NO: 2892913 - RNA, 22 nt, Human
uggcuagaggccagccccaccc

SEQ ID NO: 2892914 - RNA, 21 nt, Human
uggcuagaggccagccccacc

SEQ ID NO: 2892915 - RNA, 23 nt, Human
uggcuagaggccagccccaccca

SEQ ID NO: 2892916 - RNA, 19 nt, Human
uggcuagaggccagcccca

SEQ ID NO: 2892917 - RNA, 22 nt, Human
uggcuacuuugguuucugucug

SEQ ID NO: 2892918 - RNA, 23 nt, Human
uggcuacuuugguuucugucugu

SEQ ID NO: 2892919 - RNA, 16 nt, Human
uggcuaauaaggcuuu

SEQ ID NO: 2892920 - RNA, 21 nt, Human
uggcuaacuauauuugcuuuu

SEQ ID NO: 2892921 - RNA, 20 nt, Human
aggcucccgaggggaagggg

SEQ ID NO: 2892922 - RNA, 13 nt, Human
aggcuccgcccuu

SEQ ID NO: 2892923 - RNA, 15 nt, Human
aggcuccgcccuuag

SEQ ID NO: 2892924 - RNA, 21 nt, Human
uggcuauauggcaagaaagcu

SEQ ID NO: 2892925 - RNA, 22 nt, Human
uggcuaucaaagaauaagaaaa

SEQ ID NO: 2892926 - RNA, 16 nt, Human
uggcucacaccuguaa

SEQ ID NO: 2892927 - RNA, 17 nt, Human
uggcucacaccuguaau

SEQ ID NO: 2892928 - RNA, 16 nt, Human
uggcucaauccucuaa

SEQ ID NO: 2892929 - RNA, 19 nt, Human
uggcucacaccuguaaucc

SEQ ID NO: 2892930 - RNA, 22 nt, Human
uggcucacaccuguaaucccag

SEQ ID NO: 2892931 - RNA, 12 nt, Human
uggcuaagaccc

SEQ ID NO: 2892932 - RNA, 14 nt, Human
uggcucaccuuccg

SEQ ID NO: 2892933 - RNA, 14 nt, Human
uggcucacaguaca

SEQ ID NO: 2892934 - RNA, 22 nt, Human
uggcucacaguacagcaugugc

SEQ ID NO: 2892935 - RNA, 24 nt, Human
uggcucacaguacagcaugugccu

SEQ ID NO: 2892936 - RNA, 19 nt, Human
uggcucacgccuguaaucc

SEQ ID NO: 2892937 - RNA, 22 nt, Human
uggcucacgucuguaaucccag

SEQ ID NO: 2892938 - RNA, 21 nt, Human
uggcucacugcaacuucugcc

SEQ ID NO: 2892939 - RNA, 22 nt, Human
uggcucagcucggggagccuua

SEQ ID NO: 2892940 - RNA, 19 nt, Human
uggcucuugauaccccccu

SEQ ID NO: 2892941 - RNA, 20 nt, Human
uggcucuugauaccccccuc

SEQ ID NO: 2892942 - RNA, 21 nt, Human
uggcucuugauaccccccucu

SEQ ID NO: 2892943 - RNA, 18 nt, Human
uggcucagacauguuuuc

SEQ ID NO: 2892944 - RNA, 13 nt, Human
uggcucagagggg

SEQ ID NO: 2892945 - RNA, 22 nt, Human
uggcucagagggggacugcugc

SEQ ID NO: 2892946 - RNA, 14 nt, Human
uggcucagcucggg

SEQ ID NO: 2892947 - RNA, 15 nt, Human
uggcugaaaaaggcc

SEQ ID NO: 2892948 - RNA, 23 nt, Human
uggcucuugauaccccccucugu

SEQ ID NO: 2892949 - RNA, 19 nt, Human
uggcucuuuggagaucaag

SEQ ID NO: 2892950 - RNA, 16 nt, Human
uggcucuuugggcugg

SEQ ID NO: 2892951 - RNA, 13 nt, Human
uggcugaacucau

SEQ ID NO: 2892952 - RNA, 20 nt, Human
uggcugaagacuuuuguuau

SEQ ID NO: 2892953 - RNA, 16 nt, Human
uggcugacuuugcucu

SEQ ID NO: 2892954 - RNA, 15 nt, Human
uggcugacuaaauuu

SEQ ID NO: 2892955 - RNA, 20 nt, Human
uggcugacuaaauuugggga

SEQ ID NO: 2892956 - RNA, 22 nt, Human
uggcugacuaaauuuggggaca

SEQ ID NO: 2892957 - RNA, 23 nt, Human
uggcugacuaaauuuggggacag

SEQ ID NO: 2892958 - RNA, 11 nt, Human
uggcuguuugg

SEQ ID NO: 2892959 - RNA, 16 nt, Human
uggcuguuuggacuuu

SEQ ID NO: 2892960 - RNA, 21 nt, Human
uggcuuauuuuaaugugauga

SEQ ID NO: 2892961 - RNA, 19 nt, Human
ugggaaaaaaaugaaugag

SEQ ID NO: 2892962 - RNA, 22 nt, Human
uggcuuuuuuaaaaaagcaaca

SEQ ID NO: 2892963 - RNA, 23 nt, Human
ugggaaaaaugcccuuaaaucau

SEQ ID NO: 2892964 - RNA, 19 nt, Human
ugggaaaugagaaggcagc

SEQ ID NO: 2892965 - RNA, 20 nt, Human
ugggaaaugagaaggcagcc

SEQ ID NO: 2892966 - RNA, 15 nt, Human
ugggaaaugagcagg

SEQ ID NO: 2892967 - RNA, 16 nt, Human
ugggaaaugagcaggg

SEQ ID NO: 2892968 - RNA, 20 nt, Human
ugggaacaccauaggucacc

SEQ ID NO: 2892969 - RNA, 21 nt, Human
ugggaaaccccuucucuguga

SEQ ID NO: 2892970 - RNA, 15 nt, Human
ugggaaacuugucac

SEQ ID NO: 2892971 - RNA, 21 nt, Human
ugggaaacuugucacuugcau

SEQ ID NO: 2892972 - RNA, 22 nt, Human
ugggaaacuugucacuugcaug

SEQ ID NO: 2892973 - RNA, 16 nt, Human
ugggaaaacacugcca

SEQ ID NO: 2892974 - RNA, 15 nt, Human
ugggaaacagaggcu

SEQ ID NO: 2892975 - RNA, 17 nt, Human
ugggaaacacuccuugc

SEQ ID NO: 2892976 - RNA, 18 nt, Human
ugggaaacacuccuugca

SEQ ID NO: 2892977 - RNA, 19 nt, Human
ugggaaacacuccuugcau

SEQ ID NO: 2892978 - RNA, 20 nt, Human
ugggaaacacuccuugcauc

SEQ ID NO: 2892979 - RNA, 23 nt, Human
uggcugcaaaggguaucaggugc

SEQ ID NO: 2892980 - RNA, 14 nt, Human
uggcugugccucug

SEQ ID NO: 2892981 - RNA, 15 nt, Human
uggcugugccucugc

SEQ ID NO: 2892982 - RNA, 16 nt, Human
uggcugugccucugcc

SEQ ID NO: 2892983 - RNA, 17 nt, Human
uggcugugccucugccu

SEQ ID NO: 2892984 - RNA, 18 nt, Human
uggcugucuggaaagccc

SEQ ID NO: 2892985 - RNA, 15 nt, Human
uggcugugaggcccc

SEQ ID NO: 2892986 - RNA, 18 nt, Human
uggcuguuggcugggggc

SEQ ID NO: 2892987 - RNA, 16 nt, Human
uggcuguuggcugggg

SEQ ID NO: 2892988 - RNA, 23 nt, Human
uggcuguuggcugggggccucag

SEQ ID NO: 2892989 - RNA, 22 nt, Human
uggcugugccucugccugucuc

SEQ ID NO: 2892990 - RNA, 18 nt, Human
uggcugugccucugccug

SEQ ID NO: 2892991 - RNA, 19 nt, Human
uggcugugccucugccugu

SEQ ID NO: 2892992 - RNA, 19 nt, Human
uggcugugcucucaccagc

SEQ ID NO: 2892993 - RNA, 21 nt, Human
uggcuguggagacaaugucug

SEQ ID NO: 2892994 - RNA, 22 nt, Human
uggcuguggagacaaugucugc

SEQ ID NO: 2892995 - RNA, 16 nt, Human
agggaaaagcagcucu

SEQ ID NO: 2892996 - RNA, 10 nt, Human
agggaaaagg

SEQ ID NO: 2892997 - RNA, 14 nt, Human
agggaaaagggaag

SEQ ID NO: 2892998 - RNA, 20 nt, Human
aggcuuugugauagugacau

SEQ ID NO: 2892999 - RNA, 13 nt, Human
aggcuuuguguug

SEQ ID NO: 2893000 - RNA, 15 nt, Human
aggcuuuguguugua

SEQ ID NO: 2893001 - RNA, 16 nt, Human
aggcuuuguguuguaa

SEQ ID NO: 2893002 - RNA, 17 nt, Human
aggcuuuguguuguaau

SEQ ID NO: 2893003 - RNA, 18 nt, Human
aggcuuuguguuguaauu

SEQ ID NO: 2893004 - RNA, 19 nt, Human
aggcuuuggauuugacauu

SEQ ID NO: 2893005 - RNA, 19 nt, Human
aggcuuugauuaguuuucu

SEQ ID NO: 2893006 - RNA, 21 nt, Human
aggcuuguuccaaugccacau

SEQ ID NO: 2893007 - RNA, 23 nt, Human
aggcuuuaugauaauagauucuc

SEQ ID NO: 2893008 - RNA, 12 nt, Human
aggcuuucagcu

SEQ ID NO: 2893009 - RNA, 13 nt, Human
aggcuuucagcuu

SEQ ID NO: 2893010 - RNA, 18 nt, Human
aggcuuuaguguauuuau

SEQ ID NO: 2893011 - RNA, 22 nt, Human
aggcuuuaugauaauagauucu

SEQ ID NO: 2893012 - RNA, 15 nt, Human
aggcuuauauucaac

SEQ ID NO: 2893013 - RNA, 16 nt, Human
aggcuuauauucaacc

SEQ ID NO: 2893014 - RNA, 17 nt, Human
aggcuuauauucaacca

SEQ ID NO: 2893015 - RNA, 19 nt, Human
aggcuucaaaauguuaucu

SEQ ID NO: 2893016 - RNA, 18 nt, Human
aggcuuauauucaaccau

SEQ ID NO: 2893017 - RNA, 21 nt, Human
aggcuuauauucaaccaugga

SEQ ID NO: 2893018 - RNA, 21 nt, Human
aggcuuccugcaauuuucuaa

SEQ ID NO: 2893019 - RNA, 22 nt, Human
aggcuuccugcaauuuucuaag

SEQ ID NO: 2893020 - RNA, 22 nt, Human
aggcuucuccaauucugcccaa

SEQ ID NO: 2893021 - RNA, 13 nt, Human
aggcuuccuuggc

SEQ ID NO: 2893022 - RNA, 23 nt, Human
aggcuucugguugaugccuguga

SEQ ID NO: 2893023 - RNA, 16 nt, Human
aggcuucucuguucua

SEQ ID NO: 2893024 - RNA, 13 nt, Human
aggcuugaagcug

SEQ ID NO: 2893025 - RNA, 15 nt, Human
aggcugggugacaga

SEQ ID NO: 2893026 - RNA, 20 nt, Human
aggcuucuguuccucucuuu

SEQ ID NO: 2893027 - RNA, 15 nt, Human
aggcuugccugcagg

SEQ ID NO: 2893028 - RNA, 16 nt, Human
aggcuugccugcaggc

SEQ ID NO: 2893029 - RNA, 17 nt, Human
aggcuugccugcaggca

SEQ ID NO: 2893030 - RNA, 17 nt, Human
ugggaacacuggcagac

SEQ ID NO: 2893031 - RNA, 14 nt, Human
ugggaacauuuauu

SEQ ID NO: 2893032 - RNA, 18 nt, Human
ugggaacauuuauuuuau

SEQ ID NO: 2893033 - RNA, 21 nt, Human
ugggaacauuuauuuuaugag

SEQ ID NO: 2893034 - RNA, 22 nt, Human
ugggaacauuuauuuuaugaga

SEQ ID NO: 2893035 - RNA, 23 nt, Human
ugggaacauuuauuuuaugagaa

SEQ ID NO: 2893036 - RNA, 20 nt, Human
ugggaaccaagcuauuccuu

SEQ ID NO: 2893037 - RNA, 18 nt, Human
aggcugggccauguccaa

SEQ ID NO: 2893038 - RNA, 12 nt, Human
aggcugggccau

SEQ ID NO: 2893039 - RNA, 10 nt, Human
aggcugggcc

SEQ ID NO: 2893040 - RNA, 13 nt, Human
aggcugggcaagg

SEQ ID NO: 2893041 - RNA, 14 nt, Human
aggcugggcuucag

SEQ ID NO: 2893042 - RNA, 22 nt, Human
aggcugggccauguccaaagag

SEQ ID NO: 2893043 - RNA, 18 nt, Human
aggcugggcguaguggcu

SEQ ID NO: 2893044 - RNA, 21 nt, Human
aggcugggccauguccaaaga

SEQ ID NO: 2893045 - RNA, 20 nt, Human
aggcugggccauguccaaag

SEQ ID NO: 2893046 - RNA, 21 nt, Human
aggcugggcuucaguggcagc

SEQ ID NO: 2893047 - RNA, 20 nt, Human
aggcugggcuucaguggcag

SEQ ID NO: 2893048 - RNA, 19 nt, Human
aggcugggcuucaguggca

SEQ ID NO: 2893049 - RNA, 18 nt, Human
aggcugggcuucaguggc

SEQ ID NO: 2893050 - RNA, 23 nt, Human
aggcugggcuucaguggcagcug

SEQ ID NO: 2893051 - RNA, 22 nt, Human
aggcugggcuucaguggcagcu

SEQ ID NO: 2893052 - RNA, 16 nt, Human
aggcuggggaaguccu

SEQ ID NO: 2893053 - RNA, 18 nt, Human
aggcuggggaaguccucu

SEQ ID NO: 2893054 - RNA, 21 nt, Human
aggcuggggaaguccucuggg

SEQ ID NO: 2893055 - RNA, 22 nt, Human
aggcuggggaaguccucugggu

SEQ ID NO: 2893056 - RNA, 14 nt, Human
agggcugucaucug

SEQ ID NO: 2893057 - RNA, 15 nt, Human
agggcugucaucuga

SEQ ID NO: 2893058 - RNA, 20 nt, Human
ugggcucaagcaauccucuc

SEQ ID NO: 2893059 - RNA, 14 nt, Human
ugggcuauggacac

SEQ ID NO: 2893060 - RNA, 15 nt, Human
ugggcuauggacaca

SEQ ID NO: 2893061 - RNA, 17 nt, Human
ugggcuauggacacagg

SEQ ID NO: 2893062 - RNA, 18 nt, Human
ugggcuauggacacaggg

SEQ ID NO: 2893063 - RNA, 19 nt, Human
ugggcuauggacacagggu

SEQ ID NO: 2893064 - RNA, 21 nt, Human
ugggcuauggacacaggguga

SEQ ID NO: 2893065 - RNA, 18 nt, Human
agggcuuaccuguacacu

SEQ ID NO: 2893066 - RNA, 23 nt, Human
agggcuuaccuguacacugacuu

SEQ ID NO: 2893067 - RNA, 14 nt, Human
agggcuggccccag

SEQ ID NO: 2893068 - RNA, 18 nt, Human
agggcuggccccagggca

SEQ ID NO: 2893069 - RNA, 19 nt, Human
agggcuggccccagggcac

SEQ ID NO: 2893070 - RNA, 22 nt, Human
agggcuggccccagggcacccu

SEQ ID NO: 2893071 - RNA, 16 nt, Human
agggcugggaaacacu

SEQ ID NO: 2893072 - RNA, 22 nt, Human
agggcugggaaacacuccuugc

SEQ ID NO: 2893073 - RNA, 23 nt, Human
agggcugggaaacacuccuugca

SEQ ID NO: 2893074 - RNA, 20 nt, Human
agggcugggcaaggaaaaag

SEQ ID NO: 2893075 - RNA, 21 nt, Human
agggcugggcaaggaaaaaga

SEQ ID NO: 2893076 - RNA, 22 nt, Human
agggcugggcaaggaaaaagaa

SEQ ID NO: 2893077 - RNA, 16 nt, Human
ugggcucccguguuuu

SEQ ID NO: 2893078 - RNA, 19 nt, Human
ugggcucccguguuuugua

SEQ ID NO: 2893079 - RNA, 19 nt, Human
ugggcucugacagaaagca

SEQ ID NO: 2893080 - RNA, 17 nt, Human
ugggcucggaggcugcc

SEQ ID NO: 2893081 - RNA, 12 nt, Human
ugggcuccuggc

SEQ ID NO: 2893082 - RNA, 15 nt, Human
ugggcuccuggcaga

SEQ ID NO: 2893083 - RNA, 23 nt, Human
ugggcuccuggcagaagggagca

SEQ ID NO: 2893084 - RNA, 17 nt, Human
agggcccaggcaggcca

SEQ ID NO: 2893085 - RNA, 14 nt, Human
agggcccagagagg

SEQ ID NO: 2893086 - RNA, 16 nt, Human
agggccaagacuuggc

SEQ ID NO: 2893087 - RNA, 16 nt, Human
agggccaauccccagc

SEQ ID NO: 2893088 - RNA, 15 nt, Human
agggcccaggcaggc

SEQ ID NO: 2893089 - RNA, 14 nt, Human
agggcccaggcagg

SEQ ID NO: 2893090 - RNA, 15 nt, Human
agggcccagaggcug

SEQ ID NO: 2893091 - RNA, 12 nt, Human
agggcccaggag

SEQ ID NO: 2893092 - RNA, 11 nt, Human
agggcccagag

SEQ ID NO: 2893093 - RNA, 20 nt, Human
agggcugcugggggcaacug

SEQ ID NO: 2893094 - RNA, 12 nt, Human
agggcugcuggg

SEQ ID NO: 2893095 - RNA, 23 nt, Human
agggcugcugggggcaacuggcc

SEQ ID NO: 2893096 - RNA, 17 nt, Human
agggcugcuagacggag

SEQ ID NO: 2893097 - RNA, 13 nt, Human
agggcugcccuga

SEQ ID NO: 2893098 - RNA, 15 nt, Human
agggcugcccugaga

SEQ ID NO: 2893099 - RNA, 16 nt, Human
agggcugcccugagaa

SEQ ID NO: 2893100 - RNA, 23 nt, Human
agggcugcccugagaagcugcuc

SEQ ID NO: 2893101 - RNA, 13 nt, Human
agggcugccacca

SEQ ID NO: 2893102 - RNA, 11 nt, Human
agggcuccucc

SEQ ID NO: 2893103 - RNA, 13 nt, Human
agggcuccuccca

SEQ ID NO: 2893104 - RNA, 14 nt, Human
agggcuccucccag

SEQ ID NO: 2893105 - RNA, 15 nt, Human
agggcuccucccagc

SEQ ID NO: 2893106 - RNA, 17 nt, Human
agggcuccucccagcuu

SEQ ID NO: 2893107 - RNA, 18 nt, Human
agggcuccucccagcuug

SEQ ID NO: 2893108 - RNA, 14 nt, Human
agggcuccugcagg

SEQ ID NO: 2893109 - RNA, 15 nt, Human
agggcucccugcccu

SEQ ID NO: 2893110 - RNA, 15 nt, Human
agggcugaccugccu

SEQ ID NO: 2893111 - RNA, 16 nt, Human
agggcugaccugccuc

SEQ ID NO: 2893112 - RNA, 17 nt, Human
agggcugaccugccucu

SEQ ID NO: 2893113 - RNA, 19 nt, Human
agggcugaccugccucuca

SEQ ID NO: 2893114 - RNA, 23 nt, Human
agggcugaccugccucucacaca

SEQ ID NO: 2893115 - RNA, 16 nt, Human
agggcugagcugggga

SEQ ID NO: 2893116 - RNA, 13 nt, Human
agggcccagagag

SEQ ID NO: 2893117 - RNA, 12 nt, Human
agggcccagaga

SEQ ID NO: 2893118 - RNA, 23 nt, Human
agggccaacuugagggcccagag

SEQ ID NO: 2893119 - RNA, 13 nt, Human
agggcaguuuucu

SEQ ID NO: 2893120 - RNA, 14 nt, Human
agggcauaaaacag

SEQ ID NO: 2893121 - RNA, 15 nt, Human
agggcauaaaacagc

SEQ ID NO: 2893122 - RNA, 16 nt, Human
agggcauaaaacagcu

SEQ ID NO: 2893123 - RNA, 19 nt, Human
agggcauaaaacagcuuug

SEQ ID NO: 2893124 - RNA, 14 nt, Human
agggcauccauacc

SEQ ID NO: 2893125 - RNA, 21 nt, Human
agggcauccauaccagcucgc

SEQ ID NO: 2893126 - RNA, 16 nt, Human
agggcauucaaauggg

SEQ ID NO: 2893127 - RNA, 14 nt, Human
agggcauucuuucc

SEQ ID NO: 2893128 - RNA, 19 nt, Human
agggcauucuuucccagug

SEQ ID NO: 2893129 - RNA, 17 nt, Human
agggcauggccaggugg

SEQ ID NO: 2893130 - RNA, 15 nt, Human
agggcagagccggga

SEQ ID NO: 2893131 - RNA, 19 nt, Human
agggcagaaagguucugcc

SEQ ID NO: 2893132 - RNA, 20 nt, Human
agggcagaaagguucugccc

SEQ ID NO: 2893133 - RNA, 15 nt, Human
agggcagaaaguaga

SEQ ID NO: 2893134 - RNA, 17 nt, Human
agggcacugguggcccg

SEQ ID NO: 2893135 - RNA, 15 nt, Human
agggagugcuggcuc

SEQ ID NO: 2893136 - RNA, 16 nt, Human
agggagugcuggcuca

SEQ ID NO: 2893137 - RNA, 17 nt, Human
agggagugcuggcucac

SEQ ID NO: 2893138 - RNA, 18 nt, Human
agggagugcuggcucaca

SEQ ID NO: 2893139 - RNA, 20 nt, Human
agggagugcuggcucacagu

SEQ ID NO: 2893140 - RNA, 23 nt, Human
agggagugcuggcucacaguaca

SEQ ID NO: 2893141 - RNA, 24 nt, Human
agggagugcuggcucacaguacag

SEQ ID NO: 2893142 - RNA, 17 nt, Human
agggcagagucacacgg

SEQ ID NO: 2893143 - RNA, 21 nt, Human
agggcagugcuagugagcugg

SEQ ID NO: 2893144 - RNA, 22 nt, Human
agggcagugcuagugagcuggg

SEQ ID NO: 2893145 - RNA, 15 nt, Human
agggagggccugggc

SEQ ID NO: 2893146 - RNA, 13 nt, Human
agggagggccugg

SEQ ID NO: 2893147 - RNA, 20 nt, Human
ugggccaccaggaucagcca

SEQ ID NO: 2893148 - RNA, 16 nt, Human
ugggccaacucaccug

SEQ ID NO: 2893149 - RNA, 19 nt, Human
ugggcauugacaaaucugu

SEQ ID NO: 2893150 - RNA, 23 nt, Human
ugggcauugacaaaucuguguau

SEQ ID NO: 2893151 - RNA, 21 nt, Human
ugggccaaauccgcucucuuc

SEQ ID NO: 2893152 - RNA, 23 nt, Human
ugggccaaauccgcucucuuccu

SEQ ID NO: 2893153 - RNA, 17 nt, Human
agggagggcaguuuucu

SEQ ID NO: 2893154 - RNA, 20 nt, Human
agggaguccgaaagggacuu

SEQ ID NO: 2893155 - RNA, 20 nt, Human
agggagugacagaggcagcc

SEQ ID NO: 2893156 - RNA, 23 nt, Human
agggaguccgaaagggacuugga

SEQ ID NO: 2893157 - RNA, 15 nt, Human
agggacuuggaagcu

SEQ ID NO: 2893158 - RNA, 19 nt, Human
agggacuuggaagcuccgc

SEQ ID NO: 2893159 - RNA, 18 nt, Human
agggacuuggaagcuccg

SEQ ID NO: 2893160 - RNA, 12 nt, Human
agggaaagaaaa

SEQ ID NO: 2893161 - RNA, 19 nt, Human
agggaaagaaaaggaaggc

SEQ ID NO: 2893162 - RNA, 23 nt, Human
agggaaagaaaguugcacggcug

SEQ ID NO: 2893163 - RNA, 15 nt, Human
agggaaauaucauuu

SEQ ID NO: 2893164 - RNA, 17 nt, Human
agggagcagacaggagg

SEQ ID NO: 2893165 - RNA, 19 nt, Human
agggagcaggcggugggca

SEQ ID NO: 2893166 - RNA, 16 nt, Human
agggagcagggaaggc

SEQ ID NO: 2893167 - RNA, 20 nt, Human
agggacuuggaagcuccgcu

SEQ ID NO: 2893168 - RNA, 14 nt, Human
agggagaacuuaug

SEQ ID NO: 2893169 - RNA, 23 nt, Human
agggaaauagcuaauaauguuaa

SEQ ID NO: 2893170 - RNA, 18 nt, Human
agggagaagggauggagg

SEQ ID NO: 2893171 - RNA, 20 nt, Human
agggagacacuggccccuca

SEQ ID NO: 2893172 - RNA, 18 nt, Human
ugggacucaaugcacuga

SEQ ID NO: 2893173 - RNA, 13 nt, Human
ugggacuggccuc

SEQ ID NO: 2893174 - RNA, 16 nt, Human
ugggacuacaggugug

SEQ ID NO: 2893175 - RNA, 16 nt, Human
ugggacuggccucugc

SEQ ID NO: 2893176 - RNA, 14 nt, Human
ugggacuggccucu

SEQ ID NO: 2893177 - RNA, 15 nt, Human
ugggacuuauuacaa

SEQ ID NO: 2893178 - RNA, 18 nt, Human
ugggacuacaggcaccca

SEQ ID NO: 2893179 - RNA, 18 nt, Human
agggagccuuugguucug

SEQ ID NO: 2893180 - RNA, 19 nt, Human
agggagcagggaaggccug

SEQ ID NO: 2893181 - RNA, 18 nt, Human
agggagcaucagugcccu

SEQ ID NO: 2893182 - RNA, 20 nt, Human
agggagccuagaagcuggug

SEQ ID NO: 2893183 - RNA, 13 nt, Human
ugggaggcugagg

SEQ ID NO: 2893184 - RNA, 14 nt, Human
ugggaggcugaggc

SEQ ID NO: 2893185 - RNA, 15 nt, Human
ugggaggcugaggcg

SEQ ID NO: 2893186 - RNA, 14 nt, Human
ugggaggcuucccc

SEQ ID NO: 2893187 - RNA, 14 nt, Human
ugggagggaaaagg

SEQ ID NO: 2893188 - RNA, 18 nt, Human
ugggagggaaaagggaag

SEQ ID NO: 2893189 - RNA, 17 nt, Human
ugggagggagcagacag

SEQ ID NO: 2893190 - RNA, 18 nt, Human
ugggagggagcagacagg

SEQ ID NO: 2893191 - RNA, 19 nt, Human
ugggagggagcagacagga

SEQ ID NO: 2893192 - RNA, 14 nt, Human
ugggagggauggcc

SEQ ID NO: 2893193 - RNA, 21 nt, Human
ugggagggauggcccuuccuc

SEQ ID NO: 2893194 - RNA, 14 nt, Human
ugggaggcuccugu

SEQ ID NO: 2893195 - RNA, 17 nt, Human
ugggaggcuccuguuag

SEQ ID NO: 2893196 - RNA, 22 nt, Human
ugggaggcuccuguuagcuccu

SEQ ID NO: 2893197 - RNA, 19 nt, Human
ugggcaaugauggcaauuu

SEQ ID NO: 2893198 - RNA, 20 nt, Human
ugggcacaaagggcccagau

SEQ ID NO: 2893199 - RNA, 22 nt, Human
ugggcacaacugcaauaacuuc

SEQ ID NO: 2893200 - RNA, 16 nt, Human
ugggcacacgccuccc

SEQ ID NO: 2893201 - RNA, 21 nt, Human
ugggcacacgccucccacugg

SEQ ID NO: 2893202 - RNA, 16 nt, Human
ugggcaauauagcaag

SEQ ID NO: 2893203 - RNA, 15 nt, Human
ugggcaauauagcaa

SEQ ID NO: 2893204 - RNA, 19 nt, Human
ugggcacaaagggcccaga

SEQ ID NO: 2893205 - RNA, 21 nt, Human
ugggcaacccccagccugcua

SEQ ID NO: 2893206 - RNA, 16 nt, Human
ugggcaacagagcaag

SEQ ID NO: 2893207 - RNA, 14 nt, Human
ugggcaaggaggcc

SEQ ID NO: 2893208 - RNA, 13 nt, Human
ugggcaaggaaaa

SEQ ID NO: 2893209 - RNA, 14 nt, Human
ugggcaaggaaaaa

SEQ ID NO: 2893210 - RNA, 19 nt, Human
ugggcaaggaaaaagaaaa

SEQ ID NO: 2893211 - RNA, 14 nt, Human
ugggcaacagagca

SEQ ID NO: 2893212 - RNA, 12 nt, Human
ugggcaacagag

SEQ ID NO: 2893213 - RNA, 12 nt, Human
ugggcaacaaag

SEQ ID NO: 2893214 - RNA, 15 nt, Human
ugggcaacaaaguga

SEQ ID NO: 2893215 - RNA, 19 nt, Human
ugggaggggcgcccaccuc

SEQ ID NO: 2893216 - RNA, 23 nt, Human
ugggaggggcgcccaccucccca

SEQ ID NO: 2893217 - RNA, 18 nt, Human
ugggagggggagaaaagg

SEQ ID NO: 2893218 - RNA, 20 nt, Human
ugggaggggcgcccaccucc

SEQ ID NO: 2893219 - RNA, 18 nt, Human
ugggauuuuaaacuagau

SEQ ID NO: 2893220 - RNA, 21 nt, Human
ugggauuuuaaacuagaugac

SEQ ID NO: 2893221 - RNA, 18 nt, Human
aguauuaauacuaaaaua

SEQ ID NO: 2893222 - RNA, 14 nt, Human
aguauucauucugc

SEQ ID NO: 2893223 - RNA, 14 nt, Human
aguauguuuuacac

SEQ ID NO: 2893224 - RNA, 17 nt, Human
aguauguuuuacacugu

SEQ ID NO: 2893225 - RNA, 21 nt, Human
aguauguuuuacacuguacca

SEQ ID NO: 2893226 - RNA, 13 nt, Human
aguauuaaaacau

SEQ ID NO: 2893227 - RNA, 14 nt, Human
aguauuaaaacauu

SEQ ID NO: 2893228 - RNA, 15 nt, Human
aguauuaaaacauug

SEQ ID NO: 2893229 - RNA, 16 nt, Human
aguauuaaaacauugg

SEQ ID NO: 2893230 - RNA, 19 nt, Human
aguauuaaaacauuggauu

SEQ ID NO: 2893231 - RNA, 22 nt, Human
aguauuaaaacauuggauuauc

SEQ ID NO: 2893232 - RNA, 23 nt, Human
aguauuaaaacauuggauuaucc

SEQ ID NO: 2893233 - RNA, 18 nt, Human
aguauaauuuuuuguaau

SEQ ID NO: 2893234 - RNA, 15 nt, Human
aguauacaauauaua

SEQ ID NO: 2893235 - RNA, 16 nt, Human
aguauacaauauauaa

SEQ ID NO: 2893236 - RNA, 17 nt, Human
aguauacaauauauaaa

SEQ ID NO: 2893237 - RNA, 19 nt, Human
aguauacaauauauaaaaa

SEQ ID NO: 2893238 - RNA, 21 nt, Human
aguauacaauauauaaaaaua

SEQ ID NO: 2893239 - RNA, 23 nt, Human
aguauacaauauauaaaaauaua

SEQ ID NO: 2893240 - RNA, 21 nt, Human
aguauacaguucaauaaacuu

SEQ ID NO: 2893241 - RNA, 14 nt, Human
aguauagagagaag

SEQ ID NO: 2893242 - RNA, 16 nt, Human
aguauagagagaaguu

SEQ ID NO: 2893243 - RNA, 21 nt, Human
aguauaaccauaugauacuau

SEQ ID NO: 2893244 - RNA, 13 nt, Human
aguauaagaaaug

SEQ ID NO: 2893245 - RNA, 14 nt, Human
aguauaagaaaugc

SEQ ID NO: 2893246 - RNA, 16 nt, Human
aguauaagaaaugcau

SEQ ID NO: 2893247 - RNA, 18 nt, Human
aguauaagaaaugcauau

SEQ ID NO: 2893248 - RNA, 15 nt, Human
uguauauuuguauau

SEQ ID NO: 2893249 - RNA, 19 nt, Human
uguauauuuguauauuaca

SEQ ID NO: 2893250 - RNA, 13 nt, Human
uguauauuccuuu

SEQ ID NO: 2893251 - RNA, 14 nt, Human
uguauauuccuuug

SEQ ID NO: 2893252 - RNA, 20 nt, Human
uguauauuguguuuguguau

SEQ ID NO: 2893253 - RNA, 18 nt, Human
uguauauuacacauuugu

SEQ ID NO: 2893254 - RNA, 23 nt, Human
uguauauuacacauuuguacaga

SEQ ID NO: 2893255 - RNA, 13 nt, Human
uguauauuauuug

SEQ ID NO: 2893256 - RNA, 15 nt, Human
uguauauuauuuggc

SEQ ID NO: 2893257 - RNA, 16 nt, Human
uguauauuauuuggca

SEQ ID NO: 2893258 - RNA, 18 nt, Human
uguauauuauuuggcagu

SEQ ID NO: 2893259 - RNA, 21 nt, Human
uguauauuauuuggcaguuug

SEQ ID NO: 2893260 - RNA, 22 nt, Human
uguauauuauuuggcaguuugg

SEQ ID NO: 2893261 - RNA, 24 nt, Human
uguauauuauuuggcaguuuggua

SEQ ID NO: 2893262 - RNA, 16 nt, Human
aguauuuauaauagca

SEQ ID NO: 2893263 - RNA, 12 nt, Human
aguauuuauaua

SEQ ID NO: 2893264 - RNA, 16 nt, Human
aguauuuauauauuua

SEQ ID NO: 2893265 - RNA, 15 nt, Human
aguauuuauauauuu

SEQ ID NO: 2893266 - RNA, 14 nt, Human
aguauuuauauauu

SEQ ID NO: 2893267 - RNA, 13 nt, Human
aguauuuauauau

SEQ ID NO: 2893268 - RNA, 18 nt, Human
aguauuauucuacuauac

SEQ ID NO: 2893269 - RNA, 17 nt, Human
aguauuuauuuauguac

SEQ ID NO: 2893270 - RNA, 16 nt, Human
aguauuuauuuaugua

SEQ ID NO: 2893271 - RNA, 18 nt, Human
aguauuuauuuauguacu

SEQ ID NO: 2893272 - RNA, 21 nt, Human
aguauuugggaagugaagacu

SEQ ID NO: 2893273 - RNA, 21 nt, Human
aguauuugucguguguagaaa

SEQ ID NO: 2893274 - RNA, 20 nt, Human
aguauuuauuuauguacuuu

SEQ ID NO: 2893275 - RNA, 14 nt, Human
aguauuuauuuugu

SEQ ID NO: 2893276 - RNA, 15 nt, Human
aguauuuauuuugua

SEQ ID NO: 2893277 - RNA, 16 nt, Human
aguauuuauuuuguaa

SEQ ID NO: 2893278 - RNA, 17 nt, Human
aguauuuauuuuguaau

SEQ ID NO: 2893279 - RNA, 18 nt, Human
aguauuuauuuuguaauu

SEQ ID NO: 2893280 - RNA, 21 nt, Human
aguauuuauuuuguaauuaug

SEQ ID NO: 2893281 - RNA, 22 nt, Human
aguauuuauuuuguaauuauga

SEQ ID NO: 2893282 - RNA, 13 nt, Human
aguauuuauuuau

SEQ ID NO: 2893283 - RNA, 15 nt, Human
aguauuuauuuaugu

SEQ ID NO: 2893284 - RNA, 23 nt, Human
aguauuuauauauuuauaacuca

SEQ ID NO: 2893285 - RNA, 20 nt, Human
aguauuuauauauuuauaac

SEQ ID NO: 2893286 - RNA, 19 nt, Human
aguauuuauauauuuauaa

SEQ ID NO: 2893287 - RNA, 17 nt, Human
aguauuuauauauuuau

SEQ ID NO: 2893288 - RNA, 18 nt, Human
agucaccacuccauuccc

SEQ ID NO: 2893289 - RNA, 19 nt, Human
agucaccacuccauuccca

SEQ ID NO: 2893290 - RNA, 17 nt, Human
agucacccaugaagaca

SEQ ID NO: 2893291 - RNA, 16 nt, Human
agucacccaugaagac

SEQ ID NO: 2893292 - RNA, 15 nt, Human
ugucagauacaaugu

SEQ ID NO: 2893293 - RNA, 16 nt, Human
ugucagauacaaugua

SEQ ID NO: 2893294 - RNA, 13 nt, Human
agucaccccagga

SEQ ID NO: 2893295 - RNA, 20 nt, Human
agucacccaugaagacagga

SEQ ID NO: 2893296 - RNA, 21 nt, Human
agucaccccaaguagucugcu

SEQ ID NO: 2893297 - RNA, 15 nt, Human
agucaccaagcccag

SEQ ID NO: 2893298 - RNA, 13 nt, Human
aguauuuugaagu

SEQ ID NO: 2893299 - RNA, 14 nt, Human
aguauuuugaaguu

SEQ ID NO: 2893300 - RNA, 15 nt, Human
aguauuuugaaguuu

SEQ ID NO: 2893301 - RNA, 18 nt, Human
aguauuuugaaguuuaca

SEQ ID NO: 2893302 - RNA, 19 nt, Human
aguauuuugaaguuuacau

SEQ ID NO: 2893303 - RNA, 20 nt, Human
aguauuuugaaguuuacauu

SEQ ID NO: 2893304 - RNA, 21 nt, Human
aguauuuugaaguuuacauuu

SEQ ID NO: 2893305 - RNA, 22 nt, Human
aguauuuugaaguuuacauuuu

SEQ ID NO: 2893306 - RNA, 23 nt, Human
aguauuuugaaguuuacauuuuu

SEQ ID NO: 2893307 - RNA, 12 nt, Human
uguccagccugg

SEQ ID NO: 2893308 - RNA, 15 nt, Human
uguccagcagucacu

SEQ ID NO: 2893309 - RNA, 21 nt, Human
uguccagagagcaacucugag

SEQ ID NO: 2893310 - RNA, 23 nt, Human
uguccaauuguugacaguucuga

SEQ ID NO: 2893311 - RNA, 23 nt, Human
ugucccugcacuugcagacucua

SEQ ID NO: 2893312 - RNA, 22 nt, Human
ugucccugcacuugcagacucu

SEQ ID NO: 2893313 - RNA, 20 nt, Human
ugucccugcacuugcagacu

SEQ ID NO: 2893314 - RNA, 21 nt, Human
uguccccuuggcagguccugg

SEQ ID NO: 2893315 - RNA, 23 nt, Human
uguccagccugggcagccaggcu

SEQ ID NO: 2893316 - RNA, 22 nt, Human
uguccagccugggcagccaggc

SEQ ID NO: 2893317 - RNA, 19 nt, Human
uguccagccugggcagcca

SEQ ID NO: 2893318 - RNA, 14 nt, Human
uguccagccugggc

SEQ ID NO: 2893319 - RNA, 13 nt, Human
uguccccucccag

SEQ ID NO: 2893320 - RNA, 16 nt, Human
uguccccucccagagc

SEQ ID NO: 2893321 - RNA, 12 nt, Human
uguccccugcuu

SEQ ID NO: 2893322 - RNA, 22 nt, Human
ugucauuugagcagggcucagc

SEQ ID NO: 2893323 - RNA, 21 nt, Human
ugucauuugagcagggcucag

SEQ ID NO: 2893324 - RNA, 20 nt, Human
ugucauuugagcagggcuca

SEQ ID NO: 2893325 - RNA, 20 nt, Human
ugucagguggggcagcuuga

SEQ ID NO: 2893326 - RNA, 18 nt, Human
ugucagguggggcagcuu

SEQ ID NO: 2893327 - RNA, 17 nt, Human
ugucagguggggcagcu

SEQ ID NO: 2893328 - RNA, 16 nt, Human
ugucagaugagaacaa

SEQ ID NO: 2893329 - RNA, 17 nt, Human
ugucagaugagaacaaa

SEQ ID NO: 2893330 - RNA, 18 nt, Human
ugucagaugagaacaaag

SEQ ID NO: 2893331 - RNA, 19 nt, Human
ugucagaugagaacaaagc

SEQ ID NO: 2893332 - RNA, 20 nt, Human
ugucagaugagaacaaagcu

SEQ ID NO: 2893333 - RNA, 21 nt, Human
ugucagaugagaacaaagcug

SEQ ID NO: 2893334 - RNA, 23 nt, Human
ugucagaugagaacaaagcuguu

SEQ ID NO: 2893335 - RNA, 12 nt, Human
uguccaaagcag

SEQ ID NO: 2893336 - RNA, 17 nt, Human
uguccaaagcagggucu

SEQ ID NO: 2893337 - RNA, 18 nt, Human
uguccaaagcagggucug

SEQ ID NO: 2893338 - RNA, 19 nt, Human
uguccaaaggaggcuggca

SEQ ID NO: 2893339 - RNA, 14 nt, Human
uguccaacuaaaaa

SEQ ID NO: 2893340 - RNA, 22 nt, Human
uguccaacuaaaaacaaacccu

SEQ ID NO: 2893341 - RNA, 19 nt, Human
uguccaaagcagggucugg

SEQ ID NO: 2893342 - RNA, 21 nt, Human
uguccaaagaggcugccccuc

SEQ ID NO: 2893343 - RNA, 20 nt, Human
uguccaaagaggcugccccu

SEQ ID NO: 2893344 - RNA, 19 nt, Human
uguccaaagaggcugcccc

SEQ ID NO: 2893345 - RNA, 17 nt, Human
uguccaaagaggcugcc

SEQ ID NO: 2893346 - RNA, 11 nt, Human
uguccaaagag

SEQ ID NO: 2893347 - RNA, 15 nt, Human
agucaguguugagau

SEQ ID NO: 2893348 - RNA, 16 nt, Human
agucaguguugagaug

SEQ ID NO: 2893349 - RNA, 18 nt, Human
agucagcuuucaucuuug

SEQ ID NO: 2893350 - RNA, 17 nt, Human
agucagcucuucaucug

SEQ ID NO: 2893351 - RNA, 20 nt, Human
agucagcucuucaucugccc

SEQ ID NO: 2893352 - RNA, 22 nt, Human
agucagcucuucaucugcccaa

SEQ ID NO: 2893353 - RNA, 23 nt, Human
agucagccuucccccucccaggg

SEQ ID NO: 2893354 - RNA, 22 nt, Human
agucagccuucccccucccagg

SEQ ID NO: 2893355 - RNA, 20 nt, Human
agucacuucggccagagcug

SEQ ID NO: 2893356 - RNA, 16 nt, Human
agucacuuacuauugu

SEQ ID NO: 2893357 - RNA, 19 nt, Human
agucacuuacuauuguugc

SEQ ID NO: 2893358 - RNA, 18 nt, Human
agucagccaggagcuguc

SEQ ID NO: 2893359 - RNA, 21 nt, Human
agucagccgacaacuauuucg

SEQ ID NO: 2893360 - RNA, 13 nt, Human
agucagaaaacuu

SEQ ID NO: 2893361 - RNA, 15 nt, Human
agucagaaaacuuua

SEQ ID NO: 2893362 - RNA, 17 nt, Human
agucagaaaacuuuaaa

SEQ ID NO: 2893363 - RNA, 23 nt, Human
agucagaaaacuuuaaaaaauau

SEQ ID NO: 2893364 - RNA, 14 nt, Human
ugucccugggccag

SEQ ID NO: 2893365 - RNA, 15 nt, Human
ugucccugggccagg

SEQ ID NO: 2893366 - RNA, 20 nt, Human
ugucccugggccagggucug

SEQ ID NO: 2893367 - RNA, 18 nt, Human
ugucgcuuucccuuggau

SEQ ID NO: 2893368 - RNA, 14 nt, Human
ugucggaggaaaga

SEQ ID NO: 2893369 - RNA, 16 nt, Human
ugucggaggaaagaca

SEQ ID NO: 2893370 - RNA, 17 nt, Human
ugucggaggaaagacaa

SEQ ID NO: 2893371 - RNA, 19 nt, Human
ugucggaggaaagacaaca

SEQ ID NO: 2893372 - RNA, 14 nt, Human
ugucggcacauuca

SEQ ID NO: 2893373 - RNA, 14 nt, Human
ugucgccucugcau

SEQ ID NO: 2893374 - RNA, 13 nt, Human
ugucgccucugca

SEQ ID NO: 2893375 - RNA, 16 nt, Human
agucccaccuuggcug

SEQ ID NO: 2893376 - RNA, 15 nt, Human
agucccaccuuggcu

SEQ ID NO: 2893377 - RNA, 12 nt, Human
aguccauuuaua

SEQ ID NO: 2893378 - RNA, 16 nt, Human
aguccauuuauauaug

SEQ ID NO: 2893379 - RNA, 17 nt, Human
aguccauuuauauauga

SEQ ID NO: 2893380 - RNA, 18 nt, Human
aguccauuuauauaugaa

SEQ ID NO: 2893381 - RNA, 19 nt, Human
aguccauuuauauaugaaa

SEQ ID NO: 2893382 - RNA, 20 nt, Human
aguccauuuauauaugaaaa

SEQ ID NO: 2893383 - RNA, 22 nt, Human
aguccauuuauauaugaaaacu

SEQ ID NO: 2893384 - RNA, 20 nt, Human
aguccaugcaugacagccuc

SEQ ID NO: 2893385 - RNA, 21 nt, Human
aguccaugcaugacagccucu

SEQ ID NO: 2893386 - RNA, 22 nt, Human
aguccaugcaugacagccucua

SEQ ID NO: 2893387 - RNA, 17 nt, Human
agucccaaggaaagccc

SEQ ID NO: 2893388 - RNA, 14 nt, Human
agucccaaggaaag

SEQ ID NO: 2893389 - RNA, 14 nt, Human
agucauagaaauag

SEQ ID NO: 2893390 - RNA, 14 nt, Human
agucaguuucuaca

SEQ ID NO: 2893391 - RNA, 15 nt, Human
agucaguuucuacac

SEQ ID NO: 2893392 - RNA, 16 nt, Human
agucaguugaaauucu

SEQ ID NO: 2893393 - RNA, 14 nt, Human
agucaguuugcagu

SEQ ID NO: 2893394 - RNA, 19 nt, Human
agucccaccuuggcugcag

SEQ ID NO: 2893395 - RNA, 18 nt, Human
agucccaccuuggcugca

SEQ ID NO: 2893396 - RNA, 21 nt, Human
agucccaaggaaagccccagc

SEQ ID NO: 2893397 - RNA, 20 nt, Human
agucccaaggaaagccccag

SEQ ID NO: 2893398 - RNA, 13 nt, Human
agucccacugugc

SEQ ID NO: 2893399 - RNA, 19 nt, Human
agucccaggcugagccuca

SEQ ID NO: 2893400 - RNA, 20 nt, Human
aguccccccucccaccucca

SEQ ID NO: 2893401 - RNA, 21 nt, Human
aguccccccucccaccuccag

SEQ ID NO: 2893402 - RNA, 18 nt, Human
agucccccuauccuuggc

SEQ ID NO: 2893403 - RNA, 19 nt, Human
agucccccuauccuuggca

SEQ ID NO: 2893404 - RNA, 22 nt, Human
agucccccuauccuuggcacca

SEQ ID NO: 2893405 - RNA, 18 nt, Human
agucccccaacucugagc

SEQ ID NO: 2893406 - RNA, 19 nt, Human
agucccccaacucugagcc

SEQ ID NO: 2893407 - RNA, 22 nt, Human
agucccccaacucugagcccau

SEQ ID NO: 2893408 - RNA, 23 nt, Human
agucccccaacucugagcccaug

SEQ ID NO: 2893409 - RNA, 18 nt, Human
agucccccagagauguca

SEQ ID NO: 2893410 - RNA, 22 nt, Human
agucccagcuacucagaagccu

SEQ ID NO: 2893411 - RNA, 18 nt, Human
agucccaggcugagccuc

SEQ ID NO: 2893412 - RNA, 17 nt, Human
agucccaggcugagccu

SEQ ID NO: 2893413 - RNA, 19 nt, Human
agucucacuuugucgccca

SEQ ID NO: 2893414 - RNA, 17 nt, Human
agucucaaaaauacaaa

SEQ ID NO: 2893415 - RNA, 21 nt, Human
agucucacuguugcccaggcu

SEQ ID NO: 2893416 - RNA, 15 nt, Human
ugucucaguuggaaa

SEQ ID NO: 2893417 - RNA, 16 nt, Human
ugucucaguuggaaau

SEQ ID NO: 2893418 - RNA, 23 nt, Human
ugucucauccccaggggucccag

SEQ ID NO: 2893419 - RNA, 14 nt, Human
ugucucauccuccu

SEQ ID NO: 2893420 - RNA, 15 nt, Human
ugucucauccuccug

SEQ ID NO: 2893421 - RNA, 18 nt, Human
ugucucauccuccuggaa

SEQ ID NO: 2893422 - RNA, 19 nt, Human
ugucucauccuccuggaac

SEQ ID NO: 2893423 - RNA, 14 nt, Human
ugucucauuuuaau

SEQ ID NO: 2893424 - RNA, 23 nt, Human
ugucucauuuuaauguaaagauu

SEQ ID NO: 2893425 - RNA, 16 nt, Human
ugucucauccccaggg

SEQ ID NO: 2893426 - RNA, 13 nt, Human
ugucucaucccca

SEQ ID NO: 2893427 - RNA, 13 nt, Human
ugucuccacugug

SEQ ID NO: 2893428 - RNA, 14 nt, Human
ugucuccacugugc

SEQ ID NO: 2893429 - RNA, 23 nt, Human
agucucacuguugcccaggcugg

SEQ ID NO: 2893430 - RNA, 18 nt, Human
agucuaucuaaugacaug

SEQ ID NO: 2893431 - RNA, 11 nt, Human
agucuauggcc

SEQ ID NO: 2893432 - RNA, 23 nt, Human
agucuauggccagguaugcaugg

SEQ ID NO: 2893433 - RNA, 22 nt, Human
aguccguguggauccaauguua

SEQ ID NO: 2893434 - RNA, 23 nt, Human
agucuaaauauucagaaucuuug

SEQ ID NO: 2893435 - RNA, 15 nt, Human
agucuacgcucuccu

SEQ ID NO: 2893436 - RNA, 14 nt, Human
agucuacgcucucc

SEQ ID NO: 2893437 - RNA, 12 nt, Human
agucuaguguag

SEQ ID NO: 2893438 - RNA, 15 nt, Human
agucuaguguaguau

SEQ ID NO: 2893439 - RNA, 17 nt, Human
agucuacgcucuccuuu

SEQ ID NO: 2893440 - RNA, 23 nt, Human
agucgauuauuuccaguguucua

SEQ ID NO: 2893441 - RNA, 12 nt, Human
aguccuccccuc

SEQ ID NO: 2893442 - RNA, 13 nt, Human
aguccuccccuca

SEQ ID NO: 2893443 - RNA, 14 nt, Human
aguccuccccucac

SEQ ID NO: 2893444 - RNA, 15 nt, Human
aguccuccccucaca

SEQ ID NO: 2893445 - RNA, 16 nt, Human
aguccuccccucacag

SEQ ID NO: 2893446 - RNA, 18 nt, Human
aguccuccccucacagcc

SEQ ID NO: 2893447 - RNA, 19 nt, Human
aguccuccccucacagccu

SEQ ID NO: 2893448 - RNA, 15 nt, Human
agucggaacagcaga

SEQ ID NO: 2893449 - RNA, 23 nt, Human
agucuaaagauggaguuucuaag

SEQ ID NO: 2893450 - RNA, 22 nt, Human
agucgucaucacuuuucaguga

SEQ ID NO: 2893451 - RNA, 18 nt, Human
aguccucacucccagucc

SEQ ID NO: 2893452 - RNA, 17 nt, Human
aguccucacucccaguc

SEQ ID NO: 2893453 - RNA, 16 nt, Human
aguccucacucccagu

SEQ ID NO: 2893454 - RNA, 15 nt, Human
aguccucacucccag

SEQ ID NO: 2893455 - RNA, 14 nt, Human
aguccuauggaaac

SEQ ID NO: 2893456 - RNA, 15 nt, Human
aguccuauggaaacc

SEQ ID NO: 2893457 - RNA, 13 nt, Human
aguccuagugaac

SEQ ID NO: 2893458 - RNA, 16 nt, Human
aguccuagugaaccuc

SEQ ID NO: 2893459 - RNA, 17 nt, Human
aguccuagccacucagg

SEQ ID NO: 2893460 - RNA, 16 nt, Human
agucccccugccccag

SEQ ID NO: 2893461 - RNA, 18 nt, Human
aguccccgggcaucuuug

SEQ ID NO: 2893462 - RNA, 19 nt, Human
aguccccgggcaucuuugg

SEQ ID NO: 2893463 - RNA, 22 nt, Human
aguccccgggcaucuuugggga

SEQ ID NO: 2893464 - RNA, 16 nt, Human
aguccccucaccuccu

SEQ ID NO: 2893465 - RNA, 16 nt, Human
aguccccguggccauc

SEQ ID NO: 2893466 - RNA, 22 nt, Human
aguccccguggccaucccugug

SEQ ID NO: 2893467 - RNA, 23 nt, Human
aggugcuaaauggucgcccagga

SEQ ID NO: 2893468 - RNA, 15 nt, Human
aggugccuuucaaau

SEQ ID NO: 2893469 - RNA, 18 nt, Human
aggugccuuucaaauuua

SEQ ID NO: 2893470 - RNA, 19 nt, Human
aggugccuuucaaauuuag

SEQ ID NO: 2893471 - RNA, 21 nt, Human
aggugcgaaugacaguagcau

SEQ ID NO: 2893472 - RNA, 15 nt, Human
aggugcuaaaucugc

SEQ ID NO: 2893473 - RNA, 13 nt, Human
aggugggagcagg

SEQ ID NO: 2893474 - RNA, 14 nt, Human
aggugggagcagga

SEQ ID NO: 2893475 - RNA, 15 nt, Human
aggugggagcaggag

SEQ ID NO: 2893476 - RNA, 16 nt, Human
aggugggagcaggaga

SEQ ID NO: 2893477 - RNA, 17 nt, Human
aggugggagcaggagau

SEQ ID NO: 2893478 - RNA, 20 nt, Human
aggugggagcaggagauuga

SEQ ID NO: 2893479 - RNA, 15 nt, Human
aggugggcugagccc

SEQ ID NO: 2893480 - RNA, 17 nt, Human
aggugggcugagcccug

SEQ ID NO: 2893481 - RNA, 16 nt, Human
aggugggcugagcccu

SEQ ID NO: 2893482 - RNA, 21 nt, Human
ugggcucugccccagcucugg

SEQ ID NO: 2893483 - RNA, 20 nt, Human
ugggcucugccccagcucug

SEQ ID NO: 2893484 - RNA, 23 nt, Human
ugggcucugccccagcucuggcu

SEQ ID NO: 2893485 - RNA, 19 nt, Human
ugggcucugccccagcucu

SEQ ID NO: 2893486 - RNA, 17 nt, Human
ugggcucugccccagcu

SEQ ID NO: 2893487 - RNA, 15 nt, Human
ugggcucugccccag

SEQ ID NO: 2893488 - RNA, 12 nt, Human
ugggcucugccc

SEQ ID NO: 2893489 - RNA, 20 nt, Human
ugggcucugcaauuccccuc

SEQ ID NO: 2893490 - RNA, 22 nt, Human
ugggcucugcaauuccccucug

SEQ ID NO: 2893491 - RNA, 13 nt, Human
ugggcugcccugg

SEQ ID NO: 2893492 - RNA, 14 nt, Human
ugggcugcccuggu

SEQ ID NO: 2893493 - RNA, 13 nt, Human
aggugccuucuuc

SEQ ID NO: 2893494 - RNA, 16 nt, Human
aggugccuucuucagg

SEQ ID NO: 2893495 - RNA, 17 nt, Human
aggugccuucuucaggg

SEQ ID NO: 2893496 - RNA, 18 nt, Human
aggugccuucuucagggc

SEQ ID NO: 2893497 - RNA, 20 nt, Human
aggugccuucuucagggccu

SEQ ID NO: 2893498 - RNA, 21 nt, Human
aggugccuucuucagggccug

SEQ ID NO: 2893499 - RNA, 22 nt, Human
aggugccuucuucagggccugg

SEQ ID NO: 2893500 - RNA, 23 nt, Human
aggugccuucuucagggccuggu

SEQ ID NO: 2893501 - RNA, 11 nt, Human
aggugccuucu

SEQ ID NO: 2893502 - RNA, 15 nt, Human
ugggcugcccuggug

SEQ ID NO: 2893503 - RNA, 14 nt, Human
agguugaagcacca

SEQ ID NO: 2893504 - RNA, 20 nt, Human
agguugcauugagcugagau

SEQ ID NO: 2893505 - RNA, 16 nt, Human
agguugcuguuucaca

SEQ ID NO: 2893506 - RNA, 14 nt, Human
agguuggaagagaa

SEQ ID NO: 2893507 - RNA, 15 nt, Human
agguuggaagagaau

SEQ ID NO: 2893508 - RNA, 17 nt, Human
agguuggaagagaauca

SEQ ID NO: 2893509 - RNA, 18 nt, Human
agguuggaagagaaucac

SEQ ID NO: 2893510 - RNA, 19 nt, Human
agguucuucaucccuuucc

SEQ ID NO: 2893511 - RNA, 22 nt, Human
aggugugagucaccaagcccag

SEQ ID NO: 2893512 - RNA, 21 nt, Human
aggugugagucaccaagccca

SEQ ID NO: 2893513 - RNA, 20 nt, Human
aggugucccugcacuugcag

SEQ ID NO: 2893514 - RNA, 16 nt, Human
aggugucccugcacuu

SEQ ID NO: 2893515 - RNA, 20 nt, Human
aggugggcugagcccuggca

SEQ ID NO: 2893516 - RNA, 19 nt, Human
aggugggcugagcccuggc

SEQ ID NO: 2893517 - RNA, 18 nt, Human
aggugggcugagcccugg

SEQ ID NO: 2893518 - RNA, 15 nt, Human
aggugggcuucccag

SEQ ID NO: 2893519 - RNA, 21 nt, Human
aggugggcuucccaguggcug

SEQ ID NO: 2893520 - RNA, 18 nt, Human
aggugggcuucaguaagu

SEQ ID NO: 2893521 - RNA, 13 nt, Human
agguggggacagg

SEQ ID NO: 2893522 - RNA, 14 nt, Human
agguggggacaggg

SEQ ID NO: 2893523 - RNA, 13 nt, Human
agguguauuuaaa

SEQ ID NO: 2893524 - RNA, 13 nt, Human
aggugucacaugg

SEQ ID NO: 2893525 - RNA, 23 nt, Human
aggugucagccauugcacccagc

SEQ ID NO: 2893526 - RNA, 17 nt, Human
agguggggacagggaug

SEQ ID NO: 2893527 - RNA, 19 nt, Human
uguaauugacgguuuuuua

SEQ ID NO: 2893528 - RNA, 23 nt, Human
uguaauugacgguuuuuuauuau

SEQ ID NO: 2893529 - RNA, 14 nt, Human
uguaauucuucagu

SEQ ID NO: 2893530 - RNA, 16 nt, Human
uguaauugcuuuuuua

SEQ ID NO: 2893531 - RNA, 18 nt, Human
uguaauuguaauuuugaa

SEQ ID NO: 2893532 - RNA, 13 nt, Human
uguaauucagugu

SEQ ID NO: 2893533 - RNA, 14 nt, Human
uguaauucagugua

SEQ ID NO: 2893534 - RNA, 21 nt, Human
uguaaggcuuguuccaaugcc

SEQ ID NO: 2893535 - RNA, 18 nt, Human
agguuucuggucucuagg

SEQ ID NO: 2893536 - RNA, 14 nt, Human
uguaaggcucuaga

SEQ ID NO: 2893537 - RNA, 15 nt, Human
uguaaggcucuagau

SEQ ID NO: 2893538 - RNA, 18 nt, Human
uguaaggcucuagaucau

SEQ ID NO: 2893539 - RNA, 13 nt, Human
agguuucaaagau

SEQ ID NO: 2893540 - RNA, 14 nt, Human
agguuucaaagaug

SEQ ID NO: 2893541 - RNA, 16 nt, Human
agguuggaccccagag

SEQ ID NO: 2893542 - RNA, 17 nt, Human
agguuggaccccagaga

SEQ ID NO: 2893543 - RNA, 17 nt, Human
agguuucguuucuguau

SEQ ID NO: 2893544 - RNA, 17 nt, Human
agguuucaaagaugcug

SEQ ID NO: 2893545 - RNA, 16 nt, Human
agguuucccaauggug

SEQ ID NO: 2893546 - RNA, 18 nt, Human
agguuucccaaugguguu

SEQ ID NO: 2893547 - RNA, 11 nt, Human
uguacauaaaa

SEQ ID NO: 2893548 - RNA, 13 nt, Human
uguacauaaaaga

SEQ ID NO: 2893549 - RNA, 16 nt, Human
uguacauaaaagaauu

SEQ ID NO: 2893550 - RNA, 18 nt, Human
uguacauaaaagaauuuu

SEQ ID NO: 2893551 - RNA, 14 nt, Human
uguacauaaacaau

SEQ ID NO: 2893552 - RNA, 19 nt, Human
uguacauaaacaaugaugc

SEQ ID NO: 2893553 - RNA, 23 nt, Human
uguacauaaauugcauaaagcau

SEQ ID NO: 2893554 - RNA, 14 nt, Human
uguacauaacucug

SEQ ID NO: 2893555 - RNA, 23 nt, Human
uguacauaacucuguaaaaacac

SEQ ID NO: 2893556 - RNA, 17 nt, Human
uguacaaaauaaacaaa

SEQ ID NO: 2893557 - RNA, 13 nt, Human
uguacaaaauaaa

SEQ ID NO: 2893558 - RNA, 15 nt, Human
uguaauuguuccuuu

SEQ ID NO: 2893559 - RNA, 16 nt, Human
uguaauuguuccuuuu

SEQ ID NO: 2893560 - RNA, 19 nt, Human
uguaauuguuccuuuuauu

SEQ ID NO: 2893561 - RNA, 22 nt, Human
uguaauuuuucagcucucugua

SEQ ID NO: 2893562 - RNA, 21 nt, Human
uguacaucuauuuuggauugu

SEQ ID NO: 2893563 - RNA, 20 nt, Human
uguacaucuauuuuggauug

SEQ ID NO: 2893564 - RNA, 19 nt, Human
uguacaucuauuuuggauu

SEQ ID NO: 2893565 - RNA, 18 nt, Human
uguacaucuauuuuggau

SEQ ID NO: 2893566 - RNA, 14 nt, Human
uguacaucuggccu

SEQ ID NO: 2893567 - RNA, 14 nt, Human
uguacaucuggcuu

SEQ ID NO: 2893568 - RNA, 15 nt, Human
uguacaucuggcuua

SEQ ID NO: 2893569 - RNA, 16 nt, Human
uguacaucuggcuuau

SEQ ID NO: 2893570 - RNA, 17 nt, Human
uguacaucuggcuuauu

SEQ ID NO: 2893571 - RNA, 21 nt, Human
uguacaucuggcuuauuuuaa

SEQ ID NO: 2893572 - RNA, 23 nt, Human
uguacaucuauuuuggauuguau

SEQ ID NO: 2893573 - RNA, 21 nt, Human
uguacauacccuggccgcccc

SEQ ID NO: 2893574 - RNA, 22 nt, Human
uguacauaaugcuuaauuucua

SEQ ID NO: 2893575 - RNA, 23 nt, Human
uguacauaaugcuuaauuucuaa

SEQ ID NO: 2893576 - RNA, 18 nt, Human
uguacauaguuauuuauu

SEQ ID NO: 2893577 - RNA, 15 nt, Human
uguacauaguguaau

SEQ ID NO: 2893578 - RNA, 16 nt, Human
uguacauaguguaaug

SEQ ID NO: 2893579 - RNA, 14 nt, Human
uguagugauucaaa

SEQ ID NO: 2893580 - RNA, 15 nt, Human
uguauaguguaaaau

SEQ ID NO: 2893581 - RNA, 16 nt, Human
uguauaguguaaaaua

SEQ ID NO: 2893582 - RNA, 24 nt, Human
uguauaguguaaaauaagaaugau

SEQ ID NO: 2893583 - RNA, 13 nt, Human
uguauaguugcuu

SEQ ID NO: 2893584 - RNA, 14 nt, Human
uguauaguugcuuu

SEQ ID NO: 2893585 - RNA, 15 nt, Human
uguauaguugcuuuu

SEQ ID NO: 2893586 - RNA, 17 nt, Human
uguauaguugcuuuuga

SEQ ID NO: 2893587 - RNA, 20 nt, Human
uguauaguuaggauagcauu

SEQ ID NO: 2893588 - RNA, 17 nt, Human
uguauauacaauaacau

SEQ ID NO: 2893589 - RNA, 18 nt, Human
uguauauacaauaacaua

SEQ ID NO: 2893590 - RNA, 13 nt, Human
uguauauacacau

SEQ ID NO: 2893591 - RNA, 14 nt, Human
uguauauacacaua

SEQ ID NO: 2893592 - RNA, 16 nt, Human
uguauauacacauaua

SEQ ID NO: 2893593 - RNA, 17 nt, Human
uguauauacacauauac

SEQ ID NO: 2893594 - RNA, 18 nt, Human
uguauauacacauauacc

SEQ ID NO: 2893595 - RNA, 19 nt, Human
uguauauacacauauaccu

SEQ ID NO: 2893596 - RNA, 20 nt, Human
uguauauacacauauaccua

SEQ ID NO: 2893597 - RNA, 15 nt, Human
uguauauacauauau

SEQ ID NO: 2893598 - RNA, 16 nt, Human
uguauauacaauaaca

SEQ ID NO: 2893599 - RNA, 15 nt, Human
uguauauacaauaac

SEQ ID NO: 2893600 - RNA, 17 nt, Human
uguauaguuuucccuau

SEQ ID NO: 2893601 - RNA, 14 nt, Human
uguauauaaauggg

SEQ ID NO: 2893602 - RNA, 18 nt, Human
uguauauaaaugggaaca

SEQ ID NO: 2893603 - RNA, 19 nt, Human
uguauauaaaugggaacau

SEQ ID NO: 2893604 - RNA, 20 nt, Human
uguauauaaaugggaacauu

SEQ ID NO: 2893605 - RNA, 17 nt, Human
uguauauaucugcuuca

SEQ ID NO: 2893606 - RNA, 14 nt, Human
uguauauaugugua

SEQ ID NO: 2893607 - RNA, 15 nt, Human
uguauauauguguau

SEQ ID NO: 2893608 - RNA, 16 nt, Human
uguauauauguguaua

SEQ ID NO: 2893609 - RNA, 18 nt, Human
uguauauauguguauaua

SEQ ID NO: 2893610 - RNA, 20 nt, Human
uguauauauguguauauaua

SEQ ID NO: 2893611 - RNA, 21 nt, Human
uguauauauguguauauauac

SEQ ID NO: 2893612 - RNA, 22 nt, Human
uguauauauguguauauauaca

SEQ ID NO: 2893613 - RNA, 23 nt, Human
uguauauauguguauauauacau

SEQ ID NO: 2893614 - RNA, 17 nt, Human
uguauauauauuaagag

SEQ ID NO: 2893615 - RNA, 14 nt, Human
uguauauauaugug

SEQ ID NO: 2893616 - RNA, 21 nt, Human
uguauauauaugugaggaugu

SEQ ID NO: 2893617 - RNA, 17 nt, Human
uguauauauacauacac

SEQ ID NO: 2893618 - RNA, 18 nt, Human
uguauauauacauacacu

SEQ ID NO: 2893619 - RNA, 19 nt, Human
uguauauauacauacacuu

SEQ ID NO: 2893620 - RNA, 20 nt, Human
uguauauauacauacacuug

SEQ ID NO: 2893621 - RNA, 14 nt, Human
uguauauauacaua

SEQ ID NO: 2893622 - RNA, 13 nt, Human
uguauauauacau

SEQ ID NO: 2893623 - RNA, 13 nt, Human
uguauauacuuuu

SEQ ID NO: 2893624 - RNA, 14 nt, Human
uguauauaguuuuu

SEQ ID NO: 2893625 - RNA, 11 nt, Human
uguauauauac

SEQ ID NO: 2893626 - RNA, 12 nt, Human
uguauauacuuu

SEQ ID NO: 2893627 - RNA, 17 nt, Human
uguauauacgcaucuau

SEQ ID NO: 2893628 - RNA, 21 nt, Human
uguauauacgcaucuauaaau

SEQ ID NO: 2893629 - RNA, 16 nt, Human
uguauauauuuagugc

SEQ ID NO: 2893630 - RNA, 18 nt, Human
uguauauauuuagugcug

SEQ ID NO: 2893631 - RNA, 18 nt, Human
uguauauccuuucuaaca

SEQ ID NO: 2893632 - RNA, 13 nt, Human
uguauaucagaaa

SEQ ID NO: 2893633 - RNA, 14 nt, Human
uguauaucagaaaa

SEQ ID NO: 2893634 - RNA, 18 nt, Human
uguauaucagaaaaggga

SEQ ID NO: 2893635 - RNA, 23 nt, Human
uguaguccuagccacucaggagg

SEQ ID NO: 2893636 - RNA, 13 nt, Human
uguagguaaaaug

SEQ ID NO: 2893637 - RNA, 15 nt, Human
uguagguaaaaugua

SEQ ID NO: 2893638 - RNA, 19 nt, Human
uguagguaaaauguauuuu

SEQ ID NO: 2893639 - RNA, 14 nt, Human
uguagucauuuacu

SEQ ID NO: 2893640 - RNA, 15 nt, Human
uguagucauuuacua

SEQ ID NO: 2893641 - RNA, 19 nt, Human
uguagucauuuacuaaaca

SEQ ID NO: 2893642 - RNA, 20 nt, Human
uguagucauuuacuaaacau

SEQ ID NO: 2893643 - RNA, 24 nt, Human
uguagucauuuacuaaacauauga

SEQ ID NO: 2893644 - RNA, 16 nt, Human
uguaggguuacagaga

SEQ ID NO: 2893645 - RNA, 22 nt, Human
aguagauucuggacagucagcu

SEQ ID NO: 2893646 - RNA, 20 nt, Human
aguagauuuacagaacaaag

SEQ ID NO: 2893647 - RNA, 15 nt, Human
aguaccacucaggcc

SEQ ID NO: 2893648 - RNA, 14 nt, Human
aguaccagcgcucu

SEQ ID NO: 2893649 - RNA, 21 nt, Human
aguaccagcgcucuaaaagca

SEQ ID NO: 2893650 - RNA, 22 nt, Human
aguaccagcgcucuaaaagcac

SEQ ID NO: 2893651 - RNA, 23 nt, Human
aguaccaguaggggcuuauaaua

SEQ ID NO: 2893652 - RNA, 15 nt, Human
aguaccaaaguuuua

SEQ ID NO: 2893653 - RNA, 18 nt, Human
aguaccaaaguuuuauca

SEQ ID NO: 2893654 - RNA, 19 nt, Human
aguaccaaaguuuuaucaa

SEQ ID NO: 2893655 - RNA, 19 nt, Human
aguaaguaccacucaggcc

SEQ ID NO: 2893656 - RNA, 20 nt, Human
aguaaguaccacucaggcca

SEQ ID NO: 2893657 - RNA, 13 nt, Human
aguaauagagcaa

SEQ ID NO: 2893658 - RNA, 14 nt, Human
uguacauagauuua

SEQ ID NO: 2893659 - RNA, 17 nt, Human
aguaauaaacuguguuu

SEQ ID NO: 2893660 - RNA, 14 nt, Human
aguaaguucagcac

SEQ ID NO: 2893661 - RNA, 17 nt, Human
aguaaguucagcacuug

SEQ ID NO: 2893662 - RNA, 16 nt, Human
aguaauaaacuguguu

SEQ ID NO: 2893663 - RNA, 16 nt, Human
uguacaugagaaggaa

SEQ ID NO: 2893664 - RNA, 14 nt, Human
uguacaugcauuca

SEQ ID NO: 2893665 - RNA, 12 nt, Human
uguacaugaaau

SEQ ID NO: 2893666 - RNA, 18 nt, Human
uguacaugaaauuuuugu

SEQ ID NO: 2893667 - RNA, 19 nt, Human
uguacaugaaauuuuugua

SEQ ID NO: 2893668 - RNA, 20 nt, Human
uguacaugaaauuuuuguaa

SEQ ID NO: 2893669 - RNA, 17 nt, Human
uguacauggcagaguuu

SEQ ID NO: 2893670 - RNA, 19 nt, Human
uguacauggcagaguuugu

SEQ ID NO: 2893671 - RNA, 11 nt, Human
uguacaugugu

SEQ ID NO: 2893672 - RNA, 19 nt, Human
agguuuuuguuuguuuccu

SEQ ID NO: 2893673 - RNA, 22 nt, Human
agguuuuuuuguauaguaaagu

SEQ ID NO: 2893674 - RNA, 22 nt, Human
agguuuuuuugucaacauugug

SEQ ID NO: 2893675 - RNA, 21 nt, Human
agguuuuuuuguauaguaaag

SEQ ID NO: 2893676 - RNA, 19 nt, Human
aguaauucaagaaaacaac

SEQ ID NO: 2893677 - RNA, 14 nt, Human
aguaauucucaggc

SEQ ID NO: 2893678 - RNA, 20 nt, Human
aguaauugacaugugccagg

SEQ ID NO: 2893679 - RNA, 18 nt, Human
aguaauugacaugugcca

SEQ ID NO: 2893680 - RNA, 19 nt, Human
aguaaucuaauauggccac

SEQ ID NO: 2893681 - RNA, 13 nt, Human
aguaaucuguaca

SEQ ID NO: 2893682 - RNA, 14 nt, Human
aguaaucuguacau

SEQ ID NO: 2893683 - RNA, 15 nt, Human
aguaaucuguacauu

SEQ ID NO: 2893684 - RNA, 18 nt, Human
aguaaucuguacauuuug

SEQ ID NO: 2893685 - RNA, 19 nt, Human
aguaaucuguacauuuugu

SEQ ID NO: 2893686 - RNA, 21 nt, Human
aguaaucuguacauuuuguug

SEQ ID NO: 2893687 - RNA, 23 nt, Human
aguaaucuguacauuuuguugua

SEQ ID NO: 2893688 - RNA, 19 nt, Human
aguacacuuuuaugagcuu

SEQ ID NO: 2893689 - RNA, 19 nt, Human
aguacauuuggagacacaa

SEQ ID NO: 2893690 - RNA, 15 nt, Human
aguacagcaugugcc

SEQ ID NO: 2893691 - RNA, 16 nt, Human
aguacagcaugugccu

SEQ ID NO: 2893692 - RNA, 22 nt, Human
aguguucuguuuguuauuguuu

SEQ ID NO: 2893693 - RNA, 16 nt, Human
aguguugaaaauguuc

SEQ ID NO: 2893694 - RNA, 18 nt, Human
aguguucugccagaucuu

SEQ ID NO: 2893695 - RNA, 13 nt, Human
aguguucugucua

SEQ ID NO: 2893696 - RNA, 15 nt, Human
aguguucgcuuggcu

SEQ ID NO: 2893697 - RNA, 20 nt, Human
aguguguguggcagcaggca

SEQ ID NO: 2893698 - RNA, 14 nt, Human
agugugugugugca

SEQ ID NO: 2893699 - RNA, 16 nt, Human
agugugugugugcaug

SEQ ID NO: 2893700 - RNA, 18 nt, Human
agugugugugugcaugug

SEQ ID NO: 2893701 - RNA, 20 nt, Human
agugugugugugcaugugug

SEQ ID NO: 2893702 - RNA, 23 nt, Human
aguguugguuuaauauuaccuaa

SEQ ID NO: 2893703 - RNA, 16 nt, Human
aguuagcucaggaggc

SEQ ID NO: 2893704 - RNA, 14 nt, Human
aguuagcucaggag

SEQ ID NO: 2893705 - RNA, 12 nt, Human
aguuagagcuga

SEQ ID NO: 2893706 - RNA, 15 nt, Human
aguuagcaaacuuug

SEQ ID NO: 2893707 - RNA, 16 nt, Human
aguuagcaaacuuugu

SEQ ID NO: 2893708 - RNA, 22 nt, Human
aguuagcaaacuuuguauguca

SEQ ID NO: 2893709 - RNA, 23 nt, Human
aguuacuaucaugucaaacguga

SEQ ID NO: 2893710 - RNA, 16 nt, Human
uguucuaacauguaau

SEQ ID NO: 2893711 - RNA, 13 nt, Human
uguucuaagaugu

SEQ ID NO: 2893712 - RNA, 14 nt, Human
uguucuaagaugug

SEQ ID NO: 2893713 - RNA, 18 nt, Human
uguucuaaagcucugaca

SEQ ID NO: 2893714 - RNA, 19 nt, Human
uguucuaaagcucugacau

SEQ ID NO: 2893715 - RNA, 17 nt, Human
uguugcacugaaaugga

SEQ ID NO: 2893716 - RNA, 23 nt, Human
uguugcacacccacucagcuccg

SEQ ID NO: 2893717 - RNA, 22 nt, Human
uguucuaagaugugauauucua

SEQ ID NO: 2893718 - RNA, 10 nt, Human
uguucuaagg

SEQ ID NO: 2893719 - RNA, 16 nt, Human
uguucuaagaugugau

SEQ ID NO: 2893720 - RNA, 12 nt, Human
uguucuaaggcu

SEQ ID NO: 2893721 - RNA, 14 nt, Human
uguugcauguuuga

SEQ ID NO: 2893722 - RNA, 15 nt, Human
uguugcauguuugaa

SEQ ID NO: 2893723 - RNA, 16 nt, Human
uguugcauuauucauu

SEQ ID NO: 2893724 - RNA, 18 nt, Human
uguugcauuauucauuua

SEQ ID NO: 2893725 - RNA, 20 nt, Human
uguugcauuauucauuuagu

SEQ ID NO: 2893726 - RNA, 20 nt, Human
uguugcccaggcuggcgugc

SEQ ID NO: 2893727 - RNA, 23 nt, Human
uguugcccaggcuggcgugcagu

SEQ ID NO: 2893728 - RNA, 15 nt, Human
uguugccauguguuu

SEQ ID NO: 2893729 - RNA, 23 nt, Human
uguugcccaacuacuaucucaga

SEQ ID NO: 2893730 - RNA, 14 nt, Human
uguugccauguguu

SEQ ID NO: 2893731 - RNA, 22 nt, Human
uguugccuaaguauuaaaacau

SEQ ID NO: 2893732 - RNA, 15 nt, Human
uguugcccuuucugu

SEQ ID NO: 2893733 - RNA, 21 nt, Human
uguugcccuuucuguaccauu

SEQ ID NO: 2893734 - RNA, 12 nt, Human
uguugccuaagu

SEQ ID NO: 2893735 - RNA, 16 nt, Human
agugugugguguuagg

SEQ ID NO: 2893736 - RNA, 16 nt, Human
uguuccaaggccaggg

SEQ ID NO: 2893737 - RNA, 15 nt, Human
uguuccaaguuucca

SEQ ID NO: 2893738 - RNA, 17 nt, Human
uguuccaaguuuccaaa

SEQ ID NO: 2893739 - RNA, 15 nt, Human
uguuccaaugccaca

SEQ ID NO: 2893740 - RNA, 20 nt, Human
uguuccaaugccacauacuu

SEQ ID NO: 2893741 - RNA, 21 nt, Human
uguuccaaugccacauacuug

SEQ ID NO: 2893742 - RNA, 18 nt, Human
uguuccaaugucaaugug

SEQ ID NO: 2893743 - RNA, 17 nt, Human
uguucgguuuuuuuccu

SEQ ID NO: 2893744 - RNA, 21 nt, Human
uguucgguuuuuuuccuguuu

SEQ ID NO: 2893745 - RNA, 19 nt, Human
uguucguugguuauacaag

SEQ ID NO: 2893746 - RNA, 13 nt, Human
uguucuaaagcuc

SEQ ID NO: 2893747 - RNA, 14 nt, Human
uguucuaaagcucu

SEQ ID NO: 2893748 - RNA, 16 nt, Human
uguucuaaagcucuga

SEQ ID NO: 2893749 - RNA, 14 nt, Human
uguucgcuuggcuc

SEQ ID NO: 2893750 - RNA, 19 nt, Human
uguucgcuuggcuccaugc

SEQ ID NO: 2893751 - RNA, 23 nt, Human
uguucgcauggucacacacugau

SEQ ID NO: 2893752 - RNA, 22 nt, Human
uguucgcauggucacacacuga

SEQ ID NO: 2893753 - RNA, 20 nt, Human
uguucgcauggucacacacu

SEQ ID NO: 2893754 - RNA, 19 nt, Human
uguuccuuagaccuuccau

SEQ ID NO: 2893755 - RNA, 20 nt, Human
uguuaugacuauguaaacua

SEQ ID NO: 2893756 - RNA, 18 nt, Human
uguuaugacuauguaaac

SEQ ID NO: 2893757 - RNA, 17 nt, Human
uguuaugacuauguaaa

SEQ ID NO: 2893758 - RNA, 16 nt, Human
uguuaugacuauguaa

SEQ ID NO: 2893759 - RNA, 16 nt, Human
aguguguaugccaaga

SEQ ID NO: 2893760 - RNA, 13 nt, Human
uguuaugaaauaa

SEQ ID NO: 2893761 - RNA, 16 nt, Human
uguuaugaaauaaaga

SEQ ID NO: 2893762 - RNA, 21 nt, Human
uguuaugaaauaaagaaauug

SEQ ID NO: 2893763 - RNA, 22 nt, Human
uguuaucuucucaaguucuaag

SEQ ID NO: 2893764 - RNA, 23 nt, Human
uguuaucuucucaaguucuaaga

SEQ ID NO: 2893765 - RNA, 14 nt, Human
agugugggaggcuc

SEQ ID NO: 2893766 - RNA, 16 nt, Human
agugugggaggcuccu

SEQ ID NO: 2893767 - RNA, 18 nt, Human
agugugggaggcuccugu

SEQ ID NO: 2893768 - RNA, 20 nt, Human
agugugggaggcuccuguua

SEQ ID NO: 2893769 - RNA, 20 nt, Human
aguguggcugaggaggccuc

SEQ ID NO: 2893770 - RNA, 14 nt, Human
aguguggacucugg

SEQ ID NO: 2893771 - RNA, 12 nt, Human
aguguggagugg

SEQ ID NO: 2893772 - RNA, 17 nt, Human
aguguggaguggguaau

SEQ ID NO: 2893773 - RNA, 22 nt, Human
aguguggaguggguaauccagg

SEQ ID NO: 2893774 - RNA, 19 nt, Human
agugugcugcuguaagaaa

SEQ ID NO: 2893775 - RNA, 20 nt, Human
agugugcugcuguaagaaau

SEQ ID NO: 2893776 - RNA, 16 nt, Human
agugugacagggccag

SEQ ID NO: 2893777 - RNA, 17 nt, Human
agugugacagggccagu

SEQ ID NO: 2893778 - RNA, 22 nt, Human
agugugacagggccaguggggc

SEQ ID NO: 2893779 - RNA, 17 nt, Human
agugguccacaucccgg

SEQ ID NO: 2893780 - RNA, 19 nt, Human
uguuaacucuugucuauuu

SEQ ID NO: 2893781 - RNA, 22 nt, Human
uguguuaaguauguguaaaaug

SEQ ID NO: 2893782 - RNA, 23 nt, Human
uguuaagcagauggaaugcugug

SEQ ID NO: 2893783 - RNA, 17 nt, Human
uguuaagaaaucuguuu

SEQ ID NO: 2893784 - RNA, 15 nt, Human
uguuaagaauugacc

SEQ ID NO: 2893785 - RNA, 23 nt, Human
uguuaagaauugaccaucugcuu

SEQ ID NO: 2893786 - RNA, 22 nt, Human
uguuaacugagugccuuuuggu

SEQ ID NO: 2893787 - RNA, 16 nt, Human
uguuaacugagugccu

SEQ ID NO: 2893788 - RNA, 16 nt, Human
uguuacacaaugguuu

SEQ ID NO: 2893789 - RNA, 22 nt, Human
uguuacacaaugguuuuuaaau

SEQ ID NO: 2893790 - RNA, 22 nt, Human
uguuaaguugauggugaugaaa

SEQ ID NO: 2893791 - RNA, 18 nt, Human
uguuaagcagcuaaauuu

SEQ ID NO: 2893792 - RNA, 23 nt, Human
uguuaagcagcuaaauuuucuga

SEQ ID NO: 2893793 - RNA, 22 nt, Human
agugggcuugauucugcaguaa

SEQ ID NO: 2893794 - RNA, 16 nt, Human
agugggcuugauucug

SEQ ID NO: 2893795 - RNA, 15 nt, Human
aguggggacagagca

SEQ ID NO: 2893796 - RNA, 14 nt, Human
aguggggaggggcu

SEQ ID NO: 2893797 - RNA, 12 nt, Human
aguggauguaua

SEQ ID NO: 2893798 - RNA, 18 nt, Human
agugggguuaucucugug

SEQ ID NO: 2893799 - RNA, 19 nt, Human
agugggguuaucucugugu

SEQ ID NO: 2893800 - RNA, 16 nt, Human
aguggggcagagccuc

SEQ ID NO: 2893801 - RNA, 23 nt, Human
uguuacagccaagugccaaaugc

SEQ ID NO: 2893802 - RNA, 14 nt, Human
aguggauugcauuu

SEQ ID NO: 2893803 - RNA, 21 nt, Human
aguggauuguaggugcaagau

SEQ ID NO: 2893804 - RNA, 14 nt, Human
aguggauuguuuau

SEQ ID NO: 2893805 - RNA, 17 nt, Human
aguggauggaaggggcu

SEQ ID NO: 2893806 - RNA, 17 nt, Human
aguggaccuuaggccuu

SEQ ID NO: 2893807 - RNA, 19 nt, Human
aguggaccuuaggccuucc

SEQ ID NO: 2893808 - RNA, 20 nt, Human
aguggaccuuaggccuuccu

SEQ ID NO: 2893809 - RNA, 23 nt, Human
aguggaccuuaggccuuccucuc

SEQ ID NO: 2893810 - RNA, 17 nt, Human
uguuacauaacaagaaa

SEQ ID NO: 2893811 - RNA, 22 nt, Human
uguuacauaacaagaaaaucaa

SEQ ID NO: 2893812 - RNA, 15 nt, Human
aguggacuggccccu

SEQ ID NO: 2893813 - RNA, 16 nt, Human
aguggacuggccccug

SEQ ID NO: 2893814 - RNA, 17 nt, Human
aguggacuggccccugg

SEQ ID NO: 2893815 - RNA, 18 nt, Human
aguggacuggccccuggg

SEQ ID NO: 2893816 - RNA, 22 nt, Human
ugugucuaaauuugaauguuaa

SEQ ID NO: 2893817 - RNA, 19 nt, Human
ugugucuaaauuugaaugu

SEQ ID NO: 2893818 - RNA, 19 nt, Human
ugugucugcgucuguguug

SEQ ID NO: 2893819 - RNA, 13 nt, Human
ugugucuguacac

SEQ ID NO: 2893820 - RNA, 14 nt, Human
ugugucugcucagu

SEQ ID NO: 2893821 - RNA, 22 nt, Human
ugugucugcuuuaaagggccug

SEQ ID NO: 2893822 - RNA, 14 nt, Human
ugugucuguacacg

SEQ ID NO: 2893823 - RNA, 21 nt, Human
ugugucuguacacguguccug

SEQ ID NO: 2893824 - RNA, 24 nt, Human
ugugucuguauuucauguggcugu

SEQ ID NO: 2893825 - RNA, 14 nt, Human
ugugucuuaauuau

SEQ ID NO: 2893826 - RNA, 16 nt, Human
ugugucuuaauuauua

SEQ ID NO: 2893827 - RNA, 18 nt, Human
uguguguugucuugaaag

SEQ ID NO: 2893828 - RNA, 14 nt, Human
uguguguugucuga

SEQ ID NO: 2893829 - RNA, 22 nt, Human
uguguguugaucccaagacaau

SEQ ID NO: 2893830 - RNA, 17 nt, Human
ugugucugcgaaguccu

SEQ ID NO: 2893831 - RNA, 16 nt, Human
uguguccaccuguggg

SEQ ID NO: 2893832 - RNA, 19 nt, Human
uguguccaccugugggugu

SEQ ID NO: 2893833 - RNA, 17 nt, Human
uguguccuucccugcau

SEQ ID NO: 2893834 - RNA, 14 nt, Human
uguguccuucccug

SEQ ID NO: 2893835 - RNA, 16 nt, Human
uguguccuucccugca

SEQ ID NO: 2893836 - RNA, 14 nt, Human
uguguccugguucc

SEQ ID NO: 2893837 - RNA, 17 nt, Human
ugugucccucuucucuu

SEQ ID NO: 2893838 - RNA, 14 nt, Human
uguguccucaggga

SEQ ID NO: 2893839 - RNA, 14 nt, Human
uguguaaaauguga

SEQ ID NO: 2893840 - RNA, 15 nt, Human
uguguaaaaagagag

SEQ ID NO: 2893841 - RNA, 17 nt, Human
uguguaaaauguaaugc

SEQ ID NO: 2893842 - RNA, 10 nt, Human
ugugguuuua

SEQ ID NO: 2893843 - RNA, 14 nt, Human
ugugguuuuaugga

SEQ ID NO: 2893844 - RNA, 17 nt, Human
ugugguuuuauggagac

SEQ ID NO: 2893845 - RNA, 18 nt, Human
ugugguuugguuccucuc

SEQ ID NO: 2893846 - RNA, 21 nt, Human
ugugguuugguuccucucugg

SEQ ID NO: 2893847 - RNA, 22 nt, Human
ugugguuugguuccucucuggu

SEQ ID NO: 2893848 - RNA, 19 nt, Human
ugugguauugaauauugug

SEQ ID NO: 2893849 - RNA, 20 nt, Human
ugugucagguggggcagcuu

SEQ ID NO: 2893850 - RNA, 19 nt, Human
ugugucaguggggcucucu

SEQ ID NO: 2893851 - RNA, 21 nt, Human
ugugucaguggggcucucuga

SEQ ID NO: 2893852 - RNA, 22 nt, Human
ugugucaguggggcucucugag

SEQ ID NO: 2893853 - RNA, 21 nt, Human
uguguaaacacagucaaaaua

SEQ ID NO: 2893854 - RNA, 20 nt, Human
uguguaaagaucuacaugaa

SEQ ID NO: 2893855 - RNA, 14 nt, Human
ugugucaugccagu

SEQ ID NO: 2893856 - RNA, 16 nt, Human
ugugucaugccaguga

SEQ ID NO: 2893857 - RNA, 20 nt, Human
ugugucaucaauaguguccu

SEQ ID NO: 2893858 - RNA, 16 nt, Human
agugcccuccaggaua

SEQ ID NO: 2893859 - RNA, 21 nt, Human
agugcccuccacagccgcagc

SEQ ID NO: 2893860 - RNA, 17 nt, Human
agugcccuccacagccg

SEQ ID NO: 2893861 - RNA, 16 nt, Human
agugcccuccacagcc

SEQ ID NO: 2893862 - RNA, 20 nt, Human
agugccagucuugugucugc

SEQ ID NO: 2893863 - RNA, 17 nt, Human
ugugguaggccuuuuaa

SEQ ID NO: 2893864 - RNA, 19 nt, Human
ugugguaggccuuuuaaca

SEQ ID NO: 2893865 - RNA, 21 nt, Human
ugugguaggccuuuuaacauu

SEQ ID NO: 2893866 - RNA, 22 nt, Human
ugugguaggccuuuuaacauuu

SEQ ID NO: 2893867 - RNA, 23 nt, Human
ugugguaggccuuuuaacauuuu

SEQ ID NO: 2893868 - RNA, 24 nt, Human
ugugguaggccuuuuaacauuuug

SEQ ID NO: 2893869 - RNA, 16 nt, Human
ugugguaaaugccaca

SEQ ID NO: 2893870 - RNA, 23 nt, Human
ugugguaaaugccacacaccuuu

SEQ ID NO: 2893871 - RNA, 15 nt, Human
agucuuuaggucuuu

SEQ ID NO: 2893872 - RNA, 19 nt, Human
agucuuuaggucuuuguaa

SEQ ID NO: 2893873 - RNA, 21 nt, Human
agucuuuaggucuuuguaaga

SEQ ID NO: 2893874 - RNA, 16 nt, Human
agucuuucaagaauga

SEQ ID NO: 2893875 - RNA, 20 nt, Human
agucuugugcuuuuccuauu

SEQ ID NO: 2893876 - RNA, 17 nt, Human
agucuuuaaaggcccag

SEQ ID NO: 2893877 - RNA, 19 nt, Human
agucuuuaaaggcccagcc

SEQ ID NO: 2893878 - RNA, 20 nt, Human
agucuuuaaaggcccagccc

SEQ ID NO: 2893879 - RNA, 21 nt, Human
agucuuuaaaggcccagcccc

SEQ ID NO: 2893880 - RNA, 23 nt, Human
agucuuuaaaggcccagccccua

SEQ ID NO: 2893881 - RNA, 15 nt, Human
agucuugugcuuuuc

SEQ ID NO: 2893882 - RNA, 12 nt, Human
agucuugugcuu

SEQ ID NO: 2893883 - RNA, 12 nt, Human
agucucccuucu

SEQ ID NO: 2893884 - RNA, 16 nt, Human
agugacuccaagaaca

SEQ ID NO: 2893885 - RNA, 18 nt, Human
agugacuccaagaacaau

SEQ ID NO: 2893886 - RNA, 22 nt, Human
agugacuaugaacuucucucag

SEQ ID NO: 2893887 - RNA, 16 nt, Human
agugacuaguacaaau

SEQ ID NO: 2893888 - RNA, 17 nt, Human
agugacuaguacaaauu

SEQ ID NO: 2893889 - RNA, 18 nt, Human
agugacuaguacaaauua

SEQ ID NO: 2893890 - RNA, 22 nt, Human
agugaaccucaccccgaggccc

SEQ ID NO: 2893891 - RNA, 20 nt, Human
agugaacuacgcuugcucau

SEQ ID NO: 2893892 - RNA, 19 nt, Human
agugaacuauuucuacaca

SEQ ID NO: 2893893 - RNA, 22 nt, Human
agugagcacuaaggugugcucu

SEQ ID NO: 2893894 - RNA, 14 nt, Human
agugagcacuaagg

SEQ ID NO: 2893895 - RNA, 20 nt, Human
agugagaaaaagcuccuguc

SEQ ID NO: 2893896 - RNA, 17 nt, Human
agugagaauaggcagcc

SEQ ID NO: 2893897 - RNA, 15 nt, Human
agugagacaaaauuu

SEQ ID NO: 2893898 - RNA, 16 nt, Human
agugagacaaaauuuu

SEQ ID NO: 2893899 - RNA, 19 nt, Human
agugagacaaaauuuuagu

SEQ ID NO: 2893900 - RNA, 17 nt, Human
agugacuguucaagagc

SEQ ID NO: 2893901 - RNA, 19 nt, Human
agugacuguucaagagcac

SEQ ID NO: 2893902 - RNA, 20 nt, Human
agugacuguucaagagcaca

SEQ ID NO: 2893903 - RNA, 15 nt, Human
agugacuguaucugu

SEQ ID NO: 2893904 - RNA, 20 nt, Human
agugacuguaucuguguaga

SEQ ID NO: 2893905 - RNA, 18 nt, Human
agugacuguaucugugua

SEQ ID NO: 2893906 - RNA, 17 nt, Human
agugacuguaucugugu

SEQ ID NO: 2893907 - RNA, 16 nt, Human
agugacuguaucugug

SEQ ID NO: 2893908 - RNA, 14 nt, Human
agugagaaaaagcu

SEQ ID NO: 2893909 - RNA, 18 nt, Human
agugagaaaaagcuccug

SEQ ID NO: 2893910 - RNA, 19 nt, Human
agugagaaaaagcuccugu

SEQ ID NO: 2893911 - RNA, 22 nt, Human
agugagaaaaagcuccuguccu

SEQ ID NO: 2893912 - RNA, 12 nt, Human
agugagcugguu

SEQ ID NO: 2893913 - RNA, 14 nt, Human
agugagccuggcuc

SEQ ID NO: 2893914 - RNA, 15 nt, Human
agugagccuggcucu

SEQ ID NO: 2893915 - RNA, 14 nt, Human
agugagcuacagag

SEQ ID NO: 2893916 - RNA, 16 nt, Human
agugagcuacagagcc

SEQ ID NO: 2893917 - RNA, 11 nt, Human
agugagccuga

SEQ ID NO: 2893918 - RNA, 13 nt, Human
agugagccuggcu

SEQ ID NO: 2893919 - RNA, 21 nt, Human
agugagccugaauuuuguugc

SEQ ID NO: 2893920 - RNA, 16 nt, Human
agugagaugcauucuu

SEQ ID NO: 2893921 - RNA, 12 nt, Human
agugagaugcau

SEQ ID NO: 2893922 - RNA, 14 nt, Human
agugagaugaggga

SEQ ID NO: 2893923 - RNA, 22 nt, Human
agugagaugagggaugggccug

SEQ ID NO: 2893924 - RNA, 23 nt, Human
agugagaugagggaugggccugg

SEQ ID NO: 2893925 - RNA, 22 nt, Human
ugugaugaugaaaugaggucag

SEQ ID NO: 2893926 - RNA, 14 nt, Human
ugugaugauguaau

SEQ ID NO: 2893927 - RNA, 16 nt, Human
ugugaugauguaauug

SEQ ID NO: 2893928 - RNA, 17 nt, Human
ugugaugauguaauuga

SEQ ID NO: 2893929 - RNA, 14 nt, Human
ugugaugagcugau

SEQ ID NO: 2893930 - RNA, 13 nt, Human
ugugaugagcuga

SEQ ID NO: 2893931 - RNA, 13 nt, Human
agugagcugggca

SEQ ID NO: 2893932 - RNA, 21 nt, Human
agugagcugggcaugguacca

SEQ ID NO: 2893933 - RNA, 16 nt, Human
agucucuuuauuccua

SEQ ID NO: 2893934 - RNA, 17 nt, Human
agucucuuuauuccuag

SEQ ID NO: 2893935 - RNA, 18 nt, Human
agucucuuuauuccuagu

SEQ ID NO: 2893936 - RNA, 23 nt, Human
agucucuuuauuccuaguuggug

SEQ ID NO: 2893937 - RNA, 18 nt, Human
agucucuucuccacugga

SEQ ID NO: 2893938 - RNA, 21 nt, Human
agucucuucuccacuggaugg

SEQ ID NO: 2893939 - RNA, 11 nt, Human
agucuccucaa

SEQ ID NO: 2893940 - RNA, 23 nt, Human
agucuccucaauuuuugucucag

SEQ ID NO: 2893941 - RNA, 13 nt, Human
agucuccucuuua

SEQ ID NO: 2893942 - RNA, 14 nt, Human
agucuccucuuuaa

SEQ ID NO: 2893943 - RNA, 15 nt, Human
agucuccucuuuaaa

SEQ ID NO: 2893944 - RNA, 16 nt, Human
agucuccucuuuaaaa

SEQ ID NO: 2893945 - RNA, 18 nt, Human
agucuccucuuuaaaaca

SEQ ID NO: 2893946 - RNA, 19 nt, Human
agucuccucuuuaaaacaa

SEQ ID NO: 2893947 - RNA, 20 nt, Human
agucuccucuuuaaaacaaa

SEQ ID NO: 2893948 - RNA, 21 nt, Human
agucuccucuuuaaaacaaaa

SEQ ID NO: 2893949 - RNA, 22 nt, Human
agucuccucuuuaaaacaaaac

SEQ ID NO: 2893950 - RNA, 16 nt, Human
agucucuagguucuga

SEQ ID NO: 2893951 - RNA, 14 nt, Human
agucucuaauucua

SEQ ID NO: 2893952 - RNA, 19 nt, Human
agucucuucuccacuggau

SEQ ID NO: 2893953 - RNA, 19 nt, Human
agucucgcucuguugccca

SEQ ID NO: 2893954 - RNA, 14 nt, Human
ugucuccuacuccu

SEQ ID NO: 2893955 - RNA, 16 nt, Human
ugucuccuacuccuga

SEQ ID NO: 2893956 - RNA, 17 nt, Human
ugucuccuacuccugac

SEQ ID NO: 2893957 - RNA, 15 nt, Human
ugugacuucuccagg

SEQ ID NO: 2893958 - RNA, 15 nt, Human
ugugacuuugacgcu

SEQ ID NO: 2893959 - RNA, 20 nt, Human
ugugacuguacccaaaugga

SEQ ID NO: 2893960 - RNA, 18 nt, Human
ugugacuucagcucuguu

SEQ ID NO: 2893961 - RNA, 19 nt, Human
ugugacuucagcucuguuu

SEQ ID NO: 2893962 - RNA, 18 nt, Human
agucucccucccuugggg

SEQ ID NO: 2893963 - RNA, 14 nt, Human
ugugagccuuggcu

SEQ ID NO: 2893964 - RNA, 21 nt, Human
ugugagccccugguccugagg

SEQ ID NO: 2893965 - RNA, 22 nt, Human
ugugagccccugguccugaggg

SEQ ID NO: 2893966 - RNA, 14 nt, Human
ugugagacccccac

SEQ ID NO: 2893967 - RNA, 13 nt, Human
ugugagaccccca

SEQ ID NO: 2893968 - RNA, 19 nt, Human
ugugagacccccacaccuc

SEQ ID NO: 2893969 - RNA, 15 nt, Human
ugugagacuacuaag

SEQ ID NO: 2893970 - RNA, 18 nt, Human
ugugagacccccacaccu

SEQ ID NO: 2893971 - RNA, 16 nt, Human
ugugagacccccacac

SEQ ID NO: 2893972 - RNA, 15 nt, Human
ugugagacccccaca

SEQ ID NO: 2893973 - RNA, 12 nt, Human
ugugagccccug

SEQ ID NO: 2893974 - RNA, 14 nt, Human
ugugagccccuggu

SEQ ID NO: 2893975 - RNA, 17 nt, Human
ugugagccccugguccu

SEQ ID NO: 2893976 - RNA, 18 nt, Human
agugcaaauuugauacau

SEQ ID NO: 2893977 - RNA, 16 nt, Human
agugcaaccacacacc

SEQ ID NO: 2893978 - RNA, 18 nt, Human
agugcaaccacacaccuc

SEQ ID NO: 2893979 - RNA, 24 nt, Human
agugcaaccacacaccucaccaga

SEQ ID NO: 2893980 - RNA, 13 nt, Human
agugcaaccucug

SEQ ID NO: 2893981 - RNA, 14 nt, Human
agugcaaccucugc

SEQ ID NO: 2893982 - RNA, 15 nt, Human
agugcaaccucugcu

SEQ ID NO: 2893983 - RNA, 16 nt, Human
agugcaaccucugcuu

SEQ ID NO: 2893984 - RNA, 15 nt, Human
agugauauggagcaa

SEQ ID NO: 2893985 - RNA, 17 nt, Human
agugauauggagcaaga

SEQ ID NO: 2893986 - RNA, 14 nt, Human
agugauauggcaga

SEQ ID NO: 2893987 - RNA, 17 nt, Human
agugauauggcagaaga

SEQ ID NO: 2893988 - RNA, 20 nt, Human
agugauacuauccaguuacu

SEQ ID NO: 2893989 - RNA, 19 nt, Human
agugauaauuucuggaauu

SEQ ID NO: 2893990 - RNA, 17 nt, Human
agugauaacuccuaaga

SEQ ID NO: 2893991 - RNA, 18 nt, Human
agugauaacuccuaagag

SEQ ID NO: 2893992 - RNA, 21 nt, Human
agugauaacuccuaagaggag

SEQ ID NO: 2893993 - RNA, 19 nt, Human
uguggaugaucaauccuuu

SEQ ID NO: 2893994 - RNA, 22 nt, Human
uguggauucugaggcccugccc

SEQ ID NO: 2893995 - RNA, 17 nt, Human
uguggauucugaggccc

SEQ ID NO: 2893996 - RNA, 20 nt, Human
agugccagaauuuuaggaac

SEQ ID NO: 2893997 - RNA, 16 nt, Human
agugcauauuuaucca

SEQ ID NO: 2893998 - RNA, 15 nt, Human
agugcauuguuucug

SEQ ID NO: 2893999 - RNA, 16 nt, Human
agugcauuguuucugu

SEQ ID NO: 2894000 - RNA, 17 nt, Human
agugcauuguuucugug

SEQ ID NO: 2894001 - RNA, 20 nt, Human
agugcauuguuucugugggc

SEQ ID NO: 2894002 - RNA, 21 nt, Human
agugcauuguuucugugggcg

SEQ ID NO: 2894003 - RNA, 12 nt, Human
agugcauuucug

SEQ ID NO: 2894004 - RNA, 15 nt, Human
agugcauuucugaau

SEQ ID NO: 2894005 - RNA, 16 nt, Human
agugcauuucugaaua

SEQ ID NO: 2894006 - RNA, 21 nt, Human
agugcauuucugaauagaaau

SEQ ID NO: 2894007 - RNA, 22 nt, Human
agugcauuucugaauagaaaug

SEQ ID NO: 2894008 - RNA, 14 nt, Human
agugcacuuucuaa

SEQ ID NO: 2894009 - RNA, 18 nt, Human
agugcacuuucuaauguu

SEQ ID NO: 2894010 - RNA, 21 nt, Human
agugcacuuucuaauguuucu

SEQ ID NO: 2894011 - RNA, 17 nt, Human
agugcaagccccugcuc

SEQ ID NO: 2894012 - RNA, 15 nt, Human
agugcaagccccugc

SEQ ID NO: 2894013 - RNA, 18 nt, Human
agugcaagccccugcucc

SEQ ID NO: 2894014 - RNA, 17 nt, Human
agugcagugagccgaga

SEQ ID NO: 2894015 - RNA, 21 nt, Human
agugcagcagguuaagaauuu

SEQ ID NO: 2894016 - RNA, 12 nt, Human
ugugcuguaauu

SEQ ID NO: 2894017 - RNA, 12 nt, Human
ugugcugugacu

SEQ ID NO: 2894018 - RNA, 16 nt, Human
ugugcugccauuugau

SEQ ID NO: 2894019 - RNA, 23 nt, Human
ugugcugccauuugauuuuucua

SEQ ID NO: 2894020 - RNA, 14 nt, Human
ugugcuguggaagc

SEQ ID NO: 2894021 - RNA, 16 nt, Human
ugugcuguggaagcaa

SEQ ID NO: 2894022 - RNA, 17 nt, Human
uguggauaacaaagaua

SEQ ID NO: 2894023 - RNA, 18 nt, Human
uguggauaacaaagauau

SEQ ID NO: 2894024 - RNA, 19 nt, Human
uguggauaacaaagauauc

SEQ ID NO: 2894025 - RNA, 15 nt, Human
uguggauauaaaaug

SEQ ID NO: 2894026 - RNA, 17 nt, Human
ugugcuguggaagcaac

SEQ ID NO: 2894027 - RNA, 23 nt, Human
agugagcugguuuuuagcggaga

SEQ ID NO: 2894028 - RNA, 19 nt, Human
uguggaugagcccucagaa

SEQ ID NO: 2894029 - RNA, 23 nt, Human
uguggaugagcccucagaacccu

SEQ ID NO: 2894030 - RNA, 21 nt, Human
uguggaugccuguggaagagu

SEQ ID NO: 2894031 - RNA, 22 nt, Human
uguggaugccuguggaagagug

SEQ ID NO: 2894032 - RNA, 14 nt, Human
uguggauccaaugu

SEQ ID NO: 2894033 - RNA, 15 nt, Human
uguggauccaauguu

SEQ ID NO: 2894034 - RNA, 17 nt, Human
uguggauccaauguuag

SEQ ID NO: 2894035 - RNA, 16 nt, Human
uguggaucuuuucauu

SEQ ID NO: 2894036 - RNA, 19 nt, Human
uguggaucuuuucauucuc

SEQ ID NO: 2894037 - RNA, 13 nt, Human
ugugcugaaugug

SEQ ID NO: 2894038 - RNA, 20 nt, Human
ugugcugaucauuugaggaa

SEQ ID NO: 2894039 - RNA, 15 nt, Human
ugugcucauuuaagu

SEQ ID NO: 2894040 - RNA, 21 nt, Human
ugugcucccugguucugauga

SEQ ID NO: 2894041 - RNA, 16 nt, Human
ugugcuccuccuuggu

SEQ ID NO: 2894042 - RNA, 16 nt, Human
ugugcucucaccagcu

SEQ ID NO: 2894043 - RNA, 17 nt, Human
ugugccgacacuguucu

SEQ ID NO: 2894044 - RNA, 15 nt, Human
ugugccgacagaagg

SEQ ID NO: 2894045 - RNA, 14 nt, Human
ugugauucuaaugu

SEQ ID NO: 2894046 - RNA, 16 nt, Human
ugugauucuaaugucu

SEQ ID NO: 2894047 - RNA, 12 nt, Human
ugugcccuccug

SEQ ID NO: 2894048 - RNA, 21 nt, Human
ugugauucuaaugucuucauu

SEQ ID NO: 2894049 - RNA, 19 nt, Human
ugugauucuuccagaugug

SEQ ID NO: 2894050 - RNA, 20 nt, Human
ugugauucuuccagauguga

SEQ ID NO: 2894051 - RNA, 21 nt, Human
ugugauucuuccagaugugau

SEQ ID NO: 2894052 - RNA, 17 nt, Human
ugugauucuaaugucuu

SEQ ID NO: 2894053 - RNA, 18 nt, Human
auacuaaaaaucaugaga

SEQ ID NO: 2894054 - RNA, 13 nt, Human
auacuaaaaauca

SEQ ID NO: 2894055 - RNA, 21 nt, Human
auacuaaaaguucuucuccaa

SEQ ID NO: 2894056 - RNA, 12 nt, Human
auacuaaaauau

SEQ ID NO: 2894057 - RNA, 13 nt, Human
auacuaaaauaug

SEQ ID NO: 2894058 - RNA, 14 nt, Human
auacuaaaauaugu

SEQ ID NO: 2894059 - RNA, 16 nt, Human
auacuaaaauaugucu

SEQ ID NO: 2894060 - RNA, 14 nt, Human
auacuauaguacca

SEQ ID NO: 2894061 - RNA, 13 nt, Human
auacguuugauaa

SEQ ID NO: 2894062 - RNA, 15 nt, Human
uuauauuuuuauaga

SEQ ID NO: 2894063 - RNA, 13 nt, Human
uuauauuuuuaaa

SEQ ID NO: 2894064 - RNA, 15 nt, Human
uuauauuuucguaug

SEQ ID NO: 2894065 - RNA, 18 nt, Human
uuauauuuucguaugaaa

SEQ ID NO: 2894066 - RNA, 20 nt, Human
uuauauuuucguaugaaaau

SEQ ID NO: 2894067 - RNA, 15 nt, Human
uuauauuuguaggag

SEQ ID NO: 2894068 - RNA, 13 nt, Human
uuauauuuguauc

SEQ ID NO: 2894069 - RNA, 18 nt, Human
uuauauuugugcuauagu

SEQ ID NO: 2894070 - RNA, 19 nt, Human
uuaucaauaucuaauauau

SEQ ID NO: 2894071 - RNA, 23 nt, Human
uuaucacaccaucgcuggccccu

SEQ ID NO: 2894072 - RNA, 22 nt, Human
uuaucaauaucuaauauauaug

SEQ ID NO: 2894073 - RNA, 15 nt, Human
uuaucaauaucuaau

SEQ ID NO: 2894074 - RNA, 16 nt, Human
uuaucaauaucuaaua

SEQ ID NO: 2894075 - RNA, 17 nt, Human
uuaucaauaucuaauau

SEQ ID NO: 2894076 - RNA, 22 nt, Human
uuaucaaguuugggucugugcu

SEQ ID NO: 2894077 - RNA, 16 nt, Human
auaccacccaaugcug

SEQ ID NO: 2894078 - RNA, 13 nt, Human
auacauuaguaaa

SEQ ID NO: 2894079 - RNA, 14 nt, Human
auacauuaguaaau

SEQ ID NO: 2894080 - RNA, 16 nt, Human
auacauuaguaaaugu

SEQ ID NO: 2894081 - RNA, 17 nt, Human
auacauuaguaaauguc

SEQ ID NO: 2894082 - RNA, 15 nt, Human
auaccuuugccuugg

SEQ ID NO: 2894083 - RNA, 20 nt, Human
auaccuuugcuacuacuaug

SEQ ID NO: 2894084 - RNA, 14 nt, Human
auaccuuuuauuuu

SEQ ID NO: 2894085 - RNA, 11 nt, Human
auacgaacaaa

SEQ ID NO: 2894086 - RNA, 15 nt, Human
auaccagacugcagg

SEQ ID NO: 2894087 - RNA, 16 nt, Human
auaccagacugcaggu

SEQ ID NO: 2894088 - RNA, 16 nt, Human
auacaugcaaaaagaa

SEQ ID NO: 2894089 - RNA, 14 nt, Human
auacgaaacacaaa

SEQ ID NO: 2894090 - RNA, 17 nt, Human
auacgcacuacaugugg

SEQ ID NO: 2894091 - RNA, 15 nt, Human
auacgcuuuucuuug

SEQ ID NO: 2894092 - RNA, 24 nt, Human
auacgcuuuucuuuguuauaccau

SEQ ID NO: 2894093 - RNA, 18 nt, Human
auacggucagguuuaaca

SEQ ID NO: 2894094 - RNA, 22 nt, Human
auacggucagguuuaacauuug

SEQ ID NO: 2894095 - RNA, 23 nt, Human
auacgcaacauaauuaaauuuug

SEQ ID NO: 2894096 - RNA, 21 nt, Human
auacgccuguaguccuagcca

SEQ ID NO: 2894097 - RNA, 19 nt, Human
auacgcuacuauaaagaga

SEQ ID NO: 2894098 - RNA, 20 nt, Human
auacgcuacuauaaagagaa

SEQ ID NO: 2894099 - RNA, 16 nt, Human
auacgcacuacaugug

SEQ ID NO: 2894100 - RNA, 13 nt, Human
auacgaacaaaac

SEQ ID NO: 2894101 - RNA, 22 nt, Human
auacaguuaggcaccagaagaa

SEQ ID NO: 2894102 - RNA, 15 nt, Human
auacaguucaauaaa

SEQ ID NO: 2894103 - RNA, 19 nt, Human
auacaguucaauaaacuua

SEQ ID NO: 2894104 - RNA, 21 nt, Human
auacauaagcggcguaaguuu

SEQ ID NO: 2894105 - RNA, 13 nt, Human
auacauaauaaaa

SEQ ID NO: 2894106 - RNA, 12 nt, Human
auacauaauggg

SEQ ID NO: 2894107 - RNA, 22 nt, Human
auacauaaugggccacugaaau

SEQ ID NO: 2894108 - RNA, 15 nt, Human
auacauaacuaaauu

SEQ ID NO: 2894109 - RNA, 19 nt, Human
auacauaacuaaauuugau

SEQ ID NO: 2894110 - RNA, 21 nt, Human
auacauaacuaaauuugauac

SEQ ID NO: 2894111 - RNA, 22 nt, Human
auacauaacuaaauuugauacu

SEQ ID NO: 2894112 - RNA, 24 nt, Human
auacauaacuaaauuugauacuua

SEQ ID NO: 2894113 - RNA, 14 nt, Human
auacauacacuugu

SEQ ID NO: 2894114 - RNA, 19 nt, Human
auacauacacuuguauaaa

SEQ ID NO: 2894115 - RNA, 22 nt, Human
auacauacacuuguauaaaugu

SEQ ID NO: 2894116 - RNA, 20 nt, Human
auacauacggucagguuuaa

SEQ ID NO: 2894117 - RNA, 21 nt, Human
auacauacggucagguuuaac

SEQ ID NO: 2894118 - RNA, 22 nt, Human
auacauacggucagguuuaaca

SEQ ID NO: 2894119 - RNA, 12 nt, Human
auacaugugugu

SEQ ID NO: 2894120 - RNA, 13 nt, Human
auacaugugugua

SEQ ID NO: 2894121 - RNA, 14 nt, Human
auacauguguguau

SEQ ID NO: 2894122 - RNA, 17 nt, Human
auacauguguguauaua

SEQ ID NO: 2894123 - RNA, 18 nt, Human
auacauguguguauauau

SEQ ID NO: 2894124 - RNA, 19 nt, Human
auacauguguguauauaug

SEQ ID NO: 2894125 - RNA, 20 nt, Human
auacauguguguauauaugu

SEQ ID NO: 2894126 - RNA, 21 nt, Human
auacauguguguauauaugug

SEQ ID NO: 2894127 - RNA, 22 nt, Human
auacauguguguauauaugugu

SEQ ID NO: 2894128 - RNA, 23 nt, Human
auacauguguguauauaugugua

SEQ ID NO: 2894129 - RNA, 16 nt, Human
auacauaucgcugacu

SEQ ID NO: 2894130 - RNA, 21 nt, Human
auacauaucgcugacuucaug

SEQ ID NO: 2894131 - RNA, 23 nt, Human
auacaggaaaagcugcugacagu

SEQ ID NO: 2894132 - RNA, 22 nt, Human
auacaggaaaagcugcugacag

SEQ ID NO: 2894133 - RNA, 14 nt, Human
auacagauaacauu

SEQ ID NO: 2894134 - RNA, 15 nt, Human
auacagauaacauua

SEQ ID NO: 2894135 - RNA, 12 nt, Human
auacagaggaaa

SEQ ID NO: 2894136 - RNA, 21 nt, Human
auacagaggaaaucuguaaca

SEQ ID NO: 2894137 - RNA, 21 nt, Human
auacaggauuugaacucagau

SEQ ID NO: 2894138 - RNA, 19 nt, Human
auacaaguucuuggucccu

SEQ ID NO: 2894139 - RNA, 22 nt, Human
auacaagccauucuaaggaaau

SEQ ID NO: 2894140 - RNA, 15 nt, Human
auacaagauugaaaa

SEQ ID NO: 2894141 - RNA, 17 nt, Human
auacaagauugaaaauc

SEQ ID NO: 2894142 - RNA, 12 nt, Human
auacaagccaaa

SEQ ID NO: 2894143 - RNA, 19 nt, Human
uuauaaauaaacuguugcu

SEQ ID NO: 2894144 - RNA, 18 nt, Human
uuauaaauauaagccuuu

SEQ ID NO: 2894145 - RNA, 21 nt, Human
uuauaaauauaagccuuuuau

SEQ ID NO: 2894146 - RNA, 16 nt, Human
uuauaaauauauauaa

SEQ ID NO: 2894147 - RNA, 17 nt, Human
uuauaaauauauauaaa

SEQ ID NO: 2894148 - RNA, 19 nt, Human
uuauaaauauauauaaaga

SEQ ID NO: 2894149 - RNA, 19 nt, Human
uuauaaagaauguuucuua

SEQ ID NO: 2894150 - RNA, 17 nt, Human
uuauaaacuuuuaaaga

SEQ ID NO: 2894151 - RNA, 12 nt, Human
uuauaaagugcu

SEQ ID NO: 2894152 - RNA, 17 nt, Human
uuauaaagugcuugugu

SEQ ID NO: 2894153 - RNA, 18 nt, Human
uuauaaagugcuugugua

SEQ ID NO: 2894154 - RNA, 19 nt, Human
uuauaaagugcuuguguaa

SEQ ID NO: 2894155 - RNA, 21 nt, Human
uuauaaagugcuuguguaauu

SEQ ID NO: 2894156 - RNA, 20 nt, Human
auacaacauguagcugaguu

SEQ ID NO: 2894157 - RNA, 22 nt, Human
auacaacccuggcauuaugucc

SEQ ID NO: 2894158 - RNA, 15 nt, Human
auacaaccucccucu

SEQ ID NO: 2894159 - RNA, 16 nt, Human
auacaaccucccucuu

SEQ ID NO: 2894160 - RNA, 17 nt, Human
auacaaccucccucuug

SEQ ID NO: 2894161 - RNA, 18 nt, Human
auacaaccucccucuugu

SEQ ID NO: 2894162 - RNA, 20 nt, Human
auacaaccucccucuuguuu

SEQ ID NO: 2894163 - RNA, 21 nt, Human
auacaaccucccucuuguuuu

SEQ ID NO: 2894164 - RNA, 23 nt, Human
auacaaccucccucuuguuuugu

SEQ ID NO: 2894165 - RNA, 14 nt, Human
uuaugaaugaaaaa

SEQ ID NO: 2894166 - RNA, 13 nt, Human
uuaugaaucagug

SEQ ID NO: 2894167 - RNA, 12 nt, Human
uuaugaaucuga

SEQ ID NO: 2894168 - RNA, 23 nt, Human
uuaugacaaugacugugcuacug

SEQ ID NO: 2894169 - RNA, 13 nt, Human
uuaugaauguuuc

SEQ ID NO: 2894170 - RNA, 23 nt, Human
uuaugacaucacuuguacaaaau

SEQ ID NO: 2894171 - RNA, 21 nt, Human
uuaugacaucacuuguacaaa

SEQ ID NO: 2894172 - RNA, 18 nt, Human
uuaugacaucacuuguac

SEQ ID NO: 2894173 - RNA, 16 nt, Human
uuaugacaucacuugu

SEQ ID NO: 2894174 - RNA, 15 nt, Human
uuaugaguuugcuua

SEQ ID NO: 2894175 - RNA, 16 nt, Human
uuaugauaauagauuc

SEQ ID NO: 2894176 - RNA, 17 nt, Human
uuaugauaauagauucu

SEQ ID NO: 2894177 - RNA, 19 nt, Human
uuaugaucaccauguauuu

SEQ ID NO: 2894178 - RNA, 15 nt, Human
uuaugaucaguguug

SEQ ID NO: 2894179 - RNA, 23 nt, Human
uuaugaguuuuugauagcuuuau

SEQ ID NO: 2894180 - RNA, 21 nt, Human
uuaugaguuuuugauagcuuu

SEQ ID NO: 2894181 - RNA, 15 nt, Human
uuaugaguuuuugau

SEQ ID NO: 2894182 - RNA, 13 nt, Human
uuaugaguuuuug

SEQ ID NO: 2894183 - RNA, 13 nt, Human
uuaugagaaacug

SEQ ID NO: 2894184 - RNA, 16 nt, Human
uuaugacuauguaaac

SEQ ID NO: 2894185 - RNA, 15 nt, Human
uuaugacuauguaaa

SEQ ID NO: 2894186 - RNA, 16 nt, Human
uuaugagcagaaggaa

SEQ ID NO: 2894187 - RNA, 11 nt, Human
uuaugagaaau

SEQ ID NO: 2894188 - RNA, 12 nt, Human
uuaugagaaaug

SEQ ID NO: 2894189 - RNA, 13 nt, Human
uuaugagaaaugu

SEQ ID NO: 2894190 - RNA, 14 nt, Human
uuaugagaaaugua

SEQ ID NO: 2894191 - RNA, 18 nt, Human
uuaugagaaauguaaugc

SEQ ID NO: 2894192 - RNA, 21 nt, Human
uuaugagaaauguaaugcgau

SEQ ID NO: 2894193 - RNA, 22 nt, Human
uuaugaggcaaccugauuguaa

SEQ ID NO: 2894194 - RNA, 19 nt, Human
uuaugaggguccucuacuu

SEQ ID NO: 2894195 - RNA, 15 nt, Human
uuaugaguaacuauu

SEQ ID NO: 2894196 - RNA, 20 nt, Human
uuaugaguaacuauuauuau

SEQ ID NO: 2894197 - RNA, 19 nt, Human
uuaugaguuauucauauuc

SEQ ID NO: 2894198 - RNA, 19 nt, Human
uuaugagauggaucacaua

SEQ ID NO: 2894199 - RNA, 14 nt, Human
uuaugagcuuccaa

SEQ ID NO: 2894200 - RNA, 17 nt, Human
uuaugaggagcugcaga

SEQ ID NO: 2894201 - RNA, 15 nt, Human
uuaugaaaauaaaua

SEQ ID NO: 2894202 - RNA, 18 nt, Human
uuaugaaaauaaauagcu

SEQ ID NO: 2894203 - RNA, 18 nt, Human
uuaugaaagguuuacauu

SEQ ID NO: 2894204 - RNA, 14 nt, Human
uuaugaaauaaaga

SEQ ID NO: 2894205 - RNA, 15 nt, Human
uuaugaaagaauaua

SEQ ID NO: 2894206 - RNA, 20 nt, Human
uuaugaaauaaagaaauugc

SEQ ID NO: 2894207 - RNA, 20 nt, Human
uuaugaacccuuccugagcu

SEQ ID NO: 2894208 - RNA, 19 nt, Human
uuaugaaauucacccccuu

SEQ ID NO: 2894209 - RNA, 20 nt, Human
uuaugaagugcgugaaugua

SEQ ID NO: 2894210 - RNA, 11 nt, Human
uuaugaaguuu

SEQ ID NO: 2894211 - RNA, 13 nt, Human
uuaugaaguuuaa

SEQ ID NO: 2894212 - RNA, 14 nt, Human
uuaugaaguuuaaa

SEQ ID NO: 2894213 - RNA, 16 nt, Human
uuaugaaguuuaaaac

SEQ ID NO: 2894214 - RNA, 20 nt, Human
uuaugaaguuuaaaacagua

SEQ ID NO: 2894215 - RNA, 22 nt, Human
uuaugaaguuuaaaacaguauu

SEQ ID NO: 2894216 - RNA, 22 nt, Human
uuauccaaaaguggaagugaca

SEQ ID NO: 2894217 - RNA, 15 nt, Human
uuauccaaaaugugu

SEQ ID NO: 2894218 - RNA, 16 nt, Human
uuauccaaaaugugua

SEQ ID NO: 2894219 - RNA, 17 nt, Human
uuauccaaaauguguau

SEQ ID NO: 2894220 - RNA, 18 nt, Human
uuauccaaaauguguauu

SEQ ID NO: 2894221 - RNA, 21 nt, Human
uuauccaaaauguguauuucu

SEQ ID NO: 2894222 - RNA, 22 nt, Human
uuauccaaaauguguauuucuu

SEQ ID NO: 2894223 - RNA, 14 nt, Human
uuauccauaaaaaa

SEQ ID NO: 2894224 - RNA, 16 nt, Human
uuauauuuuuucaguu

SEQ ID NO: 2894225 - RNA, 14 nt, Human
uuauccauuuguaa

SEQ ID NO: 2894226 - RNA, 15 nt, Human
uuauccauuuguaau

SEQ ID NO: 2894227 - RNA, 19 nt, Human
uuauccauuuguaauuaaa

SEQ ID NO: 2894228 - RNA, 19 nt, Human
uuauccauauugagucaaa

SEQ ID NO: 2894229 - RNA, 17 nt, Human
uuauccaugacaggccu

SEQ ID NO: 2894230 - RNA, 17 nt, Human
uuauccauauugaguca

SEQ ID NO: 2894231 - RNA, 12 nt, Human
uuaugauagauu

SEQ ID NO: 2894232 - RNA, 23 nt, Human
uuaugaugaaaaccuacauauuc

SEQ ID NO: 2894233 - RNA, 18 nt, Human
uuaugauaauagauucuc

SEQ ID NO: 2894234 - RNA, 13 nt, Human
uuaugaugaugaa

SEQ ID NO: 2894235 - RNA, 14 nt, Human
uuaugaugaugaaa

SEQ ID NO: 2894236 - RNA, 23 nt, Human
uuaugaugaugaaaauuuuacca

SEQ ID NO: 2894237 - RNA, 21 nt, Human
uuaugauggaagacaggaaag

SEQ ID NO: 2894238 - RNA, 23 nt, Human
uuaugauggaagacaggaaaguu

SEQ ID NO: 2894239 - RNA, 19 nt, Human
uuaugggaauaauugcuuu

SEQ ID NO: 2894240 - RNA, 17 nt, Human
uuaugggcauugacaaa

SEQ ID NO: 2894241 - RNA, 22 nt, Human
uuaugggcauugacaaaucugu

SEQ ID NO: 2894242 - RNA, 22 nt, Human
uuauggucaaucccaaaaguca

SEQ ID NO: 2894243 - RNA, 19 nt, Human
uuaugguccuaaaagcaaa

SEQ ID NO: 2894244 - RNA, 21 nt, Human
uuaugguccuaaaagcaaaau

SEQ ID NO: 2894245 - RNA, 16 nt, Human
uuauguaaaauguuuu

SEQ ID NO: 2894246 - RNA, 20 nt, Human
uuauguaaaauguuuuagca

SEQ ID NO: 2894247 - RNA, 14 nt, Human
uuaugugaucaauu

SEQ ID NO: 2894248 - RNA, 20 nt, Human
uuaugugacauuuuacauua

SEQ ID NO: 2894249 - RNA, 19 nt, Human
uuaugugacauuuuacauu

SEQ ID NO: 2894250 - RNA, 14 nt, Human
uuaugugacauuuu

SEQ ID NO: 2894251 - RNA, 19 nt, Human
uuauguguaugugccauuu

SEQ ID NO: 2894252 - RNA, 16 nt, Human
uuaugugguuuuagau

SEQ ID NO: 2894253 - RNA, 15 nt, Human
uuauguguaaauaca

SEQ ID NO: 2894254 - RNA, 22 nt, Human
uuauguguaguugucucucuuc

SEQ ID NO: 2894255 - RNA, 18 nt, Human
uuaugugguuuuagauuu

SEQ ID NO: 2894256 - RNA, 19 nt, Human
uuaugugguuuuagauuuu

SEQ ID NO: 2894257 - RNA, 19 nt, Human
uuaugugugaggagcugcu

SEQ ID NO: 2894258 - RNA, 17 nt, Human
uuaugugugcaugugug

SEQ ID NO: 2894259 - RNA, 18 nt, Human
uuaugugugcaugugugu

SEQ ID NO: 2894260 - RNA, 20 nt, Human
uuaugugugcauguguguau

SEQ ID NO: 2894261 - RNA, 21 nt, Human
uuaugugugcauguguguaua

SEQ ID NO: 2894262 - RNA, 18 nt, Human
uuauguguaugugccauu

SEQ ID NO: 2894263 - RNA, 20 nt, Human
uuaugugguuuuagauuuuc

SEQ ID NO: 2894264 - RNA, 20 nt, Human
uuauguaaauguuuguuaaa

SEQ ID NO: 2894265 - RNA, 20 nt, Human
uuauguacuaguguucuguu

SEQ ID NO: 2894266 - RNA, 12 nt, Human
uuauguacugua

SEQ ID NO: 2894267 - RNA, 13 nt, Human
uuauguacuguac

SEQ ID NO: 2894268 - RNA, 15 nt, Human
uuauguacuguacua

SEQ ID NO: 2894269 - RNA, 17 nt, Human
uuauguacuguacuaau

SEQ ID NO: 2894270 - RNA, 18 nt, Human
uuauguacuguacuaauu

SEQ ID NO: 2894271 - RNA, 15 nt, Human
uuauguagauauuug

SEQ ID NO: 2894272 - RNA, 18 nt, Human
uuauguagauauuuggcu

SEQ ID NO: 2894273 - RNA, 22 nt, Human
uuauguagauauuuggcuuaaa

SEQ ID NO: 2894274 - RNA, 16 nt, Human
uuauguagcacauaaa

SEQ ID NO: 2894275 - RNA, 16 nt, Human
uuauguaguaauugac

SEQ ID NO: 2894276 - RNA, 15 nt, Human
uuauguaguaauuga

SEQ ID NO: 2894277 - RNA, 17 nt, Human
uuauguaucagaagaga

SEQ ID NO: 2894278 - RNA, 19 nt, Human
uuauguaguaauugacaug

SEQ ID NO: 2894279 - RNA, 14 nt, Human
uuaugucuguuuaa

SEQ ID NO: 2894280 - RNA, 16 nt, Human
uuaugucuguuuaaga

SEQ ID NO: 2894281 - RNA, 17 nt, Human
uuaugucuguuuaagaa

SEQ ID NO: 2894282 - RNA, 13 nt, Human
uuaugucuuuuau

SEQ ID NO: 2894283 - RNA, 21 nt, Human
uuaugucuuuuauauuuguau

SEQ ID NO: 2894284 - RNA, 17 nt, Human
uuaugucuauuuaagcc

SEQ ID NO: 2894285 - RNA, 15 nt, Human
uuauguccacugugu

SEQ ID NO: 2894286 - RNA, 17 nt, Human
uuauguccacuguguau

SEQ ID NO: 2894287 - RNA, 18 nt, Human
uuauguccacuguguaua

SEQ ID NO: 2894288 - RNA, 11 nt, Human
uuauguauuuc

SEQ ID NO: 2894289 - RNA, 19 nt, Human
uuauguauuuccuggaugu

SEQ ID NO: 2894290 - RNA, 20 nt, Human
uuauguauuuccuggauguu

SEQ ID NO: 2894291 - RNA, 16 nt, Human
auagaagcuguaguag

SEQ ID NO: 2894292 - RNA, 18 nt, Human
auagaauaaaauauaauu

SEQ ID NO: 2894293 - RNA, 21 nt, Human
auagaaguuuguccauuugua

SEQ ID NO: 2894294 - RNA, 22 nt, Human
auagaaguuuguccauuuguaa

SEQ ID NO: 2894295 - RNA, 23 nt, Human
auagaaguuuguccauuuguaaa

SEQ ID NO: 2894296 - RNA, 14 nt, Human
auagaagcuguagu

SEQ ID NO: 2894297 - RNA, 13 nt, Human
auagaagcuguag

SEQ ID NO: 2894298 - RNA, 13 nt, Human
auagaacagugcu

SEQ ID NO: 2894299 - RNA, 14 nt, Human
auagaacuggguaa

SEQ ID NO: 2894300 - RNA, 15 nt, Human
auagaacuggguaaa

SEQ ID NO: 2894301 - RNA, 16 nt, Human
auagaacuggguaaau

SEQ ID NO: 2894302 - RNA, 19 nt, Human
auagaacuggguaaaugca

SEQ ID NO: 2894303 - RNA, 20 nt, Human
auagaacuggguaaaugcaa

SEQ ID NO: 2894304 - RNA, 17 nt, Human
auagaacagagaaagag

SEQ ID NO: 2894305 - RNA, 16 nt, Human
auacuguaguauucuu

SEQ ID NO: 2894306 - RNA, 15 nt, Human
auacuguacaugaaa

SEQ ID NO: 2894307 - RNA, 19 nt, Human
auacuguacaugaaaguag

SEQ ID NO: 2894308 - RNA, 13 nt, Human
auacuguacaaua

SEQ ID NO: 2894309 - RNA, 20 nt, Human
auacuguacaauaaaaacau

SEQ ID NO: 2894310 - RNA, 12 nt, Human
auagaaugcugc

SEQ ID NO: 2894311 - RNA, 13 nt, Human
auagaaugcugca

SEQ ID NO: 2894312 - RNA, 16 nt, Human
auagaaucaaucagua

SEQ ID NO: 2894313 - RNA, 14 nt, Human
auagaauuuccaau

SEQ ID NO: 2894314 - RNA, 14 nt, Human
auagacaauugagg

SEQ ID NO: 2894315 - RNA, 13 nt, Human
auagaauuagcuu

SEQ ID NO: 2894316 - RNA, 15 nt, Human
auagaauuagcuuuu

SEQ ID NO: 2894317 - RNA, 20 nt, Human
auagaauuagcuuuuucauc

SEQ ID NO: 2894318 - RNA, 22 nt, Human
auagaauuauuucacaaauaau

SEQ ID NO: 2894319 - RNA, 20 nt, Human
auagacaauuugcacaucuu

SEQ ID NO: 2894320 - RNA, 21 nt, Human
auagacaauugagguaaguuu

SEQ ID NO: 2894321 - RNA, 22 nt, Human
auagacacuccccgaagucuuu

SEQ ID NO: 2894322 - RNA, 15 nt, Human
auagacagcuuugac

SEQ ID NO: 2894323 - RNA, 16 nt, Human
auagacagcuuugacu

SEQ ID NO: 2894324 - RNA, 13 nt, Human
auagacaguuugu

SEQ ID NO: 2894325 - RNA, 14 nt, Human
auagacaguuugua

SEQ ID NO: 2894326 - RNA, 16 nt, Human
auagacaguuuguaaa

SEQ ID NO: 2894327 - RNA, 21 nt, Human
auagacaguuuguaaauguua

SEQ ID NO: 2894328 - RNA, 22 nt, Human
auagacaguuuguaaauguuau

SEQ ID NO: 2894329 - RNA, 19 nt, Human
auagaguguacuuaacuau

SEQ ID NO: 2894330 - RNA, 14 nt, Human
auagaguguacuua

SEQ ID NO: 2894331 - RNA, 21 nt, Human
auagaguguacuuaacuauuc

SEQ ID NO: 2894332 - RNA, 16 nt, Human
auagaguguaguuuac

SEQ ID NO: 2894333 - RNA, 23 nt, Human
auagaguguaguuuacagaaaaa

SEQ ID NO: 2894334 - RNA, 14 nt, Human
auagaguauaugca

SEQ ID NO: 2894335 - RNA, 22 nt, Human
auagagugacuccaagaacaau

SEQ ID NO: 2894336 - RNA, 15 nt, Human
auagaguauaugcac

SEQ ID NO: 2894337 - RNA, 14 nt, Human
auagagggccaaga

SEQ ID NO: 2894338 - RNA, 16 nt, Human
auagagguaccagcaa

SEQ ID NO: 2894339 - RNA, 18 nt, Human
auagagguauauuggaag

SEQ ID NO: 2894340 - RNA, 19 nt, Human
auagagguauauuggaaga

SEQ ID NO: 2894341 - RNA, 22 nt, Human
auagagcaaaauugauguguuu

SEQ ID NO: 2894342 - RNA, 21 nt, Human
auagagcaaaauugauguguu

SEQ ID NO: 2894343 - RNA, 17 nt, Human
auagagcaaaauugaug

SEQ ID NO: 2894344 - RNA, 15 nt, Human
auagagcaaaauuga

SEQ ID NO: 2894345 - RNA, 17 nt, Human
auagagaguuguugugu

SEQ ID NO: 2894346 - RNA, 21 nt, Human
auagagcaccuaguccaguga

SEQ ID NO: 2894347 - RNA, 23 nt, Human
auagagcuguucaacaucacuga

SEQ ID NO: 2894348 - RNA, 12 nt, Human
auagagcuuuua

SEQ ID NO: 2894349 - RNA, 16 nt, Human
auagagcuuuuaaaaa

SEQ ID NO: 2894350 - RNA, 18 nt, Human
auagagcuuuuaaaaaug

SEQ ID NO: 2894351 - RNA, 14 nt, Human
auagagagagacca

SEQ ID NO: 2894352 - RNA, 16 nt, Human
auagagauguuuuuaa

SEQ ID NO: 2894353 - RNA, 22 nt, Human
auagagauuugucuaauugcau

SEQ ID NO: 2894354 - RNA, 24 nt, Human
auagagauuuuuuaaccauggcag

SEQ ID NO: 2894355 - RNA, 18 nt, Human
auagacccacaagaggca

SEQ ID NO: 2894356 - RNA, 21 nt, Human
auagacugccgugcauuagca

SEQ ID NO: 2894357 - RNA, 17 nt, Human
auagacuggaaaaaaug

SEQ ID NO: 2894358 - RNA, 18 nt, Human
auagacuggaaaaaauga

SEQ ID NO: 2894359 - RNA, 22 nt, Human
auagagaaggaaagcuuuggca

SEQ ID NO: 2894360 - RNA, 17 nt, Human
auagauuaauggcacug

SEQ ID NO: 2894361 - RNA, 18 nt, Human
auagauuaauggcacuga

SEQ ID NO: 2894362 - RNA, 19 nt, Human
auagauuaauggcacugau

SEQ ID NO: 2894363 - RNA, 13 nt, Human
auagauuagaaaa

SEQ ID NO: 2894364 - RNA, 14 nt, Human
auagauuagaaaaa

SEQ ID NO: 2894365 - RNA, 21 nt, Human
auagauuagaaaaauuccuaa

SEQ ID NO: 2894366 - RNA, 12 nt, Human
auagauucuaaa

SEQ ID NO: 2894367 - RNA, 13 nt, Human
auagauucuaaag

SEQ ID NO: 2894368 - RNA, 14 nt, Human
auagauucuaaaga

SEQ ID NO: 2894369 - RNA, 18 nt, Human
auagauucuaaagauucu

SEQ ID NO: 2894370 - RNA, 15 nt, Human
auagauucuaaagau

SEQ ID NO: 2894371 - RNA, 16 nt, Human
auagauucuaaagauu

SEQ ID NO: 2894372 - RNA, 19 nt, Human
auagauucucuuguauaag

SEQ ID NO: 2894373 - RNA, 14 nt, Human
auagauuugaccuc

SEQ ID NO: 2894374 - RNA, 15 nt, Human
auagauuugaccucc

SEQ ID NO: 2894375 - RNA, 13 nt, Human
auagauuuggaau

SEQ ID NO: 2894376 - RNA, 18 nt, Human
auagaugucuagguacuu

SEQ ID NO: 2894377 - RNA, 22 nt, Human
auagauguuuugguagauuaaa

SEQ ID NO: 2894378 - RNA, 23 nt, Human
auagauguuuugguagauuaaau

SEQ ID NO: 2894379 - RNA, 14 nt, Human
auagaugucuuuua

SEQ ID NO: 2894380 - RNA, 15 nt, Human
auagaugucuuuuau

SEQ ID NO: 2894381 - RNA, 16 nt, Human
auagaugucuuuuaua

SEQ ID NO: 2894382 - RNA, 17 nt, Human
auagaugucuuuuauag

SEQ ID NO: 2894383 - RNA, 19 nt, Human
auagaugucuuuuauagug

SEQ ID NO: 2894384 - RNA, 20 nt, Human
auagaugucuuuuauagugg

SEQ ID NO: 2894385 - RNA, 21 nt, Human
auagaugucuuuuauagugga

SEQ ID NO: 2894386 - RNA, 12 nt, Human
auagaucuucug

SEQ ID NO: 2894387 - RNA, 13 nt, Human
auagaucuucuga

SEQ ID NO: 2894388 - RNA, 14 nt, Human
auagaucuucugaa

SEQ ID NO: 2894389 - RNA, 21 nt, Human
auagaucuucugaaaugaaac

SEQ ID NO: 2894390 - RNA, 13 nt, Human
auagauauuuuca

SEQ ID NO: 2894391 - RNA, 17 nt, Human
auagauauuuucacaau

SEQ ID NO: 2894392 - RNA, 19 nt, Human
auagaucaaagucaaaaau

SEQ ID NO: 2894393 - RNA, 13 nt, Human
auagauacaaaug

SEQ ID NO: 2894394 - RNA, 13 nt, Human
auagaguucaucc

SEQ ID NO: 2894395 - RNA, 16 nt, Human
auagaguuuaacacaa

SEQ ID NO: 2894396 - RNA, 15 nt, Human
auagaguuugcuauu

SEQ ID NO: 2894397 - RNA, 22 nt, Human
uuauuccuauauaguuuauuga

SEQ ID NO: 2894398 - RNA, 23 nt, Human
uuauucaagaaugccaguagaaa

SEQ ID NO: 2894399 - RNA, 14 nt, Human
auacucauuucuaa

SEQ ID NO: 2894400 - RNA, 16 nt, Human
auacucauuucuaaaa

SEQ ID NO: 2894401 - RNA, 19 nt, Human
auacucauuucuaaaagaa

SEQ ID NO: 2894402 - RNA, 20 nt, Human
auacucauuucuaaaagaau

SEQ ID NO: 2894403 - RNA, 21 nt, Human
auacucauuucuaaaagaaua

SEQ ID NO: 2894404 - RNA, 22 nt, Human
auacucauuucuaaaagaauau

SEQ ID NO: 2894405 - RNA, 23 nt, Human
auacucauuucuaaaagaauauu

SEQ ID NO: 2894406 - RNA, 20 nt, Human
uuauuccuauauaguuuauu

SEQ ID NO: 2894407 - RNA, 19 nt, Human
uuauucccuuucacaaaau

SEQ ID NO: 2894408 - RNA, 14 nt, Human
uuauuccuaguugg

SEQ ID NO: 2894409 - RNA, 20 nt, Human
uuauuccccauucuuccuag

SEQ ID NO: 2894410 - RNA, 22 nt, Human
uuauuccagaaugcuguacauc

SEQ ID NO: 2894411 - RNA, 20 nt, Human
uuauuccagaaugcuguaca

SEQ ID NO: 2894412 - RNA, 17 nt, Human
uuauuccagaaugcugu

SEQ ID NO: 2894413 - RNA, 18 nt, Human
auacucuuauagacaaca

SEQ ID NO: 2894414 - RNA, 23 nt, Human
auacucuagaugaaguuuuacau

SEQ ID NO: 2894415 - RNA, 17 nt, Human
auacucuagaugaaguu

SEQ ID NO: 2894416 - RNA, 13 nt, Human
auacuccagugua

SEQ ID NO: 2894417 - RNA, 16 nt, Human
auacuccaguguacau

SEQ ID NO: 2894418 - RNA, 17 nt, Human
auacuccaguguacaua

SEQ ID NO: 2894419 - RNA, 21 nt, Human
auacuccaguguacauagugu

SEQ ID NO: 2894420 - RNA, 23 nt, Human
auacuccaguguacauaguguaa

SEQ ID NO: 2894421 - RNA, 16 nt, Human
auacuggacucuucaa

SEQ ID NO: 2894422 - RNA, 19 nt, Human
auacuggacucuucaaaaa

SEQ ID NO: 2894423 - RNA, 21 nt, Human
auacuggacucuucaaaaacu

SEQ ID NO: 2894424 - RNA, 14 nt, Human
auacuggccuggac

SEQ ID NO: 2894425 - RNA, 15 nt, Human
auacuggccuggacu

SEQ ID NO: 2894426 - RNA, 17 nt, Human
auacugauuaugucuuu

SEQ ID NO: 2894427 - RNA, 20 nt, Human
auacugauuaugucuuuuau

SEQ ID NO: 2894428 - RNA, 13 nt, Human
auacugcacuuac

SEQ ID NO: 2894429 - RNA, 16 nt, Human
auacugcacuuacaau

SEQ ID NO: 2894430 - RNA, 20 nt, Human
auacugcacuuacaauccca

SEQ ID NO: 2894431 - RNA, 22 nt, Human
auacugagggaccaacugggcc

SEQ ID NO: 2894432 - RNA, 18 nt, Human
auacugagccaaguauaa

SEQ ID NO: 2894433 - RNA, 14 nt, Human
auacugagggacca

SEQ ID NO: 2894434 - RNA, 14 nt, Human
auacugcagggcca

SEQ ID NO: 2894435 - RNA, 15 nt, Human
auacugcagggccag

SEQ ID NO: 2894436 - RNA, 17 nt, Human
auacugcagggccagga

SEQ ID NO: 2894437 - RNA, 19 nt, Human
auacugcagggccaggacu

SEQ ID NO: 2894438 - RNA, 22 nt, Human
auacucuuccuauuuuuguagu

SEQ ID NO: 2894439 - RNA, 16 nt, Human
auacucuguuguacua

SEQ ID NO: 2894440 - RNA, 14 nt, Human
auacucuuucugua

SEQ ID NO: 2894441 - RNA, 16 nt, Human
auacucuuucuguaua

SEQ ID NO: 2894442 - RNA, 15 nt, Human
auacucuuucuguau

SEQ ID NO: 2894443 - RNA, 23 nt, Human
auacucuuucuguauauacuuuu

SEQ ID NO: 2894444 - RNA, 22 nt, Human
auacucuuucuguauauacuuu

SEQ ID NO: 2894445 - RNA, 17 nt, Human
auacucuuucuguauau

SEQ ID NO: 2894446 - RNA, 12 nt, Human
uuauguuaaaau

SEQ ID NO: 2894447 - RNA, 13 nt, Human
uuauguuaaaauc

SEQ ID NO: 2894448 - RNA, 20 nt, Human
uuauuaguaagaaaacauca

SEQ ID NO: 2894449 - RNA, 14 nt, Human
uuauuaguuuacau

SEQ ID NO: 2894450 - RNA, 15 nt, Human
uuauuaguuaauaua

SEQ ID NO: 2894451 - RNA, 15 nt, Human
uuauuauauauauaa

SEQ ID NO: 2894452 - RNA, 19 nt, Human
uuauguggguugccuggug

SEQ ID NO: 2894453 - RNA, 14 nt, Human
uuauuauaaacugu

SEQ ID NO: 2894454 - RNA, 15 nt, Human
uuauuaguuuacauc

SEQ ID NO: 2894455 - RNA, 18 nt, Human
uuauuaguuuacaucauu

SEQ ID NO: 2894456 - RNA, 15 nt, Human
uuauucagcuucauu

SEQ ID NO: 2894457 - RNA, 20 nt, Human
uuauucagcuucauuugugu

SEQ ID NO: 2894458 - RNA, 21 nt, Human
uuauucacugaaguucuccug

SEQ ID NO: 2894459 - RNA, 20 nt, Human
uuauucacuuuuauuuagca

SEQ ID NO: 2894460 - RNA, 16 nt, Human
uuauucauuagcugug

SEQ ID NO: 2894461 - RNA, 17 nt, Human
uuauucauuagcuguga

SEQ ID NO: 2894462 - RNA, 23 nt, Human
uuauucauucugugaucauuuau

SEQ ID NO: 2894463 - RNA, 11 nt, Human
uuauucauugg

SEQ ID NO: 2894464 - RNA, 16 nt, Human
uuauuauuauuuuuua

SEQ ID NO: 2894465 - RNA, 13 nt, Human
uuauuaucuuuaa

SEQ ID NO: 2894466 - RNA, 22 nt, Human
uuauuauuuguguuuuaauuua

SEQ ID NO: 2894467 - RNA, 15 nt, Human
uuauuauugaaauug

SEQ ID NO: 2894468 - RNA, 16 nt, Human
uuauuauugaaauugu

SEQ ID NO: 2894469 - RNA, 11 nt, Human
uuauuauugug

SEQ ID NO: 2894470 - RNA, 14 nt, Human
uuauuauuguggua

SEQ ID NO: 2894471 - RNA, 15 nt, Human
uuauuauuuuggggu

SEQ ID NO: 2894472 - RNA, 16 nt, Human
uuauucaaguuauugu

SEQ ID NO: 2894473 - RNA, 14 nt, Human
aguuuuaguuuucu

SEQ ID NO: 2894474 - RNA, 15 nt, Human
aguuuuaguuuucuc

SEQ ID NO: 2894475 - RNA, 20 nt, Human
aguuuuucaggagcgcaaga

SEQ ID NO: 2894476 - RNA, 21 nt, Human
aguuuuucaggagcgcaagau

SEQ ID NO: 2894477 - RNA, 23 nt, Human
aguuuuucaggagcgcaagauag

SEQ ID NO: 2894478 - RNA, 16 nt, Human
aguuuuugauagcuuu

SEQ ID NO: 2894479 - RNA, 22 nt, Human
aguuuuucuguuuuguuuggca

SEQ ID NO: 2894480 - RNA, 23 nt, Human
aguuuuucuguuuuguuuggcaa

SEQ ID NO: 2894481 - RNA, 12 nt, Human
aguuuuucuguc

SEQ ID NO: 2894482 - RNA, 13 nt, Human
aguuuuucuguca

SEQ ID NO: 2894483 - RNA, 21 nt, Human
aguuuuuugaaauuaugugac

SEQ ID NO: 2894484 - RNA, 16 nt, Human
aguuuuuguaauuuau

SEQ ID NO: 2894485 - RNA, 22 nt, Human
aguuuuuggaguguuauguauu

SEQ ID NO: 2894486 - RNA, 23 nt, Human
aguuuuuggaguguuauguauuu

SEQ ID NO: 2894487 - RNA, 20 nt, Human
auaaaaggcuugaagcugug

SEQ ID NO: 2894488 - RNA, 18 nt, Human
uuaacuuuuuuucuucua

SEQ ID NO: 2894489 - RNA, 22 nt, Human
uuaacuuuuuuucuucuacuuu

SEQ ID NO: 2894490 - RNA, 19 nt, Human
auaaaaggcaaauguguac

SEQ ID NO: 2894491 - RNA, 20 nt, Human
auaaaaggcaaauguguaca

SEQ ID NO: 2894492 - RNA, 13 nt, Human
auaaaaaaaaaua

SEQ ID NO: 2894493 - RNA, 22 nt, Human
auaaaaaaaaauagaugucuuu

SEQ ID NO: 2894494 - RNA, 23 nt, Human
aguuuuuugaaauuaugugacau

SEQ ID NO: 2894495 - RNA, 16 nt, Human
aguuuuuuguuuuaca

SEQ ID NO: 2894496 - RNA, 19 nt, Human
auaaaagcugaaguuacuu

SEQ ID NO: 2894497 - RNA, 22 nt, Human
auaaaagcugaaguuacuuuau

SEQ ID NO: 2894498 - RNA, 18 nt, Human
uuaagacaugauuuccuu

SEQ ID NO: 2894499 - RNA, 18 nt, Human
uuaagaccuacuguucua

SEQ ID NO: 2894500 - RNA, 23 nt, Human
uuaagacauuuuuggaaggggac

SEQ ID NO: 2894501 - RNA, 18 nt, Human
uuaagacauuuuuggaag

SEQ ID NO: 2894502 - RNA, 16 nt, Human
uuaagacaugauuucc

SEQ ID NO: 2894503 - RNA, 20 nt, Human
uuaagaccuacuguucuaaa

SEQ ID NO: 2894504 - RNA, 21 nt, Human
uuaagaccuacuguucuaaag

SEQ ID NO: 2894505 - RNA, 20 nt, Human
uuaagaaaaaauaacacaca

SEQ ID NO: 2894506 - RNA, 14 nt, Human
uuaagaaggcaaaa

SEQ ID NO: 2894507 - RNA, 21 nt, Human
uuaagaaaaaauaacacacau

SEQ ID NO: 2894508 - RNA, 18 nt, Human
uuaagaaggcaaaaaugu

SEQ ID NO: 2894509 - RNA, 16 nt, Human
uuaagaauauguuucc

SEQ ID NO: 2894510 - RNA, 19 nt, Human
uuaagaauauguuuccuug

SEQ ID NO: 2894511 - RNA, 20 nt, Human
uuaagaauauguuuccuugu

SEQ ID NO: 2894512 - RNA, 10 nt, Human
uuaagacaag

SEQ ID NO: 2894513 - RNA, 19 nt, Human
uuaagacaagccuggcaac

SEQ ID NO: 2894514 - RNA, 22 nt, Human
uuaagaauguugguuuacuuuc

SEQ ID NO: 2894515 - RNA, 14 nt, Human
uuaagaauugacca

SEQ ID NO: 2894516 - RNA, 21 nt, Human
uuaagaauugaccaucugcuu

SEQ ID NO: 2894517 - RNA, 19 nt, Human
uuaauuuuuacauggagaa

SEQ ID NO: 2894518 - RNA, 17 nt, Human
uuaauuuuauucaagaa

SEQ ID NO: 2894519 - RNA, 17 nt, Human
uuaauuuuacuccauaa

SEQ ID NO: 2894520 - RNA, 13 nt, Human
uuaaucuucaugg

SEQ ID NO: 2894521 - RNA, 12 nt, Human
uuaaucuuggau

SEQ ID NO: 2894522 - RNA, 16 nt, Human
uuaaucuuggauagcu

SEQ ID NO: 2894523 - RNA, 19 nt, Human
uuaaucuuggauagcuaau

SEQ ID NO: 2894524 - RNA, 14 nt, Human
uuaaucuuuccuga

SEQ ID NO: 2894525 - RNA, 13 nt, Human
uuaauuucagucc

SEQ ID NO: 2894526 - RNA, 14 nt, Human
uuaauuucaguccu

SEQ ID NO: 2894527 - RNA, 17 nt, Human
uuaauuucaguccugua

SEQ ID NO: 2894528 - RNA, 20 nt, Human
uuaauuucaguccuguaguu

SEQ ID NO: 2894529 - RNA, 23 nt, Human
uuaauuucaguccuguaguuuua

SEQ ID NO: 2894530 - RNA, 11 nt, Human
uuaauuuccag

SEQ ID NO: 2894531 - RNA, 14 nt, Human
uuaauuucuucaaa

SEQ ID NO: 2894532 - RNA, 15 nt, Human
uuaauuucuucaaaa

SEQ ID NO: 2894533 - RNA, 17 nt, Human
uuaauuucuucaaaaug

SEQ ID NO: 2894534 - RNA, 18 nt, Human
uuaauuucuucaaaaugu

SEQ ID NO: 2894535 - RNA, 21 nt, Human
uuaauuucuucaaaauguaua

SEQ ID NO: 2894536 - RNA, 23 nt, Human
uuaauuucuucaaaauguauaua

SEQ ID NO: 2894537 - RNA, 18 nt, Human
uuaauuugcaucugaaau

SEQ ID NO: 2894538 - RNA, 14 nt, Human
uuaauuugauuaac

SEQ ID NO: 2894539 - RNA, 19 nt, Human
uuaauuugauuaacaaaua

SEQ ID NO: 2894540 - RNA, 21 nt, Human
uuaauuugauuaacaaauaug

SEQ ID NO: 2894541 - RNA, 18 nt, Human
uuaauuuaugaguuuuug

SEQ ID NO: 2894542 - RNA, 15 nt, Human
uuaauuuaugaguuu

SEQ ID NO: 2894543 - RNA, 15 nt, Human
uuaauuuaucuaaau

SEQ ID NO: 2894544 - RNA, 17 nt, Human
uuaauuuaucuaaauua

SEQ ID NO: 2894545 - RNA, 20 nt, Human
uuaauuuaugaguuuuugau

SEQ ID NO: 2894546 - RNA, 19 nt, Human
uuaauuuauuauugaaauu

SEQ ID NO: 2894547 - RNA, 22 nt, Human
uuaauccuuuguuuucugacua

SEQ ID NO: 2894548 - RNA, 21 nt, Human
uuaauccguaguuauuuugca

SEQ ID NO: 2894549 - RNA, 23 nt, Human
uuaauccuuuguuuucugacuaa

SEQ ID NO: 2894550 - RNA, 18 nt, Human
uuaaucaucuauaaagaa

SEQ ID NO: 2894551 - RNA, 22 nt, Human
uuaaucauuuugccucuuuucu

SEQ ID NO: 2894552 - RNA, 15 nt, Human
uuaaucacuuaacau

SEQ ID NO: 2894553 - RNA, 20 nt, Human
uuaaucacuuaacauuccua

SEQ ID NO: 2894554 - RNA, 16 nt, Human
uuaauaaaauaauucu

SEQ ID NO: 2894555 - RNA, 19 nt, Human
uuaaucacaaauuucacuu

SEQ ID NO: 2894556 - RNA, 20 nt, Human
uuaaucacaaauuucacuua

SEQ ID NO: 2894557 - RNA, 21 nt, Human
uuaaucacaaauuucacuuau

SEQ ID NO: 2894558 - RNA, 16 nt, Human
uuaaucagacaaagua

SEQ ID NO: 2894559 - RNA, 20 nt, Human
uuaaucagguccucagagaa

SEQ ID NO: 2894560 - RNA, 15 nt, Human
uuaaucaucuauaaa

SEQ ID NO: 2894561 - RNA, 23 nt, Human
uuaagagcagaacagaucuuuua

SEQ ID NO: 2894562 - RNA, 15 nt, Human
uuaagagcaguccau

SEQ ID NO: 2894563 - RNA, 16 nt, Human
uuaagagcaguccauu

SEQ ID NO: 2894564 - RNA, 22 nt, Human
uuaagaccuacuguucuaaagc

SEQ ID NO: 2894565 - RNA, 12 nt, Human
uuaagagaaacu

SEQ ID NO: 2894566 - RNA, 13 nt, Human
uuaagagaaacuu

SEQ ID NO: 2894567 - RNA, 14 nt, Human
uuaagagaaacuuu

SEQ ID NO: 2894568 - RNA, 15 nt, Human
uuaagagaaacuuua

SEQ ID NO: 2894569 - RNA, 16 nt, Human
uuaagagaaacuuuau

SEQ ID NO: 2894570 - RNA, 19 nt, Human
uuaagagaaacuuuauaca

SEQ ID NO: 2894571 - RNA, 20 nt, Human
uuaagagaaacuuuauacau

SEQ ID NO: 2894572 - RNA, 21 nt, Human
uuaagagaaacuuuauacauu

SEQ ID NO: 2894573 - RNA, 23 nt, Human
uuaagagaaacuuuauacauuag

SEQ ID NO: 2894574 - RNA, 12 nt, Human
uuaagagaaaug

SEQ ID NO: 2894575 - RNA, 13 nt, Human
uuaagagaaaugg

SEQ ID NO: 2894576 - RNA, 15 nt, Human
uuaagagaaauggca

SEQ ID NO: 2894577 - RNA, 13 nt, Human
uuaagagagaaau

SEQ ID NO: 2894578 - RNA, 14 nt, Human
uuaagagagaaauc

SEQ ID NO: 2894579 - RNA, 15 nt, Human
uuaagagagaaaucu

SEQ ID NO: 2894580 - RNA, 17 nt, Human
uuaagacguguuugugu

SEQ ID NO: 2894581 - RNA, 13 nt, Human
uuaagacguguuu

SEQ ID NO: 2894582 - RNA, 16 nt, Human
uuaagacguguuugug

SEQ ID NO: 2894583 - RNA, 21 nt, Human
uuaauaaaaagcuuuuuccuc

SEQ ID NO: 2894584 - RNA, 15 nt, Human
uuaauaaaaaugaca

SEQ ID NO: 2894585 - RNA, 17 nt, Human
uuaauaaaaaugacaga

SEQ ID NO: 2894586 - RNA, 19 nt, Human
uuaauaaaaaugacagacu

SEQ ID NO: 2894587 - RNA, 16 nt, Human
uuaaguuguuugcaug

SEQ ID NO: 2894588 - RNA, 19 nt, Human
uuaaguuguuugcauguga

SEQ ID NO: 2894589 - RNA, 15 nt, Human
uuaaguuucaaacuu

SEQ ID NO: 2894590 - RNA, 16 nt, Human
uuaaguuucaaacuua

SEQ ID NO: 2894591 - RNA, 22 nt, Human
uuaaguuucaaacuuacuauuu

SEQ ID NO: 2894592 - RNA, 20 nt, Human
uuaauaaaaaaacaaucauu

SEQ ID NO: 2894593 - RNA, 21 nt, Human
uuaauaaaaacuuacacucuu

SEQ ID NO: 2894594 - RNA, 13 nt, Human
aguuuacauugua

SEQ ID NO: 2894595 - RNA, 14 nt, Human
aguuaggaaauaaa

SEQ ID NO: 2894596 - RNA, 13 nt, Human
aguuaggaaauaa

SEQ ID NO: 2894597 - RNA, 22 nt, Human
aguuagcucaggaggcuuggaa

SEQ ID NO: 2894598 - RNA, 19 nt, Human
aguuagcucaggaggcuug

SEQ ID NO: 2894599 - RNA, 12 nt, Human
aguuaggaaaua

SEQ ID NO: 2894600 - RNA, 17 nt, Human
aguuuacauuguaaaua

SEQ ID NO: 2894601 - RNA, 15 nt, Human
aguuuacauuguaaa

SEQ ID NO: 2894602 - RNA, 12 nt, Human
aguuuacauuuu

SEQ ID NO: 2894603 - RNA, 13 nt, Human
aguuuacauuuuu

SEQ ID NO: 2894604 - RNA, 14 nt, Human
aguuuacauuuuua

SEQ ID NO: 2894605 - RNA, 19 nt, Human
aguuuacauuuuuauuuau

SEQ ID NO: 2894606 - RNA, 21 nt, Human
aguuuacauuuuuauuuauga

SEQ ID NO: 2894607 - RNA, 22 nt, Human
aguuuacauuuuuauuuaugaa

SEQ ID NO: 2894608 - RNA, 20 nt, Human
aguuuacuagcuuuucaaac

SEQ ID NO: 2894609 - RNA, 12 nt, Human
aguuuaacacaa

SEQ ID NO: 2894610 - RNA, 16 nt, Human
aguuuaccucuuuaaa

SEQ ID NO: 2894611 - RNA, 20 nt, Human
aguuuaccucuuuaaaaaca

SEQ ID NO: 2894612 - RNA, 17 nt, Human
aguuuacccaugaagau

SEQ ID NO: 2894613 - RNA, 21 nt, Human
aguuuacccaugaagauuggu

SEQ ID NO: 2894614 - RNA, 16 nt, Human
aguuuacccgguuucu

SEQ ID NO: 2894615 - RNA, 14 nt, Human
aguuuagauuucaa

SEQ ID NO: 2894616 - RNA, 21 nt, Human
aguuuagauuucaagaaaaaa

SEQ ID NO: 2894617 - RNA, 15 nt, Human
uuaaaaaaucuuaau

SEQ ID NO: 2894618 - RNA, 15 nt, Human
uuaaaaaauauuuau

SEQ ID NO: 2894619 - RNA, 19 nt, Human
uuaaaaaauauuuauuaaa

SEQ ID NO: 2894620 - RNA, 21 nt, Human
uuaaaaaauauuuauuaaaua

SEQ ID NO: 2894621 - RNA, 16 nt, Human
uuaaaaaaucuuaaug

SEQ ID NO: 2894622 - RNA, 12 nt, Human
uuaaaaaaugaa

SEQ ID NO: 2894623 - RNA, 16 nt, Human
uuaaaaaaugaaaaua

SEQ ID NO: 2894624 - RNA, 16 nt, Human
uuaaaaaaugaaaucc

SEQ ID NO: 2894625 - RNA, 19 nt, Human
uuaaaaaugagugugaagg

SEQ ID NO: 2894626 - RNA, 18 nt, Human
uuaaaaaugguggcuuca

SEQ ID NO: 2894627 - RNA, 22 nt, Human
uuaaaaaugguggcuucagcuc

SEQ ID NO: 2894628 - RNA, 17 nt, Human
uuaaaaucuauucugug

SEQ ID NO: 2894629 - RNA, 18 nt, Human
uuaaaaucuauucugugu

SEQ ID NO: 2894630 - RNA, 19 nt, Human
uuaaaaucuauucuguguu

SEQ ID NO: 2894631 - RNA, 23 nt, Human
uuaaaaucuauucuguguugcau

SEQ ID NO: 2894632 - RNA, 24 nt, Human
uuaaaaucuauucuguguugcauu

SEQ ID NO: 2894633 - RNA, 10 nt, Human
uuaaaaaugg

SEQ ID NO: 2894634 - RNA, 12 nt, Human
uuaaaaauggaa

SEQ ID NO: 2894635 - RNA, 17 nt, Human
uuaaaaauggaacugug

SEQ ID NO: 2894636 - RNA, 19 nt, Human
uuaaaccagauuggagcaa

SEQ ID NO: 2894637 - RNA, 21 nt, Human
uuaaaccaguuuagauuucaa

SEQ ID NO: 2894638 - RNA, 17 nt, Human
uuaaaauguaagauuau

SEQ ID NO: 2894639 - RNA, 24 nt, Human
uuaaaauguaagauuauagauucu

SEQ ID NO: 2894640 - RNA, 18 nt, Human
uuaaaaugauuguaaaau

SEQ ID NO: 2894641 - RNA, 18 nt, Human
uuaaaaugcaaaauaaug

SEQ ID NO: 2894642 - RNA, 16 nt, Human
uuaaaaugauuguaaa

SEQ ID NO: 2894643 - RNA, 12 nt, Human
uuaaaaugcaau

SEQ ID NO: 2894644 - RNA, 13 nt, Human
uuaaaaugcaaua

SEQ ID NO: 2894645 - RNA, 20 nt, Human
uuaaaaugcaauauuuguaa

SEQ ID NO: 2894646 - RNA, 23 nt, Human
uuaaaaugcaauauuuguaaggc

SEQ ID NO: 2894647 - RNA, 11 nt, Human
uuaaaauggaa

SEQ ID NO: 2894648 - RNA, 21 nt, Human
uuaaaauggaugccuugaaua

SEQ ID NO: 2894649 - RNA, 21 nt, Human
uuaaaauggugcuuaaguucc

SEQ ID NO: 2894650 - RNA, 19 nt, Human
uuaaaaugguuuguccuga

SEQ ID NO: 2894651 - RNA, 21 nt, Human
uuaaaaugguuuguccugaug

SEQ ID NO: 2894652 - RNA, 14 nt, Human
aguuugugugucuu

SEQ ID NO: 2894653 - RNA, 15 nt, Human
aguuugugugucuua

SEQ ID NO: 2894654 - RNA, 16 nt, Human
aguuugugugucuuaa

SEQ ID NO: 2894655 - RNA, 16 nt, Human
aguuuguguguugucu

SEQ ID NO: 2894656 - RNA, 18 nt, Human
aguuuguguguugucuug

SEQ ID NO: 2894657 - RNA, 22 nt, Human
aguuugugugucuuaauuauua

SEQ ID NO: 2894658 - RNA, 20 nt, Human
aguuuguuuaaugugaacuu

SEQ ID NO: 2894659 - RNA, 19 nt, Human
aguuuguguguugucuuga

SEQ ID NO: 2894660 - RNA, 20 nt, Human
aguuuguguguugucuugaa

SEQ ID NO: 2894661 - RNA, 13 nt, Human
aguuuuacaaagg

SEQ ID NO: 2894662 - RNA, 15 nt, Human
aguuuuaaacucauu

SEQ ID NO: 2894663 - RNA, 23 nt, Human
aguuuuaaacucauuuuugccau

SEQ ID NO: 2894664 - RNA, 14 nt, Human
aguuucucuuuuca

SEQ ID NO: 2894665 - RNA, 13 nt, Human
aguuucucagcuc

SEQ ID NO: 2894666 - RNA, 22 nt, Human
aguuuauugacaauaauuucag

SEQ ID NO: 2894667 - RNA, 22 nt, Human
aguuuauuuccaaauaaaauga

SEQ ID NO: 2894668 - RNA, 15 nt, Human
aguuuauucucauuu

SEQ ID NO: 2894669 - RNA, 16 nt, Human
aguuuauucucauuug

SEQ ID NO: 2894670 - RNA, 14 nt, Human
aguuucuaagauuc

SEQ ID NO: 2894671 - RNA, 23 nt, Human
aguuucuaagguccgguguucua

SEQ ID NO: 2894672 - RNA, 15 nt, Human
aguuucucagauccu

SEQ ID NO: 2894673 - RNA, 18 nt, Human
aguuucucagauccuugu

SEQ ID NO: 2894674 - RNA, 22 nt, Human
aguuucucagauccuuguuuca

SEQ ID NO: 2894675 - RNA, 23 nt, Human
aguuucucagauccuuguuucaa

SEQ ID NO: 2894676 - RNA, 15 nt, Human
aguuucuaagauucu

SEQ ID NO: 2894677 - RNA, 16 nt, Human
aguuucuaagauucua

SEQ ID NO: 2894678 - RNA, 17 nt, Human
aguuucuaagauucuaa

SEQ ID NO: 2894679 - RNA, 18 nt, Human
aguuucuaagauucuaaa

SEQ ID NO: 2894680 - RNA, 19 nt, Human
aguuucuaagauucuaaag

SEQ ID NO: 2894681 - RNA, 20 nt, Human
aguuucuaagauucuaaagg

SEQ ID NO: 2894682 - RNA, 11 nt, Human
aguuucuaagg

SEQ ID NO: 2894683 - RNA, 12 nt, Human
aguuucuaaggu

SEQ ID NO: 2894684 - RNA, 15 nt, Human
uuaaaguucuguaaa

SEQ ID NO: 2894685 - RNA, 20 nt, Human
uuaaauuuugaguucuacau

SEQ ID NO: 2894686 - RNA, 15 nt, Human
uuaaauuuugaguuc

SEQ ID NO: 2894687 - RNA, 23 nt, Human
uuaaauuuuacccuuuagacugu

SEQ ID NO: 2894688 - RNA, 16 nt, Human
uuaaauuuuacccuuu

SEQ ID NO: 2894689 - RNA, 20 nt, Human
uuaaauuuuacccuuuagac

SEQ ID NO: 2894690 - RNA, 13 nt, Human
uuaaauaaaagaa

SEQ ID NO: 2894691 - RNA, 14 nt, Human
uuaaaguuggaauu

SEQ ID NO: 2894692 - RNA, 19 nt, Human
uuaaaguuggaauuuacca

SEQ ID NO: 2894693 - RNA, 14 nt, Human
uuaaauuuuguaau

SEQ ID NO: 2894694 - RNA, 15 nt, Human
uuaaauuuuguaaug

SEQ ID NO: 2894695 - RNA, 16 nt, Human
uuaaauuuuguaauga

SEQ ID NO: 2894696 - RNA, 14 nt, Human
aguuuaucaugaag

SEQ ID NO: 2894697 - RNA, 15 nt, Human
aguuuaucaugaagc

SEQ ID NO: 2894698 - RNA, 16 nt, Human
aguuuaucaugaagcc

SEQ ID NO: 2894699 - RNA, 17 nt, Human
aguuuaucaugaagccu

SEQ ID NO: 2894700 - RNA, 19 nt, Human
aguuuaucaugaagccugu

SEQ ID NO: 2894701 - RNA, 16 nt, Human
uuaaauuuuuuuuaca

SEQ ID NO: 2894702 - RNA, 14 nt, Human
uuaggguacauuua

SEQ ID NO: 2894703 - RNA, 15 nt, Human
uuaggguacauuuau

SEQ ID NO: 2894704 - RNA, 15 nt, Human
uuaggguacuaaauu

SEQ ID NO: 2894705 - RNA, 15 nt, Human
uuagggugaaccacu

SEQ ID NO: 2894706 - RNA, 21 nt, Human
uuagggugaaccacuucauuc

SEQ ID NO: 2894707 - RNA, 15 nt, Human
uuagggugcagccac

SEQ ID NO: 2894708 - RNA, 15 nt, Human
uuagggccaggcagg

SEQ ID NO: 2894709 - RNA, 21 nt, Human
uuagggauaguacuaagcauu

SEQ ID NO: 2894710 - RNA, 14 nt, Human
uuagggauuuauuu

SEQ ID NO: 2894711 - RNA, 11 nt, Human
auaauuuuaaa

SEQ ID NO: 2894712 - RNA, 19 nt, Human
uuagauguugccauguguu

SEQ ID NO: 2894713 - RNA, 16 nt, Human
uuagauguugccaugu

SEQ ID NO: 2894714 - RNA, 22 nt, Human
uuagauguugccauguguuuua

SEQ ID NO: 2894715 - RNA, 15 nt, Human
uuagauguuucacac

SEQ ID NO: 2894716 - RNA, 16 nt, Human
uuaggucucuguugac

SEQ ID NO: 2894717 - RNA, 20 nt, Human
uuaggguugguuccuuucca

SEQ ID NO: 2894718 - RNA, 17 nt, Human
uuagguaauuuuuuuca

SEQ ID NO: 2894719 - RNA, 13 nt, Human
uuagguacuauuc

SEQ ID NO: 2894720 - RNA, 14 nt, Human
uuagguagaaaaac

SEQ ID NO: 2894721 - RNA, 15 nt, Human
uuagguagaaaaaca

SEQ ID NO: 2894722 - RNA, 20 nt, Human
uuagguuaaaaaaaggcauu

SEQ ID NO: 2894723 - RNA, 12 nt, Human
uuagguuaacau

SEQ ID NO: 2894724 - RNA, 12 nt, Human
uuagguucuaaa

SEQ ID NO: 2894725 - RNA, 22 nt, Human
uuagguuccauccuuuacgugu

SEQ ID NO: 2894726 - RNA, 13 nt, Human
uuagguucuaaag

SEQ ID NO: 2894727 - RNA, 14 nt, Human
uuagguucuaaagu

SEQ ID NO: 2894728 - RNA, 16 nt, Human
uuagguucuaaaguuc

SEQ ID NO: 2894729 - RNA, 18 nt, Human
uuagguucuaaaguucua

SEQ ID NO: 2894730 - RNA, 19 nt, Human
uuagguucuaaaguucuaa

SEQ ID NO: 2894731 - RNA, 20 nt, Human
uuagguucuaaaguucuaag

SEQ ID NO: 2894732 - RNA, 22 nt, Human
uuagguucuaaaguucuaagau

SEQ ID NO: 2894733 - RNA, 14 nt, Human
uuagguucuuaaaa

SEQ ID NO: 2894734 - RNA, 13 nt, Human
uuaguaaucugua

SEQ ID NO: 2894735 - RNA, 15 nt, Human
uuaguaaucuguaca

SEQ ID NO: 2894736 - RNA, 16 nt, Human
uuaguaaucuguacau

SEQ ID NO: 2894737 - RNA, 17 nt, Human
uuaguaaucuguacauu

SEQ ID NO: 2894738 - RNA, 21 nt, Human
uuaguaaucuguacauuuugu

SEQ ID NO: 2894739 - RNA, 19 nt, Human
uuauaaacagacaauaugu

SEQ ID NO: 2894740 - RNA, 21 nt, Human
uuauaaacagacaauauguga

SEQ ID NO: 2894741 - RNA, 23 nt, Human
uuauaaacagacaauaugugagu

SEQ ID NO: 2894742 - RNA, 20 nt, Human
uuauaaaauauaaacaaaga

SEQ ID NO: 2894743 - RNA, 16 nt, Human
uuauaaaaucaaguuu

SEQ ID NO: 2894744 - RNA, 10 nt, Human
uuauaaaauu

SEQ ID NO: 2894745 - RNA, 16 nt, Human
uuauaaaauuaagcaa

SEQ ID NO: 2894746 - RNA, 17 nt, Human
uuauaaaauuagaaagc

SEQ ID NO: 2894747 - RNA, 17 nt, Human
uuauaaaauuuugcuuu

SEQ ID NO: 2894748 - RNA, 18 nt, Human
uuauaaaauuuugcuuuu

SEQ ID NO: 2894749 - RNA, 13 nt, Human
uuauaaaauauaa

SEQ ID NO: 2894750 - RNA, 18 nt, Human
uuauaaaauauaaacaaa

SEQ ID NO: 2894751 - RNA, 22 nt, Human
uuauaaaaggggguccguggaa

SEQ ID NO: 2894752 - RNA, 17 nt, Human
uuauaaaaauaaauaga

SEQ ID NO: 2894753 - RNA, 20 nt, Human
uuauaaaaauaaauagaaaa

SEQ ID NO: 2894754 - RNA, 21 nt, Human
uuauaaaaauaaauagaaaag

SEQ ID NO: 2894755 - RNA, 14 nt, Human
uuaguagagacagg

SEQ ID NO: 2894756 - RNA, 19 nt, Human
uuaguuuuuguaauuuauu

SEQ ID NO: 2894757 - RNA, 13 nt, Human
uuaguagagacag

SEQ ID NO: 2894758 - RNA, 21 nt, Human
auaauuaugaguuugcuuaug

SEQ ID NO: 2894759 - RNA, 16 nt, Human
auaauuauuuauuuaa

SEQ ID NO: 2894760 - RNA, 17 nt, Human
auaauuauuuauuuaau

SEQ ID NO: 2894761 - RNA, 18 nt, Human
auaauuauuuauuuaaua

SEQ ID NO: 2894762 - RNA, 21 nt, Human
auaauuauuuauuuaauaaca

SEQ ID NO: 2894763 - RNA, 18 nt, Human
auaauucaauuuuaaaga

SEQ ID NO: 2894764 - RNA, 13 nt, Human
auaauucacucaa

SEQ ID NO: 2894765 - RNA, 16 nt, Human
auaauucacucaagca

SEQ ID NO: 2894766 - RNA, 18 nt, Human
auaauucacucaagcacu

SEQ ID NO: 2894767 - RNA, 20 nt, Human
auaauucacucaagcacuga

SEQ ID NO: 2894768 - RNA, 22 nt, Human
auaauucacucaagcacugaua

SEQ ID NO: 2894769 - RNA, 15 nt, Human
auaauuuuaaaaaug

SEQ ID NO: 2894770 - RNA, 16 nt, Human
auaauuuuaaaaaugg

SEQ ID NO: 2894771 - RNA, 17 nt, Human
auaauuuuaaaaauggu

SEQ ID NO: 2894772 - RNA, 15 nt, Human
auaauuuuaaacaaa

SEQ ID NO: 2894773 - RNA, 22 nt, Human
auaauuuguacauauguaaaau

SEQ ID NO: 2894774 - RNA, 19 nt, Human
auaauuuguacauauguaa

SEQ ID NO: 2894775 - RNA, 13 nt, Human
auaauuucgagau

SEQ ID NO: 2894776 - RNA, 15 nt, Human
auaauuucgagauuu

SEQ ID NO: 2894777 - RNA, 12 nt, Human
auaauuucuaau

SEQ ID NO: 2894778 - RNA, 14 nt, Human
auaauuucuaaugu

SEQ ID NO: 2894779 - RNA, 22 nt, Human
uuagauguuccaguaaucuaau

SEQ ID NO: 2894780 - RNA, 21 nt, Human
uuagauguuccaguaaucuaa

SEQ ID NO: 2894781 - RNA, 11 nt, Human
auaagauucua

SEQ ID NO: 2894782 - RNA, 15 nt, Human
auaagcauugaaauu

SEQ ID NO: 2894783 - RNA, 16 nt, Human
auaagcauugaaauua

SEQ ID NO: 2894784 - RNA, 18 nt, Human
auaagcauugaaauuaua

SEQ ID NO: 2894785 - RNA, 14 nt, Human
auaauaguuuuuuc

SEQ ID NO: 2894786 - RNA, 18 nt, Human
auaauauaccaaugcuuu

SEQ ID NO: 2894787 - RNA, 14 nt, Human
auaauauauuugug

SEQ ID NO: 2894788 - RNA, 23 nt, Human
auaauauauucuauuuuuauacu

SEQ ID NO: 2894789 - RNA, 10 nt, Human
auaauauaua

SEQ ID NO: 2894790 - RNA, 13 nt, Human
auaauauauauau

SEQ ID NO: 2894791 - RNA, 15 nt, Human
auaauauauauauau

SEQ ID NO: 2894792 - RNA, 21 nt, Human
auaauauauauauauaucagu

SEQ ID NO: 2894793 - RNA, 20 nt, Human
auaauauccaggucaacaga

SEQ ID NO: 2894794 - RNA, 21 nt, Human
auaauauccaggucaacagaa

SEQ ID NO: 2894795 - RNA, 22 nt, Human
auaauauccaggucaacagaau

SEQ ID NO: 2894796 - RNA, 23 nt, Human
auaauauccaggucaacagaaug

SEQ ID NO: 2894797 - RNA, 14 nt, Human
auaauaucuaaagu

SEQ ID NO: 2894798 - RNA, 17 nt, Human
auaauaucuaaaguuau

SEQ ID NO: 2894799 - RNA, 18 nt, Human
auaauaucuaaaguuaua

SEQ ID NO: 2894800 - RNA, 19 nt, Human
auaauaucuaaaguuauau

SEQ ID NO: 2894801 - RNA, 20 nt, Human
auaauaucuaaaguuauauu

SEQ ID NO: 2894802 - RNA, 13 nt, Human
auaauaugauuuu

SEQ ID NO: 2894803 - RNA, 18 nt, Human
auaauaucuuugugauaa

SEQ ID NO: 2894804 - RNA, 22 nt, Human
auaauaucuuugugauaauuua

SEQ ID NO: 2894805 - RNA, 16 nt, Human
auaauauuguuuuucu

SEQ ID NO: 2894806 - RNA, 14 nt, Human
auaauauuguugua

SEQ ID NO: 2894807 - RNA, 17 nt, Human
auaauauuguuguauaa

SEQ ID NO: 2894808 - RNA, 19 nt, Human
auaauauuguuguauaauu

SEQ ID NO: 2894809 - RNA, 22 nt, Human
auaauauuguuguauaauuucg

SEQ ID NO: 2894810 - RNA, 13 nt, Human
auaauauggcuau

SEQ ID NO: 2894811 - RNA, 17 nt, Human
auaauauggcuaugcuu

SEQ ID NO: 2894812 - RNA, 22 nt, Human
auaauauggcuaugcuuaaaag

SEQ ID NO: 2894813 - RNA, 23 nt, Human
auaauauggcuaugcuuaaaagg

SEQ ID NO: 2894814 - RNA, 13 nt, Human
auaauauuacugu

SEQ ID NO: 2894815 - RNA, 14 nt, Human
auaauauuacuguu

SEQ ID NO: 2894816 - RNA, 12 nt, Human
auaaucugucaa

SEQ ID NO: 2894817 - RNA, 13 nt, Human
auaaucugucaaa

SEQ ID NO: 2894818 - RNA, 17 nt, Human
auaaucugucaaaacac

SEQ ID NO: 2894819 - RNA, 19 nt, Human
auaaucugucaaaacacug

SEQ ID NO: 2894820 - RNA, 20 nt, Human
auaaucugucaaaacacugu

SEQ ID NO: 2894821 - RNA, 22 nt, Human
auaaucuggacuccucugucca

SEQ ID NO: 2894822 - RNA, 16 nt, Human
auaaaugauucuuagu

SEQ ID NO: 2894823 - RNA, 18 nt, Human
auaaaugauucuuaguga

SEQ ID NO: 2894824 - RNA, 13 nt, Human
auaaaugggaaca

SEQ ID NO: 2894825 - RNA, 17 nt, Human
auaaaugggaacauuua

SEQ ID NO: 2894826 - RNA, 14 nt, Human
auaaaugcagccca

SEQ ID NO: 2894827 - RNA, 15 nt, Human
auaaaugcagcccau

SEQ ID NO: 2894828 - RNA, 18 nt, Human
auaaaugcagcccauuuc

SEQ ID NO: 2894829 - RNA, 13 nt, Human
auaaauggaaauc

SEQ ID NO: 2894830 - RNA, 14 nt, Human
auaaauggaaauca

SEQ ID NO: 2894831 - RNA, 15 nt, Human
auaaauggaaaucau

SEQ ID NO: 2894832 - RNA, 13 nt, Human
auaaauugaaauu

SEQ ID NO: 2894833 - RNA, 17 nt, Human
auaaauugaaauuguga

SEQ ID NO: 2894834 - RNA, 17 nt, Human
auaaauugcauaaagca

SEQ ID NO: 2894835 - RNA, 18 nt, Human
auaaauugcauaaagcau

SEQ ID NO: 2894836 - RNA, 13 nt, Human
auaaauugcuccu

SEQ ID NO: 2894837 - RNA, 16 nt, Human
auaaauugcuccuuga

SEQ ID NO: 2894838 - RNA, 13 nt, Human
uuacaaacuacag

SEQ ID NO: 2894839 - RNA, 14 nt, Human
uuacaaacuacaga

SEQ ID NO: 2894840 - RNA, 17 nt, Human
uuaauuuuuugguacaa

SEQ ID NO: 2894841 - RNA, 18 nt, Human
uuaauuuuuugguacaaa

SEQ ID NO: 2894842 - RNA, 13 nt, Human
uuacauaacugcc

SEQ ID NO: 2894843 - RNA, 15 nt, Human
uuacauaacugccuu

SEQ ID NO: 2894844 - RNA, 17 nt, Human
uuacauaacugccuuga

SEQ ID NO: 2894845 - RNA, 16 nt, Human
uuaccagcuuuuaacc

SEQ ID NO: 2894846 - RNA, 19 nt, Human
uuaccagcuuuuaaccauc

SEQ ID NO: 2894847 - RNA, 17 nt, Human
uuaccagggauguagau

SEQ ID NO: 2894848 - RNA, 14 nt, Human
uuacaggugugaac

SEQ ID NO: 2894849 - RNA, 22 nt, Human
uuacaggguaacugugcugaau

SEQ ID NO: 2894850 - RNA, 18 nt, Human
uuacagguggacacacaa

SEQ ID NO: 2894851 - RNA, 20 nt, Human
uuacagggaugagccaccgc

SEQ ID NO: 2894852 - RNA, 12 nt, Human
auaacucuguaa

SEQ ID NO: 2894853 - RNA, 13 nt, Human
auaacucuguaaa

SEQ ID NO: 2894854 - RNA, 19 nt, Human
auaacucuguaaaaacacu

SEQ ID NO: 2894855 - RNA, 14 nt, Human
auaacuauucaguu

SEQ ID NO: 2894856 - RNA, 15 nt, Human
auaacuauucaguug

SEQ ID NO: 2894857 - RNA, 17 nt, Human
auaacuauucaguugug

SEQ ID NO: 2894858 - RNA, 15 nt, Human
auaacucaucauaaa

SEQ ID NO: 2894859 - RNA, 17 nt, Human
auaacucaucauaaaau

SEQ ID NO: 2894860 - RNA, 16 nt, Human
auaacucaucauaaaa

SEQ ID NO: 2894861 - RNA, 19 nt, Human
auaacucaucauaaaauaa

SEQ ID NO: 2894862 - RNA, 18 nt, Human
auaacucaucauaaaaua

SEQ ID NO: 2894863 - RNA, 18 nt, Human
auaaauugcuccuugaca

SEQ ID NO: 2894864 - RNA, 19 nt, Human
auaacuaguguugcuugga

SEQ ID NO: 2894865 - RNA, 16 nt, Human
auaacuaguguugcuu

SEQ ID NO: 2894866 - RNA, 15 nt, Human
auaacuauguugaua

SEQ ID NO: 2894867 - RNA, 22 nt, Human
auaagaaaaccaccccuuagau

SEQ ID NO: 2894868 - RNA, 23 nt, Human
auaagaaaaccaccccuuagauu

SEQ ID NO: 2894869 - RNA, 19 nt, Human
auaagauccuagauccuaa

SEQ ID NO: 2894870 - RNA, 13 nt, Human
auaagaaagacau

SEQ ID NO: 2894871 - RNA, 14 nt, Human
auaagaaagacauc

SEQ ID NO: 2894872 - RNA, 16 nt, Human
uuagaagucacacagu

SEQ ID NO: 2894873 - RNA, 13 nt, Human
uuagaauaaauuc

SEQ ID NO: 2894874 - RNA, 16 nt, Human
uuagaauaaauuccca

SEQ ID NO: 2894875 - RNA, 17 nt, Human
uuagaagugcauuucug

SEQ ID NO: 2894876 - RNA, 19 nt, Human
uuagaagugcauuucugaa

SEQ ID NO: 2894877 - RNA, 12 nt, Human
uuagaaguguca

SEQ ID NO: 2894878 - RNA, 13 nt, Human
uuagaagugucau

SEQ ID NO: 2894879 - RNA, 14 nt, Human
uuagaagugucaug

SEQ ID NO: 2894880 - RNA, 17 nt, Human
uuagaagugucauguuu

SEQ ID NO: 2894881 - RNA, 18 nt, Human
uuagaagguucucuccuc

SEQ ID NO: 2894882 - RNA, 23 nt, Human
uuacugucugguuuuaacaauuu

SEQ ID NO: 2894883 - RNA, 13 nt, Human
uuacuguaccugu

SEQ ID NO: 2894884 - RNA, 22 nt, Human
uuacugucugguuuuaacaauu

SEQ ID NO: 2894885 - RNA, 15 nt, Human
uuacuguaauuccuc

SEQ ID NO: 2894886 - RNA, 12 nt, Human
uuagaauuauuu

SEQ ID NO: 2894887 - RNA, 13 nt, Human
uuagaauuauuua

SEQ ID NO: 2894888 - RNA, 15 nt, Human
uuagaauuauuuaaa

SEQ ID NO: 2894889 - RNA, 16 nt, Human
uuagaauuauuuaaac

SEQ ID NO: 2894890 - RNA, 21 nt, Human
uuagaauccacguauuccccu

SEQ ID NO: 2894891 - RNA, 12 nt, Human
uuagaaugaaaa

SEQ ID NO: 2894892 - RNA, 14 nt, Human
uuagaaucuauuuu

SEQ ID NO: 2894893 - RNA, 15 nt, Human
uuagaaucuauuuuc

SEQ ID NO: 2894894 - RNA, 16 nt, Human
uuagaaucuauuuucu

SEQ ID NO: 2894895 - RNA, 17 nt, Human
uuagaaucuauuuucua

SEQ ID NO: 2894896 - RNA, 21 nt, Human
uuagaaucuauuuucuaugua

SEQ ID NO: 2894897 - RNA, 23 nt, Human
uuagaaucuauuuucuauguacu

SEQ ID NO: 2894898 - RNA, 21 nt, Human
uuagaaucagccuugaaacau

SEQ ID NO: 2894899 - RNA, 20 nt, Human
uuagaaucauuaccuuuuac

SEQ ID NO: 2894900 - RNA, 20 nt, Human
uuacucccaagacuucauug

SEQ ID NO: 2894901 - RNA, 22 nt, Human
uuacuccuauuuuuguaaacug

SEQ ID NO: 2894902 - RNA, 15 nt, Human
uuacuccucacacuu

SEQ ID NO: 2894903 - RNA, 21 nt, Human
uuacuccucacacuuacugua

SEQ ID NO: 2894904 - RNA, 12 nt, Human
uuacuccuccuc

SEQ ID NO: 2894905 - RNA, 17 nt, Human
uuacuccuccucuuucu

SEQ ID NO: 2894906 - RNA, 18 nt, Human
uuacuccuccucuuucuc

SEQ ID NO: 2894907 - RNA, 19 nt, Human
uuacaggugugcaccacca

SEQ ID NO: 2894908 - RNA, 16 nt, Human
uuacuccauaaacaga

SEQ ID NO: 2894909 - RNA, 19 nt, Human
uuacugccgguuugaaaau

SEQ ID NO: 2894910 - RNA, 21 nt, Human
uuacugccaaagggaaauauc

SEQ ID NO: 2894911 - RNA, 22 nt, Human
uuacugcagccuuugccucccc

SEQ ID NO: 2894912 - RNA, 12 nt, Human
uuacugcaguug

SEQ ID NO: 2894913 - RNA, 21 nt, Human
uuacugcauggggaaagagau

SEQ ID NO: 2894914 - RNA, 22 nt, Human
uuacucuaagaucuuagauucu

SEQ ID NO: 2894915 - RNA, 18 nt, Human
uuacucuagauaccuaaa

SEQ ID NO: 2894916 - RNA, 12 nt, Human
uuacucuaagau

SEQ ID NO: 2894917 - RNA, 14 nt, Human
uuacucuaagaucu

SEQ ID NO: 2894918 - RNA, 19 nt, Human
uuacucuaagaucuuagau

SEQ ID NO: 2894919 - RNA, 21 nt, Human
uuacucuaagaucuuagauuc

SEQ ID NO: 2894920 - RNA, 21 nt, Human
uuacucauuuuuuuaauuuau

SEQ ID NO: 2894921 - RNA, 13 nt, Human
uuacucauugaaa

SEQ ID NO: 2894922 - RNA, 14 nt, Human
uuacucauugaaau

SEQ ID NO: 2894923 - RNA, 15 nt, Human
uuacucauugaaaug

SEQ ID NO: 2894924 - RNA, 16 nt, Human
uuacucauugaaaugu

SEQ ID NO: 2894925 - RNA, 17 nt, Human
uuacucauugaaauguc

SEQ ID NO: 2894926 - RNA, 18 nt, Human
uuacucauugaaauguca

SEQ ID NO: 2894927 - RNA, 19 nt, Human
uuacucauugaaaugucac

SEQ ID NO: 2894928 - RNA, 13 nt, Human
uuacucagggcuc

SEQ ID NO: 2894929 - RNA, 18 nt, Human
uuacucagggcuccuccc

SEQ ID NO: 2894930 - RNA, 19 nt, Human
uuacucagggcuccuccca

SEQ ID NO: 2894931 - RNA, 20 nt, Human
uuacucagggcuccucccag

SEQ ID NO: 2894932 - RNA, 21 nt, Human
uuacucagggcuccucccagc

SEQ ID NO: 2894933 - RNA, 15 nt, Human
uuacucaguuuaugu

SEQ ID NO: 2894934 - RNA, 19 nt, Human
uuaccauggaguuaacauc

SEQ ID NO: 2894935 - RNA, 21 nt, Human
uuaccagucuuuaaaggccca

SEQ ID NO: 2894936 - RNA, 23 nt, Human
uuaccagucuuuaaaggcccagc

SEQ ID NO: 2894937 - RNA, 23 nt, Human
uuaccaguggcguuguugcaugu

SEQ ID NO: 2894938 - RNA, 24 nt, Human
uuaccaguggcguuguugcauguu

SEQ ID NO: 2894939 - RNA, 16 nt, Human
uuaccaguuaauuacu

SEQ ID NO: 2894940 - RNA, 18 nt, Human
uuaccaguuaauuacuca

SEQ ID NO: 2894941 - RNA, 22 nt, Human
augaauaucuauuaauauaugu

SEQ ID NO: 2894942 - RNA, 18 nt, Human
augaagagcuugcuuuga

SEQ ID NO: 2894943 - RNA, 17 nt, Human
augaauauugaaguuuc

SEQ ID NO: 2894944 - RNA, 13 nt, Human
augaaucacuguu

SEQ ID NO: 2894945 - RNA, 17 nt, Human
augaaucacuguuuuua

SEQ ID NO: 2894946 - RNA, 18 nt, Human
augaaucacuguuuuuag

SEQ ID NO: 2894947 - RNA, 19 nt, Human
augaaucacuguuuuuaga

SEQ ID NO: 2894948 - RNA, 21 nt, Human
augaaucacuguuuuuagaca

SEQ ID NO: 2894949 - RNA, 23 nt, Human
augaaucacuguuuuuagacacc

SEQ ID NO: 2894950 - RNA, 18 nt, Human
augaauaucuauuaauau

SEQ ID NO: 2894951 - RNA, 19 nt, Human
augaauaucuauuaauaua

SEQ ID NO: 2894952 - RNA, 20 nt, Human
augaauaucuauuaauauau

SEQ ID NO: 2894953 - RNA, 21 nt, Human
augaauaucuauuaauauaug

SEQ ID NO: 2894954 - RNA, 12 nt, Human
augaauauuuug

SEQ ID NO: 2894955 - RNA, 13 nt, Human
augaauauuuuga

SEQ ID NO: 2894956 - RNA, 14 nt, Human
augaauauuuugau

SEQ ID NO: 2894957 - RNA, 15 nt, Human
augaauauuuugaua

SEQ ID NO: 2894958 - RNA, 19 nt, Human
augaauauuuugauaauaa

SEQ ID NO: 2894959 - RNA, 20 nt, Human
augaauauuuugauaauaau

SEQ ID NO: 2894960 - RNA, 22 nt, Human
augaauauuuugauaauaauau

SEQ ID NO: 2894961 - RNA, 21 nt, Human
augaaugguauggaacucucu

SEQ ID NO: 2894962 - RNA, 16 nt, Human
uuggggagauuugcca

SEQ ID NO: 2894963 - RNA, 20 nt, Human
uuggggaggacaaaacuucu

SEQ ID NO: 2894964 - RNA, 16 nt, Human
uuggugagaaaccugu

SEQ ID NO: 2894965 - RNA, 18 nt, Human
uuggugagaaaccuguau

SEQ ID NO: 2894966 - RNA, 21 nt, Human
uuggugagaaaccuguaucuu

SEQ ID NO: 2894967 - RNA, 15 nt, Human
uuggugauucaaaug

SEQ ID NO: 2894968 - RNA, 16 nt, Human
uuggugauucaaaugg

SEQ ID NO: 2894969 - RNA, 21 nt, Human
uuggugcaacccuuaccccuu

SEQ ID NO: 2894970 - RNA, 16 nt, Human
uuggugcaacccuuac

SEQ ID NO: 2894971 - RNA, 15 nt, Human
uuggggagguguuca

SEQ ID NO: 2894972 - RNA, 12 nt, Human
uuggugccuggc

SEQ ID NO: 2894973 - RNA, 13 nt, Human
uuggugccuggcc

SEQ ID NO: 2894974 - RNA, 15 nt, Human
uuggugcauagaacu

SEQ ID NO: 2894975 - RNA, 16 nt, Human
uuggugcauagaacug

SEQ ID NO: 2894976 - RNA, 21 nt, Human
uuggugcauagaacuggguaa

SEQ ID NO: 2894977 - RNA, 22 nt, Human
uuggugcauagaacuggguaaa

SEQ ID NO: 2894978 - RNA, 22 nt, Human
augaaauugucuagcagagcag

SEQ ID NO: 2894979 - RNA, 20 nt, Human
augaaauugucuagcagagc

SEQ ID NO: 2894980 - RNA, 16 nt, Human
augaaauuacuuauca

SEQ ID NO: 2894981 - RNA, 23 nt, Human
augaaauuacuuaucauccacau

SEQ ID NO: 2894982 - RNA, 16 nt, Human
augaacuuauucugua

SEQ ID NO: 2894983 - RNA, 17 nt, Human
augaacuuauucuguag

SEQ ID NO: 2894984 - RNA, 18 nt, Human
augaacuuauucuguaga

SEQ ID NO: 2894985 - RNA, 23 nt, Human
augaaauugucuagcagagcagg

SEQ ID NO: 2894986 - RNA, 12 nt, Human
augaaauuuaaa

SEQ ID NO: 2894987 - RNA, 14 nt, Human
augaaauuuaaaca

SEQ ID NO: 2894988 - RNA, 15 nt, Human
augaaauuuaaacau

SEQ ID NO: 2894989 - RNA, 16 nt, Human
augaaauuuaaacauu

SEQ ID NO: 2894990 - RNA, 18 nt, Human
augaaauuuaaacauuaa

SEQ ID NO: 2894991 - RNA, 21 nt, Human
augaaauuuaaacauuaaaaa

SEQ ID NO: 2894992 - RNA, 19 nt, Human
augaaagggcccagagagg

SEQ ID NO: 2894993 - RNA, 16 nt, Human
augaaagguuuacauu

SEQ ID NO: 2894994 - RNA, 14 nt, Human
augaaagguacuau

SEQ ID NO: 2894995 - RNA, 15 nt, Human
augaaagguacuaua

SEQ ID NO: 2894996 - RNA, 20 nt, Human
augaaagguacuauauuugc

SEQ ID NO: 2894997 - RNA, 21 nt, Human
augaaagguacuauauuugcu

SEQ ID NO: 2894998 - RNA, 21 nt, Human
augaaagguuuacauugucaa

SEQ ID NO: 2894999 - RNA, 16 nt, Human
augaagacaggacagu

SEQ ID NO: 2895000 - RNA, 21 nt, Human
augaagacaggacagugcuuc

SEQ ID NO: 2895001 - RNA, 15 nt, Human
augaagagaagcaau

SEQ ID NO: 2895002 - RNA, 18 nt, Human
augaagagaagcaauuuu

SEQ ID NO: 2895003 - RNA, 11 nt, Human
augaagaggag

SEQ ID NO: 2895004 - RNA, 13 nt, Human
augaagagcaaaa

SEQ ID NO: 2895005 - RNA, 15 nt, Human
augaagagcaaaaau

SEQ ID NO: 2895006 - RNA, 17 nt, Human
augaauaucuauuaaua

SEQ ID NO: 2895007 - RNA, 18 nt, Human
augaauaucauacaaauc

SEQ ID NO: 2895008 - RNA, 20 nt, Human
uuggagacacaacuauuuuu

SEQ ID NO: 2895009 - RNA, 17 nt, Human
uugcuugagcccaggag

SEQ ID NO: 2895010 - RNA, 16 nt, Human
uugcuugagcccagga

SEQ ID NO: 2895011 - RNA, 18 nt, Human
uugcuugagcccaggagu

SEQ ID NO: 2895012 - RNA, 22 nt, Human
uuggagacccgccuggcuaaca

SEQ ID NO: 2895013 - RNA, 22 nt, Human
uuggagacccugcaaacagaac

SEQ ID NO: 2895014 - RNA, 23 nt, Human
uuggagacccugcaaacagaaca

SEQ ID NO: 2895015 - RNA, 15 nt, Human
uuggagaccuuaccc

SEQ ID NO: 2895016 - RNA, 11 nt, Human
uuggagacaga

SEQ ID NO: 2895017 - RNA, 14 nt, Human
uugcuugagcccag

SEQ ID NO: 2895018 - RNA, 15 nt, Human
uuggagacucugugg

SEQ ID NO: 2895019 - RNA, 13 nt, Human
uuggagacucugu

SEQ ID NO: 2895020 - RNA, 20 nt, Human
uuggagacucuguggggccu

SEQ ID NO: 2895021 - RNA, 16 nt, Human
uuggagacuuucuuua

SEQ ID NO: 2895022 - RNA, 22 nt, Human
uuggagacuuucuuuaaauuau

SEQ ID NO: 2895023 - RNA, 15 nt, Human
uuggagagacacagc

SEQ ID NO: 2895024 - RNA, 22 nt, Human
uugcucgggucccuucaccucc

SEQ ID NO: 2895025 - RNA, 17 nt, Human
uugcuugacuucaguua

SEQ ID NO: 2895026 - RNA, 23 nt, Human
uuggagggugggagagcccagcc

SEQ ID NO: 2895027 - RNA, 22 nt, Human
uuggagggugggagagcccagc

SEQ ID NO: 2895028 - RNA, 22 nt, Human
uuggagggcccacuuguauccu

SEQ ID NO: 2895029 - RNA, 16 nt, Human
uuggagggugucccaa

SEQ ID NO: 2895030 - RNA, 23 nt, Human
uuggaguccccucaccuccucua

SEQ ID NO: 2895031 - RNA, 18 nt, Human
uuggccccugcccggcug

SEQ ID NO: 2895032 - RNA, 23 nt, Human
uuggcuauuagagaucaaccccu

SEQ ID NO: 2895033 - RNA, 11 nt, Human
uuggccugagu

SEQ ID NO: 2895034 - RNA, 14 nt, Human
uuggcucaauccuc

SEQ ID NO: 2895035 - RNA, 13 nt, Human
uuggcucaauccu

SEQ ID NO: 2895036 - RNA, 17 nt, Human
uuggcucaauaaagauu

SEQ ID NO: 2895037 - RNA, 19 nt, Human
uuggcccuuuccuuccaga

SEQ ID NO: 2895038 - RNA, 14 nt, Human
uuggcccuuuccuu

SEQ ID NO: 2895039 - RNA, 23 nt, Human
uuggccuagcccacccugcugcc

SEQ ID NO: 2895040 - RNA, 20 nt, Human
uuggccuaucuccuagggcu

SEQ ID NO: 2895041 - RNA, 19 nt, Human
uuggccggcugugcucaga

SEQ ID NO: 2895042 - RNA, 21 nt, Human
uuggccggcugugcucagaga

SEQ ID NO: 2895043 - RNA, 12 nt, Human
uuggccucagaa

SEQ ID NO: 2895044 - RNA, 14 nt, Human
aucuuugcacucca

SEQ ID NO: 2895045 - RNA, 16 nt, Human
aucuuugcacuccaau

SEQ ID NO: 2895046 - RNA, 13 nt, Human
aucuuuucauucu

SEQ ID NO: 2895047 - RNA, 17 nt, Human
aucuuugcagacaggca

SEQ ID NO: 2895048 - RNA, 18 nt, Human
augaaagggcccagagag

SEQ ID NO: 2895049 - RNA, 15 nt, Human
augaaagggcccaga

SEQ ID NO: 2895050 - RNA, 14 nt, Human
aucuuuugggggaa

SEQ ID NO: 2895051 - RNA, 11 nt, Human
aucuuuugaac

SEQ ID NO: 2895052 - RNA, 12 nt, Human
aucuuuucuuua

SEQ ID NO: 2895053 - RNA, 13 nt, Human
aucuuuucuuuag

SEQ ID NO: 2895054 - RNA, 18 nt, Human
aucuuuucuuuagagaac

SEQ ID NO: 2895055 - RNA, 19 nt, Human
aucuuuucuuuagagaacu

SEQ ID NO: 2895056 - RNA, 20 nt, Human
aucuuuucuuuagagaacug

SEQ ID NO: 2895057 - RNA, 22 nt, Human
aucuuuucuuuagagaacugaa

SEQ ID NO: 2895058 - RNA, 23 nt, Human
aucuuuucuuuagagaacugaaa

SEQ ID NO: 2895059 - RNA, 13 nt, Human
uuggcucagacau

SEQ ID NO: 2895060 - RNA, 14 nt, Human
uuggcucagacaug

SEQ ID NO: 2895061 - RNA, 13 nt, Human
aucuuucugcaga

SEQ ID NO: 2895062 - RNA, 11 nt, Human
aucuuucuucu

SEQ ID NO: 2895063 - RNA, 22 nt, Human
aucuuucuucuauuuuauuccc

SEQ ID NO: 2895064 - RNA, 19 nt, Human
aucuuucuucuauuuuauu

SEQ ID NO: 2895065 - RNA, 21 nt, Human
aucuuucuuuugauucuuccu

SEQ ID NO: 2895066 - RNA, 13 nt, Human
aucugcccgccug

SEQ ID NO: 2895067 - RNA, 15 nt, Human
aucugcccgccugcc

SEQ ID NO: 2895068 - RNA, 17 nt, Human
aucugcccgccugccca

SEQ ID NO: 2895069 - RNA, 18 nt, Human
aucugcccgccugcccac

SEQ ID NO: 2895070 - RNA, 19 nt, Human
aucugcccgccugcccacc

SEQ ID NO: 2895071 - RNA, 20 nt, Human
aucugcccgccugcccaccu

SEQ ID NO: 2895072 - RNA, 21 nt, Human
aucugcccgccugcccaccug

SEQ ID NO: 2895073 - RNA, 22 nt, Human
aucugcccgccugcccaccugc

SEQ ID NO: 2895074 - RNA, 23 nt, Human
aucugcccgccugcccaccugcc

SEQ ID NO: 2895075 - RNA, 17 nt, Human
aucugccccucccccaa

SEQ ID NO: 2895076 - RNA, 23 nt, Human
aucugcggaucucagcuuugaga

SEQ ID NO: 2895077 - RNA, 22 nt, Human
aucugcggaucucagcuuugag

SEQ ID NO: 2895078 - RNA, 15 nt, Human
aucugcgaucaucgu

SEQ ID NO: 2895079 - RNA, 20 nt, Human
aucugcuagggaauaucaau

SEQ ID NO: 2895080 - RNA, 14 nt, Human
aucugcccaacugu

SEQ ID NO: 2895081 - RNA, 21 nt, Human
aucugcccaacuguguagcau

SEQ ID NO: 2895082 - RNA, 15 nt, Human
aucugcccaccucag

SEQ ID NO: 2895083 - RNA, 23 nt, Human
aucugcccaccucagccucccaa

SEQ ID NO: 2895084 - RNA, 16 nt, Human
aucugccccuccccca

SEQ ID NO: 2895085 - RNA, 15 nt, Human
aucugccccuccccc

SEQ ID NO: 2895086 - RNA, 12 nt, Human
aucugccccucc

SEQ ID NO: 2895087 - RNA, 11 nt, Human
aucugccccuc

SEQ ID NO: 2895088 - RNA, 15 nt, Human
uugcauuugcucuuu

SEQ ID NO: 2895089 - RNA, 20 nt, Human
uugcauuuauauguaccgua

SEQ ID NO: 2895090 - RNA, 15 nt, Human
uugcauuuauaugua

SEQ ID NO: 2895091 - RNA, 15 nt, Human
uugccaaaaaggaua

SEQ ID NO: 2895092 - RNA, 13 nt, Human
aucugcucacuuu

SEQ ID NO: 2895093 - RNA, 14 nt, Human
aucugcucacuuua

SEQ ID NO: 2895094 - RNA, 18 nt, Human
aucugcucacuuuaaacc

SEQ ID NO: 2895095 - RNA, 21 nt, Human
aucuggucuuguuagaaaaca

SEQ ID NO: 2895096 - RNA, 14 nt, Human
aucuggugaucucc

SEQ ID NO: 2895097 - RNA, 20 nt, Human
aucuguauauacaauaacau

SEQ ID NO: 2895098 - RNA, 14 nt, Human
aucuguauauacaa

SEQ ID NO: 2895099 - RNA, 18 nt, Human
aucugucucccaguuaug

SEQ ID NO: 2895100 - RNA, 20 nt, Human
aucugucucccaguuaugaa

SEQ ID NO: 2895101 - RNA, 13 nt, Human
aucugucuaaaga

SEQ ID NO: 2895102 - RNA, 17 nt, Human
aucugucuaaagauaga

SEQ ID NO: 2895103 - RNA, 21 nt, Human
aucuguauauacaauaacaua

SEQ ID NO: 2895104 - RNA, 12 nt, Human
uugcauuuggaa

SEQ ID NO: 2895105 - RNA, 23 nt, Human
aucuguauguauuagugauauuu

SEQ ID NO: 2895106 - RNA, 15 nt, Human
aucugucaaaacacu

SEQ ID NO: 2895107 - RNA, 16 nt, Human
aucugucaaaacacug

SEQ ID NO: 2895108 - RNA, 17 nt, Human
aucugucaaaacacugu

SEQ ID NO: 2895109 - RNA, 18 nt, Human
aucugucaaaacacugug

SEQ ID NO: 2895110 - RNA, 19 nt, Human
aucugucaaaacacugugg

SEQ ID NO: 2895111 - RNA, 20 nt, Human
aucugucaaaacacugugga

SEQ ID NO: 2895112 - RNA, 22 nt, Human
aucugucaaaacacuguggaac

SEQ ID NO: 2895113 - RNA, 23 nt, Human
aucuguccaaaggaggcuggcag

SEQ ID NO: 2895114 - RNA, 21 nt, Human
aucuguccaaaggaggcuggc

SEQ ID NO: 2895115 - RNA, 19 nt, Human
aucuguccaaaggaggcug

SEQ ID NO: 2895116 - RNA, 18 nt, Human
aucuguccaaaggaggcu

SEQ ID NO: 2895117 - RNA, 16 nt, Human
aucuugcgaauccaag

SEQ ID NO: 2895118 - RNA, 21 nt, Human
aucuugcgaauccaagcuccc

SEQ ID NO: 2895119 - RNA, 22 nt, Human
aucuugcgaauccaagcucccu

SEQ ID NO: 2895120 - RNA, 23 nt, Human
aucuugcgaauccaagcucccug

SEQ ID NO: 2895121 - RNA, 17 nt, Human
aucuugccggucauuuu

SEQ ID NO: 2895122 - RNA, 23 nt, Human
aucuuaguuuggauucuuaugua

SEQ ID NO: 2895123 - RNA, 22 nt, Human
aucuugcagaaguucuuagugu

SEQ ID NO: 2895124 - RNA, 13 nt, Human
aucuugcucugcu

SEQ ID NO: 2895125 - RNA, 14 nt, Human
aucuuaguuuggau

SEQ ID NO: 2895126 - RNA, 22 nt, Human
aucuuaguuuggauucuuaugu

SEQ ID NO: 2895127 - RNA, 12 nt, Human
aucuuagugguu

SEQ ID NO: 2895128 - RNA, 15 nt, Human
aucuuagggugaacc

SEQ ID NO: 2895129 - RNA, 18 nt, Human
aucuuagggugaaccacu

SEQ ID NO: 2895130 - RNA, 19 nt, Human
aucuguuuugaaggcaaaa

SEQ ID NO: 2895131 - RNA, 18 nt, Human
aucuguuuugaaggcaaa

SEQ ID NO: 2895132 - RNA, 17 nt, Human
aucuguuuugaaggcaa

SEQ ID NO: 2895133 - RNA, 12 nt, Human
aucugucuugua

SEQ ID NO: 2895134 - RNA, 13 nt, Human
aucugucuuguaa

SEQ ID NO: 2895135 - RNA, 14 nt, Human
aucugucuuguaau

SEQ ID NO: 2895136 - RNA, 15 nt, Human
aucugucuuguaaua

SEQ ID NO: 2895137 - RNA, 16 nt, Human
aucugucuuguaauau

SEQ ID NO: 2895138 - RNA, 21 nt, Human
aucugucuuguaauauuuugu

SEQ ID NO: 2895139 - RNA, 22 nt, Human
aucugucuuguaauauuuugua

SEQ ID NO: 2895140 - RNA, 13 nt, Human
aucuguuucccag

SEQ ID NO: 2895141 - RNA, 14 nt, Human
aucuguuucccagc

SEQ ID NO: 2895142 - RNA, 15 nt, Human
uugcuucuugugaag

SEQ ID NO: 2895143 - RNA, 18 nt, Human
uugcuucuugugaaggcc

SEQ ID NO: 2895144 - RNA, 21 nt, Human
uugcuucuugugaaggccaug

SEQ ID NO: 2895145 - RNA, 20 nt, Human
uugcucugccaacuucuuca

SEQ ID NO: 2895146 - RNA, 15 nt, Human
uugcuucuuacugau

SEQ ID NO: 2895147 - RNA, 18 nt, Human
uugcuucuuacugauaau

SEQ ID NO: 2895148 - RNA, 20 nt, Human
uugcucucugugucugagag

SEQ ID NO: 2895149 - RNA, 22 nt, Human
uugcucaaguucauugaugacc

SEQ ID NO: 2895150 - RNA, 21 nt, Human
uugcucaaguucauugaugac

SEQ ID NO: 2895151 - RNA, 14 nt, Human
uugcucuaggaaga

SEQ ID NO: 2895152 - RNA, 16 nt, Human
uugcucuaucucucaa

SEQ ID NO: 2895153 - RNA, 21 nt, Human
uugcucuccccugcccugcug

SEQ ID NO: 2895154 - RNA, 12 nt, Human
uugcuccuugac

SEQ ID NO: 2895155 - RNA, 14 nt, Human
uugcuccuggccuu

SEQ ID NO: 2895156 - RNA, 18 nt, Human
uugcuccuggccuugcug

SEQ ID NO: 2895157 - RNA, 16 nt, Human
aucuuguauacacaua

SEQ ID NO: 2895158 - RNA, 18 nt, Human
uugcuauugaauugagau

SEQ ID NO: 2895159 - RNA, 14 nt, Human
uugcuauuagagca

SEQ ID NO: 2895160 - RNA, 17 nt, Human
uugcuauuagagcauug

SEQ ID NO: 2895161 - RNA, 11 nt, Human
aucuugugaaa

SEQ ID NO: 2895162 - RNA, 15 nt, Human
uugcuauguuacuau

SEQ ID NO: 2895163 - RNA, 16 nt, Human
uugcuauguuacuauu

SEQ ID NO: 2895164 - RNA, 18 nt, Human
uugcuauguuacuauuuu

SEQ ID NO: 2895165 - RNA, 19 nt, Human
uugcuauguuacuauuuuc

SEQ ID NO: 2895166 - RNA, 21 nt, Human
uugcuauguuacuauuuucua

SEQ ID NO: 2895167 - RNA, 23 nt, Human
uugcuauguuacuauuuucuaca

SEQ ID NO: 2895168 - RNA, 15 nt, Human
aucuugugaaauggc

SEQ ID NO: 2895169 - RNA, 20 nt, Human
aucuugugaaauggccagga

SEQ ID NO: 2895170 - RNA, 18 nt, Human
aucuugugcuagaauacu

SEQ ID NO: 2895171 - RNA, 19 nt, Human
aucuugugcuagaauacuu

SEQ ID NO: 2895172 - RNA, 20 nt, Human
aucuugugcuagaauacuuu

SEQ ID NO: 2895173 - RNA, 22 nt, Human
aucuugugcuagaauacuuuuu

SEQ ID NO: 2895174 - RNA, 21 nt, Human
aucuacaucuuuuuucacaaa

SEQ ID NO: 2895175 - RNA, 14 nt, Human
aucuacaucuuuuu

SEQ ID NO: 2895176 - RNA, 17 nt, Human
aucuacaucuuuuuuca

SEQ ID NO: 2895177 - RNA, 20 nt, Human
aucuacaucuuuuuucacaa

SEQ ID NO: 2895178 - RNA, 22 nt, Human
aucuaauauauaugaauaaagu

SEQ ID NO: 2895179 - RNA, 23 nt, Human
aucuaauauggccacaguagucu

SEQ ID NO: 2895180 - RNA, 18 nt, Human
aucuaauauguaacaagc

SEQ ID NO: 2895181 - RNA, 19 nt, Human
aucuaauauauaugaauaa

SEQ ID NO: 2895182 - RNA, 20 nt, Human
aucuaauauauaugaauaaa

SEQ ID NO: 2895183 - RNA, 16 nt, Human
aucuaauauggccaca

SEQ ID NO: 2895184 - RNA, 15 nt, Human
aucuaauauauauga

SEQ ID NO: 2895185 - RNA, 22 nt, Human
aucuaauagcggguuacuuuca

SEQ ID NO: 2895186 - RNA, 17 nt, Human
aucuaauauauaugaau

SEQ ID NO: 2895187 - RNA, 18 nt, Human
aucuaauauauaugaaua

SEQ ID NO: 2895188 - RNA, 13 nt, Human
uugauaccccccu

SEQ ID NO: 2895189 - RNA, 15 nt, Human
uugauaccccccucu

SEQ ID NO: 2895190 - RNA, 13 nt, Human
uugauaccccugg

SEQ ID NO: 2895191 - RNA, 16 nt, Human
uugauaccccugggga

SEQ ID NO: 2895192 - RNA, 20 nt, Human
uugauaccccuggggaacau

SEQ ID NO: 2895193 - RNA, 23 nt, Human
uugauaccccuggggaacauuuc

SEQ ID NO: 2895194 - RNA, 22 nt, Human
aucuaauaccucugugugcucc

SEQ ID NO: 2895195 - RNA, 21 nt, Human
aucuaauagcggguuacuuuc

SEQ ID NO: 2895196 - RNA, 19 nt, Human
aucuaauaccucugugugc

SEQ ID NO: 2895197 - RNA, 22 nt, Human
uugagucuguuuuuuuauaguu

SEQ ID NO: 2895198 - RNA, 18 nt, Human
uugaguucuguagagccu

SEQ ID NO: 2895199 - RNA, 13 nt, Human
uugauacauaaua

SEQ ID NO: 2895200 - RNA, 17 nt, Human
uugauacauaauaaaaa

SEQ ID NO: 2895201 - RNA, 23 nt, Human
uugauacauaauaaaaaauuaug

SEQ ID NO: 2895202 - RNA, 15 nt, Human
uugauaauugcauuc

SEQ ID NO: 2895203 - RNA, 23 nt, Human
uugauaauugcauucaucuugug

SEQ ID NO: 2895204 - RNA, 14 nt, Human
uugauaauguuaaa

SEQ ID NO: 2895205 - RNA, 15 nt, Human
uugauaauguuaaau

SEQ ID NO: 2895206 - RNA, 18 nt, Human
uugauaauguuaaauuug

SEQ ID NO: 2895207 - RNA, 19 nt, Human
uugauaauguuaaauuugu

SEQ ID NO: 2895208 - RNA, 20 nt, Human
uugauaauguuaaauuugua

SEQ ID NO: 2895209 - RNA, 21 nt, Human
uugauaauguuaaauuuguaa

SEQ ID NO: 2895210 - RNA, 22 nt, Human
uugauaauguuaaauuuguaag

SEQ ID NO: 2895211 - RNA, 12 nt, Human
uugauaauucuu

SEQ ID NO: 2895212 - RNA, 21 nt, Human
uugauaauucuuauuuugugg

SEQ ID NO: 2895213 - RNA, 22 nt, Human
uugauaauucuuauuuugugga

SEQ ID NO: 2895214 - RNA, 13 nt, Human
uugaguuuguagg

SEQ ID NO: 2895215 - RNA, 20 nt, Human
uugaguuuguagguaaaaug

SEQ ID NO: 2895216 - RNA, 14 nt, Human
uugauaaugauaaa

SEQ ID NO: 2895217 - RNA, 15 nt, Human
uugauaaugcuuuca

SEQ ID NO: 2895218 - RNA, 23 nt, Human
uugauaaugcuuucacaacauuu

SEQ ID NO: 2895219 - RNA, 18 nt, Human
uugaguuuucuucuguga

SEQ ID NO: 2895220 - RNA, 13 nt, Human
uugauaauguuaa

SEQ ID NO: 2895221 - RNA, 21 nt, Human
uugacuuaaugugauuacugc

SEQ ID NO: 2895222 - RNA, 18 nt, Human
uugacuuauaguacauga

SEQ ID NO: 2895223 - RNA, 16 nt, Human
uugacuugauuagugc

SEQ ID NO: 2895224 - RNA, 16 nt, Human
uugacuugcaugaaga

SEQ ID NO: 2895225 - RNA, 13 nt, Human
uugacuuuaauuu

SEQ ID NO: 2895226 - RNA, 14 nt, Human
uugacuuuaauuua

SEQ ID NO: 2895227 - RNA, 12 nt, Human
uugacuuucagg

SEQ ID NO: 2895228 - RNA, 12 nt, Human
uugagacagagu

SEQ ID NO: 2895229 - RNA, 21 nt, Human
uugacuuucagguacuaaaua

SEQ ID NO: 2895230 - RNA, 15 nt, Human
uugacuuucagguac

SEQ ID NO: 2895231 - RNA, 14 nt, Human
uugacuuucaggua

SEQ ID NO: 2895232 - RNA, 13 nt, Human
uugacuuucaggu

SEQ ID NO: 2895233 - RNA, 20 nt, Human
uugagacagugcacaugaac

SEQ ID NO: 2895234 - RNA, 15 nt, Human
uugagaccagccugg

SEQ ID NO: 2895235 - RNA, 13 nt, Human
uugagaccagccu

SEQ ID NO: 2895236 - RNA, 12 nt, Human
uugagacaguuu

SEQ ID NO: 2895237 - RNA, 13 nt, Human
uugagacaguuuc

SEQ ID NO: 2895238 - RNA, 17 nt, Human
uugagacaguuucuuag

SEQ ID NO: 2895239 - RNA, 19 nt, Human
uugagacaguuucuuagcu

SEQ ID NO: 2895240 - RNA, 13 nt, Human
uugagauggggau

SEQ ID NO: 2895241 - RNA, 18 nt, Human
uugagauggggauaaaau

SEQ ID NO: 2895242 - RNA, 22 nt, Human
uugagauggggauaaaaugacu

SEQ ID NO: 2895243 - RNA, 23 nt, Human
uugagauggggauaaaaugacua

SEQ ID NO: 2895244 - RNA, 13 nt, Human
uugagauguauga

SEQ ID NO: 2895245 - RNA, 17 nt, Human
uugagauguaugaaggc

SEQ ID NO: 2895246 - RNA, 22 nt, Human
uugagacaguuucuuagcuuuu

SEQ ID NO: 2895247 - RNA, 14 nt, Human
uugagacuaguuuu

SEQ ID NO: 2895248 - RNA, 16 nt, Human
uugagacuauuuaaac

SEQ ID NO: 2895249 - RNA, 23 nt, Human
uugagacuauuuaaacuuauaaa

SEQ ID NO: 2895250 - RNA, 13 nt, Human
uugaguagauauu

SEQ ID NO: 2895251 - RNA, 16 nt, Human
uugaguagauauuacu

SEQ ID NO: 2895252 - RNA, 17 nt, Human
uugaguagauauuacuu

SEQ ID NO: 2895253 - RNA, 19 nt, Human
uugaguagauauuacuuua

SEQ ID NO: 2895254 - RNA, 20 nt, Human
uugaguagauauuacuuuau

SEQ ID NO: 2895255 - RNA, 21 nt, Human
uugaguagauauuacuuuauc

SEQ ID NO: 2895256 - RNA, 17 nt, Human
uugaguauaagaaaugc

SEQ ID NO: 2895257 - RNA, 19 nt, Human
uugaguauaagaaaugcau

SEQ ID NO: 2895258 - RNA, 21 nt, Human
uugagaugcuguaggugguau

SEQ ID NO: 2895259 - RNA, 15 nt, Human
uugagauugccccag

SEQ ID NO: 2895260 - RNA, 17 nt, Human
uugagauugccccaggu

SEQ ID NO: 2895261 - RNA, 19 nt, Human
uugagauugccccaggucu

SEQ ID NO: 2895262 - RNA, 20 nt, Human
uugagauugccccaggucug

SEQ ID NO: 2895263 - RNA, 15 nt, Human
uugagauuguccuca

SEQ ID NO: 2895264 - RNA, 11 nt, Human
uugagauuucu

SEQ ID NO: 2895265 - RNA, 21 nt, Human
uugaauaaagccugcuuuuua

SEQ ID NO: 2895266 - RNA, 20 nt, Human
uugaauaaaaauauguacaa

SEQ ID NO: 2895267 - RNA, 14 nt, Human
uugaauaaaagugc

SEQ ID NO: 2895268 - RNA, 16 nt, Human
uugaauaaaagugcac

SEQ ID NO: 2895269 - RNA, 13 nt, Human
uugaagccuuugu

SEQ ID NO: 2895270 - RNA, 15 nt, Human
uugaaggcaaaauug

SEQ ID NO: 2895271 - RNA, 12 nt, Human
uugaaggcaaaa

SEQ ID NO: 2895272 - RNA, 13 nt, Human
uugaaggccugga

SEQ ID NO: 2895273 - RNA, 15 nt, Human
uugaaggccuggaau

SEQ ID NO: 2895274 - RNA, 17 nt, Human
uugaaggcaaaauugca

SEQ ID NO: 2895275 - RNA, 18 nt, Human
uugaaucaguuuccaauu

SEQ ID NO: 2895276 - RNA, 21 nt, Human
uugaaucaguuuccaauuauu

SEQ ID NO: 2895277 - RNA, 15 nt, Human
uugaaucuauuuaag

SEQ ID NO: 2895278 - RNA, 14 nt, Human
uugaauccuuugcc

SEQ ID NO: 2895279 - RNA, 17 nt, Human
uugaaucuauuuaagua

SEQ ID NO: 2895280 - RNA, 12 nt, Human
uugaauauugug

SEQ ID NO: 2895281 - RNA, 13 nt, Human
uugaauauugugu

SEQ ID NO: 2895282 - RNA, 13 nt, Human
uugaauauuacuc

SEQ ID NO: 2895283 - RNA, 21 nt, Human
uugaauauuacuccuauuuuu

SEQ ID NO: 2895284 - RNA, 23 nt, Human
uugaauauuacuccuauuuuugu

SEQ ID NO: 2895285 - RNA, 13 nt, Human
uugaaucacagua

SEQ ID NO: 2895286 - RNA, 15 nt, Human
uugaauacuuacauu

SEQ ID NO: 2895287 - RNA, 16 nt, Human
uugaauaccauuaaaa

SEQ ID NO: 2895288 - RNA, 19 nt, Human
uugaauaccauuaaaacug

SEQ ID NO: 2895289 - RNA, 22 nt, Human
uugaauaccauuaaaacugcuu

SEQ ID NO: 2895290 - RNA, 12 nt, Human
uugaauaauaag

SEQ ID NO: 2895291 - RNA, 20 nt, Human
uugaauaauaagcaggaugu

SEQ ID NO: 2895292 - RNA, 22 nt, Human
aucuaaaucuauuuauuaauau

SEQ ID NO: 2895293 - RNA, 20 nt, Human
aucuaaaucuauuuauuaau

SEQ ID NO: 2895294 - RNA, 18 nt, Human
aucuaaaucuauuuauua

SEQ ID NO: 2895295 - RNA, 14 nt, Human
aucguuuauuucac

SEQ ID NO: 2895296 - RNA, 14 nt, Human
aucguucucugccu

SEQ ID NO: 2895297 - RNA, 21 nt, Human
auccuacaaggccuaugagua

SEQ ID NO: 2895298 - RNA, 14 nt, Human
aucuaaaugaugag

SEQ ID NO: 2895299 - RNA, 13 nt, Human
uugaagccacuga

SEQ ID NO: 2895300 - RNA, 21 nt, Human
uugaagccacugaagcuggga

SEQ ID NO: 2895301 - RNA, 17 nt, Human
uugaagccacugaagcu

SEQ ID NO: 2895302 - RNA, 19 nt, Human
auccucugguucuucauuu

SEQ ID NO: 2895303 - RNA, 21 nt, Human
aucguguauugagauuucuua

SEQ ID NO: 2895304 - RNA, 12 nt, Human
auccuccuggaa

SEQ ID NO: 2895305 - RNA, 14 nt, Human
auccuccuggaacc

SEQ ID NO: 2895306 - RNA, 16 nt, Human
auccuccuggaaccuu

SEQ ID NO: 2895307 - RNA, 21 nt, Human
auccuccuggaaccuugcugu

SEQ ID NO: 2895308 - RNA, 22 nt, Human
auccuccuggaaccuugcuguc

SEQ ID NO: 2895309 - RNA, 23 nt, Human
auccuccuggaaccuugcugucc

SEQ ID NO: 2895310 - RNA, 13 nt, Human
auccucucaccuc

SEQ ID NO: 2895311 - RNA, 16 nt, Human
auccucucaccucagc

SEQ ID NO: 2895312 - RNA, 14 nt, Human
auccucuccuuuga

SEQ ID NO: 2895313 - RNA, 15 nt, Human
auccucuccuuugaa

SEQ ID NO: 2895314 - RNA, 16 nt, Human
auccucuccuuugaaa

SEQ ID NO: 2895315 - RNA, 12 nt, Human
uugauucaaaau

SEQ ID NO: 2895316 - RNA, 15 nt, Human
uugauucaaaauauu

SEQ ID NO: 2895317 - RNA, 18 nt, Human
uugauucaaaauauuuaa

SEQ ID NO: 2895318 - RNA, 22 nt, Human
uugauucaaaauauuuaaaaau

SEQ ID NO: 2895319 - RNA, 21 nt, Human
uugauuauccauauugaguca

SEQ ID NO: 2895320 - RNA, 14 nt, Human
uugauuaacaaaua

SEQ ID NO: 2895321 - RNA, 16 nt, Human
uugauuaacaaauaug

SEQ ID NO: 2895322 - RNA, 15 nt, Human
uugauuaagauuuua

SEQ ID NO: 2895323 - RNA, 16 nt, Human
uugauuaagauuuuac

SEQ ID NO: 2895324 - RNA, 17 nt, Human
uugauuaagauuuuaca

SEQ ID NO: 2895325 - RNA, 18 nt, Human
uugauuaagauuuuacaa

SEQ ID NO: 2895326 - RNA, 20 nt, Human
uugauuaagauuuuacaaaa

SEQ ID NO: 2895327 - RNA, 11 nt, Human
uugauuaaggc

SEQ ID NO: 2895328 - RNA, 14 nt, Human
uugauuaaggcagu

SEQ ID NO: 2895329 - RNA, 16 nt, Human
uugauuaguuuucuug

SEQ ID NO: 2895330 - RNA, 22 nt, Human
uugauguuuguggccucagaau

SEQ ID NO: 2895331 - RNA, 20 nt, Human
uugauguuuguggccucaga

SEQ ID NO: 2895332 - RNA, 21 nt, Human
aucugaaauaggaaacaagug

SEQ ID NO: 2895333 - RNA, 13 nt, Human
aucugaaauguga

SEQ ID NO: 2895334 - RNA, 13 nt, Human
uugcauauucauu

SEQ ID NO: 2895335 - RNA, 19 nt, Human
uugcaauggcuauauggca

SEQ ID NO: 2895336 - RNA, 20 nt, Human
uugcaucaaggggucacuua

SEQ ID NO: 2895337 - RNA, 16 nt, Human
uugcauaugagccgug

SEQ ID NO: 2895338 - RNA, 20 nt, Human
uugcaucaccucuguaauuu

SEQ ID NO: 2895339 - RNA, 22 nt, Human
uugcauugaacacaaacuguaa

SEQ ID NO: 2895340 - RNA, 18 nt, Human
uugcauugaacacaaacu

SEQ ID NO: 2895341 - RNA, 15 nt, Human
uugcauugaacacaa

SEQ ID NO: 2895342 - RNA, 14 nt, Human
uugcauugaacaca

SEQ ID NO: 2895343 - RNA, 15 nt, Human
uugcauugacauuau

SEQ ID NO: 2895344 - RNA, 23 nt, Human
uugcauugaacacaaacuguaaa

SEQ ID NO: 2895345 - RNA, 21 nt, Human
uugcauugaccgcgacuaauu

SEQ ID NO: 2895346 - RNA, 16 nt, Human
uugcauugagcugaga

SEQ ID NO: 2895347 - RNA, 19 nt, Human
uugcaauggcagccuuggc

SEQ ID NO: 2895348 - RNA, 17 nt, Human
uugcaauggcagccuug

SEQ ID NO: 2895349 - RNA, 16 nt, Human
uugcaauggcagccuu

SEQ ID NO: 2895350 - RNA, 15 nt, Human
uugcaagguuccaca

SEQ ID NO: 2895351 - RNA, 17 nt, Human
uugcaagguuccacaga

SEQ ID NO: 2895352 - RNA, 19 nt, Human
uugcaagguuccacagagu

SEQ ID NO: 2895353 - RNA, 16 nt, Human
aucucauguaucaucu

SEQ ID NO: 2895354 - RNA, 19 nt, Human
aucucauguaucaucugga

SEQ ID NO: 2895355 - RNA, 21 nt, Human
aucuagaacacaggcaaaauc

SEQ ID NO: 2895356 - RNA, 17 nt, Human
aucuagacaauauacaa

SEQ ID NO: 2895357 - RNA, 15 nt, Human
aucucaggggccaga

SEQ ID NO: 2895358 - RNA, 16 nt, Human
aucucaggggccagag

SEQ ID NO: 2895359 - RNA, 17 nt, Human
aucucaggggccagagg

SEQ ID NO: 2895360 - RNA, 23 nt, Human
aucucaggggccagaggaacugu

SEQ ID NO: 2895361 - RNA, 15 nt, Human
aucucagucaugcau

SEQ ID NO: 2895362 - RNA, 16 nt, Human
aucucagucaugcaua

SEQ ID NO: 2895363 - RNA, 18 nt, Human
aucucagucaugcauaaa

SEQ ID NO: 2895364 - RNA, 20 nt, Human
aucucagucaugcauaaaua

SEQ ID NO: 2895365 - RNA, 21 nt, Human
aucucagucaugcauaaauau

SEQ ID NO: 2895366 - RNA, 22 nt, Human
aucuacagauagagaguuguug

SEQ ID NO: 2895367 - RNA, 21 nt, Human
aucucuucuggguuccuuccu

SEQ ID NO: 2895368 - RNA, 19 nt, Human
aucuccacagucaaagaag

SEQ ID NO: 2895369 - RNA, 18 nt, Human
aucuccaagaccagagau

SEQ ID NO: 2895370 - RNA, 20 nt, Human
aucucuucuuuuggcuucca

SEQ ID NO: 2895371 - RNA, 15 nt, Human
uugaaauuguacaua

SEQ ID NO: 2895372 - RNA, 13 nt, Human
uugaaauugugaa

SEQ ID NO: 2895373 - RNA, 19 nt, Human
uugaaauugugaacucauu

SEQ ID NO: 2895374 - RNA, 13 nt, Human
uugaaccugggag

SEQ ID NO: 2895375 - RNA, 21 nt, Human
uugaaccugugaguaaauauu

SEQ ID NO: 2895376 - RNA, 23 nt, Human
uugaaccugugaguaaauauuga

SEQ ID NO: 2895377 - RNA, 18 nt, Human
uugaacccgggaggcaga

SEQ ID NO: 2895378 - RNA, 20 nt, Human
uugaaauuaugugacauuuu

SEQ ID NO: 2895379 - RNA, 20 nt, Human
uugaaauuaagaaggcaaaa

SEQ ID NO: 2895380 - RNA, 11 nt, Human
uugaaauuaua

SEQ ID NO: 2895381 - RNA, 14 nt, Human
uugaaauuauaucu

SEQ ID NO: 2895382 - RNA, 16 nt, Human
uugaaauuauaucugu

SEQ ID NO: 2895383 - RNA, 17 nt, Human
uugaaauuauaucugug

SEQ ID NO: 2895384 - RNA, 19 nt, Human
uugaaauuauaucuguggu

SEQ ID NO: 2895385 - RNA, 14 nt, Human
uugaaaugucacgu

SEQ ID NO: 2895386 - RNA, 18 nt, Human
uugaaaugugguuuuccu

SEQ ID NO: 2895387 - RNA, 19 nt, Human
uugaaaugugguuuuccug

SEQ ID NO: 2895388 - RNA, 17 nt, Human
uugaaauuaugugacau

SEQ ID NO: 2895389 - RNA, 18 nt, Human
uugaaagugaauaaacuu

SEQ ID NO: 2895390 - RNA, 21 nt, Human
uugaaagugaauaaacuucag

SEQ ID NO: 2895391 - RNA, 22 nt, Human
uugaaagugaauaaacuucagc

SEQ ID NO: 2895392 - RNA, 17 nt, Human
uugaaagggaucaucau

SEQ ID NO: 2895393 - RNA, 17 nt, Human
uugaaagggcaauauga

SEQ ID NO: 2895394 - RNA, 22 nt, Human
uugaaagauucagguauguugc

SEQ ID NO: 2895395 - RNA, 13 nt, Human
uugaaagcaaaaa

SEQ ID NO: 2895396 - RNA, 14 nt, Human
uugaaagcaaaaau

SEQ ID NO: 2895397 - RNA, 17 nt, Human
uugaaagcaaaaaugcu

SEQ ID NO: 2895398 - RNA, 18 nt, Human
uugaaagcaaaaaugcua

SEQ ID NO: 2895399 - RNA, 19 nt, Human
uugaaagcaaaaaugcuaa

SEQ ID NO: 2895400 - RNA, 20 nt, Human
uugaaagcaaaaaugcuaau

SEQ ID NO: 2895401 - RNA, 21 nt, Human
uugaaagcaaaaaugcuaaua

SEQ ID NO: 2895402 - RNA, 16 nt, Human
auccgcccgccucggc

SEQ ID NO: 2895403 - RNA, 14 nt, Human
auccgccuuuugua

SEQ ID NO: 2895404 - RNA, 15 nt, Human
auccgccuuuuguau

SEQ ID NO: 2895405 - RNA, 18 nt, Human
auccgccuuuuguauaca

SEQ ID NO: 2895406 - RNA, 12 nt, Human
auccgcucucuu

SEQ ID NO: 2895407 - RNA, 13 nt, Human
auccgcucucuuc

SEQ ID NO: 2895408 - RNA, 14 nt, Human
auccgcucucuucc

SEQ ID NO: 2895409 - RNA, 15 nt, Human
auccgcucucuuccu

SEQ ID NO: 2895410 - RNA, 16 nt, Human
auccgcucucuuccug

SEQ ID NO: 2895411 - RNA, 17 nt, Human
auccgcucucuuccugc

SEQ ID NO: 2895412 - RNA, 18 nt, Human
auccgcucucuuccugcc

SEQ ID NO: 2895413 - RNA, 19 nt, Human
auccgcucucuuccugccc

SEQ ID NO: 2895414 - RNA, 20 nt, Human
auccgcucucuuccugcccc

SEQ ID NO: 2895415 - RNA, 23 nt, Human
auccuaaaacaaaagcucaucca

SEQ ID NO: 2895416 - RNA, 18 nt, Human
auccguaguuauuuugca

SEQ ID NO: 2895417 - RNA, 19 nt, Human
auccuaaaacaaaagcuca

SEQ ID NO: 2895418 - RNA, 18 nt, Human
auccuaacugaagagaca

SEQ ID NO: 2895419 - RNA, 12 nt, Human
auccuaagaaau

SEQ ID NO: 2895420 - RNA, 14 nt, Human
auccuaagaaauau

SEQ ID NO: 2895421 - RNA, 15 nt, Human
auccuaagaaauaug

SEQ ID NO: 2895422 - RNA, 16 nt, Human
auccuaagaaauaugu

SEQ ID NO: 2895423 - RNA, 19 nt, Human
auccuaagaaauaugugag

SEQ ID NO: 2895424 - RNA, 20 nt, Human
auccuaagaaauaugugaga

SEQ ID NO: 2895425 - RNA, 21 nt, Human
auccuaagaaauaugugagau

SEQ ID NO: 2895426 - RNA, 22 nt, Human
auccuaagaaauaugugagauu

SEQ ID NO: 2895427 - RNA, 23 nt, Human
auccuaagaaauaugugagauuu

SEQ ID NO: 2895428 - RNA, 14 nt, Human
auccuaagacacaa

SEQ ID NO: 2895429 - RNA, 15 nt, Human
auccuaagacacaaa

SEQ ID NO: 2895430 - RNA, 20 nt, Human
auccuaagacacaaaugcau

SEQ ID NO: 2895431 - RNA, 14 nt, Human
auccuaaaacaaau

SEQ ID NO: 2895432 - RNA, 17 nt, Human
auccuaagcaucuaagu

SEQ ID NO: 2895433 - RNA, 14 nt, Human
auccuacaagacac

SEQ ID NO: 2895434 - RNA, 19 nt, Human
auccuacaagacacaguga

SEQ ID NO: 2895435 - RNA, 18 nt, Human
auccuacaagacacagug

SEQ ID NO: 2895436 - RNA, 16 nt, Human
auccuagauccuaagg

SEQ ID NO: 2895437 - RNA, 13 nt, Human
auccuagauuaua

SEQ ID NO: 2895438 - RNA, 17 nt, Human
auccuagauuauaucaa

SEQ ID NO: 2895439 - RNA, 18 nt, Human
auccuagauuauaucaaa

SEQ ID NO: 2895440 - RNA, 20 nt, Human
auccuagauuauaucaaagu

SEQ ID NO: 2895441 - RNA, 23 nt, Human
auccuagauuauaucaaaguauu

SEQ ID NO: 2895442 - RNA, 16 nt, Human
auccuagcacaugcuu

SEQ ID NO: 2895443 - RNA, 19 nt, Human
auccuagcacaugcuucaa

SEQ ID NO: 2895444 - RNA, 13 nt, Human
auccuccuccagg

SEQ ID NO: 2895445 - RNA, 15 nt, Human
auccuccuccagggu

SEQ ID NO: 2895446 - RNA, 18 nt, Human
auccuaagcaucuaaguu

SEQ ID NO: 2895447 - RNA, 15 nt, Human
auccuagauccuaag

SEQ ID NO: 2895448 - RNA, 18 nt, Human
uucuuaagacauguauca

SEQ ID NO: 2895449 - RNA, 20 nt, Human
uucuuaacccuuuccagagu

SEQ ID NO: 2895450 - RNA, 19 nt, Human
aucccaugagacccuggug

SEQ ID NO: 2895451 - RNA, 18 nt, Human
aucccaucuaagcugcag

SEQ ID NO: 2895452 - RNA, 19 nt, Human
aucccaucuaagcugcagc

SEQ ID NO: 2895453 - RNA, 20 nt, Human
aucccaucuaagcugcagcu

SEQ ID NO: 2895454 - RNA, 21 nt, Human
aucccaggacaccacacccag

SEQ ID NO: 2895455 - RNA, 23 nt, Human
uucuuaaggugaggccugucugu

SEQ ID NO: 2895456 - RNA, 19 nt, Human
aucccagccccaauuuucu

SEQ ID NO: 2895457 - RNA, 15 nt, Human
uucuucugcuucagc

SEQ ID NO: 2895458 - RNA, 13 nt, Human
uucuucugcuuca

SEQ ID NO: 2895459 - RNA, 20 nt, Human
uucuucugcuucagccuccc

SEQ ID NO: 2895460 - RNA, 20 nt, Human
uucuucuguguuuauaaaau

SEQ ID NO: 2895461 - RNA, 20 nt, Human
uucuucuguccugagaagca

SEQ ID NO: 2895462 - RNA, 21 nt, Human
uucuucuguguuuauaaaaua

SEQ ID NO: 2895463 - RNA, 16 nt, Human
uucuucuguucugcag

SEQ ID NO: 2895464 - RNA, 12 nt, Human
uucuucuuuaau

SEQ ID NO: 2895465 - RNA, 17 nt, Human
uucuucuuuuugcuuca

SEQ ID NO: 2895466 - RNA, 21 nt, Human
uucuucuuuuugcuucaaaaa

SEQ ID NO: 2895467 - RNA, 16 nt, Human
uucuugaaagaagaau

SEQ ID NO: 2895468 - RNA, 19 nt, Human
uucuugaaagaauuuuccu

SEQ ID NO: 2895469 - RNA, 14 nt, Human
uucuuugcuguaag

SEQ ID NO: 2895470 - RNA, 15 nt, Human
uucuuugcuguaaga

SEQ ID NO: 2895471 - RNA, 16 nt, Human
uucuuugcuguaagau

SEQ ID NO: 2895472 - RNA, 17 nt, Human
uucuuuuuuaaaaucaa

SEQ ID NO: 2895473 - RNA, 16 nt, Human
uucuuuuuuucuuggc

SEQ ID NO: 2895474 - RNA, 14 nt, Human
uucuuuuuuuguga

SEQ ID NO: 2895475 - RNA, 15 nt, Human
uugaaagauucaggu

SEQ ID NO: 2895476 - RNA, 14 nt, Human
uugaaagaguccua

SEQ ID NO: 2895477 - RNA, 21 nt, Human
uucuccuugaauaucuuucga

SEQ ID NO: 2895478 - RNA, 21 nt, Human
uucuccuuguuguugguuguu

SEQ ID NO: 2895479 - RNA, 20 nt, Human
uucucuugagcuggccucuc

SEQ ID NO: 2895480 - RNA, 18 nt, Human
uucucuugagcuggccuc

SEQ ID NO: 2895481 - RNA, 22 nt, Human
uucucuugagcuggccucucua

SEQ ID NO: 2895482 - RNA, 18 nt, Human
uucucuugagucacacug

SEQ ID NO: 2895483 - RNA, 23 nt, Human
uucucuucccugcgccugugaug

SEQ ID NO: 2895484 - RNA, 14 nt, Human
uucucuugcuuucu

SEQ ID NO: 2895485 - RNA, 17 nt, Human
uucucuugagcuggccu

SEQ ID NO: 2895486 - RNA, 16 nt, Human
uucucuugagcuggcc

SEQ ID NO: 2895487 - RNA, 15 nt, Human
uucucuugagcuggc

SEQ ID NO: 2895488 - RNA, 14 nt, Human
uucucuugagcugg

SEQ ID NO: 2895489 - RNA, 20 nt, Human
uucuccuguuuauucccauc

SEQ ID NO: 2895490 - RNA, 14 nt, Human
uucuccuggaugcu

SEQ ID NO: 2895491 - RNA, 21 nt, Human
uucuccugccugugcugugac

SEQ ID NO: 2895492 - RNA, 22 nt, Human
uucuccugccuuugccuccaga

SEQ ID NO: 2895493 - RNA, 15 nt, Human
uucuccugccugugc

SEQ ID NO: 2895494 - RNA, 19 nt, Human
aucaguaagaaaaagaaga

SEQ ID NO: 2895495 - RNA, 15 nt, Human
aucaguaauauuuau

SEQ ID NO: 2895496 - RNA, 14 nt, Human
aucaguaggcuaau

SEQ ID NO: 2895497 - RNA, 16 nt, Human
aucaguaggcuaaugu

SEQ ID NO: 2895498 - RNA, 18 nt, Human
aucaguaggcuaauguca

SEQ ID NO: 2895499 - RNA, 13 nt, Human
aucaggucuccca

SEQ ID NO: 2895500 - RNA, 11 nt, Human
uucucuuggug

SEQ ID NO: 2895501 - RNA, 21 nt, Human
uucucuugguguuaaaacacu

SEQ ID NO: 2895502 - RNA, 19 nt, Human
uucucuuguauaagauccu

SEQ ID NO: 2895503 - RNA, 22 nt, Human
uucucuugggaacugaacucac

SEQ ID NO: 2895504 - RNA, 17 nt, Human
uucucuugggaacugaa

SEQ ID NO: 2895505 - RNA, 15 nt, Human
uucugccauauucug

SEQ ID NO: 2895506 - RNA, 19 nt, Human
uucugcccaauuggaggaa

SEQ ID NO: 2895507 - RNA, 13 nt, Human
uucugcccccagc

SEQ ID NO: 2895508 - RNA, 14 nt, Human
uucugcccccagcc

SEQ ID NO: 2895509 - RNA, 15 nt, Human
uucugcccccagccc

SEQ ID NO: 2895510 - RNA, 16 nt, Human
uucugcccccagccca

SEQ ID NO: 2895511 - RNA, 19 nt, Human
uucugcccaaaaauauggu

SEQ ID NO: 2895512 - RNA, 19 nt, Human
uucugcccacauuggaccc

SEQ ID NO: 2895513 - RNA, 16 nt, Human
uucugccagggagcuu

SEQ ID NO: 2895514 - RNA, 15 nt, Human
uucugccagggagcu

SEQ ID NO: 2895515 - RNA, 18 nt, Human
uucugccugcccaggccc

SEQ ID NO: 2895516 - RNA, 17 nt, Human
uucugccugcccaggcc

SEQ ID NO: 2895517 - RNA, 21 nt, Human
uucugccugcccaggccccug

SEQ ID NO: 2895518 - RNA, 11 nt, Human
uucuggcugcc

SEQ ID NO: 2895519 - RNA, 20 nt, Human
uucuggcugccccaaccugc

SEQ ID NO: 2895520 - RNA, 15 nt, Human
uucuggcugaaaaag

SEQ ID NO: 2895521 - RNA, 18 nt, Human
uucuggcugaaaaaggcc

SEQ ID NO: 2895522 - RNA, 16 nt, Human
uucugggaggaagcag

SEQ ID NO: 2895523 - RNA, 20 nt, Human
uucuggcuuccuucucucaa

SEQ ID NO: 2895524 - RNA, 13 nt, Human
auccaucaggcca

SEQ ID NO: 2895525 - RNA, 20 nt, Human
auccauauugagucaaaugg

SEQ ID NO: 2895526 - RNA, 18 nt, Human
auccauauugagucaaau

SEQ ID NO: 2895527 - RNA, 23 nt, Human
auccauaucuuaaagaaacagcu

SEQ ID NO: 2895528 - RNA, 16 nt, Human
auccauaguaguauga

SEQ ID NO: 2895529 - RNA, 17 nt, Human
auccauaguaacugaca

SEQ ID NO: 2895530 - RNA, 18 nt, Human
auccauaguaacugacau

SEQ ID NO: 2895531 - RNA, 20 nt, Human
auccauaguaacugacauga

SEQ ID NO: 2895532 - RNA, 14 nt, Human
auccaccaccuccc

SEQ ID NO: 2895533 - RNA, 17 nt, Human
auccaccaccucccuca

SEQ ID NO: 2895534 - RNA, 18 nt, Human
auccacauuguuuuaaaa

SEQ ID NO: 2895535 - RNA, 19 nt, Human
auccacauuguuuuaaaaa

SEQ ID NO: 2895536 - RNA, 15 nt, Human
auccacauuucuaaa

SEQ ID NO: 2895537 - RNA, 16 nt, Human
auccacauuucuaaaa

SEQ ID NO: 2895538 - RNA, 20 nt, Human
auccacccaacccuaucucc

SEQ ID NO: 2895539 - RNA, 16 nt, Human
auccaguucaugagaa

SEQ ID NO: 2895540 - RNA, 17 nt, Human
auccacauuguuuuaaa

SEQ ID NO: 2895541 - RNA, 16 nt, Human
auccauaccagcucgc

SEQ ID NO: 2895542 - RNA, 13 nt, Human
auccauuuguaau

SEQ ID NO: 2895543 - RNA, 13 nt, Human
aucccaaaaguca

SEQ ID NO: 2895544 - RNA, 14 nt, Human
aucccaaacuguga

SEQ ID NO: 2895545 - RNA, 24 nt, Human
aucccaaacugugaugaagccgac

SEQ ID NO: 2895546 - RNA, 12 nt, Human
aucccaggacac

SEQ ID NO: 2895547 - RNA, 17 nt, Human
aucccaggacaccacac

SEQ ID NO: 2895548 - RNA, 14 nt, Human
aucccagccggcca

SEQ ID NO: 2895549 - RNA, 22 nt, Human
aucccagccggccaauggaaac

SEQ ID NO: 2895550 - RNA, 24 nt, Human
aucccagccggccaauggaaaccu

SEQ ID NO: 2895551 - RNA, 15 nt, Human
auccacccaccucag

SEQ ID NO: 2895552 - RNA, 13 nt, Human
auccacccaccuc

SEQ ID NO: 2895553 - RNA, 21 nt, Human
auccaagcuggucccacucag

SEQ ID NO: 2895554 - RNA, 18 nt, Human
auccaagcuggucccacu

SEQ ID NO: 2895555 - RNA, 21 nt, Human
auccaagccuccacagcgagg

SEQ ID NO: 2895556 - RNA, 13 nt, Human
auccaagcucccu

SEQ ID NO: 2895557 - RNA, 14 nt, Human
auccaagcucccug

SEQ ID NO: 2895558 - RNA, 15 nt, Human
auccaagcucccugc

SEQ ID NO: 2895559 - RNA, 17 nt, Human
auccaagcucccugccc

SEQ ID NO: 2895560 - RNA, 18 nt, Human
auccaagcucccugcccc

SEQ ID NO: 2895561 - RNA, 19 nt, Human
auccaagcucccugcccca

SEQ ID NO: 2895562 - RNA, 19 nt, Human
auccaagccuccacagcga

SEQ ID NO: 2895563 - RNA, 18 nt, Human
auccaagccuccacagcg

SEQ ID NO: 2895564 - RNA, 17 nt, Human
auccaagccuccacagc

SEQ ID NO: 2895565 - RNA, 16 nt, Human
auccaagccuccacag

SEQ ID NO: 2895566 - RNA, 15 nt, Human
auccaagccuccaca

SEQ ID NO: 2895567 - RNA, 14 nt, Human
auccaagccuccac

SEQ ID NO: 2895568 - RNA, 12 nt, Human
auccaagccucc

SEQ ID NO: 2895569 - RNA, 19 nt, Human
uucuggggcaggcugggcc

SEQ ID NO: 2895570 - RNA, 18 nt, Human
uucuggggcaggcugggc

SEQ ID NO: 2895571 - RNA, 23 nt, Human
uucuggggaaagacacugccugg

SEQ ID NO: 2895572 - RNA, 22 nt, Human
uucuggggaaagacacugccug

SEQ ID NO: 2895573 - RNA, 17 nt, Human
uucuggggcaggcuggg

SEQ ID NO: 2895574 - RNA, 21 nt, Human
uucuggggaaagacacugccu

SEQ ID NO: 2895575 - RNA, 20 nt, Human
uucuggggaaagacacugcc

SEQ ID NO: 2895576 - RNA, 14 nt, Human
uucuggggaaagac

SEQ ID NO: 2895577 - RNA, 12 nt, Human
uucugggcucuu

SEQ ID NO: 2895578 - RNA, 13 nt, Human
uucugggcucuuu

SEQ ID NO: 2895579 - RNA, 16 nt, Human
uucugggcucuuuccu

SEQ ID NO: 2895580 - RNA, 21 nt, Human
uucuggggcaggcugggccau

SEQ ID NO: 2895581 - RNA, 20 nt, Human
uucuggggcaggcugggcca

SEQ ID NO: 2895582 - RNA, 14 nt, Human
uucuggggucccca

SEQ ID NO: 2895583 - RNA, 17 nt, Human
aucauuuuccccccacu

SEQ ID NO: 2895584 - RNA, 19 nt, Human
aucauuuugccucuuuucu

SEQ ID NO: 2895585 - RNA, 14 nt, Human
aucauuuuguuuuc

SEQ ID NO: 2895586 - RNA, 16 nt, Human
aucauuuuguuuucca

SEQ ID NO: 2895587 - RNA, 13 nt, Human
aucauuuuccccc

SEQ ID NO: 2895588 - RNA, 15 nt, Human
aucauuuucccccca

SEQ ID NO: 2895589 - RNA, 14 nt, Human
aucauuuucccccc

SEQ ID NO: 2895590 - RNA, 15 nt, Human
aucauuuuaggaaag

SEQ ID NO: 2895591 - RNA, 16 nt, Human
aucauuuuaggaaagg

SEQ ID NO: 2895592 - RNA, 22 nt, Human
uuccggauccuaagcaucuaag

SEQ ID NO: 2895593 - RNA, 17 nt, Human
uuccgugaaaacggagc

SEQ ID NO: 2895594 - RNA, 18 nt, Human
uuccgugacgucacugga

SEQ ID NO: 2895595 - RNA, 15 nt, Human
uuccgucagaaagug

SEQ ID NO: 2895596 - RNA, 17 nt, Human
uuccgucagaaagugua

SEQ ID NO: 2895597 - RNA, 20 nt, Human
uuccguagguagauguguaa

SEQ ID NO: 2895598 - RNA, 21 nt, Human
uuccguaauaacacccuuccu

SEQ ID NO: 2895599 - RNA, 19 nt, Human
uuccgucaacguuguacug

SEQ ID NO: 2895600 - RNA, 21 nt, Human
uuccgucaacguuguacugua

SEQ ID NO: 2895601 - RNA, 17 nt, Human
uuccgguagggaggcag

SEQ ID NO: 2895602 - RNA, 19 nt, Human
uuccgguagggaggcagcc

SEQ ID NO: 2895603 - RNA, 21 nt, Human
uuccgguagggaggcagccuc

SEQ ID NO: 2895604 - RNA, 14 nt, Human
uucccggucccgag

SEQ ID NO: 2895605 - RNA, 15 nt, Human
uucccggucccgagu

SEQ ID NO: 2895606 - RNA, 19 nt, Human
uucccggucccgaguacag

SEQ ID NO: 2895607 - RNA, 20 nt, Human
uucccggucccgaguacagu

SEQ ID NO: 2895608 - RNA, 23 nt, Human
auagcaaaacuuuuaaacuacag

SEQ ID NO: 2895609 - RNA, 20 nt, Human
auagauuuauuuuucaguuc

SEQ ID NO: 2895610 - RNA, 21 nt, Human
auagauuuauuuuucaguucc

SEQ ID NO: 2895611 - RNA, 22 nt, Human
auagauuuauuuuucaguucca

SEQ ID NO: 2895612 - RNA, 23 nt, Human
auagauuuauuuuucaguuccaa

SEQ ID NO: 2895613 - RNA, 16 nt, Human
uucccgcucagcccuc

SEQ ID NO: 2895614 - RNA, 18 nt, Human
uucccgcucagcccuccc

SEQ ID NO: 2895615 - RNA, 21 nt, Human
uucccgcucagcccucccugc

SEQ ID NO: 2895616 - RNA, 22 nt, Human
uucccgcucagcccucccugcc

SEQ ID NO: 2895617 - RNA, 14 nt, Human
uuccguugucugug

SEQ ID NO: 2895618 - RNA, 13 nt, Human
uuccuaaaaugcu

SEQ ID NO: 2895619 - RNA, 15 nt, Human
uuccguuugcuuuug

SEQ ID NO: 2895620 - RNA, 17 nt, Human
uuccguuugcuuuuguu

SEQ ID NO: 2895621 - RNA, 18 nt, Human
uuccuaauuccacagcug

SEQ ID NO: 2895622 - RNA, 17 nt, Human
uuccuaauuccacagcu

SEQ ID NO: 2895623 - RNA, 16 nt, Human
uuccuaauuccacagc

SEQ ID NO: 2895624 - RNA, 21 nt, Human
uuccucugaggcugaaauuca

SEQ ID NO: 2895625 - RNA, 18 nt, Human
uuccuaauuucccuucuu

SEQ ID NO: 2895626 - RNA, 23 nt, Human
uuccuacaagagcagccuguggc

SEQ ID NO: 2895627 - RNA, 22 nt, Human
uuccuacaagagcagccugugg

SEQ ID NO: 2895628 - RNA, 20 nt, Human
uuccuacaagagcagccugu

SEQ ID NO: 2895629 - RNA, 17 nt, Human
uuccucugagccuuggg

SEQ ID NO: 2895630 - RNA, 14 nt, Human
uuccucugagccuu

SEQ ID NO: 2895631 - RNA, 17 nt, Human
auauuuuuuaauuuaaa

SEQ ID NO: 2895632 - RNA, 21 nt, Human
auauuuuuuaauuuaaagcuu

SEQ ID NO: 2895633 - RNA, 20 nt, Human
aucaaauuucacgucgucuu

SEQ ID NO: 2895634 - RNA, 20 nt, Human
auauuuuuuauauauacagu

SEQ ID NO: 2895635 - RNA, 22 nt, Human
auauuuuuuauaucuggaauga

SEQ ID NO: 2895636 - RNA, 18 nt, Human
auauuuuuauauuuaguu

SEQ ID NO: 2895637 - RNA, 15 nt, Human
aucaacaagauuucc

SEQ ID NO: 2895638 - RNA, 22 nt, Human
aucaaauuucacgucgucuucu

SEQ ID NO: 2895639 - RNA, 15 nt, Human
aucaacaaagaaaua

SEQ ID NO: 2895640 - RNA, 14 nt, Human
aucaagcagccaag

SEQ ID NO: 2895641 - RNA, 18 nt, Human
aucaagcagguuagagaa

SEQ ID NO: 2895642 - RNA, 19 nt, Human
aucaagcaugaaaggcuuu

SEQ ID NO: 2895643 - RNA, 21 nt, Human
aucaagccauguauaaaugug

SEQ ID NO: 2895644 - RNA, 13 nt, Human
aucaacagaagca

SEQ ID NO: 2895645 - RNA, 17 nt, Human
aucaacagaagcauuug

SEQ ID NO: 2895646 - RNA, 22 nt, Human
aucaacagaagcauuuguauuu

SEQ ID NO: 2895647 - RNA, 11 nt, Human
uuccugugucu

SEQ ID NO: 2895648 - RNA, 22 nt, Human
uuccugugauccacccaacccu

SEQ ID NO: 2895649 - RNA, 11 nt, Human
uuccuguguca

SEQ ID NO: 2895650 - RNA, 13 nt, Human
uuccugugucaau

SEQ ID NO: 2895651 - RNA, 18 nt, Human
uuccugugucaauccaga

SEQ ID NO: 2895652 - RNA, 17 nt, Human
uuccugugauccaccca

SEQ ID NO: 2895653 - RNA, 20 nt, Human
uuccugucuagucucuccug

SEQ ID NO: 2895654 - RNA, 15 nt, Human
uuccugaacuauaac

SEQ ID NO: 2895655 - RNA, 22 nt, Human
aucaaugcaagagugauugcag

SEQ ID NO: 2895656 - RNA, 15 nt, Human
aucaaugaauauuga

SEQ ID NO: 2895657 - RNA, 16 nt, Human
aucaaugaauauugaa

SEQ ID NO: 2895658 - RNA, 18 nt, Human
aucaaugaauauugaagu

SEQ ID NO: 2895659 - RNA, 14 nt, Human
aucaauccuuuauu

SEQ ID NO: 2895660 - RNA, 16 nt, Human
aucaauccuuuauuau

SEQ ID NO: 2895661 - RNA, 22 nt, Human
aucaaucaucugugugaaaaug

SEQ ID NO: 2895662 - RNA, 19 nt, Human
aucaaggggucacuuacag

SEQ ID NO: 2895663 - RNA, 15 nt, Human
aucaaggcacugccu

SEQ ID NO: 2895664 - RNA, 16 nt, Human
aucaaggcacugccug

SEQ ID NO: 2895665 - RNA, 22 nt, Human
aucaaggaagaaaugguucaga

SEQ ID NO: 2895666 - RNA, 21 nt, Human
aucaaggacucugguuucuca

SEQ ID NO: 2895667 - RNA, 13 nt, Human
aucaaggcacugc

SEQ ID NO: 2895668 - RNA, 14 nt, Human
aucaaggcacugcc

SEQ ID NO: 2895669 - RNA, 15 nt, Human
aucacggcucacugc

SEQ ID NO: 2895670 - RNA, 19 nt, Human
aucacgauguaaauuauua

SEQ ID NO: 2895671 - RNA, 18 nt, Human
aucacgauguaaauuauu

SEQ ID NO: 2895672 - RNA, 13 nt, Human
aucacgccacugc

SEQ ID NO: 2895673 - RNA, 17 nt, Human
aucacgacgcugcagag

SEQ ID NO: 2895674 - RNA, 15 nt, Human
aucacgauguaaauu

SEQ ID NO: 2895675 - RNA, 19 nt, Human
aucacggcucacugcagcc

SEQ ID NO: 2895676 - RNA, 18 nt, Human
aucacggcucacugcagc

SEQ ID NO: 2895677 - RNA, 22 nt, Human
aucacugccacacucuccauca

SEQ ID NO: 2895678 - RNA, 21 nt, Human
aucacugccagagauaaacua

SEQ ID NO: 2895679 - RNA, 23 nt, Human
aucacugccagagauaaacuaau

SEQ ID NO: 2895680 - RNA, 20 nt, Human
aucacugccacacucuccau

SEQ ID NO: 2895681 - RNA, 19 nt, Human
aucacugccacacucucca

SEQ ID NO: 2895682 - RNA, 18 nt, Human
aucacugccacacucucc

SEQ ID NO: 2895683 - RNA, 12 nt, Human
aucacugccaca

SEQ ID NO: 2895684 - RNA, 22 nt, Human
aucacugcauuauucucuuuua

SEQ ID NO: 2895685 - RNA, 15 nt, Human
aucacugaauuuaua

SEQ ID NO: 2895686 - RNA, 20 nt, Human
aucacugaauuuauaaagua

SEQ ID NO: 2895687 - RNA, 21 nt, Human
aucacuuguacaaaauaaaca

SEQ ID NO: 2895688 - RNA, 19 nt, Human
aucagaauagccacauuug

SEQ ID NO: 2895689 - RNA, 18 nt, Human
aucagaaguuucucagcu

SEQ ID NO: 2895690 - RNA, 17 nt, Human
uucucaggccaucauca

SEQ ID NO: 2895691 - RNA, 19 nt, Human
uucucagggucucugcugc

SEQ ID NO: 2895692 - RNA, 20 nt, Human
uucucagggucucugcugcc

SEQ ID NO: 2895693 - RNA, 13 nt, Human
uucucagggucuc

SEQ ID NO: 2895694 - RNA, 16 nt, Human
uucucagggucucugc

SEQ ID NO: 2895695 - RNA, 17 nt, Human
uucucagggucucugcu

SEQ ID NO: 2895696 - RNA, 18 nt, Human
uucucagggucucugcug

SEQ ID NO: 2895697 - RNA, 15 nt, Human
aucacuugauucaua

SEQ ID NO: 2895698 - RNA, 18 nt, Human
aucacuugauucauaaag

SEQ ID NO: 2895699 - RNA, 21 nt, Human
uucucagggucucugcugccg

SEQ ID NO: 2895700 - RNA, 18 nt, Human
aucacuuguacaaaauaa

SEQ ID NO: 2895701 - RNA, 17 nt, Human
aucacuuguacaaaaua

SEQ ID NO: 2895702 - RNA, 16 nt, Human
aucacuuguacaaaau

SEQ ID NO: 2895703 - RNA, 14 nt, Human
aucacuuguacaaa

SEQ ID NO: 2895704 - RNA, 16 nt, Human
uucucacuccuaccug

SEQ ID NO: 2895705 - RNA, 18 nt, Human
uucucacuccuaccuggu

SEQ ID NO: 2895706 - RNA, 21 nt, Human
aucagggcaaucccaacacau

SEQ ID NO: 2895707 - RNA, 11 nt, Human
aucagggccug

SEQ ID NO: 2895708 - RNA, 13 nt, Human
aucagggccuggg

SEQ ID NO: 2895709 - RNA, 14 nt, Human
aucagggccugggg

SEQ ID NO: 2895710 - RNA, 15 nt, Human
aucagggccuggggc

SEQ ID NO: 2895711 - RNA, 17 nt, Human
aucagggccuggggccu

SEQ ID NO: 2895712 - RNA, 19 nt, Human
aucagggccuggggccuga

SEQ ID NO: 2895713 - RNA, 20 nt, Human
aucagggccuggggccugag

SEQ ID NO: 2895714 - RNA, 21 nt, Human
aucagggccuggggccugaga

SEQ ID NO: 2895715 - RNA, 22 nt, Human
aucagggccuggggccugagag

SEQ ID NO: 2895716 - RNA, 23 nt, Human
aucagggccuggggccugagaga

SEQ ID NO: 2895717 - RNA, 24 nt, Human
aucagggccuggggccugagagaa

SEQ ID NO: 2895718 - RNA, 14 nt, Human
aucagggggaagaa

SEQ ID NO: 2895719 - RNA, 16 nt, Human
aucagggggaagaagc

SEQ ID NO: 2895720 - RNA, 18 nt, Human
aucagggggaagaagcag

SEQ ID NO: 2895721 - RNA, 21 nt, Human
aucagggggaagaagcagaga

SEQ ID NO: 2895722 - RNA, 23 nt, Human
aucagggggaagaagcagagaga

SEQ ID NO: 2895723 - RNA, 20 nt, Human
aucagguccucagagaauuu

SEQ ID NO: 2895724 - RNA, 16 nt, Human
aucagguccucagaga

SEQ ID NO: 2895725 - RNA, 16 nt, Human
aucaggcuacuagaau

SEQ ID NO: 2895726 - RNA, 22 nt, Human
aucagcacagauaaaaagugga

SEQ ID NO: 2895727 - RNA, 15 nt, Human
aucagcacauauuuu

SEQ ID NO: 2895728 - RNA, 17 nt, Human
aucagauuuuaacagcu

SEQ ID NO: 2895729 - RNA, 12 nt, Human
aucagcaaaaaa

SEQ ID NO: 2895730 - RNA, 13 nt, Human
aucagcaaaaaag

SEQ ID NO: 2895731 - RNA, 18 nt, Human
aucaggccuaaucucaua

SEQ ID NO: 2895732 - RNA, 19 nt, Human
aucaggccuaaucucauac

SEQ ID NO: 2895733 - RNA, 22 nt, Human
aucagaauagccacauuuggaa

SEQ ID NO: 2895734 - RNA, 19 nt, Human
uucucacuccuuuuggugu

SEQ ID NO: 2895735 - RNA, 17 nt, Human
aucagaauugaaacacu

SEQ ID NO: 2895736 - RNA, 21 nt, Human
aucagaugcuccaagauucua

SEQ ID NO: 2895737 - RNA, 22 nt, Human
aucagaugcuccaagauucuag

SEQ ID NO: 2895738 - RNA, 23 nt, Human
aucagcaacaaccagcaucccuu

SEQ ID NO: 2895739 - RNA, 23 nt, Human
aucagaugcuccaagauucuaga

SEQ ID NO: 2895740 - RNA, 14 nt, Human
aucagauggaaaua

SEQ ID NO: 2895741 - RNA, 21 nt, Human
aucagauggaaauauuuugau

SEQ ID NO: 2895742 - RNA, 22 nt, Human
aucagauggaaauauuuugaua

SEQ ID NO: 2895743 - RNA, 23 nt, Human
aucagauggaaauauuuugauaa

SEQ ID NO: 2895744 - RNA, 15 nt, Human
aucagauguugaauu

SEQ ID NO: 2895745 - RNA, 16 nt, Human
aucagauguugaauuc

SEQ ID NO: 2895746 - RNA, 19 nt, Human
aucagauguugaauucuuu

SEQ ID NO: 2895747 - RNA, 21 nt, Human
aucagauguuuuggucaagua

SEQ ID NO: 2895748 - RNA, 23 nt, Human
uucuagaucagaugcuccaagau

SEQ ID NO: 2895749 - RNA, 23 nt, Human
uucuaagguccgguguucuaaga

SEQ ID NO: 2895750 - RNA, 24 nt, Human
uucuagaucagaugcuccaagauu

SEQ ID NO: 2895751 - RNA, 18 nt, Human
uucuaaggcucugagagu

SEQ ID NO: 2895752 - RNA, 20 nt, Human
uucuaaggcucugagagucu

SEQ ID NO: 2895753 - RNA, 20 nt, Human
uucuaagguccgguguucua

SEQ ID NO: 2895754 - RNA, 21 nt, Human
uucuaagguccgguguucuaa

SEQ ID NO: 2895755 - RNA, 21 nt, Human
uucuaagacuuacucuaagau

SEQ ID NO: 2895756 - RNA, 20 nt, Human
uucuaaggccuaggauucua

SEQ ID NO: 2895757 - RNA, 21 nt, Human
uucuaaggccuaggauucuaa

SEQ ID NO: 2895758 - RNA, 22 nt, Human
uucuaaggccuaggauucuaaa

SEQ ID NO: 2895759 - RNA, 12 nt, Human
uucuaaggcucu

SEQ ID NO: 2895760 - RNA, 13 nt, Human
uucuaaggcucug

SEQ ID NO: 2895761 - RNA, 16 nt, Human
uucuaaggcucugaga

SEQ ID NO: 2895762 - RNA, 17 nt, Human
uucuaaggcucugagag

SEQ ID NO: 2895763 - RNA, 12 nt, Human
uucuaagacuca

SEQ ID NO: 2895764 - RNA, 13 nt, Human
uucuaagacucaa

SEQ ID NO: 2895765 - RNA, 16 nt, Human
uucuaagacucaaaug

SEQ ID NO: 2895766 - RNA, 19 nt, Human
uucuaaggccuaggauucu

SEQ ID NO: 2895767 - RNA, 20 nt, Human
uucuaagacucaaauguucu

SEQ ID NO: 2895768 - RNA, 21 nt, Human
uucuaagacucaaauguucua

SEQ ID NO: 2895769 - RNA, 22 nt, Human
uucuaagacucaaauguucuaa

SEQ ID NO: 2895770 - RNA, 20 nt, Human
uucuaagacuuacucuaaga

SEQ ID NO: 2895771 - RNA, 12 nt, Human
uucuagaugauu

SEQ ID NO: 2895772 - RNA, 22 nt, Human
uucuagaugauuaaauaagauu

SEQ ID NO: 2895773 - RNA, 12 nt, Human
uucuagccugca

SEQ ID NO: 2895774 - RNA, 24 nt, Human
uucuagccugcacuuugaugucau

SEQ ID NO: 2895775 - RNA, 17 nt, Human
uucuagcuaauguaaua

SEQ ID NO: 2895776 - RNA, 16 nt, Human
uucggccagagcugaa

SEQ ID NO: 2895777 - RNA, 13 nt, Human
uucuaaaggucca

SEQ ID NO: 2895778 - RNA, 14 nt, Human
uucuaaaugaagug

SEQ ID NO: 2895779 - RNA, 16 nt, Human
uucuaaagguccacag

SEQ ID NO: 2895780 - RNA, 19 nt, Human
uucggaggccccacugaug

SEQ ID NO: 2895781 - RNA, 17 nt, Human
uucgcuuggcuccaugc

SEQ ID NO: 2895782 - RNA, 17 nt, Human
aucacuggagcccagga

SEQ ID NO: 2895783 - RNA, 16 nt, Human
aucacuggagcccagg

SEQ ID NO: 2895784 - RNA, 19 nt, Human
uucgcuccugugucuugca

SEQ ID NO: 2895785 - RNA, 15 nt, Human
uucgcuccugugucu

SEQ ID NO: 2895786 - RNA, 21 nt, Human
aucacugccacacucuccauc

SEQ ID NO: 2895787 - RNA, 10 nt, Human
aucacuggag

SEQ ID NO: 2895788 - RNA, 14 nt, Human
aucacugcuugaug

SEQ ID NO: 2895789 - RNA, 19 nt, Human
aucacugcuugaugaagca

SEQ ID NO: 2895790 - RNA, 21 nt, Human
aucacugcuugaugaagcaag

SEQ ID NO: 2895791 - RNA, 15 nt, Human
aucacuggagcccag

SEQ ID NO: 2895792 - RNA, 14 nt, Human
aucacuggagccca

SEQ ID NO: 2895793 - RNA, 13 nt, Human
aucacuggagccc

SEQ ID NO: 2895794 - RNA, 12 nt, Human
aucacuggagcc

SEQ ID NO: 2895795 - RNA, 12 nt, Human
uuuguaguuuuu

SEQ ID NO: 2895796 - RNA, 22 nt, Human
uuuguaauuaaauuaugguauu

SEQ ID NO: 2895797 - RNA, 24 nt, Human
uuuguaauuaaauuaugguauuaa

SEQ ID NO: 2895798 - RNA, 13 nt, Human
uuuguaauuauga

SEQ ID NO: 2895799 - RNA, 13 nt, Human
uuuguaauugcuu

SEQ ID NO: 2895800 - RNA, 14 nt, Human
uuuguaaugaauuc

SEQ ID NO: 2895801 - RNA, 20 nt, Human
uuuguaaugaauuccuagaa

SEQ ID NO: 2895802 - RNA, 15 nt, Human
uuuguaaugugugaa

SEQ ID NO: 2895803 - RNA, 18 nt, Human
uuuguaaugugugaaaaa

SEQ ID NO: 2895804 - RNA, 16 nt, Human
augugcacccaugggc

SEQ ID NO: 2895805 - RNA, 17 nt, Human
uuugucuuuuaaugcuu

SEQ ID NO: 2895806 - RNA, 22 nt, Human
uuugugaaaugauggugaaagu

SEQ ID NO: 2895807 - RNA, 16 nt, Human
uuugucuugaaugucu

SEQ ID NO: 2895808 - RNA, 14 nt, Human
uuugugacuauaua

SEQ ID NO: 2895809 - RNA, 23 nt, Human
uuugugaauggauuggauuauuu

SEQ ID NO: 2895810 - RNA, 19 nt, Human
uuugugaauggauuggauu

SEQ ID NO: 2895811 - RNA, 17 nt, Human
uuugugaauggauugga

SEQ ID NO: 2895812 - RNA, 14 nt, Human
uuugugaagcccug

SEQ ID NO: 2895813 - RNA, 15 nt, Human
uuugugaagcccugu

SEQ ID NO: 2895814 - RNA, 17 nt, Human
uuugugaagcccuguug

SEQ ID NO: 2895815 - RNA, 23 nt, Human
augugcacaugcacgugugugca

SEQ ID NO: 2895816 - RNA, 18 nt, Human
augugcaauugauuucuu

SEQ ID NO: 2895817 - RNA, 20 nt, Human
augugcaagcgacgacagau

SEQ ID NO: 2895818 - RNA, 14 nt, Human
augugacuguauaa

SEQ ID NO: 2895819 - RNA, 14 nt, Human
augugauguucuaa

SEQ ID NO: 2895820 - RNA, 15 nt, Human
augugauguucuaag

SEQ ID NO: 2895821 - RNA, 14 nt, Human
augugacucuggcu

SEQ ID NO: 2895822 - RNA, 15 nt, Human
augugacucuggcuu

SEQ ID NO: 2895823 - RNA, 22 nt, Human
augugacucuggcuuggccuau

SEQ ID NO: 2895824 - RNA, 14 nt, Human
augugaugauguaa

SEQ ID NO: 2895825 - RNA, 16 nt, Human
augugaugauguaauu

SEQ ID NO: 2895826 - RNA, 17 nt, Human
augugaugauguaauug

SEQ ID NO: 2895827 - RNA, 21 nt, Human
augugaugauguaauugacgg

SEQ ID NO: 2895828 - RNA, 15 nt, Human
augugauuacaaggc

SEQ ID NO: 2895829 - RNA, 15 nt, Human
augugauucaaaaga

SEQ ID NO: 2895830 - RNA, 21 nt, Human
augugauguucuaaggcucug

SEQ ID NO: 2895831 - RNA, 16 nt, Human
augugauguucuaagg

SEQ ID NO: 2895832 - RNA, 17 nt, Human
augugauguucuaaggc

SEQ ID NO: 2895833 - RNA, 19 nt, Human
augugauguucuaaggcuc

SEQ ID NO: 2895834 - RNA, 20 nt, Human
augugauguucuaaggcucu

SEQ ID NO: 2895835 - RNA, 22 nt, Human
augugauuguggaauggagauu

SEQ ID NO: 2895836 - RNA, 17 nt, Human
augugauuguggaaugg

SEQ ID NO: 2895837 - RNA, 15 nt, Human
augugauuguggaau

SEQ ID NO: 2895838 - RNA, 14 nt, Human
augugauuguggaa

SEQ ID NO: 2895839 - RNA, 15 nt, Human
augugauucuaaugu

SEQ ID NO: 2895840 - RNA, 16 nt, Human
augugacauuuuacau

SEQ ID NO: 2895841 - RNA, 18 nt, Human
augugacauuuuacauua

SEQ ID NO: 2895842 - RNA, 13 nt, Human
auguccugccuuu

SEQ ID NO: 2895843 - RNA, 15 nt, Human
auguccugccuuuua

SEQ ID NO: 2895844 - RNA, 16 nt, Human
auguccacuguguaua

SEQ ID NO: 2895845 - RNA, 17 nt, Human
auguccacuguguauag

SEQ ID NO: 2895846 - RNA, 14 nt, Human
auguccacugugua

SEQ ID NO: 2895847 - RNA, 16 nt, Human
augucaguauuucagu

SEQ ID NO: 2895848 - RNA, 24 nt, Human
augucaguauuucaguguaguuaa

SEQ ID NO: 2895849 - RNA, 13 nt, Human
augucuccucccc

SEQ ID NO: 2895850 - RNA, 15 nt, Human
augucucgcuaguga

SEQ ID NO: 2895851 - RNA, 16 nt, Human
augucucgcuagugau

SEQ ID NO: 2895852 - RNA, 14 nt, Human
augucucuaaagca

SEQ ID NO: 2895853 - RNA, 15 nt, Human
augucucuaaagcac

SEQ ID NO: 2895854 - RNA, 17 nt, Human
augucucugagcauuag

SEQ ID NO: 2895855 - RNA, 13 nt, Human
augucgccucugc

SEQ ID NO: 2895856 - RNA, 14 nt, Human
augucgccucugca

SEQ ID NO: 2895857 - RNA, 17 nt, Human
augucucaggucccugc

SEQ ID NO: 2895858 - RNA, 22 nt, Human
augucucaggucccugcagggc

SEQ ID NO: 2895859 - RNA, 14 nt, Human
auguaucugaguug

SEQ ID NO: 2895860 - RNA, 17 nt, Human
auguaucugaguugcca

SEQ ID NO: 2895861 - RNA, 14 nt, Human
auguaucugugaag

SEQ ID NO: 2895862 - RNA, 13 nt, Human
auguaugaaggcu

SEQ ID NO: 2895863 - RNA, 14 nt, Human
auguaugaaggcuu

SEQ ID NO: 2895864 - RNA, 17 nt, Human
auguaugaauacagcag

SEQ ID NO: 2895865 - RNA, 18 nt, Human
auguaugaauacagcagc

SEQ ID NO: 2895866 - RNA, 23 nt, Human
auguaugaauacagcagcaagaa

SEQ ID NO: 2895867 - RNA, 18 nt, Human
auguaugagguacaaccu

SEQ ID NO: 2895868 - RNA, 22 nt, Human
uuuggcaggggcagaaaacucu

SEQ ID NO: 2895869 - RNA, 20 nt, Human
uuuggcagagcuucuuccag

SEQ ID NO: 2895870 - RNA, 14 nt, Human
uuuggcaaggaaag

SEQ ID NO: 2895871 - RNA, 23 nt, Human
uuuggcaaggaaaggggagaagg

SEQ ID NO: 2895872 - RNA, 21 nt, Human
auguauuaauaaauagagcaa

SEQ ID NO: 2895873 - RNA, 12 nt, Human
auguauuaguga

SEQ ID NO: 2895874 - RNA, 16 nt, Human
auguauuagugauauu

SEQ ID NO: 2895875 - RNA, 19 nt, Human
auguauuagugauauuucu

SEQ ID NO: 2895876 - RNA, 21 nt, Human
auguauuagugauauuucucu

SEQ ID NO: 2895877 - RNA, 22 nt, Human
auguauuagugauauuucucua

SEQ ID NO: 2895878 - RNA, 23 nt, Human
auguauuagugauauuucucuag

SEQ ID NO: 2895879 - RNA, 22 nt, Human
auguacuuuuauuuuacacaga

SEQ ID NO: 2895880 - RNA, 20 nt, Human
auguacuuuuauuuuacaca

SEQ ID NO: 2895881 - RNA, 13 nt, Human
auguagaagcugc

SEQ ID NO: 2895882 - RNA, 16 nt, Human
auguagacuauauaca

SEQ ID NO: 2895883 - RNA, 17 nt, Human
auguagacuauauacau

SEQ ID NO: 2895884 - RNA, 19 nt, Human
auguagacuauauacaugu

SEQ ID NO: 2895885 - RNA, 20 nt, Human
auguagacuauauacaugug

SEQ ID NO: 2895886 - RNA, 21 nt, Human
auguagacuauauacaugugu

SEQ ID NO: 2895887 - RNA, 23 nt, Human
auguagacuauauacaugugugu

SEQ ID NO: 2895888 - RNA, 15 nt, Human
auguagagaaaagca

SEQ ID NO: 2895889 - RNA, 13 nt, Human
auguagauauuug

SEQ ID NO: 2895890 - RNA, 15 nt, Human
auguagauauuuggc

SEQ ID NO: 2895891 - RNA, 16 nt, Human
auguagauauuuggcu

SEQ ID NO: 2895892 - RNA, 20 nt, Human
auguagauauuuggcuuaaa

SEQ ID NO: 2895893 - RNA, 21 nt, Human
auguagauauuuggcuuaaau

SEQ ID NO: 2895894 - RNA, 19 nt, Human
auguacuuguuucucuguu

SEQ ID NO: 2895895 - RNA, 17 nt, Human
auguacuccucuuuaca

SEQ ID NO: 2895896 - RNA, 20 nt, Human
auguacuccucuuuacacug

SEQ ID NO: 2895897 - RNA, 16 nt, Human
auguacugauugagaa

SEQ ID NO: 2895898 - RNA, 18 nt, Human
auguacugauugagaagu

SEQ ID NO: 2895899 - RNA, 14 nt, Human
auguacugagauuu

SEQ ID NO: 2895900 - RNA, 11 nt, Human
auguacuguac

SEQ ID NO: 2895901 - RNA, 12 nt, Human
auguacuguacu

SEQ ID NO: 2895902 - RNA, 13 nt, Human
auguacuguacua

SEQ ID NO: 2895903 - RNA, 14 nt, Human
auguacuguacuaa

SEQ ID NO: 2895904 - RNA, 16 nt, Human
auguacuguacuaauu

SEQ ID NO: 2895905 - RNA, 17 nt, Human
auguacuguacuaauuc

SEQ ID NO: 2895906 - RNA, 18 nt, Human
auguacuguacuaauucu

SEQ ID NO: 2895907 - RNA, 20 nt, Human
auguacuguacuaauucuua

SEQ ID NO: 2895908 - RNA, 22 nt, Human
auguaccuucuuucacucuguc

SEQ ID NO: 2895909 - RNA, 14 nt, Human
auguacguuuguau

SEQ ID NO: 2895910 - RNA, 21 nt, Human
auguacguuuguaugugugua

SEQ ID NO: 2895911 - RNA, 15 nt, Human
auguacuaguacugu

SEQ ID NO: 2895912 - RNA, 17 nt, Human
auguacuaguacugugu

SEQ ID NO: 2895913 - RNA, 18 nt, Human
auguacuaguacugugua

SEQ ID NO: 2895914 - RNA, 19 nt, Human
auguacuaguacuguguac

SEQ ID NO: 2895915 - RNA, 21 nt, Human
auguacuaguacuguguacug

SEQ ID NO: 2895916 - RNA, 22 nt, Human
auguacuaguacuguguacugu

SEQ ID NO: 2895917 - RNA, 15 nt, Human
auguacuaguguucu

SEQ ID NO: 2895918 - RNA, 18 nt, Human
auguacuaguguucuguu

SEQ ID NO: 2895919 - RNA, 20 nt, Human
auguacuaguguucuguuug

SEQ ID NO: 2895920 - RNA, 22 nt, Human
auguacuaguguucuguuuguu

SEQ ID NO: 2895921 - RNA, 21 nt, Human
auguacuaguuuuaguuuucu

SEQ ID NO: 2895922 - RNA, 18 nt, Human
auguaccaugaaacaaag

SEQ ID NO: 2895923 - RNA, 15 nt, Human
auguaccauuugcau

SEQ ID NO: 2895924 - RNA, 18 nt, Human
auguaccauuugcauggc

SEQ ID NO: 2895925 - RNA, 22 nt, Human
auguaccauuugcauggcucca

SEQ ID NO: 2895926 - RNA, 16 nt, Human
auguaccguaggcuuu

SEQ ID NO: 2895927 - RNA, 14 nt, Human
auguaccuccccug

SEQ ID NO: 2895928 - RNA, 16 nt, Human
auguaccuccccugcc

SEQ ID NO: 2895929 - RNA, 17 nt, Human
auguaccuccccugccu

SEQ ID NO: 2895930 - RNA, 18 nt, Human
auguaccuccccugccuu

SEQ ID NO: 2895931 - RNA, 19 nt, Human
auguaccuccccugccuug

SEQ ID NO: 2895932 - RNA, 22 nt, Human
auguaccuccccugccuugcug

SEQ ID NO: 2895933 - RNA, 23 nt, Human
auguaccuccccugccuugcugu

SEQ ID NO: 2895934 - RNA, 13 nt, Human
uuugaccuuuuau

SEQ ID NO: 2895935 - RNA, 20 nt, Human
uuugacauugcguuugaccu

SEQ ID NO: 2895936 - RNA, 17 nt, Human
uuugacauuguauguau

SEQ ID NO: 2895937 - RNA, 22 nt, Human
uuugacauuguauguaucuauu

SEQ ID NO: 2895938 - RNA, 14 nt, Human
uuugacauuuaauu

SEQ ID NO: 2895939 - RNA, 16 nt, Human
uuugacauuuaauuua

SEQ ID NO: 2895940 - RNA, 18 nt, Human
uuugaccucacagugacc

SEQ ID NO: 2895941 - RNA, 10 nt, Human
uuugaccucc

SEQ ID NO: 2895942 - RNA, 17 nt, Human
uuugaccuccucccugu

SEQ ID NO: 2895943 - RNA, 19 nt, Human
auguaguauaaagaaaagu

SEQ ID NO: 2895944 - RNA, 18 nt, Human
uuugacaguuauuuugau

SEQ ID NO: 2895945 - RNA, 19 nt, Human
uuugacaucagccagcugc

SEQ ID NO: 2895946 - RNA, 19 nt, Human
uuugacaguguugaaaaug

SEQ ID NO: 2895947 - RNA, 18 nt, Human
uuugacaguguugaaaau

SEQ ID NO: 2895948 - RNA, 17 nt, Human
auguaguauaaagaaaa

SEQ ID NO: 2895949 - RNA, 16 nt, Human
auguaguauaaagaaa

SEQ ID NO: 2895950 - RNA, 18 nt, Human
auguaguaauugacaugu

SEQ ID NO: 2895951 - RNA, 17 nt, Human
auguaguaauugacaug

SEQ ID NO: 2895952 - RNA, 16 nt, Human
auguaguaauugacau

SEQ ID NO: 2895953 - RNA, 13 nt, Human
auguaguaauuga

SEQ ID NO: 2895954 - RNA, 23 nt, Human
auguaggagcugccuuggcucag

SEQ ID NO: 2895955 - RNA, 18 nt, Human
auguagcuuuucaccuuu

SEQ ID NO: 2895956 - RNA, 16 nt, Human
auguaggaaaaaaaua

SEQ ID NO: 2895957 - RNA, 17 nt, Human
auguaggaaaaaaauag

SEQ ID NO: 2895958 - RNA, 21 nt, Human
auguaggaaaaaaauagucua

SEQ ID NO: 2895959 - RNA, 13 nt, Human
auguagcguguuu

SEQ ID NO: 2895960 - RNA, 16 nt, Human
auguagcguguuuaca

SEQ ID NO: 2895961 - RNA, 21 nt, Human
auguagcguguuuacaugugu

SEQ ID NO: 2895962 - RNA, 22 nt, Human
auguagcguguuuacaugugua

SEQ ID NO: 2895963 - RNA, 22 nt, Human
auguagcucugcaucuccuguc

SEQ ID NO: 2895964 - RNA, 20 nt, Human
auguagauuuguacaggagu

SEQ ID NO: 2895965 - RNA, 19 nt, Human
auguagauuaaggugaugu

SEQ ID NO: 2895966 - RNA, 22 nt, Human
auguagauuaaggugaugugau

SEQ ID NO: 2895967 - RNA, 18 nt, Human
auguagcccccuggccuc

SEQ ID NO: 2895968 - RNA, 19 nt, Human
auguagcccccuggccucu

SEQ ID NO: 2895969 - RNA, 21 nt, Human
auguagcccccuggccucugu

SEQ ID NO: 2895970 - RNA, 23 nt, Human
auguagcccccuggccucugugc

SEQ ID NO: 2895971 - RNA, 18 nt, Human
auguagcauuaugcaauu

SEQ ID NO: 2895972 - RNA, 13 nt, Human
auguagcccaucc

SEQ ID NO: 2895973 - RNA, 16 nt, Human
auguagcccauccuuc

SEQ ID NO: 2895974 - RNA, 20 nt, Human
auguagcccauccuucccuu

SEQ ID NO: 2895975 - RNA, 15 nt, Human
auguagcacauaaac

SEQ ID NO: 2895976 - RNA, 16 nt, Human
auguagcacauaaacu

SEQ ID NO: 2895977 - RNA, 19 nt, Human
auguagcacauaaacuuug

SEQ ID NO: 2895978 - RNA, 14 nt, Human
uuugcuccgaagcu

SEQ ID NO: 2895979 - RNA, 13 nt, Human
uuugccucugccu

SEQ ID NO: 2895980 - RNA, 19 nt, Human
uuugccugccuggugugcc

SEQ ID NO: 2895981 - RNA, 18 nt, Human
uuugccugguuuugucuu

SEQ ID NO: 2895982 - RNA, 20 nt, Human
uuugccucuuuucucugugc

SEQ ID NO: 2895983 - RNA, 22 nt, Human
uuugccuccagaagcacuggga

SEQ ID NO: 2895984 - RNA, 21 nt, Human
uuugccuccuguguacugugu

SEQ ID NO: 2895985 - RNA, 17 nt, Human
uuugcucuugucccacg

SEQ ID NO: 2895986 - RNA, 17 nt, Human
uuugcucuuguuuuuau

SEQ ID NO: 2895987 - RNA, 23 nt, Human
uuugcucuuguuuuuauuaauuu

SEQ ID NO: 2895988 - RNA, 13 nt, Human
uuugcucuuucuu

SEQ ID NO: 2895989 - RNA, 12 nt, Human
uuugcucugcca

SEQ ID NO: 2895990 - RNA, 19 nt, Human
uuugcugauggucuggucu

SEQ ID NO: 2895991 - RNA, 21 nt, Human
uuugcugauuuccccucuucc

SEQ ID NO: 2895992 - RNA, 10 nt, Human
uuugcugcca

SEQ ID NO: 2895993 - RNA, 19 nt, Human
uuugauguuuguggccuca

SEQ ID NO: 2895994 - RNA, 17 nt, Human
uuugauguuuguggccu

SEQ ID NO: 2895995 - RNA, 20 nt, Human
uuugauucauaguaacuucu

SEQ ID NO: 2895996 - RNA, 15 nt, Human
uuugauucauaguaa

SEQ ID NO: 2895997 - RNA, 22 nt, Human
uuugcaaaguauuguaaauuau

SEQ ID NO: 2895998 - RNA, 17 nt, Human
uuugcaaauauaaacau

SEQ ID NO: 2895999 - RNA, 13 nt, Human
uuugcaacauuua

SEQ ID NO: 2896000 - RNA, 12 nt, Human
uuugauucuccu

SEQ ID NO: 2896001 - RNA, 21 nt, Human
uuugacgucacugauauuuuu

SEQ ID NO: 2896002 - RNA, 19 nt, Human
uuugaccuuuuauguagua

SEQ ID NO: 2896003 - RNA, 21 nt, Human
uuugacuagggauucaggcug

SEQ ID NO: 2896004 - RNA, 16 nt, Human
uuugacuauucuguau

SEQ ID NO: 2896005 - RNA, 19 nt, Human
uuugacuagaugauggaug

SEQ ID NO: 2896006 - RNA, 15 nt, Human
uuugaugcuguuuga

SEQ ID NO: 2896007 - RNA, 19 nt, Human
uuugacugaagaugcagcu

SEQ ID NO: 2896008 - RNA, 15 nt, Human
uuugaugucaugugu

SEQ ID NO: 2896009 - RNA, 16 nt, Human
uuugaugucauguguu

SEQ ID NO: 2896010 - RNA, 18 nt, Human
uuugaugucauguguucc

SEQ ID NO: 2896011 - RNA, 14 nt, Human
uuugaugugacaau

SEQ ID NO: 2896012 - RNA, 19 nt, Human
uuugaugugacaauaauau

SEQ ID NO: 2896013 - RNA, 19 nt, Human
augguuccccuguucacuc

SEQ ID NO: 2896014 - RNA, 20 nt, Human
augguuccccuguucacucu

SEQ ID NO: 2896015 - RNA, 13 nt, Human
augguucugugcc

SEQ ID NO: 2896016 - RNA, 15 nt, Human
augguugccuuaaag

SEQ ID NO: 2896017 - RNA, 17 nt, Human
augguugccuuaaagaa

SEQ ID NO: 2896018 - RNA, 18 nt, Human
augguugccuuaaagaaa

SEQ ID NO: 2896019 - RNA, 15 nt, Human
augguuucuugcaag

SEQ ID NO: 2896020 - RNA, 23 nt, Human
augguugguaacacaaauuuuca

SEQ ID NO: 2896021 - RNA, 19 nt, Human
augguuuauuuuguauugu

SEQ ID NO: 2896022 - RNA, 21 nt, Human
augguuuauuuuguauugugg

SEQ ID NO: 2896023 - RNA, 22 nt, Human
augguuuauuuuguauuguggu

SEQ ID NO: 2896024 - RNA, 15 nt, Human
augguuuguccugau

SEQ ID NO: 2896025 - RNA, 22 nt, Human
augguuugacucccgaacauca

SEQ ID NO: 2896026 - RNA, 16 nt, Human
augguuuuuaaauuuu

SEQ ID NO: 2896027 - RNA, 18 nt, Human
augguuuuuaaauuuugu

SEQ ID NO: 2896028 - RNA, 21 nt, Human
augguuuuuaaauuuuguaau

SEQ ID NO: 2896029 - RNA, 11 nt, Human
auguaaaaaag

SEQ ID NO: 2896030 - RNA, 13 nt, Human
auguaaaaaagaa

SEQ ID NO: 2896031 - RNA, 19 nt, Human
auguaaaaaagaaaaacac

SEQ ID NO: 2896032 - RNA, 12 nt, Human
auguaaauauuc

SEQ ID NO: 2896033 - RNA, 15 nt, Human
auguaaauauucuau

SEQ ID NO: 2896034 - RNA, 18 nt, Human
auguaaaguauguaaaca

SEQ ID NO: 2896035 - RNA, 13 nt, Human
auguaaauacugu

SEQ ID NO: 2896036 - RNA, 12 nt, Human
auguaaauagug

SEQ ID NO: 2896037 - RNA, 17 nt, Human
auguaaauagugcagaa

SEQ ID NO: 2896038 - RNA, 20 nt, Human
auguaaaggagucaaaacua

SEQ ID NO: 2896039 - RNA, 13 nt, Human
auguaaaguaugu

SEQ ID NO: 2896040 - RNA, 17 nt, Human
auguaaaguauguaaac

SEQ ID NO: 2896041 - RNA, 14 nt, Human
auguacauuuggaa

SEQ ID NO: 2896042 - RNA, 16 nt, Human
auguacauuuggaacu

SEQ ID NO: 2896043 - RNA, 19 nt, Human
auguaccauaugaucuguu

SEQ ID NO: 2896044 - RNA, 19 nt, Human
auguaaaagaacuuacuga

SEQ ID NO: 2896045 - RNA, 22 nt, Human
auguaaaagaacuuacugauua

SEQ ID NO: 2896046 - RNA, 23 nt, Human
auguaaaagaacuuacugauuau

SEQ ID NO: 2896047 - RNA, 21 nt, Human
auguaaaagguauuaaauuga

SEQ ID NO: 2896048 - RNA, 13 nt, Human
auguaaaauguuu

SEQ ID NO: 2896049 - RNA, 16 nt, Human
auguaaaauguugaau

SEQ ID NO: 2896050 - RNA, 17 nt, Human
auguaaaauguugaaua

SEQ ID NO: 2896051 - RNA, 12 nt, Human
auguaaaaugau

SEQ ID NO: 2896052 - RNA, 13 nt, Human
auguaaaaugauu

SEQ ID NO: 2896053 - RNA, 18 nt, Human
auguaaacauaccaacau

SEQ ID NO: 2896054 - RNA, 20 nt, Human
auguaaacauaccaacaugu

SEQ ID NO: 2896055 - RNA, 12 nt, Human
auguaaacauuu

SEQ ID NO: 2896056 - RNA, 11 nt, Human
auguaaacugc

SEQ ID NO: 2896057 - RNA, 13 nt, Human
auguaaacugcca

SEQ ID NO: 2896058 - RNA, 14 nt, Human
auguaaacugccau

SEQ ID NO: 2896059 - RNA, 15 nt, Human
auguaaacugccaua

SEQ ID NO: 2896060 - RNA, 14 nt, Human
auguaaacaggaga

SEQ ID NO: 2896061 - RNA, 14 nt, Human
auguaaagaaaugu

SEQ ID NO: 2896062 - RNA, 16 nt, Human
auguaaagaaaugucu

SEQ ID NO: 2896063 - RNA, 17 nt, Human
auguaaagaaaugucuu

SEQ ID NO: 2896064 - RNA, 17 nt, Human
augguggcuggguugga

SEQ ID NO: 2896065 - RNA, 15 nt, Human
augguggcuucagcu

SEQ ID NO: 2896066 - RNA, 17 nt, Human
augguggcuucagcucc

SEQ ID NO: 2896067 - RNA, 18 nt, Human
augguggcuucagcucca

SEQ ID NO: 2896068 - RNA, 22 nt, Human
augguggcuucagcuccagccc

SEQ ID NO: 2896069 - RNA, 22 nt, Human
augguggcuucuuuucuuugua

SEQ ID NO: 2896070 - RNA, 23 nt, Human
augguggcuucuuuucuuuguau

SEQ ID NO: 2896071 - RNA, 14 nt, Human
auggugggcuucag

SEQ ID NO: 2896072 - RNA, 16 nt, Human
auggugggcuucaggg

SEQ ID NO: 2896073 - RNA, 17 nt, Human
auggugggcuucagggc

SEQ ID NO: 2896074 - RNA, 23 nt, Human
auggugggcuucagggcaggugg

SEQ ID NO: 2896075 - RNA, 15 nt, Human
augguggcuggguug

SEQ ID NO: 2896076 - RNA, 13 nt, Human
augguggcugggu

SEQ ID NO: 2896077 - RNA, 12 nt, Human
augguggcuggg

SEQ ID NO: 2896078 - RNA, 19 nt, Human
augguggcaugcaccugca

SEQ ID NO: 2896079 - RNA, 20 nt, Human
auggugcuacgccugcaugu

SEQ ID NO: 2896080 - RNA, 15 nt, Human
auggugcucaccaug

SEQ ID NO: 2896081 - RNA, 22 nt, Human
auggugcucaccaugcuuccag

SEQ ID NO: 2896082 - RNA, 16 nt, Human
augguggacccagcgg

SEQ ID NO: 2896083 - RNA, 16 nt, Human
auggugcuuaaguucc

SEQ ID NO: 2896084 - RNA, 17 nt, Human
auggugcuuaaguucca

SEQ ID NO: 2896085 - RNA, 19 nt, Human
auggugcuuaaguuccagc

SEQ ID NO: 2896086 - RNA, 14 nt, Human
augguuaugaaaga

SEQ ID NO: 2896087 - RNA, 15 nt, Human
augguuaugaaagaa

SEQ ID NO: 2896088 - RNA, 16 nt, Human
augguuaugaaagaau

SEQ ID NO: 2896089 - RNA, 18 nt, Human
augguuaugaaagaauau

SEQ ID NO: 2896090 - RNA, 19 nt, Human
augguuaugaaagaauaua

SEQ ID NO: 2896091 - RNA, 20 nt, Human
augguuaugaaagaauauau

SEQ ID NO: 2896092 - RNA, 18 nt, Human
augguuaagaguccaaga

SEQ ID NO: 2896093 - RNA, 23 nt, Human
augguuaagaguccaagaaucca

SEQ ID NO: 2896094 - RNA, 17 nt, Human
augguuacaaacuacag

SEQ ID NO: 2896095 - RNA, 17 nt, Human
augguguuuuucuugua

SEQ ID NO: 2896096 - RNA, 18 nt, Human
augguguuuuucuuguaa

SEQ ID NO: 2896097 - RNA, 19 nt, Human
augguguuuuucuuguaaa

SEQ ID NO: 2896098 - RNA, 22 nt, Human
augguguuuuucuuguaaaugu

SEQ ID NO: 2896099 - RNA, 20 nt, Human
augguguaauaagacauaac

SEQ ID NO: 2896100 - RNA, 22 nt, Human
augguguaauaagacauaacgu

SEQ ID NO: 2896101 - RNA, 12 nt, Human
augguguaauaa

SEQ ID NO: 2896102 - RNA, 14 nt, Human
augguguaauaaga

SEQ ID NO: 2896103 - RNA, 16 nt, Human
augguguaauaagaca

SEQ ID NO: 2896104 - RNA, 18 nt, Human
augguguaauaagacaua

SEQ ID NO: 2896105 - RNA, 23 nt, Human
augguguggacugaaugggauca

SEQ ID NO: 2896106 - RNA, 14 nt, Human
augguguguuacac

SEQ ID NO: 2896107 - RNA, 22 nt, Human
auggugugaaagucagaugccc

SEQ ID NO: 2896108 - RNA, 18 nt, Human
auggugugaaagucagau

SEQ ID NO: 2896109 - RNA, 14 nt, Human
augguguuacugca

SEQ ID NO: 2896110 - RNA, 18 nt, Human
augguguuacugcaguug

SEQ ID NO: 2896111 - RNA, 16 nt, Human
auggugaugaaaugua

SEQ ID NO: 2896112 - RNA, 17 nt, Human
auggugaugaaauguaa

SEQ ID NO: 2896113 - RNA, 15 nt, Human
augggugauauccug

SEQ ID NO: 2896114 - RNA, 16 nt, Human
augggugcaaggaaaa

SEQ ID NO: 2896115 - RNA, 20 nt, Human
augggugcaaggaaaauuag

SEQ ID NO: 2896116 - RNA, 14 nt, Human
auggugaugaaaug

SEQ ID NO: 2896117 - RNA, 23 nt, Human
uuucuccccaaugagacuugccu

SEQ ID NO: 2896118 - RNA, 13 nt, Human
uuucucccccugg

SEQ ID NO: 2896119 - RNA, 15 nt, Human
uuucucccccugggc

SEQ ID NO: 2896120 - RNA, 12 nt, Human
uuucuccccgcu

SEQ ID NO: 2896121 - RNA, 14 nt, Human
uuucucccccuggg

SEQ ID NO: 2896122 - RNA, 17 nt, Human
augggauacaaccuccc

SEQ ID NO: 2896123 - RNA, 21 nt, Human
augggauacaaccucccucuu

SEQ ID NO: 2896124 - RNA, 15 nt, Human
augggaucaugaaag

SEQ ID NO: 2896125 - RNA, 21 nt, Human
augggauguaugaauacagca

SEQ ID NO: 2896126 - RNA, 23 nt, Human
augggauguaugaauacagcagc

SEQ ID NO: 2896127 - RNA, 13 nt, Human
augggaucuuucu

SEQ ID NO: 2896128 - RNA, 14 nt, Human
uuucugcagaaaca

SEQ ID NO: 2896129 - RNA, 14 nt, Human
uuucugcaaaauag

SEQ ID NO: 2896130 - RNA, 14 nt, Human
uuucugcaaacaaa

SEQ ID NO: 2896131 - RNA, 19 nt, Human
uuucugcaaacaaacaccu

SEQ ID NO: 2896132 - RNA, 20 nt, Human
uuucugcaaacaaacaccuu

SEQ ID NO: 2896133 - RNA, 15 nt, Human
uuucugauguugccu

SEQ ID NO: 2896134 - RNA, 16 nt, Human
uuucugauguugccuu

SEQ ID NO: 2896135 - RNA, 14 nt, Human
uuucugauuagcuu

SEQ ID NO: 2896136 - RNA, 16 nt, Human
uuucugauuagcuuug

SEQ ID NO: 2896137 - RNA, 17 nt, Human
uuucugauuagcuuugu

SEQ ID NO: 2896138 - RNA, 18 nt, Human
uuucugauuagcuuugug

SEQ ID NO: 2896139 - RNA, 19 nt, Human
uuucugauuagcuuugugu

SEQ ID NO: 2896140 - RNA, 20 nt, Human
uuucugauuagcuuuguguu

SEQ ID NO: 2896141 - RNA, 15 nt, Human
uuucugguucuaaca

SEQ ID NO: 2896142 - RNA, 15 nt, Human
uuucuguaaauacca

SEQ ID NO: 2896143 - RNA, 13 nt, Human
uuucuguaccauu

SEQ ID NO: 2896144 - RNA, 11 nt, Human
uuucuguacuu

SEQ ID NO: 2896145 - RNA, 19 nt, Human
uuucuguagucauuuacua

SEQ ID NO: 2896146 - RNA, 24 nt, Human
uuucuguagucauuuacuaaacau

SEQ ID NO: 2896147 - RNA, 17 nt, Human
uuucuguauauacuuuu

SEQ ID NO: 2896148 - RNA, 15 nt, Human
uuucugucaagaaga

SEQ ID NO: 2896149 - RNA, 14 nt, Human
uuucugucagaaug

SEQ ID NO: 2896150 - RNA, 15 nt, Human
uuucugucagaaugc

SEQ ID NO: 2896151 - RNA, 16 nt, Human
uuucugucagaaugcu

SEQ ID NO: 2896152 - RNA, 17 nt, Human
uuucugucagaugagaa

SEQ ID NO: 2896153 - RNA, 19 nt, Human
uuucugucagaugagaaca

SEQ ID NO: 2896154 - RNA, 20 nt, Human
uuucugucagaugagaacaa

SEQ ID NO: 2896155 - RNA, 22 nt, Human
uuucugucagaugagaacaaag

SEQ ID NO: 2896156 - RNA, 23 nt, Human
uuucugucagaugagaacaaagc

SEQ ID NO: 2896157 - RNA, 13 nt, Human
uuucugucauuca

SEQ ID NO: 2896158 - RNA, 23 nt, Human
uuucugggcaccggggccucgga

SEQ ID NO: 2896159 - RNA, 22 nt, Human
uuucuggggaaagacacugccu

SEQ ID NO: 2896160 - RNA, 15 nt, Human
uuucuggguccugaa

SEQ ID NO: 2896161 - RNA, 15 nt, Human
uuucugggucuuuug

SEQ ID NO: 2896162 - RNA, 21 nt, Human
uuucuggggaaagacacugcc

SEQ ID NO: 2896163 - RNA, 15 nt, Human
uuucuggggaaagac

SEQ ID NO: 2896164 - RNA, 11 nt, Human
uuucugugugc

SEQ ID NO: 2896165 - RNA, 20 nt, Human
uuucugugugcaccuuacca

SEQ ID NO: 2896166 - RNA, 14 nt, Human
uuucugucuucucu

SEQ ID NO: 2896167 - RNA, 13 nt, Human
uuucugugcccua

SEQ ID NO: 2896168 - RNA, 18 nt, Human
uuucugugcccuacucau

SEQ ID NO: 2896169 - RNA, 15 nt, Human
uuucugucccuucug

SEQ ID NO: 2896170 - RNA, 22 nt, Human
uuucugugugcaccuuaccaac

SEQ ID NO: 2896171 - RNA, 15 nt, Human
uuucuuucagauuuu

SEQ ID NO: 2896172 - RNA, 12 nt, Human
uuucuuucuagu

SEQ ID NO: 2896173 - RNA, 13 nt, Human
uuucuuucuagug

SEQ ID NO: 2896174 - RNA, 16 nt, Human
uuucuuugaaugcuuu

SEQ ID NO: 2896175 - RNA, 22 nt, Human
uuucuuugaaugcuuuuugaau

SEQ ID NO: 2896176 - RNA, 14 nt, Human
uuucuuugcaaagu

SEQ ID NO: 2896177 - RNA, 15 nt, Human
uuucuuugcaaagua

SEQ ID NO: 2896178 - RNA, 13 nt, Human
uuugaaaaaguua

SEQ ID NO: 2896179 - RNA, 13 nt, Human
uuugaaaugaaau

SEQ ID NO: 2896180 - RNA, 14 nt, Human
uuugaaaugaaauu

SEQ ID NO: 2896181 - RNA, 15 nt, Human
uuugaaaugaaauuu

SEQ ID NO: 2896182 - RNA, 16 nt, Human
uuugaaaugaaauuua

SEQ ID NO: 2896183 - RNA, 17 nt, Human
uuugaaaugaaauuuaa

SEQ ID NO: 2896184 - RNA, 22 nt, Human
uuugaaaugaaauuuaaacauu

SEQ ID NO: 2896185 - RNA, 20 nt, Human
uuugaaaugaggucuguuua

SEQ ID NO: 2896186 - RNA, 21 nt, Human
uuugaaaugaggucuguuuaa

SEQ ID NO: 2896187 - RNA, 17 nt, Human
uuucuuuuuuaaaauca

SEQ ID NO: 2896188 - RNA, 16 nt, Human
uuugaaaaaaacuuca

SEQ ID NO: 2896189 - RNA, 14 nt, Human
uuugaaaaaagcuc

SEQ ID NO: 2896190 - RNA, 15 nt, Human
uuugaaaaaagcuca

SEQ ID NO: 2896191 - RNA, 21 nt, Human
uuugaaaaaagcucauuucau

SEQ ID NO: 2896192 - RNA, 20 nt, Human
uuucuuuuuaaguaaugugg

SEQ ID NO: 2896193 - RNA, 22 nt, Human
uuucuuuuuaaguaauguggaa

SEQ ID NO: 2896194 - RNA, 12 nt, Human
uuucuuuuuaca

SEQ ID NO: 2896195 - RNA, 13 nt, Human
uuucuuuuuacau

SEQ ID NO: 2896196 - RNA, 14 nt, Human
uuucuuuuuacaua

SEQ ID NO: 2896197 - RNA, 17 nt, Human
uuucuuuguaucauuca

SEQ ID NO: 2896198 - RNA, 19 nt, Human
uuucuuuuguaauaaacua

SEQ ID NO: 2896199 - RNA, 14 nt, Human
uuucuuuuguuacu

SEQ ID NO: 2896200 - RNA, 16 nt, Human
uuucuuuuguuacugu

SEQ ID NO: 2896201 - RNA, 17 nt, Human
uuucuuuuguuacuguu

SEQ ID NO: 2896202 - RNA, 20 nt, Human
uuucuuuuguuacuguucuu

SEQ ID NO: 2896203 - RNA, 24 nt, Human
uuucuuuuguuacuguucuugcug

SEQ ID NO: 2896204 - RNA, 18 nt, Human
augggccuccugugugug

SEQ ID NO: 2896205 - RNA, 13 nt, Human
augggccuggcau

SEQ ID NO: 2896206 - RNA, 20 nt, Human
augggccuggccaccucucu

SEQ ID NO: 2896207 - RNA, 22 nt, Human
uuugaaauuaugugacauuuua

SEQ ID NO: 2896208 - RNA, 23 nt, Human
uuugaaaugugguuuuccugaaa

SEQ ID NO: 2896209 - RNA, 17 nt, Human
uuugaaauuaugugaca

SEQ ID NO: 2896210 - RNA, 15 nt, Human
uuugaaauuauguga

SEQ ID NO: 2896211 - RNA, 17 nt, Human
auggggauaaaaugacu

SEQ ID NO: 2896212 - RNA, 22 nt, Human
auggggauaaaaugacuacuua

SEQ ID NO: 2896213 - RNA, 21 nt, Human
augggcucugacagaaagcag

SEQ ID NO: 2896214 - RNA, 14 nt, Human
augggcucuucacu

SEQ ID NO: 2896215 - RNA, 14 nt, Human
augggcucuuccaa

SEQ ID NO: 2896216 - RNA, 15 nt, Human
augggcucuuccaac

SEQ ID NO: 2896217 - RNA, 18 nt, Human
augggcguacgcuggugc

SEQ ID NO: 2896218 - RNA, 20 nt, Human
auggggcccuaauucagcca

SEQ ID NO: 2896219 - RNA, 11 nt, Human
augggggaaag

SEQ ID NO: 2896220 - RNA, 16 nt, Human
augggggaaagcacag

SEQ ID NO: 2896221 - RNA, 17 nt, Human
augggggcacugaggac

SEQ ID NO: 2896222 - RNA, 22 nt, Human
augggggaaagcacaggugggc

SEQ ID NO: 2896223 - RNA, 19 nt, Human
auggggugggguagggcug

SEQ ID NO: 2896224 - RNA, 20 nt, Human
uuuaaauacgcacuacaugu

SEQ ID NO: 2896225 - RNA, 12 nt, Human
uuuaaauauaau

SEQ ID NO: 2896226 - RNA, 16 nt, Human
uuuaaauaauuuaacu

SEQ ID NO: 2896227 - RNA, 21 nt, Human
uuuaaauaauuuaacuacccu

SEQ ID NO: 2896228 - RNA, 13 nt, Human
uuuaaauauaauu

SEQ ID NO: 2896229 - RNA, 15 nt, Human
uuuaaauauaauucu

SEQ ID NO: 2896230 - RNA, 16 nt, Human
uuuaaauauaauucug

SEQ ID NO: 2896231 - RNA, 18 nt, Human
uuuaaauauaauucugua

SEQ ID NO: 2896232 - RNA, 19 nt, Human
uuuaagugaaagugaggaa

SEQ ID NO: 2896233 - RNA, 20 nt, Human
uuuaaguauuuauauauuua

SEQ ID NO: 2896234 - RNA, 20 nt, Human
uuuaagucaguauggucuaa

SEQ ID NO: 2896235 - RNA, 15 nt, Human
uuuaaguauuuauau

SEQ ID NO: 2896236 - RNA, 14 nt, Human
uuuaaguauuuaua

SEQ ID NO: 2896237 - RNA, 13 nt, Human
uuuaaguauuuau

SEQ ID NO: 2896238 - RNA, 21 nt, Human
uuuaaauauaauucuguaaau

SEQ ID NO: 2896239 - RNA, 14 nt, Human
uuuaaguaaugugg

SEQ ID NO: 2896240 - RNA, 16 nt, Human
uuuaaguaauguggaa

SEQ ID NO: 2896241 - RNA, 22 nt, Human
uuuaaguaauguggaagaaaau

SEQ ID NO: 2896242 - RNA, 23 nt, Human
uuuaaguaauguggaagaaaaug

SEQ ID NO: 2896243 - RNA, 20 nt, Human
uuuaaguacuacacauuuuu

SEQ ID NO: 2896244 - RNA, 21 nt, Human
uuuaaguacuacacauuuuua

SEQ ID NO: 2896245 - RNA, 12 nt, Human
uuuaaguauuua

SEQ ID NO: 2896246 - RNA, 16 nt, Human
uuuaagguuuuuacug

SEQ ID NO: 2896247 - RNA, 18 nt, Human
uuuaaguauuuagguuuu

SEQ ID NO: 2896248 - RNA, 13 nt, Human
uuuaaguauuuag

SEQ ID NO: 2896249 - RNA, 13 nt, Human
uuuaauuaaauaa

SEQ ID NO: 2896250 - RNA, 15 nt, Human
uuuaauguuuuaaau

SEQ ID NO: 2896251 - RNA, 18 nt, Human
uuuaauguuuuaaaugua

SEQ ID NO: 2896252 - RNA, 19 nt, Human
uuuaauguuuuaaauguac

SEQ ID NO: 2896253 - RNA, 18 nt, Human
uuuaauuaaaaacuagua

SEQ ID NO: 2896254 - RNA, 20 nt, Human
uuuaauuaaaaacuaguagu

SEQ ID NO: 2896255 - RNA, 21 nt, Human
uuuaauuaaaaacuaguaguu

SEQ ID NO: 2896256 - RNA, 18 nt, Human
uuuaagugcguguguaga

SEQ ID NO: 2896257 - RNA, 20 nt, Human
uuuaagugcguguguagagu

SEQ ID NO: 2896258 - RNA, 13 nt, Human
uuuaaugugaacu

SEQ ID NO: 2896259 - RNA, 15 nt, Human
uuuaaugugaacuug

SEQ ID NO: 2896260 - RNA, 16 nt, Human
uuuaaugugaacuugu

SEQ ID NO: 2896261 - RNA, 17 nt, Human
uuuaaugugaacuugua

SEQ ID NO: 2896262 - RNA, 19 nt, Human
uuuaaugugaacuuguagc

SEQ ID NO: 2896263 - RNA, 20 nt, Human
uuuaaugugaacuuguagcu

SEQ ID NO: 2896264 - RNA, 21 nt, Human
uuuaaugugaacuuguagcug

SEQ ID NO: 2896265 - RNA, 13 nt, Human
uuuaaugugauga

SEQ ID NO: 2896266 - RNA, 21 nt, Human
uuuaaugugaugauguaauug

SEQ ID NO: 2896267 - RNA, 22 nt, Human
uuuaaugugaugauguaauuga

SEQ ID NO: 2896268 - RNA, 15 nt, Human
uuuaauguucuguga

SEQ ID NO: 2896269 - RNA, 13 nt, Human
uuuaauugucaug

SEQ ID NO: 2896270 - RNA, 14 nt, Human
uuuaauugucaugg

SEQ ID NO: 2896271 - RNA, 21 nt, Human
uuuaauugucaugguuacaaa

SEQ ID NO: 2896272 - RNA, 11 nt, Human
uuuaauuauua

SEQ ID NO: 2896273 - RNA, 18 nt, Human
uuuaauuauuaacuacau

SEQ ID NO: 2896274 - RNA, 19 nt, Human
uuuaauuauuaacuacauu

SEQ ID NO: 2896275 - RNA, 13 nt, Human
augcagcgugaag

SEQ ID NO: 2896276 - RNA, 19 nt, Human
augcaggauuuguucucug

SEQ ID NO: 2896277 - RNA, 21 nt, Human
augcaggcacuuauuguaaau

SEQ ID NO: 2896278 - RNA, 22 nt, Human
augcaggcacuuauuguaaauu

SEQ ID NO: 2896279 - RNA, 12 nt, Human
augcaggcccuu

SEQ ID NO: 2896280 - RNA, 22 nt, Human
augcaggcccuuugaagccuca

SEQ ID NO: 2896281 - RNA, 22 nt, Human
augcagcccaugcccaccugcc

SEQ ID NO: 2896282 - RNA, 13 nt, Human
augcagcucaacu

SEQ ID NO: 2896283 - RNA, 23 nt, Human
augcagcucaacuuucuguugga

SEQ ID NO: 2896284 - RNA, 17 nt, Human
augcagcaucuaaguaa

SEQ ID NO: 2896285 - RNA, 16 nt, Human
augcagcaaggcccug

SEQ ID NO: 2896286 - RNA, 19 nt, Human
augcagcaaggcccugcug

SEQ ID NO: 2896287 - RNA, 21 nt, Human
augcagcaaggcccugcugcc

SEQ ID NO: 2896288 - RNA, 23 nt, Human
augcagcccaugcccaccugccc

SEQ ID NO: 2896289 - RNA, 14 nt, Human
augcagcccauuuc

SEQ ID NO: 2896290 - RNA, 16 nt, Human
augcagcccauuucuc

SEQ ID NO: 2896291 - RNA, 20 nt, Human
augcagcccauuucuccaga

SEQ ID NO: 2896292 - RNA, 21 nt, Human
augcagcccauuucuccagaa

SEQ ID NO: 2896293 - RNA, 18 nt, Human
augcagccgccuuccuug

SEQ ID NO: 2896294 - RNA, 19 nt, Human
augcagccgccuuccuuga

SEQ ID NO: 2896295 - RNA, 21 nt, Human
augcagcccaugcccaccugc

SEQ ID NO: 2896296 - RNA, 15 nt, Human
augcagcccaugccc

SEQ ID NO: 2896297 - RNA, 12 nt, Human
augcagcauuug

SEQ ID NO: 2896298 - RNA, 14 nt, Human
augcagcauuugau

SEQ ID NO: 2896299 - RNA, 15 nt, Human
augcagcauuugaua

SEQ ID NO: 2896300 - RNA, 16 nt, Human
augcagcauuugauaa

SEQ ID NO: 2896301 - RNA, 19 nt, Human
uuuaauuuuuuugagacag

SEQ ID NO: 2896302 - RNA, 20 nt, Human
uuuaauuucugucagaaugc

SEQ ID NO: 2896303 - RNA, 13 nt, Human
uuuaauuucuuca

SEQ ID NO: 2896304 - RNA, 23 nt, Human
uuuaauuguuguuucuuucuagu

SEQ ID NO: 2896305 - RNA, 24 nt, Human
uuuaauuguuguuucuuucuagug

SEQ ID NO: 2896306 - RNA, 16 nt, Human
uuuaauuguuguuucu

SEQ ID NO: 2896307 - RNA, 18 nt, Human
uuuaauuguuguuucuuu

SEQ ID NO: 2896308 - RNA, 21 nt, Human
uuuaauuguuguuucuuucua

SEQ ID NO: 2896309 - RNA, 22 nt, Human
uuuaauuguuguuucuuucuag

SEQ ID NO: 2896310 - RNA, 16 nt, Human
uuuaauuuaugaguuu

SEQ ID NO: 2896311 - RNA, 14 nt, Human
uuuaauuuauguaa

SEQ ID NO: 2896312 - RNA, 20 nt, Human
uuuaauuuauguaacuugaa

SEQ ID NO: 2896313 - RNA, 16 nt, Human
uuuaauuuaguaaaug

SEQ ID NO: 2896314 - RNA, 18 nt, Human
uuuaauuuaguaaauguu

SEQ ID NO: 2896315 - RNA, 19 nt, Human
uuuaauuuaguaaauguua

SEQ ID NO: 2896316 - RNA, 18 nt, Human
uuuaauuuuuuuuaguau

SEQ ID NO: 2896317 - RNA, 17 nt, Human
uuuaauuuuuuuuagua

SEQ ID NO: 2896318 - RNA, 19 nt, Human
uuuacaaaacuacaugaga

SEQ ID NO: 2896319 - RNA, 21 nt, Human
uuuacaaaagaaauaccuuga

SEQ ID NO: 2896320 - RNA, 20 nt, Human
uuuacaaaagaggagcacuu

SEQ ID NO: 2896321 - RNA, 20 nt, Human
uuuacaacauaaucuaguuu

SEQ ID NO: 2896322 - RNA, 14 nt, Human
augcauuugcauuu

SEQ ID NO: 2896323 - RNA, 23 nt, Human
augcagugguaugaucacggcuc

SEQ ID NO: 2896324 - RNA, 18 nt, Human
augccaaaaaaagacagg

SEQ ID NO: 2896325 - RNA, 17 nt, Human
augccaauauuaaaucu

SEQ ID NO: 2896326 - RNA, 16 nt, Human
augccaauacuaguca

SEQ ID NO: 2896327 - RNA, 23 nt, Human
augccaauacuagucaccccaag

SEQ ID NO: 2896328 - RNA, 12 nt, Human
augcccaaggga

SEQ ID NO: 2896329 - RNA, 15 nt, Human
augcccaagggaaag

SEQ ID NO: 2896330 - RNA, 23 nt, Human
augcccacauuuagucucuuuau

SEQ ID NO: 2896331 - RNA, 14 nt, Human
augccacccuagcc

SEQ ID NO: 2896332 - RNA, 15 nt, Human
augccacccacaucu

SEQ ID NO: 2896333 - RNA, 22 nt, Human
augccaauuagcaauugacugu

SEQ ID NO: 2896334 - RNA, 16 nt, Human
augccaauuauuguua

SEQ ID NO: 2896335 - RNA, 14 nt, Human
augccacacaccuu

SEQ ID NO: 2896336 - RNA, 15 nt, Human
augccacacaccuuu

SEQ ID NO: 2896337 - RNA, 13 nt, Human
augcgucccaaga

SEQ ID NO: 2896338 - RNA, 19 nt, Human
augcgucccaagauguuga

SEQ ID NO: 2896339 - RNA, 21 nt, Human
augcguacguuuccugagaag

SEQ ID NO: 2896340 - RNA, 16 nt, Human
augcguaaacgacacu

SEQ ID NO: 2896341 - RNA, 22 nt, Human
augccucccuaucccucacaca

SEQ ID NO: 2896342 - RNA, 14 nt, Human
augccuccuguggg

SEQ ID NO: 2896343 - RNA, 15 nt, Human
augccuccugugggg

SEQ ID NO: 2896344 - RNA, 11 nt, Human
augcagcccau

SEQ ID NO: 2896345 - RNA, 14 nt, Human
augcccugcuccag

SEQ ID NO: 2896346 - RNA, 14 nt, Human
augcccuggaucca

SEQ ID NO: 2896347 - RNA, 19 nt, Human
augccgauauacucuagau

SEQ ID NO: 2896348 - RNA, 16 nt, Human
augccucagccuccug

SEQ ID NO: 2896349 - RNA, 15 nt, Human
augcccuuaaaucau

SEQ ID NO: 2896350 - RNA, 22 nt, Human
augauccaugaguuugcccugg

SEQ ID NO: 2896351 - RNA, 21 nt, Human
augauccaugaguuugcccug

SEQ ID NO: 2896352 - RNA, 20 nt, Human
augaucaguguuguugcucu

SEQ ID NO: 2896353 - RNA, 14 nt, Human
augauaucccugau

SEQ ID NO: 2896354 - RNA, 12 nt, Human
augauaugcauu

SEQ ID NO: 2896355 - RNA, 17 nt, Human
augauacaaugaacacu

SEQ ID NO: 2896356 - RNA, 22 nt, Human
augauacccugaauuuggccug

SEQ ID NO: 2896357 - RNA, 20 nt, Human
augauaaguuccuuuccuuu

SEQ ID NO: 2896358 - RNA, 21 nt, Human
augauacuaucauacuacuga

SEQ ID NO: 2896359 - RNA, 17 nt, Human
augauaguaagaaaagu

SEQ ID NO: 2896360 - RNA, 14 nt, Human
augauagauuugac

SEQ ID NO: 2896361 - RNA, 17 nt, Human
augauagauuugaccuc

SEQ ID NO: 2896362 - RNA, 18 nt, Human
augauagauuugaccucc

SEQ ID NO: 2896363 - RNA, 20 nt, Human
augauagauuugaccuccuc

SEQ ID NO: 2896364 - RNA, 18 nt, Human
uuguugacaguucugaag

SEQ ID NO: 2896365 - RNA, 21 nt, Human
uuguugacaguucugaagaau

SEQ ID NO: 2896366 - RNA, 17 nt, Human
augauaaguaaaugcua

SEQ ID NO: 2896367 - RNA, 16 nt, Human
uuguugacaaaauuuu

SEQ ID NO: 2896368 - RNA, 13 nt, Human
augauacaaugaa

SEQ ID NO: 2896369 - RNA, 17 nt, Human
augauacaagauuagaa

SEQ ID NO: 2896370 - RNA, 18 nt, Human
uuguugagcuauugcugu

SEQ ID NO: 2896371 - RNA, 15 nt, Human
augauaauagauucu

SEQ ID NO: 2896372 - RNA, 19 nt, Human
augauaauagauucucuug

SEQ ID NO: 2896373 - RNA, 16 nt, Human
uuguuccaaugccaca

SEQ ID NO: 2896374 - RNA, 12 nt, Human
uuguuccagcuc

SEQ ID NO: 2896375 - RNA, 15 nt, Human
uuguucuuuguucuu

SEQ ID NO: 2896376 - RNA, 17 nt, Human
uugguggaaucuuuagc

SEQ ID NO: 2896377 - RNA, 13 nt, Human
uuguucuuuuuau

SEQ ID NO: 2896378 - RNA, 12 nt, Human
uuguugaaauuu

SEQ ID NO: 2896379 - RNA, 18 nt, Human
uuguugaaauuuugcaaa

SEQ ID NO: 2896380 - RNA, 17 nt, Human
uuguugaacagguguuu

SEQ ID NO: 2896381 - RNA, 20 nt, Human
uuggugccuggccuggcaca

SEQ ID NO: 2896382 - RNA, 22 nt, Human
uuggugccuggccuggcacaca

SEQ ID NO: 2896383 - RNA, 12 nt, Human
uuguucauguuu

SEQ ID NO: 2896384 - RNA, 13 nt, Human
uuguucauguuug

SEQ ID NO: 2896385 - RNA, 14 nt, Human
uuguucauguuugg

SEQ ID NO: 2896386 - RNA, 19 nt, Human
uuguucauguuuggugcau

SEQ ID NO: 2896387 - RNA, 19 nt, Human
uuggugcucauuuaaauau

SEQ ID NO: 2896388 - RNA, 14 nt, Human
uuggugcugggaac

SEQ ID NO: 2896389 - RNA, 20 nt, Human
uuguguuaaguauguguaaa

SEQ ID NO: 2896390 - RNA, 18 nt, Human
augauucguguaauuacu

SEQ ID NO: 2896391 - RNA, 23 nt, Human
augauucuaauuuuuaagcaaaa

SEQ ID NO: 2896392 - RNA, 23 nt, Human
augauucuauuuauauguacaug

SEQ ID NO: 2896393 - RNA, 22 nt, Human
augauucuauuuauauguacau

SEQ ID NO: 2896394 - RNA, 23 nt, Human
augcaagauaguuuaucuaacuu

SEQ ID NO: 2896395 - RNA, 18 nt, Human
augcaagagugauugcag

SEQ ID NO: 2896396 - RNA, 20 nt, Human
augcaagagugauugcagcu

SEQ ID NO: 2896397 - RNA, 21 nt, Human
augcaagagugauugcagcuu

SEQ ID NO: 2896398 - RNA, 20 nt, Human
augcaacacgcauggucaac

SEQ ID NO: 2896399 - RNA, 16 nt, Human
augcaaggaaggaaag

SEQ ID NO: 2896400 - RNA, 15 nt, Human
augcaaggaaggaaa

SEQ ID NO: 2896401 - RNA, 14 nt, Human
augcaaggaaggaa

SEQ ID NO: 2896402 - RNA, 13 nt, Human
augcaaggaagga

SEQ ID NO: 2896403 - RNA, 20 nt, Human
augcaccuagcugugcaaga

SEQ ID NO: 2896404 - RNA, 22 nt, Human
augcaccagcccuuagcaggga

SEQ ID NO: 2896405 - RNA, 15 nt, Human
augcaaggaccagga

SEQ ID NO: 2896406 - RNA, 14 nt, Human
augcaaggaccagg

SEQ ID NO: 2896407 - RNA, 20 nt, Human
augcaaggaaggaaagaaag

SEQ ID NO: 2896408 - RNA, 18 nt, Human
augcaaggaaggaaagaa

SEQ ID NO: 2896409 - RNA, 13 nt, Human
uuuaaagagucua

SEQ ID NO: 2896410 - RNA, 15 nt, Human
uuuaaagagucuaga

SEQ ID NO: 2896411 - RNA, 16 nt, Human
uuuaaagagucuagau

SEQ ID NO: 2896412 - RNA, 17 nt, Human
uuuaaagagucuagauu

SEQ ID NO: 2896413 - RNA, 18 nt, Human
uuuaaagagucuagauuc

SEQ ID NO: 2896414 - RNA, 21 nt, Human
uuuaaagagucuagauucaaa

SEQ ID NO: 2896415 - RNA, 23 nt, Human
uuuaaagagucuagauucaaagg

SEQ ID NO: 2896416 - RNA, 23 nt, Human
uuuaaagguggauuuuguuuaaa

SEQ ID NO: 2896417 - RNA, 18 nt, Human
uuuaaaguggcaaucuca

SEQ ID NO: 2896418 - RNA, 18 nt, Human
uuuaaaguguaauaauau

SEQ ID NO: 2896419 - RNA, 19 nt, Human
uuuaaaguguuucuguuau

SEQ ID NO: 2896420 - RNA, 14 nt, Human
uuuaaaguguuuca

SEQ ID NO: 2896421 - RNA, 18 nt, Human
uuuaaaguguuucagcua

SEQ ID NO: 2896422 - RNA, 12 nt, Human
uuuaaauaaacu

SEQ ID NO: 2896423 - RNA, 13 nt, Human
uuuaaauaaacuu

SEQ ID NO: 2896424 - RNA, 14 nt, Human
uuuaaauaaacuuu

SEQ ID NO: 2896425 - RNA, 15 nt, Human
uuuaaauaaacuuuu

SEQ ID NO: 2896426 - RNA, 20 nt, Human
uuuaaauaaacuuuuuuuca

SEQ ID NO: 2896427 - RNA, 21 nt, Human
uuuaaauaaacuuuuuuucaa

SEQ ID NO: 2896428 - RNA, 22 nt, Human
uuuaaauaaacuuuuuuucaau

SEQ ID NO: 2896429 - RNA, 23 nt, Human
uuuaaauaaacuuuuuuucaaug

SEQ ID NO: 2896430 - RNA, 20 nt, Human
uuuaaaguguuucuguuauu

SEQ ID NO: 2896431 - RNA, 23 nt, Human
uuuaaauaaaagaaaaaauaucu

SEQ ID NO: 2896432 - RNA, 17 nt, Human
uuuaaaaauagacacuc

SEQ ID NO: 2896433 - RNA, 11 nt, Human
uuuaaaaaugg

SEQ ID NO: 2896434 - RNA, 11 nt, Human
uuuaaaaaugu

SEQ ID NO: 2896435 - RNA, 12 nt, Human
uuuaaaaauguc

SEQ ID NO: 2896436 - RNA, 13 nt, Human
uuuaaaaaugucu

SEQ ID NO: 2896437 - RNA, 14 nt, Human
uuuaaaaaugucuu

SEQ ID NO: 2896438 - RNA, 17 nt, Human
uuuaaaaaugucuugcu

SEQ ID NO: 2896439 - RNA, 15 nt, Human
uuguuuucugacuaa

SEQ ID NO: 2896440 - RNA, 20 nt, Human
augcaccugcaaucccagcu

SEQ ID NO: 2896441 - RNA, 18 nt, Human
uuguuuucugacuaauua

SEQ ID NO: 2896442 - RNA, 16 nt, Human
uuguuuucugacuaau

SEQ ID NO: 2896443 - RNA, 17 nt, Human
uuguuuucugacuaauu

SEQ ID NO: 2896444 - RNA, 23 nt, Human
uuguuuugauguuuguggccuca

SEQ ID NO: 2896445 - RNA, 22 nt, Human
uuguuuucuuucuuuaaauguu

SEQ ID NO: 2896446 - RNA, 16 nt, Human
uuguuuugcacuuuuu

SEQ ID NO: 2896447 - RNA, 14 nt, Human
uuguuuugcacuuu

SEQ ID NO: 2896448 - RNA, 15 nt, Human
uuguuuugcacuuuu

SEQ ID NO: 2896449 - RNA, 17 nt, Human
auggagaauugcugaag

SEQ ID NO: 2896450 - RNA, 18 nt, Human
auggagacgcauuucggu

SEQ ID NO: 2896451 - RNA, 18 nt, Human
auggagacugucucaaga

SEQ ID NO: 2896452 - RNA, 21 nt, Human
auggagacugguccugugugc

SEQ ID NO: 2896453 - RNA, 19 nt, Human
auggcaccaaagccaccag

SEQ ID NO: 2896454 - RNA, 17 nt, Human
auggcagcagaaaacuu

SEQ ID NO: 2896455 - RNA, 20 nt, Human
auggcacuuagcuaucagaa

SEQ ID NO: 2896456 - RNA, 22 nt, Human
auggcacuuagcuaucagaaga

SEQ ID NO: 2896457 - RNA, 15 nt, Human
auggcacucccucca

SEQ ID NO: 2896458 - RNA, 16 nt, Human
auggcacucccuccag

SEQ ID NO: 2896459 - RNA, 18 nt, Human
auggcacucccuccagca

SEQ ID NO: 2896460 - RNA, 20 nt, Human
auggcacucccuccagcaca

SEQ ID NO: 2896461 - RNA, 21 nt, Human
auggcacucccuccagcacaa

SEQ ID NO: 2896462 - RNA, 23 nt, Human
auggcacucccuccagcacaaac

SEQ ID NO: 2896463 - RNA, 14 nt, Human
auggcagcugccac

SEQ ID NO: 2896464 - RNA, 16 nt, Human
auggcaggauggccug

SEQ ID NO: 2896465 - RNA, 17 nt, Human
auggcaggauggccugg

SEQ ID NO: 2896466 - RNA, 22 nt, Human
auggcaggauggccuggccagg

SEQ ID NO: 2896467 - RNA, 20 nt, Human
auggcaucuucgucuucacu

SEQ ID NO: 2896468 - RNA, 15 nt, Human
auggcaucaccucca

SEQ ID NO: 2896469 - RNA, 20 nt, Human
auggcgugucccucucggaa

SEQ ID NO: 2896470 - RNA, 22 nt, Human
auggcguccguggguugcuaac

SEQ ID NO: 2896471 - RNA, 24 nt, Human
auggcguccguggguugcuaacug

SEQ ID NO: 2896472 - RNA, 21 nt, Human
auggcccuguagccagcaccu

SEQ ID NO: 2896473 - RNA, 11 nt, Human
auggcccuggg

SEQ ID NO: 2896474 - RNA, 11 nt, Human
auggccccucu

SEQ ID NO: 2896475 - RNA, 18 nt, Human
auggccccucugaccugc

SEQ ID NO: 2896476 - RNA, 23 nt, Human
auggccccucugaccugcacugg

SEQ ID NO: 2896477 - RNA, 17 nt, Human
auggcccggaugcugcu

SEQ ID NO: 2896478 - RNA, 18 nt, Human
auggcccggaugcugcuu

SEQ ID NO: 2896479 - RNA, 19 nt, Human
auggcccggaugcugcuuc

SEQ ID NO: 2896480 - RNA, 21 nt, Human
auggcccggaugcugcuuccg

SEQ ID NO: 2896481 - RNA, 14 nt, Human
auggcuauauggca

SEQ ID NO: 2896482 - RNA, 15 nt, Human
auggcuccagaaaug

SEQ ID NO: 2896483 - RNA, 16 nt, Human
auggcuccagaaaugu

SEQ ID NO: 2896484 - RNA, 12 nt, Human
auggcucagagg

SEQ ID NO: 2896485 - RNA, 13 nt, Human
auggcucagaggg

SEQ ID NO: 2896486 - RNA, 15 nt, Human
auggcucagaggggg

SEQ ID NO: 2896487 - RNA, 22 nt, Human
auggcucagagggggacugcug

SEQ ID NO: 2896488 - RNA, 19 nt, Human
auggcuauauggcaagaaa

SEQ ID NO: 2896489 - RNA, 14 nt, Human
auggcuaugcuuaa

SEQ ID NO: 2896490 - RNA, 21 nt, Human
augggagggauggcccuuccu

SEQ ID NO: 2896491 - RNA, 21 nt, Human
augggagcugguuagaaaugc

SEQ ID NO: 2896492 - RNA, 13 nt, Human
augggaggaaaga

SEQ ID NO: 2896493 - RNA, 18 nt, Human
augggaggaaagagagca

SEQ ID NO: 2896494 - RNA, 22 nt, Human
augggagcugguuagaaaugca

SEQ ID NO: 2896495 - RNA, 20 nt, Human
augggagcugguuagaaaug

SEQ ID NO: 2896496 - RNA, 15 nt, Human
augggagaguagaug

SEQ ID NO: 2896497 - RNA, 17 nt, Human
auggcuccagaaauguc

SEQ ID NO: 2896498 - RNA, 17 nt, Human
auggcucccacaggagu

SEQ ID NO: 2896499 - RNA, 23 nt, Human
auggcuccccuuuuucuuccuca

SEQ ID NO: 2896500 - RNA, 13 nt, Human
uuucauuauuagu

SEQ ID NO: 2896501 - RNA, 21 nt, Human
uuucauuauuaguacugcucu

SEQ ID NO: 2896502 - RNA, 12 nt, Human
uuuccaucuuua

SEQ ID NO: 2896503 - RNA, 20 nt, Human
uuuccccugcccccagaccu

SEQ ID NO: 2896504 - RNA, 18 nt, Human
uuuccccuaucauuuauu

SEQ ID NO: 2896505 - RNA, 17 nt, Human
uuuccaugaaguuugaa

SEQ ID NO: 2896506 - RNA, 23 nt, Human
uuuccccccacucuccccacacu

SEQ ID NO: 2896507 - RNA, 19 nt, Human
uuuccccccuuuuuuuccu

SEQ ID NO: 2896508 - RNA, 19 nt, Human
uuuccccccacucucccca

SEQ ID NO: 2896509 - RNA, 16 nt, Human
uuucccccuucuacau

SEQ ID NO: 2896510 - RNA, 18 nt, Human
uuucauuauguaaaaugu

SEQ ID NO: 2896511 - RNA, 20 nt, Human
uuucauuauguaaaauguuu

SEQ ID NO: 2896512 - RNA, 14 nt, Human
uuucauuacaaugg

SEQ ID NO: 2896513 - RNA, 16 nt, Human
uuucauuacaauggaa

SEQ ID NO: 2896514 - RNA, 21 nt, Human
uuucauuacaauggaaacaau

SEQ ID NO: 2896515 - RNA, 14 nt, Human
uuucaaauuucaca

SEQ ID NO: 2896516 - RNA, 23 nt, Human
uuucaacaaauaucuuguguugu

SEQ ID NO: 2896517 - RNA, 20 nt, Human
uuucaaccagauaacauacc

SEQ ID NO: 2896518 - RNA, 14 nt, Human
uuucaaccccaccc

SEQ ID NO: 2896519 - RNA, 19 nt, Human
uuucaaccccacccuguuu

SEQ ID NO: 2896520 - RNA, 21 nt, Human
uuucaaccccacccuguuugg

SEQ ID NO: 2896521 - RNA, 23 nt, Human
uuucaaccccacccuguuuggau

SEQ ID NO: 2896522 - RNA, 13 nt, Human
uuucaaagaugcu

SEQ ID NO: 2896523 - RNA, 14 nt, Human
uuucaaagaugcug

SEQ ID NO: 2896524 - RNA, 19 nt, Human
uuucaaagaugcugugagu

SEQ ID NO: 2896525 - RNA, 17 nt, Human
uuucaaagcuuuuucca

SEQ ID NO: 2896526 - RNA, 14 nt, Human
uuucaaauuuagaa

SEQ ID NO: 2896527 - RNA, 18 nt, Human
uuucaaauuuagaaacua

SEQ ID NO: 2896528 - RNA, 20 nt, Human
uuucaaauuuagaaacuaau

SEQ ID NO: 2896529 - RNA, 21 nt, Human
uuucaaauuuagaaacuaauu

SEQ ID NO: 2896530 - RNA, 23 nt, Human
uuucaaauuuagaaacuaauuga

SEQ ID NO: 2896531 - RNA, 19 nt, Human
uuucaaauuggacuuucaa

SEQ ID NO: 2896532 - RNA, 20 nt, Human
uuucaaauuggacuuucaaa

SEQ ID NO: 2896533 - RNA, 21 nt, Human
uuucaaauuggacuuucaaaa

SEQ ID NO: 2896534 - RNA, 14 nt, Human
uuucaaaugugcug

SEQ ID NO: 2896535 - RNA, 17 nt, Human
auggacuuuauaagcca

SEQ ID NO: 2896536 - RNA, 15 nt, Human
auggacugguuugag

SEQ ID NO: 2896537 - RNA, 17 nt, Human
auggacugguuugagau

SEQ ID NO: 2896538 - RNA, 18 nt, Human
auggacuuauuucuucaa

SEQ ID NO: 2896539 - RNA, 19 nt, Human
auggacuuauuucuucaaa

SEQ ID NO: 2896540 - RNA, 20 nt, Human
auggacuuauuucuucaaau

SEQ ID NO: 2896541 - RNA, 15 nt, Human
auggacucugcacau

SEQ ID NO: 2896542 - RNA, 15 nt, Human
auggacuuuggaagc

SEQ ID NO: 2896543 - RNA, 17 nt, Human
auggacuuuggaagcag

SEQ ID NO: 2896544 - RNA, 18 nt, Human
auggacuuuggaagcagg

SEQ ID NO: 2896545 - RNA, 11 nt, Human
auggacacucc

SEQ ID NO: 2896546 - RNA, 13 nt, Human
auggacacuccag

SEQ ID NO: 2896547 - RNA, 15 nt, Human
auggacacuccagug

SEQ ID NO: 2896548 - RNA, 17 nt, Human
auggacacuccagugcc

SEQ ID NO: 2896549 - RNA, 19 nt, Human
auggacacuccagugccag

SEQ ID NO: 2896550 - RNA, 14 nt, Human
auggacacuuuuca

SEQ ID NO: 2896551 - RNA, 16 nt, Human
auggacacuuuucacc

SEQ ID NO: 2896552 - RNA, 20 nt, Human
auggacaagagguacagggu

SEQ ID NO: 2896553 - RNA, 12 nt, Human
uuuccccuuccu

SEQ ID NO: 2896554 - RNA, 21 nt, Human
uuucaaaauccaaaaagaaau

SEQ ID NO: 2896555 - RNA, 19 nt, Human
uuucaaaauccaaaaagaa

SEQ ID NO: 2896556 - RNA, 12 nt, Human
uuucaaaaugcu

SEQ ID NO: 2896557 - RNA, 15 nt, Human
uuucaaaaugcuuuu

SEQ ID NO: 2896558 - RNA, 13 nt, Human
uuucaaaaugcuu

SEQ ID NO: 2896559 - RNA, 18 nt, Human
uuucaaaauccaaaaaga

SEQ ID NO: 2896560 - RNA, 17 nt, Human
uuucaaaauccaaaaag

SEQ ID NO: 2896561 - RNA, 11 nt, Human
uuucaaaauag

SEQ ID NO: 2896562 - RNA, 19 nt, Human
uuucaaaauagaaaaguua

SEQ ID NO: 2896563 - RNA, 20 nt, Human
uuucaaaauagaaaaguuau

SEQ ID NO: 2896564 - RNA, 21 nt, Human
uuucaaaauagaaaaguuauu

SEQ ID NO: 2896565 - RNA, 16 nt, Human
uuucaaacacaaaugc

SEQ ID NO: 2896566 - RNA, 17 nt, Human
uuucaaacacaaaugca

SEQ ID NO: 2896567 - RNA, 23 nt, Human
uuuauuuuuacaagaaguuuauu

SEQ ID NO: 2896568 - RNA, 15 nt, Human
uuuauuuuucauauu

SEQ ID NO: 2896569 - RNA, 12 nt, Human
uuucaaaagaca

SEQ ID NO: 2896570 - RNA, 13 nt, Human
uuucaaaagacau

SEQ ID NO: 2896571 - RNA, 18 nt, Human
uuucaaaagacauguugu

SEQ ID NO: 2896572 - RNA, 12 nt, Human
uuucaaaagcau

SEQ ID NO: 2896573 - RNA, 23 nt, Human
uuucaaaacacaucuuuccuguc

SEQ ID NO: 2896574 - RNA, 21 nt, Human
uuucaaaaauauaacuuaaaa

SEQ ID NO: 2896575 - RNA, 17 nt, Human
uuucaaaaauauaacuu

SEQ ID NO: 2896576 - RNA, 18 nt, Human
uuucaaaaauauaacuua

SEQ ID NO: 2896577 - RNA, 20 nt, Human
uuuauuuuucauauugugcc

SEQ ID NO: 2896578 - RNA, 16 nt, Human
uuucaaaaauauaacu

SEQ ID NO: 2896579 - RNA, 13 nt, Human
uuucaaaaacauu

SEQ ID NO: 2896580 - RNA, 16 nt, Human
uuuauuuuucauauug

SEQ ID NO: 2896581 - RNA, 17 nt, Human
uuuauuuuucauauugu

SEQ ID NO: 2896582 - RNA, 17 nt, Human
augcuucauucaauauu

SEQ ID NO: 2896583 - RNA, 20 nt, Human
augcuucauucaauauugac

SEQ ID NO: 2896584 - RNA, 21 nt, Human
augcuucauucaauauugaca

SEQ ID NO: 2896585 - RNA, 18 nt, Human
augcugugcuaaauauca

SEQ ID NO: 2896586 - RNA, 17 nt, Human
augcuggaaccugcaaa

SEQ ID NO: 2896587 - RNA, 18 nt, Human
augcuggaaccugcaaaa

SEQ ID NO: 2896588 - RNA, 15 nt, Human
augcugcuuuuauau

SEQ ID NO: 2896589 - RNA, 16 nt, Human
augcugcuuuuauauc

SEQ ID NO: 2896590 - RNA, 18 nt, Human
augcugcuuuuauaucug

SEQ ID NO: 2896591 - RNA, 19 nt, Human
augcugcuuuuauaucugu

SEQ ID NO: 2896592 - RNA, 20 nt, Human
augcugcuuuuauaucugua

SEQ ID NO: 2896593 - RNA, 21 nt, Human
augcugcuuuuauaucuguau

SEQ ID NO: 2896594 - RNA, 14 nt, Human
augcucccuccccu

SEQ ID NO: 2896595 - RNA, 21 nt, Human
augcuaggaugcggaaauccc

SEQ ID NO: 2896596 - RNA, 15 nt, Human
augcuaggucucgga

SEQ ID NO: 2896597 - RNA, 16 nt, Human
augcuagaagaaaaca

SEQ ID NO: 2896598 - RNA, 17 nt, Human
augcuagcgcguugccu

SEQ ID NO: 2896599 - RNA, 18 nt, Human
augcuagcgcguugccug

SEQ ID NO: 2896600 - RNA, 19 nt, Human
augcuagcgcguugccugu

SEQ ID NO: 2896601 - RNA, 16 nt, Human
uuuauuaauuuauaug

SEQ ID NO: 2896602 - RNA, 14 nt, Human
uuuauuaagauuau

SEQ ID NO: 2896603 - RNA, 23 nt, Human
uuuauuaagauuauuuuauuaug

SEQ ID NO: 2896604 - RNA, 23 nt, Human
uuuaucaugacauguuauauauu

SEQ ID NO: 2896605 - RNA, 18 nt, Human
augcuagguuaauuccaa

SEQ ID NO: 2896606 - RNA, 13 nt, Human
augcuaucucugu

SEQ ID NO: 2896607 - RNA, 13 nt, Human
augcuauuaaagu

SEQ ID NO: 2896608 - RNA, 15 nt, Human
augcuauugaaaaug

SEQ ID NO: 2896609 - RNA, 11 nt, Human
augcuauuuuu

SEQ ID NO: 2896610 - RNA, 18 nt, Human
augcuauuuuuguuuuua

SEQ ID NO: 2896611 - RNA, 22 nt, Human
augcuauuuuuguuuuuagaau

SEQ ID NO: 2896612 - RNA, 21 nt, Human
augcuccagcaacacagccug

SEQ ID NO: 2896613 - RNA, 18 nt, Human
augcuccaagauucuaga

SEQ ID NO: 2896614 - RNA, 19 nt, Human
augcuccaagauucuagau

SEQ ID NO: 2896615 - RNA, 15 nt, Human
augcuccaagauucu

SEQ ID NO: 2896616 - RNA, 16 nt, Human
augcuccaagauucua

SEQ ID NO: 2896617 - RNA, 17 nt, Human
augcuccaagauucuag

SEQ ID NO: 2896618 - RNA, 22 nt, Human
augcuccagcaacacagccugg

SEQ ID NO: 2896619 - RNA, 20 nt, Human
augcuccaagauucuagaug

SEQ ID NO: 2896620 - RNA, 17 nt, Human
uuuauauuuaauuauua

SEQ ID NO: 2896621 - RNA, 18 nt, Human
uuuauauuuaauuauuaa

SEQ ID NO: 2896622 - RNA, 21 nt, Human
uuuauauguguugaaaaccaa

SEQ ID NO: 2896623 - RNA, 16 nt, Human
uuuauauuaguugcuu

SEQ ID NO: 2896624 - RNA, 19 nt, Human
uuuauauuaguugcuuugu

SEQ ID NO: 2896625 - RNA, 20 nt, Human
uuuauauuaguugcuuuguu

SEQ ID NO: 2896626 - RNA, 21 nt, Human
uuuauauuaguugcuuuguua

SEQ ID NO: 2896627 - RNA, 12 nt, Human
uuuauauugaaa

SEQ ID NO: 2896628 - RNA, 14 nt, Human
uuuauauugaaaaa

SEQ ID NO: 2896629 - RNA, 14 nt, Human
uuuauauuuaguga

SEQ ID NO: 2896630 - RNA, 14 nt, Human
uuuauauuuaguua

SEQ ID NO: 2896631 - RNA, 14 nt, Human
uuuauauuuaucca

SEQ ID NO: 2896632 - RNA, 16 nt, Human
uuuauauuuauccacu

SEQ ID NO: 2896633 - RNA, 14 nt, Human
uuuauauuaaugua

SEQ ID NO: 2896634 - RNA, 16 nt, Human
uuuauauuaauguacu

SEQ ID NO: 2896635 - RNA, 21 nt, Human
augcuaagcaagcuaaccuua

SEQ ID NO: 2896636 - RNA, 16 nt, Human
augcuaagacucagug

SEQ ID NO: 2896637 - RNA, 22 nt, Human
uuuaucaaacagaauuuuaaag

SEQ ID NO: 2896638 - RNA, 14 nt, Human
uuuaucaaagcaua

SEQ ID NO: 2896639 - RNA, 22 nt, Human
uuuaucaaagcauagauguuuu

SEQ ID NO: 2896640 - RNA, 12 nt, Human
uuuauauuuuua

SEQ ID NO: 2896641 - RNA, 13 nt, Human
uuuauauuuuccc

SEQ ID NO: 2896642 - RNA, 14 nt, Human
uuuauauuuucccu

SEQ ID NO: 2896643 - RNA, 22 nt, Human
uuuaucacaaccaccguuacaa

SEQ ID NO: 2896644 - RNA, 15 nt, Human
uuuaucacacuucug

SEQ ID NO: 2896645 - RNA, 14 nt, Human
uuuaucaaaucagu

SEQ ID NO: 2896646 - RNA, 17 nt, Human
uuuaucaacucaagaau

SEQ ID NO: 2896647 - RNA, 18 nt, Human
uuuaucacacuucuguga

SEQ ID NO: 2896648 - RNA, 17 nt, Human
uuuaucacacuucugug

SEQ ID NO: 2896649 - RNA, 14 nt, Human
uuuaucaugacaug

SEQ ID NO: 2896650 - RNA, 15 nt, Human
uuuaucaugacaugu

SEQ ID NO: 2896651 - RNA, 14 nt, Human
auugcuuuuuuaaa

SEQ ID NO: 2896652 - RNA, 16 nt, Human
auugcuuuuuuaaaua

SEQ ID NO: 2896653 - RNA, 17 nt, Human
auugcuuuuuuaaauau

SEQ ID NO: 2896654 - RNA, 18 nt, Human
auuggaaugggcagcuca

SEQ ID NO: 2896655 - RNA, 15 nt, Human
auugcuuuuuuguau

SEQ ID NO: 2896656 - RNA, 18 nt, Human
auugcuuuuuuguauugg

SEQ ID NO: 2896657 - RNA, 12 nt, Human
auuggaaaaauc

SEQ ID NO: 2896658 - RNA, 13 nt, Human
auuggaaaaauca

SEQ ID NO: 2896659 - RNA, 14 nt, Human
auuggaaaaaucac

SEQ ID NO: 2896660 - RNA, 15 nt, Human
auuggaccaggccau

SEQ ID NO: 2896661 - RNA, 13 nt, Human
auuggaccaggcc

SEQ ID NO: 2896662 - RNA, 13 nt, Human
auuggacaguugu

SEQ ID NO: 2896663 - RNA, 21 nt, Human
auuggacaguugucuagagau

SEQ ID NO: 2896664 - RNA, 16 nt, Human
auuggacauagauauu

SEQ ID NO: 2896665 - RNA, 22 nt, Human
auuggacauagauauuuucaca

SEQ ID NO: 2896666 - RNA, 16 nt, Human
auuggauuauccugag

SEQ ID NO: 2896667 - RNA, 16 nt, Human
auuggauaaagcagcu

SEQ ID NO: 2896668 - RNA, 13 nt, Human
auuggauacagca

SEQ ID NO: 2896669 - RNA, 15 nt, Human
auuggauacagcagu

SEQ ID NO: 2896670 - RNA, 20 nt, Human
auuggauacagcaguagaca

SEQ ID NO: 2896671 - RNA, 23 nt, Human
auuggauacagcaguagacauuu

SEQ ID NO: 2896672 - RNA, 22 nt, Human
auuggagggugggagagcccag

SEQ ID NO: 2896673 - RNA, 15 nt, Human
auuggaggaaagcaa

SEQ ID NO: 2896674 - RNA, 23 nt, Human
auuggaggaaagcaaccggugga

SEQ ID NO: 2896675 - RNA, 23 nt, Human
auuggagggugggagagcccagc

SEQ ID NO: 2896676 - RNA, 22 nt, Human
auugauuccuuuuuucaaaauc

SEQ ID NO: 2896677 - RNA, 13 nt, Human
auugauuccuuuu

SEQ ID NO: 2896678 - RNA, 14 nt, Human
auugcuuuggucau

SEQ ID NO: 2896679 - RNA, 13 nt, Human
auugauuuccugu

SEQ ID NO: 2896680 - RNA, 15 nt, Human
auugauuuccugugu

SEQ ID NO: 2896681 - RNA, 16 nt, Human
auugauuuccuguguc

SEQ ID NO: 2896682 - RNA, 17 nt, Human
auugauuuccuguguca

SEQ ID NO: 2896683 - RNA, 18 nt, Human
auugcuuuggucauauga

SEQ ID NO: 2896684 - RNA, 16 nt, Human
auugcuuuuauuuuga

SEQ ID NO: 2896685 - RNA, 18 nt, Human
auugcuuuuauuuugaaa

SEQ ID NO: 2896686 - RNA, 19 nt, Human
auugcuuuuauuuugaaaa

SEQ ID NO: 2896687 - RNA, 19 nt, Human
auuggauuauuuaauaaca

SEQ ID NO: 2896688 - RNA, 20 nt, Human
auuggauuauuuaauaacau

SEQ ID NO: 2896689 - RNA, 22 nt, Human
auuggauuauuuaauaacauua

SEQ ID NO: 2896690 - RNA, 14 nt, Human
auuggauuauuuaa

SEQ ID NO: 2896691 - RNA, 16 nt, Human
auuggauuauuuaaua

SEQ ID NO: 2896692 - RNA, 17 nt, Human
auuggauuauuuaauaa

SEQ ID NO: 2896693 - RNA, 18 nt, Human
auuggauuauuuaauaac

SEQ ID NO: 2896694 - RNA, 13 nt, Human
auugguuaauuuu

SEQ ID NO: 2896695 - RNA, 15 nt, Human
auugguuaauuuuua

SEQ ID NO: 2896696 - RNA, 18 nt, Human
auugguauucacuaaucu

SEQ ID NO: 2896697 - RNA, 14 nt, Human
auuggguucaugau

SEQ ID NO: 2896698 - RNA, 18 nt, Human
auuggguucaugaugcag

SEQ ID NO: 2896699 - RNA, 19 nt, Human
auuggguucaugaugcagu

SEQ ID NO: 2896700 - RNA, 22 nt, Human
auuggguucaugaugcagucuc

SEQ ID NO: 2896701 - RNA, 23 nt, Human
auuggguucaugaugcagucucc

SEQ ID NO: 2896702 - RNA, 18 nt, Human
auugguaaagaauggaag

SEQ ID NO: 2896703 - RNA, 20 nt, Human
auugggaaggggacccccgc

SEQ ID NO: 2896704 - RNA, 18 nt, Human
auugggagcuugggaaug

SEQ ID NO: 2896705 - RNA, 21 nt, Human
auuuaaagacagggaagagca

SEQ ID NO: 2896706 - RNA, 13 nt, Human
auuuaaagauauu

SEQ ID NO: 2896707 - RNA, 19 nt, Human
auuuaaagauauuguucaa

SEQ ID NO: 2896708 - RNA, 18 nt, Human
auuguccucauuucucca

SEQ ID NO: 2896709 - RNA, 22 nt, Human
auugucgaaaagagucuuccaa

SEQ ID NO: 2896710 - RNA, 15 nt, Human
auugucgcuauugau

SEQ ID NO: 2896711 - RNA, 21 nt, Human
auugucauaucagcacauauu

SEQ ID NO: 2896712 - RNA, 15 nt, Human
auugucaucaggaga

SEQ ID NO: 2896713 - RNA, 21 nt, Human
auugugggacuuauuacaauu

SEQ ID NO: 2896714 - RNA, 16 nt, Human
auugugggcauaaacu

SEQ ID NO: 2896715 - RNA, 19 nt, Human
auugugggcauaaacuguu

SEQ ID NO: 2896716 - RNA, 18 nt, Human
auugugggggaaaaauaa

SEQ ID NO: 2896717 - RNA, 12 nt, Human
auugucuauuua

SEQ ID NO: 2896718 - RNA, 13 nt, Human
auugucuauuuau

SEQ ID NO: 2896719 - RNA, 14 nt, Human
auugucuauuuauc

SEQ ID NO: 2896720 - RNA, 23 nt, Human
auuguaaaaaaaaaugccuuuga

SEQ ID NO: 2896721 - RNA, 21 nt, Human
auuguaaaaaaaaaugccuuu

SEQ ID NO: 2896722 - RNA, 22 nt, Human
auuguaaaaaaaaaugccuuug

SEQ ID NO: 2896723 - RNA, 17 nt, Human
auuguaaaaaaaaaugc

SEQ ID NO: 2896724 - RNA, 20 nt, Human
auuguaaaaaaaaaugccuu

SEQ ID NO: 2896725 - RNA, 12 nt, Human
auuguacauaaa

SEQ ID NO: 2896726 - RNA, 15 nt, Human
auuguacauaaaaga

SEQ ID NO: 2896727 - RNA, 15 nt, Human
auuguacauauuugu

SEQ ID NO: 2896728 - RNA, 20 nt, Human
auuguacauauuuguggaau

SEQ ID NO: 2896729 - RNA, 21 nt, Human
auuguuuggggaugagaaagg

SEQ ID NO: 2896730 - RNA, 14 nt, Human
auuguuuuaaaaag

SEQ ID NO: 2896731 - RNA, 23 nt, Human
auuguuuuaaaaagaaacaagau

SEQ ID NO: 2896732 - RNA, 13 nt, Human
auuguuuuaaucu

SEQ ID NO: 2896733 - RNA, 17 nt, Human
auuguuuuaaucugaaa

SEQ ID NO: 2896734 - RNA, 18 nt, Human
auuguuuuaaucugaaau

SEQ ID NO: 2896735 - RNA, 20 nt, Human
auuguuuuaaucugaaauuc

SEQ ID NO: 2896736 - RNA, 22 nt, Human
auuguuuuaaaaagaaacaaga

SEQ ID NO: 2896737 - RNA, 13 nt, Human
auuuaaaagauuc

SEQ ID NO: 2896738 - RNA, 16 nt, Human
auuuaaacuaucuugu

SEQ ID NO: 2896739 - RNA, 17 nt, Human
auuuaaacuaucuugug

SEQ ID NO: 2896740 - RNA, 18 nt, Human
auuuaaacucaagacaau

SEQ ID NO: 2896741 - RNA, 17 nt, Human
auuuaaacauuaaaaau

SEQ ID NO: 2896742 - RNA, 13 nt, Human
auuuauuuaaaag

SEQ ID NO: 2896743 - RNA, 16 nt, Human
auuucauuuuuugcau

SEQ ID NO: 2896744 - RNA, 22 nt, Human
auuucauuuuuugcaucaguau

SEQ ID NO: 2896745 - RNA, 13 nt, Human
auuuccaaauaaa

SEQ ID NO: 2896746 - RNA, 15 nt, Human
auuuccaaauaaaau

SEQ ID NO: 2896747 - RNA, 22 nt, Human
auuuauuuuaaaaaaugaaaau

SEQ ID NO: 2896748 - RNA, 14 nt, Human
auuuauuuuaagca

SEQ ID NO: 2896749 - RNA, 12 nt, Human
auuuauuuaaua

SEQ ID NO: 2896750 - RNA, 14 nt, Human
auuuauuuaaagca

SEQ ID NO: 2896751 - RNA, 15 nt, Human
auuuauuuaaagcau

SEQ ID NO: 2896752 - RNA, 20 nt, Human
auuuauuuaaagcauugcuu

SEQ ID NO: 2896753 - RNA, 20 nt, Human
auuuauuuaaaagauucauu

SEQ ID NO: 2896754 - RNA, 14 nt, Human
auuuauuuaaaaga

SEQ ID NO: 2896755 - RNA, 16 nt, Human
auuuauuuaaaagauu

SEQ ID NO: 2896756 - RNA, 16 nt, Human
auuuauuuaauaacaa

SEQ ID NO: 2896757 - RNA, 13 nt, Human
auuuauuuaauaa

SEQ ID NO: 2896758 - RNA, 20 nt, Human
auuuauuuaauaacaauugu

SEQ ID NO: 2896759 - RNA, 14 nt, Human
auuuauuuauuuau

SEQ ID NO: 2896760 - RNA, 19 nt, Human
auuuccaaguaauauaaug

SEQ ID NO: 2896761 - RNA, 23 nt, Human
auuuccaacaccacagacacaca

SEQ ID NO: 2896762 - RNA, 21 nt, Human
auuuccaacaccacagacaca

SEQ ID NO: 2896763 - RNA, 22 nt, Human
auuuccaacaccacagacacac

SEQ ID NO: 2896764 - RNA, 19 nt, Human
auuuccaacaccacagaca

SEQ ID NO: 2896765 - RNA, 20 nt, Human
auuuccaacaccacagacac

SEQ ID NO: 2896766 - RNA, 17 nt, Human
auuuccaaauaaaauga

SEQ ID NO: 2896767 - RNA, 18 nt, Human
auuuccaaauaaaaugag

SEQ ID NO: 2896768 - RNA, 11 nt, Human
auuugaccucc

SEQ ID NO: 2896769 - RNA, 21 nt, Human
auuugaccuccucccuguuau

SEQ ID NO: 2896770 - RNA, 22 nt, Human
auuugaccuccucccuguuauu

SEQ ID NO: 2896771 - RNA, 22 nt, Human
auuucuucuccuggaguugcau

SEQ ID NO: 2896772 - RNA, 17 nt, Human
auuucuucguucuuuuu

SEQ ID NO: 2896773 - RNA, 19 nt, Human
auuucuucguucuuuuuaa

SEQ ID NO: 2896774 - RNA, 18 nt, Human
auuucccuaaaauacauu

SEQ ID NO: 2896775 - RNA, 20 nt, Human
auuucccuaaaauacauuua

SEQ ID NO: 2896776 - RNA, 21 nt, Human
auuucccuaaaauacauuuaa

SEQ ID NO: 2896777 - RNA, 20 nt, Human
auuucuaguccaaaauuaca

SEQ ID NO: 2896778 - RNA, 21 nt, Human
auuucuaguccaaaauuacaa

SEQ ID NO: 2896779 - RNA, 22 nt, Human
auuucuagggcugggaaacacu

SEQ ID NO: 2896780 - RNA, 16 nt, Human
auuuguaaggcuuguu

SEQ ID NO: 2896781 - RNA, 18 nt, Human
auuuguaaguuucaggug

SEQ ID NO: 2896782 - RNA, 16 nt, Human
auuuguauuuugugug

SEQ ID NO: 2896783 - RNA, 17 nt, Human
auuuguauuuuguguga

SEQ ID NO: 2896784 - RNA, 18 nt, Human
auuuguauuuugugugac

SEQ ID NO: 2896785 - RNA, 23 nt, Human
auuuguauuuugugugaccaacu

SEQ ID NO: 2896786 - RNA, 14 nt, Human
auuuguaaguuuca

SEQ ID NO: 2896787 - RNA, 15 nt, Human
auuuguaaguuucag

SEQ ID NO: 2896788 - RNA, 17 nt, Human
auuuguaaguuucaggu

SEQ ID NO: 2896789 - RNA, 13 nt, Human
auuuguaaaugcu

SEQ ID NO: 2896790 - RNA, 17 nt, Human
auuugggagggaaaagg

SEQ ID NO: 2896791 - RNA, 21 nt, Human
auuugggagggaaaagggaag

SEQ ID NO: 2896792 - RNA, 13 nt, Human
auuugacuauucu

SEQ ID NO: 2896793 - RNA, 17 nt, Human
auuugacuauucuguau

SEQ ID NO: 2896794 - RNA, 14 nt, Human
auuugacugaagau

SEQ ID NO: 2896795 - RNA, 18 nt, Human
auuugacuugcaugaaga

SEQ ID NO: 2896796 - RNA, 19 nt, Human
auuugacuugcaugaagag

SEQ ID NO: 2896797 - RNA, 21 nt, Human
auuugacuugcaugaagagaa

SEQ ID NO: 2896798 - RNA, 13 nt, Human
auuugacuugugg

SEQ ID NO: 2896799 - RNA, 15 nt, Human
auuugacuugugguu

SEQ ID NO: 2896800 - RNA, 16 nt, Human
auuugacuugugguug

SEQ ID NO: 2896801 - RNA, 18 nt, Human
auuugacuuuaauuuaug

SEQ ID NO: 2896802 - RNA, 14 nt, Human
auuuggcuuaaaua

SEQ ID NO: 2896803 - RNA, 15 nt, Human
auuuggcuuaaauau

SEQ ID NO: 2896804 - RNA, 16 nt, Human
auuuggcuuaaauaua

SEQ ID NO: 2896805 - RNA, 17 nt, Human
auuuggcuuaaauauag

SEQ ID NO: 2896806 - RNA, 19 nt, Human
auuuggccugcacuaauuu

SEQ ID NO: 2896807 - RNA, 16 nt, Human
auuuggccugcacuaa

SEQ ID NO: 2896808 - RNA, 18 nt, Human
auuugggaagugaagacu

SEQ ID NO: 2896809 - RNA, 16 nt, Human
auuugggacccugcuu

SEQ ID NO: 2896810 - RNA, 22 nt, Human
auuugggacccugcuuuagagc

SEQ ID NO: 2896811 - RNA, 14 nt, Human
auuugggaagugaa

SEQ ID NO: 2896812 - RNA, 19 nt, Human
auuugggaaacuugucacu

SEQ ID NO: 2896813 - RNA, 23 nt, Human
auuugggaagguuuguguuuucu

SEQ ID NO: 2896814 - RNA, 13 nt, Human
auuuuaacaagaa

SEQ ID NO: 2896815 - RNA, 14 nt, Human
auuuuaacaagaag

SEQ ID NO: 2896816 - RNA, 17 nt, Human
auuuuaacaagaagaug

SEQ ID NO: 2896817 - RNA, 18 nt, Human
auuuuaacaagaagauga

SEQ ID NO: 2896818 - RNA, 19 nt, Human
auuuuaacaagaagaugaa

SEQ ID NO: 2896819 - RNA, 20 nt, Human
auuuuaacaagaagaugaau

SEQ ID NO: 2896820 - RNA, 21 nt, Human
auuuuaacaagaagaugaaug

SEQ ID NO: 2896821 - RNA, 22 nt, Human
auuuuaacaagaagaugaaugg

SEQ ID NO: 2896822 - RNA, 13 nt, Human
auuuuaaaaaugg

SEQ ID NO: 2896823 - RNA, 15 nt, Human
auuuuaaaaauggug

SEQ ID NO: 2896824 - RNA, 16 nt, Human
auuuuaaaaauggugg

SEQ ID NO: 2896825 - RNA, 19 nt, Human
auuuuaaaagccacauaga

SEQ ID NO: 2896826 - RNA, 14 nt, Human
auuuuaaaaauaca

SEQ ID NO: 2896827 - RNA, 15 nt, Human
auuuuaaaaauacau

SEQ ID NO: 2896828 - RNA, 17 nt, Human
auuuuaaaaauacauau

SEQ ID NO: 2896829 - RNA, 18 nt, Human
auuuuaaaaauacauauc

SEQ ID NO: 2896830 - RNA, 22 nt, Human
auuuuaaaaauacauaucgcug

SEQ ID NO: 2896831 - RNA, 23 nt, Human
auuugugaaaugauggugaaagu

SEQ ID NO: 2896832 - RNA, 15 nt, Human
auuugucuugccuua

SEQ ID NO: 2896833 - RNA, 15 nt, Human
auuugucuuucagga

SEQ ID NO: 2896834 - RNA, 17 nt, Human
auuuuccccuaucauuu

SEQ ID NO: 2896835 - RNA, 15 nt, Human
auuuuccccccacuc

SEQ ID NO: 2896836 - RNA, 14 nt, Human
auuuuccccccacu

SEQ ID NO: 2896837 - RNA, 21 nt, Human
auuuuccccccacucucccca

SEQ ID NO: 2896838 - RNA, 20 nt, Human
auuuuccccccacucucccc

SEQ ID NO: 2896839 - RNA, 22 nt, Human
auuuuccccccacucuccccac

SEQ ID NO: 2896840 - RNA, 19 nt, Human
auuuuaagacguguuugug

SEQ ID NO: 2896841 - RNA, 20 nt, Human
auuuugauuuuuuuuuuaaa

SEQ ID NO: 2896842 - RNA, 18 nt, Human
auuuugaugugacaauaa

SEQ ID NO: 2896843 - RNA, 19 nt, Human
auuuugaugugacaauaau

SEQ ID NO: 2896844 - RNA, 21 nt, Human
auuuugaugugacaauaauau

SEQ ID NO: 2896845 - RNA, 19 nt, Human
auuuugauccaagcugguc

SEQ ID NO: 2896846 - RNA, 19 nt, Human
auuuucuagacuuucuguu

SEQ ID NO: 2896847 - RNA, 12 nt, Human
auuuugaugcag

SEQ ID NO: 2896848 - RNA, 16 nt, Human
auuuugaugcagcauu

SEQ ID NO: 2896849 - RNA, 17 nt, Human
auuuugaugcagcauuu

SEQ ID NO: 2896850 - RNA, 20 nt, Human
auuuugaugcagcauuugau

SEQ ID NO: 2896851 - RNA, 21 nt, Human
auuuugaugcagcauuugaua

SEQ ID NO: 2896852 - RNA, 22 nt, Human
auuuugaugcagcauuugauaa

SEQ ID NO: 2896853 - RNA, 23 nt, Human
auuuugaugcagcauuugauaau

SEQ ID NO: 2896854 - RNA, 24 nt, Human
auuuugaugcagcauuugauaaug

SEQ ID NO: 2896855 - RNA, 19 nt, Human
auuuuaaaauaaauuaguu

SEQ ID NO: 2896856 - RNA, 13 nt, Human
auuuuccugcuuc

SEQ ID NO: 2896857 - RNA, 17 nt, Human
auuuucuauaacagaua

SEQ ID NO: 2896858 - RNA, 19 nt, Human
auuuugcuggaauuccuaa

SEQ ID NO: 2896859 - RNA, 18 nt, Human
auuuugccucuuuucucu

SEQ ID NO: 2896860 - RNA, 16 nt, Human
auuuugccauuuagcg

SEQ ID NO: 2896861 - RNA, 21 nt, Human
auuuugccucuuuucucugug

SEQ ID NO: 2896862 - RNA, 13 nt, Human
auuuugccugugu

SEQ ID NO: 2896863 - RNA, 13 nt, Human
auuuugcaaauau

SEQ ID NO: 2896864 - RNA, 14 nt, Human
auuuugcaaauaua

SEQ ID NO: 2896865 - RNA, 19 nt, Human
auuuugcaaauauaaacau

SEQ ID NO: 2896866 - RNA, 18 nt, Human
auuuugcacccacugaaa

SEQ ID NO: 2896867 - RNA, 16 nt, Human
auuuugcauuugaaua

SEQ ID NO: 2896868 - RNA, 18 nt, Human
auuuugccagugggaacu

SEQ ID NO: 2896869 - RNA, 17 nt, Human
auuuuguuuaaaaaauc

SEQ ID NO: 2896870 - RNA, 13 nt, Human
auuuuguuguaaa

SEQ ID NO: 2896871 - RNA, 14 nt, Human
auuuuguuguaaaa

SEQ ID NO: 2896872 - RNA, 17 nt, Human
auuuuguuguaaaaaga

SEQ ID NO: 2896873 - RNA, 18 nt, Human
auuuuguuguaaaaagaa

SEQ ID NO: 2896874 - RNA, 19 nt, Human
auuuuguuguaaaaagaaa

SEQ ID NO: 2896875 - RNA, 23 nt, Human
auuuuguugcuguuuugauuugu

SEQ ID NO: 2896876 - RNA, 19 nt, Human
auuuuguugcuguuuugau

SEQ ID NO: 2896877 - RNA, 14 nt, Human
auuuuguucuuaca

SEQ ID NO: 2896878 - RNA, 16 nt, Human
auuuuguucuuacaca

SEQ ID NO: 2896879 - RNA, 17 nt, Human
auuuuguucuuacacau

SEQ ID NO: 2896880 - RNA, 18 nt, Human
auuuuguucuuacacaua

SEQ ID NO: 2896881 - RNA, 20 nt, Human
auuuugucaccagaacacaa

SEQ ID NO: 2896882 - RNA, 20 nt, Human
auuuugucugcuuaguaucu

SEQ ID NO: 2896883 - RNA, 12 nt, Human
auuuugugaaug

SEQ ID NO: 2896884 - RNA, 13 nt, Human
auuuugugaaugg

SEQ ID NO: 2896885 - RNA, 15 nt, Human
auuuugugaauggau

SEQ ID NO: 2896886 - RNA, 12 nt, Human
auuuugugaagc

SEQ ID NO: 2896887 - RNA, 18 nt, Human
auuuugugaagcccuguu

SEQ ID NO: 2896888 - RNA, 16 nt, Human
auuuugugcucauuua

SEQ ID NO: 2896889 - RNA, 20 nt, Human
auuuugugcucauuuaaguu

SEQ ID NO: 2896890 - RNA, 21 nt, Human
auuuuguggaggcagugucau

SEQ ID NO: 2896891 - RNA, 23 nt, Human
auuuuguggaggcagugucauuu

SEQ ID NO: 2896892 - RNA, 20 nt, Human
auuuugugggaauuuaagag

SEQ ID NO: 2896893 - RNA, 21 nt, Human
auuuugugggaauuuaagagc

SEQ ID NO: 2896894 - RNA, 13 nt, Human
auuuugugugacc

SEQ ID NO: 2896895 - RNA, 14 nt, Human
auuuugugugacca

SEQ ID NO: 2896896 - RNA, 15 nt, Human
auuuugugugaccaa

SEQ ID NO: 2896897 - RNA, 17 nt, Human
auuuugugugaccaacu

SEQ ID NO: 2896898 - RNA, 18 nt, Human
auuuugugugaccaacug

SEQ ID NO: 2896899 - RNA, 20 nt, Human
auuuugugugaccaacugug

SEQ ID NO: 2896900 - RNA, 22 nt, Human
auuuugugugaccaacuguguu

SEQ ID NO: 2896901 - RNA, 23 nt, Human
auuuugugugaccaacuguguug

SEQ ID NO: 2896902 - RNA, 19 nt, Human
auuuuggaaaguuuuugua

SEQ ID NO: 2896903 - RNA, 17 nt, Human
auuuuggaagauuuuca

SEQ ID NO: 2896904 - RNA, 20 nt, Human
auuuuggaagauuuucaguc

SEQ ID NO: 2896905 - RNA, 16 nt, Human
auuuuguauuauugcu

SEQ ID NO: 2896906 - RNA, 17 nt, Human
auuuuguauuauugcug

SEQ ID NO: 2896907 - RNA, 19 nt, Human
auuuuguauuauugcuguu

SEQ ID NO: 2896908 - RNA, 22 nt, Human
auuuuguauuauugcuguugcu

SEQ ID NO: 2896909 - RNA, 23 nt, Human
auuuuguauuauugcuguugcuu

SEQ ID NO: 2896910 - RNA, 14 nt, Human
auuuuguauugugg

SEQ ID NO: 2896911 - RNA, 15 nt, Human
auuuuguauuguggu

SEQ ID NO: 2896912 - RNA, 17 nt, Human
auuuuguauugugguau

SEQ ID NO: 2896913 - RNA, 14 nt, Human
auuuuguauauauc

SEQ ID NO: 2896914 - RNA, 19 nt, Human
auuuuguaacgaagacaca

SEQ ID NO: 2896915 - RNA, 18 nt, Human
auuuuguaacgaagacac

SEQ ID NO: 2896916 - RNA, 20 nt, Human
auuuuguaaacucaaaauau

SEQ ID NO: 2896917 - RNA, 23 nt, Human
auuuuguaaauaauaaaauagua

SEQ ID NO: 2896918 - RNA, 19 nt, Human
auuuuguaaacucaaaaua

SEQ ID NO: 2896919 - RNA, 15 nt, Human
auuuuguaauuauga

SEQ ID NO: 2896920 - RNA, 12 nt, Human
auuuuguaauga

SEQ ID NO: 2896921 - RNA, 16 nt, Human
auuuuguaaugaauuc

SEQ ID NO: 2896922 - RNA, 17 nt, Human
auuuuugaaaaaaguac

SEQ ID NO: 2896923 - RNA, 15 nt, Human
auuuuucuuccagga

SEQ ID NO: 2896924 - RNA, 13 nt, Human
auuuuucugcaga

SEQ ID NO: 2896925 - RNA, 15 nt, Human
auuuuugacaguguu

SEQ ID NO: 2896926 - RNA, 21 nt, Human
auuuuugauaaagccucaagg

SEQ ID NO: 2896927 - RNA, 23 nt, Human
auuuuugauuuaugcauggaaac

SEQ ID NO: 2896928 - RNA, 13 nt, Human
auuuuugauuuau

SEQ ID NO: 2896929 - RNA, 19 nt, Human
auuuuugcaauaccaagua

SEQ ID NO: 2896930 - RNA, 22 nt, Human
auuuuugcccugaguccaagag

SEQ ID NO: 2896931 - RNA, 15 nt, Human
auuuuugccauacau

SEQ ID NO: 2896932 - RNA, 18 nt, Human
auuuuugccauacaucag

SEQ ID NO: 2896933 - RNA, 14 nt, Human
auuuuugccuucau

SEQ ID NO: 2896934 - RNA, 15 nt, Human
auuuuugccuucauu

SEQ ID NO: 2896935 - RNA, 12 nt, Human
auuuuuguaaau

SEQ ID NO: 2896936 - RNA, 19 nt, Human
auuuuuguaaacuggaauu

SEQ ID NO: 2896937 - RNA, 16 nt, Human
auuuuugcuugacuuc

SEQ ID NO: 2896938 - RNA, 20 nt, Human
auuuuguuuuauuuugaaug

SEQ ID NO: 2896939 - RNA, 16 nt, Human
auuuuguuucuuuuaa

SEQ ID NO: 2896940 - RNA, 20 nt, Human
auuuuguuucuuuuaaagca

SEQ ID NO: 2896941 - RNA, 15 nt, Human
auuuuucaaggaagg

SEQ ID NO: 2896942 - RNA, 20 nt, Human
auuuuucaacaaauaucuug

SEQ ID NO: 2896943 - RNA, 21 nt, Human
auuuuucaacaaauaucuugu

SEQ ID NO: 2896944 - RNA, 22 nt, Human
auuuuucaaccccacccuguuu

SEQ ID NO: 2896945 - RNA, 23 nt, Human
auuuuucaaccccacccuguuug

SEQ ID NO: 2896946 - RNA, 19 nt, Human
auuuuuauuuuuuagugca

SEQ ID NO: 2896947 - RNA, 17 nt, Human
auuuuucaauaauaaaa

SEQ ID NO: 2896948 - RNA, 17 nt, Human
auuuuuccguuugcuuu

SEQ ID NO: 2896949 - RNA, 22 nt, Human
auuuuucggaggccccacugau

SEQ ID NO: 2896950 - RNA, 23 nt, Human
auuuuucggaggccccacugaug

SEQ ID NO: 2896951 - RNA, 21 nt, Human
auuuuucucaaaguuuugaaa

SEQ ID NO: 2896952 - RNA, 19 nt, Human
auuuuucucaguuuguaua

SEQ ID NO: 2896953 - RNA, 16 nt, Human
auuuuucuaaacguaa

SEQ ID NO: 2896954 - RNA, 17 nt, Human
auuuuucuaaccuugaa

SEQ ID NO: 2896955 - RNA, 18 nt, Human
auuuuucuaaccuugaau

SEQ ID NO: 2896956 - RNA, 17 nt, Human
auuuuucucaaaguuuu

SEQ ID NO: 2896957 - RNA, 19 nt, Human
auuuuucauauugugccaa

SEQ ID NO: 2896958 - RNA, 15 nt, Human
auuuuuccaaaauaa

SEQ ID NO: 2896959 - RNA, 13 nt, Human
auuuuucauauug

SEQ ID NO: 2896960 - RNA, 18 nt, Human
auuuuucauauugugcca

SEQ ID NO: 2896961 - RNA, 18 nt, Human
auuuuucagcucucugua

SEQ ID NO: 2896962 - RNA, 20 nt, Human
auuuuucagcucucuguaua

SEQ ID NO: 2896963 - RNA, 15 nt, Human
auuuuucaguuccaa

SEQ ID NO: 2896964 - RNA, 16 nt, Human
auuuuucaguuccaag

SEQ ID NO: 2896965 - RNA, 18 nt, Human
auuuuucaguuccaagaa

SEQ ID NO: 2896966 - RNA, 22 nt, Human
auuuuucaguuccaagaaagau

SEQ ID NO: 2896967 - RNA, 16 nt, Human
auuuuugucucagaag

SEQ ID NO: 2896968 - RNA, 23 nt, Human
auuuuugucuuauauauauuucu

SEQ ID NO: 2896969 - RNA, 21 nt, Human
auuuuuguaucuacaucuuuu

SEQ ID NO: 2896970 - RNA, 13 nt, Human
auuuuuguaucua

SEQ ID NO: 2896971 - RNA, 15 nt, Human
auuuuuguaguagcg

SEQ ID NO: 2896972 - RNA, 12 nt, Human
auuuuuguaauu

SEQ ID NO: 2896973 - RNA, 19 nt, Human
auuuuuguagagccagggu

SEQ ID NO: 2896974 - RNA, 12 nt, Human
auuuuuuaaagu

SEQ ID NO: 2896975 - RNA, 22 nt, Human
auuuuuuaaaacaagccaagaa

SEQ ID NO: 2896976 - RNA, 23 nt, Human
auuuuuuaaaacaagccaagaaa

SEQ ID NO: 2896977 - RNA, 14 nt, Human
auuuuuuaaaagaa

SEQ ID NO: 2896978 - RNA, 17 nt, Human
auuuuuuaaaagaaauu

SEQ ID NO: 2896979 - RNA, 15 nt, Human
auuuuuuaaaagaga

SEQ ID NO: 2896980 - RNA, 21 nt, Human
auuuuuuaaaagagacaaacu

SEQ ID NO: 2896981 - RNA, 18 nt, Human
auuuuuuaaauugaauuc

SEQ ID NO: 2896982 - RNA, 11 nt, Human
auuuuuuaagu

SEQ ID NO: 2896983 - RNA, 16 nt, Human
auuuuuuaaggaaaca

SEQ ID NO: 2896984 - RNA, 17 nt, Human
auuuuuuaaggaaacaa

SEQ ID NO: 2896985 - RNA, 23 nt, Human
auuuuuuguaaugugugaaaaag

SEQ ID NO: 2896986 - RNA, 22 nt, Human
auuuuuugggcagcaauuuaaa

SEQ ID NO: 2896987 - RNA, 17 nt, Human
auuuuuugguacaaaaa

SEQ ID NO: 2896988 - RNA, 18 nt, Human
auuuuuugcaucaguauu

SEQ ID NO: 2896989 - RNA, 14 nt, Human
auuuuuucuugcau

SEQ ID NO: 2896990 - RNA, 17 nt, Human
auuuuuucuugcauuga

SEQ ID NO: 2896991 - RNA, 20 nt, Human
auuuuuucagacuugucaag

SEQ ID NO: 2896992 - RNA, 14 nt, Human
auuuuuucaguugu

SEQ ID NO: 2896993 - RNA, 13 nt, Human
auuuuuucauuuc

SEQ ID NO: 2896994 - RNA, 14 nt, Human
auuuuuucauuuca

SEQ ID NO: 2896995 - RNA, 21 nt, Human
auuuuuucauuucaaaaugcu

SEQ ID NO: 2896996 - RNA, 12 nt, Human
auuuuuuauugu

SEQ ID NO: 2896997 - RNA, 13 nt, Human
auuuuuuauuguu

SEQ ID NO: 2896998 - RNA, 13 nt, Human
auuuuuuauugcu

SEQ ID NO: 2896999 - RNA, 14 nt, Human
auuuuuuauugcua

SEQ ID NO: 2897000 - RNA, 18 nt, Human
auuuuuuauauauacagu

SEQ ID NO: 2897001 - RNA, 22 nt, Human
auuuuuuaugggcauugacaaa

SEQ ID NO: 2897002 - RNA, 19 nt, Human
auuuuuuaauuuaaagcuu

SEQ ID NO: 2897003 - RNA, 13 nt, Human
auuuuuuauauau

SEQ ID NO: 2897004 - RNA, 19 nt, Human
auuuuuuacagcugccugc

SEQ ID NO: 2897005 - RNA, 19 nt, Human
auuuuuuaaguauuuauau

SEQ ID NO: 2897006 - RNA, 18 nt, Human
auuuuuuaaguauuuaua

SEQ ID NO: 2897007 - RNA, 17 nt, Human
auuuuuuaaguauuuau

SEQ ID NO: 2897008 - RNA, 16 nt, Human
auuuuuuaaguauuua

SEQ ID NO: 2897009 - RNA, 22 nt, Human
auuuuuuaaguauuuauauauu

SEQ ID NO: 2897010 - RNA, 20 nt, Human
auuuuuuaaguauuuauaua

SEQ ID NO: 2897011 - RNA, 20 nt, Human
auugacaauaauuucagguu

SEQ ID NO: 2897012 - RNA, 18 nt, Human
auugacaauaauuucagg

SEQ ID NO: 2897013 - RNA, 14 nt, Human
auugacacagaaaa

SEQ ID NO: 2897014 - RNA, 12 nt, Human
auugacacagaa

SEQ ID NO: 2897015 - RNA, 17 nt, Human
auugacaauaauuucag

SEQ ID NO: 2897016 - RNA, 15 nt, Human
auugacaagaacuga

SEQ ID NO: 2897017 - RNA, 14 nt, Human
auugaagaaacaga

SEQ ID NO: 2897018 - RNA, 15 nt, Human
auugaagaaacagau

SEQ ID NO: 2897019 - RNA, 17 nt, Human
auugaagaaacagauac

SEQ ID NO: 2897020 - RNA, 13 nt, Human
auugaagaagaau

SEQ ID NO: 2897021 - RNA, 13 nt, Human
auugaagacaauu

SEQ ID NO: 2897022 - RNA, 14 nt, Human
auugaagacaauuu

SEQ ID NO: 2897023 - RNA, 19 nt, Human
auugaagacaauuugauac

SEQ ID NO: 2897024 - RNA, 20 nt, Human
auugaagacaauuugauaca

SEQ ID NO: 2897025 - RNA, 22 nt, Human
auugaagacaauuugauacaua

SEQ ID NO: 2897026 - RNA, 19 nt, Human
auugaagagagauauaucu

SEQ ID NO: 2897027 - RNA, 21 nt, Human
auugaagagagauauaucuga

SEQ ID NO: 2897028 - RNA, 23 nt, Human
auugaagagagauauaucugaaa

SEQ ID NO: 2897029 - RNA, 13 nt, Human
auugacaaaucug

SEQ ID NO: 2897030 - RNA, 15 nt, Human
auugacaaaucugug

SEQ ID NO: 2897031 - RNA, 16 nt, Human
auugacaaaucugugu

SEQ ID NO: 2897032 - RNA, 17 nt, Human
auugacaaaucugugua

SEQ ID NO: 2897033 - RNA, 18 nt, Human
auugacaaaucuguguau

SEQ ID NO: 2897034 - RNA, 20 nt, Human
auugacaaaucuguguauau

SEQ ID NO: 2897035 - RNA, 21 nt, Human
auugacaaaucuguguauauu

SEQ ID NO: 2897036 - RNA, 22 nt, Human
auugacaaaucuguguauauua

SEQ ID NO: 2897037 - RNA, 16 nt, Human
auugacgauuccuucu

SEQ ID NO: 2897038 - RNA, 20 nt, Human
auugacgauuccuucucuga

SEQ ID NO: 2897039 - RNA, 15 nt, Human
auugacgguuuuuua

SEQ ID NO: 2897040 - RNA, 21 nt, Human
auugacgguuuuuuauuauug

SEQ ID NO: 2897041 - RNA, 22 nt, Human
auugacgguuuuuuauuauugu

SEQ ID NO: 2897042 - RNA, 12 nt, Human
auugaccugcuc

SEQ ID NO: 2897043 - RNA, 17 nt, Human
auugaccugcuccgcug

SEQ ID NO: 2897044 - RNA, 21 nt, Human
auugaccugcuccgcugcucc

SEQ ID NO: 2897045 - RNA, 17 nt, Human
auugacacagaaaaugu

SEQ ID NO: 2897046 - RNA, 22 nt, Human
auugacucaaaucuccaguauu

SEQ ID NO: 2897047 - RNA, 19 nt, Human
auugacacauccgccuuuu

SEQ ID NO: 2897048 - RNA, 22 nt, Human
auugacuauuuucguucauuac

SEQ ID NO: 2897049 - RNA, 21 nt, Human
auugacugguuuacaggcccu

SEQ ID NO: 2897050 - RNA, 22 nt, Human
auugacugguuuacaggcccug

SEQ ID NO: 2897051 - RNA, 11 nt, Human
auugacuucuu

SEQ ID NO: 2897052 - RNA, 21 nt, Human
auugacuuuagaaagcugaca

SEQ ID NO: 2897053 - RNA, 15 nt, Human
auugacuuucaguaa

SEQ ID NO: 2897054 - RNA, 19 nt, Human
auugacuuucaguaaacau

SEQ ID NO: 2897055 - RNA, 14 nt, Human
auugacuucaauga

SEQ ID NO: 2897056 - RNA, 18 nt, Human
auugacuucaaugauagu

SEQ ID NO: 2897057 - RNA, 17 nt, Human
auucuguagauucugug

SEQ ID NO: 2897058 - RNA, 13 nt, Human
auucuguuggaag

SEQ ID NO: 2897059 - RNA, 15 nt, Human
auucuuaaccaugga

SEQ ID NO: 2897060 - RNA, 22 nt, Human
auucuuaagggaacuuccacau

SEQ ID NO: 2897061 - RNA, 15 nt, Human
auucuuacacugccu

SEQ ID NO: 2897062 - RNA, 22 nt, Human
auucuuccaagcugagagucua

SEQ ID NO: 2897063 - RNA, 18 nt, Human
auucuuccagaugugaug

SEQ ID NO: 2897064 - RNA, 19 nt, Human
auucuuccuaguuuucucc

SEQ ID NO: 2897065 - RNA, 17 nt, Human
auucuuccuaguuuucu

SEQ ID NO: 2897066 - RNA, 12 nt, Human
auucuuccuagu

SEQ ID NO: 2897067 - RNA, 20 nt, Human
auucuucccuuuuaaacaca

SEQ ID NO: 2897068 - RNA, 22 nt, Human
auucuucccuuuuaaacacauu

SEQ ID NO: 2897069 - RNA, 12 nt, Human
auugaaauguca

SEQ ID NO: 2897070 - RNA, 13 nt, Human
auugaaaaaaaua

SEQ ID NO: 2897071 - RNA, 15 nt, Human
auugaaaaaaauaau

SEQ ID NO: 2897072 - RNA, 15 nt, Human
auucuguagauucug

SEQ ID NO: 2897073 - RNA, 12 nt, Human
auucuguaaaug

SEQ ID NO: 2897074 - RNA, 14 nt, Human
auucuguguugcau

SEQ ID NO: 2897075 - RNA, 18 nt, Human
auucuguguugcauuauu

SEQ ID NO: 2897076 - RNA, 12 nt, Human
auucuguuaaaa

SEQ ID NO: 2897077 - RNA, 15 nt, Human
auucuguuaaaaucu

SEQ ID NO: 2897078 - RNA, 16 nt, Human
auucuguuaaaaucua

SEQ ID NO: 2897079 - RNA, 20 nt, Human
auucuguuaaaaucuauucu

SEQ ID NO: 2897080 - RNA, 22 nt, Human
auucuguuaaaaucuauucugu

SEQ ID NO: 2897081 - RNA, 14 nt, Human
auucuguuggccag

SEQ ID NO: 2897082 - RNA, 21 nt, Human
auucuguuggccagugugaca

SEQ ID NO: 2897083 - RNA, 19 nt, Human
auucuguuggccaguguga

SEQ ID NO: 2897084 - RNA, 22 nt, Human
auucugcucacauaucugucau

SEQ ID NO: 2897085 - RNA, 21 nt, Human
auucugcucacauaucuguca

SEQ ID NO: 2897086 - RNA, 20 nt, Human
auucugcucacauaucuguc

SEQ ID NO: 2897087 - RNA, 19 nt, Human
auucugcucacauaucugu

SEQ ID NO: 2897088 - RNA, 21 nt, Human
auucugccugcccaggccccu

SEQ ID NO: 2897089 - RNA, 20 nt, Human
auucugccugcccaggcccc

SEQ ID NO: 2897090 - RNA, 18 nt, Human
auucugcucacauaucug

SEQ ID NO: 2897091 - RNA, 21 nt, Human
auucugccgcccccuccugaa

SEQ ID NO: 2897092 - RNA, 20 nt, Human
auucugccgcccccuccuga

SEQ ID NO: 2897093 - RNA, 22 nt, Human
auucugccgcccccuccugaac

SEQ ID NO: 2897094 - RNA, 17 nt, Human
auucugccucucuagga

SEQ ID NO: 2897095 - RNA, 15 nt, Human
auucugccucucuag

SEQ ID NO: 2897096 - RNA, 16 nt, Human
auucugccucucuagg

SEQ ID NO: 2897097 - RNA, 19 nt, Human
auucugccugcccaggccc

SEQ ID NO: 2897098 - RNA, 18 nt, Human
auucugccugcccaggcc

SEQ ID NO: 2897099 - RNA, 17 nt, Human
auucugccugcccaggc

SEQ ID NO: 2897100 - RNA, 16 nt, Human
auucugccugcccagg

SEQ ID NO: 2897101 - RNA, 15 nt, Human
auucugccugcccag

SEQ ID NO: 2897102 - RNA, 14 nt, Human
auucugccugccca

SEQ ID NO: 2897103 - RNA, 13 nt, Human
auucugccugccc

SEQ ID NO: 2897104 - RNA, 11 nt, Human
auucugccugc

SEQ ID NO: 2897105 - RNA, 17 nt, Human
auucucauuugucacac

SEQ ID NO: 2897106 - RNA, 19 nt, Human
auucugcccaaaaauaugg

SEQ ID NO: 2897107 - RNA, 17 nt, Human
auucugcccuccuuaau

SEQ ID NO: 2897108 - RNA, 19 nt, Human
auucugcccuccuuaauuu

SEQ ID NO: 2897109 - RNA, 13 nt, Human
auucugcccugug

SEQ ID NO: 2897110 - RNA, 16 nt, Human
auucucauugcagaau

SEQ ID NO: 2897111 - RNA, 18 nt, Human
auucucauugcagaauaa

SEQ ID NO: 2897112 - RNA, 22 nt, Human
auucucaugccucagccuccug

SEQ ID NO: 2897113 - RNA, 18 nt, Human
auucuagcuaauguaaua

SEQ ID NO: 2897114 - RNA, 15 nt, Human
auucuagcuaaugua

SEQ ID NO: 2897115 - RNA, 15 nt, Human
auucuagcuuugagc

SEQ ID NO: 2897116 - RNA, 14 nt, Human
auucuaaugucuuc

SEQ ID NO: 2897117 - RNA, 16 nt, Human
auucuaaugucuucau

SEQ ID NO: 2897118 - RNA, 21 nt, Human
auucucaugccucagccuccu

SEQ ID NO: 2897119 - RNA, 17 nt, Human
auugaaggaagccaaau

SEQ ID NO: 2897120 - RNA, 21 nt, Human
auuauuuucuucauccaacuu

SEQ ID NO: 2897121 - RNA, 15 nt, Human
auuauuauuuguguu

SEQ ID NO: 2897122 - RNA, 13 nt, Human
auuauuuauuauu

SEQ ID NO: 2897123 - RNA, 15 nt, Human
auuauuuauuuauuu

SEQ ID NO: 2897124 - RNA, 20 nt, Human
auuauuuauuucugguaacu

SEQ ID NO: 2897125 - RNA, 18 nt, Human
auuauuucacaaauaaua

SEQ ID NO: 2897126 - RNA, 23 nt, Human
auuauuuauucagcuucauuugu

SEQ ID NO: 2897127 - RNA, 14 nt, Human
auuauuuauuuaau

SEQ ID NO: 2897128 - RNA, 17 nt, Human
auuauuuauuuaauaac

SEQ ID NO: 2897129 - RNA, 15 nt, Human
auuauuuguguaaua

SEQ ID NO: 2897130 - RNA, 15 nt, Human
auuauuuuggaaagu

SEQ ID NO: 2897131 - RNA, 12 nt, Human
auuauuuugggg

SEQ ID NO: 2897132 - RNA, 14 nt, Human
auuauuuugggguc

SEQ ID NO: 2897133 - RNA, 16 nt, Human
auuauuuuggggucuc

SEQ ID NO: 2897134 - RNA, 17 nt, Human
auuauuuuggggucucu

SEQ ID NO: 2897135 - RNA, 19 nt, Human
auuauuuuggggucucuuu

SEQ ID NO: 2897136 - RNA, 21 nt, Human
auuauuuuggggucucuuuug

SEQ ID NO: 2897137 - RNA, 22 nt, Human
auuauuuuggggucucuuuugu

SEQ ID NO: 2897138 - RNA, 11 nt, Human
auuauuuggca

SEQ ID NO: 2897139 - RNA, 18 nt, Human
auuauuuggcaguuuggu

SEQ ID NO: 2897140 - RNA, 23 nt, Human
auuauuuggcaguuugguauuug

SEQ ID NO: 2897141 - RNA, 20 nt, Human
auuauuugggagggaaaagg

SEQ ID NO: 2897142 - RNA, 21 nt, Human
auuauuugggagggaaaaggg

SEQ ID NO: 2897143 - RNA, 15 nt, Human
auuauuacuguugau

SEQ ID NO: 2897144 - RNA, 21 nt, Human
auuauuacuguugauaauucu

SEQ ID NO: 2897145 - RNA, 23 nt, Human
auuauuacuguugauaauucuua

SEQ ID NO: 2897146 - RNA, 16 nt, Human
auuauguuguuagaga

SEQ ID NO: 2897147 - RNA, 21 nt, Human
auuauuacuuauuuuugacag

SEQ ID NO: 2897148 - RNA, 20 nt, Human
auuauuacuuauuuuugaca

SEQ ID NO: 2897149 - RNA, 14 nt, Human
auuauuaucuuuaa

SEQ ID NO: 2897150 - RNA, 22 nt, Human
auuauuaguuuacaucauuuuu

SEQ ID NO: 2897151 - RNA, 15 nt, Human
auuauuauaaaaggg

SEQ ID NO: 2897152 - RNA, 19 nt, Human
auuauuauaaaaggggguc

SEQ ID NO: 2897153 - RNA, 20 nt, Human
auuauuauaagcauugaaau

SEQ ID NO: 2897154 - RNA, 15 nt, Human
auuauuauagguaau

SEQ ID NO: 2897155 - RNA, 17 nt, Human
auuauuauuaaaaauau

SEQ ID NO: 2897156 - RNA, 21 nt, Human
auuauuaguaagaaaacauca

SEQ ID NO: 2897157 - RNA, 15 nt, Human
auuauuaguacugcu

SEQ ID NO: 2897158 - RNA, 12 nt, Human
auuauuagaaau

SEQ ID NO: 2897159 - RNA, 19 nt, Human
auuauauuugugcuauagu

SEQ ID NO: 2897160 - RNA, 19 nt, Human
auuaucuaaaaucugcuag

SEQ ID NO: 2897161 - RNA, 13 nt, Human
auuccccucugcu

SEQ ID NO: 2897162 - RNA, 15 nt, Human
auuccccucugcugc

SEQ ID NO: 2897163 - RNA, 22 nt, Human
auuccccucugcugcugucccu

SEQ ID NO: 2897164 - RNA, 23 nt, Human
auuccccgucucugguuccuccc

SEQ ID NO: 2897165 - RNA, 17 nt, Human
auucccuagaucuuucu

SEQ ID NO: 2897166 - RNA, 12 nt, Human
auucuaagacuu

SEQ ID NO: 2897167 - RNA, 18 nt, Human
auucuaacggucuguucu

SEQ ID NO: 2897168 - RNA, 23 nt, Human
auucuaagacuuacucuaagauc

SEQ ID NO: 2897169 - RNA, 20 nt, Human
auucuaagacuuacucuaag

SEQ ID NO: 2897170 - RNA, 22 nt, Human
auucuaagacuuacucuaagau

SEQ ID NO: 2897171 - RNA, 23 nt, Human
auucuaaugaugaucaauuauag

SEQ ID NO: 2897172 - RNA, 12 nt, Human
auucuaaugucu

SEQ ID NO: 2897173 - RNA, 13 nt, Human
auucuaaugucuu

SEQ ID NO: 2897174 - RNA, 21 nt, Human
auuccagagaguggcuccucc

SEQ ID NO: 2897175 - RNA, 19 nt, Human
auuccagagaguggcuccu

SEQ ID NO: 2897176 - RNA, 19 nt, Human
auucccagagcaaaauaau

SEQ ID NO: 2897177 - RNA, 17 nt, Human
auucccagagcaaaaua

SEQ ID NO: 2897178 - RNA, 15 nt, Human
auucccaucugucac

SEQ ID NO: 2897179 - RNA, 15 nt, Human
auucccaucuuuacu

SEQ ID NO: 2897180 - RNA, 20 nt, Human
auucagcuucauuuguguca

SEQ ID NO: 2897181 - RNA, 12 nt, Human
auucagcuucau

SEQ ID NO: 2897182 - RNA, 22 nt, Human
auucaggaagcagcuuucccca

SEQ ID NO: 2897183 - RNA, 15 nt, Human
auucagaauauucau

SEQ ID NO: 2897184 - RNA, 21 nt, Human
auucaccaaaauagucuucuc

SEQ ID NO: 2897185 - RNA, 16 nt, Human
auucaccaaaauuauc

SEQ ID NO: 2897186 - RNA, 13 nt, Human
auucagaaauugg

SEQ ID NO: 2897187 - RNA, 14 nt, Human
auucagaaauugga

SEQ ID NO: 2897188 - RNA, 13 nt, Human
auuauauuggugg

SEQ ID NO: 2897189 - RNA, 20 nt, Human
auuauauuggugguucucag

SEQ ID NO: 2897190 - RNA, 15 nt, Human
auuauaauuuaaugc

SEQ ID NO: 2897191 - RNA, 19 nt, Human
auuauacccccugcaaagc

SEQ ID NO: 2897192 - RNA, 17 nt, Human
auuauacuaacuuauuu

SEQ ID NO: 2897193 - RNA, 18 nt, Human
auuaguuuacaucauuuu

SEQ ID NO: 2897194 - RNA, 14 nt, Human
auuaguuaauauau

SEQ ID NO: 2897195 - RNA, 18 nt, Human
auuaguucccugucucuu

SEQ ID NO: 2897196 - RNA, 21 nt, Human
auuaguucccugucucuugaa

SEQ ID NO: 2897197 - RNA, 13 nt, Human
auuaguugcuuug

SEQ ID NO: 2897198 - RNA, 14 nt, Human
auuaguugcuuugu

SEQ ID NO: 2897199 - RNA, 15 nt, Human
auuaguugcuuuguu

SEQ ID NO: 2897200 - RNA, 14 nt, Human
auuaguuuucuugu

SEQ ID NO: 2897201 - RNA, 15 nt, Human
auuaguuuucuuguu

SEQ ID NO: 2897202 - RNA, 16 nt, Human
auuaguuuucuuguug

SEQ ID NO: 2897203 - RNA, 19 nt, Human
auuaguuuucuuguugcuu

SEQ ID NO: 2897204 - RNA, 21 nt, Human
auuaguuuucuuguugcuuug

SEQ ID NO: 2897205 - RNA, 18 nt, Human
auuauacaaauuaaaaag

SEQ ID NO: 2897206 - RNA, 19 nt, Human
auuauacaaauuaaaaaga

SEQ ID NO: 2897207 - RNA, 17 nt, Human
auuauaauuuaaugcau

SEQ ID NO: 2897208 - RNA, 14 nt, Human
uuuguggccucaga

SEQ ID NO: 2897209 - RNA, 12 nt, Human
uuuguggccuca

SEQ ID NO: 2897210 - RNA, 17 nt, Human
uuuguggcaccuuuucu

SEQ ID NO: 2897211 - RNA, 12 nt, Human
uuuguggaauaa

SEQ ID NO: 2897212 - RNA, 11 nt, Human
uuuguggaaaa

SEQ ID NO: 2897213 - RNA, 12 nt, Human
cuguuuaagaaa

SEQ ID NO: 2897214 - RNA, 13 nt, Human
cuguuuaagaaaa

SEQ ID NO: 2897215 - RNA, 20 nt, Human
cuguuuaagaaaaguauuuu

SEQ ID NO: 2897216 - RNA, 22 nt, Human
cuguuuaagaaaaguauuuuga

SEQ ID NO: 2897217 - RNA, 12 nt, Human
cuguuguacauu

SEQ ID NO: 2897218 - RNA, 13 nt, Human
cuguuguacauuu

SEQ ID NO: 2897219 - RNA, 14 nt, Human
cuguuguacauuua

SEQ ID NO: 2897220 - RNA, 22 nt, Human
cuguuguaacuaggcucagaga

SEQ ID NO: 2897221 - RNA, 12 nt, Human
cuguuguaacuu

SEQ ID NO: 2897222 - RNA, 15 nt, Human
cuguuguaacuuaug

SEQ ID NO: 2897223 - RNA, 17 nt, Human
cuguuguaacuuaugua

SEQ ID NO: 2897224 - RNA, 18 nt, Human
cuguuguaacuuauguag

SEQ ID NO: 2897225 - RNA, 20 nt, Human
cuguuguaacuuauguagau

SEQ ID NO: 2897226 - RNA, 21 nt, Human
cuguuguaacuuauguagaua

SEQ ID NO: 2897227 - RNA, 22 nt, Human
cuguuguacauuuaugauuuaa

SEQ ID NO: 2897228 - RNA, 15 nt, Human
cuguuguacuaugga

SEQ ID NO: 2897229 - RNA, 15 nt, Human
cuguuguacauuuau

SEQ ID NO: 2897230 - RNA, 17 nt, Human
cuguuguacauuuauga

SEQ ID NO: 2897231 - RNA, 18 nt, Human
cuguuguacauuuaugau

SEQ ID NO: 2897232 - RNA, 19 nt, Human
cuguuguacauuuaugauu

SEQ ID NO: 2897233 - RNA, 16 nt, Human
cuguuguuuuguuuua

SEQ ID NO: 2897234 - RNA, 20 nt, Human
cuguuguuuuguuuuaaaua

SEQ ID NO: 2897235 - RNA, 22 nt, Human
cuguuggcugggggccucagug

SEQ ID NO: 2897236 - RNA, 19 nt, Human
cuguuggcugggggccuca

SEQ ID NO: 2897237 - RNA, 11 nt, Human
cuguuguaacu

SEQ ID NO: 2897238 - RNA, 16 nt, Human
cuguuguaacuaggcu

SEQ ID NO: 2897239 - RNA, 14 nt, Human
cuguuggcuggggg

SEQ ID NO: 2897240 - RNA, 14 nt, Human
cuuaaaacaacacu

SEQ ID NO: 2897241 - RNA, 16 nt, Human
cuguuuaauauuuaaa

SEQ ID NO: 2897242 - RNA, 18 nt, Human
cuguuuaauauuuaaaca

SEQ ID NO: 2897243 - RNA, 20 nt, Human
cuguuuaauauuuaaacagc

SEQ ID NO: 2897244 - RNA, 15 nt, Human
cuuaaaaauguaaau

SEQ ID NO: 2897245 - RNA, 16 nt, Human
cuuaaaaauguaaaua

SEQ ID NO: 2897246 - RNA, 17 nt, Human
cuuaaaaauguaaauau

SEQ ID NO: 2897247 - RNA, 18 nt, Human
cuuaaaaauguaaauauu

SEQ ID NO: 2897248 - RNA, 22 nt, Human
cuuaaaaauguuuuuucaugug

SEQ ID NO: 2897249 - RNA, 23 nt, Human
cuuaaaaauguuuuuucaugugu

SEQ ID NO: 2897250 - RNA, 19 nt, Human
cuuaauuuuuuuuucauag

SEQ ID NO: 2897251 - RNA, 20 nt, Human
cuuaauuuuuuuuucauaga

SEQ ID NO: 2897252 - RNA, 19 nt, Human
cuuaaauaaugcuucagau

SEQ ID NO: 2897253 - RNA, 20 nt, Human
cuuaaauaaugcuucagaua

SEQ ID NO: 2897254 - RNA, 21 nt, Human
cuuaaauaaugcuucagauau

SEQ ID NO: 2897255 - RNA, 15 nt, Human
cuuaccaacuuucug

SEQ ID NO: 2897256 - RNA, 16 nt, Human
cuuaccaacuuucugu

SEQ ID NO: 2897257 - RNA, 17 nt, Human
cuuaccaacuuucugua

SEQ ID NO: 2897258 - RNA, 19 nt, Human
cuuaccaacuuucuguaaa

SEQ ID NO: 2897259 - RNA, 16 nt, Human
cuuaccaauagcaggg

SEQ ID NO: 2897260 - RNA, 13 nt, Human
cuuaccagaagcu

SEQ ID NO: 2897261 - RNA, 20 nt, Human
cuuacauuuuacuuuuuccu

SEQ ID NO: 2897262 - RNA, 14 nt, Human
cuuaccaacuuucu

SEQ ID NO: 2897263 - RNA, 12 nt, Human
cuuacauucucu

SEQ ID NO: 2897264 - RNA, 16 nt, Human
cuuacauucucuaaua

SEQ ID NO: 2897265 - RNA, 20 nt, Human
cuuacauucucuaauaagaa

SEQ ID NO: 2897266 - RNA, 21 nt, Human
cuuacauucucuaauaagaaa

SEQ ID NO: 2897267 - RNA, 22 nt, Human
cuuacauucucuaauaagaaaa

SEQ ID NO: 2897268 - RNA, 23 nt, Human
cuuacauucucuaauaagaaaac

SEQ ID NO: 2897269 - RNA, 12 nt, Human
cuuacauuugug

SEQ ID NO: 2897270 - RNA, 13 nt, Human
cuuacauuuguga

SEQ ID NO: 2897271 - RNA, 18 nt, Human
cuuacauuugugagauuc

SEQ ID NO: 2897272 - RNA, 20 nt, Human
cuuacauuugugagauuccu

SEQ ID NO: 2897273 - RNA, 17 nt, Human
cuuacaaucgcaaauca

SEQ ID NO: 2897274 - RNA, 21 nt, Human
cuuacaaucgcaaaucaaaac

SEQ ID NO: 2897275 - RNA, 16 nt, Human
cuuacaagccagcugg

SEQ ID NO: 2897276 - RNA, 17 nt, Human
cuuacaagccagcugga

SEQ ID NO: 2897277 - RNA, 21 nt, Human
cuuacauuagcaguuugcuuu

SEQ ID NO: 2897278 - RNA, 22 nt, Human
cuuacauuagcaguuugcuuug

SEQ ID NO: 2897279 - RNA, 13 nt, Human
cuuacacaaaggg

SEQ ID NO: 2897280 - RNA, 16 nt, Human
cuuacacaaaggggau

SEQ ID NO: 2897281 - RNA, 18 nt, Human
cuuacacaaaggggauca

SEQ ID NO: 2897282 - RNA, 21 nt, Human
cuuacacaaaggggaucauaa

SEQ ID NO: 2897283 - RNA, 21 nt, Human
cuuacacaaaucuauuuaauu

SEQ ID NO: 2897284 - RNA, 12 nt, Human
cuguuauguacu

SEQ ID NO: 2897285 - RNA, 13 nt, Human
cuguuauguacug

SEQ ID NO: 2897286 - RNA, 14 nt, Human
cuguuauguacugu

SEQ ID NO: 2897287 - RNA, 15 nt, Human
cuguuauguacugua

SEQ ID NO: 2897288 - RNA, 16 nt, Human
cuguuauguacuguac

SEQ ID NO: 2897289 - RNA, 17 nt, Human
cuguuauguacuguacu

SEQ ID NO: 2897290 - RNA, 21 nt, Human
cuguuauguacuguacuaauu

SEQ ID NO: 2897291 - RNA, 12 nt, Human
cuguuaugucug

SEQ ID NO: 2897292 - RNA, 16 nt, Human
cuguuaugucuguuua

SEQ ID NO: 2897293 - RNA, 17 nt, Human
cuguuaugucuguuuaa

SEQ ID NO: 2897294 - RNA, 20 nt, Human
cuguuaugucuguuuaagaa

SEQ ID NO: 2897295 - RNA, 21 nt, Human
cuguuaugucuguuuaagaaa

SEQ ID NO: 2897296 - RNA, 22 nt, Human
cuguuaugucuguuuaagaaaa

SEQ ID NO: 2897297 - RNA, 20 nt, Human
cuguuauuuucaaguagcug

SEQ ID NO: 2897298 - RNA, 14 nt, Human
cuguuauuuagacu

SEQ ID NO: 2897299 - RNA, 16 nt, Human
cuguuauuuagacuca

SEQ ID NO: 2897300 - RNA, 12 nt, Human
cuguucaagagc

SEQ ID NO: 2897301 - RNA, 16 nt, Human
cuguucaacaucacug

SEQ ID NO: 2897302 - RNA, 19 nt, Human
cuguucaacaucacugaaa

SEQ ID NO: 2897303 - RNA, 17 nt, Human
cuguucaauguuuaaug

SEQ ID NO: 2897304 - RNA, 21 nt, Human
cuguucaagagcacacuuggc

SEQ ID NO: 2897305 - RNA, 23 nt, Human
cuguucaagagcacacuuggccc

SEQ ID NO: 2897306 - RNA, 17 nt, Human
cuguucaaggccccuga

SEQ ID NO: 2897307 - RNA, 16 nt, Human
cuuagggugaaccacu

SEQ ID NO: 2897308 - RNA, 20 nt, Human
cuuagggaagcuggccugag

SEQ ID NO: 2897309 - RNA, 12 nt, Human
cuuaggccuucc

SEQ ID NO: 2897310 - RNA, 13 nt, Human
cuuaggccuuccu

SEQ ID NO: 2897311 - RNA, 15 nt, Human
cuuaggccuuccucu

SEQ ID NO: 2897312 - RNA, 17 nt, Human
cuuaggccuuccucucu

SEQ ID NO: 2897313 - RNA, 23 nt, Human
cuuaggccuuccucucuccagau

SEQ ID NO: 2897314 - RNA, 16 nt, Human
cuuaggcugcugggau

SEQ ID NO: 2897315 - RNA, 13 nt, Human
cuuaggcuuugua

SEQ ID NO: 2897316 - RNA, 17 nt, Human
cuuagggaagcuggccu

SEQ ID NO: 2897317 - RNA, 13 nt, Human
cuuagggaagcug

SEQ ID NO: 2897318 - RNA, 16 nt, Human
cuuagcuuuuuaauug

SEQ ID NO: 2897319 - RNA, 17 nt, Human
cuuagcuuuuuaauugu

SEQ ID NO: 2897320 - RNA, 19 nt, Human
cuuaggcaugacuguagaa

SEQ ID NO: 2897321 - RNA, 21 nt, Human
cuuaggcccggagcugccccu

SEQ ID NO: 2897322 - RNA, 22 nt, Human
cuuaggcauguaggacccugca

SEQ ID NO: 2897323 - RNA, 18 nt, Human
cuuagcuuugcucugcca

SEQ ID NO: 2897324 - RNA, 14 nt, Human
cuuagcuuuuuaau

SEQ ID NO: 2897325 - RNA, 17 nt, Human
cuuagcugucugcucag

SEQ ID NO: 2897326 - RNA, 14 nt, Human
cuuagcuaucagaa

SEQ ID NO: 2897327 - RNA, 14 nt, Human
cuuagcugucugcu

SEQ ID NO: 2897328 - RNA, 13 nt, Human
cuuagcugggaga

SEQ ID NO: 2897329 - RNA, 11 nt, Human
cuuagcucccu

SEQ ID NO: 2897330 - RNA, 13 nt, Human
cuuagcucccucc

SEQ ID NO: 2897331 - RNA, 17 nt, Human
cuuagcucccucccgca

SEQ ID NO: 2897332 - RNA, 21 nt, Human
cuuagcucccucccgcacccc

SEQ ID NO: 2897333 - RNA, 14 nt, Human
cuuagccuggagca

SEQ ID NO: 2897334 - RNA, 15 nt, Human
cuuagccuggagcac

SEQ ID NO: 2897335 - RNA, 17 nt, Human
cuuagccuggagcaccu

SEQ ID NO: 2897336 - RNA, 22 nt, Human
cuuagccuggagcaccuuuccu

SEQ ID NO: 2897337 - RNA, 15 nt, Human
cuuagccucccugaa

SEQ ID NO: 2897338 - RNA, 14 nt, Human
cuuagccucccuga

SEQ ID NO: 2897339 - RNA, 11 nt, Human
cuuagccuccc

SEQ ID NO: 2897340 - RNA, 13 nt, Human
cuuaccauuaaag

SEQ ID NO: 2897341 - RNA, 23 nt, Human
cuuaccauuugcuacuguacaua

SEQ ID NO: 2897342 - RNA, 22 nt, Human
cuuacccaaacuguucaagaaa

SEQ ID NO: 2897343 - RNA, 15 nt, Human
cuuacccaauuuccc

SEQ ID NO: 2897344 - RNA, 16 nt, Human
cuuacccaauuuccca

SEQ ID NO: 2897345 - RNA, 19 nt, Human
cuuagcauagcuuauuauu

SEQ ID NO: 2897346 - RNA, 22 nt, Human
cuuagcauagcuuauuauugaa

SEQ ID NO: 2897347 - RNA, 18 nt, Human
cuuagcauccuaagaaau

SEQ ID NO: 2897348 - RNA, 19 nt, Human
cuuagcauccuaagaaaua

SEQ ID NO: 2897349 - RNA, 20 nt, Human
cuuagcauccuaagaaauau

SEQ ID NO: 2897350 - RNA, 22 nt, Human
cuuagcauccuaagaaauaugu

SEQ ID NO: 2897351 - RNA, 18 nt, Human
cuguuaggagaagcugca

SEQ ID NO: 2897352 - RNA, 13 nt, Human
cugugucuaagau

SEQ ID NO: 2897353 - RNA, 12 nt, Human
cugugucuaaga

SEQ ID NO: 2897354 - RNA, 16 nt, Human
cugugucguagccaag

SEQ ID NO: 2897355 - RNA, 15 nt, Human
cuguguccuucccug

SEQ ID NO: 2897356 - RNA, 16 nt, Human
cuguguccuucccugc

SEQ ID NO: 2897357 - RNA, 20 nt, Human
cuguguccugguuagcagag

SEQ ID NO: 2897358 - RNA, 17 nt, Human
cugugcugcccugaaga

SEQ ID NO: 2897359 - RNA, 18 nt, Human
cugugcugcccugaagaa

SEQ ID NO: 2897360 - RNA, 14 nt, Human
cugugucacccagg

SEQ ID NO: 2897361 - RNA, 17 nt, Human
cugugucaauccagaug

SEQ ID NO: 2897362 - RNA, 19 nt, Human
cugugucaauccagauggu

SEQ ID NO: 2897363 - RNA, 20 nt, Human
cugugucaauccagauggug

SEQ ID NO: 2897364 - RNA, 14 nt, Human
cugugaccucaggc

SEQ ID NO: 2897365 - RNA, 17 nt, Human
cugugaccucaggcacu

SEQ ID NO: 2897366 - RNA, 22 nt, Human
cugugacccacuucucaucaca

SEQ ID NO: 2897367 - RNA, 23 nt, Human
cugugacccacuucucaucacac

SEQ ID NO: 2897368 - RNA, 14 nt, Human
cugugaccugcauc

SEQ ID NO: 2897369 - RNA, 15 nt, Human
cugugaccugcaucu

SEQ ID NO: 2897370 - RNA, 22 nt, Human
cugugaccucaggcacuagccu

SEQ ID NO: 2897371 - RNA, 23 nt, Human
cugugaccucaggcacuagccuu

SEQ ID NO: 2897372 - RNA, 22 nt, Human
cugugaccugccccgcccagcu

SEQ ID NO: 2897373 - RNA, 16 nt, Human
cugugaccugccccgc

SEQ ID NO: 2897374 - RNA, 19 nt, Human
cugugccuucuuuugauua

SEQ ID NO: 2897375 - RNA, 19 nt, Human
cugugccuuugcaaaucag

SEQ ID NO: 2897376 - RNA, 19 nt, Human
cuguagaauagccuguggc

SEQ ID NO: 2897377 - RNA, 20 nt, Human
cuguagaauagccuguggcc

SEQ ID NO: 2897378 - RNA, 21 nt, Human
cuguagaauagccuguggccu

SEQ ID NO: 2897379 - RNA, 18 nt, Human
cuguagagccuucugaug

SEQ ID NO: 2897380 - RNA, 15 nt, Human
cuguaggugguaugu

SEQ ID NO: 2897381 - RNA, 18 nt, Human
cuguaguagcccuuucug

SEQ ID NO: 2897382 - RNA, 19 nt, Human
cuguaguagcccuuucugu

SEQ ID NO: 2897383 - RNA, 21 nt, Human
cuguaguagcccuuucugugu

SEQ ID NO: 2897384 - RNA, 14 nt, Human
cuguagucagccga

SEQ ID NO: 2897385 - RNA, 16 nt, Human
cuguagucauuuacua

SEQ ID NO: 2897386 - RNA, 17 nt, Human
cuguagucauuuacuaa

SEQ ID NO: 2897387 - RNA, 22 nt, Human
cuguagucauuuacuaaacaua

SEQ ID NO: 2897388 - RNA, 23 nt, Human
cuguagucauuuacuaaacauau

SEQ ID NO: 2897389 - RNA, 17 nt, Human
cuguaacagguauuuug

SEQ ID NO: 2897390 - RNA, 18 nt, Human
cuguaacagguauuuugu

SEQ ID NO: 2897391 - RNA, 23 nt, Human
cuguaacagguauuuuguuucuu

SEQ ID NO: 2897392 - RNA, 19 nt, Human
cuguaacauacuggccugg

SEQ ID NO: 2897393 - RNA, 21 nt, Human
cuguaacaucacuauccaugc

SEQ ID NO: 2897394 - RNA, 22 nt, Human
cuguaacaucacuauccaugca

SEQ ID NO: 2897395 - RNA, 18 nt, Human
cuguacucuggggugcug

SEQ ID NO: 2897396 - RNA, 23 nt, Human
cuguacucuggggugcugccuga

SEQ ID NO: 2897397 - RNA, 15 nt, Human
cuguaacuuaaaaua

SEQ ID NO: 2897398 - RNA, 16 nt, Human
cuguaacuuaaaauag

SEQ ID NO: 2897399 - RNA, 16 nt, Human
cuguacugacuugagg

SEQ ID NO: 2897400 - RNA, 17 nt, Human
cuguacuguucuguguc

SEQ ID NO: 2897401 - RNA, 20 nt, Human
cuguacuguucugugucuuu

SEQ ID NO: 2897402 - RNA, 14 nt, Human
cuguacugcucagg

SEQ ID NO: 2897403 - RNA, 16 nt, Human
cuguacugcucaggcu

SEQ ID NO: 2897404 - RNA, 21 nt, Human
cuguacugcucaggcugcagc

SEQ ID NO: 2897405 - RNA, 22 nt, Human
cuguacugcucaggcugcagcu

SEQ ID NO: 2897406 - RNA, 20 nt, Human
cuggugaauggccuuccuuc

SEQ ID NO: 2897407 - RNA, 15 nt, Human
cuggucuuuccucug

SEQ ID NO: 2897408 - RNA, 18 nt, Human
cuggucuuguggaauugg

SEQ ID NO: 2897409 - RNA, 20 nt, Human
cuggucuuguggaauuggga

SEQ ID NO: 2897410 - RNA, 15 nt, Human
cuggucuuguuagaa

SEQ ID NO: 2897411 - RNA, 19 nt, Human
cuggucuuguuagaaaaca

SEQ ID NO: 2897412 - RNA, 20 nt, Human
cuggucuuguuagaaaacaa

SEQ ID NO: 2897413 - RNA, 22 nt, Human
cuguaaacucaaaacuuaacau

SEQ ID NO: 2897414 - RNA, 17 nt, Human
cugguuucacuggccca

SEQ ID NO: 2897415 - RNA, 13 nt, Human
cugguuucacugg

SEQ ID NO: 2897416 - RNA, 18 nt, Human
cugguuucacuggcccaa

SEQ ID NO: 2897417 - RNA, 16 nt, Human
cugguuuacaggcccu

SEQ ID NO: 2897418 - RNA, 17 nt, Human
cugguuuacaggcccug

SEQ ID NO: 2897419 - RNA, 18 nt, Human
cugguuuacaggcccugc

SEQ ID NO: 2897420 - RNA, 21 nt, Human
cugguuuacaggcccugcucc

SEQ ID NO: 2897421 - RNA, 22 nt, Human
cugguuuacaggcccugcuccu

SEQ ID NO: 2897422 - RNA, 14 nt, Human
cugguuuccugccc

SEQ ID NO: 2897423 - RNA, 13 nt, Human
cugguuuccugcc

SEQ ID NO: 2897424 - RNA, 19 nt, Human
cuguaaacucaaaacuuaa

SEQ ID NO: 2897425 - RNA, 16 nt, Human
cugucgcccagucugg

SEQ ID NO: 2897426 - RNA, 15 nt, Human
cugucgcccagucug

SEQ ID NO: 2897427 - RNA, 16 nt, Human
cugucauagaaauuac

SEQ ID NO: 2897428 - RNA, 14 nt, Human
cugucauagaaauu

SEQ ID NO: 2897429 - RNA, 13 nt, Human
cugucacaccagc

SEQ ID NO: 2897430 - RNA, 15 nt, Human
cugucacaccagcca

SEQ ID NO: 2897431 - RNA, 16 nt, Human
cugucacaccagccau

SEQ ID NO: 2897432 - RNA, 14 nt, Human
cugucaucugaauu

SEQ ID NO: 2897433 - RNA, 17 nt, Human
cuguccuccaagccagc

SEQ ID NO: 2897434 - RNA, 15 nt, Human
cuguccuccaagcca

SEQ ID NO: 2897435 - RNA, 16 nt, Human
cuguccucccaucccc

SEQ ID NO: 2897436 - RNA, 18 nt, Human
cuguccucccauccccug

SEQ ID NO: 2897437 - RNA, 19 nt, Human
cuguccucccauccccugg

SEQ ID NO: 2897438 - RNA, 13 nt, Human
cuguccucucccc

SEQ ID NO: 2897439 - RNA, 14 nt, Human
cuguccucuccccu

SEQ ID NO: 2897440 - RNA, 16 nt, Human
cuguccucuccccucc

SEQ ID NO: 2897441 - RNA, 17 nt, Human
cuguccucuccccucca

SEQ ID NO: 2897442 - RNA, 18 nt, Human
cuguccucuccccuccag

SEQ ID NO: 2897443 - RNA, 19 nt, Human
cuguccucuccccuccagc

SEQ ID NO: 2897444 - RNA, 20 nt, Human
cuguccucuccccuccagcc

SEQ ID NO: 2897445 - RNA, 21 nt, Human
cuguccucuccccuccagccu

SEQ ID NO: 2897446 - RNA, 22 nt, Human
cuguccucuccccuccagccuu

SEQ ID NO: 2897447 - RNA, 21 nt, Human
cuguccucccauccccuggac

SEQ ID NO: 2897448 - RNA, 14 nt, Human
cuguccucccucca

SEQ ID NO: 2897449 - RNA, 15 nt, Human
cuguccucccuccac

SEQ ID NO: 2897450 - RNA, 14 nt, Human
cuguccucccucug

SEQ ID NO: 2897451 - RNA, 21 nt, Human
cuguccugggagugagcuggu

SEQ ID NO: 2897452 - RNA, 20 nt, Human
cugaugaacuuauucuguag

SEQ ID NO: 2897453 - RNA, 14 nt, Human
cugaugaaucacug

SEQ ID NO: 2897454 - RNA, 15 nt, Human
cugaugaaucacugu

SEQ ID NO: 2897455 - RNA, 16 nt, Human
cugaugaaucacuguu

SEQ ID NO: 2897456 - RNA, 18 nt, Human
cugaugaaucacuguuuu

SEQ ID NO: 2897457 - RNA, 21 nt, Human
cugaugaaacucacaaaugau

SEQ ID NO: 2897458 - RNA, 12 nt, Human
cugaucugcgga

SEQ ID NO: 2897459 - RNA, 20 nt, Human
cugaucugcggaucucagcu

SEQ ID NO: 2897460 - RNA, 19 nt, Human
cugaucugcggaucucagc

SEQ ID NO: 2897461 - RNA, 20 nt, Human
cugaucugaugcaagcaaga

SEQ ID NO: 2897462 - RNA, 13 nt, Human
cugaucucuuccu

SEQ ID NO: 2897463 - RNA, 14 nt, Human
cugaucucuuccug

SEQ ID NO: 2897464 - RNA, 15 nt, Human
cugaucucuuccugu

SEQ ID NO: 2897465 - RNA, 16 nt, Human
cugaucucuuccuguu

SEQ ID NO: 2897466 - RNA, 21 nt, Human
cugaucucuuccuguuuugua

SEQ ID NO: 2897467 - RNA, 18 nt, Human
cugaucuuuguauauuac

SEQ ID NO: 2897468 - RNA, 12 nt, Human
cugaugaaaaca

SEQ ID NO: 2897469 - RNA, 18 nt, Human
cugaucuuaagaggcuga

SEQ ID NO: 2897470 - RNA, 23 nt, Human
cugccuccgcgugaucaaagcca

SEQ ID NO: 2897471 - RNA, 11 nt, Human
cugccuccucg

SEQ ID NO: 2897472 - RNA, 15 nt, Human
cugccuccucguucc

SEQ ID NO: 2897473 - RNA, 17 nt, Human
cugccuccucguuccuu

SEQ ID NO: 2897474 - RNA, 19 nt, Human
cugccuccucguuccuuuc

SEQ ID NO: 2897475 - RNA, 13 nt, Human
cugccuccucuuc

SEQ ID NO: 2897476 - RNA, 14 nt, Human
cugccuccucuuca

SEQ ID NO: 2897477 - RNA, 15 nt, Human
cugccuccucuucaa

SEQ ID NO: 2897478 - RNA, 19 nt, Human
cugccuguucagcuccagc

SEQ ID NO: 2897479 - RNA, 18 nt, Human
cugccuguucagcuccag

SEQ ID NO: 2897480 - RNA, 17 nt, Human
cugccuguucagcucca

SEQ ID NO: 2897481 - RNA, 16 nt, Human
cugccuguagcaguga

SEQ ID NO: 2897482 - RNA, 19 nt, Human
cugccuguagcccacucug

SEQ ID NO: 2897483 - RNA, 15 nt, Human
cugccuguagcccac

SEQ ID NO: 2897484 - RNA, 13 nt, Human
cugccuguaguua

SEQ ID NO: 2897485 - RNA, 23 nt, Human
cugccuguagcccacucugcucg

SEQ ID NO: 2897486 - RNA, 22 nt, Human
cugccuguagcccacucugcuc

SEQ ID NO: 2897487 - RNA, 20 nt, Human
cugccuguagcccacucugc

SEQ ID NO: 2897488 - RNA, 15 nt, Human
cugccuguaguuagg

SEQ ID NO: 2897489 - RNA, 16 nt, Human
cugcuaguguucuguc

SEQ ID NO: 2897490 - RNA, 13 nt, Human
cugcucaggcugc

SEQ ID NO: 2897491 - RNA, 16 nt, Human
cugcucaggcugcagc

SEQ ID NO: 2897492 - RNA, 18 nt, Human
cugcucaggcugcagcug

SEQ ID NO: 2897493 - RNA, 19 nt, Human
cugcucaggcugcagcugg

SEQ ID NO: 2897494 - RNA, 20 nt, Human
cugcucaggcugcagcugga

SEQ ID NO: 2897495 - RNA, 22 nt, Human
cugcucaggcugcagcuggaca

SEQ ID NO: 2897496 - RNA, 23 nt, Human
cugcucaggcugcagcuggacag

SEQ ID NO: 2897497 - RNA, 22 nt, Human
cugcucagggaaaagcagcucu

SEQ ID NO: 2897498 - RNA, 23 nt, Human
cugcucagggaaaagcagcucuc

SEQ ID NO: 2897499 - RNA, 12 nt, Human
cugcucaucauu

SEQ ID NO: 2897500 - RNA, 11 nt, Human
cugcugaccaa

SEQ ID NO: 2897501 - RNA, 20 nt, Human
cugcugaccaauugugcugc

SEQ ID NO: 2897502 - RNA, 21 nt, Human
cugcugaccaauugugcugcc

SEQ ID NO: 2897503 - RNA, 22 nt, Human
cugcugaccaauugugcugcca

SEQ ID NO: 2897504 - RNA, 23 nt, Human
cugcugaccaauugugcugccau

SEQ ID NO: 2897505 - RNA, 20 nt, Human
cugcuuuugucuaugggacu

SEQ ID NO: 2897506 - RNA, 19 nt, Human
cugcuucaaggcuuccacu

SEQ ID NO: 2897507 - RNA, 13 nt, Human
cuggaguugucac

SEQ ID NO: 2897508 - RNA, 13 nt, Human
cuggauaggagcc

SEQ ID NO: 2897509 - RNA, 15 nt, Human
cuggauaggagccug

SEQ ID NO: 2897510 - RNA, 15 nt, Human
cuggauaacuuaggu

SEQ ID NO: 2897511 - RNA, 20 nt, Human
cuggauacaguauaaaaaua

SEQ ID NO: 2897512 - RNA, 14 nt, Human
cuggauaacuuagg

SEQ ID NO: 2897513 - RNA, 18 nt, Human
cuggaguuucauguacaa

SEQ ID NO: 2897514 - RNA, 22 nt, Human
cuggaguuuuuguuuggagagc

SEQ ID NO: 2897515 - RNA, 23 nt, Human
cuggaguuuuuguuuggagagca

SEQ ID NO: 2897516 - RNA, 13 nt, Human
cuggaguuucaug

SEQ ID NO: 2897517 - RNA, 22 nt, Human
cuggaguuucauguacaagaug

SEQ ID NO: 2897518 - RNA, 14 nt, Human
cuggaguuugggau

SEQ ID NO: 2897519 - RNA, 20 nt, Human
cuggaguuugggaucccugu

SEQ ID NO: 2897520 - RNA, 20 nt, Human
cuggaucacgacgcugcaga

SEQ ID NO: 2897521 - RNA, 21 nt, Human
cuggaucacgacgcugcagag

SEQ ID NO: 2897522 - RNA, 24 nt, Human
cuggaucacgacgcugcagagcac

SEQ ID NO: 2897523 - RNA, 20 nt, Human
cuggauaggagccugcuggu

SEQ ID NO: 2897524 - RNA, 18 nt, Human
cuggauaggagccugcug

SEQ ID NO: 2897525 - RNA, 19 nt, Human
cuggauaggagccugcugg

SEQ ID NO: 2897526 - RNA, 14 nt, Human
cuggaguugcauug

SEQ ID NO: 2897527 - RNA, 15 nt, Human
cuggaguugcauuga

SEQ ID NO: 2897528 - RNA, 18 nt, Human
cuggacuuuccuguuguc

SEQ ID NO: 2897529 - RNA, 20 nt, Human
cuggacuugagcuuggcagc

SEQ ID NO: 2897530 - RNA, 18 nt, Human
cuggacuugagcuuggca

SEQ ID NO: 2897531 - RNA, 21 nt, Human
cugcuuuugucuaugggacuc

SEQ ID NO: 2897532 - RNA, 19 nt, Human
cugcuuuugucuaugggac

SEQ ID NO: 2897533 - RNA, 12 nt, Human
cuggaagaaaaa

SEQ ID NO: 2897534 - RNA, 14 nt, Human
cuggaagaaaaaaa

SEQ ID NO: 2897535 - RNA, 18 nt, Human
cuggaagaaaaaaaccac

SEQ ID NO: 2897536 - RNA, 19 nt, Human
cugcuucaaucccagccua

SEQ ID NO: 2897537 - RNA, 20 nt, Human
cugcuucagauguggagcca

SEQ ID NO: 2897538 - RNA, 21 nt, Human
cugcuucagauguggagccag

SEQ ID NO: 2897539 - RNA, 13 nt, Human
cuggaagacagag

SEQ ID NO: 2897540 - RNA, 21 nt, Human
cuggaagacagagaccuccug

SEQ ID NO: 2897541 - RNA, 15 nt, Human
cuggacucugcaucc

SEQ ID NO: 2897542 - RNA, 18 nt, Human
cuggacucugcaucccag

SEQ ID NO: 2897543 - RNA, 23 nt, Human
cuggacucugcaucccagcaccu

SEQ ID NO: 2897544 - RNA, 24 nt, Human
cuggacucugcaucccagcaccug

SEQ ID NO: 2897545 - RNA, 12 nt, Human
cuggacugacag

SEQ ID NO: 2897546 - RNA, 13 nt, Human
cuggacugacagc

SEQ ID NO: 2897547 - RNA, 15 nt, Human
cuggacugacagcau

SEQ ID NO: 2897548 - RNA, 16 nt, Human
cuggacugacagcaug

SEQ ID NO: 2897549 - RNA, 17 nt, Human
cuggacugacagcaugu

SEQ ID NO: 2897550 - RNA, 21 nt, Human
cuggacugacagcaugugccc

SEQ ID NO: 2897551 - RNA, 14 nt, Human
cuggacucuucaaa

SEQ ID NO: 2897552 - RNA, 22 nt, Human
cuggacucuucaaaaacuguuu

SEQ ID NO: 2897553 - RNA, 23 nt, Human
cuggacucuucaaaaacuguuuu

SEQ ID NO: 2897554 - RNA, 20 nt, Human
cugggcaccggggccucgga

SEQ ID NO: 2897555 - RNA, 12 nt, Human
cugggcacuucc

SEQ ID NO: 2897556 - RNA, 13 nt, Human
cugggcacuuccc

SEQ ID NO: 2897557 - RNA, 16 nt, Human
cugggcacuucccugc

SEQ ID NO: 2897558 - RNA, 17 nt, Human
cugggcacuucccugcu

SEQ ID NO: 2897559 - RNA, 18 nt, Human
cugggcacuucccugcug

SEQ ID NO: 2897560 - RNA, 22 nt, Human
cugggcacuucccugcugccug

SEQ ID NO: 2897561 - RNA, 14 nt, Human
cuggggagaaagua

SEQ ID NO: 2897562 - RNA, 16 nt, Human
cuggggagaggaaaga

SEQ ID NO: 2897563 - RNA, 13 nt, Human
cugggccagagua

SEQ ID NO: 2897564 - RNA, 13 nt, Human
cugggccaggguc

SEQ ID NO: 2897565 - RNA, 14 nt, Human
cugggccagggucu

SEQ ID NO: 2897566 - RNA, 15 nt, Human
cugggccagggucug

SEQ ID NO: 2897567 - RNA, 17 nt, Human
cugggccagggucugug

SEQ ID NO: 2897568 - RNA, 19 nt, Human
cugggccagggucugugug

SEQ ID NO: 2897569 - RNA, 20 nt, Human
cugggccagggucuguguga

SEQ ID NO: 2897570 - RNA, 14 nt, Human
cugggccagaauuu

SEQ ID NO: 2897571 - RNA, 20 nt, Human
cugggccaaguuccucuagu

SEQ ID NO: 2897572 - RNA, 18 nt, Human
cugggccaaguuccucua

SEQ ID NO: 2897573 - RNA, 15 nt, Human
cugggccaaguuccu

SEQ ID NO: 2897574 - RNA, 19 nt, Human
cugggccaacucaccugag

SEQ ID NO: 2897575 - RNA, 21 nt, Human
cugggccaaguuccucuagug

SEQ ID NO: 2897576 - RNA, 20 nt, Human
cugggccaauucaauacaaa

SEQ ID NO: 2897577 - RNA, 22 nt, Human
cugggccaauucaauacaaaca

SEQ ID NO: 2897578 - RNA, 23 nt, Human
cugggccaauucaauacaaacaa

SEQ ID NO: 2897579 - RNA, 12 nt, Human
cugggccagaau

SEQ ID NO: 2897580 - RNA, 15 nt, Human
cuggggcaggcuggg

SEQ ID NO: 2897581 - RNA, 14 nt, Human
cuggggcaggcugg

SEQ ID NO: 2897582 - RNA, 12 nt, Human
cuggggcaggcu

SEQ ID NO: 2897583 - RNA, 14 nt, Human
cuggggcaggcugc

SEQ ID NO: 2897584 - RNA, 18 nt, Human
cuggggcaggcugcuuca

SEQ ID NO: 2897585 - RNA, 20 nt, Human
cuggggagcccgucucagug

SEQ ID NO: 2897586 - RNA, 14 nt, Human
cuggggaggaccug

SEQ ID NO: 2897587 - RNA, 12 nt, Human
cuggggaggagc

SEQ ID NO: 2897588 - RNA, 12 nt, Human
cuggggagcccg

SEQ ID NO: 2897589 - RNA, 15 nt, Human
cuggggagcccgucu

SEQ ID NO: 2897590 - RNA, 15 nt, Human
cuggguucacugcaa

SEQ ID NO: 2897591 - RNA, 23 nt, Human
cuggguggccucgggacaccugc

SEQ ID NO: 2897592 - RNA, 19 nt, Human
cuggguggccucgggacac

SEQ ID NO: 2897593 - RNA, 20 nt, Human
cuggguucacugcaaccucc

SEQ ID NO: 2897594 - RNA, 18 nt, Human
cuggguucacugcaaccu

SEQ ID NO: 2897595 - RNA, 16 nt, Human
cuggucuugaaguccu

SEQ ID NO: 2897596 - RNA, 18 nt, Human
cuggucuugaaguccugg

SEQ ID NO: 2897597 - RNA, 21 nt, Human
cuggucuugaaguccuggcuu

SEQ ID NO: 2897598 - RNA, 22 nt, Human
cuggucuugaaguccuggcuuc

SEQ ID NO: 2897599 - RNA, 17 nt, Human
cuggguuccaauccugg

SEQ ID NO: 2897600 - RNA, 19 nt, Human
cuggggcaggcugggccau

SEQ ID NO: 2897601 - RNA, 18 nt, Human
cuggggcaggcugggcca

SEQ ID NO: 2897602 - RNA, 17 nt, Human
cuggggcaggcugggcc

SEQ ID NO: 2897603 - RNA, 16 nt, Human
cuggggcaggcugggc

SEQ ID NO: 2897604 - RNA, 21 nt, Human
cuggggcaggcugggccaugu

SEQ ID NO: 2897605 - RNA, 12 nt, Human
cuggggccaggc

SEQ ID NO: 2897606 - RNA, 13 nt, Human
cuggggccaggcc

SEQ ID NO: 2897607 - RNA, 14 nt, Human
cuggggccaggccg

SEQ ID NO: 2897608 - RNA, 16 nt, Human
cuggguggccucggga

SEQ ID NO: 2897609 - RNA, 19 nt, Human
cuggggcucugugcaggga

SEQ ID NO: 2897610 - RNA, 17 nt, Human
cuggggcucugugcagg

SEQ ID NO: 2897611 - RNA, 14 nt, Human
cuggggcucugugc

SEQ ID NO: 2897612 - RNA, 16 nt, Human
cuggcagcccagagac

SEQ ID NO: 2897613 - RNA, 13 nt, Human
cuggcagcccaga

SEQ ID NO: 2897614 - RNA, 12 nt, Human
cuggcagcccag

SEQ ID NO: 2897615 - RNA, 19 nt, Human
cuggcagccgugccuucag

SEQ ID NO: 2897616 - RNA, 20 nt, Human
cuggcagccgugccuucagc

SEQ ID NO: 2897617 - RNA, 21 nt, Human
cuggcagccgugccuucagcu

SEQ ID NO: 2897618 - RNA, 22 nt, Human
cuggcagccgugccuucagcuc

SEQ ID NO: 2897619 - RNA, 14 nt, Human
cuggcagaggaggg

SEQ ID NO: 2897620 - RNA, 15 nt, Human
cuggcagacugugua

SEQ ID NO: 2897621 - RNA, 23 nt, Human
cuggcagacuguguaaaauguaa

SEQ ID NO: 2897622 - RNA, 17 nt, Human
cuggcagaagggagcag

SEQ ID NO: 2897623 - RNA, 13 nt, Human
cuggccguacuug

SEQ ID NO: 2897624 - RNA, 11 nt, Human
cugggacacag

SEQ ID NO: 2897625 - RNA, 24 nt, Human
cuggcucugcaaugggcacuggga

SEQ ID NO: 2897626 - RNA, 14 nt, Human
cuggcucugcuguc

SEQ ID NO: 2897627 - RNA, 15 nt, Human
cuggcucugcugucc

SEQ ID NO: 2897628 - RNA, 18 nt, Human
cuggcucugcaaugggca

SEQ ID NO: 2897629 - RNA, 14 nt, Human
cugggacuggccag

SEQ ID NO: 2897630 - RNA, 13 nt, Human
cugggacuggcca

SEQ ID NO: 2897631 - RNA, 16 nt, Human
cugggacacaaaacuc

SEQ ID NO: 2897632 - RNA, 21 nt, Human
cugggacacaaaacuccgccc

SEQ ID NO: 2897633 - RNA, 22 nt, Human
cuggcagcccagagacuuugua

SEQ ID NO: 2897634 - RNA, 14 nt, Human
cuggccccucgccu

SEQ ID NO: 2897635 - RNA, 15 nt, Human
cuggccccucgccug

SEQ ID NO: 2897636 - RNA, 24 nt, Human
cuggccccucgccuguggagcuca

SEQ ID NO: 2897637 - RNA, 12 nt, Human
cuggccccuggg

SEQ ID NO: 2897638 - RNA, 13 nt, Human
cuggccccugggu

SEQ ID NO: 2897639 - RNA, 14 nt, Human
cuggccccuggguc

SEQ ID NO: 2897640 - RNA, 17 nt, Human
cuggccccuuugggccc

SEQ ID NO: 2897641 - RNA, 20 nt, Human
cuggccccuuugggcccugc

SEQ ID NO: 2897642 - RNA, 21 nt, Human
cuggccccuuugggcccugca

SEQ ID NO: 2897643 - RNA, 22 nt, Human
cuggccccuuugggcccugcau

SEQ ID NO: 2897644 - RNA, 23 nt, Human
cuggccccuuugggcccugcaug

SEQ ID NO: 2897645 - RNA, 14 nt, Human
cuggcccugcccug

SEQ ID NO: 2897646 - RNA, 15 nt, Human
cuggcccugcccuga

SEQ ID NO: 2897647 - RNA, 16 nt, Human
cuggcccugcccugag

SEQ ID NO: 2897648 - RNA, 17 nt, Human
cuggcccugcccugagg

SEQ ID NO: 2897649 - RNA, 13 nt, Human
cuggcccugcccu

SEQ ID NO: 2897650 - RNA, 11 nt, Human
cuggcccugcc

SEQ ID NO: 2897651 - RNA, 15 nt, Human
cuggccgugggccug

SEQ ID NO: 2897652 - RNA, 23 nt, Human
cuggccguugauguuggcuggga

SEQ ID NO: 2897653 - RNA, 16 nt, Human
cuggccuaaaaucuug

SEQ ID NO: 2897654 - RNA, 19 nt, Human
cuggccuaaaaucuuggaa

SEQ ID NO: 2897655 - RNA, 20 nt, Human
cuggccuaaaaucuuggaag

SEQ ID NO: 2897656 - RNA, 21 nt, Human
cuggccuaaaaucuuggaagu

SEQ ID NO: 2897657 - RNA, 16 nt, Human
cuggccgggagccuga

SEQ ID NO: 2897658 - RNA, 15 nt, Human
cuggcccugcccugg

SEQ ID NO: 2897659 - RNA, 20 nt, Human
cuggcucucccauuuccuga

SEQ ID NO: 2897660 - RNA, 22 nt, Human
cuggccguugauguuggcuggg

SEQ ID NO: 2897661 - RNA, 17 nt, Human
cuggcucucaugggguc

SEQ ID NO: 2897662 - RNA, 18 nt, Human
cuuccugacgaaacuggc

SEQ ID NO: 2897663 - RNA, 14 nt, Human
cuuccugagcuuua

SEQ ID NO: 2897664 - RNA, 15 nt, Human
cuuccugagcuuuau

SEQ ID NO: 2897665 - RNA, 20 nt, Human
cuucuagguggcaaggcugu

SEQ ID NO: 2897666 - RNA, 16 nt, Human
cuucucuuaaacuugu

SEQ ID NO: 2897667 - RNA, 19 nt, Human
cuucucuuaaacuugugaa

SEQ ID NO: 2897668 - RNA, 20 nt, Human
cuucucuuaaacuugugaau

SEQ ID NO: 2897669 - RNA, 13 nt, Human
cuucucugugacc

SEQ ID NO: 2897670 - RNA, 20 nt, Human
cuucucugugacccacuucu

SEQ ID NO: 2897671 - RNA, 14 nt, Human
cuucucugucucag

SEQ ID NO: 2897672 - RNA, 11 nt, Human
cuucucuguga

SEQ ID NO: 2897673 - RNA, 22 nt, Human
cuucuagguggcaaggcugugc

SEQ ID NO: 2897674 - RNA, 18 nt, Human
cuucucacagcacaugcu

SEQ ID NO: 2897675 - RNA, 19 nt, Human
cuucucacagcacaugcug

SEQ ID NO: 2897676 - RNA, 23 nt, Human
cuucucacagcacaugcuggcca

SEQ ID NO: 2897677 - RNA, 16 nt, Human
cuuccucucuccagau

SEQ ID NO: 2897678 - RNA, 16 nt, Human
cuuccucugaggcuga

SEQ ID NO: 2897679 - RNA, 22 nt, Human
cuuccucugaggcugaaauuca

SEQ ID NO: 2897680 - RNA, 15 nt, Human
cuuccucucuccaga

SEQ ID NO: 2897681 - RNA, 12 nt, Human
cuuccucuccuu

SEQ ID NO: 2897682 - RNA, 15 nt, Human
cuuccucuccuuccu

SEQ ID NO: 2897683 - RNA, 16 nt, Human
cuuccucuccuuccuu

SEQ ID NO: 2897684 - RNA, 17 nt, Human
cuuccucuccuuccuug

SEQ ID NO: 2897685 - RNA, 15 nt, Human
cuuccucugagccuu

SEQ ID NO: 2897686 - RNA, 14 nt, Human
cuuccucugagccu

SEQ ID NO: 2897687 - RNA, 13 nt, Human
cuuccucuccacu

SEQ ID NO: 2897688 - RNA, 14 nt, Human
cuuccucuccacug

SEQ ID NO: 2897689 - RNA, 15 nt, Human
cuuccucuccacugc

SEQ ID NO: 2897690 - RNA, 16 nt, Human
cuucucuuguuaggua

SEQ ID NO: 2897691 - RNA, 13 nt, Human
cuucucuugcuuu

SEQ ID NO: 2897692 - RNA, 15 nt, Human
cuucucuugcuuucu

SEQ ID NO: 2897693 - RNA, 16 nt, Human
cuucucuugcuuucua

SEQ ID NO: 2897694 - RNA, 17 nt, Human
cuucucuugcuuucuau

SEQ ID NO: 2897695 - RNA, 20 nt, Human
cuucugaaugugcugaucau

SEQ ID NO: 2897696 - RNA, 21 nt, Human
cuucugaaugugcugaucauu

SEQ ID NO: 2897697 - RNA, 16 nt, Human
cuucugacaaacugug

SEQ ID NO: 2897698 - RNA, 14 nt, Human
cuucugaauauuuu

SEQ ID NO: 2897699 - RNA, 15 nt, Human
cuucugaauauuuua

SEQ ID NO: 2897700 - RNA, 18 nt, Human
cuucugaauauuuuaucu

SEQ ID NO: 2897701 - RNA, 19 nt, Human
cuucuuaaauaucuuuuau

SEQ ID NO: 2897702 - RNA, 22 nt, Human
cuucuuaaauaucuuuuauguu

SEQ ID NO: 2897703 - RNA, 12 nt, Human
cuucuuaauuaa

SEQ ID NO: 2897704 - RNA, 14 nt, Human
cuucuuaauuaauu

SEQ ID NO: 2897705 - RNA, 16 nt, Human
cuucuuaauuaauuug

SEQ ID NO: 2897706 - RNA, 17 nt, Human
cuucuuaauuaauuuga

SEQ ID NO: 2897707 - RNA, 18 nt, Human
cuucuuaauuaauuugau

SEQ ID NO: 2897708 - RNA, 21 nt, Human
cuucuuaauuaauuugauuaa

SEQ ID NO: 2897709 - RNA, 22 nt, Human
cuucuuaauuaauuugauuaac

SEQ ID NO: 2897710 - RNA, 13 nt, Human
cuugaagggccca

SEQ ID NO: 2897711 - RNA, 14 nt, Human
cuugaagggcccag

SEQ ID NO: 2897712 - RNA, 15 nt, Human
cuugaagggcccagg

SEQ ID NO: 2897713 - RNA, 16 nt, Human
cuugaagggcccagga

SEQ ID NO: 2897714 - RNA, 20 nt, Human
cuugacagggcacaccgggc

SEQ ID NO: 2897715 - RNA, 15 nt, Human
cuugaaugugucagg

SEQ ID NO: 2897716 - RNA, 20 nt, Human
cuugaauguggcuugagaaa

SEQ ID NO: 2897717 - RNA, 22 nt, Human
cuugaauguggcuugagaaaua

SEQ ID NO: 2897718 - RNA, 17 nt, Human
cuugaauguggucucag

SEQ ID NO: 2897719 - RNA, 18 nt, Human
cuugaauguggucucagg

SEQ ID NO: 2897720 - RNA, 19 nt, Human
cuugaauguggucucagga

SEQ ID NO: 2897721 - RNA, 20 nt, Human
cuugaauguggucucaggau

SEQ ID NO: 2897722 - RNA, 21 nt, Human
cuugaauguggucucaggaua

SEQ ID NO: 2897723 - RNA, 19 nt, Human
cuugaauguggcuugagaa

SEQ ID NO: 2897724 - RNA, 13 nt, Human
cuugaaugucuuu

SEQ ID NO: 2897725 - RNA, 16 nt, Human
cuugaauguagcagcc

SEQ ID NO: 2897726 - RNA, 20 nt, Human
cuugaauguagcagccccgg

SEQ ID NO: 2897727 - RNA, 21 nt, Human
cuugaauguagcagccccggg

SEQ ID NO: 2897728 - RNA, 23 nt, Human
cuugaaugccauagucaaagaga

SEQ ID NO: 2897729 - RNA, 13 nt, Human
cuugaaugcugcc

SEQ ID NO: 2897730 - RNA, 14 nt, Human
cuugaaugcugcca

SEQ ID NO: 2897731 - RNA, 15 nt, Human
cuugaaugcugccag

SEQ ID NO: 2897732 - RNA, 16 nt, Human
cuugaaugcugccagu

SEQ ID NO: 2897733 - RNA, 13 nt, Human
cuugauauuuucu

SEQ ID NO: 2897734 - RNA, 14 nt, Human
cuugauauuuucua

SEQ ID NO: 2897735 - RNA, 16 nt, Human
cuugaucauuuuggga

SEQ ID NO: 2897736 - RNA, 18 nt, Human
cuugauucacaaugaaau

SEQ ID NO: 2897737 - RNA, 16 nt, Human
cuugauuauccauauu

SEQ ID NO: 2897738 - RNA, 15 nt, Human
cuugauuaagauuuu

SEQ ID NO: 2897739 - RNA, 18 nt, Human
cuugauuaagauuuuaca

SEQ ID NO: 2897740 - RNA, 20 nt, Human
cuugauuaagauuuuacaaa

SEQ ID NO: 2897741 - RNA, 21 nt, Human
cuugauuaagauuuuacaaaa

SEQ ID NO: 2897742 - RNA, 22 nt, Human
cuugauuaagauuuuacaaaag

SEQ ID NO: 2897743 - RNA, 22 nt, Human
cuuggccugucucauccccagg

SEQ ID NO: 2897744 - RNA, 17 nt, Human
cuuggccugucucaucc

SEQ ID NO: 2897745 - RNA, 23 nt, Human
cuuggccugucucauccccaggg

SEQ ID NO: 2897746 - RNA, 17 nt, Human
cuugcuaauuuucucaa

SEQ ID NO: 2897747 - RNA, 19 nt, Human
cuugacaucuggaaaccuc

SEQ ID NO: 2897748 - RNA, 24 nt, Human
cuugauuugaguugauugagaaga

SEQ ID NO: 2897749 - RNA, 14 nt, Human
cuugcucauuaauu

SEQ ID NO: 2897750 - RNA, 16 nt, Human
cuugcucauuaauuuu

SEQ ID NO: 2897751 - RNA, 20 nt, Human
cuugcuagcuaugugaccuu

SEQ ID NO: 2897752 - RNA, 23 nt, Human
cuugcuagcuaugugaccuugag

SEQ ID NO: 2897753 - RNA, 17 nt, Human
cuugcuauauugcccag

SEQ ID NO: 2897754 - RNA, 22 nt, Human
cuugcuauauugcccaggcugg

SEQ ID NO: 2897755 - RNA, 23 nt, Human
cuugcuauauugcccaggcuggu

SEQ ID NO: 2897756 - RNA, 21 nt, Human
cuugcuaucggggaagccaga

SEQ ID NO: 2897757 - RNA, 20 nt, Human
cuuggcaacagaagcaguug

SEQ ID NO: 2897758 - RNA, 18 nt, Human
cuuggccuagcccacccu

SEQ ID NO: 2897759 - RNA, 20 nt, Human
cuuggccuagcccacccugc

SEQ ID NO: 2897760 - RNA, 21 nt, Human
cuuggccuagcccacccugcu

SEQ ID NO: 2897761 - RNA, 13 nt, Human
cuuggccuaucuc

SEQ ID NO: 2897762 - RNA, 21 nt, Human
cuuggccuaucuccuagggcu

SEQ ID NO: 2897763 - RNA, 11 nt, Human
cuuggccucag

SEQ ID NO: 2897764 - RNA, 15 nt, Human
cuuggcaacagaagc

SEQ ID NO: 2897765 - RNA, 15 nt, Human
cuugcucccuguguc

SEQ ID NO: 2897766 - RNA, 20 nt, Human
cuugcucccuguguccaccu

SEQ ID NO: 2897767 - RNA, 13 nt, Human
cuugcucccuuca

SEQ ID NO: 2897768 - RNA, 15 nt, Human
cuuggcaaaagccuu

SEQ ID NO: 2897769 - RNA, 16 nt, Human
cuuggcaaaagccuug

SEQ ID NO: 2897770 - RNA, 17 nt, Human
cuuggcaaaagccuugu

SEQ ID NO: 2897771 - RNA, 18 nt, Human
cuuggcaaaagccuugug

SEQ ID NO: 2897772 - RNA, 20 nt, Human
cuuggcaaaagccuugugua

SEQ ID NO: 2897773 - RNA, 21 nt, Human
cuuggcaaaagccuuguguau

SEQ ID NO: 2897774 - RNA, 23 nt, Human
cuuggcaaaagccuuguguauau

SEQ ID NO: 2897775 - RNA, 23 nt, Human
cuuggccucagaauucacaaaau

SEQ ID NO: 2897776 - RNA, 12 nt, Human
cuuggccucaga

SEQ ID NO: 2897777 - RNA, 14 nt, Human
cuuggccucccaag

SEQ ID NO: 2897778 - RNA, 16 nt, Human
cuuucaccuuugugua

SEQ ID NO: 2897779 - RNA, 17 nt, Human
cuuuaccccaucccugu

SEQ ID NO: 2897780 - RNA, 17 nt, Human
cuuuacccaccuagaac

SEQ ID NO: 2897781 - RNA, 19 nt, Human
cuuuacccaccuagaacac

SEQ ID NO: 2897782 - RNA, 18 nt, Human
cuuuacccaccuagaaca

SEQ ID NO: 2897783 - RNA, 23 nt, Human
cuuucaccccagggccugagccu

SEQ ID NO: 2897784 - RNA, 22 nt, Human
cuuucaccccagggccugagcc

SEQ ID NO: 2897785 - RNA, 14 nt, Human
cuuuaccaaacagc

SEQ ID NO: 2897786 - RNA, 16 nt, Human
cuuuaccaaacagcaa

SEQ ID NO: 2897787 - RNA, 18 nt, Human
cuuuaccaaacagcaaac

SEQ ID NO: 2897788 - RNA, 20 nt, Human
cuuuaccaaacagcaaacca

SEQ ID NO: 2897789 - RNA, 23 nt, Human
cuuuaccaaacagcaaaccaaga

SEQ ID NO: 2897790 - RNA, 17 nt, Human
cuuuacaugcaauuuau

SEQ ID NO: 2897791 - RNA, 14 nt, Human
cuuuacaugcaauu

SEQ ID NO: 2897792 - RNA, 19 nt, Human
cuuuacaugcaauuuauua

SEQ ID NO: 2897793 - RNA, 23 nt, Human
cuuuaaugucacaggcaggucca

SEQ ID NO: 2897794 - RNA, 15 nt, Human
cuugugccugggagu

SEQ ID NO: 2897795 - RNA, 21 nt, Human
cuugugcuggauggagcccag

SEQ ID NO: 2897796 - RNA, 22 nt, Human
cuugugcuggauggagcccagg

SEQ ID NO: 2897797 - RNA, 23 nt, Human
cuugugcuggauggagcccaggc

SEQ ID NO: 2897798 - RNA, 14 nt, Human
cuugugcuuugcuc

SEQ ID NO: 2897799 - RNA, 16 nt, Human
cuugugcuuugcucuu

SEQ ID NO: 2897800 - RNA, 17 nt, Human
cuugugcuuugcucuug

SEQ ID NO: 2897801 - RNA, 23 nt, Human
cuugugcuuugcucuugucccac

SEQ ID NO: 2897802 - RNA, 19 nt, Human
cuugugccauagucacaug

SEQ ID NO: 2897803 - RNA, 11 nt, Human
cuugugccaua

SEQ ID NO: 2897804 - RNA, 18 nt, Human
cuugugccaacacucaag

SEQ ID NO: 2897805 - RNA, 17 nt, Human
cuugugccacacccucc

SEQ ID NO: 2897806 - RNA, 12 nt, Human
cuuuaauuuaug

SEQ ID NO: 2897807 - RNA, 15 nt, Human
cuuuaauuuauguaa

SEQ ID NO: 2897808 - RNA, 19 nt, Human
cuuuaauucucuuucaaag

SEQ ID NO: 2897809 - RNA, 21 nt, Human
cuuuacagguauuuauaauau

SEQ ID NO: 2897810 - RNA, 18 nt, Human
cuuuaauuucugucagaa

SEQ ID NO: 2897811 - RNA, 21 nt, Human
cuuuaauuucugucagaaugc

SEQ ID NO: 2897812 - RNA, 18 nt, Human
cuuguggaauugggagcu

SEQ ID NO: 2897813 - RNA, 20 nt, Human
cuugugcuuuuccuauuugu

SEQ ID NO: 2897814 - RNA, 13 nt, Human
cuuggucugccag

SEQ ID NO: 2897815 - RNA, 17 nt, Human
cuuggucugccaggccc

SEQ ID NO: 2897816 - RNA, 20 nt, Human
cuuggucugccaggccccca

SEQ ID NO: 2897817 - RNA, 18 nt, Human
cuugguccaacugcaacu

SEQ ID NO: 2897818 - RNA, 15 nt, Human
cuugguaagaagccg

SEQ ID NO: 2897819 - RNA, 23 nt, Human
cuuggguucaagugauucuccug

SEQ ID NO: 2897820 - RNA, 22 nt, Human
cuugguaaaguccuuuucuugc

SEQ ID NO: 2897821 - RNA, 19 nt, Human
cuuggguagaguuuacagc

SEQ ID NO: 2897822 - RNA, 22 nt, Human
cuuggguagaguuuacagcucu

SEQ ID NO: 2897823 - RNA, 23 nt, Human
cuuggguagaguuuacagcucug

SEQ ID NO: 2897824 - RNA, 17 nt, Human
cuugucuauuuuugucu

SEQ ID NO: 2897825 - RNA, 16 nt, Human
cuugguggcuuauggg

SEQ ID NO: 2897826 - RNA, 13 nt, Human
cuuggugcuggga

SEQ ID NO: 2897827 - RNA, 14 nt, Human
cuuggugcugggaa

SEQ ID NO: 2897828 - RNA, 15 nt, Human
cuuggugcugggaac

SEQ ID NO: 2897829 - RNA, 22 nt, Human
cuuggugaauuuuuuuuuccua

SEQ ID NO: 2897830 - RNA, 20 nt, Human
cuuggugaauuuuuuuuucc

SEQ ID NO: 2897831 - RNA, 16 nt, Human
cuuggucuuuguaucu

SEQ ID NO: 2897832 - RNA, 18 nt, Human
cuugugaaaauguguucu

SEQ ID NO: 2897833 - RNA, 14 nt, Human
cuugugaaacacag

SEQ ID NO: 2897834 - RNA, 16 nt, Human
cuugugaaacacagcu

SEQ ID NO: 2897835 - RNA, 17 nt, Human
cuugugaaacacagcug

SEQ ID NO: 2897836 - RNA, 18 nt, Human
cuugugaaacacagcugu

SEQ ID NO: 2897837 - RNA, 19 nt, Human
cuugugaaacacagcuguu

SEQ ID NO: 2897838 - RNA, 20 nt, Human
cuugugaaacacagcuguuc

SEQ ID NO: 2897839 - RNA, 12 nt, Human
cuugugaacaga

SEQ ID NO: 2897840 - RNA, 10 nt, Human
cuugugaagg

SEQ ID NO: 2897841 - RNA, 16 nt, Human
cuugugaaggccauga

SEQ ID NO: 2897842 - RNA, 20 nt, Human
cuugugaaggccaugauauu

SEQ ID NO: 2897843 - RNA, 21 nt, Human
cuugugaaggccaugauauuu

SEQ ID NO: 2897844 - RNA, 14 nt, Human
cuugugaaaaugug

SEQ ID NO: 2897845 - RNA, 13 nt, Human
cuugugaaaaugu

SEQ ID NO: 2897846 - RNA, 16 nt, Human
cuugugaaaauguguu

SEQ ID NO: 2897847 - RNA, 23 nt, Human
cuugguauuuuucagagauuuau

SEQ ID NO: 2897848 - RNA, 22 nt, Human
cuugugacagcucuuuuuguga

SEQ ID NO: 2897849 - RNA, 15 nt, Human
cuugugaaugcuucu

SEQ ID NO: 2897850 - RNA, 16 nt, Human
cuugugaaugcuucuc

SEQ ID NO: 2897851 - RNA, 17 nt, Human
cuugugaaugcuucuca

SEQ ID NO: 2897852 - RNA, 19 nt, Human
cuugugaaugcuucucacu

SEQ ID NO: 2897853 - RNA, 19 nt, Human
cuuuguacagagugcuuuu

SEQ ID NO: 2897854 - RNA, 15 nt, Human
cuuuguacagcccag

SEQ ID NO: 2897855 - RNA, 13 nt, Human
cuuuguauucaaa

SEQ ID NO: 2897856 - RNA, 20 nt, Human
cuuuguaugucauuuccuuc

SEQ ID NO: 2897857 - RNA, 22 nt, Human
cuuuuauaacuaguccuuuacu

SEQ ID NO: 2897858 - RNA, 12 nt, Human
cuuuguaugcac

SEQ ID NO: 2897859 - RNA, 18 nt, Human
cuuuguaucauucaucuu

SEQ ID NO: 2897860 - RNA, 19 nt, Human
cuuuguaucauucaucuuc

SEQ ID NO: 2897861 - RNA, 15 nt, Human
cuuuguaucuuccau

SEQ ID NO: 2897862 - RNA, 23 nt, Human
cuuuguaucuuccauauuuggaa

SEQ ID NO: 2897863 - RNA, 15 nt, Human
cuuuguacagagugc

SEQ ID NO: 2897864 - RNA, 19 nt, Human
cuuugguuggcagcauucc

SEQ ID NO: 2897865 - RNA, 14 nt, Human
cuuugguucuggcc

SEQ ID NO: 2897866 - RNA, 19 nt, Human
cuuugguucuggccagaau

SEQ ID NO: 2897867 - RNA, 13 nt, Human
cuuugguucuaag

SEQ ID NO: 2897868 - RNA, 14 nt, Human
cuuugguucuaagg

SEQ ID NO: 2897869 - RNA, 15 nt, Human
cuuugguucuaagga

SEQ ID NO: 2897870 - RNA, 21 nt, Human
cuuugguucuggccagaaugc

SEQ ID NO: 2897871 - RNA, 16 nt, Human
cuuugguucuaaggac

SEQ ID NO: 2897872 - RNA, 16 nt, Human
cuuugguuucugucug

SEQ ID NO: 2897873 - RNA, 19 nt, Human
cuuugagaagccuucagcu

SEQ ID NO: 2897874 - RNA, 17 nt, Human
cuuugagaagccuucag

SEQ ID NO: 2897875 - RNA, 15 nt, Human
cuuugagaagccuuc

SEQ ID NO: 2897876 - RNA, 22 nt, Human
cuuugagaagccuucagcucca

SEQ ID NO: 2897877 - RNA, 13 nt, Human
cuuugagacaguu

SEQ ID NO: 2897878 - RNA, 15 nt, Human
cuuugagacaguuuc

SEQ ID NO: 2897879 - RNA, 16 nt, Human
cuuugagacaguuucu

SEQ ID NO: 2897880 - RNA, 17 nt, Human
cuuugagacugggucuc

SEQ ID NO: 2897881 - RNA, 17 nt, Human
cuuugagacaguuucuu

SEQ ID NO: 2897882 - RNA, 18 nt, Human
cuuugagacaguuucuua

SEQ ID NO: 2897883 - RNA, 22 nt, Human
cuuugauucuccuuuuaugugu

SEQ ID NO: 2897884 - RNA, 23 nt, Human
cuuugauucuccuuuuaugugua

SEQ ID NO: 2897885 - RNA, 14 nt, Human
cuuugauugcacau

SEQ ID NO: 2897886 - RNA, 18 nt, Human
cuuugauugcacauuguu

SEQ ID NO: 2897887 - RNA, 21 nt, Human
cuuugauugcacauuguuguu

SEQ ID NO: 2897888 - RNA, 13 nt, Human
cuuugauuuacag

SEQ ID NO: 2897889 - RNA, 18 nt, Human
cuuugauuuacagcaagu

SEQ ID NO: 2897890 - RNA, 14 nt, Human
cuuugguucagcua

SEQ ID NO: 2897891 - RNA, 12 nt, Human
cuuugauuucca

SEQ ID NO: 2897892 - RNA, 20 nt, Human
cuuugauuuccaaguaauau

SEQ ID NO: 2897893 - RNA, 18 nt, Human
cuuugcacagcucuccgg

SEQ ID NO: 2897894 - RNA, 16 nt, Human
cuuugcacaggaugcu

SEQ ID NO: 2897895 - RNA, 20 nt, Human
cuuugcacaggaugcuggcc

SEQ ID NO: 2897896 - RNA, 14 nt, Human
cuuugcacauuuug

SEQ ID NO: 2897897 - RNA, 15 nt, Human
cuuugcacauuuuga

SEQ ID NO: 2897898 - RNA, 17 nt, Human
cuuugcacgacgcccuc

SEQ ID NO: 2897899 - RNA, 18 nt, Human
cuuugcacgacgcccucu

SEQ ID NO: 2897900 - RNA, 21 nt, Human
cuuugcacgacgcccucuccc

SEQ ID NO: 2897901 - RNA, 22 nt, Human
cuuugcacgacgcccucucccc

SEQ ID NO: 2897902 - RNA, 23 nt, Human
cuuugcacgacgcccucucccca

SEQ ID NO: 2897903 - RNA, 15 nt, Human
cuuugcaaaguauug

SEQ ID NO: 2897904 - RNA, 19 nt, Human
cuuugcaaaguauuguaaa

SEQ ID NO: 2897905 - RNA, 20 nt, Human
cuuugcaaaguauuguaaau

SEQ ID NO: 2897906 - RNA, 21 nt, Human
cuuugcaaaguauuguaaauu

SEQ ID NO: 2897907 - RNA, 22 nt, Human
cuuugcaaaguauuguaaauua

SEQ ID NO: 2897908 - RNA, 17 nt, Human
cuuucuaaugugugaau

SEQ ID NO: 2897909 - RNA, 15 nt, Human
cuuucuaauguuucu

SEQ ID NO: 2897910 - RNA, 23 nt, Human
cuuucuacaaagcacuagagaau

SEQ ID NO: 2897911 - RNA, 16 nt, Human
cuuucuacccagcgag

SEQ ID NO: 2897912 - RNA, 15 nt, Human
cuuucuacccagcga

SEQ ID NO: 2897913 - RNA, 17 nt, Human
cuuucuauuugacuugu

SEQ ID NO: 2897914 - RNA, 18 nt, Human
cuuucuauuugacuugug

SEQ ID NO: 2897915 - RNA, 15 nt, Human
cuuucuauuccaaag

SEQ ID NO: 2897916 - RNA, 21 nt, Human
cuuugacugaugcugagauuc

SEQ ID NO: 2897917 - RNA, 18 nt, Human
cuuugacuggagggucca

SEQ ID NO: 2897918 - RNA, 14 nt, Human
cuuugacuuucuuc

SEQ ID NO: 2897919 - RNA, 20 nt, Human
cuuugacgagucaccuucca

SEQ ID NO: 2897920 - RNA, 21 nt, Human
cuuugacgagucaccuuccag

SEQ ID NO: 2897921 - RNA, 21 nt, Human
cuuucucagccgcuucugacu

SEQ ID NO: 2897922 - RNA, 22 nt, Human
cuuucucagccgcuucugacug

SEQ ID NO: 2897923 - RNA, 14 nt, Human
cuuucuccaaaguu

SEQ ID NO: 2897924 - RNA, 15 nt, Human
cuuucuccaaaguua

SEQ ID NO: 2897925 - RNA, 20 nt, Human
cuuucuccaaaguuauccag

SEQ ID NO: 2897926 - RNA, 23 nt, Human
cuuucuccaaaguuauccagagg

SEQ ID NO: 2897927 - RNA, 13 nt, Human
cuuucuccaggac

SEQ ID NO: 2897928 - RNA, 14 nt, Human
cuuucuccaggacc

SEQ ID NO: 2897929 - RNA, 15 nt, Human
cuuucuccaggacca

SEQ ID NO: 2897930 - RNA, 18 nt, Human
cuuucucccacugaguuu

SEQ ID NO: 2897931 - RNA, 13 nt, Human
gaacuccuggccu

SEQ ID NO: 2897932 - RNA, 16 nt, Human
gaacccgggaggcaga

SEQ ID NO: 2897933 - RNA, 15 nt, Human
gaacuccugaccuca

SEQ ID NO: 2897934 - RNA, 14 nt, Human
gaacuccugaccuc

SEQ ID NO: 2897935 - RNA, 14 nt, Human
gaacuccuggccuc

SEQ ID NO: 2897936 - RNA, 19 nt, Human
gaaccccgucgaggggcuc

SEQ ID NO: 2897937 - RNA, 15 nt, Human
gaacucuuagaaaug

SEQ ID NO: 2897938 - RNA, 18 nt, Human
gaacucuuagaaaugaag

SEQ ID NO: 2897939 - RNA, 13 nt, Human
gaacucugggcuc

SEQ ID NO: 2897940 - RNA, 14 nt, Human
gaacucugggcuca

SEQ ID NO: 2897941 - RNA, 22 nt, Human
gaacucugggcucaagcaaucc

SEQ ID NO: 2897942 - RNA, 17 nt, Human
gaacugcacaugaagaa

SEQ ID NO: 2897943 - RNA, 18 nt, Human
gaacugcacaugaagaaa

SEQ ID NO: 2897944 - RNA, 20 nt, Human
gaacugcacaugaagaaaua

SEQ ID NO: 2897945 - RNA, 11 nt, Human
gaacugcagca

SEQ ID NO: 2897946 - RNA, 19 nt, Human
gaacugcagcaaucuuuga

SEQ ID NO: 2897947 - RNA, 20 nt, Human
gaacugcagcaaucuuugaa

SEQ ID NO: 2897948 - RNA, 21 nt, Human
gaacugcagcaaucuuugaaa

SEQ ID NO: 2897949 - RNA, 13 nt, Human
gaacugaaaagag

SEQ ID NO: 2897950 - RNA, 14 nt, Human
gaacugaaaagaga

SEQ ID NO: 2897951 - RNA, 17 nt, Human
gaacugaaaagagagca

SEQ ID NO: 2897952 - RNA, 18 nt, Human
gaacugaaaagagagcag

SEQ ID NO: 2897953 - RNA, 19 nt, Human
gaacugaaaagagagcaga

SEQ ID NO: 2897954 - RNA, 21 nt, Human
gaacugaaaagagagcagaga

SEQ ID NO: 2897955 - RNA, 18 nt, Human
gaacccagcaguucuguu

SEQ ID NO: 2897956 - RNA, 19 nt, Human
gaacccagcaguucuguua

SEQ ID NO: 2897957 - RNA, 12 nt, Human
gaacccagggcu

SEQ ID NO: 2897958 - RNA, 13 nt, Human
gaacccagggcuc

SEQ ID NO: 2897959 - RNA, 14 nt, Human
gaacccagggcucu

SEQ ID NO: 2897960 - RNA, 17 nt, Human
gaacccagggcucugcc

SEQ ID NO: 2897961 - RNA, 18 nt, Human
gaacccagggcucugccc

SEQ ID NO: 2897962 - RNA, 20 nt, Human
gaacccagggcucugcccca

SEQ ID NO: 2897963 - RNA, 21 nt, Human
gaacccagggcucugccccag

SEQ ID NO: 2897964 - RNA, 21 nt, Human
gaaccccuacaugaaacagaa

SEQ ID NO: 2897965 - RNA, 21 nt, Human
gaaccacgcgggggccuugag

SEQ ID NO: 2897966 - RNA, 21 nt, Human
gaaccauguugguugcacuuu

SEQ ID NO: 2897967 - RNA, 16 nt, Human
gaaccaugaagacagg

SEQ ID NO: 2897968 - RNA, 17 nt, Human
gaaccaugaagacagga

SEQ ID NO: 2897969 - RNA, 18 nt, Human
gaaccaugaagacaggau

SEQ ID NO: 2897970 - RNA, 20 nt, Human
gaaccauccacuuacauaua

SEQ ID NO: 2897971 - RNA, 23 nt, Human
gaaccaccacacccagcccacuu

SEQ ID NO: 2897972 - RNA, 19 nt, Human
gaaccacuacaugcagccc

SEQ ID NO: 2897973 - RNA, 16 nt, Human
gaagacacugaugggc

SEQ ID NO: 2897974 - RNA, 18 nt, Human
gaacugccauuauuuucu

SEQ ID NO: 2897975 - RNA, 21 nt, Human
gaagacacugaugggcaaccc

SEQ ID NO: 2897976 - RNA, 23 nt, Human
gaagacaccagagcagaugcaga

SEQ ID NO: 2897977 - RNA, 18 nt, Human
gaagacagagaccuccug

SEQ ID NO: 2897978 - RNA, 14 nt, Human
gaagacauuucuuu

SEQ ID NO: 2897979 - RNA, 15 nt, Human
gaagacauuucuuuu

SEQ ID NO: 2897980 - RNA, 17 nt, Human
gaagacauuucuuuucu

SEQ ID NO: 2897981 - RNA, 23 nt, Human
gaagacauuucuuuucuuuuuac

SEQ ID NO: 2897982 - RNA, 15 nt, Human
gaagacaggacagug

SEQ ID NO: 2897983 - RNA, 21 nt, Human
gaagacagagaccuccugccu

SEQ ID NO: 2897984 - RNA, 12 nt, Human
gaagacaggaaa

SEQ ID NO: 2897985 - RNA, 13 nt, Human
gaagacaggaaag

SEQ ID NO: 2897986 - RNA, 19 nt, Human
gaagaccucaccuagaaau

SEQ ID NO: 2897987 - RNA, 22 nt, Human
gaagaccguuuaccuagaagaa

SEQ ID NO: 2897988 - RNA, 19 nt, Human
gaagaccccugacucauca

SEQ ID NO: 2897989 - RNA, 20 nt, Human
gaagaccucaccuagaaauu

SEQ ID NO: 2897990 - RNA, 22 nt, Human
gaagaccuggcaaggacacaga

SEQ ID NO: 2897991 - RNA, 14 nt, Human
gaagacccuccccg

SEQ ID NO: 2897992 - RNA, 16 nt, Human
gaagacucauucuucu

SEQ ID NO: 2897993 - RNA, 21 nt, Human
gaagacgccgucuccauggca

SEQ ID NO: 2897994 - RNA, 15 nt, Human
gaagacgccugagcu

SEQ ID NO: 2897995 - RNA, 16 nt, Human
gaagacgccugagcuc

SEQ ID NO: 2897996 - RNA, 18 nt, Human
gaagacucauucuucugu

SEQ ID NO: 2897997 - RNA, 17 nt, Human
gaagacucauucuucug

SEQ ID NO: 2897998 - RNA, 14 nt, Human
gaagcacagcuuca

SEQ ID NO: 2897999 - RNA, 13 nt, Human
gaagcacagcuuc

SEQ ID NO: 2898000 - RNA, 20 nt, Human
gaagcacaugcaccuaccca

SEQ ID NO: 2898001 - RNA, 18 nt, Human
gaagcacugggaucacag

SEQ ID NO: 2898002 - RNA, 21 nt, Human
gaagcaccccaugccaaagcu

SEQ ID NO: 2898003 - RNA, 16 nt, Human
gaagcaccccaugcca

SEQ ID NO: 2898004 - RNA, 18 nt, Human
gaagcagguugaggggcu

SEQ ID NO: 2898005 - RNA, 22 nt, Human
gaagcagguugaggggcuccug

SEQ ID NO: 2898006 - RNA, 19 nt, Human
gaagcagguugaggggcuc

SEQ ID NO: 2898007 - RNA, 23 nt, Human
gaagcagguugaggggcuccugg

SEQ ID NO: 2898008 - RNA, 19 nt, Human
gaagcaggcuacacugaca

SEQ ID NO: 2898009 - RNA, 23 nt, Human
gaagcaggcuacacugacacugg

SEQ ID NO: 2898010 - RNA, 14 nt, Human
gaagcaggcuacac

SEQ ID NO: 2898011 - RNA, 18 nt, Human
gaagcaggcuacacugac

SEQ ID NO: 2898012 - RNA, 23 nt, Human
gaagcacacucuggucuuggaau

SEQ ID NO: 2898013 - RNA, 22 nt, Human
gaaccaccacacccagcccacu

SEQ ID NO: 2898014 - RNA, 21 nt, Human
gaaccaccacacccagcccac

SEQ ID NO: 2898015 - RNA, 20 nt, Human
gaaccaccacacccagccca

SEQ ID NO: 2898016 - RNA, 18 nt, Human
gaaccaccacacccagcc

SEQ ID NO: 2898017 - RNA, 17 nt, Human
gaaaaaaguuccuuccu

SEQ ID NO: 2898018 - RNA, 22 nt, Human
gaaaacuugugugaaauuuucu

SEQ ID NO: 2898019 - RNA, 12 nt, Human
gaaaacuuuaaa

SEQ ID NO: 2898020 - RNA, 13 nt, Human
gaaaacuuuaaaa

SEQ ID NO: 2898021 - RNA, 19 nt, Human
gaaaacuuuaaaaaauauu

SEQ ID NO: 2898022 - RNA, 20 nt, Human
gaaaacuuuaaaaaauauuu

SEQ ID NO: 2898023 - RNA, 22 nt, Human
gaaaacuuuaaaaaauauuuau

SEQ ID NO: 2898024 - RNA, 11 nt, Human
gaaaagaaaua

SEQ ID NO: 2898025 - RNA, 14 nt, Human
gaaaagaaauaaua

SEQ ID NO: 2898026 - RNA, 15 nt, Human
gaaaagaaauaauaa

SEQ ID NO: 2898027 - RNA, 21 nt, Human
gaaaagaaaauuuuuguagua

SEQ ID NO: 2898028 - RNA, 10 nt, Human
gaaaaaagcu

SEQ ID NO: 2898029 - RNA, 11 nt, Human
gaaaaaagcuc

SEQ ID NO: 2898030 - RNA, 13 nt, Human
gaaaaaagcucau

SEQ ID NO: 2898031 - RNA, 17 nt, Human
gaaaaaauaacacacau

SEQ ID NO: 2898032 - RNA, 13 nt, Human
gaaaaaaauguug

SEQ ID NO: 2898033 - RNA, 21 nt, Human
gaaaaaaauguuguuuccuaa

SEQ ID NO: 2898034 - RNA, 19 nt, Human
gaaaaaacaccuagcuuua

SEQ ID NO: 2898035 - RNA, 16 nt, Human
gaaaagacaagaaaau

SEQ ID NO: 2898036 - RNA, 19 nt, Human
gaaaagaacguauuuuaaa

SEQ ID NO: 2898037 - RNA, 19 nt, Human
gaaaagaacuguuuacugc

SEQ ID NO: 2898038 - RNA, 20 nt, Human
gaaaagauguaccuggugga

SEQ ID NO: 2898039 - RNA, 14 nt, Human
gaaaauguucauca

SEQ ID NO: 2898040 - RNA, 22 nt, Human
gaaaauuaggauuucaugauuu

SEQ ID NO: 2898041 - RNA, 17 nt, Human
gaaaauguugagaaucc

SEQ ID NO: 2898042 - RNA, 15 nt, Human
gaaaauguugagaau

SEQ ID NO: 2898043 - RNA, 19 nt, Human
gaaaauguguccuaucuau

SEQ ID NO: 2898044 - RNA, 15 nt, Human
gaaaaugugugugug

SEQ ID NO: 2898045 - RNA, 12 nt, Human
gaaaaugugugu

SEQ ID NO: 2898046 - RNA, 23 nt, Human
gaaaagauucuucuguguuuaua

SEQ ID NO: 2898047 - RNA, 14 nt, Human
gaaaagauuuaagc

SEQ ID NO: 2898048 - RNA, 15 nt, Human
gaaaagauucuucug

SEQ ID NO: 2898049 - RNA, 17 nt, Human
gaaaauuauuuuaaaca

SEQ ID NO: 2898050 - RNA, 17 nt, Human
gaaaauucaaaaagugu

SEQ ID NO: 2898051 - RNA, 19 nt, Human
gaaaauucaaaaaguguuu

SEQ ID NO: 2898052 - RNA, 20 nt, Human
gaaaauucaaaaaguguuua

SEQ ID NO: 2898053 - RNA, 21 nt, Human
gaaaauucaaaaaguguuuau

SEQ ID NO: 2898054 - RNA, 21 nt, Human
gaaacaacagcuuuaaaagaa

SEQ ID NO: 2898055 - RNA, 15 nt, Human
gaaacaacagcuuua

SEQ ID NO: 2898056 - RNA, 14 nt, Human
gaaacaaauaauca

SEQ ID NO: 2898057 - RNA, 17 nt, Human
gaaacaaauaaucacau

SEQ ID NO: 2898058 - RNA, 19 nt, Human
gaaacaaauaaucacauug

SEQ ID NO: 2898059 - RNA, 15 nt, Human
gaaagaaagaaggaa

SEQ ID NO: 2898060 - RNA, 17 nt, Human
gaaacuggcacugaauu

SEQ ID NO: 2898061 - RNA, 12 nt, Human
gaaacuggcccc

SEQ ID NO: 2898062 - RNA, 15 nt, Human
gaaacuggccccgga

SEQ ID NO: 2898063 - RNA, 16 nt, Human
gaaacuggccccggau

SEQ ID NO: 2898064 - RNA, 13 nt, Human
gaaagggcccaga

SEQ ID NO: 2898065 - RNA, 22 nt, Human
gaaagaaaguugcacggcugcu

SEQ ID NO: 2898066 - RNA, 23 nt, Human
gaaagaaaguugcacggcugcug

SEQ ID NO: 2898067 - RNA, 18 nt, Human
gaaaucucccaugugcau

SEQ ID NO: 2898068 - RNA, 20 nt, Human
gaaaucuccuuuagccauca

SEQ ID NO: 2898069 - RNA, 20 nt, Human
gaaaucugucaagaguaguu

SEQ ID NO: 2898070 - RNA, 19 nt, Human
gaaaucuuacagcugggug

SEQ ID NO: 2898071 - RNA, 14 nt, Human
gaaaucuuuuaaaa

SEQ ID NO: 2898072 - RNA, 23 nt, Human
gaacaaaacacacgcgcgcacac

SEQ ID NO: 2898073 - RNA, 13 nt, Human
gaacaaaaggguc

SEQ ID NO: 2898074 - RNA, 14 nt, Human
gaacaaaaggguca

SEQ ID NO: 2898075 - RNA, 14 nt, Human
gaaauuuuuguaaa

SEQ ID NO: 2898076 - RNA, 15 nt, Human
gaaauuuuuguaaau

SEQ ID NO: 2898077 - RNA, 16 nt, Human
gaaauuuuuguaaauc

SEQ ID NO: 2898078 - RNA, 21 nt, Human
gaaauuuuuguaaaucacauc

SEQ ID NO: 2898079 - RNA, 14 nt, Human
gaacaaaaaaacca

SEQ ID NO: 2898080 - RNA, 18 nt, Human
gaacaaaaaaaccacaaa

SEQ ID NO: 2898081 - RNA, 19 nt, Human
gaacaaaaaaaccacaaag

SEQ ID NO: 2898082 - RNA, 20 nt, Human
gaacaaaaaaaccacaaagg

SEQ ID NO: 2898083 - RNA, 15 nt, Human
gaacaaaaucuguug

SEQ ID NO: 2898084 - RNA, 13 nt, Human
gaacaaagcuguu

SEQ ID NO: 2898085 - RNA, 14 nt, Human
gaacaaagcuguua

SEQ ID NO: 2898086 - RNA, 15 nt, Human
gaacaaagcuguuaa

SEQ ID NO: 2898087 - RNA, 16 nt, Human
gaacaaagcuguuaaa

SEQ ID NO: 2898088 - RNA, 18 nt, Human
gaacaaagcuguuaaacu

SEQ ID NO: 2898089 - RNA, 19 nt, Human
gaacaaagcuguuaaacug

SEQ ID NO: 2898090 - RNA, 20 nt, Human
gaacaaagcuguuaaacugu

SEQ ID NO: 2898091 - RNA, 21 nt, Human
gaacaaagcuguuaaacuguu

SEQ ID NO: 2898092 - RNA, 22 nt, Human
gaacaaagcuguuaaacuguua

SEQ ID NO: 2898093 - RNA, 22 nt, Human
gaacaaaggacagaguaugaac

SEQ ID NO: 2898094 - RNA, 17 nt, Human
gaacaaagugaaggaca

SEQ ID NO: 2898095 - RNA, 15 nt, Human
gaacaaagugagaca

SEQ ID NO: 2898096 - RNA, 19 nt, Human
gaacaaauauucagaauau

SEQ ID NO: 2898097 - RNA, 16 nt, Human
gaaagggcccagagag

SEQ ID NO: 2898098 - RNA, 15 nt, Human
gaaagggcccagaga

SEQ ID NO: 2898099 - RNA, 20 nt, Human
gaaagggccuugacaucagu

SEQ ID NO: 2898100 - RNA, 14 nt, Human
gaaagggaucauca

SEQ ID NO: 2898101 - RNA, 20 nt, Human
gaaauccuaguuuccucucc

SEQ ID NO: 2898102 - RNA, 21 nt, Human
gaaauccuaguuuccucuccu

SEQ ID NO: 2898103 - RNA, 22 nt, Human
gaaauccuaguuuccucuccuu

SEQ ID NO: 2898104 - RNA, 23 nt, Human
gaaauccuaguuuccucuccuuc

SEQ ID NO: 2898105 - RNA, 18 nt, Human
gaaaucccuguuuaauau

SEQ ID NO: 2898106 - RNA, 19 nt, Human
gaaaucccuguuuaauauu

SEQ ID NO: 2898107 - RNA, 21 nt, Human
gaaaucccuguuuaauauuua

SEQ ID NO: 2898108 - RNA, 22 nt, Human
gaaaucccuguuuaauauuuaa

SEQ ID NO: 2898109 - RNA, 23 nt, Human
gaaaucccuguuuaauauuuaaa

SEQ ID NO: 2898110 - RNA, 12 nt, Human
gaaaucucaccc

SEQ ID NO: 2898111 - RNA, 15 nt, Human
gaaaucuaguauuuc

SEQ ID NO: 2898112 - RNA, 19 nt, Human
gaaauccuugacuggaccu

SEQ ID NO: 2898113 - RNA, 12 nt, Human
gaacaaguuuua

SEQ ID NO: 2898114 - RNA, 17 nt, Human
gaacaauagguaaagcu

SEQ ID NO: 2898115 - RNA, 17 nt, Human
gaacacaaacuguaaau

SEQ ID NO: 2898116 - RNA, 13 nt, Human
gaacaauuuucuu

SEQ ID NO: 2898117 - RNA, 20 nt, Human
gaacacaaacacauuguuau

SEQ ID NO: 2898118 - RNA, 22 nt, Human
gaacacaaacacauuguuauuu

SEQ ID NO: 2898119 - RNA, 19 nt, Human
gaacacaaacuguaaauaa

SEQ ID NO: 2898120 - RNA, 11 nt, Human
gaacacaggca

SEQ ID NO: 2898121 - RNA, 17 nt, Human
gaacacaggcaaaaucc

SEQ ID NO: 2898122 - RNA, 12 nt, Human
gaacacaggcag

SEQ ID NO: 2898123 - RNA, 13 nt, Human
gaacacaggcagc

SEQ ID NO: 2898124 - RNA, 14 nt, Human
gaacacaggcagcu

SEQ ID NO: 2898125 - RNA, 16 nt, Human
gaacacaggcagcuuu

SEQ ID NO: 2898126 - RNA, 19 nt, Human
gaacacaggcagcuuucua

SEQ ID NO: 2898127 - RNA, 20 nt, Human
gaacacauaauucaggaagc

SEQ ID NO: 2898128 - RNA, 17 nt, Human
gaacacauaauucagga

SEQ ID NO: 2898129 - RNA, 22 nt, Human
gaacacuaacucaccagcccca

SEQ ID NO: 2898130 - RNA, 19 nt, Human
gaacacuaacucaccagcc

SEQ ID NO: 2898131 - RNA, 14 nt, Human
gaacacccucgaag

SEQ ID NO: 2898132 - RNA, 13 nt, Human
gaacacccuuaga

SEQ ID NO: 2898133 - RNA, 23 nt, Human
gaacacccuuagaaaaugugucc

SEQ ID NO: 2898134 - RNA, 16 nt, Human
gaacacgcguauuuac

SEQ ID NO: 2898135 - RNA, 17 nt, Human
gaacacgcguauuuaca

SEQ ID NO: 2898136 - RNA, 18 nt, Human
gcaaaaauccgaggugcu

SEQ ID NO: 2898137 - RNA, 12 nt, Human
gcaaaaaugcua

SEQ ID NO: 2898138 - RNA, 13 nt, Human
gcaaaaaugcuaa

SEQ ID NO: 2898139 - RNA, 14 nt, Human
gcaaaaaugcuaau

SEQ ID NO: 2898140 - RNA, 15 nt, Human
gcaaaaaugcuaaua

SEQ ID NO: 2898141 - RNA, 12 nt, Human
gcaaaaaaauua

SEQ ID NO: 2898142 - RNA, 21 nt, Human
gcaaaaaaauuaaaauggaug

SEQ ID NO: 2898143 - RNA, 20 nt, Human
gauuucaguuuuaacaaaug

SEQ ID NO: 2898144 - RNA, 23 nt, Human
gauuucaguuuuaacaaaugcua

SEQ ID NO: 2898145 - RNA, 16 nt, Human
gauuucauaccucaga

SEQ ID NO: 2898146 - RNA, 23 nt, Human
gauuucauaccucagaauguaaa

SEQ ID NO: 2898147 - RNA, 15 nt, Human
gauuuaauaaaauaa

SEQ ID NO: 2898148 - RNA, 15 nt, Human
gauuucagcucacug

SEQ ID NO: 2898149 - RNA, 20 nt, Human
gauuucagcucacugcaacc

SEQ ID NO: 2898150 - RNA, 17 nt, Human
gauuucagcucacugca

SEQ ID NO: 2898151 - RNA, 16 nt, Human
gauuuaagcacaaacu

SEQ ID NO: 2898152 - RNA, 14 nt, Human
gauuuaauaaaaua

SEQ ID NO: 2898153 - RNA, 13 nt, Human
gauuuaauaaaau

SEQ ID NO: 2898154 - RNA, 20 nt, Human
gauucuucuguguuuauaaa

SEQ ID NO: 2898155 - RNA, 16 nt, Human
gauucuucuguguuua

SEQ ID NO: 2898156 - RNA, 21 nt, Human
gauucuucugcuucagccucc

SEQ ID NO: 2898157 - RNA, 15 nt, Human
gauucuguggaacaa

SEQ ID NO: 2898158 - RNA, 21 nt, Human
gauucuccugccucagccucc

SEQ ID NO: 2898159 - RNA, 20 nt, Human
gauucuccugccucagccuc

SEQ ID NO: 2898160 - RNA, 19 nt, Human
gauucuccugccucagccu

SEQ ID NO: 2898161 - RNA, 12 nt, Human
gaugugcaagcg

SEQ ID NO: 2898162 - RNA, 19 nt, Human
gaugugcaagcgacgacag

SEQ ID NO: 2898163 - RNA, 14 nt, Human
gaugugcaauugau

SEQ ID NO: 2898164 - RNA, 16 nt, Human
gaugugcaauugauuu

SEQ ID NO: 2898165 - RNA, 19 nt, Human
gaugugcaauugauuucuu

SEQ ID NO: 2898166 - RNA, 14 nt, Human
gaugugcagcagau

SEQ ID NO: 2898167 - RNA, 15 nt, Human
gaugugcagcagauu

SEQ ID NO: 2898168 - RNA, 21 nt, Human
gaugugcagcagauuggaagg

SEQ ID NO: 2898169 - RNA, 23 nt, Human
gaugugcagcagauuggaaggag

SEQ ID NO: 2898170 - RNA, 14 nt, Human
gaugugcacccaug

SEQ ID NO: 2898171 - RNA, 18 nt, Human
gaugugauuguggaaugg

SEQ ID NO: 2898172 - RNA, 16 nt, Human
gaugugauuguggaau

SEQ ID NO: 2898173 - RNA, 15 nt, Human
gaugugauuguggaa

SEQ ID NO: 2898174 - RNA, 15 nt, Human
gaugugauauucuaa

SEQ ID NO: 2898175 - RNA, 20 nt, Human
gaugugauucaaaagaugcc

SEQ ID NO: 2898176 - RNA, 19 nt, Human
gaugugauauauuccuaaa

SEQ ID NO: 2898177 - RNA, 17 nt, Human
gauguccucaccacaug

SEQ ID NO: 2898178 - RNA, 16 nt, Human
gaugucucuaaagcac

SEQ ID NO: 2898179 - RNA, 21 nt, Human
gaugucugaacuuugggaagc

SEQ ID NO: 2898180 - RNA, 14 nt, Human
gaugucugccaauu

SEQ ID NO: 2898181 - RNA, 22 nt, Human
gaugucugccaauuuuugccuu

SEQ ID NO: 2898182 - RNA, 19 nt, Human
gaugucuguuugcugaugg

SEQ ID NO: 2898183 - RNA, 20 nt, Human
gaugucuguuugcugauggu

SEQ ID NO: 2898184 - RNA, 21 nt, Human
gaugucugccaauuuuugccu

SEQ ID NO: 2898185 - RNA, 13 nt, Human
gaugucuuuuaua

SEQ ID NO: 2898186 - RNA, 18 nt, Human
gaugucuuuuauagugga

SEQ ID NO: 2898187 - RNA, 14 nt, Human
gaugucuuuucuug

SEQ ID NO: 2898188 - RNA, 14 nt, Human
gaugugacuguaua

SEQ ID NO: 2898189 - RNA, 18 nt, Human
gaucuggguucacugcaa

SEQ ID NO: 2898190 - RNA, 17 nt, Human
gaucuggaagggccaag

SEQ ID NO: 2898191 - RNA, 22 nt, Human
gaucuggaagggccaaggucug

SEQ ID NO: 2898192 - RNA, 20 nt, Human
gaucuggguucacugcaacc

SEQ ID NO: 2898193 - RNA, 15 nt, Human
gaugauucagaaauu

SEQ ID NO: 2898194 - RNA, 15 nt, Human
gaugauucaggugca

SEQ ID NO: 2898195 - RNA, 16 nt, Human
gaugauucaggugcag

SEQ ID NO: 2898196 - RNA, 23 nt, Human
gaugauuaaauaagauucuaacg

SEQ ID NO: 2898197 - RNA, 12 nt, Human
gaugcugggugg

SEQ ID NO: 2898198 - RNA, 17 nt, Human
gaugcuggguggcccug

SEQ ID NO: 2898199 - RNA, 19 nt, Human
gaugcuguaacuuaaaaua

SEQ ID NO: 2898200 - RNA, 21 nt, Human
gaugaugaaaugaggucagag

SEQ ID NO: 2898201 - RNA, 16 nt, Human
gaugagggaugggccu

SEQ ID NO: 2898202 - RNA, 18 nt, Human
gaugagggaugggccugg

SEQ ID NO: 2898203 - RNA, 19 nt, Human
gaugagggaugggccuggc

SEQ ID NO: 2898204 - RNA, 19 nt, Human
gaugaugagaauuucuaaa

SEQ ID NO: 2898205 - RNA, 21 nt, Human
gaugauggucuucagccucuu

SEQ ID NO: 2898206 - RNA, 22 nt, Human
gaugaugguugcaaaagacuaa

SEQ ID NO: 2898207 - RNA, 14 nt, Human
gaugaugugccugg

SEQ ID NO: 2898208 - RNA, 15 nt, Human
gaugaugugccuggg

SEQ ID NO: 2898209 - RNA, 17 nt, Human
gaugaugugccugggug

SEQ ID NO: 2898210 - RNA, 13 nt, Human
gaugauguguaua

SEQ ID NO: 2898211 - RNA, 16 nt, Human
gaugagcucuacccag

SEQ ID NO: 2898212 - RNA, 11 nt, Human
gaugagcucua

SEQ ID NO: 2898213 - RNA, 14 nt, Human
gaugagcugggccg

SEQ ID NO: 2898214 - RNA, 20 nt, Human
gaugagcucuacccagggcc

SEQ ID NO: 2898215 - RNA, 19 nt, Human
gaugagcucuacccagggc

SEQ ID NO: 2898216 - RNA, 13 nt, Human
gaugcuguuugac

SEQ ID NO: 2898217 - RNA, 14 nt, Human
gaugcuguuugaca

SEQ ID NO: 2898218 - RNA, 20 nt, Human
gaugcuuagagggauuucuu

SEQ ID NO: 2898219 - RNA, 22 nt, Human
gaugcuuagagggauuucuuug

SEQ ID NO: 2898220 - RNA, 21 nt, Human
gaugcuuuaagugcacaacau

SEQ ID NO: 2898221 - RNA, 14 nt, Human
gaugcuuuaccaaa

SEQ ID NO: 2898222 - RNA, 20 nt, Human
gaugcuuuaccaaacagcaa

SEQ ID NO: 2898223 - RNA, 21 nt, Human
gaugcuuuaccaaacagcaaa

SEQ ID NO: 2898224 - RNA, 16 nt, Human
gauggaggggaguguu

SEQ ID NO: 2898225 - RNA, 23 nt, Human
gauggaggaaaaccaagccgugg

SEQ ID NO: 2898226 - RNA, 22 nt, Human
gauggagcgcaccugcccccug

SEQ ID NO: 2898227 - RNA, 16 nt, Human
gaugcuuuugucuaau

SEQ ID NO: 2898228 - RNA, 18 nt, Human
gauggauaaccuauauga

SEQ ID NO: 2898229 - RNA, 17 nt, Human
gauggaguuucuaaggu

SEQ ID NO: 2898230 - RNA, 13 nt, Human
gauggaguuucua

SEQ ID NO: 2898231 - RNA, 15 nt, Human
gauggaguuucuaag

SEQ ID NO: 2898232 - RNA, 16 nt, Human
gauggaguucuugugc

SEQ ID NO: 2898233 - RNA, 18 nt, Human
gauggaguucuugugcca

SEQ ID NO: 2898234 - RNA, 19 nt, Human
gauggaguucuugugccau

SEQ ID NO: 2898235 - RNA, 19 nt, Human
gauguaccaugaaacaaag

SEQ ID NO: 2898236 - RNA, 20 nt, Human
gauguaaucucucugcagcu

SEQ ID NO: 2898237 - RNA, 21 nt, Human
gauguaaucucucugcagcug

SEQ ID NO: 2898238 - RNA, 22 nt, Human
gauguaaucucucugcagcugc

SEQ ID NO: 2898239 - RNA, 23 nt, Human
gauguaaucucucugcagcugcc

SEQ ID NO: 2898240 - RNA, 13 nt, Human
gauguaauguuuu

SEQ ID NO: 2898241 - RNA, 11 nt, Human
gauguaauuga

SEQ ID NO: 2898242 - RNA, 12 nt, Human
gauguaauuuag

SEQ ID NO: 2898243 - RNA, 22 nt, Human
gauguaauuuaggguacuaaau

SEQ ID NO: 2898244 - RNA, 23 nt, Human
gauguaauuuaggguacuaaauu

SEQ ID NO: 2898245 - RNA, 16 nt, Human
gauguacaauuaaaaa

SEQ ID NO: 2898246 - RNA, 20 nt, Human
gaugucaucagagcuccucu

SEQ ID NO: 2898247 - RNA, 14 nt, Human
gaugucauguguuc

SEQ ID NO: 2898248 - RNA, 16 nt, Human
gaugucauguguuccc

SEQ ID NO: 2898249 - RNA, 17 nt, Human
gaugucccaacuuguaa

SEQ ID NO: 2898250 - RNA, 21 nt, Human
gauguccucaccacaugcgga

SEQ ID NO: 2898251 - RNA, 16 nt, Human
gaugucccugggccag

SEQ ID NO: 2898252 - RNA, 19 nt, Human
gaugucccugggccagggu

SEQ ID NO: 2898253 - RNA, 20 nt, Human
gaugucccugggccaggguc

SEQ ID NO: 2898254 - RNA, 21 nt, Human
gaugucccugggccagggucu

SEQ ID NO: 2898255 - RNA, 22 nt, Human
gaugucccugggccagggucug

SEQ ID NO: 2898256 - RNA, 19 nt, Human
gaugucccuugaugcacag

SEQ ID NO: 2898257 - RNA, 20 nt, Human
gaugucccuugaugcacaga

SEQ ID NO: 2898258 - RNA, 21 nt, Human
gaugucccuugaugcacagag

SEQ ID NO: 2898259 - RNA, 22 nt, Human
gaugucccuugaugcacagaga

SEQ ID NO: 2898260 - RNA, 18 nt, Human
gaugucccaacuuguaaa

SEQ ID NO: 2898261 - RNA, 13 nt, Human
gcaauaccaagua

SEQ ID NO: 2898262 - RNA, 19 nt, Human
gcaauagaagugcuccccu

SEQ ID NO: 2898263 - RNA, 19 nt, Human
gcaauaaacgcauuaucag

SEQ ID NO: 2898264 - RNA, 16 nt, Human
gcaauaaaauuauuug

SEQ ID NO: 2898265 - RNA, 18 nt, Human
gcaauaaaauuauuugca

SEQ ID NO: 2898266 - RNA, 19 nt, Human
gcaauaaaauuauuugcag

SEQ ID NO: 2898267 - RNA, 19 nt, Human
gcacacaccagagcccacc

SEQ ID NO: 2898268 - RNA, 18 nt, Human
gcacacaccagagcccac

SEQ ID NO: 2898269 - RNA, 17 nt, Human
gcacacaccagagccca

SEQ ID NO: 2898270 - RNA, 16 nt, Human
gcacacaccagagccc

SEQ ID NO: 2898271 - RNA, 15 nt, Human
gcacacaccagagcc

SEQ ID NO: 2898272 - RNA, 14 nt, Human
gcacacaccagagc

SEQ ID NO: 2898273 - RNA, 12 nt, Human
gcacacaccaga

SEQ ID NO: 2898274 - RNA, 16 nt, Human
gcaaaagacuaauuua

SEQ ID NO: 2898275 - RNA, 14 nt, Human
gcaaaacuuuuaaa

SEQ ID NO: 2898276 - RNA, 16 nt, Human
gcaaaacuuuuaaacu

SEQ ID NO: 2898277 - RNA, 17 nt, Human
gcaaaacuuuuaaacua

SEQ ID NO: 2898278 - RNA, 12 nt, Human
gcaaaagaaaaa

SEQ ID NO: 2898279 - RNA, 21 nt, Human
gcaaaaccacuagaacucucc

SEQ ID NO: 2898280 - RNA, 20 nt, Human
gcaaaacuaaauacuugcuc

SEQ ID NO: 2898281 - RNA, 23 nt, Human
gcaaaacuaaauacuugcuccau

SEQ ID NO: 2898282 - RNA, 18 nt, Human
gcaacccccagccugcua

SEQ ID NO: 2898283 - RNA, 17 nt, Human
gcaacccccagccugcu

SEQ ID NO: 2898284 - RNA, 21 nt, Human
gcaacccuuaccccuuagccu

SEQ ID NO: 2898285 - RNA, 18 nt, Human
gcaaccgccucaaaaugu

SEQ ID NO: 2898286 - RNA, 14 nt, Human
gcaaccgcuucccu

SEQ ID NO: 2898287 - RNA, 12 nt, Human
gcaaccucccaa

SEQ ID NO: 2898288 - RNA, 17 nt, Human
gcaaccucccaacccag

SEQ ID NO: 2898289 - RNA, 18 nt, Human
gcaaccuccgccucuugg

SEQ ID NO: 2898290 - RNA, 12 nt, Human
gcaccuccugcc

SEQ ID NO: 2898291 - RNA, 14 nt, Human
gcacacagucaccu

SEQ ID NO: 2898292 - RNA, 20 nt, Human
gcacacaccagagcccaccu

SEQ ID NO: 2898293 - RNA, 11 nt, Human
gcacacacugu

SEQ ID NO: 2898294 - RNA, 15 nt, Human
gcacacacucagugc

SEQ ID NO: 2898295 - RNA, 23 nt, Human
gcacacagcacgggggccaagga

SEQ ID NO: 2898296 - RNA, 11 nt, Human
gcacacagcac

SEQ ID NO: 2898297 - RNA, 13 nt, Human
gcacacagaaaua

SEQ ID NO: 2898298 - RNA, 14 nt, Human
gcacacagaaauau

SEQ ID NO: 2898299 - RNA, 15 nt, Human
gcacacagaaauaua

SEQ ID NO: 2898300 - RNA, 17 nt, Human
gcacacagaaauauaua

SEQ ID NO: 2898301 - RNA, 18 nt, Human
gcacacagaaauauauau

SEQ ID NO: 2898302 - RNA, 20 nt, Human
gcacacagaaauauauauac

SEQ ID NO: 2898303 - RNA, 22 nt, Human
gcacacagaaauauauauacau

SEQ ID NO: 2898304 - RNA, 23 nt, Human
gcacacagaaauauauauacaua

SEQ ID NO: 2898305 - RNA, 18 nt, Human
gcaccucagccugcacag

SEQ ID NO: 2898306 - RNA, 18 nt, Human
gcaccuaccaccacgccc

SEQ ID NO: 2898307 - RNA, 17 nt, Human
gcaccuaccaccacgcc

SEQ ID NO: 2898308 - RNA, 12 nt, Human
gcacucuagauu

SEQ ID NO: 2898309 - RNA, 13 nt, Human
gcacucuagauuc

SEQ ID NO: 2898310 - RNA, 21 nt, Human
gcacucgugugcaacagacaa

SEQ ID NO: 2898311 - RNA, 11 nt, Human
gcacucuagau

SEQ ID NO: 2898312 - RNA, 15 nt, Human
gcacuccagccuggg

SEQ ID NO: 2898313 - RNA, 19 nt, Human
gcacucaaccuuaagaccu

SEQ ID NO: 2898314 - RNA, 21 nt, Human
gcacuccagccugggcgacag

SEQ ID NO: 2898315 - RNA, 17 nt, Human
gcacuccagccugggca

SEQ ID NO: 2898316 - RNA, 16 nt, Human
gcacuccagccugggc

SEQ ID NO: 2898317 - RNA, 22 nt, Human
gcacuaugaggaauaauuauuu

SEQ ID NO: 2898318 - RNA, 22 nt, Human
gcacuauagccuaggugacaga

SEQ ID NO: 2898319 - RNA, 13 nt, Human
gcauugggauuuu

SEQ ID NO: 2898320 - RNA, 21 nt, Human
gcaugugaaaaucaaauacau

SEQ ID NO: 2898321 - RNA, 20 nt, Human
gcaugugaucacgccuggcu

SEQ ID NO: 2898322 - RNA, 14 nt, Human
gcaugucaaacaug

SEQ ID NO: 2898323 - RNA, 21 nt, Human
gcaugucaaacaugagaugug

SEQ ID NO: 2898324 - RNA, 20 nt, Human
gcaugucaaacaugagaugu

SEQ ID NO: 2898325 - RNA, 21 nt, Human
gcaugucagacagaacuugaa

SEQ ID NO: 2898326 - RNA, 16 nt, Human
gcaugucccaucacgu

SEQ ID NO: 2898327 - RNA, 23 nt, Human
gcaugucccuaccgagucucuuc

SEQ ID NO: 2898328 - RNA, 13 nt, Human
gcaugggccuggc

SEQ ID NO: 2898329 - RNA, 15 nt, Human
gcaugggccagcccc

SEQ ID NO: 2898330 - RNA, 17 nt, Human
gcaugggccagccccuc

SEQ ID NO: 2898331 - RNA, 12 nt, Human
gcauggcccugg

SEQ ID NO: 2898332 - RNA, 15 nt, Human
gcaugggcacucccu

SEQ ID NO: 2898333 - RNA, 14 nt, Human
gcauguaggacccu

SEQ ID NO: 2898334 - RNA, 20 nt, Human
gcauguaccauuugcauggc

SEQ ID NO: 2898335 - RNA, 18 nt, Human
gcauguaccauuugcaug

SEQ ID NO: 2898336 - RNA, 22 nt, Human
gcaugggccuggccaccucucu

SEQ ID NO: 2898337 - RNA, 22 nt, Human
gcauggggauaaaggagaaggc

SEQ ID NO: 2898338 - RNA, 14 nt, Human
gcauguaugucuug

SEQ ID NO: 2898339 - RNA, 15 nt, Human
gcauguaugucuugg

SEQ ID NO: 2898340 - RNA, 22 nt, Human
gcauguagugugggaggcuccu

SEQ ID NO: 2898341 - RNA, 16 nt, Human
gcauguauaguugcuu

SEQ ID NO: 2898342 - RNA, 18 nt, Human
gcauguauaguugcuuuu

SEQ ID NO: 2898343 - RNA, 19 nt, Human
gcauguauaguugcuuuug

SEQ ID NO: 2898344 - RNA, 21 nt, Human
gcauccuggcacccggccccu

SEQ ID NO: 2898345 - RNA, 17 nt, Human
gcauccuggcacccggc

SEQ ID NO: 2898346 - RNA, 23 nt, Human
gcauccuggcacccggccccugc

SEQ ID NO: 2898347 - RNA, 22 nt, Human
gcauccuggcacccggccccug

SEQ ID NO: 2898348 - RNA, 14 nt, Human
gcauccuggcaccc

SEQ ID NO: 2898349 - RNA, 13 nt, Human
gcauccuuccuau

SEQ ID NO: 2898350 - RNA, 14 nt, Human
gcauccuuccuaua

SEQ ID NO: 2898351 - RNA, 15 nt, Human
gcauccuuccuauaa

SEQ ID NO: 2898352 - RNA, 16 nt, Human
gcauccuuccuauaac

SEQ ID NO: 2898353 - RNA, 19 nt, Human
gcauccuuccuauaacuug

SEQ ID NO: 2898354 - RNA, 23 nt, Human
gcauccuuccuauaacuugaugc

SEQ ID NO: 2898355 - RNA, 20 nt, Human
gcauccuuuucugcagaggg

SEQ ID NO: 2898356 - RNA, 13 nt, Human
gcaucgcaaugua

SEQ ID NO: 2898357 - RNA, 18 nt, Human
gcauggcaucaccuccac

SEQ ID NO: 2898358 - RNA, 14 nt, Human
gcauggccaggugg

SEQ ID NO: 2898359 - RNA, 17 nt, Human
gcauggccagguggcca

SEQ ID NO: 2898360 - RNA, 13 nt, Human
gcauggccaggug

SEQ ID NO: 2898361 - RNA, 13 nt, Human
gccaacuccucac

SEQ ID NO: 2898362 - RNA, 14 nt, Human
gccaacuccucaca

SEQ ID NO: 2898363 - RNA, 17 nt, Human
gccaacugguguuugaa

SEQ ID NO: 2898364 - RNA, 12 nt, Human
gccaacuguugu

SEQ ID NO: 2898365 - RNA, 19 nt, Human
gccaacuucuucagagcug

SEQ ID NO: 2898366 - RNA, 20 nt, Human
gccaacuucuucagagcuga

SEQ ID NO: 2898367 - RNA, 15 nt, Human
gccaacuugagggcc

SEQ ID NO: 2898368 - RNA, 20 nt, Human
gccaacuugagggcccagag

SEQ ID NO: 2898369 - RNA, 21 nt, Human
gccaacuugagggcccagagc

SEQ ID NO: 2898370 - RNA, 22 nt, Human
gccaacuugagggcccagagca

SEQ ID NO: 2898371 - RNA, 23 nt, Human
gccaacuugagggcccagagcag

SEQ ID NO: 2898372 - RNA, 14 nt, Human
gccaacgacaaagc

SEQ ID NO: 2898373 - RNA, 23 nt, Human
gccaacgacaaagccaaacucug

SEQ ID NO: 2898374 - RNA, 20 nt, Human
gccaagaaaagggcugacau

SEQ ID NO: 2898375 - RNA, 15 nt, Human
gccaagaaacgucuu

SEQ ID NO: 2898376 - RNA, 22 nt, Human
gccaagaaacgucuucuaaacu

SEQ ID NO: 2898377 - RNA, 19 nt, Human
gccaagaaagauguauaua

SEQ ID NO: 2898378 - RNA, 21 nt, Human
gccaagaaacgucuucuaaac

SEQ ID NO: 2898379 - RNA, 13 nt, Human
gccaagacaaauc

SEQ ID NO: 2898380 - RNA, 15 nt, Human
gccaagacaaaucaa

SEQ ID NO: 2898381 - RNA, 17 nt, Human
gccaagacaaaucaaca

SEQ ID NO: 2898382 - RNA, 19 nt, Human
gccaagacaaaucaacaga

SEQ ID NO: 2898383 - RNA, 22 nt, Human
gccaagacaaaucaacagaagc

SEQ ID NO: 2898384 - RNA, 23 nt, Human
gccaagacaaaucaacagaagca

SEQ ID NO: 2898385 - RNA, 12 nt, Human
gccaagacuugg

SEQ ID NO: 2898386 - RNA, 18 nt, Human
gccaagacuuggcaacag

SEQ ID NO: 2898387 - RNA, 22 nt, Human
gccaagacuuggcaacagaagc

SEQ ID NO: 2898388 - RNA, 21 nt, Human
gccaagagaaaggccugcaca

SEQ ID NO: 2898389 - RNA, 22 nt, Human
gccaagagaaaggccugcacac

SEQ ID NO: 2898390 - RNA, 23 nt, Human
gccaagagaaaggccugcacaca

SEQ ID NO: 2898391 - RNA, 20 nt, Human
gccaagagcagaggcagcga

SEQ ID NO: 2898392 - RNA, 16 nt, Human
gccaagagcagaggca

SEQ ID NO: 2898393 - RNA, 18 nt, Human
gcauuucugaauagaaau

SEQ ID NO: 2898394 - RNA, 19 nt, Human
gcauuucugaauagaaaug

SEQ ID NO: 2898395 - RNA, 22 nt, Human
gcauuucgguugagaauggaaa

SEQ ID NO: 2898396 - RNA, 11 nt, Human
gccaacagcua

SEQ ID NO: 2898397 - RNA, 14 nt, Human
gccaacagcuacaa

SEQ ID NO: 2898398 - RNA, 17 nt, Human
gccaacagcuacaacag

SEQ ID NO: 2898399 - RNA, 18 nt, Human
gccaacagcuacaacagc

SEQ ID NO: 2898400 - RNA, 22 nt, Human
gccaacagcuacaacagccuca

SEQ ID NO: 2898401 - RNA, 23 nt, Human
gcauugugaguaaaucagauguu

SEQ ID NO: 2898402 - RNA, 14 nt, Human
gcauuguuucugug

SEQ ID NO: 2898403 - RNA, 17 nt, Human
gcauuguuucugugggc

SEQ ID NO: 2898404 - RNA, 19 nt, Human
gcauuucacaaaacagccu

SEQ ID NO: 2898405 - RNA, 20 nt, Human
gcauuucacaaaacagccuu

SEQ ID NO: 2898406 - RNA, 22 nt, Human
gcauuucacaaaacagccuuug

SEQ ID NO: 2898407 - RNA, 17 nt, Human
gcauuuaucauucuugu

SEQ ID NO: 2898408 - RNA, 16 nt, Human
gcauuucauaaacuaa

SEQ ID NO: 2898409 - RNA, 21 nt, Human
gcauuuccaacaccacagaca

SEQ ID NO: 2898410 - RNA, 22 nt, Human
gcauuuccaacaccacagacac

SEQ ID NO: 2898411 - RNA, 23 nt, Human
gcauuuccaacaccacagacaca

SEQ ID NO: 2898412 - RNA, 21 nt, Human
gcauuuccuaucaccuauuuc

SEQ ID NO: 2898413 - RNA, 20 nt, Human
gccaaggagggugagugcaa

SEQ ID NO: 2898414 - RNA, 21 nt, Human
gccaaggagggugagugcaag

SEQ ID NO: 2898415 - RNA, 20 nt, Human
gccaaggaggugaggagcag

SEQ ID NO: 2898416 - RNA, 18 nt, Human
gccaagauaggaccuugg

SEQ ID NO: 2898417 - RNA, 20 nt, Human
gccaagauaggaccuugggc

SEQ ID NO: 2898418 - RNA, 22 nt, Human
gccaagauaggaccuugggcca

SEQ ID NO: 2898419 - RNA, 23 nt, Human
gccaagacuuggcaacagaagca

SEQ ID NO: 2898420 - RNA, 23 nt, Human
gccaagcacugugcucagggcua

SEQ ID NO: 2898421 - RNA, 15 nt, Human
gccaagcacugugcu

SEQ ID NO: 2898422 - RNA, 18 nt, Human
gccaagcacugugcucag

SEQ ID NO: 2898423 - RNA, 22 nt, Human
gccaagcaccuagccucgcucu

SEQ ID NO: 2898424 - RNA, 23 nt, Human
gccaagcucaggaccaggcaaug

SEQ ID NO: 2898425 - RNA, 21 nt, Human
gccaagcccuccccaucccau

SEQ ID NO: 2898426 - RNA, 22 nt, Human
gccaagcccuccccaucccaug

SEQ ID NO: 2898427 - RNA, 20 nt, Human
gccaagcucaggaccaggca

SEQ ID NO: 2898428 - RNA, 22 nt, Human
gccaagcuuguuaucagcuuuc

SEQ ID NO: 2898429 - RNA, 14 nt, Human
gcagcuucaccaga

SEQ ID NO: 2898430 - RNA, 13 nt, Human
gcagcuuccuguc

SEQ ID NO: 2898431 - RNA, 14 nt, Human
gcagcuuccuguca

SEQ ID NO: 2898432 - RNA, 16 nt, Human
gcagcuugaggguugg

SEQ ID NO: 2898433 - RNA, 22 nt, Human
gcagcugcuauuuauuuuccua

SEQ ID NO: 2898434 - RNA, 12 nt, Human
gcagcuggacag

SEQ ID NO: 2898435 - RNA, 14 nt, Human
gcagcuggacagag

SEQ ID NO: 2898436 - RNA, 15 nt, Human
gcagcuggacagagg

SEQ ID NO: 2898437 - RNA, 17 nt, Human
gcagcuggacagagggg

SEQ ID NO: 2898438 - RNA, 23 nt, Human
gcagcuggacagaggggacucug

SEQ ID NO: 2898439 - RNA, 16 nt, Human
gcagcuggacucugca

SEQ ID NO: 2898440 - RNA, 22 nt, Human
gcagcuggacucugcaucccag

SEQ ID NO: 2898441 - RNA, 12 nt, Human
gcagcugggcug

SEQ ID NO: 2898442 - RNA, 20 nt, Human
gcagcugcuuuugucuaugg

SEQ ID NO: 2898443 - RNA, 13 nt, Human
gcagcugcuuuug

SEQ ID NO: 2898444 - RNA, 23 nt, Human
gcagcugcgguccacccaggagc

SEQ ID NO: 2898445 - RNA, 22 nt, Human
gcagcugcgguccacccaggag

SEQ ID NO: 2898446 - RNA, 21 nt, Human
gcagcuugaggguugggcugg

SEQ ID NO: 2898447 - RNA, 19 nt, Human
gcagcuugaggguugggcu

SEQ ID NO: 2898448 - RNA, 16 nt, Human
gcaggcugagccacuc

SEQ ID NO: 2898449 - RNA, 17 nt, Human
gcaggcugagccacucu

SEQ ID NO: 2898450 - RNA, 22 nt, Human
gcagggaaacagcuaaugggac

SEQ ID NO: 2898451 - RNA, 15 nt, Human
gcagggaaggccuga

SEQ ID NO: 2898452 - RNA, 14 nt, Human
gcagggaaggccug

SEQ ID NO: 2898453 - RNA, 12 nt, Human
gcaggcuggcca

SEQ ID NO: 2898454 - RNA, 13 nt, Human
gcaggcuggccag

SEQ ID NO: 2898455 - RNA, 14 nt, Human
gcaggcuggccagc

SEQ ID NO: 2898456 - RNA, 15 nt, Human
gcaggcuggccagcc

SEQ ID NO: 2898457 - RNA, 16 nt, Human
gcaggcuggccagccg

SEQ ID NO: 2898458 - RNA, 17 nt, Human
gcaggcuggccagccgc

SEQ ID NO: 2898459 - RNA, 20 nt, Human
gcaggcuggccagccgcucu

SEQ ID NO: 2898460 - RNA, 13 nt, Human
gcaggcuggcccu

SEQ ID NO: 2898461 - RNA, 11 nt, Human
gcacuuugggg

SEQ ID NO: 2898462 - RNA, 13 nt, Human
gcacuuuguaaau

SEQ ID NO: 2898463 - RNA, 14 nt, Human
gcacuuuguaaauu

SEQ ID NO: 2898464 - RNA, 15 nt, Human
gcacuuuguaaauuc

SEQ ID NO: 2898465 - RNA, 11 nt, Human
gcacuuuguag

SEQ ID NO: 2898466 - RNA, 17 nt, Human
gcacuuuguaguguuug

SEQ ID NO: 2898467 - RNA, 21 nt, Human
gcacuuugggaggcugaggcg

SEQ ID NO: 2898468 - RNA, 20 nt, Human
gcacuuugggaggcugaggc

SEQ ID NO: 2898469 - RNA, 16 nt, Human
gcacuuugggaggcug

SEQ ID NO: 2898470 - RNA, 15 nt, Human
gcacuuugaugucau

SEQ ID NO: 2898471 - RNA, 21 nt, Human
gcacuuugaugucauguguuc

SEQ ID NO: 2898472 - RNA, 16 nt, Human
gcacucuuaagcuucc

SEQ ID NO: 2898473 - RNA, 14 nt, Human
gcacucuguuauuu

SEQ ID NO: 2898474 - RNA, 19 nt, Human
gcacucuguuauuuagacu

SEQ ID NO: 2898475 - RNA, 15 nt, Human
gcacucuuaaagcaa

SEQ ID NO: 2898476 - RNA, 15 nt, Human
gcacucuagauucca

SEQ ID NO: 2898477 - RNA, 14 nt, Human
gcacugaaaagguu

SEQ ID NO: 2898478 - RNA, 20 nt, Human
gcacugaaaauaccaucagg

SEQ ID NO: 2898479 - RNA, 13 nt, Human
gcacuuugaaaua

SEQ ID NO: 2898480 - RNA, 16 nt, Human
gcacuuugaaauaccu

SEQ ID NO: 2898481 - RNA, 17 nt, Human
gcacuuugaaauaccuc

SEQ ID NO: 2898482 - RNA, 18 nt, Human
gcacuuugaaauaccuca

SEQ ID NO: 2898483 - RNA, 19 nt, Human
gcacuuugaaauaccucau

SEQ ID NO: 2898484 - RNA, 21 nt, Human
gcacuuugaaauaccucaugu

SEQ ID NO: 2898485 - RNA, 22 nt, Human
gcacuuugaaauaccucauguu

SEQ ID NO: 2898486 - RNA, 23 nt, Human
gcacuuugaaauaccucauguuu

SEQ ID NO: 2898487 - RNA, 22 nt, Human
gcaguugaaugacaacagaagc

SEQ ID NO: 2898488 - RNA, 19 nt, Human
gcagguucugccugcuuug

SEQ ID NO: 2898489 - RNA, 15 nt, Human
gcagggaauuucuau

SEQ ID NO: 2898490 - RNA, 16 nt, Human
gcagggaaggccugac

SEQ ID NO: 2898491 - RNA, 13 nt, Human
gcagguuagagaa

SEQ ID NO: 2898492 - RNA, 15 nt, Human
gcagguuagagaaaa

SEQ ID NO: 2898493 - RNA, 16 nt, Human
gcauaacaaauucuga

SEQ ID NO: 2898494 - RNA, 18 nt, Human
gcauaacaaauucugaau

SEQ ID NO: 2898495 - RNA, 14 nt, Human
gcauaaauaugcag

SEQ ID NO: 2898496 - RNA, 15 nt, Human
gcauaaauaugcagu

SEQ ID NO: 2898497 - RNA, 13 nt, Human
gcauaaauaugca

SEQ ID NO: 2898498 - RNA, 11 nt, Human
gcauaaaacag

SEQ ID NO: 2898499 - RNA, 12 nt, Human
gcauaaaacagc

SEQ ID NO: 2898500 - RNA, 13 nt, Human
gcauaaaacagcu

SEQ ID NO: 2898501 - RNA, 12 nt, Human
gcauaaacuguu

SEQ ID NO: 2898502 - RNA, 16 nt, Human
gcauaaaaacauuuua

SEQ ID NO: 2898503 - RNA, 21 nt, Human
gcauacagaaauauaauaaaa

SEQ ID NO: 2898504 - RNA, 19 nt, Human
gcauacaugcaaaaagaaa

SEQ ID NO: 2898505 - RNA, 15 nt, Human
gagcgcuacccacuu

SEQ ID NO: 2898506 - RNA, 17 nt, Human
gagcgccugugcacaca

SEQ ID NO: 2898507 - RNA, 16 nt, Human
gagcgagcauccccca

SEQ ID NO: 2898508 - RNA, 16 nt, Human
gagcgagcgcuaccca

SEQ ID NO: 2898509 - RNA, 17 nt, Human
gagcccggcgccccugc

SEQ ID NO: 2898510 - RNA, 19 nt, Human
gagccuuagccgcccaugc

SEQ ID NO: 2898511 - RNA, 19 nt, Human
gagccugugccuccucacc

SEQ ID NO: 2898512 - RNA, 20 nt, Human
gagcccuaaccccuuccaga

SEQ ID NO: 2898513 - RNA, 19 nt, Human
gagcccuaaccccuuccag

SEQ ID NO: 2898514 - RNA, 18 nt, Human
gagcccuaaccccuucca

SEQ ID NO: 2898515 - RNA, 16 nt, Human
gagcccuaaccccuuc

SEQ ID NO: 2898516 - RNA, 19 nt, Human
gagcccuacucccugcaga

SEQ ID NO: 2898517 - RNA, 18 nt, Human
gagcccuacucccugcag

SEQ ID NO: 2898518 - RNA, 17 nt, Human
gagcccuacucccugca

SEQ ID NO: 2898519 - RNA, 21 nt, Human
gagcccuaaccccuuccagau

SEQ ID NO: 2898520 - RNA, 22 nt, Human
gagcccuacucccugcagaugc

SEQ ID NO: 2898521 - RNA, 13 nt, Human
gagcccucagaac

SEQ ID NO: 2898522 - RNA, 16 nt, Human
gagcuguuaccauuca

SEQ ID NO: 2898523 - RNA, 22 nt, Human
gagcuguucaacaucacugaaa

SEQ ID NO: 2898524 - RNA, 19 nt, Human
gagcuguggaggauugcua

SEQ ID NO: 2898525 - RNA, 22 nt, Human
gagcuguggaggauugcuaucu

SEQ ID NO: 2898526 - RNA, 19 nt, Human
gagcugccuguucagcucc

SEQ ID NO: 2898527 - RNA, 16 nt, Human
gagcugccuguucagc

SEQ ID NO: 2898528 - RNA, 15 nt, Human
gagcugccuguucag

SEQ ID NO: 2898529 - RNA, 23 nt, Human
gagcugguggacccagggaacag

SEQ ID NO: 2898530 - RNA, 16 nt, Human
gagcugguggacccag

SEQ ID NO: 2898531 - RNA, 16 nt, Human
gagcugucaccaagga

SEQ ID NO: 2898532 - RNA, 17 nt, Human
gagcugucaccaaggaa

SEQ ID NO: 2898533 - RNA, 18 nt, Human
gagcugucaccaaggaaa

SEQ ID NO: 2898534 - RNA, 19 nt, Human
gagcugucaccaaggaaac

SEQ ID NO: 2898535 - RNA, 18 nt, Human
gagcuguccggcuggugg

SEQ ID NO: 2898536 - RNA, 21 nt, Human
gagcuggugcccggagauugg

SEQ ID NO: 2898537 - RNA, 17 nt, Human
gagcuggugcccggaga

SEQ ID NO: 2898538 - RNA, 16 nt, Human
gagcuggugcccggag

SEQ ID NO: 2898539 - RNA, 15 nt, Human
gagcuggugcccgga

SEQ ID NO: 2898540 - RNA, 14 nt, Human
gagaagcugcaucc

SEQ ID NO: 2898541 - RNA, 11 nt, Human
gagaagcugcu

SEQ ID NO: 2898542 - RNA, 12 nt, Human
gagaagcugcuc

SEQ ID NO: 2898543 - RNA, 19 nt, Human
gagaagcugcuccaggccu

SEQ ID NO: 2898544 - RNA, 20 nt, Human
gagaagcugcuccaggccug

SEQ ID NO: 2898545 - RNA, 12 nt, Human
gagaagcugcug

SEQ ID NO: 2898546 - RNA, 13 nt, Human
gagaagcugcuga

SEQ ID NO: 2898547 - RNA, 17 nt, Human
gagaagcugcugaccaa

SEQ ID NO: 2898548 - RNA, 18 nt, Human
gagaagcugcugaccaau

SEQ ID NO: 2898549 - RNA, 15 nt, Human
gagaagcuggggagg

SEQ ID NO: 2898550 - RNA, 15 nt, Human
gagcagugagcagaa

SEQ ID NO: 2898551 - RNA, 14 nt, Human
gagcagugcaggca

SEQ ID NO: 2898552 - RNA, 15 nt, Human
gagcagugcaggcac

SEQ ID NO: 2898553 - RNA, 16 nt, Human
gagcagugcaggcaca

SEQ ID NO: 2898554 - RNA, 17 nt, Human
gagcagugcaggcacag

SEQ ID NO: 2898555 - RNA, 19 nt, Human
gagguggaggcugcaguga

SEQ ID NO: 2898556 - RNA, 19 nt, Human
gagguggagguugcauuga

SEQ ID NO: 2898557 - RNA, 18 nt, Human
gagguggcagcccuguag

SEQ ID NO: 2898558 - RNA, 16 nt, Human
gagguggcagcccugu

SEQ ID NO: 2898559 - RNA, 15 nt, Human
gagguggcagcccug

SEQ ID NO: 2898560 - RNA, 13 nt, Human
gaggugggagcag

SEQ ID NO: 2898561 - RNA, 20 nt, Human
gagguggcuuuugcggccag

SEQ ID NO: 2898562 - RNA, 23 nt, Human
gagguggccagagcugggaggca

SEQ ID NO: 2898563 - RNA, 13 nt, Human
gagguggccuccu

SEQ ID NO: 2898564 - RNA, 18 nt, Human
gagguggccuccuugcuu

SEQ ID NO: 2898565 - RNA, 17 nt, Human
gagguggccagagcugg

SEQ ID NO: 2898566 - RNA, 19 nt, Human
gagguggccagagcuggga

SEQ ID NO: 2898567 - RNA, 21 nt, Human
gagguggccagagcugggagg

SEQ ID NO: 2898568 - RNA, 22 nt, Human
gagguggccagagcugggaggc

SEQ ID NO: 2898569 - RNA, 14 nt, Human
gagucauugcugua

SEQ ID NO: 2898570 - RNA, 13 nt, Human
gagucauuuaaau

SEQ ID NO: 2898571 - RNA, 14 nt, Human
gagucauuuaaaug

SEQ ID NO: 2898572 - RNA, 15 nt, Human
gagucauuuaaaugu

SEQ ID NO: 2898573 - RNA, 16 nt, Human
gagucauuuaaaugug

SEQ ID NO: 2898574 - RNA, 20 nt, Human
gagucauuuaaauguguaca

SEQ ID NO: 2898575 - RNA, 18 nt, Human
gagugagacucugucuca

SEQ ID NO: 2898576 - RNA, 14 nt, Human
gagugagacucugu

SEQ ID NO: 2898577 - RNA, 18 nt, Human
gagugcagugagccgaga

SEQ ID NO: 2898578 - RNA, 13 nt, Human
gagugcagugagc

SEQ ID NO: 2898579 - RNA, 23 nt, Human
gagugcccacccugggagacaga

SEQ ID NO: 2898580 - RNA, 13 nt, Human
gagugagacccug

SEQ ID NO: 2898581 - RNA, 15 nt, Human
gaguccaagaaucca

SEQ ID NO: 2898582 - RNA, 14 nt, Human
gagugccuggccaa

SEQ ID NO: 2898583 - RNA, 23 nt, Human
gaggggaagaaacacuuucucuu

SEQ ID NO: 2898584 - RNA, 12 nt, Human
gaggggaacaga

SEQ ID NO: 2898585 - RNA, 16 nt, Human
gaggggaagcugcagc

SEQ ID NO: 2898586 - RNA, 19 nt, Human
gaggggaagcugcagcuug

SEQ ID NO: 2898587 - RNA, 16 nt, Human
gaggggaaggggcggu

SEQ ID NO: 2898588 - RNA, 14 nt, Human
gaggggaagucccu

SEQ ID NO: 2898589 - RNA, 15 nt, Human
gagggcuugugaaca

SEQ ID NO: 2898590 - RNA, 17 nt, Human
gaggggaaaaaaauguu

SEQ ID NO: 2898591 - RNA, 18 nt, Human
gaggggaaaggggagagg

SEQ ID NO: 2898592 - RNA, 15 nt, Human
gaggggaacacugcc

SEQ ID NO: 2898593 - RNA, 16 nt, Human
gaggggaacacugccc

SEQ ID NO: 2898594 - RNA, 17 nt, Human
gaggggaacacugcccu

SEQ ID NO: 2898595 - RNA, 19 nt, Human
gaggcugccccucucacca

SEQ ID NO: 2898596 - RNA, 18 nt, Human
gaggcugccccucucacc

SEQ ID NO: 2898597 - RNA, 23 nt, Human
gaggcugcccccggcccccuggu

SEQ ID NO: 2898598 - RNA, 15 nt, Human
gaggcugccccucuc

SEQ ID NO: 2898599 - RNA, 14 nt, Human
gaggcugccccucu

SEQ ID NO: 2898600 - RNA, 19 nt, Human
gaggcugcccccggccccc

SEQ ID NO: 2898601 - RNA, 20 nt, Human
gaggcugcccccggcccccu

SEQ ID NO: 2898602 - RNA, 21 nt, Human
gaggcugcccccggcccccug

SEQ ID NO: 2898603 - RNA, 22 nt, Human
gaggcugcccccggcccccugg

SEQ ID NO: 2898604 - RNA, 14 nt, Human
gaggcugcagucag

SEQ ID NO: 2898605 - RNA, 16 nt, Human
gaggcugcagcgagcu

SEQ ID NO: 2898606 - RNA, 9 nt, Human
gaggcugcc

SEQ ID NO: 2898607 - RNA, 12 nt, Human
gaggcugccccc

SEQ ID NO: 2898608 - RNA, 17 nt, Human
gaggcugcccccggccc

SEQ ID NO: 2898609 - RNA, 21 nt, Human
gaggcuccuguuagcuccuca

SEQ ID NO: 2898610 - RNA, 13 nt, Human
gaggcuccugucc

SEQ ID NO: 2898611 - RNA, 16 nt, Human
gagggcggagccggcc

SEQ ID NO: 2898612 - RNA, 14 nt, Human
gaggccagccccac

SEQ ID NO: 2898613 - RNA, 13 nt, Human
gaggccagcccca

SEQ ID NO: 2898614 - RNA, 21 nt, Human
gaggccagccccacccaggag

SEQ ID NO: 2898615 - RNA, 20 nt, Human
gaggccagccccacccagga

SEQ ID NO: 2898616 - RNA, 18 nt, Human
gaggccagccccacccag

SEQ ID NO: 2898617 - RNA, 16 nt, Human
gaggccagccccaccc

SEQ ID NO: 2898618 - RNA, 22 nt, Human
gaggccagccccacccaggagg

SEQ ID NO: 2898619 - RNA, 22 nt, Human
gacugucucaagagggcacugg

SEQ ID NO: 2898620 - RNA, 23 nt, Human
gacugucucaagagggcacuggu

SEQ ID NO: 2898621 - RNA, 21 nt, Human
gacugucucaagagggcacug

SEQ ID NO: 2898622 - RNA, 15 nt, Human
gacugucauagaaau

SEQ ID NO: 2898623 - RNA, 16 nt, Human
gacuguccucuccccu

SEQ ID NO: 2898624 - RNA, 19 nt, Human
gacuguccucuccccucca

SEQ ID NO: 2898625 - RNA, 20 nt, Human
gacuguccucuccccuccag

SEQ ID NO: 2898626 - RNA, 22 nt, Human
gacuguccucuccccuccagcc

SEQ ID NO: 2898627 - RNA, 23 nt, Human
gacuguccucuccccuccagccu

SEQ ID NO: 2898628 - RNA, 14 nt, Human
gacucaaugcacug

SEQ ID NO: 2898629 - RNA, 15 nt, Human
gacucaaucccuagg

SEQ ID NO: 2898630 - RNA, 17 nt, Human
gacucaaugcacugaca

SEQ ID NO: 2898631 - RNA, 16 nt, Human
gacuguacuccuccca

SEQ ID NO: 2898632 - RNA, 17 nt, Human
gacuguacuccucccag

SEQ ID NO: 2898633 - RNA, 14 nt, Human
gacucacaggaagg

SEQ ID NO: 2898634 - RNA, 19 nt, Human
gacucacagguuggaagag

SEQ ID NO: 2898635 - RNA, 17 nt, Human
gacugguuuacaggccc

SEQ ID NO: 2898636 - RNA, 18 nt, Human
gacugguuuacaggcccu

SEQ ID NO: 2898637 - RNA, 19 nt, Human
gacugguuuacaggcccug

SEQ ID NO: 2898638 - RNA, 21 nt, Human
gacuuugcugauuuccccucu

SEQ ID NO: 2898639 - RNA, 15 nt, Human
gacuuuguagauccu

SEQ ID NO: 2898640 - RNA, 16 nt, Human
gacuuuguauacuuua

SEQ ID NO: 2898641 - RNA, 18 nt, Human
gacuuuguauacuuuaaa

SEQ ID NO: 2898642 - RNA, 19 nt, Human
gacugucucacuuaauccu

SEQ ID NO: 2898643 - RNA, 19 nt, Human
gacuguuuucucucggcuc

SEQ ID NO: 2898644 - RNA, 21 nt, Human
gacuguuuucucucggcuccc

SEQ ID NO: 2898645 - RNA, 11 nt, Human
gacuuucuguu

SEQ ID NO: 2898646 - RNA, 13 nt, Human
gacuuucuguugg

SEQ ID NO: 2898647 - RNA, 20 nt, Human
gacuuugauugcacauuguu

SEQ ID NO: 2898648 - RNA, 15 nt, Human
gacuuuggaagcagg

SEQ ID NO: 2898649 - RNA, 12 nt, Human
gacuauauacau

SEQ ID NO: 2898650 - RNA, 13 nt, Human
gacuauauacaug

SEQ ID NO: 2898651 - RNA, 16 nt, Human
gacuauauacaugugu

SEQ ID NO: 2898652 - RNA, 21 nt, Human
gacuauauacauguguguaua

SEQ ID NO: 2898653 - RNA, 22 nt, Human
gacuauauacauguguguauau

SEQ ID NO: 2898654 - RNA, 23 nt, Human
gacuauauacauguguguauaua

SEQ ID NO: 2898655 - RNA, 16 nt, Human
gacuauauagagaugu

SEQ ID NO: 2898656 - RNA, 19 nt, Human
gacuauauagagauguuuu

SEQ ID NO: 2898657 - RNA, 20 nt, Human
gacuauauagagauguuuuu

SEQ ID NO: 2898658 - RNA, 23 nt, Human
gacuauauagagauguuuuuaaa

SEQ ID NO: 2898659 - RNA, 22 nt, Human
gacucaaaugcucagaccagcu

SEQ ID NO: 2898660 - RNA, 19 nt, Human
gacucaaaucuccaguauu

SEQ ID NO: 2898661 - RNA, 12 nt, Human
gacuauggagcc

SEQ ID NO: 2898662 - RNA, 16 nt, Human
gacuauggagccuggc

SEQ ID NO: 2898663 - RNA, 20 nt, Human
gacuauggagccuggcacag

SEQ ID NO: 2898664 - RNA, 22 nt, Human
gacuauuaggugcaauuucaag

SEQ ID NO: 2898665 - RNA, 15 nt, Human
gacuauuauguuguu

SEQ ID NO: 2898666 - RNA, 16 nt, Human
gacuauuauguuguua

SEQ ID NO: 2898667 - RNA, 20 nt, Human
gacuauuauguuguuagaga

SEQ ID NO: 2898668 - RNA, 21 nt, Human
gacuauuauguuguuagagaa

SEQ ID NO: 2898669 - RNA, 19 nt, Human
gacucaaauguucuaaguu

SEQ ID NO: 2898670 - RNA, 23 nt, Human
gacucaaauguucuaaguuucua

SEQ ID NO: 2898671 - RNA, 15 nt, Human
gacucaaauguucua

SEQ ID NO: 2898672 - RNA, 16 nt, Human
gacucaaauguucuaa

SEQ ID NO: 2898673 - RNA, 17 nt, Human
gacucaaauguucuaag

SEQ ID NO: 2898674 - RNA, 18 nt, Human
gacucaaauguucuaagu

SEQ ID NO: 2898675 - RNA, 13 nt, Human
gacuaguacaaau

SEQ ID NO: 2898676 - RNA, 14 nt, Human
gacuaguacaaauu

SEQ ID NO: 2898677 - RNA, 17 nt, Human
gacuaguacaaauuaua

SEQ ID NO: 2898678 - RNA, 15 nt, Human
gacgcugauacauaa

SEQ ID NO: 2898679 - RNA, 19 nt, Human
gacgcugauacauaacuaa

SEQ ID NO: 2898680 - RNA, 22 nt, Human
gacgcugauacauaacuaaauu

SEQ ID NO: 2898681 - RNA, 13 nt, Human
gacgcugcagagc

SEQ ID NO: 2898682 - RNA, 22 nt, Human
gacccuccuccucccccagagg

SEQ ID NO: 2898683 - RNA, 19 nt, Human
gacccuccuccucccccag

SEQ ID NO: 2898684 - RNA, 17 nt, Human
gacccuccccgcacccc

SEQ ID NO: 2898685 - RNA, 15 nt, Human
gacccuccccgcacc

SEQ ID NO: 2898686 - RNA, 14 nt, Human
gacacucuccuugc

SEQ ID NO: 2898687 - RNA, 15 nt, Human
gacacucuccuugca

SEQ ID NO: 2898688 - RNA, 17 nt, Human
gacacucuccuugcagu

SEQ ID NO: 2898689 - RNA, 18 nt, Human
gacacucuccuugcaguu

SEQ ID NO: 2898690 - RNA, 19 nt, Human
gacacucuccuugcaguuc

SEQ ID NO: 2898691 - RNA, 15 nt, Human
gacacucucuggaag

SEQ ID NO: 2898692 - RNA, 17 nt, Human
gacacucucuggaagcc

SEQ ID NO: 2898693 - RNA, 21 nt, Human
gacacuccccgaagucuuuug

SEQ ID NO: 2898694 - RNA, 16 nt, Human
gacacuccccgaaguc

SEQ ID NO: 2898695 - RNA, 12 nt, Human
gacacuccagug

SEQ ID NO: 2898696 - RNA, 14 nt, Human
gacacuccagugcc

SEQ ID NO: 2898697 - RNA, 19 nt, Human
gacacuccagugccagcaa

SEQ ID NO: 2898698 - RNA, 13 nt, Human
gacacucccaccc

SEQ ID NO: 2898699 - RNA, 16 nt, Human
gacacucccacccagu

SEQ ID NO: 2898700 - RNA, 23 nt, Human
gacacucccacccagucucugcu

SEQ ID NO: 2898701 - RNA, 16 nt, Human
gacacuccagugccag

SEQ ID NO: 2898702 - RNA, 14 nt, Human
gacacuccuagaga

SEQ ID NO: 2898703 - RNA, 21 nt, Human
gacacuccuagagaacgcagc

SEQ ID NO: 2898704 - RNA, 22 nt, Human
gacacuccuagagaacgcagcc

SEQ ID NO: 2898705 - RNA, 13 nt, Human
gacagcccuccau

SEQ ID NO: 2898706 - RNA, 11 nt, Human
gacagccuccc

SEQ ID NO: 2898707 - RNA, 12 nt, Human
gacagaaagcag

SEQ ID NO: 2898708 - RNA, 16 nt, Human
gacagccucccacccc

SEQ ID NO: 2898709 - RNA, 15 nt, Human
gacagcuccuucugu

SEQ ID NO: 2898710 - RNA, 14 nt, Human
gacagcuccuucug

SEQ ID NO: 2898711 - RNA, 13 nt, Human
gacagcuccuucu

SEQ ID NO: 2898712 - RNA, 11 nt, Human
gacagccuggc

SEQ ID NO: 2898713 - RNA, 12 nt, Human
gacagccuggca

SEQ ID NO: 2898714 - RNA, 15 nt, Human
gacacucagaccuga

SEQ ID NO: 2898715 - RNA, 13 nt, Human
gacacucagaccu

SEQ ID NO: 2898716 - RNA, 23 nt, Human
gacacucaagucccccaagaccu

SEQ ID NO: 2898717 - RNA, 19 nt, Human
gacacucagaccagagaag

SEQ ID NO: 2898718 - RNA, 13 nt, Human
gaagcaguugugu

SEQ ID NO: 2898719 - RNA, 14 nt, Human
gaagcaguuguguc

SEQ ID NO: 2898720 - RNA, 16 nt, Human
gaagcaguugugucag

SEQ ID NO: 2898721 - RNA, 12 nt, Human
gaagcauguuuc

SEQ ID NO: 2898722 - RNA, 13 nt, Human
gaagcauguuuca

SEQ ID NO: 2898723 - RNA, 14 nt, Human
gaagcauguuucau

SEQ ID NO: 2898724 - RNA, 16 nt, Human
gaagcauguuucaugu

SEQ ID NO: 2898725 - RNA, 18 nt, Human
gacaguaucccacaucca

SEQ ID NO: 2898726 - RNA, 16 nt, Human
gacaguaucccacauc

SEQ ID NO: 2898727 - RNA, 21 nt, Human
gacaguaucccacauccaacu

SEQ ID NO: 2898728 - RNA, 19 nt, Human
gacagguuuucacauaaau

SEQ ID NO: 2898729 - RNA, 15 nt, Human
gacaguaucccacau

SEQ ID NO: 2898730 - RNA, 17 nt, Human
gacaggguuucaccaug

SEQ ID NO: 2898731 - RNA, 12 nt, Human
gacaggguuuca

SEQ ID NO: 2898732 - RNA, 22 nt, Human
gacccuacucccuugcccuaga

SEQ ID NO: 2898733 - RNA, 13 nt, Human
gacccggcugcgu

SEQ ID NO: 2898734 - RNA, 12 nt, Human
gacccggcugcg

SEQ ID NO: 2898735 - RNA, 21 nt, Human
gaccccuggcuuuucacugcu

SEQ ID NO: 2898736 - RNA, 22 nt, Human
gaccccuggcuuuucacugcug

SEQ ID NO: 2898737 - RNA, 22 nt, Human
gaccaugguuaagaguccaaga

SEQ ID NO: 2898738 - RNA, 12 nt, Human
gaccauguguca

SEQ ID NO: 2898739 - RNA, 13 nt, Human
gaccaugugucac

SEQ ID NO: 2898740 - RNA, 15 nt, Human
gaccaugugucacuu

SEQ ID NO: 2898741 - RNA, 20 nt, Human
gaccaugugucacuugugcu

SEQ ID NO: 2898742 - RNA, 21 nt, Human
gaccaugugucacuugugcuu

SEQ ID NO: 2898743 - RNA, 13 nt, Human
gaccccuggcuuu

SEQ ID NO: 2898744 - RNA, 22 nt, Human
gaccaguggugccuuggaggga

SEQ ID NO: 2898745 - RNA, 22 nt, Human
gaccagugguuuccagucauga

SEQ ID NO: 2898746 - RNA, 22 nt, Human
gaccaguugaauaaaagugcac

SEQ ID NO: 2898747 - RNA, 23 nt, Human
gaccaguugaauaaaagugcaca

SEQ ID NO: 2898748 - RNA, 14 nt, Human
gaccaguggucuca

SEQ ID NO: 2898749 - RNA, 15 nt, Human
gaccaguggugccuu

SEQ ID NO: 2898750 - RNA, 19 nt, Human
gaccaguuuaaccugaugc

SEQ ID NO: 2898751 - RNA, 14 nt, Human
gaccaggcuguguc

SEQ ID NO: 2898752 - RNA, 15 nt, Human
gaccaggcugugucc

SEQ ID NO: 2898753 - RNA, 15 nt, Human
gaccaggauuucuaa

SEQ ID NO: 2898754 - RNA, 13 nt, Human
gaccaggccuggg

SEQ ID NO: 2898755 - RNA, 19 nt, Human
gaccaggccauucugccgc

SEQ ID NO: 2898756 - RNA, 13 nt, Human
gaccaggauccag

SEQ ID NO: 2898757 - RNA, 15 nt, Human
gaccaggauccagcc

SEQ ID NO: 2898758 - RNA, 17 nt, Human
gaccaggauccagccuc

SEQ ID NO: 2898759 - RNA, 23 nt, Human
gaccaggacucccuccucaccuc

SEQ ID NO: 2898760 - RNA, 21 nt, Human
gaccaggacucccuccucacc

SEQ ID NO: 2898761 - RNA, 19 nt, Human
gaccaggacucccuccuca

SEQ ID NO: 2898762 - RNA, 17 nt, Human
gaccaggacucccuccu

SEQ ID NO: 2898763 - RNA, 16 nt, Human
gaccaggacucccucc

SEQ ID NO: 2898764 - RNA, 14 nt, Human
gaccaggacucccu

SEQ ID NO: 2898765 - RNA, 18 nt, Human
ggcuccaagaccuaggcu

SEQ ID NO: 2898766 - RNA, 18 nt, Human
ggcucagagaugugcacc

SEQ ID NO: 2898767 - RNA, 17 nt, Human
ggcucagaugaaaugca

SEQ ID NO: 2898768 - RNA, 12 nt, Human
ggcucagagggg

SEQ ID NO: 2898769 - RNA, 15 nt, Human
ggcucagagggggac

SEQ ID NO: 2898770 - RNA, 21 nt, Human
ggcucagagggggacugcugc

SEQ ID NO: 2898771 - RNA, 18 nt, Human
ggcucagcggggacagcu

SEQ ID NO: 2898772 - RNA, 13 nt, Human
ggcucagagaugu

SEQ ID NO: 2898773 - RNA, 17 nt, Human
ggcucacuggcuuugaa

SEQ ID NO: 2898774 - RNA, 21 nt, Human
ggcucagcucggggagccuua

SEQ ID NO: 2898775 - RNA, 20 nt, Human
ggcucagcggggacagcucc

SEQ ID NO: 2898776 - RNA, 19 nt, Human
ggcucagcggggacagcuc

SEQ ID NO: 2898777 - RNA, 16 nt, Human
ggcucaggucacauaa

SEQ ID NO: 2898778 - RNA, 14 nt, Human
ggcucagucucagg

SEQ ID NO: 2898779 - RNA, 17 nt, Human
ggcucagucucaggagc

SEQ ID NO: 2898780 - RNA, 15 nt, Human
ggcucagucucagga

SEQ ID NO: 2898781 - RNA, 18 nt, Human
ggcucagugcaaccucug

SEQ ID NO: 2898782 - RNA, 19 nt, Human
ggcucagugcaaccucugc

SEQ ID NO: 2898783 - RNA, 21 nt, Human
ggcucagugcaaccucugcuu

SEQ ID NO: 2898784 - RNA, 13 nt, Human
ggcuccuggaaag

SEQ ID NO: 2898785 - RNA, 11 nt, Human
ggcucuagauc

SEQ ID NO: 2898786 - RNA, 22 nt, Human
ggcucuagaucauaaggcuuca

SEQ ID NO: 2898787 - RNA, 19 nt, Human
ggcucuaggguugcuggag

SEQ ID NO: 2898788 - RNA, 22 nt, Human
ggcucuaggguugcuggagccu

SEQ ID NO: 2898789 - RNA, 18 nt, Human
ggcuccuguuagcuccuc

SEQ ID NO: 2898790 - RNA, 21 nt, Human
ggcuccuguuagcuccucacu

SEQ ID NO: 2898791 - RNA, 20 nt, Human
ggcuccuucccaucgcuguc

SEQ ID NO: 2898792 - RNA, 11 nt, Human
ggcuccugucc

SEQ ID NO: 2898793 - RNA, 12 nt, Human
ggcucuucuccu

SEQ ID NO: 2898794 - RNA, 13 nt, Human
ggcucuucuccuu

SEQ ID NO: 2898795 - RNA, 17 nt, Human
ggcucuucuccccagag

SEQ ID NO: 2898796 - RNA, 11 nt, Human
ggcucuuccaa

SEQ ID NO: 2898797 - RNA, 16 nt, Human
ggcucuucuccccaga

SEQ ID NO: 2898798 - RNA, 18 nt, Human
ggcucuaugagucuagau

SEQ ID NO: 2898799 - RNA, 23 nt, Human
ggcucuaugagucuagauguuua

SEQ ID NO: 2898800 - RNA, 19 nt, Human
ggcucucagcucagcgcca

SEQ ID NO: 2898801 - RNA, 12 nt, Human
ggcucucagcuc

SEQ ID NO: 2898802 - RNA, 14 nt, Human
ggcucucagcucag

SEQ ID NO: 2898803 - RNA, 15 nt, Human
ggcucugugcaggga

SEQ ID NO: 2898804 - RNA, 15 nt, Human
ggcucugucccccug

SEQ ID NO: 2898805 - RNA, 18 nt, Human
ggcucuguggcuugcuag

SEQ ID NO: 2898806 - RNA, 16 nt, Human
ggcucuucuccuuuca

SEQ ID NO: 2898807 - RNA, 21 nt, Human
ggcugacacuucaaggugaca

SEQ ID NO: 2898808 - RNA, 22 nt, Human
ggcugacacuucaaggugacag

SEQ ID NO: 2898809 - RNA, 22 nt, Human
ggcugacagacagcccuccauc

SEQ ID NO: 2898810 - RNA, 14 nt, Human
ggcucuucuccuuu

SEQ ID NO: 2898811 - RNA, 15 nt, Human
ggcucuucuccuuuc

SEQ ID NO: 2898812 - RNA, 15 nt, Human
ggcugccaaggccag

SEQ ID NO: 2898813 - RNA, 13 nt, Human
ggcugcccuggug

SEQ ID NO: 2898814 - RNA, 14 nt, Human
ggcugcccuggugc

SEQ ID NO: 2898815 - RNA, 15 nt, Human
ggcugcccuggugcu

SEQ ID NO: 2898816 - RNA, 16 nt, Human
ggcugcccuggugcug

SEQ ID NO: 2898817 - RNA, 19 nt, Human
ggcugcccuggugcugcca

SEQ ID NO: 2898818 - RNA, 22 nt, Human
ggcugcggaaugaaccacaucu

SEQ ID NO: 2898819 - RNA, 16 nt, Human
ggcugccuuagaaccu

SEQ ID NO: 2898820 - RNA, 17 nt, Human
ggcugccaaggccagag

SEQ ID NO: 2898821 - RNA, 15 nt, Human
ggcugcgcuuccuau

SEQ ID NO: 2898822 - RNA, 23 nt, Human
ggcugcgcuuccuauuucuaggg

SEQ ID NO: 2898823 - RNA, 17 nt, Human
ggcugcggcgucugucu

SEQ ID NO: 2898824 - RNA, 16 nt, Human
ggcugcuacccagaaa

SEQ ID NO: 2898825 - RNA, 15 nt, Human
ggcugcuacccagaa

SEQ ID NO: 2898826 - RNA, 19 nt, Human
ggcugcugaaaaccaucug

SEQ ID NO: 2898827 - RNA, 23 nt, Human
ggcugcugaaaaccaucuggccu

SEQ ID NO: 2898828 - RNA, 21 nt, Human
gggacagggugucuccugaag

SEQ ID NO: 2898829 - RNA, 20 nt, Human
gggacaguuuaucaugaagc

SEQ ID NO: 2898830 - RNA, 21 nt, Human
gggacaguuuaucaugaagcc

SEQ ID NO: 2898831 - RNA, 22 nt, Human
gggacaguuuaucaugaagccu

SEQ ID NO: 2898832 - RNA, 15 nt, Human
gggacagcuccuucu

SEQ ID NO: 2898833 - RNA, 14 nt, Human
gggacagaggccug

SEQ ID NO: 2898834 - RNA, 22 nt, Human
gggacagauucagucuugccuu

SEQ ID NO: 2898835 - RNA, 22 nt, Human
gggacaguaauaagaauggaaa

SEQ ID NO: 2898836 - RNA, 20 nt, Human
gggaagaaacacuuucucuu

SEQ ID NO: 2898837 - RNA, 21 nt, Human
gggaagaaacacuuucucuuc

SEQ ID NO: 2898838 - RNA, 16 nt, Human
gggaagaagcagagag

SEQ ID NO: 2898839 - RNA, 17 nt, Human
gggaagaagcagagaga

SEQ ID NO: 2898840 - RNA, 19 nt, Human
gggaagaagcagagagaug

SEQ ID NO: 2898841 - RNA, 14 nt, Human
gggacaccugcccu

SEQ ID NO: 2898842 - RNA, 16 nt, Human
gggacaccugcccugc

SEQ ID NO: 2898843 - RNA, 17 nt, Human
gggacaccugcccugcc

SEQ ID NO: 2898844 - RNA, 17 nt, Human
gggaagacgccugagcu

SEQ ID NO: 2898845 - RNA, 13 nt, Human
gggacagcuccuu

SEQ ID NO: 2898846 - RNA, 12 nt, Human
gggacagcuccu

SEQ ID NO: 2898847 - RNA, 13 nt, Human
gggacagagcaga

SEQ ID NO: 2898848 - RNA, 19 nt, Human
gggaaccaugaagacagga

SEQ ID NO: 2898849 - RNA, 11 nt, Human
gggaaccuccc

SEQ ID NO: 2898850 - RNA, 14 nt, Human
gggaaccucccaga

SEQ ID NO: 2898851 - RNA, 16 nt, Human
gggaaccucccagagg

SEQ ID NO: 2898852 - RNA, 17 nt, Human
gggaaccucccagaggu

SEQ ID NO: 2898853 - RNA, 16 nt, Human
gggaacgaugugucug

SEQ ID NO: 2898854 - RNA, 13 nt, Human
gggaaccugaccc

SEQ ID NO: 2898855 - RNA, 13 nt, Human
gggaacucugaca

SEQ ID NO: 2898856 - RNA, 14 nt, Human
gggaacucugacaa

SEQ ID NO: 2898857 - RNA, 19 nt, Human
gggaacucugacaagggcu

SEQ ID NO: 2898858 - RNA, 21 nt, Human
gggaacucugacaagggcuga

SEQ ID NO: 2898859 - RNA, 22 nt, Human
gggaacucaccuggggcugcug

SEQ ID NO: 2898860 - RNA, 23 nt, Human
gggaacucaccuggggcugcugg

SEQ ID NO: 2898861 - RNA, 13 nt, Human
ggcuuccuccuga

SEQ ID NO: 2898862 - RNA, 22 nt, Human
ggcuucccgcucagcccucccu

SEQ ID NO: 2898863 - RNA, 13 nt, Human
gggaacagccacu

SEQ ID NO: 2898864 - RNA, 22 nt, Human
gggaacagccacuccccuccac

SEQ ID NO: 2898865 - RNA, 18 nt, Human
gggaaccaugaagacagg

SEQ ID NO: 2898866 - RNA, 10 nt, Human
gggaacauuu

SEQ ID NO: 2898867 - RNA, 21 nt, Human
gggaacauuuauuuuaugaga

SEQ ID NO: 2898868 - RNA, 19 nt, Human
gggaacauuucuguaaaua

SEQ ID NO: 2898869 - RNA, 22 nt, Human
gggaacauuucuguaaauacca

SEQ ID NO: 2898870 - RNA, 22 nt, Human
gggaaccaagcuauuccuuucc

SEQ ID NO: 2898871 - RNA, 21 nt, Human
ggcuucugugaugagcugauc

SEQ ID NO: 2898872 - RNA, 18 nt, Human
ggcuucugugaugagcug

SEQ ID NO: 2898873 - RNA, 20 nt, Human
ggcuucuggagcccuugggu

SEQ ID NO: 2898874 - RNA, 18 nt, Human
ggcuucuggagcccuugg

SEQ ID NO: 2898875 - RNA, 16 nt, Human
ggcuucuggagcccuu

SEQ ID NO: 2898876 - RNA, 13 nt, Human
ggcuucuggagcc

SEQ ID NO: 2898877 - RNA, 17 nt, Human
aaaaauaaauaaaagcc

SEQ ID NO: 2898878 - RNA, 12 nt, Human
aaaaauaaaugg

SEQ ID NO: 2898879 - RNA, 19 nt, Human
ggcugggggccucagugcc

SEQ ID NO: 2898880 - RNA, 17 nt, Human
ggcugggggccucagug

SEQ ID NO: 2898881 - RNA, 16 nt, Human
ggcugggggccucagu

SEQ ID NO: 2898882 - RNA, 15 nt, Human
ggcugggggccucag

SEQ ID NO: 2898883 - RNA, 16 nt, Human
ggcugggguggccugu

SEQ ID NO: 2898884 - RNA, 20 nt, Human
ggcugggguggccugugugg

SEQ ID NO: 2898885 - RNA, 14 nt, Human
ggcuguaaggcucu

SEQ ID NO: 2898886 - RNA, 15 nt, Human
ggcuguaaggcucua

SEQ ID NO: 2898887 - RNA, 20 nt, Human
ggcuguacugcucaggcugc

SEQ ID NO: 2898888 - RNA, 21 nt, Human
ggcuguacugcucaggcugca

SEQ ID NO: 2898889 - RNA, 18 nt, Human
ggcuguaucccaugagcc

SEQ ID NO: 2898890 - RNA, 20 nt, Human
ggcuucaguggcagcugcuu

SEQ ID NO: 2898891 - RNA, 19 nt, Human
ggcuucaguggcagcugcu

SEQ ID NO: 2898892 - RNA, 17 nt, Human
ggcuucaguggcagcug

SEQ ID NO: 2898893 - RNA, 18 nt, Human
ggcuucaguggcagcugc

SEQ ID NO: 2898894 - RNA, 16 nt, Human
ggcuuccucauaguau

SEQ ID NO: 2898895 - RNA, 19 nt, Human
ggcuucccgcucagcccuc

SEQ ID NO: 2898896 - RNA, 21 nt, Human
ggcuucccgcucagcccuccc

SEQ ID NO: 2898897 - RNA, 15 nt, Human
ggcuucccgcucagc

SEQ ID NO: 2898898 - RNA, 16 nt, Human
ggcuucccgcucagcc

SEQ ID NO: 2898899 - RNA, 17 nt, Human
ggcuucccgcucagccc

SEQ ID NO: 2898900 - RNA, 18 nt, Human
ggcuucccgcucagcccu

SEQ ID NO: 2898901 - RNA, 14 nt, Human
ggcuucccgcucag

SEQ ID NO: 2898902 - RNA, 10 nt, Human
aaaacuucuu

SEQ ID NO: 2898903 - RNA, 18 nt, Human
aaaacuucuuaaauaucu

SEQ ID NO: 2898904 - RNA, 23 nt, Human
aaaacuucuuaaauaucuuuuau

SEQ ID NO: 2898905 - RNA, 18 nt, Human
aaaacuucuugucagaca

SEQ ID NO: 2898906 - RNA, 20 nt, Human
aaaacuucuugucagacaua

SEQ ID NO: 2898907 - RNA, 22 nt, Human
aaaacuucuugucagacauaaa

SEQ ID NO: 2898908 - RNA, 23 nt, Human
aaaacuucuugucagacauaaag

SEQ ID NO: 2898909 - RNA, 24 nt, Human
aaaacuucuugucagacauaaagc

SEQ ID NO: 2898910 - RNA, 16 nt, Human
aaaacuguuaccuaaa

SEQ ID NO: 2898911 - RNA, 23 nt, Human
aaaacuguuuuggguagcugcca

SEQ ID NO: 2898912 - RNA, 17 nt, Human
aaaacuuaacauauuua

SEQ ID NO: 2898913 - RNA, 19 nt, Human
aaaacuuaacauauuuacu

SEQ ID NO: 2898914 - RNA, 21 nt, Human
aaaacuuaacuuccaaugaaa

SEQ ID NO: 2898915 - RNA, 21 nt, Human
aaaacccacaaaaauguugaa

SEQ ID NO: 2898916 - RNA, 21 nt, Human
aaaagauuuucagaaaauauu

SEQ ID NO: 2898917 - RNA, 13 nt, Human
aaaagcaaaauaa

SEQ ID NO: 2898918 - RNA, 21 nt, Human
aaaagcaaaauaaaaacuauu

SEQ ID NO: 2898919 - RNA, 12 nt, Human
aaaagauucuuc

SEQ ID NO: 2898920 - RNA, 18 nt, Human
aaaagauucuuuuucuga

SEQ ID NO: 2898921 - RNA, 15 nt, Human
aaaagauuguauugc

SEQ ID NO: 2898922 - RNA, 17 nt, Human
aaaagauuguauugcug

SEQ ID NO: 2898923 - RNA, 13 nt, Human
aaaagauuuaagc

SEQ ID NO: 2898924 - RNA, 11 nt, Human
aaaagauucau

SEQ ID NO: 2898925 - RNA, 13 nt, Human
aaaagauucauuu

SEQ ID NO: 2898926 - RNA, 15 nt, Human
aaaagauuaaacugc

SEQ ID NO: 2898927 - RNA, 13 nt, Human
aaaagauuagcaa

SEQ ID NO: 2898928 - RNA, 20 nt, Human
aaaacuugaaaauauaugau

SEQ ID NO: 2898929 - RNA, 21 nt, Human
aaaacuugacuccauuucauc

SEQ ID NO: 2898930 - RNA, 23 nt, Human
aaaacugaaagugaaaguccaga

SEQ ID NO: 2898931 - RNA, 18 nt, Human
aaaacugaaaaucuaaua

SEQ ID NO: 2898932 - RNA, 19 nt, Human
aaaacugaaaaucuaauau

SEQ ID NO: 2898933 - RNA, 20 nt, Human
aaaaccuuucaaauuucaca

SEQ ID NO: 2898934 - RNA, 13 nt, Human
aaaacgaaaacag

SEQ ID NO: 2898935 - RNA, 14 nt, Human
aaaacgaaaacagu

SEQ ID NO: 2898936 - RNA, 14 nt, Human
aaaacgcgcagaug

SEQ ID NO: 2898937 - RNA, 15 nt, Human
aaaacgcgcagaugu

SEQ ID NO: 2898938 - RNA, 16 nt, Human
aaaacgcgcagaugug

SEQ ID NO: 2898939 - RNA, 17 nt, Human
aaaacgcgcagaugugc

SEQ ID NO: 2898940 - RNA, 21 nt, Human
aaaacgcgcagaugugcagca

SEQ ID NO: 2898941 - RNA, 19 nt, Human
aaaacgcugucaaaaguug

SEQ ID NO: 2898942 - RNA, 13 nt, Human
aaaaccuuucaaa

SEQ ID NO: 2898943 - RNA, 23 nt, Human
aaaaccuuagcucccucccgcac

SEQ ID NO: 2898944 - RNA, 14 nt, Human
aaaaccugucaaug

SEQ ID NO: 2898945 - RNA, 17 nt, Human
aaaaccugucaaugaua

SEQ ID NO: 2898946 - RNA, 13 nt, Human
aaaaccauuugaa

SEQ ID NO: 2898947 - RNA, 18 nt, Human
aaaaccaucuggccuggc

SEQ ID NO: 2898948 - RNA, 18 nt, Human
aaaaaugguggcuucagc

SEQ ID NO: 2898949 - RNA, 19 nt, Human
aaaaaugguggcuucagcu

SEQ ID NO: 2898950 - RNA, 20 nt, Human
aaaaaugguggcuucagcuc

SEQ ID NO: 2898951 - RNA, 22 nt, Human
aaaaaugguggcuucagcucca

SEQ ID NO: 2898952 - RNA, 12 nt, Human
aaaaauguaaau

SEQ ID NO: 2898953 - RNA, 13 nt, Human
aaaaauguaaaua

SEQ ID NO: 2898954 - RNA, 22 nt, Human
aaaaaugguauaaguaacuuua

SEQ ID NO: 2898955 - RNA, 13 nt, Human
aaaaaugguaauu

SEQ ID NO: 2898956 - RNA, 15 nt, Human
gggacauugggaagg

SEQ ID NO: 2898957 - RNA, 12 nt, Human
aaaaccaccccu

SEQ ID NO: 2898958 - RNA, 16 nt, Human
aaaaccacuagaacuc

SEQ ID NO: 2898959 - RNA, 11 nt, Human
aaaaccaggcc

SEQ ID NO: 2898960 - RNA, 17 nt, Human
aaaaccacuagaacucu

SEQ ID NO: 2898961 - RNA, 15 nt, Human
gggaggucaggcccu

SEQ ID NO: 2898962 - RNA, 16 nt, Human
gggaggucaggcccug

SEQ ID NO: 2898963 - RNA, 17 nt, Human
gggaggucaggcccugg

SEQ ID NO: 2898964 - RNA, 22 nt, Human
gggaggucaggcccuggaacuc

SEQ ID NO: 2898965 - RNA, 20 nt, Human
gggaugacuaaaauauuuau

SEQ ID NO: 2898966 - RNA, 19 nt, Human
gggaugacuaaaauauuua

SEQ ID NO: 2898967 - RNA, 13 nt, Human
gggaggcuucccc

SEQ ID NO: 2898968 - RNA, 13 nt, Human
gggagggaaaagg

SEQ ID NO: 2898969 - RNA, 20 nt, Human
gggagggaaaagggaaguag

SEQ ID NO: 2898970 - RNA, 14 nt, Human
gggaggcugaggcg

SEQ ID NO: 2898971 - RNA, 16 nt, Human
gggaggcugaggcaca

SEQ ID NO: 2898972 - RNA, 13 nt, Human
gggagggauggcc

SEQ ID NO: 2898973 - RNA, 11 nt, Human
gggagggauua

SEQ ID NO: 2898974 - RNA, 14 nt, Human
gggagagccccugg

SEQ ID NO: 2898975 - RNA, 15 nt, Human
gggagagccccuggg

SEQ ID NO: 2898976 - RNA, 13 nt, Human
gggagaggaaaga

SEQ ID NO: 2898977 - RNA, 13 nt, Human
gggagaggaacuc

SEQ ID NO: 2898978 - RNA, 22 nt, Human
gggagccaaaaucucaagaaau

SEQ ID NO: 2898979 - RNA, 24 nt, Human
gggagcaggcggugggcacccacc

SEQ ID NO: 2898980 - RNA, 17 nt, Human
gggagcaguccaugcau

SEQ ID NO: 2898981 - RNA, 15 nt, Human
gggagcagggaaggc

SEQ ID NO: 2898982 - RNA, 23 nt, Human
gggacuuggaagcuccgcuuucu

SEQ ID NO: 2898983 - RNA, 18 nt, Human
gggacuuggaagcuccgc

SEQ ID NO: 2898984 - RNA, 17 nt, Human
gggacuuggaagcuccg

SEQ ID NO: 2898985 - RNA, 15 nt, Human
gggacuuggaagcuc

SEQ ID NO: 2898986 - RNA, 21 nt, Human
gggagaaaaggaaaagaaaaa

SEQ ID NO: 2898987 - RNA, 22 nt, Human
gggagaaaaggaaaagaaaaaa

SEQ ID NO: 2898988 - RNA, 23 nt, Human
gggacuuugcugauuuccccucu

SEQ ID NO: 2898989 - RNA, 15 nt, Human
gggagaaccucaggc

SEQ ID NO: 2898990 - RNA, 14 nt, Human
gggagaaccucagg

SEQ ID NO: 2898991 - RNA, 14 nt, Human
aaaaggaacugcag

SEQ ID NO: 2898992 - RNA, 16 nt, Human
aaaaggaacugcagca

SEQ ID NO: 2898993 - RNA, 21 nt, Human
aaaagccucaacuagucauuu

SEQ ID NO: 2898994 - RNA, 13 nt, Human
aaaagcuucuuaa

SEQ ID NO: 2898995 - RNA, 15 nt, Human
aaaagcuucuuaauu

SEQ ID NO: 2898996 - RNA, 16 nt, Human
aaaagcuucuuaauua

SEQ ID NO: 2898997 - RNA, 20 nt, Human
aaaagcuucuuaauuaauuu

SEQ ID NO: 2898998 - RNA, 21 nt, Human
aaaagcuucuuaauuaauuug

SEQ ID NO: 2898999 - RNA, 22 nt, Human
aaaagcuucuuaauuaauuuga

SEQ ID NO: 2899000 - RNA, 11 nt, Human
aaaagcuuuau

SEQ ID NO: 2899001 - RNA, 17 nt, Human
aaaagcuuuaugauuuu

SEQ ID NO: 2899002 - RNA, 18 nt, Human
aaaagcuuuaugauuuuc

SEQ ID NO: 2899003 - RNA, 20 nt, Human
aaaagcuuuaugauuuucau

SEQ ID NO: 2899004 - RNA, 22 nt, Human
aaaagcuuuaugauuuucauaa

SEQ ID NO: 2899005 - RNA, 11 nt, Human
aaaaggaaaaa

SEQ ID NO: 2899006 - RNA, 13 nt, Human
aaaaggaaaaaaa

SEQ ID NO: 2899007 - RNA, 15 nt, Human
aaaaggaaaaaaaga

SEQ ID NO: 2899008 - RNA, 21 nt, Human
aaaaggaaaaaaagacucuuu

SEQ ID NO: 2899009 - RNA, 14 nt, Human
aaaaggaaaaagcu

SEQ ID NO: 2899010 - RNA, 15 nt, Human
aaaaggaaaaagcuc

SEQ ID NO: 2899011 - RNA, 12 nt, Human
aaaaggaaaaga

SEQ ID NO: 2899012 - RNA, 15 nt, Human
aaaaggaaaagaaaa

SEQ ID NO: 2899013 - RNA, 16 nt, Human
aaaaggaaaagaaaaa

SEQ ID NO: 2899014 - RNA, 23 nt, Human
aaaaggaaaagaaaaaaaaaaga

SEQ ID NO: 2899015 - RNA, 18 nt, Human
aaaacuucauucucguga

SEQ ID NO: 2899016 - RNA, 21 nt, Human
aaaagccaaggugucauuuau

SEQ ID NO: 2899017 - RNA, 17 nt, Human
aaaagccacuagacucu

SEQ ID NO: 2899018 - RNA, 13 nt, Human
ggcauaaaacagc

SEQ ID NO: 2899019 - RNA, 16 nt, Human
ggcauaaaacagcuuu

SEQ ID NO: 2899020 - RNA, 13 nt, Human
ggcauaaacuguu

SEQ ID NO: 2899021 - RNA, 14 nt, Human
ggcauaaacuguuu

SEQ ID NO: 2899022 - RNA, 21 nt, Human
ggcauacgccuguaguccuag

SEQ ID NO: 2899023 - RNA, 19 nt, Human
ggcauagaugcaggugagc

SEQ ID NO: 2899024 - RNA, 16 nt, Human
ggccaguccugccugg

SEQ ID NO: 2899025 - RNA, 20 nt, Human
ggccagugugacaaggauug

SEQ ID NO: 2899026 - RNA, 22 nt, Human
ggccaguccugccuggccaggc

SEQ ID NO: 2899027 - RNA, 21 nt, Human
ggccaguccugccuggccagg

SEQ ID NO: 2899028 - RNA, 20 nt, Human
ggccaguccugccuggccag

SEQ ID NO: 2899029 - RNA, 19 nt, Human
ggccaguccugccuggcca

SEQ ID NO: 2899030 - RNA, 18 nt, Human
ggccaguccugccuggcc

SEQ ID NO: 2899031 - RNA, 19 nt, Human
ggccagugugaucccaagu

SEQ ID NO: 2899032 - RNA, 19 nt, Human
ggccucaccgagugggggc

SEQ ID NO: 2899033 - RNA, 15 nt, Human
ggccucaccucuacc

SEQ ID NO: 2899034 - RNA, 17 nt, Human
ggccucagcugaaugcc

SEQ ID NO: 2899035 - RNA, 23 nt, Human
ggccucaagugauucuccugccu

SEQ ID NO: 2899036 - RNA, 19 nt, Human
ggccgaauccccucccugu

SEQ ID NO: 2899037 - RNA, 10 nt, Human
ggccucagaa

SEQ ID NO: 2899038 - RNA, 11 nt, Human
ggccucagacu

SEQ ID NO: 2899039 - RNA, 18 nt, Human
ggccucagacugcaccca

SEQ ID NO: 2899040 - RNA, 19 nt, Human
ggccucagacugcacccag

SEQ ID NO: 2899041 - RNA, 20 nt, Human
ggccucagacugcacccagg

SEQ ID NO: 2899042 - RNA, 21 nt, Human
ggccucagacugcacccagga

SEQ ID NO: 2899043 - RNA, 22 nt, Human
ggccucagacugcacccaggag

SEQ ID NO: 2899044 - RNA, 23 nt, Human
ggccucagacugcacccaggagg

SEQ ID NO: 2899045 - RNA, 19 nt, Human
ggccucacuaggcuucugg

SEQ ID NO: 2899046 - RNA, 21 nt, Human
ggccgaauccccucccuguca

SEQ ID NO: 2899047 - RNA, 18 nt, Human
ggccucaccgaguggggg

SEQ ID NO: 2899048 - RNA, 19 nt, Human
ggcccuuuccuuccagauc

SEQ ID NO: 2899049 - RNA, 18 nt, Human
ggcccuuugaagccucag

SEQ ID NO: 2899050 - RNA, 19 nt, Human
ggcccuuugaagccucagc

SEQ ID NO: 2899051 - RNA, 20 nt, Human
ggcccuuugaagccucagcu

SEQ ID NO: 2899052 - RNA, 21 nt, Human
ggcccuugcaguucagcacca

SEQ ID NO: 2899053 - RNA, 14 nt, Human
ggccccugcugguu

SEQ ID NO: 2899054 - RNA, 13 nt, Human
ggccccugcuggu

SEQ ID NO: 2899055 - RNA, 23 nt, Human
ggccccugcugguucaggguugg

SEQ ID NO: 2899056 - RNA, 13 nt, Human
ggcccggcuccag

SEQ ID NO: 2899057 - RNA, 23 nt, Human
ggcccggagcugccccucucugg

SEQ ID NO: 2899058 - RNA, 15 nt, Human
ggcccggaugcugcu

SEQ ID NO: 2899059 - RNA, 17 nt, Human
ggcccggaugcugcuuc

SEQ ID NO: 2899060 - RNA, 15 nt, Human
ggcccggcuccaggc

SEQ ID NO: 2899061 - RNA, 16 nt, Human
ggcccuccuacccugc

SEQ ID NO: 2899062 - RNA, 22 nt, Human
ggcccuccgaccacuuccaggg

SEQ ID NO: 2899063 - RNA, 20 nt, Human
ggcccuccuacccugcgccc

SEQ ID NO: 2899064 - RNA, 17 nt, Human
ggcccuccuacccugcg

SEQ ID NO: 2899065 - RNA, 19 nt, Human
ggcccuccuacccugcgcc

SEQ ID NO: 2899066 - RNA, 21 nt, Human
ggcccuccuacccugcgccca

SEQ ID NO: 2899067 - RNA, 14 nt, Human
ggcccuccugugcu

SEQ ID NO: 2899068 - RNA, 20 nt, Human
ggcccuccugugcuggggga

SEQ ID NO: 2899069 - RNA, 15 nt, Human
ggcccucgacacuca

SEQ ID NO: 2899070 - RNA, 23 nt, Human
ggcccucgacacucaccaugaag

SEQ ID NO: 2899071 - RNA, 14 nt, Human
ggcacaggucaggg

SEQ ID NO: 2899072 - RNA, 22 nt, Human
ggcacaggucaggggugacaca

SEQ ID NO: 2899073 - RNA, 17 nt, Human
ggcacaggucgggcgca

SEQ ID NO: 2899074 - RNA, 17 nt, Human
ggcacaguaugucccau

SEQ ID NO: 2899075 - RNA, 14 nt, Human
ggcacaguccagga

SEQ ID NO: 2899076 - RNA, 15 nt, Human
ggcacaguccaggaa

SEQ ID NO: 2899077 - RNA, 22 nt, Human
ggcacaguccaggaacaagcua

SEQ ID NO: 2899078 - RNA, 20 nt, Human
ggcacucagaagacacugau

SEQ ID NO: 2899079 - RNA, 23 nt, Human
ggcacucagaagacacugauggg

SEQ ID NO: 2899080 - RNA, 22 nt, Human
ggcacucuguuauuuagacuca

SEQ ID NO: 2899081 - RNA, 13 nt, Human
ggcacucuagauu

SEQ ID NO: 2899082 - RNA, 14 nt, Human
ggcacuccaaccua

SEQ ID NO: 2899083 - RNA, 19 nt, Human
ggcacuccaaccuaaccug

SEQ ID NO: 2899084 - RNA, 20 nt, Human
ggcacuccaaccuaaccugu

SEQ ID NO: 2899085 - RNA, 22 nt, Human
ggcacuccaaccuaaccugugu

SEQ ID NO: 2899086 - RNA, 16 nt, Human
ggcacucccuccagca

SEQ ID NO: 2899087 - RNA, 18 nt, Human
ggcacucccuccagcaca

SEQ ID NO: 2899088 - RNA, 16 nt, Human
ggcacuugccuggguc

SEQ ID NO: 2899089 - RNA, 15 nt, Human
ggcacuugccugggu

SEQ ID NO: 2899090 - RNA, 14 nt, Human
ggcacuugccuggg

SEQ ID NO: 2899091 - RNA, 16 nt, Human
ggcacuugauuccuug

SEQ ID NO: 2899092 - RNA, 13 nt, Human
ggcacuucccugc

SEQ ID NO: 2899093 - RNA, 14 nt, Human
ggcacuucccugcu

SEQ ID NO: 2899094 - RNA, 18 nt, Human
ggcacuucccugcugccu

SEQ ID NO: 2899095 - RNA, 20 nt, Human
ggcacuguaguucuaagacu

SEQ ID NO: 2899096 - RNA, 24 nt, Human
ggcacuguacuaggcgugagaagc

SEQ ID NO: 2899097 - RNA, 17 nt, Human
ggcacuguaguucuaag

SEQ ID NO: 2899098 - RNA, 18 nt, Human
ggcacuguaguucuaaga

SEQ ID NO: 2899099 - RNA, 15 nt, Human
ggcacuuaagcacaa

SEQ ID NO: 2899100 - RNA, 22 nt, Human
ggcacuuauuguaaauuuuaga

SEQ ID NO: 2899101 - RNA, 22 nt, Human
ggcacugauuguuuuagagacu

SEQ ID NO: 2899102 - RNA, 15 nt, Human
ggcacugguggcccg

SEQ ID NO: 2899103 - RNA, 17 nt, Human
ggcagacagcaggcagc

SEQ ID NO: 2899104 - RNA, 23 nt, Human
ggcagacagcaggcagcgccaag

SEQ ID NO: 2899105 - RNA, 16 nt, Human
ggcagacgccggggac

SEQ ID NO: 2899106 - RNA, 15 nt, Human
ggcagacuacacagg

SEQ ID NO: 2899107 - RNA, 17 nt, Human
ggcagacuacacaggau

SEQ ID NO: 2899108 - RNA, 23 nt, Human
ggcagccccauucugccugccca

SEQ ID NO: 2899109 - RNA, 18 nt, Human
ggagagaaacaauaaaga

SEQ ID NO: 2899110 - RNA, 16 nt, Human
ggagagaaagugggug

SEQ ID NO: 2899111 - RNA, 18 nt, Human
ggagagaaagugggugag

SEQ ID NO: 2899112 - RNA, 24 nt, Human
ggagagaaagugggugagaugcug

SEQ ID NO: 2899113 - RNA, 22 nt, Human
ggagacuugccagagccgggca

SEQ ID NO: 2899114 - RNA, 14 nt, Human
ggagagaaaauaua

SEQ ID NO: 2899115 - RNA, 15 nt, Human
ggagagaaaauauau

SEQ ID NO: 2899116 - RNA, 16 nt, Human
ggagagaaaauauaug

SEQ ID NO: 2899117 - RNA, 20 nt, Human
ggagacucuguggggccuug

SEQ ID NO: 2899118 - RNA, 14 nt, Human
ggagagacacagcg

SEQ ID NO: 2899119 - RNA, 15 nt, Human
ggcagcccuguaggg

SEQ ID NO: 2899120 - RNA, 13 nt, Human
ggcagcccuguag

SEQ ID NO: 2899121 - RNA, 21 nt, Human
ggcagggcuggccccagggca

SEQ ID NO: 2899122 - RNA, 20 nt, Human
ggcaguuuugacaucagcca

SEQ ID NO: 2899123 - RNA, 21 nt, Human
ggcaguuuugacaucagccag

SEQ ID NO: 2899124 - RNA, 23 nt, Human
ggcaguuuugacaucagccagcu

SEQ ID NO: 2899125 - RNA, 15 nt, Human
ggcaguguuuugaga

SEQ ID NO: 2899126 - RNA, 14 nt, Human
guacuucagcaaga

SEQ ID NO: 2899127 - RNA, 16 nt, Human
guacuucagcaagaga

SEQ ID NO: 2899128 - RNA, 18 nt, Human
guacuucagcaagagaga

SEQ ID NO: 2899129 - RNA, 19 nt, Human
guacuucagcaagagagaa

SEQ ID NO: 2899130 - RNA, 21 nt, Human
guacuucagcaagagagaacc

SEQ ID NO: 2899131 - RNA, 23 nt, Human
guacuucagcaagagagaaccua

SEQ ID NO: 2899132 - RNA, 15 nt, Human
guacuguaugugaug

SEQ ID NO: 2899133 - RNA, 17 nt, Human
guacugucugauuggcu

SEQ ID NO: 2899134 - RNA, 18 nt, Human
guacugucugauuggcuu

SEQ ID NO: 2899135 - RNA, 14 nt, Human
guacuguucugugu

SEQ ID NO: 2899136 - RNA, 15 nt, Human
guacuguucuguguc

SEQ ID NO: 2899137 - RNA, 14 nt, Human
guacuuaacuauuc

SEQ ID NO: 2899138 - RNA, 17 nt, Human
guacuuagaguuucugu

SEQ ID NO: 2899139 - RNA, 19 nt, Human
guacuuagaguuucuguuu

SEQ ID NO: 2899140 - RNA, 20 nt, Human
guacuuagaguuucuguuug

SEQ ID NO: 2899141 - RNA, 17 nt, Human
guacuguucugugucuu

SEQ ID NO: 2899142 - RNA, 18 nt, Human
guacuguucugugucuuu

SEQ ID NO: 2899143 - RNA, 15 nt, Human
guacuguuuaauguu

SEQ ID NO: 2899144 - RNA, 19 nt, Human
guacuguuuaauguucugu

SEQ ID NO: 2899145 - RNA, 13 nt, Human
guacuguuuacca

SEQ ID NO: 2899146 - RNA, 20 nt, Human
guacuguuuaccauuuuuca

SEQ ID NO: 2899147 - RNA, 19 nt, Human
guacuggcugauggaguaa

SEQ ID NO: 2899148 - RNA, 16 nt, Human
guacuggcaugguacg

SEQ ID NO: 2899149 - RNA, 14 nt, Human
guacuggcauggua

SEQ ID NO: 2899150 - RNA, 16 nt, Human
guacuguauagacagu

SEQ ID NO: 2899151 - RNA, 17 nt, Human
guacuguauagacaguu

SEQ ID NO: 2899152 - RNA, 18 nt, Human
guacuguauagacaguuu

SEQ ID NO: 2899153 - RNA, 20 nt, Human
guacuguauagacaguuugu

SEQ ID NO: 2899154 - RNA, 12 nt, Human
guacuguacuaa

SEQ ID NO: 2899155 - RNA, 13 nt, Human
guacuguacuaau

SEQ ID NO: 2899156 - RNA, 14 nt, Human
guacuguacuaauu

SEQ ID NO: 2899157 - RNA, 12 nt, Human
guacuguaauaa

SEQ ID NO: 2899158 - RNA, 13 nt, Human
guacuguaauaau

SEQ ID NO: 2899159 - RNA, 17 nt, Human
guacuguaauaauaccu

SEQ ID NO: 2899160 - RNA, 18 nt, Human
guacuguaauaauaccuc

SEQ ID NO: 2899161 - RNA, 19 nt, Human
guacuguaauaauaccuca

SEQ ID NO: 2899162 - RNA, 20 nt, Human
guacuguaauaauaccucaa

SEQ ID NO: 2899163 - RNA, 23 nt, Human
guacugaaagccuuagggaagcu

SEQ ID NO: 2899164 - RNA, 22 nt, Human
guacugaaagccuuagggaagc

SEQ ID NO: 2899165 - RNA, 14 nt, Human
guacugaaagccuu

SEQ ID NO: 2899166 - RNA, 12 nt, Human
guacugagauuu

SEQ ID NO: 2899167 - RNA, 17 nt, Human
guacugauugagaaguu

SEQ ID NO: 2899168 - RNA, 19 nt, Human
guacugccccccaugagga

SEQ ID NO: 2899169 - RNA, 23 nt, Human
guacugccccccaugaggaagga

SEQ ID NO: 2899170 - RNA, 22 nt, Human
guacugccccccaugaggaagg

SEQ ID NO: 2899171 - RNA, 21 nt, Human
guacugccccccaugaggaag

SEQ ID NO: 2899172 - RNA, 17 nt, Human
guacugcucaggcugca

SEQ ID NO: 2899173 - RNA, 20 nt, Human
guacugcucaggcugcagcu

SEQ ID NO: 2899174 - RNA, 22 nt, Human
guacugcucaggcugcagcugg

SEQ ID NO: 2899175 - RNA, 23 nt, Human
guacugcucaggcugcagcugga

SEQ ID NO: 2899176 - RNA, 14 nt, Human
guacccacugcucu

SEQ ID NO: 2899177 - RNA, 13 nt, Human
guacccacugcuc

SEQ ID NO: 2899178 - RNA, 13 nt, Human
guacuaguuuuag

SEQ ID NO: 2899179 - RNA, 21 nt, Human
guacuauaaugaaaacauccu

SEQ ID NO: 2899180 - RNA, 14 nt, Human
guacuaguguucug

SEQ ID NO: 2899181 - RNA, 15 nt, Human
guacuaguguucugu

SEQ ID NO: 2899182 - RNA, 17 nt, Human
guacuaguguucuguuu

SEQ ID NO: 2899183 - RNA, 13 nt, Human
guacuaguacugu

SEQ ID NO: 2899184 - RNA, 16 nt, Human
guacuaguacugugua

SEQ ID NO: 2899185 - RNA, 17 nt, Human
guacuaguacuguguac

SEQ ID NO: 2899186 - RNA, 19 nt, Human
guacuaguacuguguacug

SEQ ID NO: 2899187 - RNA, 14 nt, Human
guacucauuaaaaa

SEQ ID NO: 2899188 - RNA, 23 nt, Human
guacucaggaggcugaggggagg

SEQ ID NO: 2899189 - RNA, 17 nt, Human
guacucaggaggcugag

SEQ ID NO: 2899190 - RNA, 15 nt, Human
guacucacugaagcc

SEQ ID NO: 2899191 - RNA, 16 nt, Human
guacucacugaagccu

SEQ ID NO: 2899192 - RNA, 20 nt, Human
guacucacugaagccugcgu

SEQ ID NO: 2899193 - RNA, 21 nt, Human
guacuauuuagauauaacacu

SEQ ID NO: 2899194 - RNA, 15 nt, Human
guacuaccuguguau

SEQ ID NO: 2899195 - RNA, 15 nt, Human
guacucuaacuuaag

SEQ ID NO: 2899196 - RNA, 14 nt, Human
guacucugaaacac

SEQ ID NO: 2899197 - RNA, 21 nt, Human
guacucugaaacacacugaaa

SEQ ID NO: 2899198 - RNA, 20 nt, Human
guacucccucucaggaucca

SEQ ID NO: 2899199 - RNA, 15 nt, Human
guacucccucucagg

SEQ ID NO: 2899200 - RNA, 16 nt, Human
guacucccucucagga

SEQ ID NO: 2899201 - RNA, 14 nt, Human
guacuccucccagg

SEQ ID NO: 2899202 - RNA, 15 nt, Human
guagacuauauacau

SEQ ID NO: 2899203 - RNA, 16 nt, Human
guagacuauauacaug

SEQ ID NO: 2899204 - RNA, 17 nt, Human
guagacuauauacaugu

SEQ ID NO: 2899205 - RNA, 12 nt, Human
guagagacaggg

SEQ ID NO: 2899206 - RNA, 11 nt, Human
guagagacagg

SEQ ID NO: 2899207 - RNA, 13 nt, Human
guagacaguuuug

SEQ ID NO: 2899208 - RNA, 22 nt, Human
guagacaagcaauuagacaaga

SEQ ID NO: 2899209 - RNA, 18 nt, Human
guagacaaucauuguuuu

SEQ ID NO: 2899210 - RNA, 21 nt, Human
guagacacacuaucauaguua

SEQ ID NO: 2899211 - RNA, 16 nt, Human
guagaccaaaauaaaa

SEQ ID NO: 2899212 - RNA, 15 nt, Human
guagaccaaaauaaa

SEQ ID NO: 2899213 - RNA, 14 nt, Human
guagaccaaaauaa

SEQ ID NO: 2899214 - RNA, 14 nt, Human
guagacauuuuaac

SEQ ID NO: 2899215 - RNA, 21 nt, Human
guagacauuuuaacaagaaga

SEQ ID NO: 2899216 - RNA, 22 nt, Human
guagacauuuuaacaagaagau

SEQ ID NO: 2899217 - RNA, 11 nt, Human
guagagccagg

SEQ ID NO: 2899218 - RNA, 10 nt, Human
guagagccag

SEQ ID NO: 2899219 - RNA, 13 nt, Human
guagagacagggu

SEQ ID NO: 2899220 - RNA, 18 nt, Human
guagagccagggucucac

SEQ ID NO: 2899221 - RNA, 15 nt, Human
guagagccagggucu

SEQ ID NO: 2899222 - RNA, 14 nt, Human
guagagccagcuug

SEQ ID NO: 2899223 - RNA, 12 nt, Human
guagagccagcu

SEQ ID NO: 2899224 - RNA, 14 nt, Human
guagcccuuucugu

SEQ ID NO: 2899225 - RNA, 16 nt, Human
guagccuauguugugg

SEQ ID NO: 2899226 - RNA, 16 nt, Human
guagaaauaauaugca

SEQ ID NO: 2899227 - RNA, 18 nt, Human
guacuucaggggcacuuc

SEQ ID NO: 2899228 - RNA, 17 nt, Human
guagaaauaauaugcau

SEQ ID NO: 2899229 - RNA, 14 nt, Human
guacuguguacugu

SEQ ID NO: 2899230 - RNA, 17 nt, Human
guagaacuuacuauuca

SEQ ID NO: 2899231 - RNA, 19 nt, Human
guagaacguaaccacggaa

SEQ ID NO: 2899232 - RNA, 18 nt, Human
guagaacguaaccacgga

SEQ ID NO: 2899233 - RNA, 14 nt, Human
guagaaccucaccu

SEQ ID NO: 2899234 - RNA, 22 nt, Human
guagaagcauuccuucuuugau

SEQ ID NO: 2899235 - RNA, 18 nt, Human
guagaagcauuccuucuu

SEQ ID NO: 2899236 - RNA, 21 nt, Human
guagaagcauuccuucuuuga

SEQ ID NO: 2899237 - RNA, 15 nt, Human
guagaagcauuccuu

SEQ ID NO: 2899238 - RNA, 15 nt, Human
guagaauugcauuga

SEQ ID NO: 2899239 - RNA, 16 nt, Human
guagaauuguuauaga

SEQ ID NO: 2899240 - RNA, 14 nt, Human
guagaauugcauug

SEQ ID NO: 2899241 - RNA, 19 nt, Human
guagaagguugacacaguu

SEQ ID NO: 2899242 - RNA, 19 nt, Human
guagaauagccuguggccu

SEQ ID NO: 2899243 - RNA, 22 nt, Human
aaaucauaggaaaguauuuuuu

SEQ ID NO: 2899244 - RNA, 16 nt, Human
aaaucauuuuaggaaa

SEQ ID NO: 2899245 - RNA, 18 nt, Human
aaaucauuuuaggaaagg

SEQ ID NO: 2899246 - RNA, 19 nt, Human
aaaucauuuuaggaaagga

SEQ ID NO: 2899247 - RNA, 17 nt, Human
aaauccacccauauguu

SEQ ID NO: 2899248 - RNA, 19 nt, Human
aaauccacccauauguuaa

SEQ ID NO: 2899249 - RNA, 20 nt, Human
aaauccacccauauguuaaa

SEQ ID NO: 2899250 - RNA, 22 nt, Human
aaaucagagacaaaauauuucc

SEQ ID NO: 2899251 - RNA, 22 nt, Human
aaaucagauguugaauucuuuu

SEQ ID NO: 2899252 - RNA, 15 nt, Human
aaaucagguauuaau

SEQ ID NO: 2899253 - RNA, 17 nt, Human
aaaucagguauuaaucu

SEQ ID NO: 2899254 - RNA, 22 nt, Human
aaaucagucagugcaaauguca

SEQ ID NO: 2899255 - RNA, 14 nt, Human
aaauauuauguguu

SEQ ID NO: 2899256 - RNA, 19 nt, Human
aaauauuaguuaauggauu

SEQ ID NO: 2899257 - RNA, 14 nt, Human
aaauauacuuaaau

SEQ ID NO: 2899258 - RNA, 18 nt, Human
aaauauacuuaaauggaa

SEQ ID NO: 2899259 - RNA, 18 nt, Human
aaauacauuuaaaacuua

SEQ ID NO: 2899260 - RNA, 16 nt, Human
aaaucagagacaaaau

SEQ ID NO: 2899261 - RNA, 14 nt, Human
aaaucacauccuua

SEQ ID NO: 2899262 - RNA, 18 nt, Human
aaaucacauccuuauccu

SEQ ID NO: 2899263 - RNA, 15 nt, Human
aaauauuccugcauu

SEQ ID NO: 2899264 - RNA, 15 nt, Human
aaauauuauguguuu

SEQ ID NO: 2899265 - RNA, 23 nt, Human
aaauauuauuguggaaaugaaua

SEQ ID NO: 2899266 - RNA, 12 nt, Human
aaauauucagaa

SEQ ID NO: 2899267 - RNA, 13 nt, Human
aaauauucagaau

SEQ ID NO: 2899268 - RNA, 17 nt, Human
aaauauucagaaucuuu

SEQ ID NO: 2899269 - RNA, 16 nt, Human
aaauauucaugcuucu

SEQ ID NO: 2899270 - RNA, 20 nt, Human
aaauauuauuuuaugaaagg

SEQ ID NO: 2899271 - RNA, 19 nt, Human
guacauauuuguggaauaa

SEQ ID NO: 2899272 - RNA, 20 nt, Human
guacauauuuguggaauaau

SEQ ID NO: 2899273 - RNA, 14 nt, Human
guacaucuggccuu

SEQ ID NO: 2899274 - RNA, 13 nt, Human
guacaucuggcuu

SEQ ID NO: 2899275 - RNA, 14 nt, Human
guacaucuggcuua

SEQ ID NO: 2899276 - RNA, 16 nt, Human
guacaucuggcuuauu

SEQ ID NO: 2899277 - RNA, 18 nt, Human
guacaucuggcuuauuuu

SEQ ID NO: 2899278 - RNA, 19 nt, Human
guacaucuggcuuauuuua

SEQ ID NO: 2899279 - RNA, 20 nt, Human
guacaucuggcuuauuuuaa

SEQ ID NO: 2899280 - RNA, 21 nt, Human
guacaucuggcuuauuuuaau

SEQ ID NO: 2899281 - RNA, 22 nt, Human
guacaucuggcuuauuuuaaug

SEQ ID NO: 2899282 - RNA, 23 nt, Human
guacaucuggcuuauuuuaaugu

SEQ ID NO: 2899283 - RNA, 20 nt, Human
guacaucuauuuuggauugu

SEQ ID NO: 2899284 - RNA, 18 nt, Human
guacaucuauuuuggauu

SEQ ID NO: 2899285 - RNA, 16 nt, Human
guacauggcagaguuu

SEQ ID NO: 2899286 - RNA, 10 nt, Human
guacauguau

SEQ ID NO: 2899287 - RNA, 11 nt, Human
guacaugagaa

SEQ ID NO: 2899288 - RNA, 14 nt, Human
guacaugaaaguag

SEQ ID NO: 2899289 - RNA, 11 nt, Human
guacaugaaau

SEQ ID NO: 2899290 - RNA, 19 nt, Human
guacaugaaauuuuuguaa

SEQ ID NO: 2899291 - RNA, 20 nt, Human
guacaugaaauuuuuguaaa

SEQ ID NO: 2899292 - RNA, 18 nt, Human
guacauucaauguuuaug

SEQ ID NO: 2899293 - RNA, 17 nt, Human
guacauucaauguuuau

SEQ ID NO: 2899294 - RNA, 12 nt, Human
guacauuuauaa

SEQ ID NO: 2899295 - RNA, 13 nt, Human
guacauuuauaau

SEQ ID NO: 2899296 - RNA, 14 nt, Human
guacauuuauaauu

SEQ ID NO: 2899297 - RNA, 15 nt, Human
guacauuuauaauug

SEQ ID NO: 2899298 - RNA, 17 nt, Human
guacauugaaggccugg

SEQ ID NO: 2899299 - RNA, 14 nt, Human
guacauuuaaaauu

SEQ ID NO: 2899300 - RNA, 15 nt, Human
guacauuuaaaauug

SEQ ID NO: 2899301 - RNA, 19 nt, Human
guacauguguagccugugc

SEQ ID NO: 2899302 - RNA, 20 nt, Human
guacauguguagccugugca

SEQ ID NO: 2899303 - RNA, 23 nt, Human
guaccaggaaaggauuuuauaau

SEQ ID NO: 2899304 - RNA, 16 nt, Human
guaccagcccuggggc

SEQ ID NO: 2899305 - RNA, 17 nt, Human
guaccagcccuggggcu

SEQ ID NO: 2899306 - RNA, 21 nt, Human
guaccagcgcucuaaaagcac

SEQ ID NO: 2899307 - RNA, 22 nt, Human
guaccagcgcucuaaaagcacc

SEQ ID NO: 2899308 - RNA, 16 nt, Human
guaccagcaauaugua

SEQ ID NO: 2899309 - RNA, 20 nt, Human
guaccaugaaacaaagcugc

SEQ ID NO: 2899310 - RNA, 21 nt, Human
guaccagguauuauuaucuuu

SEQ ID NO: 2899311 - RNA, 12 nt, Human
guacccacugcu

SEQ ID NO: 2899312 - RNA, 14 nt, Human
guaccauuugcaug

SEQ ID NO: 2899313 - RNA, 22 nt, Human
guacccaauagcugcccauuuc

SEQ ID NO: 2899314 - RNA, 15 nt, Human
guacauuuggagaca

SEQ ID NO: 2899315 - RNA, 14 nt, Human
guacauuuaugauu

SEQ ID NO: 2899316 - RNA, 16 nt, Human
guacauuuaugauuua

SEQ ID NO: 2899317 - RNA, 18 nt, Human
guacauuuaugauuuaau

SEQ ID NO: 2899318 - RNA, 19 nt, Human
guacauuuaugauuuaaua

SEQ ID NO: 2899319 - RNA, 20 nt, Human
guacauuuaugauuuaauaa

SEQ ID NO: 2899320 - RNA, 21 nt, Human
guacauuuaugauuuaauaaa

SEQ ID NO: 2899321 - RNA, 22 nt, Human
guacauuuaugauuuaauaaaa

SEQ ID NO: 2899322 - RNA, 16 nt, Human
guacauuuuguuguaa

SEQ ID NO: 2899323 - RNA, 17 nt, Human
guacauuuuguuguaaa

SEQ ID NO: 2899324 - RNA, 18 nt, Human
guacauuuuguuguaaaa

SEQ ID NO: 2899325 - RNA, 19 nt, Human
guacauuuuguuguaaaaa

SEQ ID NO: 2899326 - RNA, 21 nt, Human
guacauuuuguuguaaaaaga

SEQ ID NO: 2899327 - RNA, 22 nt, Human
guacauuuuguuguaaaaagaa

SEQ ID NO: 2899328 - RNA, 23 nt, Human
guacauuuuguuguaaaaagaaa

SEQ ID NO: 2899329 - RNA, 13 nt, Human
guaccaaaguuuu

SEQ ID NO: 2899330 - RNA, 18 nt, Human
guaccaaaguuuuaucaa

SEQ ID NO: 2899331 - RNA, 21 nt, Human
guaccaaaguuuuaucaaguu

SEQ ID NO: 2899332 - RNA, 14 nt, Human
guaccacucaggcc

SEQ ID NO: 2899333 - RNA, 19 nt, Human
guaauauaauggaagagaa

SEQ ID NO: 2899334 - RNA, 20 nt, Human
guaauauaauggaagagaaa

SEQ ID NO: 2899335 - RNA, 22 nt, Human
guaauauaauggaagagaaauc

SEQ ID NO: 2899336 - RNA, 12 nt, Human
guaauauaaaag

SEQ ID NO: 2899337 - RNA, 14 nt, Human
guaauauaaaagau

SEQ ID NO: 2899338 - RNA, 13 nt, Human
guaauaagacaua

SEQ ID NO: 2899339 - RNA, 14 nt, Human
guaauaagacauaa

SEQ ID NO: 2899340 - RNA, 19 nt, Human
guaauaagacauaacguuu

SEQ ID NO: 2899341 - RNA, 19 nt, Human
guaauagagcaaaauugau

SEQ ID NO: 2899342 - RNA, 22 nt, Human
guaauaacugugaaguuuacau

SEQ ID NO: 2899343 - RNA, 17 nt, Human
guaauaacacccuuccu

SEQ ID NO: 2899344 - RNA, 13 nt, Human
guaacugacauga

SEQ ID NO: 2899345 - RNA, 20 nt, Human
guaauaagaauggaaaagag

SEQ ID NO: 2899346 - RNA, 16 nt, Human
guaauaacugugaagu

SEQ ID NO: 2899347 - RNA, 15 nt, Human
guaauaacugugaag

SEQ ID NO: 2899348 - RNA, 16 nt, Human
guaaacuguggaugau

SEQ ID NO: 2899349 - RNA, 13 nt, Human
guaaagaaauguc

SEQ ID NO: 2899350 - RNA, 16 nt, Human
guaaagaaaugucuua

SEQ ID NO: 2899351 - RNA, 16 nt, Human
guaauuugaggacaac

SEQ ID NO: 2899352 - RNA, 18 nt, Human
guaauuugguuuaaaaau

SEQ ID NO: 2899353 - RNA, 15 nt, Human
guaauuuguaaaaug

SEQ ID NO: 2899354 - RNA, 11 nt, Human
guaauuuauuu

SEQ ID NO: 2899355 - RNA, 17 nt, Human
guaauuuaguuauugau

SEQ ID NO: 2899356 - RNA, 14 nt, Human
guaauuuauaaaau

SEQ ID NO: 2899357 - RNA, 15 nt, Human
guaauuuauaaaauu

SEQ ID NO: 2899358 - RNA, 18 nt, Human
guaauuuauaaaauuaga

SEQ ID NO: 2899359 - RNA, 17 nt, Human
guaauuuagauuguaaa

SEQ ID NO: 2899360 - RNA, 18 nt, Human
guaauuuagauuguaaac

SEQ ID NO: 2899361 - RNA, 19 nt, Human
guaauuuaggguacuaaau

SEQ ID NO: 2899362 - RNA, 20 nt, Human
guaauuuaggguacuaaauu

SEQ ID NO: 2899363 - RNA, 21 nt, Human
guaauuguugcuaaucuucuu

SEQ ID NO: 2899364 - RNA, 22 nt, Human
guaauauauucugaagcaacau

SEQ ID NO: 2899365 - RNA, 14 nt, Human
guaauuguuccuuu

SEQ ID NO: 2899366 - RNA, 15 nt, Human
guaaucccagcacuu

SEQ ID NO: 2899367 - RNA, 15 nt, Human
guaauccaccugccu

SEQ ID NO: 2899368 - RNA, 18 nt, Human
guaauccaggcacagcug

SEQ ID NO: 2899369 - RNA, 19 nt, Human
guaauccaggcacagcuga

SEQ ID NO: 2899370 - RNA, 20 nt, Human
guaauccaggcacagcugag

SEQ ID NO: 2899371 - RNA, 16 nt, Human
guaaucccagcacacu

SEQ ID NO: 2899372 - RNA, 14 nt, Human
guacacguguccug

SEQ ID NO: 2899373 - RNA, 15 nt, Human
guacacguguccugu

SEQ ID NO: 2899374 - RNA, 17 nt, Human
guacacguguccuguag

SEQ ID NO: 2899375 - RNA, 20 nt, Human
guacacagcucuagacacug

SEQ ID NO: 2899376 - RNA, 22 nt, Human
guaauuuuuacccuaaugucuu

SEQ ID NO: 2899377 - RNA, 16 nt, Human
guacacugacuugaga

SEQ ID NO: 2899378 - RNA, 21 nt, Human
aaauacauaucgcugacuuca

SEQ ID NO: 2899379 - RNA, 20 nt, Human
aaauacaguuugucacauga

SEQ ID NO: 2899380 - RNA, 22 nt, Human
aaauacaguuugucacaugaaa

SEQ ID NO: 2899381 - RNA, 16 nt, Human
aaauacauacggucag

SEQ ID NO: 2899382 - RNA, 14 nt, Human
aaauacaugcaucu

SEQ ID NO: 2899383 - RNA, 20 nt, Human
aaauacuauuuaaagccucc

SEQ ID NO: 2899384 - RNA, 18 nt, Human
aaaguauauauagaaucu

SEQ ID NO: 2899385 - RNA, 17 nt, Human
aaaguauauauagaauc

SEQ ID NO: 2899386 - RNA, 13 nt, Human
aaaguauauauag

SEQ ID NO: 2899387 - RNA, 13 nt, Human
aaaguauagagag

SEQ ID NO: 2899388 - RNA, 17 nt, Human
aaaguauagagagaagu

SEQ ID NO: 2899389 - RNA, 21 nt, Human
aaaguacuucuccacccugcu

SEQ ID NO: 2899390 - RNA, 20 nt, Human
aaaguacuucuccacccugc

SEQ ID NO: 2899391 - RNA, 23 nt, Human
aaaguacuucuccacccugcucu

SEQ ID NO: 2899392 - RNA, 15 nt, Human
aaagguaaaacaaaa

SEQ ID NO: 2899393 - RNA, 12 nt, Human
aaagguauuugg

SEQ ID NO: 2899394 - RNA, 21 nt, Human
aaagguagcuuaccugacaca

SEQ ID NO: 2899395 - RNA, 18 nt, Human
aaagguauuuugaauacc

SEQ ID NO: 2899396 - RNA, 19 nt, Human
aaagguccacaggucuaga

SEQ ID NO: 2899397 - RNA, 20 nt, Human
aaagguccacaggucuagac

SEQ ID NO: 2899398 - RNA, 19 nt, Human
aaaguacuucuccacccug

SEQ ID NO: 2899399 - RNA, 18 nt, Human
aaaggucuuuuuaaacca

SEQ ID NO: 2899400 - RNA, 17 nt, Human
aaaguacauauuuauuu

SEQ ID NO: 2899401 - RNA, 13 nt, Human
aaaggucuaugca

SEQ ID NO: 2899402 - RNA, 21 nt, Human
aaagguccacaggucuagacu

SEQ ID NO: 2899403 - RNA, 17 nt, Human
aaaguucuguaaaauau

SEQ ID NO: 2899404 - RNA, 18 nt, Human
aaaguucuaauaauuucu

SEQ ID NO: 2899405 - RNA, 19 nt, Human
aaaguucuaauaauuucua

SEQ ID NO: 2899406 - RNA, 20 nt, Human
aaaguucuaauaauuucuaa

SEQ ID NO: 2899407 - RNA, 21 nt, Human
aaaguucuaauaauuucuaau

SEQ ID NO: 2899408 - RNA, 17 nt, Human
aaaguucuguguuuaau

SEQ ID NO: 2899409 - RNA, 15 nt, Human
aaaguucuaagauuc

SEQ ID NO: 2899410 - RNA, 16 nt, Human
aaaguucuaagauucu

SEQ ID NO: 2899411 - RNA, 17 nt, Human
aaaguucuaagauucug

SEQ ID NO: 2899412 - RNA, 18 nt, Human
aaaguuauuagugguuua

SEQ ID NO: 2899413 - RNA, 13 nt, Human
aaaguuauauuuc

SEQ ID NO: 2899414 - RNA, 14 nt, Human
aaaguuauauuuca

SEQ ID NO: 2899415 - RNA, 22 nt, Human
aaaguuauauuucagauguaau

SEQ ID NO: 2899416 - RNA, 24 nt, Human
aaaguuauauuucagauguaaugu

SEQ ID NO: 2899417 - RNA, 13 nt, Human
aaaguuagaaucu

SEQ ID NO: 2899418 - RNA, 15 nt, Human
aaaguuagaaucuau

SEQ ID NO: 2899419 - RNA, 18 nt, Human
aaaguuagaaucuauuuu

SEQ ID NO: 2899420 - RNA, 19 nt, Human
aaaguuagaaucuauuuuc

SEQ ID NO: 2899421 - RNA, 20 nt, Human
aaaguuagaaucuauuuucu

SEQ ID NO: 2899422 - RNA, 17 nt, Human
aaaguuacccacugaag

SEQ ID NO: 2899423 - RNA, 22 nt, Human
aaaguuacugauucacugcaug

SEQ ID NO: 2899424 - RNA, 13 nt, Human
aaaguauuguaaa

SEQ ID NO: 2899425 - RNA, 14 nt, Human
aaaguauuguaaau

SEQ ID NO: 2899426 - RNA, 15 nt, Human
aaaguauuguaaauu

SEQ ID NO: 2899427 - RNA, 16 nt, Human
aaaguauuguaaauua

SEQ ID NO: 2899428 - RNA, 20 nt, Human
aaaguauuguaaauuauauu

SEQ ID NO: 2899429 - RNA, 21 nt, Human
aaaguauuguaaauuauauuu

SEQ ID NO: 2899430 - RNA, 23 nt, Human
aaaguauuguaaauuauauuugu

SEQ ID NO: 2899431 - RNA, 10 nt, Human
aaaguauuuu

SEQ ID NO: 2899432 - RNA, 13 nt, Human
aaaguuggacuaa

SEQ ID NO: 2899433 - RNA, 14 nt, Human
aaaguuggacuaaa

SEQ ID NO: 2899434 - RNA, 15 nt, Human
aaaguuggacuaaau

SEQ ID NO: 2899435 - RNA, 19 nt, Human
aaaguuggacuaaaugccu

SEQ ID NO: 2899436 - RNA, 13 nt, Human
aaauaaaaacuau

SEQ ID NO: 2899437 - RNA, 18 nt, Human
aaauaaaaacaaacguuu

SEQ ID NO: 2899438 - RNA, 18 nt, Human
aaaguugugauuccagau

SEQ ID NO: 2899439 - RNA, 16 nt, Human
aaaguuguucaacuau

SEQ ID NO: 2899440 - RNA, 17 nt, Human
aaaguuguucaacuauu

SEQ ID NO: 2899441 - RNA, 18 nt, Human
aaaguuguucaacuauuu

SEQ ID NO: 2899442 - RNA, 19 nt, Human
aaaguuguucaacuauuuu

SEQ ID NO: 2899443 - RNA, 12 nt, Human
aaaguuguacau

SEQ ID NO: 2899444 - RNA, 13 nt, Human
aaaguuguacaug

SEQ ID NO: 2899445 - RNA, 17 nt, Human
aaaguuguacaugaaau

SEQ ID NO: 2899446 - RNA, 14 nt, Human
aaauaaaaauauug

SEQ ID NO: 2899447 - RNA, 13 nt, Human
aaauaacacacau

SEQ ID NO: 2899448 - RNA, 18 nt, Human
aaauaacaauguuaagga

SEQ ID NO: 2899449 - RNA, 22 nt, Human
aaaguucugcuuucuccccaau

SEQ ID NO: 2899450 - RNA, 17 nt, Human
aaauaacaauguuaagg

SEQ ID NO: 2899451 - RNA, 13 nt, Human
aaauaaaaagaaa

SEQ ID NO: 2899452 - RNA, 14 nt, Human
aaauaaaaagugac

SEQ ID NO: 2899453 - RNA, 15 nt, Human
aaauaaaaagugaca

SEQ ID NO: 2899454 - RNA, 19 nt, Human
aaauaaaaagugacacagc

SEQ ID NO: 2899455 - RNA, 20 nt, Human
aaauaaaaagugacacagca

SEQ ID NO: 2899456 - RNA, 21 nt, Human
aaauaaaaagugacacagcag

SEQ ID NO: 2899457 - RNA, 20 nt, Human
aaauaacaggcauuuguuca

SEQ ID NO: 2899458 - RNA, 19 nt, Human
aaauaacaauguuaaggaa

SEQ ID NO: 2899459 - RNA, 21 nt, Human
aaauaacacacauauaaacau

SEQ ID NO: 2899460 - RNA, 17 nt, Human
aaauaacuaguguugcu

SEQ ID NO: 2899461 - RNA, 23 nt, Human
aaauaacccuucaacguuucuuc

SEQ ID NO: 2899462 - RNA, 18 nt, Human
aaauaacuucaagcaaac

SEQ ID NO: 2899463 - RNA, 14 nt, Human
aaauaacuucaguc

SEQ ID NO: 2899464 - RNA, 15 nt, Human
aaauaacuucagucc

SEQ ID NO: 2899465 - RNA, 16 nt, Human
aaauaacuucaguccu

SEQ ID NO: 2899466 - RNA, 15 nt, Human
aaauaacuucaagca

SEQ ID NO: 2899467 - RNA, 15 nt, Human
guaaaccaauuuuuu

SEQ ID NO: 2899468 - RNA, 19 nt, Human
guaaaccaauuuuuuguuc

SEQ ID NO: 2899469 - RNA, 22 nt, Human
guaaaccccuuuaguggcuuca

SEQ ID NO: 2899470 - RNA, 21 nt, Human
guaaaccgcuuuggccugagu

SEQ ID NO: 2899471 - RNA, 16 nt, Human
guaaacauaccaacau

SEQ ID NO: 2899472 - RNA, 19 nt, Human
guaaacauaccaacauguu

SEQ ID NO: 2899473 - RNA, 14 nt, Human
guaaacauguguuu

SEQ ID NO: 2899474 - RNA, 20 nt, Human
guaaacauguguuuuaauuc

SEQ ID NO: 2899475 - RNA, 22 nt, Human
guaaacauguguuuuaauucca

SEQ ID NO: 2899476 - RNA, 12 nt, Human
aaauaauuuuaa

SEQ ID NO: 2899477 - RNA, 17 nt, Human
aaauaauuuuaaaaaug

SEQ ID NO: 2899478 - RNA, 18 nt, Human
aaauaauuuuaaaaaugg

SEQ ID NO: 2899479 - RNA, 20 nt, Human
aaauaauuuuaaaaauggug

SEQ ID NO: 2899480 - RNA, 20 nt, Human
aaauaauuuuaaacaaaggu

SEQ ID NO: 2899481 - RNA, 13 nt, Human
aaauaauuuuagu

SEQ ID NO: 2899482 - RNA, 18 nt, Human
aaauaauuuuaaacaaag

SEQ ID NO: 2899483 - RNA, 14 nt, Human
aaauaauuuuaaac

SEQ ID NO: 2899484 - RNA, 13 nt, Human
aaauaauuuaacu

SEQ ID NO: 2899485 - RNA, 14 nt, Human
aaauaauuuaacua

SEQ ID NO: 2899486 - RNA, 18 nt, Human
aaauaauuuaacuacccu

SEQ ID NO: 2899487 - RNA, 19 nt, Human
aaauaauuuaacuacccuu

SEQ ID NO: 2899488 - RNA, 19 nt, Human
guaaacagauggcacuuug

SEQ ID NO: 2899489 - RNA, 20 nt, Human
guaaacagauggcacuuuga

SEQ ID NO: 2899490 - RNA, 19 nt, Human
aaauaauaaagaugcucuu

SEQ ID NO: 2899491 - RNA, 17 nt, Human
aaauaauaaagaugcuc

SEQ ID NO: 2899492 - RNA, 14 nt, Human
aaauaauaaaagau

SEQ ID NO: 2899493 - RNA, 11 nt, Human
aaauaauaaag

SEQ ID NO: 2899494 - RNA, 14 nt, Human
aaauaauaugcauu

SEQ ID NO: 2899495 - RNA, 12 nt, Human
aaauaauaugca

SEQ ID NO: 2899496 - RNA, 13 nt, Human
aaauaauaugcau

SEQ ID NO: 2899497 - RNA, 20 nt, Human
aaauaagaacgaggauuuua

SEQ ID NO: 2899498 - RNA, 16 nt, Human
aaauaacuucaagcaa

SEQ ID NO: 2899499 - RNA, 12 nt, Human
aaauaagauucu

SEQ ID NO: 2899500 - RNA, 17 nt, Human
aaauaagaauagaaaua

SEQ ID NO: 2899501 - RNA, 14 nt, Human
aaauaagaauagaa

SEQ ID NO: 2899502 - RNA, 18 nt, Human
aaagagcacuuacuguaa

SEQ ID NO: 2899503 - RNA, 11 nt, Human
aaagaggaaaa

SEQ ID NO: 2899504 - RNA, 12 nt, Human
aaagagcacaaa

SEQ ID NO: 2899505 - RNA, 18 nt, Human
aaagagcacaaacauuuu

SEQ ID NO: 2899506 - RNA, 19 nt, Human
aaagagcacaaacauuuuu

SEQ ID NO: 2899507 - RNA, 19 nt, Human
aaagaggacucgcuuguaa

SEQ ID NO: 2899508 - RNA, 20 nt, Human
aaagaggacucgcuuguaaa

SEQ ID NO: 2899509 - RNA, 21 nt, Human
aaagaggacucgcuuguaaau

SEQ ID NO: 2899510 - RNA, 23 nt, Human
aaagagaguuuuuaauagaacca

SEQ ID NO: 2899511 - RNA, 21 nt, Human
aaagagauaccaagaugccau

SEQ ID NO: 2899512 - RNA, 17 nt, Human
aaagagauaugggaaca

SEQ ID NO: 2899513 - RNA, 24 nt, Human
aaagagauccaggaagcaugagug

SEQ ID NO: 2899514 - RNA, 21 nt, Human
aaagagaugagacaaacaugc

SEQ ID NO: 2899515 - RNA, 17 nt, Human
aaagacucuauucucaa

SEQ ID NO: 2899516 - RNA, 17 nt, Human
gguccugagggucccca

SEQ ID NO: 2899517 - RNA, 12 nt, Human
gguccugucccc

SEQ ID NO: 2899518 - RNA, 15 nt, Human
gguccuguccccgca

SEQ ID NO: 2899519 - RNA, 19 nt, Human
gguccugugaucuuauuuu

SEQ ID NO: 2899520 - RNA, 21 nt, Human
gguccuucaaguuagcucagg

SEQ ID NO: 2899521 - RNA, 14 nt, Human
gguccuucuccaca

SEQ ID NO: 2899522 - RNA, 16 nt, Human
gguccuugcaccccuc

SEQ ID NO: 2899523 - RNA, 16 nt, Human
gguccuuccaggcccc

SEQ ID NO: 2899524 - RNA, 15 nt, Human
gguccuuccaggccc

SEQ ID NO: 2899525 - RNA, 20 nt, Human
aaagagagcagagaauauaa

SEQ ID NO: 2899526 - RNA, 23 nt, Human
aaagcaaugcugaugaaucacug

SEQ ID NO: 2899527 - RNA, 22 nt, Human
aaagcaagugauugggacagag

SEQ ID NO: 2899528 - RNA, 13 nt, Human
aaagcaauaaaau

SEQ ID NO: 2899529 - RNA, 21 nt, Human
aaagcaauaaaauuuuuuugg

SEQ ID NO: 2899530 - RNA, 18 nt, Human
aaagauggcucagagggg

SEQ ID NO: 2899531 - RNA, 23 nt, Human
aaagauggcugugccucugccug

SEQ ID NO: 2899532 - RNA, 21 nt, Human
aaagauggaguuucuaagguc

SEQ ID NO: 2899533 - RNA, 18 nt, Human
aaagauggaguuucuaag

SEQ ID NO: 2899534 - RNA, 19 nt, Human
aaagauggaguuucuaagg

SEQ ID NO: 2899535 - RNA, 15 nt, Human
aaagauggaguuucu

SEQ ID NO: 2899536 - RNA, 16 nt, Human
aaagauggaguuucua

SEQ ID NO: 2899537 - RNA, 17 nt, Human
aaagauggaguuucuaa

SEQ ID NO: 2899538 - RNA, 21 nt, Human
aaagauggcugugccucugcc

SEQ ID NO: 2899539 - RNA, 22 nt, Human
aaagauggcugugccucugccu

SEQ ID NO: 2899540 - RNA, 22 nt, Human
aaagaccuuuggagcaaagcug

SEQ ID NO: 2899541 - RNA, 19 nt, Human
aaagacgauuugucaguua

SEQ ID NO: 2899542 - RNA, 12 nt, Human
aaacuuuucuca

SEQ ID NO: 2899543 - RNA, 14 nt, Human
aaacuuuuaaacua

SEQ ID NO: 2899544 - RNA, 13 nt, Human
aaacuuuuaacug

SEQ ID NO: 2899545 - RNA, 22 nt, Human
aaacuuuucaaggcuuauauuc

SEQ ID NO: 2899546 - RNA, 12 nt, Human
aaagacacugcc

SEQ ID NO: 2899547 - RNA, 13 nt, Human
aaagacacugccu

SEQ ID NO: 2899548 - RNA, 14 nt, Human
aaacuuuucucaga

SEQ ID NO: 2899549 - RNA, 9 nt, Human
aaagacaga

SEQ ID NO: 2899550 - RNA, 16 nt, Human
aaagacccagggggag

SEQ ID NO: 2899551 - RNA, 15 nt, Human
aaagacccaggggga

SEQ ID NO: 2899552 - RNA, 20 nt, Human
aaagacauugauucagccug

SEQ ID NO: 2899553 - RNA, 11 nt, Human
aaagaccaaac

SEQ ID NO: 2899554 - RNA, 13 nt, Human
aaagaccaaacuu

SEQ ID NO: 2899555 - RNA, 14 nt, Human
aaagaccaaacuuc

SEQ ID NO: 2899556 - RNA, 22 nt, Human
aaagaccaaacuucacucuggg

SEQ ID NO: 2899557 - RNA, 13 nt, Human
aaagacaucuuuc

SEQ ID NO: 2899558 - RNA, 23 nt, Human
aaagacaucuuucucuuuucuaa

SEQ ID NO: 2899559 - RNA, 14 nt, Human
aaagacauguugua

SEQ ID NO: 2899560 - RNA, 17 nt, Human
aaagacacugccugggc

SEQ ID NO: 2899561 - RNA, 16 nt, Human
aaagacacugccuggg

SEQ ID NO: 2899562 - RNA, 19 nt, Human
aaagacacugccugggcug

SEQ ID NO: 2899563 - RNA, 22 nt, Human
aaagacagggcugauaagcuaa

SEQ ID NO: 2899564 - RNA, 15 nt, Human
aaagacaggcucugu

SEQ ID NO: 2899565 - RNA, 17 nt, Human
aaacuucauucucguga

SEQ ID NO: 2899566 - RNA, 20 nt, Human
aaacuucagaugggaggaaa

SEQ ID NO: 2899567 - RNA, 13 nt, Human
aaacuucagcacc

SEQ ID NO: 2899568 - RNA, 15 nt, Human
aaacuucauguaacu

SEQ ID NO: 2899569 - RNA, 16 nt, Human
gggugggggccaccug

SEQ ID NO: 2899570 - RNA, 21 nt, Human
gggugggggccaccugccugc

SEQ ID NO: 2899571 - RNA, 16 nt, Human
aaacuugcugagcugu

SEQ ID NO: 2899572 - RNA, 18 nt, Human
aaacuugcuuuaugccuu

SEQ ID NO: 2899573 - RNA, 18 nt, Human
aaacuuuucaaggcuuau

SEQ ID NO: 2899574 - RNA, 16 nt, Human
aaacuugucacuugca

SEQ ID NO: 2899575 - RNA, 17 nt, Human
aaacuugucacuugcau

SEQ ID NO: 2899576 - RNA, 18 nt, Human
aaacuugucacuugcaug

SEQ ID NO: 2899577 - RNA, 19 nt, Human
aaacuugucacuugcaugu

SEQ ID NO: 2899578 - RNA, 20 nt, Human
aaacuugucacuugcauguc

SEQ ID NO: 2899579 - RNA, 22 nt, Human
aaacuugucuuuucaaaauauu

SEQ ID NO: 2899580 - RNA, 12 nt, Human
aaacuugugaau

SEQ ID NO: 2899581 - RNA, 13 nt, Human
aaacuugugaaug

SEQ ID NO: 2899582 - RNA, 15 nt, Human
aaacuugugaaugcu

SEQ ID NO: 2899583 - RNA, 20 nt, Human
aaagggguuggggugacagu

SEQ ID NO: 2899584 - RNA, 22 nt, Human
aaagggguuggggugacaguca

SEQ ID NO: 2899585 - RNA, 22 nt, Human
aaagggucaaugcuauuuuugu

SEQ ID NO: 2899586 - RNA, 20 nt, Human
aaagggaucaucaugcagcu

SEQ ID NO: 2899587 - RNA, 22 nt, Human
aaagggacuuggaagcuccgcu

SEQ ID NO: 2899588 - RNA, 23 nt, Human
aaaggagcccuuaucugugcuca

SEQ ID NO: 2899589 - RNA, 18 nt, Human
aaagggagcuaucaggaa

SEQ ID NO: 2899590 - RNA, 23 nt, Human
aaagggagcacuggguugacuuu

SEQ ID NO: 2899591 - RNA, 17 nt, Human
aaaggaaaucucacccc

SEQ ID NO: 2899592 - RNA, 12 nt, Human
aaaggaacauuu

SEQ ID NO: 2899593 - RNA, 16 nt, Human
aaaggaacauuuaggg

SEQ ID NO: 2899594 - RNA, 15 nt, Human
aaaggaacugcagca

SEQ ID NO: 2899595 - RNA, 23 nt, Human
aaaggaaaucucaccccauccca

SEQ ID NO: 2899596 - RNA, 19 nt, Human
aaaggagcccuuaucugug

SEQ ID NO: 2899597 - RNA, 17 nt, Human
aaaggaaagugcuuucc

SEQ ID NO: 2899598 - RNA, 14 nt, Human
aaagcacggacucu

SEQ ID NO: 2899599 - RNA, 15 nt, Human
aaagcacuagagaau

SEQ ID NO: 2899600 - RNA, 18 nt, Human
aaagcacuagagaaugca

SEQ ID NO: 2899601 - RNA, 22 nt, Human
aaagcacuagagaaugcacaga

SEQ ID NO: 2899602 - RNA, 21 nt, Human
aaagcucauauuuuguauaua

SEQ ID NO: 2899603 - RNA, 19 nt, Human
aaagcucauuucaugcucu

SEQ ID NO: 2899604 - RNA, 20 nt, Human
aaagcucauuucaugcucug

SEQ ID NO: 2899605 - RNA, 19 nt, Human
aaagcuccaugugccucuu

SEQ ID NO: 2899606 - RNA, 22 nt, Human
aaagcuccaugugccucuuugu

SEQ ID NO: 2899607 - RNA, 20 nt, Human
aaagcuccuggggcguccag

SEQ ID NO: 2899608 - RNA, 13 nt, Human
aaagcucauauuu

SEQ ID NO: 2899609 - RNA, 13 nt, Human
aaagcucuguggc

SEQ ID NO: 2899610 - RNA, 22 nt, Human
aaagcucuguugcaauuaggau

SEQ ID NO: 2899611 - RNA, 14 nt, Human
aaagcucuagaauc

SEQ ID NO: 2899612 - RNA, 13 nt, Human
aaagcuccugucc

SEQ ID NO: 2899613 - RNA, 16 nt, Human
aaagcuccuguccucc

SEQ ID NO: 2899614 - RNA, 15 nt, Human
aaagcugaaaacugc

SEQ ID NO: 2899615 - RNA, 12 nt, Human
aaagcuuuauga

SEQ ID NO: 2899616 - RNA, 13 nt, Human
aaagcuuuaugau

SEQ ID NO: 2899617 - RNA, 19 nt, Human
aaagcuuuaugauuuucau

SEQ ID NO: 2899618 - RNA, 20 nt, Human
aaagcuuuaugauuuucaua

SEQ ID NO: 2899619 - RNA, 21 nt, Human
aaagcuuuaugauuuucauaa

SEQ ID NO: 2899620 - RNA, 18 nt, Human
aaagcuuuauuaccagug

SEQ ID NO: 2899621 - RNA, 13 nt, Human
aaagcugcugaca

SEQ ID NO: 2899622 - RNA, 21 nt, Human
aaagcugcucagggaaaagca

SEQ ID NO: 2899623 - RNA, 24 nt, Human
aaagcugcccacuguuucucuuga

SEQ ID NO: 2899624 - RNA, 22 nt, Human
aaagcugcccacuguuucucuu

SEQ ID NO: 2899625 - RNA, 15 nt, Human
aaagcugccuguagu

SEQ ID NO: 2899626 - RNA, 12 nt, Human
aaagcugaaaac

SEQ ID NO: 2899627 - RNA, 23 nt, Human
aaagcugccuguaguuaggaaau

SEQ ID NO: 2899628 - RNA, 21 nt, Human
aaagcugccuguaguuaggaa

SEQ ID NO: 2899629 - RNA, 17 nt, Human
aaagcugccuguaguua

SEQ ID NO: 2899630 - RNA, 16 nt, Human
aaagcugccuguaguu

SEQ ID NO: 2899631 - RNA, 20 nt, Human
ggucgaccccaaagccccuu

SEQ ID NO: 2899632 - RNA, 13 nt, Human
ggucgcccaggag

SEQ ID NO: 2899633 - RNA, 12 nt, Human
ggucgcccagga

SEQ ID NO: 2899634 - RNA, 14 nt, Human
ggucgcccaggaga

SEQ ID NO: 2899635 - RNA, 13 nt, Human
ggugaaagggagc

SEQ ID NO: 2899636 - RNA, 24 nt, Human
ggugauccacccaccucagccucc

SEQ ID NO: 2899637 - RNA, 23 nt, Human
ggugauccacccaccucagccuc

SEQ ID NO: 2899638 - RNA, 18 nt, Human
ggugauccacccaccuca

SEQ ID NO: 2899639 - RNA, 14 nt, Human
ggugaaagggagcu

SEQ ID NO: 2899640 - RNA, 23 nt, Human
ggugaaauuuauuaguuaauaua

SEQ ID NO: 2899641 - RNA, 22 nt, Human
ggugcaacccaaggacugaggg

SEQ ID NO: 2899642 - RNA, 18 nt, Human
ggugcaaaguucccuacu

SEQ ID NO: 2899643 - RNA, 13 nt, Human
gguggaugccugg

SEQ ID NO: 2899644 - RNA, 20 nt, Human
gguggagguugcauugagcu

SEQ ID NO: 2899645 - RNA, 19 nt, Human
gguggagugcaguggugcg

SEQ ID NO: 2899646 - RNA, 16 nt, Human
gguggaucaccugagg

SEQ ID NO: 2899647 - RNA, 21 nt, Human
gguggagccaguaaacagagg

SEQ ID NO: 2899648 - RNA, 20 nt, Human
gguggaggguggggggcgcu

SEQ ID NO: 2899649 - RNA, 21 nt, Human
ggugcuuguucccucucccug

SEQ ID NO: 2899650 - RNA, 11 nt, Human
gguggaagagc

SEQ ID NO: 2899651 - RNA, 14 nt, Human
gguggaagagcuca

SEQ ID NO: 2899652 - RNA, 15 nt, Human
gguggaaggcagaca

SEQ ID NO: 2899653 - RNA, 15 nt, Human
ggugcauagaacugg

SEQ ID NO: 2899654 - RNA, 18 nt, Human
ggugcauagaacugggua

SEQ ID NO: 2899655 - RNA, 23 nt, Human
ggugcaacccaaggacugaggga

SEQ ID NO: 2899656 - RNA, 13 nt, Human
ggugcaaggaaaa

SEQ ID NO: 2899657 - RNA, 16 nt, Human
ggugcaacccuuaccc

SEQ ID NO: 2899658 - RNA, 15 nt, Human
ggugcagcagugagg

SEQ ID NO: 2899659 - RNA, 23 nt, Human
aaacucaggauggucaucuugga

SEQ ID NO: 2899660 - RNA, 13 nt, Human
aaacucagggaca

SEQ ID NO: 2899661 - RNA, 17 nt, Human
aaacucagggacagagc

SEQ ID NO: 2899662 - RNA, 21 nt, Human
aaacucagccugggacaguuu

SEQ ID NO: 2899663 - RNA, 18 nt, Human
aaacucagggacagagcc

SEQ ID NO: 2899664 - RNA, 19 nt, Human
aaacucagggacagagcca

SEQ ID NO: 2899665 - RNA, 13 nt, Human
aaacucacaaaug

SEQ ID NO: 2899666 - RNA, 15 nt, Human
aaacucacaaaugau

SEQ ID NO: 2899667 - RNA, 13 nt, Human
aaacucaagacaa

SEQ ID NO: 2899668 - RNA, 14 nt, Human
aaacucaagacaau

SEQ ID NO: 2899669 - RNA, 20 nt, Human
aaacuauuugucuuucagga

SEQ ID NO: 2899670 - RNA, 13 nt, Human
aaacucaaaacuu

SEQ ID NO: 2899671 - RNA, 21 nt, Human
aaacucaaaauauuuguacau

SEQ ID NO: 2899672 - RNA, 22 nt, Human
aaacucaaaacuuaacauauuu

SEQ ID NO: 2899673 - RNA, 13 nt, Human
aaacucaaaauau

SEQ ID NO: 2899674 - RNA, 18 nt, Human
aaacucaaaacuuaacau

SEQ ID NO: 2899675 - RNA, 19 nt, Human
aaacucaaaacuuaacaua

SEQ ID NO: 2899676 - RNA, 17 nt, Human
aaacuaggaaauuuuuu

SEQ ID NO: 2899677 - RNA, 14 nt, Human
aaacgguucaguuu

SEQ ID NO: 2899678 - RNA, 17 nt, Human
aaacgguucaguuucuu

SEQ ID NO: 2899679 - RNA, 19 nt, Human
aaacgguucaguuucuucu

SEQ ID NO: 2899680 - RNA, 15 nt, Human
aaaccuuuuuuaaga

SEQ ID NO: 2899681 - RNA, 16 nt, Human
aaaccuuuuuuaagau

SEQ ID NO: 2899682 - RNA, 11 nt, Human
aaacuaucagu

SEQ ID NO: 2899683 - RNA, 13 nt, Human
aaacuauacuuga

SEQ ID NO: 2899684 - RNA, 18 nt, Human
aaacuauacuugaacaaa

SEQ ID NO: 2899685 - RNA, 19 nt, Human
aaacuauacuugaacaaaa

SEQ ID NO: 2899686 - RNA, 20 nt, Human
aaacuauacuugaacaaaag

SEQ ID NO: 2899687 - RNA, 22 nt, Human
aaacuauacuugaacaaaaggg

SEQ ID NO: 2899688 - RNA, 16 nt, Human
aaacuaucuuggugaa

SEQ ID NO: 2899689 - RNA, 14 nt, Human
aaacuaucuugugu

SEQ ID NO: 2899690 - RNA, 14 nt, Human
aaacuaugaaaccu

SEQ ID NO: 2899691 - RNA, 19 nt, Human
aaacuaugaaaccuuuuuc

SEQ ID NO: 2899692 - RNA, 16 nt, Human
aaacuaucaguuuguc

SEQ ID NO: 2899693 - RNA, 15 nt, Human
aaacuaucuggccau

SEQ ID NO: 2899694 - RNA, 14 nt, Human
aaacuauuaaggau

SEQ ID NO: 2899695 - RNA, 21 nt, Human
aaacuauuaaggauguagcuu

SEQ ID NO: 2899696 - RNA, 22 nt, Human
aaacuauuaaggauguagcuuu

SEQ ID NO: 2899697 - RNA, 19 nt, Human
aaacuauucaugcuaccca

SEQ ID NO: 2899698 - RNA, 14 nt, Human
aaacuaguaguucu

SEQ ID NO: 2899699 - RNA, 15 nt, Human
aaacuaguaguucuc

SEQ ID NO: 2899700 - RNA, 17 nt, Human
aaacuaguaguucucuu

SEQ ID NO: 2899701 - RNA, 18 nt, Human
aaacuaguaguucucuug

SEQ ID NO: 2899702 - RNA, 22 nt, Human
aaacugcccccucugcccugcg

SEQ ID NO: 2899703 - RNA, 21 nt, Human
aaacucuaaacauuaaucaau

SEQ ID NO: 2899704 - RNA, 20 nt, Human
aaacucuaaacauuaaucaa

SEQ ID NO: 2899705 - RNA, 21 nt, Human
aaacugcuggacgucuuucuu

SEQ ID NO: 2899706 - RNA, 21 nt, Human
aaacugcccccucugcccugc

SEQ ID NO: 2899707 - RNA, 19 nt, Human
aaacuggaacggugaaggu

SEQ ID NO: 2899708 - RNA, 20 nt, Human
aaacuggaacggugaaggug

SEQ ID NO: 2899709 - RNA, 21 nt, Human
aaacugcuuuuuuuuuuccag

SEQ ID NO: 2899710 - RNA, 22 nt, Human
aaacugcuuuuuuuuuuccagc

SEQ ID NO: 2899711 - RNA, 23 nt, Human
aaacugcuuuuuuuuuuccagca

SEQ ID NO: 2899712 - RNA, 14 nt, Human
aaacuggaauaaga

SEQ ID NO: 2899713 - RNA, 15 nt, Human
aaacuggaauaagaa

SEQ ID NO: 2899714 - RNA, 18 nt, Human
aaacugucuuuaaaagag

SEQ ID NO: 2899715 - RNA, 19 nt, Human
aaacugucuuuaaaagaga

SEQ ID NO: 2899716 - RNA, 20 nt, Human
aaacugucuuuaaaagagag

SEQ ID NO: 2899717 - RNA, 14 nt, Human
ggguggcacugcca

SEQ ID NO: 2899718 - RNA, 12 nt, Human
aaaccacacaaa

SEQ ID NO: 2899719 - RNA, 14 nt, Human
aaaccacacaaaga

SEQ ID NO: 2899720 - RNA, 20 nt, Human
aaaccaagucggaacagcag

SEQ ID NO: 2899721 - RNA, 21 nt, Human
aaaccaagucggaacagcaga

SEQ ID NO: 2899722 - RNA, 19 nt, Human
aaaccaauuuuuuguucuu

SEQ ID NO: 2899723 - RNA, 22 nt, Human
aaaccaauuuuuuguucuucag

SEQ ID NO: 2899724 - RNA, 15 nt, Human
aaaccacaaaaaaau

SEQ ID NO: 2899725 - RNA, 12 nt, Human
aaaccacaaagg

SEQ ID NO: 2899726 - RNA, 15 nt, Human
aaaccacaaaggcca

SEQ ID NO: 2899727 - RNA, 19 nt, Human
aaaccacaaaggccaaacu

SEQ ID NO: 2899728 - RNA, 22 nt, Human
aaaccacaaaggccaaacugcu

SEQ ID NO: 2899729 - RNA, 21 nt, Human
aaaccacaacugacacaggaa

SEQ ID NO: 2899730 - RNA, 22 nt, Human
aaaccacaacugacacaggaaa

SEQ ID NO: 2899731 - RNA, 14 nt, Human
aaaccacaacuuuu

SEQ ID NO: 2899732 - RNA, 12 nt, Human
aaacauugaaga

SEQ ID NO: 2899733 - RNA, 16 nt, Human
aaaccaagccguggcu

SEQ ID NO: 2899734 - RNA, 23 nt, Human
aaacauucugauuuggaaaaaga

SEQ ID NO: 2899735 - RNA, 23 nt, Human
aaacauucuuuuaacuucuuucu

SEQ ID NO: 2899736 - RNA, 15 nt, Human
aaacauuaugaugug

SEQ ID NO: 2899737 - RNA, 20 nt, Human
aaacauuauagauuuucaug

SEQ ID NO: 2899738 - RNA, 13 nt, Human
aaaccuuugcccc

SEQ ID NO: 2899739 - RNA, 20 nt, Human
aaaccuuuuggaaaaucugc

SEQ ID NO: 2899740 - RNA, 22 nt, Human
aaaccucuccucauguucugcu

SEQ ID NO: 2899741 - RNA, 11 nt, Human
aaaccucuccu

SEQ ID NO: 2899742 - RNA, 17 nt, Human
aaaccucuacauauuua

SEQ ID NO: 2899743 - RNA, 16 nt, Human
aaaccugaaaaaaagu

SEQ ID NO: 2899744 - RNA, 17 nt, Human
aaaccuuucaaauuuca

SEQ ID NO: 2899745 - RNA, 11 nt, Human
aaaccuuucaa

SEQ ID NO: 2899746 - RNA, 19 nt, Human
aaaccuuucaaauuucaca

SEQ ID NO: 2899747 - RNA, 22 nt, Human
aaaccugaaaaaaaguuuacaa

SEQ ID NO: 2899748 - RNA, 12 nt, Human
aaaccugaagac

SEQ ID NO: 2899749 - RNA, 15 nt, Human
aaaccugaagacuga

SEQ ID NO: 2899750 - RNA, 18 nt, Human
aaaccugaagacugagga

SEQ ID NO: 2899751 - RNA, 14 nt, Human
gggucgaaagcucu

SEQ ID NO: 2899752 - RNA, 16 nt, Human
gggucgaaagcucuag

SEQ ID NO: 2899753 - RNA, 15 nt, Human
ggguccuucuccaca

SEQ ID NO: 2899754 - RNA, 13 nt, Human
ggguccccagggc

SEQ ID NO: 2899755 - RNA, 16 nt, Human
gggucccagccacccc

SEQ ID NO: 2899756 - RNA, 23 nt, Human
gggucggaacccaagcuuagaac

SEQ ID NO: 2899757 - RNA, 16 nt, Human
ggggggauguggauca

SEQ ID NO: 2899758 - RNA, 21 nt, Human
gggggucaccggccgauggag

SEQ ID NO: 2899759 - RNA, 20 nt, Human
gggggucaggcagccaguga

SEQ ID NO: 2899760 - RNA, 15 nt, Human
ggggggccaaaagga

SEQ ID NO: 2899761 - RNA, 16 nt, Human
ggguccagggagcagg

SEQ ID NO: 2899762 - RNA, 17 nt, Human
ggguccagggagcaggc

SEQ ID NO: 2899763 - RNA, 19 nt, Human
ggguccaguggaugccaca

SEQ ID NO: 2899764 - RNA, 15 nt, Human
aaacaauuuaaaaau

SEQ ID NO: 2899765 - RNA, 18 nt, Human
aaacagguggugagaaau

SEQ ID NO: 2899766 - RNA, 12 nt, Human
aaacaguauuua

SEQ ID NO: 2899767 - RNA, 14 nt, Human
aaacaguauuuauu

SEQ ID NO: 2899768 - RNA, 15 nt, Human
aaacaguauuuauuu

SEQ ID NO: 2899769 - RNA, 17 nt, Human
aaacaguauuuauuuug

SEQ ID NO: 2899770 - RNA, 19 nt, Human
aaacaguauuuauuuugua

SEQ ID NO: 2899771 - RNA, 20 nt, Human
aaacaguauuuauuuuguaa

SEQ ID NO: 2899772 - RNA, 15 nt, Human
aaacaguauuucauu

SEQ ID NO: 2899773 - RNA, 17 nt, Human
aaacaguauuucauugc

SEQ ID NO: 2899774 - RNA, 18 nt, Human
aaacaguauuucauugcc

SEQ ID NO: 2899775 - RNA, 17 nt, Human
aaacauguuagaagcaa

SEQ ID NO: 2899776 - RNA, 14 nt, Human
aaacauguguuuua

SEQ ID NO: 2899777 - RNA, 16 nt, Human
aaacauguuagaagca

SEQ ID NO: 2899778 - RNA, 13 nt, Human
aaacauguauuua

SEQ ID NO: 2899779 - RNA, 15 nt, Human
aaacauguauuuaug

SEQ ID NO: 2899780 - RNA, 12 nt, Human
ggggaaucuaag

SEQ ID NO: 2899781 - RNA, 19 nt, Human
ggggaaugagcccagagaa

SEQ ID NO: 2899782 - RNA, 21 nt, Human
ggggaaugagcccagagaaca

SEQ ID NO: 2899783 - RNA, 23 nt, Human
ggggaaugagcccagagaacagc

SEQ ID NO: 2899784 - RNA, 20 nt, Human
ggggaauucucagugccaac

SEQ ID NO: 2899785 - RNA, 16 nt, Human
ggggaaguccucuggg

SEQ ID NO: 2899786 - RNA, 22 nt, Human
ggggacagaggccugcccgggc

SEQ ID NO: 2899787 - RNA, 13 nt, Human
ggggacagauuca

SEQ ID NO: 2899788 - RNA, 22 nt, Human
ggggaauguuugccucugccuc

SEQ ID NO: 2899789 - RNA, 18 nt, Human
ggggaauguuugccucug

SEQ ID NO: 2899790 - RNA, 15 nt, Human
ggggaagcugcagcu

SEQ ID NO: 2899791 - RNA, 19 nt, Human
ggggaagcugcagcuuggg

SEQ ID NO: 2899792 - RNA, 21 nt, Human
ggggaaggaggguacagcugg

SEQ ID NO: 2899793 - RNA, 22 nt, Human
ggggaaggaggguacagcuggg

SEQ ID NO: 2899794 - RNA, 14 nt, Human
ggggaaggggcggu

SEQ ID NO: 2899795 - RNA, 13 nt, Human
ggggaaggcaggg

SEQ ID NO: 2899796 - RNA, 11 nt, Human
ggggagaaagu

SEQ ID NO: 2899797 - RNA, 16 nt, Human
ggggacucagcccuga

SEQ ID NO: 2899798 - RNA, 21 nt, Human
ggggacuagccccuguggaga

SEQ ID NO: 2899799 - RNA, 13 nt, Human
ggggccgggcaca

SEQ ID NO: 2899800 - RNA, 17 nt, Human
ggggaaggccaagggga

SEQ ID NO: 2899801 - RNA, 21 nt, Human
ggggcccugguccuuccaggc

SEQ ID NO: 2899802 - RNA, 12 nt, Human
ggggacugcugc

SEQ ID NO: 2899803 - RNA, 18 nt, Human
ggggacugcugcugccug

SEQ ID NO: 2899804 - RNA, 16 nt, Human
ggggacgcuccgcugc

SEQ ID NO: 2899805 - RNA, 13 nt, Human
ggggacucagccc

SEQ ID NO: 2899806 - RNA, 15 nt, Human
ggggacucagcccug

SEQ ID NO: 2899807 - RNA, 14 nt, Human
ggggacucagcccu

SEQ ID NO: 2899808 - RNA, 20 nt, Human
ggggacucugagcgggaggc

SEQ ID NO: 2899809 - RNA, 21 nt, Human
ggggacucugagcgggaggca

SEQ ID NO: 2899810 - RNA, 23 nt, Human
ggggacucugagcgggaggcaga

SEQ ID NO: 2899811 - RNA, 15 nt, Human
ggggacucugggcua

SEQ ID NO: 2899812 - RNA, 16 nt, Human
ggggacucugggcuau

SEQ ID NO: 2899813 - RNA, 22 nt, Human
ggggacucugggcuauggacac

SEQ ID NO: 2899814 - RNA, 21 nt, Human
ggggacccaauguaggagcug

SEQ ID NO: 2899815 - RNA, 11 nt, Human
ggggacccacg

SEQ ID NO: 2899816 - RNA, 13 nt, Human
ggggacccaggcu

SEQ ID NO: 2899817 - RNA, 14 nt, Human
ggggacccaggcuc

SEQ ID NO: 2899818 - RNA, 19 nt, Human
ggggacccaggcuccgccc

SEQ ID NO: 2899819 - RNA, 18 nt, Human
ggggacccccgcccccug

SEQ ID NO: 2899820 - RNA, 13 nt, Human
ggggacccccgcc

SEQ ID NO: 2899821 - RNA, 15 nt, Human
ggggacccccgcccc

SEQ ID NO: 2899822 - RNA, 18 nt, Human
gggggccucagugccacu

SEQ ID NO: 2899823 - RNA, 17 nt, Human
gggggccucagugccac

SEQ ID NO: 2899824 - RNA, 15 nt, Human
gggggccucagugcc

SEQ ID NO: 2899825 - RNA, 12 nt, Human
gggggccucagu

SEQ ID NO: 2899826 - RNA, 15 nt, Human
ggggccucagugcca

SEQ ID NO: 2899827 - RNA, 23 nt, Human
ggggccuacagcuuugaucccug

SEQ ID NO: 2899828 - RNA, 18 nt, Human
ggggccguggggguugag

SEQ ID NO: 2899829 - RNA, 14 nt, Human
gggggccaccugcc

SEQ ID NO: 2899830 - RNA, 16 nt, Human
gggggccaccugccug

SEQ ID NO: 2899831 - RNA, 13 nt, Human
ggggccucagacg

SEQ ID NO: 2899832 - RNA, 14 nt, Human
ggggccucagacga

SEQ ID NO: 2899833 - RNA, 11 nt, Human
aaacacagagg

SEQ ID NO: 2899834 - RNA, 10 nt, Human
aaacacagag

SEQ ID NO: 2899835 - RNA, 22 nt, Human
aaacacaaaccacaacugacac

SEQ ID NO: 2899836 - RNA, 11 nt, Human
aaacacagcug

SEQ ID NO: 2899837 - RNA, 12 nt, Human
aaacacagcugu

SEQ ID NO: 2899838 - RNA, 13 nt, Human
aaacacagcuguu

SEQ ID NO: 2899839 - RNA, 23 nt, Human
aaacacagcuuacaaucgcaaau

SEQ ID NO: 2899840 - RNA, 19 nt, Human
aaacacagucaaaauaauu

SEQ ID NO: 2899841 - RNA, 20 nt, Human
aaacacagucaaaauaauuc

SEQ ID NO: 2899842 - RNA, 18 nt, Human
aaacacaucuuuccuguc

SEQ ID NO: 2899843 - RNA, 13 nt, Human
aaacacauugccu

SEQ ID NO: 2899844 - RNA, 23 nt, Human
aaacacauugccuaacuacuagu

SEQ ID NO: 2899845 - RNA, 15 nt, Human
aaacacauuguuauu

SEQ ID NO: 2899846 - RNA, 16 nt, Human
aaacacauuguuauuu

SEQ ID NO: 2899847 - RNA, 20 nt, Human
aaacacauuguuauuuucag

SEQ ID NO: 2899848 - RNA, 17 nt, Human
aaacaaugcaaaaccuu

SEQ ID NO: 2899849 - RNA, 15 nt, Human
aaacaaucacacuca

SEQ ID NO: 2899850 - RNA, 12 nt, Human
aaacaaucucuu

SEQ ID NO: 2899851 - RNA, 15 nt, Human
aaacaaucucuuaaa

SEQ ID NO: 2899852 - RNA, 18 nt, Human
aaacaaucuggaagaaaa

SEQ ID NO: 2899853 - RNA, 22 nt, Human
aaacaauaguaauucucaggcc

SEQ ID NO: 2899854 - RNA, 12 nt, Human
aaacaauaucau

SEQ ID NO: 2899855 - RNA, 21 nt, Human
aaacaaauucauauucugucu

SEQ ID NO: 2899856 - RNA, 16 nt, Human
aaacaacaacacaaua

SEQ ID NO: 2899857 - RNA, 16 nt, Human
aaacaauaaaugugca

SEQ ID NO: 2899858 - RNA, 15 nt, Human
aaacaauaaaugugc

SEQ ID NO: 2899859 - RNA, 12 nt, Human
aaacaaauaugc

SEQ ID NO: 2899860 - RNA, 13 nt, Human
aaacaaauaaaaa

SEQ ID NO: 2899861 - RNA, 15 nt, Human
aaacaaauaaucaca

SEQ ID NO: 2899862 - RNA, 16 nt, Human
aaacaaauaaucacau

SEQ ID NO: 2899863 - RNA, 17 nt, Human
aaacaaauaaucacauu

SEQ ID NO: 2899864 - RNA, 13 nt, Human
aaacaaauaugca

SEQ ID NO: 2899865 - RNA, 14 nt, Human
aaacaaauaugcaa

SEQ ID NO: 2899866 - RNA, 17 nt, Human
aaacaaauaugcaaaag

SEQ ID NO: 2899867 - RNA, 19 nt, Human
aaacaaauucauauucugu

SEQ ID NO: 2899868 - RNA, 13 nt, Human
aaaauuuuauucc

SEQ ID NO: 2899869 - RNA, 15 nt, Human
aaaauuuucucauuu

SEQ ID NO: 2899870 - RNA, 19 nt, Human
aaaauuuucucauuuucuu

SEQ ID NO: 2899871 - RNA, 21 nt, Human
aaaauuuuaggcacucuuaaa

SEQ ID NO: 2899872 - RNA, 16 nt, Human
aaaauuuugcuuuuaa

SEQ ID NO: 2899873 - RNA, 17 nt, Human
aaaauuuugcuuuuaau

SEQ ID NO: 2899874 - RNA, 17 nt, Human
aaacaaagguugagaug

SEQ ID NO: 2899875 - RNA, 13 nt, Human
aaacaaagucuuu

SEQ ID NO: 2899876 - RNA, 20 nt, Human
gggaugccacuccucccucc

SEQ ID NO: 2899877 - RNA, 18 nt, Human
aaaauuuaagugcgugug

SEQ ID NO: 2899878 - RNA, 23 nt, Human
aaaauuuaagugcguguguagag

SEQ ID NO: 2899879 - RNA, 19 nt, Human
aaaauuuuaccagcagaag

SEQ ID NO: 2899880 - RNA, 22 nt, Human
aaaauuuuaccagcagaaggau

SEQ ID NO: 2899881 - RNA, 21 nt, Human
aaaauuuuauaaaauuaagca

SEQ ID NO: 2899882 - RNA, 13 nt, Human
aaaauuuuauaag

SEQ ID NO: 2899883 - RNA, 15 nt, Human
aaaauuuuauaagca

SEQ ID NO: 2899884 - RNA, 23 nt, Human
aaaauuuuauaagcaaauuucaa

SEQ ID NO: 2899885 - RNA, 13 nt, Human
aaaauuuauuuca

SEQ ID NO: 2899886 - RNA, 14 nt, Human
aaaauuuauuucau

SEQ ID NO: 2899887 - RNA, 19 nt, Human
aaaauuuguuugaaaucuu

SEQ ID NO: 2899888 - RNA, 13 nt, Human
gggaugagaaagg

SEQ ID NO: 2899889 - RNA, 20 nt, Human
gggaugacaugcacucagcu

SEQ ID NO: 2899890 - RNA, 20 nt, Human
gggaugagcauggagcuggc

SEQ ID NO: 2899891 - RNA, 18 nt, Human
aaaauguuaucuucucaa

SEQ ID NO: 2899892 - RNA, 21 nt, Human
gggaugagcauggagcuggcc

SEQ ID NO: 2899893 - RNA, 15 nt, Human
gggaugagccgcugu

SEQ ID NO: 2899894 - RNA, 20 nt, Human
gggaugagcucaagcaggaa

SEQ ID NO: 2899895 - RNA, 22 nt, Human
aaaauguuaucuucucaaguuc

SEQ ID NO: 2899896 - RNA, 16 nt, Human
aaaauguucagaaggu

SEQ ID NO: 2899897 - RNA, 12 nt, Human
aaaauguucauc

SEQ ID NO: 2899898 - RNA, 22 nt, Human
aaaauguucaucaauucccauu

SEQ ID NO: 2899899 - RNA, 15 nt, Human
aaaauguuuuagcaa

SEQ ID NO: 2899900 - RNA, 18 nt, Human
aaaauguuuuagcaauuu

SEQ ID NO: 2899901 - RNA, 15 nt, Human
aaaauguuuuuucau

SEQ ID NO: 2899902 - RNA, 21 nt, Human
aaaauguuuuuucauguguuu

SEQ ID NO: 2899903 - RNA, 12 nt, Human
aaaauuaaaaug

SEQ ID NO: 2899904 - RNA, 18 nt, Human
aaaauuaaacacaaagug

SEQ ID NO: 2899905 - RNA, 19 nt, Human
aaaauuuaaguaucuuuuu

SEQ ID NO: 2899906 - RNA, 15 nt, Human
aaaauuuaagugcgu

SEQ ID NO: 2899907 - RNA, 14 nt, Human
aaaauguugagaau

SEQ ID NO: 2899908 - RNA, 20 nt, Human
ggacucagggccaugccugc

SEQ ID NO: 2899909 - RNA, 18 nt, Human
ggacuccagaaucuaaag

SEQ ID NO: 2899910 - RNA, 14 nt, Human
ggacucaugaggag

SEQ ID NO: 2899911 - RNA, 18 nt, Human
ggacucaaugcacugaca

SEQ ID NO: 2899912 - RNA, 16 nt, Human
ggacucaaugcacuga

SEQ ID NO: 2899913 - RNA, 13 nt, Human
ggacucagcuccc

SEQ ID NO: 2899914 - RNA, 17 nt, Human
ggacucagcuccccaga

SEQ ID NO: 2899915 - RNA, 21 nt, Human
ggacuaagccuaccugcucuc

SEQ ID NO: 2899916 - RNA, 14 nt, Human
ggacuacaggugug

SEQ ID NO: 2899917 - RNA, 15 nt, Human
ggacucaaugcacug

SEQ ID NO: 2899918 - RNA, 14 nt, Human
ggacuauuauaauu

SEQ ID NO: 2899919 - RNA, 16 nt, Human
ggacuaagccuaccug

SEQ ID NO: 2899920 - RNA, 19 nt, Human
ggacuaagccuaccugcuc

SEQ ID NO: 2899921 - RNA, 22 nt, Human
ggacuaaccccaacgcacagga

SEQ ID NO: 2899922 - RNA, 12 nt, Human
ggacguuucuca

SEQ ID NO: 2899923 - RNA, 21 nt, Human
ggacuaaaugccuaguuuuua

SEQ ID NO: 2899924 - RNA, 22 nt, Human
ggacuuugcugauuuccccucu

SEQ ID NO: 2899925 - RNA, 17 nt, Human
ggagacuaucagcccaa

SEQ ID NO: 2899926 - RNA, 16 nt, Human
ggagacucuguggggc

SEQ ID NO: 2899927 - RNA, 13 nt, Human
ggagacucugugg

SEQ ID NO: 2899928 - RNA, 18 nt, Human
ggagacuccuaggcagga

SEQ ID NO: 2899929 - RNA, 21 nt, Human
ggagacuccuaggcaggacau

SEQ ID NO: 2899930 - RNA, 13 nt, Human
ggagacuccuagg

SEQ ID NO: 2899931 - RNA, 16 nt, Human
ggagacuccuaggcag

SEQ ID NO: 2899932 - RNA, 19 nt, Human
ggacuugaacuuuccugga

SEQ ID NO: 2899933 - RNA, 14 nt, Human
ggacuuggaagcuc

SEQ ID NO: 2899934 - RNA, 22 nt, Human
ggacuuucaaaauuaaaucugu

SEQ ID NO: 2899935 - RNA, 11 nt, Human
ggacuccaucu

SEQ ID NO: 2899936 - RNA, 22 nt, Human
ggacuccaucucucauccucca

SEQ ID NO: 2899937 - RNA, 16 nt, Human
ggacuccggcccuccu

SEQ ID NO: 2899938 - RNA, 21 nt, Human
ggacuccuccccacccuccug

SEQ ID NO: 2899939 - RNA, 22 nt, Human
ggacuccuccccacccuccugg

SEQ ID NO: 2899940 - RNA, 23 nt, Human
ggacuccuccccacccuccuggc

SEQ ID NO: 2899941 - RNA, 15 nt, Human
ggacuccuccuuucu

SEQ ID NO: 2899942 - RNA, 17 nt, Human
ggacuccuccuuucucc

SEQ ID NO: 2899943 - RNA, 22 nt, Human
ggacucccuccucaccucugga

SEQ ID NO: 2899944 - RNA, 20 nt, Human
ggacucccuccucaccucug

SEQ ID NO: 2899945 - RNA, 22 nt, Human
ggacggccugaugcucccuccc

SEQ ID NO: 2899946 - RNA, 15 nt, Human
ggacggcugggcaca

SEQ ID NO: 2899947 - RNA, 17 nt, Human
ggacggggaagccgagc

SEQ ID NO: 2899948 - RNA, 21 nt, Human
ggacggccugaugcucccucc

SEQ ID NO: 2899949 - RNA, 18 nt, Human
ggacggcauuccugcuua

SEQ ID NO: 2899950 - RNA, 13 nt, Human
ggacgucuuucuu

SEQ ID NO: 2899951 - RNA, 20 nt, Human
ggacggugcuccaggcaggc

SEQ ID NO: 2899952 - RNA, 17 nt, Human
ggacgucagacuuggcu

SEQ ID NO: 2899953 - RNA, 17 nt, Human
ggacggugcuccaggca

SEQ ID NO: 2899954 - RNA, 18 nt, Human
ggacggugcuccaggcag

SEQ ID NO: 2899955 - RNA, 14 nt, Human
ggacggugcuccag

SEQ ID NO: 2899956 - RNA, 15 nt, Human
ggacggugcuccagg

SEQ ID NO: 2899957 - RNA, 15 nt, Human
ggacggucaguuugg

SEQ ID NO: 2899958 - RNA, 23 nt, Human
ggacccuugagaguaucaggucu

SEQ ID NO: 2899959 - RNA, 11 nt, Human
ggacccugcuu

SEQ ID NO: 2899960 - RNA, 21 nt, Human
ggacccugcuuuagagcuagg

SEQ ID NO: 2899961 - RNA, 23 nt, Human
ggacccccgcccccugcccuccc

SEQ ID NO: 2899962 - RNA, 16 nt, Human
ggacccccgcccccug

SEQ ID NO: 2899963 - RNA, 19 nt, Human
ggacccccgcccccugccc

SEQ ID NO: 2899964 - RNA, 20 nt, Human
ggacccccgcccccugcccu

SEQ ID NO: 2899965 - RNA, 22 nt, Human
ggacccccgcccccugcccucc

SEQ ID NO: 2899966 - RNA, 14 nt, Human
ggacccccgccccc

SEQ ID NO: 2899967 - RNA, 15 nt, Human
ggacccccgcccccu

SEQ ID NO: 2899968 - RNA, 20 nt, Human
ggacaggaugaccuggauaa

SEQ ID NO: 2899969 - RNA, 12 nt, Human
ggaagagaaauc

SEQ ID NO: 2899970 - RNA, 13 nt, Human
ggaagagaaucac

SEQ ID NO: 2899971 - RNA, 13 nt, Human
ggaagacauuucu

SEQ ID NO: 2899972 - RNA, 15 nt, Human
ggaagacauuucuuu

SEQ ID NO: 2899973 - RNA, 19 nt, Human
ggaagacauuucuuuucuu

SEQ ID NO: 2899974 - RNA, 23 nt, Human
ggaagacauuucuuuucuuuuua

SEQ ID NO: 2899975 - RNA, 15 nt, Human
ggaagacauuuuucc

SEQ ID NO: 2899976 - RNA, 12 nt, Human
ggaagacagaga

SEQ ID NO: 2899977 - RNA, 23 nt, Human
ggaagacagagaccuccugccuc

SEQ ID NO: 2899978 - RNA, 21 nt, Human
ggaacuugagcgugaaucugu

SEQ ID NO: 2899979 - RNA, 16 nt, Human
ggaacuguccagagag

SEQ ID NO: 2899980 - RNA, 17 nt, Human
ggaacuguccagagagc

SEQ ID NO: 2899981 - RNA, 14 nt, Human
ggaacuucagagau

SEQ ID NO: 2899982 - RNA, 18 nt, Human
ggaacuguccagagagca

SEQ ID NO: 2899983 - RNA, 15 nt, Human
ggaacuucuaauaua

SEQ ID NO: 2899984 - RNA, 12 nt, Human
ggaacacugccc

SEQ ID NO: 2899985 - RNA, 13 nt, Human
ggaacacugcccu

SEQ ID NO: 2899986 - RNA, 16 nt, Human
ggaacacugcccucgc

SEQ ID NO: 2899987 - RNA, 14 nt, Human
ggaacacuggcaga

SEQ ID NO: 2899988 - RNA, 15 nt, Human
ggaacacuggcagac

SEQ ID NO: 2899989 - RNA, 19 nt, Human
ggaacagaaggaugaauga

SEQ ID NO: 2899990 - RNA, 13 nt, Human
ggaacagaaggau

SEQ ID NO: 2899991 - RNA, 12 nt, Human
ggaacagaagga

SEQ ID NO: 2899992 - RNA, 11 nt, Human
ggaacagaagg

SEQ ID NO: 2899993 - RNA, 21 nt, Human
ggaacagacaacagaagucau

SEQ ID NO: 2899994 - RNA, 20 nt, Human
ggaacagacaacagaaguca

SEQ ID NO: 2899995 - RNA, 18 nt, Human
ggaacagacaacagaagu

SEQ ID NO: 2899996 - RNA, 12 nt, Human
ggaacagaaugu

SEQ ID NO: 2899997 - RNA, 16 nt, Human
ggaacagaauguuuua

SEQ ID NO: 2899998 - RNA, 19 nt, Human
ggaacagaauguuuuacug

SEQ ID NO: 2899999 - RNA, 14 nt, Human
ggaacuguccagag

SEQ ID NO: 2900000 - RNA, 15 nt, Human
ggaacuguccagaga

SEQ ID NO: 2900001 - RNA, 17 nt, Human
ggaauaagaagcaaaua

SEQ ID NO: 2900002 - RNA, 20 nt, Human
ggaauaagaagcaaauaaau

SEQ ID NO: 2900003 - RNA, 21 nt, Human
ggaauaagaagcaaauaaaua

SEQ ID NO: 2900004 - RNA, 14 nt, Human
ggaauaaccuucca

SEQ ID NO: 2900005 - RNA, 22 nt, Human
ggaauaaccuuccauacauuuu

SEQ ID NO: 2900006 - RNA, 22 nt, Human
ggaauaaaaggcuugaagcugu

SEQ ID NO: 2900007 - RNA, 21 nt, Human
ggaauaaaauccuaagacaca

SEQ ID NO: 2900008 - RNA, 18 nt, Human
ggaauaaaaggcuugaag

SEQ ID NO: 2900009 - RNA, 17 nt, Human
ggaauaaaaggcuugaa

SEQ ID NO: 2900010 - RNA, 15 nt, Human
ggaauaaaaggcuug

SEQ ID NO: 2900011 - RNA, 14 nt, Human
ggaauaaaaggcuu

SEQ ID NO: 2900012 - RNA, 16 nt, Human
ggaauccagacccggc

SEQ ID NO: 2900013 - RNA, 17 nt, Human
ggaauccuauauagaau

SEQ ID NO: 2900014 - RNA, 22 nt, Human
ggaauccuauauagaaugcugc

SEQ ID NO: 2900015 - RNA, 23 nt, Human
ggaauccuauauagaaugcugca

SEQ ID NO: 2900016 - RNA, 14 nt, Human
ggaauccuccucca

SEQ ID NO: 2900017 - RNA, 16 nt, Human
ggaauccuccuccagg

SEQ ID NO: 2900018 - RNA, 19 nt, Human
ggaauccuccuccagggug

SEQ ID NO: 2900019 - RNA, 16 nt, Human
ggaauccacucccagg

SEQ ID NO: 2900020 - RNA, 19 nt, Human
ggaauccacucccaggcag

SEQ ID NO: 2900021 - RNA, 21 nt, Human
ggaauccaagccuccacagcg

SEQ ID NO: 2900022 - RNA, 14 nt, Human
ggaauccacuccca

SEQ ID NO: 2900023 - RNA, 20 nt, Human
ggaauccaagccuccacagc

SEQ ID NO: 2900024 - RNA, 16 nt, Human
ggaaucagcaagaaga

SEQ ID NO: 2900025 - RNA, 13 nt, Human
ggaaucagcuucu

SEQ ID NO: 2900026 - RNA, 19 nt, Human
ggaaucaugucaggccugu

SEQ ID NO: 2900027 - RNA, 21 nt, Human
ggaaucaugucaggccugugu

SEQ ID NO: 2900028 - RNA, 14 nt, Human
ggaaucagcuucua

SEQ ID NO: 2900029 - RNA, 15 nt, Human
ggaaucaugucaggc

SEQ ID NO: 2900030 - RNA, 18 nt, Human
ggaaucaugucaggccug

SEQ ID NO: 2900031 - RNA, 13 nt, Human
ggacaagcagagg

SEQ ID NO: 2900032 - RNA, 20 nt, Human
ggacaagcagagguggccag

SEQ ID NO: 2900033 - RNA, 21 nt, Human
ggaauccuggcagcccagaga

SEQ ID NO: 2900034 - RNA, 13 nt, Human
ggaauccuggcag

SEQ ID NO: 2900035 - RNA, 12 nt, Human
ggaauccuggca

SEQ ID NO: 2900036 - RNA, 20 nt, Human
ggaauccacucccaggcagc

SEQ ID NO: 2900037 - RNA, 22 nt, Human
ggaaucuaauauccccaaauua

SEQ ID NO: 2900038 - RNA, 18 nt, Human
ggacacagcucuucucca

SEQ ID NO: 2900039 - RNA, 15 nt, Human
ggacacagcucuucu

SEQ ID NO: 2900040 - RNA, 21 nt, Human
ggacacagcucuucuccaggc

SEQ ID NO: 2900041 - RNA, 16 nt, Human
ggacaccugcccugcc

SEQ ID NO: 2900042 - RNA, 21 nt, Human
ggacacgcgccccccucccag

SEQ ID NO: 2900043 - RNA, 22 nt, Human
ggacacgcgccccccucccaga

SEQ ID NO: 2900044 - RNA, 23 nt, Human
ggacacgcgccccccucccagag

SEQ ID NO: 2900045 - RNA, 14 nt, Human
ggacacagcucuuc

SEQ ID NO: 2900046 - RNA, 19 nt, Human
ggacaaucaugaaauaugc

SEQ ID NO: 2900047 - RNA, 21 nt, Human
ggacaaucaugaaauaugcau

SEQ ID NO: 2900048 - RNA, 19 nt, Human
ggacaaggacuaggguccu

SEQ ID NO: 2900049 - RNA, 12 nt, Human
ggacaauaaacc

SEQ ID NO: 2900050 - RNA, 13 nt, Human
ggacaauaaaccu

SEQ ID NO: 2900051 - RNA, 19 nt, Human
ggacaauaaaccuccgcca

SEQ ID NO: 2900052 - RNA, 20 nt, Human
ggacagcuccuucuguccua

SEQ ID NO: 2900053 - RNA, 19 nt, Human
ggacagcuccuucuguccu

SEQ ID NO: 2900054 - RNA, 22 nt, Human
ggacacuaaccacgcuggaccu

SEQ ID NO: 2900055 - RNA, 17 nt, Human
ggacacuaaccacgcug

SEQ ID NO: 2900056 - RNA, 15 nt, Human
ggacaagagguacag

SEQ ID NO: 2900057 - RNA, 22 nt, Human
ggacacggggcaguggcaaccu

SEQ ID NO: 2900058 - RNA, 15 nt, Human
ggaagcuggccugag

SEQ ID NO: 2900059 - RNA, 18 nt, Human
ggaagcucugaagucaca

SEQ ID NO: 2900060 - RNA, 17 nt, Human
ggaagcugcccugccca

SEQ ID NO: 2900061 - RNA, 10 nt, Human
ggaagcugca

SEQ ID NO: 2900062 - RNA, 11 nt, Human
ggaagcugcag

SEQ ID NO: 2900063 - RNA, 12 nt, Human
ggaagcugcagc

SEQ ID NO: 2900064 - RNA, 13 nt, Human
ggaagcugcagcu

SEQ ID NO: 2900065 - RNA, 14 nt, Human
ggaagcugcagcuu

SEQ ID NO: 2900066 - RNA, 15 nt, Human
ggaagcugcagcuug

SEQ ID NO: 2900067 - RNA, 16 nt, Human
ggaagcugcagcuugg

SEQ ID NO: 2900068 - RNA, 18 nt, Human
ggaagcugcagcuuggga

SEQ ID NO: 2900069 - RNA, 18 nt, Human
ggaagcuggccgaggguc

SEQ ID NO: 2900070 - RNA, 11 nt, Human
ggaagcuccgc

SEQ ID NO: 2900071 - RNA, 23 nt, Human
ggaagcuccacugucacccucca

SEQ ID NO: 2900072 - RNA, 14 nt, Human
ggaagcuccacugu

SEQ ID NO: 2900073 - RNA, 14 nt, Human
ggaaggagacacag

SEQ ID NO: 2900074 - RNA, 16 nt, Human
ggaaggagacacagau

SEQ ID NO: 2900075 - RNA, 17 nt, Human
ggaaggagacacagaug

SEQ ID NO: 2900076 - RNA, 19 nt, Human
ggaaggagacacagauguu

SEQ ID NO: 2900077 - RNA, 20 nt, Human
ggaaggagacacagauguuc

SEQ ID NO: 2900078 - RNA, 19 nt, Human
ggaaggaaagaaagaagga

SEQ ID NO: 2900079 - RNA, 19 nt, Human
ggaagcuuuguccccugcu

SEQ ID NO: 2900080 - RNA, 21 nt, Human
ggaagcuuuguccccugcuuc

SEQ ID NO: 2900081 - RNA, 13 nt, Human
ggaaggagagccu

SEQ ID NO: 2900082 - RNA, 14 nt, Human
ggaaguuuucugua

SEQ ID NO: 2900083 - RNA, 18 nt, Human
ggaaguuucauauauugu

SEQ ID NO: 2900084 - RNA, 19 nt, Human
ggaaguguguguggcagca

SEQ ID NO: 2900085 - RNA, 23 nt, Human
ggaaguucauaccuaaguacugu

SEQ ID NO: 2900086 - RNA, 18 nt, Human
ggaaguugacuuauagua

SEQ ID NO: 2900087 - RNA, 22 nt, Human
ggaagcggagguugcagggagc

SEQ ID NO: 2900088 - RNA, 21 nt, Human
ggaagcggcccuaagggagug

SEQ ID NO: 2900089 - RNA, 16 nt, Human
ggaagcuaauuugcau

SEQ ID NO: 2900090 - RNA, 21 nt, Human
ggaagccgagcuccagagcaa

SEQ ID NO: 2900091 - RNA, 15 nt, Human
ggaagcccuggagac

SEQ ID NO: 2900092 - RNA, 21 nt, Human
gcuggguaaacuguggaugau

SEQ ID NO: 2900093 - RNA, 15 nt, Human
gcuggguauuggaaa

SEQ ID NO: 2900094 - RNA, 23 nt, Human
gcuggguauuggaaauggaugca

SEQ ID NO: 2900095 - RNA, 16 nt, Human
gcuggcuguuggcugg

SEQ ID NO: 2900096 - RNA, 15 nt, Human
gcuggcuguuggcug

SEQ ID NO: 2900097 - RNA, 16 nt, Human
gcuggcugggcaugga

SEQ ID NO: 2900098 - RNA, 15 nt, Human
gcuggcugggcaugg

SEQ ID NO: 2900099 - RNA, 13 nt, Human
gcuggcuggggug

SEQ ID NO: 2900100 - RNA, 21 nt, Human
gcuggcugggguggccugugu

SEQ ID NO: 2900101 - RNA, 22 nt, Human
gcuggcugggguggccugugug

SEQ ID NO: 2900102 - RNA, 20 nt, Human
gcuggaguacaguggugcca

SEQ ID NO: 2900103 - RNA, 16 nt, Human
gcuggcucacaguaca

SEQ ID NO: 2900104 - RNA, 17 nt, Human
gcuggcucacaguacag

SEQ ID NO: 2900105 - RNA, 18 nt, Human
gcuggcucacaguacagc

SEQ ID NO: 2900106 - RNA, 23 nt, Human
gcuggcucacaguacagcaugug

SEQ ID NO: 2900107 - RNA, 22 nt, Human
gcuggagugcagugagccgaga

SEQ ID NO: 2900108 - RNA, 17 nt, Human
gcuggagugcagugagc

SEQ ID NO: 2900109 - RNA, 18 nt, Human
gcuggagugcagugagcc

SEQ ID NO: 2900110 - RNA, 20 nt, Human
gcuggcgugcaguggugcga

SEQ ID NO: 2900111 - RNA, 22 nt, Human
gcuggaggugggagcaggagau

SEQ ID NO: 2900112 - RNA, 16 nt, Human
gcuggagguggggcga

SEQ ID NO: 2900113 - RNA, 22 nt, Human
gcuggagguggggcgaggcagg

SEQ ID NO: 2900114 - RNA, 23 nt, Human
gcuggagguggggcgaggcaggc

SEQ ID NO: 2900115 - RNA, 16 nt, Human
gcuggaggugggagca

SEQ ID NO: 2900116 - RNA, 17 nt, Human
gcuggaggugggagcag

SEQ ID NO: 2900117 - RNA, 19 nt, Human
gcuggaggugggagcagga

SEQ ID NO: 2900118 - RNA, 21 nt, Human
gcuggaggugggagcaggaga

SEQ ID NO: 2900119 - RNA, 23 nt, Human
gcuggagggaggcgggggcugcc

SEQ ID NO: 2900120 - RNA, 14 nt, Human
gcuggaggugggag

SEQ ID NO: 2900121 - RNA, 15 nt, Human
gcuggaggugggagc

SEQ ID NO: 2900122 - RNA, 13 nt, Human
gcucugccccagu

SEQ ID NO: 2900123 - RNA, 11 nt, Human
gcugcuggcuu

SEQ ID NO: 2900124 - RNA, 13 nt, Human
gcugcugcugcug

SEQ ID NO: 2900125 - RNA, 12 nt, Human
gcugcugcugcu

SEQ ID NO: 2900126 - RNA, 13 nt, Human
gcugcuggagacu

SEQ ID NO: 2900127 - RNA, 14 nt, Human
gcugcuggagacuc

SEQ ID NO: 2900128 - RNA, 16 nt, Human
gcuuugagaagccuuc

SEQ ID NO: 2900129 - RNA, 14 nt, Human
gcuuugagaagccu

SEQ ID NO: 2900130 - RNA, 22 nt, Human
gcuuugagaagccuucagcucc

SEQ ID NO: 2900131 - RNA, 21 nt, Human
gcuuugacuggaggguccauu

SEQ ID NO: 2900132 - RNA, 13 nt, Human
gcuuguaggagcu

SEQ ID NO: 2900133 - RNA, 14 nt, Human
gcuuguaggagcug

SEQ ID NO: 2900134 - RNA, 22 nt, Human
gcuuguaggagcugagguuuca

SEQ ID NO: 2900135 - RNA, 14 nt, Human
gcuuguauagugua

SEQ ID NO: 2900136 - RNA, 17 nt, Human
gcuuguaucaacacugu

SEQ ID NO: 2900137 - RNA, 18 nt, Human
gcuuguaugcaauggauu

SEQ ID NO: 2900138 - RNA, 18 nt, Human
gcuugugaaaauguguuc

SEQ ID NO: 2900139 - RNA, 15 nt, Human
gcuuucuugcucccu

SEQ ID NO: 2900140 - RNA, 20 nt, Human
gcuuucuugcucccuucagc

SEQ ID NO: 2900141 - RNA, 21 nt, Human
gcuuucuugcucccuucagcc

SEQ ID NO: 2900142 - RNA, 17 nt, Human
gcuuucuuugauucucc

SEQ ID NO: 2900143 - RNA, 19 nt, Human
gcuuucuuugauucuccuu

SEQ ID NO: 2900144 - RNA, 20 nt, Human
gcuuguaaauagcucaggug

SEQ ID NO: 2900145 - RNA, 16 nt, Human
gcuugagcccaggagu

SEQ ID NO: 2900146 - RNA, 15 nt, Human
gcuugagcccaggag

SEQ ID NO: 2900147 - RNA, 14 nt, Human
gcuugagcccagga

SEQ ID NO: 2900148 - RNA, 12 nt, Human
gcuugagcccag

SEQ ID NO: 2900149 - RNA, 20 nt, Human
gcuugagaaauauggacacu

SEQ ID NO: 2900150 - RNA, 16 nt, Human
gcuugacucaggauuu

SEQ ID NO: 2900151 - RNA, 23 nt, Human
gcuugacucaggauuuaaaaacu

SEQ ID NO: 2900152 - RNA, 17 nt, Human
gcuugacucccaaguuu

SEQ ID NO: 2900153 - RNA, 22 nt, Human
gcuuccucauaguaugguggcu

SEQ ID NO: 2900154 - RNA, 20 nt, Human
gcuuccucccaacaagcagc

SEQ ID NO: 2900155 - RNA, 14 nt, Human
gcuuccucccaaca

SEQ ID NO: 2900156 - RNA, 23 nt, Human
gcuuccuauuucuagggcuggga

SEQ ID NO: 2900157 - RNA, 11 nt, Human
gcuuccuccug

SEQ ID NO: 2900158 - RNA, 21 nt, Human
gcuuccuccuccccaacugug

SEQ ID NO: 2900159 - RNA, 12 nt, Human
gcuucuaauaaa

SEQ ID NO: 2900160 - RNA, 16 nt, Human
gcuucuaauaaauuau

SEQ ID NO: 2900161 - RNA, 17 nt, Human
gcuucuaccaugaacag

SEQ ID NO: 2900162 - RNA, 19 nt, Human
gcuucuaccaugaacagaa

SEQ ID NO: 2900163 - RNA, 15 nt, Human
gcuucuuccaggugc

SEQ ID NO: 2900164 - RNA, 19 nt, Human
gcuucuuccaggugcccag

SEQ ID NO: 2900165 - RNA, 16 nt, Human
gcuucuuccaggugcc

SEQ ID NO: 2900166 - RNA, 21 nt, Human
gcuucuuccuauuugccaugg

SEQ ID NO: 2900167 - RNA, 14 nt, Human
gcuuauuauugaag

SEQ ID NO: 2900168 - RNA, 16 nt, Human
gcuuauuuauuaacag

SEQ ID NO: 2900169 - RNA, 19 nt, Human
gcuuauuuauuaacaggau

SEQ ID NO: 2900170 - RNA, 16 nt, Human
gcuuauuuaauaaaga

SEQ ID NO: 2900171 - RNA, 14 nt, Human
gcuuauuuaauaaa

SEQ ID NO: 2900172 - RNA, 17 nt, Human
gcuuauugcuuaguaaa

SEQ ID NO: 2900173 - RNA, 18 nt, Human
gcuuauugcuuaguaaaa

SEQ ID NO: 2900174 - RNA, 20 nt, Human
gcuuauucaucuguuuuucu

SEQ ID NO: 2900175 - RNA, 12 nt, Human
gcuucagccucc

SEQ ID NO: 2900176 - RNA, 17 nt, Human
gcuucagccuccccacc

SEQ ID NO: 2900177 - RNA, 20 nt, Human
gcuucagccugaggcugaga

SEQ ID NO: 2900178 - RNA, 15 nt, Human
gcuucagccugaggc

SEQ ID NO: 2900179 - RNA, 14 nt, Human
gcuucagccugagg

SEQ ID NO: 2900180 - RNA, 12 nt, Human
gcuucagccuga

SEQ ID NO: 2900181 - RNA, 23 nt, Human
gcuucagccugaggcugagacug

SEQ ID NO: 2900182 - RNA, 12 nt, Human
gcuucagcucca

SEQ ID NO: 2900183 - RNA, 13 nt, Human
gcuucagcuccag

SEQ ID NO: 2900184 - RNA, 14 nt, Human
gcuucagcuccagc

SEQ ID NO: 2900185 - RNA, 15 nt, Human
gcuucagcuccagcc

SEQ ID NO: 2900186 - RNA, 16 nt, Human
gcuucagcuccagccc

SEQ ID NO: 2900187 - RNA, 18 nt, Human
gcuucagcuccagccccu

SEQ ID NO: 2900188 - RNA, 21 nt, Human
gcuucagccugaggcugagac

SEQ ID NO: 2900189 - RNA, 16 nt, Human
gcuauuggaggaucag

SEQ ID NO: 2900190 - RNA, 19 nt, Human
gcuauuggaggaucaguuu

SEQ ID NO: 2900191 - RNA, 14 nt, Human
gcuauuccuuuccc

SEQ ID NO: 2900192 - RNA, 16 nt, Human
gcuauuccuuucccuu

SEQ ID NO: 2900193 - RNA, 17 nt, Human
gcuauuccuuucccuuc

SEQ ID NO: 2900194 - RNA, 19 nt, Human
gcuauuccuuucccuuccu

SEQ ID NO: 2900195 - RNA, 21 nt, Human
gcuauuccuuucccuuccucu

SEQ ID NO: 2900196 - RNA, 13 nt, Human
gcucaaaacuuuc

SEQ ID NO: 2900197 - RNA, 14 nt, Human
gcucacugcagccu

SEQ ID NO: 2900198 - RNA, 13 nt, Human
gcucacugcagcc

SEQ ID NO: 2900199 - RNA, 12 nt, Human
gcucacugcagc

SEQ ID NO: 2900200 - RNA, 11 nt, Human
gcucacugcag

SEQ ID NO: 2900201 - RNA, 16 nt, Human
gcucacugcagccuca

SEQ ID NO: 2900202 - RNA, 15 nt, Human
gcucacugcagccuc

SEQ ID NO: 2900203 - RNA, 17 nt, Human
gcucacugcagccucaa

SEQ ID NO: 2900204 - RNA, 16 nt, Human
gcucacugcauccucc

SEQ ID NO: 2900205 - RNA, 16 nt, Human
gcucacucggcacccu

SEQ ID NO: 2900206 - RNA, 14 nt, Human
gcucaggugucccu

SEQ ID NO: 2900207 - RNA, 16 nt, Human
gcucaggugucccugc

SEQ ID NO: 2900208 - RNA, 17 nt, Human
gcucagggaaaagcagc

SEQ ID NO: 2900209 - RNA, 15 nt, Human
gcucagggaaaagca

SEQ ID NO: 2900210 - RNA, 24 nt, Human
gcucaggcgauccaccugucucag

SEQ ID NO: 2900211 - RNA, 12 nt, Human
gcucaggcugca

SEQ ID NO: 2900212 - RNA, 14 nt, Human
gcucaggcugcagc

SEQ ID NO: 2900213 - RNA, 17 nt, Human
gcucaggcugcagcugg

SEQ ID NO: 2900214 - RNA, 21 nt, Human
gcucaggcugcagcuggacag

SEQ ID NO: 2900215 - RNA, 22 nt, Human
gcucaggcugcagcuggacaga

SEQ ID NO: 2900216 - RNA, 23 nt, Human
gcucaggcugcagcuggacagag

SEQ ID NO: 2900217 - RNA, 22 nt, Human
gcucaggcgauccaccugucuc

SEQ ID NO: 2900218 - RNA, 19 nt, Human
gcucaggcgauccaccugu

SEQ ID NO: 2900219 - RNA, 20 nt, Human
gcucaggccuauaaccccag

SEQ ID NO: 2900220 - RNA, 15 nt, Human
gcucaggaccaggca

SEQ ID NO: 2900221 - RNA, 16 nt, Human
gcucaggaccaggcaa

SEQ ID NO: 2900222 - RNA, 19 nt, Human
gcucagagagggcaggcau

SEQ ID NO: 2900223 - RNA, 14 nt, Human
gcucaggaccaggc

SEQ ID NO: 2900224 - RNA, 16 nt, Human
gcucagagagggcagg

SEQ ID NO: 2900225 - RNA, 18 nt, Human
gcucagagagggcaggca

SEQ ID NO: 2900226 - RNA, 21 nt, Human
gcucagacauguuuuccguga

SEQ ID NO: 2900227 - RNA, 16 nt, Human
gcucagaccagcucuu

SEQ ID NO: 2900228 - RNA, 13 nt, Human
gcucagagagggc

SEQ ID NO: 2900229 - RNA, 20 nt, Human
gcucacugcauccuccgccu

SEQ ID NO: 2900230 - RNA, 16 nt, Human
gcucagacauguuuuc

SEQ ID NO: 2900231 - RNA, 16 nt, Human
gcuaggccuggccaga

SEQ ID NO: 2900232 - RNA, 23 nt, Human
gcuaggccuggccagaugcacca

SEQ ID NO: 2900233 - RNA, 17 nt, Human
gcuaggccuggccagau

SEQ ID NO: 2900234 - RNA, 20 nt, Human
gcuaguccggacccaccuca

SEQ ID NO: 2900235 - RNA, 22 nt, Human
gcuaguccggacccaccucacc

SEQ ID NO: 2900236 - RNA, 15 nt, Human
gcuaguccuagugaa

SEQ ID NO: 2900237 - RNA, 18 nt, Human
gcuaguccuagugaaccu

SEQ ID NO: 2900238 - RNA, 19 nt, Human
gcuaguccuagugaaccuc

SEQ ID NO: 2900239 - RNA, 13 nt, Human
gcuagugagcugg

SEQ ID NO: 2900240 - RNA, 15 nt, Human
gcuagugagcugggc

SEQ ID NO: 2900241 - RNA, 17 nt, Human
gcuagugauguuuuuau

SEQ ID NO: 2900242 - RNA, 17 nt, Human
gcuaguguaccuccucu

SEQ ID NO: 2900243 - RNA, 22 nt, Human
gcuaguguaccuccucucagug

SEQ ID NO: 2900244 - RNA, 17 nt, Human
gcuaugaucgcgccacu

SEQ ID NO: 2900245 - RNA, 11 nt, Human
gcuauggacac

SEQ ID NO: 2900246 - RNA, 13 nt, Human
gcuauggacacag

SEQ ID NO: 2900247 - RNA, 14 nt, Human
gcuauggacacagg

SEQ ID NO: 2900248 - RNA, 16 nt, Human
gcuauggacacagggu

SEQ ID NO: 2900249 - RNA, 18 nt, Human
gcuauggacacaggguga

SEQ ID NO: 2900250 - RNA, 14 nt, Human
gcuaugggagcccc

SEQ ID NO: 2900251 - RNA, 13 nt, Human
gcuaugggagccc

SEQ ID NO: 2900252 - RNA, 18 nt, Human
gcuacugcagcuuuacau

SEQ ID NO: 2900253 - RNA, 19 nt, Human
gcuacugcagcuuuacaug

SEQ ID NO: 2900254 - RNA, 19 nt, Human
gcuacucgggaggcugagg

SEQ ID NO: 2900255 - RNA, 21 nt, Human
gcuacucgggaggcugaggca

SEQ ID NO: 2900256 - RNA, 22 nt, Human
gcuacucgggaggcugaggcac

SEQ ID NO: 2900257 - RNA, 23 nt, Human
gcuacucgggaggcugaggcaca

SEQ ID NO: 2900258 - RNA, 16 nt, Human
gcuacugauuuuugug

SEQ ID NO: 2900259 - RNA, 17 nt, Human
gcuacugauuuuuguga

SEQ ID NO: 2900260 - RNA, 20 nt, Human
gcgggaggauguucugggac

SEQ ID NO: 2900261 - RNA, 22 nt, Human
gcgggaggauguucugggacac

SEQ ID NO: 2900262 - RNA, 21 nt, Human
gcgggaggauguucugggaca

SEQ ID NO: 2900263 - RNA, 20 nt, Human
gcgugcacacaccagagccc

SEQ ID NO: 2900264 - RNA, 22 nt, Human
gcguuugaccuuuuauguagua

SEQ ID NO: 2900265 - RNA, 19 nt, Human
gcguuuuuuaaauguauac

SEQ ID NO: 2900266 - RNA, 23 nt, Human
gcguguucauaucuacucuuuac

SEQ ID NO: 2900267 - RNA, 22 nt, Human
gcguguguagaguuaagaagcu

SEQ ID NO: 2900268 - RNA, 20 nt, Human
gcguguguagaguuaagaag

SEQ ID NO: 2900269 - RNA, 21 nt, Human
gcguguguagaguuaagaagc

SEQ ID NO: 2900270 - RNA, 12 nt, Human
gcguguguagag

SEQ ID NO: 2900271 - RNA, 15 nt, Human
gcguguguagaguua

SEQ ID NO: 2900272 - RNA, 23 nt, Human
gcgugcacacaccagagcccacc

SEQ ID NO: 2900273 - RNA, 19 nt, Human
gcgugcacacaccagagcc

SEQ ID NO: 2900274 - RNA, 19 nt, Human
gcgugucgugggugugugu

SEQ ID NO: 2900275 - RNA, 17 nt, Human
gcguguccccggggccc

SEQ ID NO: 2900276 - RNA, 20 nt, Human
gcguguccccggggcccagg

SEQ ID NO: 2900277 - RNA, 14 nt, Human
gcgugcccucgcug

SEQ ID NO: 2900278 - RNA, 23 nt, Human
gcgugccagucaagaagaaaaag

SEQ ID NO: 2900279 - RNA, 16 nt, Human
gcgugccccugcugcu

SEQ ID NO: 2900280 - RNA, 15 nt, Human
gcgugguuccuuucu

SEQ ID NO: 2900281 - RNA, 14 nt, Human
gcuaauuaaaaagu

SEQ ID NO: 2900282 - RNA, 15 nt, Human
gcuaauuaaaaaguu

SEQ ID NO: 2900283 - RNA, 15 nt, Human
gcuaaugggacacua

SEQ ID NO: 2900284 - RNA, 13 nt, Human
gcuaaugggacac

SEQ ID NO: 2900285 - RNA, 15 nt, Human
gcuacucagaagccu

SEQ ID NO: 2900286 - RNA, 19 nt, Human
gcuacucagaagccugagg

SEQ ID NO: 2900287 - RNA, 18 nt, Human
gcuacucagaagccugag

SEQ ID NO: 2900288 - RNA, 17 nt, Human
gcuacucagaagccuga

SEQ ID NO: 2900289 - RNA, 16 nt, Human
gcuacucagaagccug

SEQ ID NO: 2900290 - RNA, 21 nt, Human
gcuacucagaagccugaggcu

SEQ ID NO: 2900291 - RNA, 14 nt, Human
gcuacucagaagcc

SEQ ID NO: 2900292 - RNA, 23 nt, Human
gcuaagugauccucccaccucag

SEQ ID NO: 2900293 - RNA, 20 nt, Human
gcuaaacacugcgcuuuauu

SEQ ID NO: 2900294 - RNA, 22 nt, Human
gcuaaacacugcgcuuuauuuu

SEQ ID NO: 2900295 - RNA, 18 nt, Human
gcuaauaaugagcuauua

SEQ ID NO: 2900296 - RNA, 20 nt, Human
gcuaauaaugagcuauuaaa

SEQ ID NO: 2900297 - RNA, 21 nt, Human
gcuaauaaugagcuauuaaaa

SEQ ID NO: 2900298 - RNA, 17 nt, Human
gcuaauaauguuaacca

SEQ ID NO: 2900299 - RNA, 14 nt, Human
gcuaaucagcauuc

SEQ ID NO: 2900300 - RNA, 14 nt, Human
gcuaauauuaaaag

SEQ ID NO: 2900301 - RNA, 18 nt, Human
gcuaaucaaagccagggu

SEQ ID NO: 2900302 - RNA, 19 nt, Human
gcuaaucaaagccaggguc

SEQ ID NO: 2900303 - RNA, 20 nt, Human
gcuaaucaaagccagggucu

SEQ ID NO: 2900304 - RNA, 21 nt, Human
gcuaaucaaagccagggucuc

SEQ ID NO: 2900305 - RNA, 16 nt, Human
gcuaaucagcauucuc

SEQ ID NO: 2900306 - RNA, 17 nt, Human
gcuaaucagcauucuca

SEQ ID NO: 2900307 - RNA, 22 nt, Human
gcuaaucagcauucucacuccu

SEQ ID NO: 2900308 - RNA, 23 nt, Human
gcuccacccuuggccugucucau

SEQ ID NO: 2900309 - RNA, 22 nt, Human
gcuccacccuuggccugucuca

SEQ ID NO: 2900310 - RNA, 20 nt, Human
gcuccaccagcaucaccugc

SEQ ID NO: 2900311 - RNA, 18 nt, Human
gcuccaccagcaucaccu

SEQ ID NO: 2900312 - RNA, 23 nt, Human
gcuccaccagcaucaccugccug

SEQ ID NO: 2900313 - RNA, 15 nt, Human
gcuccaccacauccu

SEQ ID NO: 2900314 - RNA, 12 nt, Human
gcuccaccacau

SEQ ID NO: 2900315 - RNA, 19 nt, Human
gcuccaccaagaaagcagg

SEQ ID NO: 2900316 - RNA, 19 nt, Human
gcuccacccuuggccuguc

SEQ ID NO: 2900317 - RNA, 17 nt, Human
gcuccacccuuggccug

SEQ ID NO: 2900318 - RNA, 16 nt, Human
gcuccacccuuggccu

SEQ ID NO: 2900319 - RNA, 15 nt, Human
gcuccacccuuggcc

SEQ ID NO: 2900320 - RNA, 14 nt, Human
gcuccacccuuggc

SEQ ID NO: 2900321 - RNA, 13 nt, Human
gcuccacccuugg

SEQ ID NO: 2900322 - RNA, 11 nt, Human
gcuccacccuu

SEQ ID NO: 2900323 - RNA, 23 nt, Human
gcuccugaggggcaucugccccu

SEQ ID NO: 2900324 - RNA, 22 nt, Human
gcuccugaggggcaucugcccc

SEQ ID NO: 2900325 - RNA, 18 nt, Human
gcuccugccaccacgccc

SEQ ID NO: 2900326 - RNA, 12 nt, Human
gcuccugccacc

SEQ ID NO: 2900327 - RNA, 21 nt, Human
gcuccugaggggcaucugccc

SEQ ID NO: 2900328 - RNA, 18 nt, Human
gcuccugaggggcaucug

SEQ ID NO: 2900329 - RNA, 14 nt, Human
gcucccguggccug

SEQ ID NO: 2900330 - RNA, 15 nt, Human
gcucccguggccugu

SEQ ID NO: 2900331 - RNA, 18 nt, Human
gcucccuaagccagccug

SEQ ID NO: 2900332 - RNA, 19 nt, Human
gcucccuaagccagccugg

SEQ ID NO: 2900333 - RNA, 23 nt, Human
gcucccuaagccagccuggucca

SEQ ID NO: 2900334 - RNA, 18 nt, Human
gcuccuggcagaagggag

SEQ ID NO: 2900335 - RNA, 22 nt, Human
gcuccuggcagaagggagcagc

SEQ ID NO: 2900336 - RNA, 17 nt, Human
gcuccuggccuugcuga

SEQ ID NO: 2900337 - RNA, 22 nt, Human
gcuccuggaaaggcucagucuc

SEQ ID NO: 2900338 - RNA, 21 nt, Human
gcuccuggaaaggcucagucu

SEQ ID NO: 2900339 - RNA, 23 nt, Human
gcuccuggaaaggcucagucuca

SEQ ID NO: 2900340 - RNA, 18 nt, Human
gcuccuggaaaggcucag

SEQ ID NO: 2900341 - RNA, 14 nt, Human
gcuccugcagcaug

SEQ ID NO: 2900342 - RNA, 15 nt, Human
gcuccugcagcaugg

SEQ ID NO: 2900343 - RNA, 21 nt, Human
gcuccugcagcauggucccug

SEQ ID NO: 2900344 - RNA, 23 nt, Human
gcuccugcaggccacagccaccu

SEQ ID NO: 2900345 - RNA, 18 nt, Human
gcuccagcucaccagccc

SEQ ID NO: 2900346 - RNA, 12 nt, Human
gcuccacuguca

SEQ ID NO: 2900347 - RNA, 18 nt, Human
gcuccacugucacccucc

SEQ ID NO: 2900348 - RNA, 17 nt, Human
gcuccagcucaccagcc

SEQ ID NO: 2900349 - RNA, 21 nt, Human
gcuccagcucaccagccccag

SEQ ID NO: 2900350 - RNA, 20 nt, Human
gcuccagcucaccagcccca

SEQ ID NO: 2900351 - RNA, 16 nt, Human
gcucccacaggcccuu

SEQ ID NO: 2900352 - RNA, 17 nt, Human
gcucccacaggcccuuc

SEQ ID NO: 2900353 - RNA, 20 nt, Human
gcucccacaggcccuuccuc

SEQ ID NO: 2900354 - RNA, 21 nt, Human
gcucccacaggcccuuccucu

SEQ ID NO: 2900355 - RNA, 21 nt, Human
gcuccccagcccuggcucugc

SEQ ID NO: 2900356 - RNA, 14 nt, Human
gcuccccauguguc

SEQ ID NO: 2900357 - RNA, 22 nt, Human
gcuccccagcccuggcucugca

SEQ ID NO: 2900358 - RNA, 14 nt, Human
gcuccaccuuucag

SEQ ID NO: 2900359 - RNA, 12 nt, Human
gcuccccaugug

SEQ ID NO: 2900360 - RNA, 16 nt, Human
gcucccacauucugau

SEQ ID NO: 2900361 - RNA, 22 nt, Human
gcucccacaggcccuuccucuc

SEQ ID NO: 2900362 - RNA, 19 nt, Human
gcucugccccagcucuggc

SEQ ID NO: 2900363 - RNA, 18 nt, Human
gcucugccccagcucugg

SEQ ID NO: 2900364 - RNA, 20 nt, Human
gcucugccccagcucuggcu

SEQ ID NO: 2900365 - RNA, 15 nt, Human
gcucugccccagcuc

SEQ ID NO: 2900366 - RNA, 13 nt, Human
gcucugccccagc

SEQ ID NO: 2900367 - RNA, 12 nt, Human
gcucugccccag

SEQ ID NO: 2900368 - RNA, 23 nt, Human
gcucugcaaugggcacugggaug

SEQ ID NO: 2900369 - RNA, 15 nt, Human
gcucugcaaaaggag

SEQ ID NO: 2900370 - RNA, 17 nt, Human
gcucugcaauuccccuc

SEQ ID NO: 2900371 - RNA, 17 nt, Human
gcucugaucauccacug

SEQ ID NO: 2900372 - RNA, 23 nt, Human
gcucugaucauccacugugccau

SEQ ID NO: 2900373 - RNA, 14 nt, Human
gccuguugcccuuu

SEQ ID NO: 2900374 - RNA, 15 nt, Human
gcgagcccugguggc

SEQ ID NO: 2900375 - RNA, 17 nt, Human
gcgagcccugguggcag

SEQ ID NO: 2900376 - RNA, 21 nt, Human
gcgagcuaugaucgcgccacu

SEQ ID NO: 2900377 - RNA, 21 nt, Human
gcgauccaccugucucagccu

SEQ ID NO: 2900378 - RNA, 15 nt, Human
gcgaucccacacagg

SEQ ID NO: 2900379 - RNA, 20 nt, Human
gcgaucccacacaggcuggc

SEQ ID NO: 2900380 - RNA, 17 nt, Human
gcgauccaccugucuca

SEQ ID NO: 2900381 - RNA, 22 nt, Human
gccuugcccggauucugggagg

SEQ ID NO: 2900382 - RNA, 23 nt, Human
gccuugccuaaauuuaaugcugc

SEQ ID NO: 2900383 - RNA, 22 nt, Human
gcgaucuggguucacugcaacc

SEQ ID NO: 2900384 - RNA, 19 nt, Human
gcgaugaauuuggagacuc

SEQ ID NO: 2900385 - RNA, 16 nt, Human
gcgaucucggcucagu

SEQ ID NO: 2900386 - RNA, 15 nt, Human
gcgauggucucagaa

SEQ ID NO: 2900387 - RNA, 19 nt, Human
gcgcaccugcccccuggug

SEQ ID NO: 2900388 - RNA, 18 nt, Human
gcgcaccugcccccuggu

SEQ ID NO: 2900389 - RNA, 17 nt, Human
gcgcaccugcccccugg

SEQ ID NO: 2900390 - RNA, 12 nt, Human
gcgcaccugccc

SEQ ID NO: 2900391 - RNA, 18 nt, Human
gcgcacacacacacauac

SEQ ID NO: 2900392 - RNA, 13 nt, Human
gcgcacacacaca

SEQ ID NO: 2900393 - RNA, 15 nt, Human
gcgcacacacacaca

SEQ ID NO: 2900394 - RNA, 16 nt, Human
gcgcacacacacacau

SEQ ID NO: 2900395 - RNA, 20 nt, Human
gcgcacaauaguaaccuggg

SEQ ID NO: 2900396 - RNA, 11 nt, Human
gcgcacacaca

SEQ ID NO: 2900397 - RNA, 19 nt, Human
gcgcacacacacacauaca

SEQ ID NO: 2900398 - RNA, 23 nt, Human
gccuguucccauucuugcauggc

SEQ ID NO: 2900399 - RNA, 19 nt, Human
gccuguucccauucuugca

SEQ ID NO: 2900400 - RNA, 16 nt, Human
gccuguggccuuugca

SEQ ID NO: 2900401 - RNA, 19 nt, Human
gccugugccuccucacccc

SEQ ID NO: 2900402 - RNA, 14 nt, Human
gccuguggcugugg

SEQ ID NO: 2900403 - RNA, 16 nt, Human
gccuguggcuguggag

SEQ ID NO: 2900404 - RNA, 17 nt, Human
gccuguggcuguggaga

SEQ ID NO: 2900405 - RNA, 12 nt, Human
gccuguggcugc

SEQ ID NO: 2900406 - RNA, 13 nt, Human
gccuguggcugcg

SEQ ID NO: 2900407 - RNA, 12 nt, Human
gccuguggcugu

SEQ ID NO: 2900408 - RNA, 14 nt, Human
gccuggccuggccc

SEQ ID NO: 2900409 - RNA, 15 nt, Human
gccuggccuggcccu

SEQ ID NO: 2900410 - RNA, 16 nt, Human
gccuggccuggcccug

SEQ ID NO: 2900411 - RNA, 17 nt, Human
gccuggccuggcccugc

SEQ ID NO: 2900412 - RNA, 19 nt, Human
gccuggccuggcccugccc

SEQ ID NO: 2900413 - RNA, 13 nt, Human
gccuggccuggca

SEQ ID NO: 2900414 - RNA, 16 nt, Human
gccuggccuggcacac

SEQ ID NO: 2900415 - RNA, 22 nt, Human
gccucgaacuggcugcaaaggg

SEQ ID NO: 2900416 - RNA, 20 nt, Human
gccucgaacuggcugcaaag

SEQ ID NO: 2900417 - RNA, 23 nt, Human
gccucuuaaagcugccuguaguu

SEQ ID NO: 2900418 - RNA, 22 nt, Human
gccucuuaaagcugccuguagu

SEQ ID NO: 2900419 - RNA, 20 nt, Human
gccucuuacgguaguuagga

SEQ ID NO: 2900420 - RNA, 17 nt, Human
gccucuuacuaauguaa

SEQ ID NO: 2900421 - RNA, 19 nt, Human
gccucuuacuaauguaaaa

SEQ ID NO: 2900422 - RNA, 20 nt, Human
gccucuuaaagcugccugua

SEQ ID NO: 2900423 - RNA, 14 nt, Human
gccucuuggguuca

SEQ ID NO: 2900424 - RNA, 20 nt, Human
gccucuuggagaccuuaccc

SEQ ID NO: 2900425 - RNA, 14 nt, Human
gccugcccaggccc

SEQ ID NO: 2900426 - RNA, 13 nt, Human
gccugcccaggcc

SEQ ID NO: 2900427 - RNA, 19 nt, Human
gccucuuaaagcugccugu

SEQ ID NO: 2900428 - RNA, 17 nt, Human
gccucuuucugucccuu

SEQ ID NO: 2900429 - RNA, 12 nt, Human
gccucuuuucuc

SEQ ID NO: 2900430 - RNA, 17 nt, Human
gccucccaaagugcugg

SEQ ID NO: 2900431 - RNA, 13 nt, Human
gccuccugugugu

SEQ ID NO: 2900432 - RNA, 16 nt, Human
gccucccaaagugcug

SEQ ID NO: 2900433 - RNA, 11 nt, Human
gccuccaugcu

SEQ ID NO: 2900434 - RNA, 23 nt, Human
gccuccugugugugcgccuacag

SEQ ID NO: 2900435 - RNA, 19 nt, Human
gccuccugugugugcgccu

SEQ ID NO: 2900436 - RNA, 17 nt, Human
gccucgaacuggcugca

SEQ ID NO: 2900437 - RNA, 13 nt, Human
gccucccaaagug

SEQ ID NO: 2900438 - RNA, 20 nt, Human
gccugcccaggccccugcca

SEQ ID NO: 2900439 - RNA, 15 nt, Human
gccugcccaggcccc

SEQ ID NO: 2900440 - RNA, 22 nt, Human
gccugcccaggccccugccacc

SEQ ID NO: 2900441 - RNA, 22 nt, Human
gccugcccauucugcccugugg

SEQ ID NO: 2900442 - RNA, 17 nt, Human
gccugccccaaacaaau

SEQ ID NO: 2900443 - RNA, 23 nt, Human
gccugccccaaacaaauaugcaa

SEQ ID NO: 2900444 - RNA, 18 nt, Human
gccucuuuucucugugcu

SEQ ID NO: 2900445 - RNA, 16 nt, Human
gccugccccccucauc

SEQ ID NO: 2900446 - RNA, 16 nt, Human
gccccugccacccugg

SEQ ID NO: 2900447 - RNA, 17 nt, Human
gccccugccacccuggg

SEQ ID NO: 2900448 - RNA, 15 nt, Human
gcccccccuuccacu

SEQ ID NO: 2900449 - RNA, 23 nt, Human
gcccccccuucccccuuuuuugu

SEQ ID NO: 2900450 - RNA, 13 nt, Human
gccccccucccag

SEQ ID NO: 2900451 - RNA, 18 nt, Human
gccccugccaccucccug

SEQ ID NO: 2900452 - RNA, 13 nt, Human
gcccccccuucca

SEQ ID NO: 2900453 - RNA, 14 nt, Human
gcccccccuuccac

SEQ ID NO: 2900454 - RNA, 16 nt, Human
gccccccagccucugg

SEQ ID NO: 2900455 - RNA, 13 nt, Human
gccccccagcuca

SEQ ID NO: 2900456 - RNA, 15 nt, Human
gccccccagcucagg

SEQ ID NO: 2900457 - RNA, 16 nt, Human
gccccccagcucaggg

SEQ ID NO: 2900458 - RNA, 15 nt, Human
gccccugcugcuguc

SEQ ID NO: 2900459 - RNA, 20 nt, Human
gccccugcugcugucaccuc

SEQ ID NO: 2900460 - RNA, 22 nt, Human
gccccugcugcugucaccucuc

SEQ ID NO: 2900461 - RNA, 16 nt, Human
gcccggucccaccccu

SEQ ID NO: 2900462 - RNA, 10 nt, Human
gccccugcug

SEQ ID NO: 2900463 - RNA, 12 nt, Human
gccccugccugc

SEQ ID NO: 2900464 - RNA, 13 nt, Human
gccccugccugcc

SEQ ID NO: 2900465 - RNA, 14 nt, Human
gccccugccugcca

SEQ ID NO: 2900466 - RNA, 15 nt, Human
gccccugccugccau

SEQ ID NO: 2900467 - RNA, 21 nt, Human
gccccugccugccauguaccu

SEQ ID NO: 2900468 - RNA, 22 nt, Human
gccccugccugccauguaccuc

SEQ ID NO: 2900469 - RNA, 14 nt, Human
gcccuaagggagug

SEQ ID NO: 2900470 - RNA, 17 nt, Human
gcccguaaacacgccug

SEQ ID NO: 2900471 - RNA, 18 nt, Human
gcccuaaccccuuccaga

SEQ ID NO: 2900472 - RNA, 21 nt, Human
gcccuaaccucugagucacca

SEQ ID NO: 2900473 - RNA, 20 nt, Human
gcccuaaugcgcaggcuggc

SEQ ID NO: 2900474 - RNA, 19 nt, Human
gcccuaaugcgcaggcugg

SEQ ID NO: 2900475 - RNA, 17 nt, Human
gcccuaaugcgcaggcu

SEQ ID NO: 2900476 - RNA, 16 nt, Human
gcccuaaugcgcaggc

SEQ ID NO: 2900477 - RNA, 19 nt, Human
gccuagcugccuagcaagc

SEQ ID NO: 2900478 - RNA, 14 nt, Human
gccuagcccacccu

SEQ ID NO: 2900479 - RNA, 16 nt, Human
gccuagcccacccugc

SEQ ID NO: 2900480 - RNA, 18 nt, Human
gccuagcccacccugcug

SEQ ID NO: 2900481 - RNA, 22 nt, Human
gccuagcccacccugcugccuu

SEQ ID NO: 2900482 - RNA, 23 nt, Human
gccuagcccacccugcugccuuc

SEQ ID NO: 2900483 - RNA, 15 nt, Human
gccuaggugacagag

SEQ ID NO: 2900484 - RNA, 14 nt, Human
gccuaggugacaga

SEQ ID NO: 2900485 - RNA, 13 nt, Human
gccuaggugacag

SEQ ID NO: 2900486 - RNA, 15 nt, Human
gccuaggauucuaaa

SEQ ID NO: 2900487 - RNA, 16 nt, Human
gccuaggauucuaaaa

SEQ ID NO: 2900488 - RNA, 12 nt, Human
gccuaggauucu

SEQ ID NO: 2900489 - RNA, 13 nt, Human
gccuaggauucua

SEQ ID NO: 2900490 - RNA, 14 nt, Human
gccuaggauucuaa

SEQ ID NO: 2900491 - RNA, 15 nt, Human
gccuaggaccacuca

SEQ ID NO: 2900492 - RNA, 18 nt, Human
gccuaggaccacucagcc

SEQ ID NO: 2900493 - RNA, 19 nt, Human
gccuaggaccacucagccc

SEQ ID NO: 2900494 - RNA, 20 nt, Human
gccuaggaccacucagcccc

SEQ ID NO: 2900495 - RNA, 21 nt, Human
gccuaggaccacucagccccu

SEQ ID NO: 2900496 - RNA, 22 nt, Human
gccuaggaccacucagccccua

SEQ ID NO: 2900497 - RNA, 23 nt, Human
gccuaggaccacucagccccuag

SEQ ID NO: 2900498 - RNA, 20 nt, Human
gccuaggugacagagugaga

SEQ ID NO: 2900499 - RNA, 16 nt, Human
gccuaguuuacuguuu

SEQ ID NO: 2900500 - RNA, 15 nt, Human
gccuaguuuuuagua

SEQ ID NO: 2900501 - RNA, 21 nt, Human
gccuaguuuuuaguaaucugu

SEQ ID NO: 2900502 - RNA, 14 nt, Human
gccuaguggcuugu

SEQ ID NO: 2900503 - RNA, 17 nt, Human
gccgccuaggcucagcg

SEQ ID NO: 2900504 - RNA, 16 nt, Human
gcccugcccugguuuc

SEQ ID NO: 2900505 - RNA, 12 nt, Human
gcccugcccugg

SEQ ID NO: 2900506 - RNA, 20 nt, Human
gcccugcccucuccuuccuu

SEQ ID NO: 2900507 - RNA, 11 nt, Human
gcccugcccug

SEQ ID NO: 2900508 - RNA, 21 nt, Human
gcccugcagaggggaaaccag

SEQ ID NO: 2900509 - RNA, 14 nt, Human
gcccugcagccagc

SEQ ID NO: 2900510 - RNA, 15 nt, Human
gcccugcagccagcu

SEQ ID NO: 2900511 - RNA, 13 nt, Human
gcccugcaguguu

SEQ ID NO: 2900512 - RNA, 22 nt, Human
gcccugcaguguucgcuuggcu

SEQ ID NO: 2900513 - RNA, 15 nt, Human
gcccugcaugggcca

SEQ ID NO: 2900514 - RNA, 18 nt, Human
gcccugcaugggccagcc

SEQ ID NO: 2900515 - RNA, 19 nt, Human
gcccugcaugggccagccc

SEQ ID NO: 2900516 - RNA, 21 nt, Human
gcccugcaugggccagccccu

SEQ ID NO: 2900517 - RNA, 22 nt, Human
gcccugcaugggccagccccuc

SEQ ID NO: 2900518 - RNA, 23 nt, Human
gcccugcaugggccagccccucc

SEQ ID NO: 2900519 - RNA, 11 nt, Human
gcccugcaugu

SEQ ID NO: 2900520 - RNA, 14 nt, Human
gcccugcauguagu

SEQ ID NO: 2900521 - RNA, 20 nt, Human
gcccuuagcagggaaacagc

SEQ ID NO: 2900522 - RNA, 19 nt, Human
gcccuuagcagggaaacag

SEQ ID NO: 2900523 - RNA, 11 nt, Human
gcccugucugu

SEQ ID NO: 2900524 - RNA, 22 nt, Human
gcccuguccugccuaaggcuga

SEQ ID NO: 2900525 - RNA, 19 nt, Human
gcccugucccucccaccuc

SEQ ID NO: 2900526 - RNA, 20 nt, Human
gcccugucccucccaccucu

SEQ ID NO: 2900527 - RNA, 21 nt, Human
gcccugucccucccaccucug

SEQ ID NO: 2900528 - RNA, 22 nt, Human
gcccugucccucccaccucugu

SEQ ID NO: 2900529 - RNA, 23 nt, Human
gcccugucccucccaccucugug

SEQ ID NO: 2900530 - RNA, 15 nt, Human
gcccuguccugccau

SEQ ID NO: 2900531 - RNA, 16 nt, Human
gcccugucgggcuuug

SEQ ID NO: 2900532 - RNA, 17 nt, Human
gcccugucgggcuuugu

SEQ ID NO: 2900533 - RNA, 19 nt, Human
gcccugucgggcuuugugu

SEQ ID NO: 2900534 - RNA, 20 nt, Human
gcccugucgggcuuugugug

SEQ ID NO: 2900535 - RNA, 13 nt, Human
gcccugucccucc

SEQ ID NO: 2900536 - RNA, 13 nt, Human
gcccugcccugag

SEQ ID NO: 2900537 - RNA, 15 nt, Human
gcccugcccugagga

SEQ ID NO: 2900538 - RNA, 20 nt, Human
gcccugcccugaggaaggag

SEQ ID NO: 2900539 - RNA, 15 nt, Human
gcccugcccuggcag

SEQ ID NO: 2900540 - RNA, 17 nt, Human
gcccugcccuggcaggg

SEQ ID NO: 2900541 - RNA, 15 nt, Human
gcccugucccuccca

SEQ ID NO: 2900542 - RNA, 16 nt, Human
gcccugucccucccac

SEQ ID NO: 2900543 - RNA, 17 nt, Human
gcccugucccucccacc

SEQ ID NO: 2900544 - RNA, 18 nt, Human
gcccugucccucccaccu

SEQ ID NO: 2900545 - RNA, 18 nt, Human
gcccugcccugguuuccu

SEQ ID NO: 2900546 - RNA, 22 nt, Human
gcccuuagcagggaaacagcua

SEQ ID NO: 2900547 - RNA, 16 nt, Human
gcccuuaucugugcuc

SEQ ID NO: 2900548 - RNA, 15 nt, Human
gcccuuaucugugcu

SEQ ID NO: 2900549 - RNA, 15 nt, Human
gcccuuaguccccca

SEQ ID NO: 2900550 - RNA, 16 nt, Human
gcccuuagucccccaa

SEQ ID NO: 2900551 - RNA, 17 nt, Human
gcccuuagucccccaac

SEQ ID NO: 2900552 - RNA, 18 nt, Human
gcccuuagucccccaacu

SEQ ID NO: 2900553 - RNA, 20 nt, Human
gcccuuagucccccaacucu

SEQ ID NO: 2900554 - RNA, 23 nt, Human
gcccuuagucccccaacucugag

SEQ ID NO: 2900555 - RNA, 18 nt, Human
gccgcagccucccucuga

SEQ ID NO: 2900556 - RNA, 17 nt, Human
gccgcagccucccucug

SEQ ID NO: 2900557 - RNA, 14 nt, Human
gccgcccaaggccc

SEQ ID NO: 2900558 - RNA, 16 nt, Human
gccgcccccuccugaa

SEQ ID NO: 2900559 - RNA, 15 nt, Human
gccgccccacccaga

SEQ ID NO: 2900560 - RNA, 17 nt, Human
gccgcccccugcccccc

SEQ ID NO: 2900561 - RNA, 15 nt, Human
gccgcccccuccuga

SEQ ID NO: 2900562 - RNA, 14 nt, Human
gccgccccacccag

SEQ ID NO: 2900563 - RNA, 23 nt, Human
gccgcccccugccccccagccuc

SEQ ID NO: 2900564 - RNA, 12 nt, Human
caggaacagaag

SEQ ID NO: 2900565 - RNA, 19 nt, Human
caggaaagcucagcuacug

SEQ ID NO: 2900566 - RNA, 18 nt, Human
cagcuucauuuccugugu

SEQ ID NO: 2900567 - RNA, 15 nt, Human
cagcuucauuuccug

SEQ ID NO: 2900568 - RNA, 14 nt, Human
cagcuucagguuau

SEQ ID NO: 2900569 - RNA, 18 nt, Human
cagcugugcucuggacag

SEQ ID NO: 2900570 - RNA, 17 nt, Human
cagcuguccucccucca

SEQ ID NO: 2900571 - RNA, 18 nt, Human
cagcuguccucccuccac

SEQ ID NO: 2900572 - RNA, 12 nt, Human
cagcugucucua

SEQ ID NO: 2900573 - RNA, 14 nt, Human
cagcugucuguggc

SEQ ID NO: 2900574 - RNA, 16 nt, Human
cagcugucuguggcuu

SEQ ID NO: 2900575 - RNA, 13 nt, Human
cagcugugagccu

SEQ ID NO: 2900576 - RNA, 15 nt, Human
cagcugugagccuug

SEQ ID NO: 2900577 - RNA, 16 nt, Human
cagcugugagccuugg

SEQ ID NO: 2900578 - RNA, 17 nt, Human
cagcugugagccuuggc

SEQ ID NO: 2900579 - RNA, 14 nt, Human
cagcugcaccagag

SEQ ID NO: 2900580 - RNA, 16 nt, Human
cagcugcaccagagca

SEQ ID NO: 2900581 - RNA, 19 nt, Human
cagcugcaccagagcaacc

SEQ ID NO: 2900582 - RNA, 21 nt, Human
cagcugcaccugccagccugg

SEQ ID NO: 2900583 - RNA, 20 nt, Human
cagcugcaccugccagccug

SEQ ID NO: 2900584 - RNA, 18 nt, Human
cagcugcaccugccagcc

SEQ ID NO: 2900585 - RNA, 17 nt, Human
cagcugcaccugccagc

SEQ ID NO: 2900586 - RNA, 16 nt, Human
cagcugcaccugccag

SEQ ID NO: 2900587 - RNA, 16 nt, Human
cagcugcagcugggcu

SEQ ID NO: 2900588 - RNA, 12 nt, Human
cagcugccaccu

SEQ ID NO: 2900589 - RNA, 17 nt, Human
cagcugcagcugggcug

SEQ ID NO: 2900590 - RNA, 15 nt, Human
cagcugcaggaauca

SEQ ID NO: 2900591 - RNA, 22 nt, Human
cagcugcaccugccagccuggc

SEQ ID NO: 2900592 - RNA, 15 nt, Human
cagcuccagcucacc

SEQ ID NO: 2900593 - RNA, 14 nt, Human
cagcuccagcucac

SEQ ID NO: 2900594 - RNA, 13 nt, Human
cagcuccagcuca

SEQ ID NO: 2900595 - RNA, 20 nt, Human
cagcuccagcucaccagccc

SEQ ID NO: 2900596 - RNA, 18 nt, Human
cagcuccagcucaccagc

SEQ ID NO: 2900597 - RNA, 17 nt, Human
cagcuccagcucaccag

SEQ ID NO: 2900598 - RNA, 16 nt, Human
cagcuccagcucacca

SEQ ID NO: 2900599 - RNA, 22 nt, Human
cagcuccagcucaccagcccca

SEQ ID NO: 2900600 - RNA, 20 nt, Human
cagcuccagggaauccaagc

SEQ ID NO: 2900601 - RNA, 20 nt, Human
cagcuccagccccuuuccaa

SEQ ID NO: 2900602 - RNA, 22 nt, Human
cagcuccagccccuuuccaaaa

SEQ ID NO: 2900603 - RNA, 22 nt, Human
cagcuccagggaauccaagccu

SEQ ID NO: 2900604 - RNA, 21 nt, Human
cagcuccagggaauccaagcc

SEQ ID NO: 2900605 - RNA, 17 nt, Human
cagcuccagguggcucu

SEQ ID NO: 2900606 - RNA, 21 nt, Human
cagcuccagguggcucugagg

SEQ ID NO: 2900607 - RNA, 21 nt, Human
cagcucccaaggcucugagca

SEQ ID NO: 2900608 - RNA, 14 nt, Human
cagcuccauuuucu

SEQ ID NO: 2900609 - RNA, 18 nt, Human
cagccgauucaccugagc

SEQ ID NO: 2900610 - RNA, 11 nt, Human
cagccucuuaa

SEQ ID NO: 2900611 - RNA, 20 nt, Human
cagccggcguggcaaauaua

SEQ ID NO: 2900612 - RNA, 21 nt, Human
cagccggcguggcaaauauaa

SEQ ID NO: 2900613 - RNA, 21 nt, Human
cagccucuuaaagcugccugu

SEQ ID NO: 2900614 - RNA, 20 nt, Human
cagccucuuaaagcugccug

SEQ ID NO: 2900615 - RNA, 19 nt, Human
cagccucuuaaagcugccu

SEQ ID NO: 2900616 - RNA, 15 nt, Human
cagccucuuaaagcu

SEQ ID NO: 2900617 - RNA, 18 nt, Human
cagccucuuggccccaga

SEQ ID NO: 2900618 - RNA, 16 nt, Human
cagccucuuucugucc

SEQ ID NO: 2900619 - RNA, 16 nt, Human
cagccggccaauggaa

SEQ ID NO: 2900620 - RNA, 19 nt, Human
cagccggccaauggaaacc

SEQ ID NO: 2900621 - RNA, 20 nt, Human
cagccggccaauggaaaccu

SEQ ID NO: 2900622 - RNA, 18 nt, Human
cagccgcuucugacugcu

SEQ ID NO: 2900623 - RNA, 14 nt, Human
cagccgcuucugac

SEQ ID NO: 2900624 - RNA, 16 nt, Human
cagccgcagccucccu

SEQ ID NO: 2900625 - RNA, 19 nt, Human
cagccgauucaccugagca

SEQ ID NO: 2900626 - RNA, 21 nt, Human
cagcccuuagcagggaaacag

SEQ ID NO: 2900627 - RNA, 16 nt, Human
cagcccuuagcaggga

SEQ ID NO: 2900628 - RNA, 15 nt, Human
cagcccuuagcaggg

SEQ ID NO: 2900629 - RNA, 17 nt, Human
cagccucuuucuguccc

SEQ ID NO: 2900630 - RNA, 15 nt, Human
cagccugaccuuccu

SEQ ID NO: 2900631 - RNA, 22 nt, Human
cagccugaccuuccuuccuguu

SEQ ID NO: 2900632 - RNA, 17 nt, Human
cagcggggacagcuccu

SEQ ID NO: 2900633 - RNA, 16 nt, Human
cagcggggacagcucc

SEQ ID NO: 2900634 - RNA, 14 nt, Human
cagcggggacagcu

SEQ ID NO: 2900635 - RNA, 20 nt, Human
cagccugagcaacucuugau

SEQ ID NO: 2900636 - RNA, 16 nt, Human
cagccugagcaacucu

SEQ ID NO: 2900637 - RNA, 15 nt, Human
cagcggggacagcuc

SEQ ID NO: 2900638 - RNA, 14 nt, Human
cagcgucccagucu

SEQ ID NO: 2900639 - RNA, 21 nt, Human
cagcguauauauaagaaagac

SEQ ID NO: 2900640 - RNA, 23 nt, Human
cagcguauauauaagaaagacau

SEQ ID NO: 2900641 - RNA, 21 nt, Human
cagcgucccagucucuggcag

SEQ ID NO: 2900642 - RNA, 17 nt, Human
cagcgucccuagcagug

SEQ ID NO: 2900643 - RNA, 18 nt, Human
cagcgucccuagcaguga

SEQ ID NO: 2900644 - RNA, 21 nt, Human
cagccugagcaacucuugauu

SEQ ID NO: 2900645 - RNA, 14 nt, Human
cagcguaaaauggu

SEQ ID NO: 2900646 - RNA, 15 nt, Human
cagcguaaaauggug

SEQ ID NO: 2900647 - RNA, 16 nt, Human
cagcguaaaaugguga

SEQ ID NO: 2900648 - RNA, 17 nt, Human
cagcguaaaauggugaa

SEQ ID NO: 2900649 - RNA, 21 nt, Human
cagcgugcccgcuuccgcugu

SEQ ID NO: 2900650 - RNA, 22 nt, Human
cagcagguccuccaucccaaca

SEQ ID NO: 2900651 - RNA, 14 nt, Human
cagcaucaccugcc

SEQ ID NO: 2900652 - RNA, 18 nt, Human
cagccaggagcugucacc

SEQ ID NO: 2900653 - RNA, 19 nt, Human
cagcacagauaaaaagugg

SEQ ID NO: 2900654 - RNA, 21 nt, Human
cagcacagauaaaaaguggaa

SEQ ID NO: 2900655 - RNA, 23 nt, Human
cagcaggugauuggaccaggcca

SEQ ID NO: 2900656 - RNA, 21 nt, Human
cagcaggugauuggaccaggc

SEQ ID NO: 2900657 - RNA, 20 nt, Human
cagcaggugauuggaccagg

SEQ ID NO: 2900658 - RNA, 18 nt, Human
cagcaggugauuggacca

SEQ ID NO: 2900659 - RNA, 15 nt, Human
cagcaguacaauaaa

SEQ ID NO: 2900660 - RNA, 13 nt, Human
cagcaguagacau

SEQ ID NO: 2900661 - RNA, 14 nt, Human
cagcaguagacauu

SEQ ID NO: 2900662 - RNA, 15 nt, Human
cagcaguagacauuu

SEQ ID NO: 2900663 - RNA, 19 nt, Human
cagcaguccuuuguaaaca

SEQ ID NO: 2900664 - RNA, 19 nt, Human
cagcagucgguuggagcga

SEQ ID NO: 2900665 - RNA, 13 nt, Human
cagcagucucugc

SEQ ID NO: 2900666 - RNA, 15 nt, Human
cagcagucucugccu

SEQ ID NO: 2900667 - RNA, 16 nt, Human
cagcagucucugccuu

SEQ ID NO: 2900668 - RNA, 17 nt, Human
cagcagucucugccuug

SEQ ID NO: 2900669 - RNA, 21 nt, Human
cagcagucucugccuugccuu

SEQ ID NO: 2900670 - RNA, 15 nt, Human
cagcaccucagccug

SEQ ID NO: 2900671 - RNA, 16 nt, Human
cagcaccucagccugc

SEQ ID NO: 2900672 - RNA, 17 nt, Human
cagcaccucagccugca

SEQ ID NO: 2900673 - RNA, 19 nt, Human
cagagggcuugugaacaga

SEQ ID NO: 2900674 - RNA, 23 nt, Human
cagaggggaaaccaguguagccu

SEQ ID NO: 2900675 - RNA, 12 nt, Human
cagaggggaagg

SEQ ID NO: 2900676 - RNA, 14 nt, Human
cagaggggacucug

SEQ ID NO: 2900677 - RNA, 15 nt, Human
cagaggggacucugg

SEQ ID NO: 2900678 - RNA, 16 nt, Human
cagaggggacucuggg

SEQ ID NO: 2900679 - RNA, 17 nt, Human
cagaggggacucugggc

SEQ ID NO: 2900680 - RNA, 20 nt, Human
cagagcugguggacccaggg

SEQ ID NO: 2900681 - RNA, 18 nt, Human
cagagcugguggacccag

SEQ ID NO: 2900682 - RNA, 17 nt, Human
cagagcugguggaccca

SEQ ID NO: 2900683 - RNA, 22 nt, Human
cagagcuguuuauggccucagc

SEQ ID NO: 2900684 - RNA, 21 nt, Human
cagagcuguuuauggccucag

SEQ ID NO: 2900685 - RNA, 20 nt, Human
cagagcuguuuauggccuca

SEQ ID NO: 2900686 - RNA, 19 nt, Human
cagagcuguuuauggccuc

SEQ ID NO: 2900687 - RNA, 15 nt, Human
cagagcuguggagga

SEQ ID NO: 2900688 - RNA, 21 nt, Human
cagagcugguggacccaggga

SEQ ID NO: 2900689 - RNA, 12 nt, Human
cagagcugugga

SEQ ID NO: 2900690 - RNA, 19 nt, Human
cagagucacaagccucgag

SEQ ID NO: 2900691 - RNA, 22 nt, Human
cagagucacaagccucgaggug

SEQ ID NO: 2900692 - RNA, 21 nt, Human
cagagucacacgggggcagcu

SEQ ID NO: 2900693 - RNA, 20 nt, Human
cagaguauuugaaaaaugua

SEQ ID NO: 2900694 - RNA, 20 nt, Human
cagaguauggagcucagaga

SEQ ID NO: 2900695 - RNA, 13 nt, Human
cagaguaugaaca

SEQ ID NO: 2900696 - RNA, 21 nt, Human
cagaguaugaacaccugggcu

SEQ ID NO: 2900697 - RNA, 14 nt, Human
cagaguauggagcu

SEQ ID NO: 2900698 - RNA, 22 nt, Human
cagucugaugagaacucugagc

SEQ ID NO: 2900699 - RNA, 14 nt, Human
cagucucaggagca

SEQ ID NO: 2900700 - RNA, 13 nt, Human
cagucucaggagc

SEQ ID NO: 2900701 - RNA, 19 nt, Human
cagucucaggagcaugggg

SEQ ID NO: 2900702 - RNA, 18 nt, Human
cagucucaggagcauggg

SEQ ID NO: 2900703 - RNA, 14 nt, Human
cagucucccucccu

SEQ ID NO: 2900704 - RNA, 15 nt, Human
caguccuuccaccuc

SEQ ID NO: 2900705 - RNA, 14 nt, Human
caguccuuuguaaa

SEQ ID NO: 2900706 - RNA, 20 nt, Human
caguccuuuguaaacagugu

SEQ ID NO: 2900707 - RNA, 21 nt, Human
caguccuuuguaaacaguguu

SEQ ID NO: 2900708 - RNA, 21 nt, Human
caguccuuuuacuacagcuau

SEQ ID NO: 2900709 - RNA, 12 nt, Human
cagugcaggcac

SEQ ID NO: 2900710 - RNA, 13 nt, Human
cagugcagcaaua

SEQ ID NO: 2900711 - RNA, 20 nt, Human
cagucugauucccaagcucu

SEQ ID NO: 2900712 - RNA, 19 nt, Human
cagucugauucccaagcuc

SEQ ID NO: 2900713 - RNA, 22 nt, Human
cagugcaaugguauaaauuuca

SEQ ID NO: 2900714 - RNA, 12 nt, Human
cagugcacauga

SEQ ID NO: 2900715 - RNA, 14 nt, Human
cagugcacaugaac

SEQ ID NO: 2900716 - RNA, 12 nt, Human
cagugcccacag

SEQ ID NO: 2900717 - RNA, 19 nt, Human
cagugggacagggcauggc

SEQ ID NO: 2900718 - RNA, 16 nt, Human
cagugggacagggcau

SEQ ID NO: 2900719 - RNA, 11 nt, Human
cagugggagcu

SEQ ID NO: 2900720 - RNA, 15 nt, Human
cagugggagauguua

SEQ ID NO: 2900721 - RNA, 17 nt, Human
cagugggagauguuaga

SEQ ID NO: 2900722 - RNA, 14 nt, Human
cagugcaggcacag

SEQ ID NO: 2900723 - RNA, 14 nt, Human
cagugcaggcuggc

SEQ ID NO: 2900724 - RNA, 16 nt, Human
cagugcaggcuggcca

SEQ ID NO: 2900725 - RNA, 17 nt, Human
cagugcaggcuggccag

SEQ ID NO: 2900726 - RNA, 18 nt, Human
cagugcaggcuggccagc

SEQ ID NO: 2900727 - RNA, 19 nt, Human
cagugcaggcuggccagcc

SEQ ID NO: 2900728 - RNA, 20 nt, Human
cagugcaggcuggccagccg

SEQ ID NO: 2900729 - RNA, 22 nt, Human
cagugcaggcuggccagccgcu

SEQ ID NO: 2900730 - RNA, 17 nt, Human
cagugcagggcaaaaua

SEQ ID NO: 2900731 - RNA, 20 nt, Human
cagugcagggcaaaauauuc

SEQ ID NO: 2900732 - RNA, 10 nt, Human
cagugccaac

SEQ ID NO: 2900733 - RNA, 11 nt, Human
cagugccaacu

SEQ ID NO: 2900734 - RNA, 17 nt, Human
cagugccaacuccucac

SEQ ID NO: 2900735 - RNA, 16 nt, Human
cagugccaacuguggc

SEQ ID NO: 2900736 - RNA, 17 nt, Human
cagugccaacuguggcu

SEQ ID NO: 2900737 - RNA, 18 nt, Human
cagugccaacuguggcug

SEQ ID NO: 2900738 - RNA, 19 nt, Human
cagugccaacuguggcugg

SEQ ID NO: 2900739 - RNA, 20 nt, Human
cagugccaacuguggcuggu

SEQ ID NO: 2900740 - RNA, 12 nt, Human
cagugccaagga

SEQ ID NO: 2900741 - RNA, 13 nt, Human
cagugccaaggac

SEQ ID NO: 2900742 - RNA, 23 nt, Human
cagugccaaggaccuccucuucc

SEQ ID NO: 2900743 - RNA, 14 nt, Human
cagugccagcaaug

SEQ ID NO: 2900744 - RNA, 15 nt, Human
cagugccagcaauga

SEQ ID NO: 2900745 - RNA, 17 nt, Human
cagugccagcaaugaca

SEQ ID NO: 2900746 - RNA, 21 nt, Human
cagugccagcaaugacaucuc

SEQ ID NO: 2900747 - RNA, 20 nt, Human
cagguuucuggucucuaggc

SEQ ID NO: 2900748 - RNA, 17 nt, Human
cagguuucuggucucua

SEQ ID NO: 2900749 - RNA, 20 nt, Human
caguauuuuggagaaauuau

SEQ ID NO: 2900750 - RNA, 19 nt, Human
caguauuuuggagaaauua

SEQ ID NO: 2900751 - RNA, 21 nt, Human
caguauuuuggagaaauuauu

SEQ ID NO: 2900752 - RNA, 23 nt, Human
caguauuuuggagaaauuauuua

SEQ ID NO: 2900753 - RNA, 15 nt, Human
cagucaacaagccug

SEQ ID NO: 2900754 - RNA, 15 nt, Human
cagucaaaauaauuc

SEQ ID NO: 2900755 - RNA, 13 nt, Human
cagucaagaagaa

SEQ ID NO: 2900756 - RNA, 14 nt, Human
cagucaagaagaaa

SEQ ID NO: 2900757 - RNA, 20 nt, Human
cagucaagaagaaaaagguu

SEQ ID NO: 2900758 - RNA, 15 nt, Human
caggugcuauuguua

SEQ ID NO: 2900759 - RNA, 18 nt, Human
caggugcuauuguuacuc

SEQ ID NO: 2900760 - RNA, 20 nt, Human
caggugcuauuguuacucuu

SEQ ID NO: 2900761 - RNA, 15 nt, Human
cagguuggaagagaa

SEQ ID NO: 2900762 - RNA, 18 nt, Human
cagguuggaagagaauca

SEQ ID NO: 2900763 - RNA, 20 nt, Human
cagguuggaagagaaucacc

SEQ ID NO: 2900764 - RNA, 13 nt, Human
cagguuggacccc

SEQ ID NO: 2900765 - RNA, 14 nt, Human
cagguuggacccca

SEQ ID NO: 2900766 - RNA, 17 nt, Human
cagguuggaccccagag

SEQ ID NO: 2900767 - RNA, 13 nt, Human
caggugcaguggc

SEQ ID NO: 2900768 - RNA, 14 nt, Human
caggugccuuucaa

SEQ ID NO: 2900769 - RNA, 15 nt, Human
caggugccuuucaaa

SEQ ID NO: 2900770 - RNA, 17 nt, Human
caggugccuuucaaauu

SEQ ID NO: 2900771 - RNA, 21 nt, Human
caggugccuuucaaauuuaga

SEQ ID NO: 2900772 - RNA, 12 nt, Human
caggugcagugg

SEQ ID NO: 2900773 - RNA, 17 nt, Human
caggugauccacccacc

SEQ ID NO: 2900774 - RNA, 16 nt, Human
caggugauccacccac

SEQ ID NO: 2900775 - RNA, 12 nt, Human
caggguuggccc

SEQ ID NO: 2900776 - RNA, 13 nt, Human
caggugcagagga

SEQ ID NO: 2900777 - RNA, 14 nt, Human
caggugcagaggaa

SEQ ID NO: 2900778 - RNA, 15 nt, Human
caggugcagaggaag

SEQ ID NO: 2900779 - RNA, 19 nt, Human
caggugcagaggaaguaca

SEQ ID NO: 2900780 - RNA, 18 nt, Human
cagggucucacucugucg

SEQ ID NO: 2900781 - RNA, 17 nt, Human
cagggucucacucuguc

SEQ ID NO: 2900782 - RNA, 21 nt, Human
cagggucucacucugucgccc

SEQ ID NO: 2900783 - RNA, 13 nt, Human
cagggucucugcu

SEQ ID NO: 2900784 - RNA, 15 nt, Human
cagggucucucccuc

SEQ ID NO: 2900785 - RNA, 16 nt, Human
cagggucucucccuca

SEQ ID NO: 2900786 - RNA, 18 nt, Human
cagggucucucccucagg

SEQ ID NO: 2900787 - RNA, 20 nt, Human
cagggucucucccucaggug

SEQ ID NO: 2900788 - RNA, 21 nt, Human
cagggucucucccucaggugu

SEQ ID NO: 2900789 - RNA, 15 nt, Human
cagggucucugcugc

SEQ ID NO: 2900790 - RNA, 16 nt, Human
cagggucucugcugcc

SEQ ID NO: 2900791 - RNA, 17 nt, Human
cagggucucugcugccg

SEQ ID NO: 2900792 - RNA, 18 nt, Human
cagggucucugcugccgc

SEQ ID NO: 2900793 - RNA, 17 nt, Human
cagggugucuccugaag

SEQ ID NO: 2900794 - RNA, 20 nt, Human
cagggugugagcgccacauc

SEQ ID NO: 2900795 - RNA, 15 nt, Human
cagggucugggcagg

SEQ ID NO: 2900796 - RNA, 17 nt, Human
cagggucuucccuaccu

SEQ ID NO: 2900797 - RNA, 13 nt, Human
cagggucuucccu

SEQ ID NO: 2900798 - RNA, 16 nt, Human
cagggucugggcagga

SEQ ID NO: 2900799 - RNA, 15 nt, Human
cagggucugugugaa

SEQ ID NO: 2900800 - RNA, 19 nt, Human
cagggucugugugaaugug

SEQ ID NO: 2900801 - RNA, 20 nt, Human
cagggucugugugaaugugg

SEQ ID NO: 2900802 - RNA, 23 nt, Human
cagggucugugugaaugugggca

SEQ ID NO: 2900803 - RNA, 19 nt, Human
cagggucucugcugccgcc

SEQ ID NO: 2900804 - RNA, 14 nt, Human
cagggucugggcag

SEQ ID NO: 2900805 - RNA, 23 nt, Human
caggguucucccucccaccuuaa

SEQ ID NO: 2900806 - RNA, 23 nt, Human
caggguguugggauacugcaggg

SEQ ID NO: 2900807 - RNA, 19 nt, Human
caggcugggcuucaguggc

SEQ ID NO: 2900808 - RNA, 17 nt, Human
caggcugggcuucagug

SEQ ID NO: 2900809 - RNA, 13 nt, Human
cagggagggccug

SEQ ID NO: 2900810 - RNA, 12 nt, Human
cagggagggccu

SEQ ID NO: 2900811 - RNA, 23 nt, Human
cagggaggagguggcagcccugu

SEQ ID NO: 2900812 - RNA, 22 nt, Human
cagggaggagguggcagcccug

SEQ ID NO: 2900813 - RNA, 17 nt, Human
caggcgccccuuccccc

SEQ ID NO: 2900814 - RNA, 15 nt, Human
caggcgcugugcuau

SEQ ID NO: 2900815 - RNA, 20 nt, Human
caggcgcugugcuaucauga

SEQ ID NO: 2900816 - RNA, 23 nt, Human
caggcgggagcgguggcccuguc

SEQ ID NO: 2900817 - RNA, 16 nt, Human
caggcgggaggaggug

SEQ ID NO: 2900818 - RNA, 21 nt, Human
caggcgggagcgguggcccug

SEQ ID NO: 2900819 - RNA, 15 nt, Human
caggcggugggcacc

SEQ ID NO: 2900820 - RNA, 17 nt, Human
caggcggugggcaccca

SEQ ID NO: 2900821 - RNA, 17 nt, Human
caggcuggcccugcccu

SEQ ID NO: 2900822 - RNA, 19 nt, Human
caggcuggcccugcccugg

SEQ ID NO: 2900823 - RNA, 18 nt, Human
caggcuggcccugcccug

SEQ ID NO: 2900824 - RNA, 15 nt, Human
caggcugggcuucag

SEQ ID NO: 2900825 - RNA, 16 nt, Human
caggcugggcuucagu

SEQ ID NO: 2900826 - RNA, 15 nt, Human
caggcuggcgugcag

SEQ ID NO: 2900827 - RNA, 20 nt, Human
caggcuggcccugcccuggu

SEQ ID NO: 2900828 - RNA, 12 nt, Human
caggccucaccu

SEQ ID NO: 2900829 - RNA, 13 nt, Human
caggccucaccuc

SEQ ID NO: 2900830 - RNA, 17 nt, Human
caggccucaccucuacc

SEQ ID NO: 2900831 - RNA, 19 nt, Human
caggccucaccucuaccca

SEQ ID NO: 2900832 - RNA, 21 nt, Human
caggccucaccucuacccaaa

SEQ ID NO: 2900833 - RNA, 22 nt, Human
caggccucaccucuacccaaac

SEQ ID NO: 2900834 - RNA, 12 nt, Human
caggccucccuc

SEQ ID NO: 2900835 - RNA, 22 nt, Human
caggccuauguugauccaucca

SEQ ID NO: 2900836 - RNA, 20 nt, Human
caggccugccuguucccauu

SEQ ID NO: 2900837 - RNA, 15 nt, Human
caggcgccccuuccc

SEQ ID NO: 2900838 - RNA, 20 nt, Human
caggcgauccaccugucuca

SEQ ID NO: 2900839 - RNA, 12 nt, Human
caggccugcagc

SEQ ID NO: 2900840 - RNA, 22 nt, Human
caggccugcagcaggaguggug

SEQ ID NO: 2900841 - RNA, 19 nt, Human
caggccucccucucucuuc

SEQ ID NO: 2900842 - RNA, 18 nt, Human
caggccucccucucucuu

SEQ ID NO: 2900843 - RNA, 17 nt, Human
caggccucccucucucu

SEQ ID NO: 2900844 - RNA, 16 nt, Human
caggccucccucucuc

SEQ ID NO: 2900845 - RNA, 15 nt, Human
caggccucccucucu

SEQ ID NO: 2900846 - RNA, 14 nt, Human
caggccucccucuc

SEQ ID NO: 2900847 - RNA, 13 nt, Human
caggccucccucu

SEQ ID NO: 2900848 - RNA, 23 nt, Human
caggccucccucucucuucugcu

SEQ ID NO: 2900849 - RNA, 22 nt, Human
caggccucccucucucuucugc

SEQ ID NO: 2900850 - RNA, 18 nt, Human
cagggaggugaccccagg

SEQ ID NO: 2900851 - RNA, 16 nt, Human
cagggagggccugggc

SEQ ID NO: 2900852 - RNA, 14 nt, Human
cagggagggccugg

SEQ ID NO: 2900853 - RNA, 22 nt, Human
cagggaguccgaaagggacuug

SEQ ID NO: 2900854 - RNA, 14 nt, Human
cagggagugcuggc

SEQ ID NO: 2900855 - RNA, 16 nt, Human
cagggagugcuggcuc

SEQ ID NO: 2900856 - RNA, 17 nt, Human
cagggagugcuggcuca

SEQ ID NO: 2900857 - RNA, 22 nt, Human
cagggagugcuggcucacagua

SEQ ID NO: 2900858 - RNA, 17 nt, Human
caggcgcugaguaugga

SEQ ID NO: 2900859 - RNA, 21 nt, Human
caggccagagggagugacaga

SEQ ID NO: 2900860 - RNA, 19 nt, Human
caggccagagggagugaca

SEQ ID NO: 2900861 - RNA, 16 nt, Human
caggccagagggagug

SEQ ID NO: 2900862 - RNA, 23 nt, Human
caggccagagggagugacagagg

SEQ ID NO: 2900863 - RNA, 12 nt, Human
caggagcucuuc

SEQ ID NO: 2900864 - RNA, 20 nt, Human
caggagcucuucaggccucc

SEQ ID NO: 2900865 - RNA, 19 nt, Human
caggagcucuucaggccuc

SEQ ID NO: 2900866 - RNA, 18 nt, Human
caggagcucuucaggccu

SEQ ID NO: 2900867 - RNA, 15 nt, Human
caggagcucuucagg

SEQ ID NO: 2900868 - RNA, 19 nt, Human
caggagcugucaccaagga

SEQ ID NO: 2900869 - RNA, 21 nt, Human
caggagcugucaccaaggaaa

SEQ ID NO: 2900870 - RNA, 22 nt, Human
caggagcugucaccaaggaaac

SEQ ID NO: 2900871 - RNA, 23 nt, Human
caggagcucuucaggccucccuc

SEQ ID NO: 2900872 - RNA, 22 nt, Human
caggagcucuucaggccucccu

SEQ ID NO: 2900873 - RNA, 13 nt, Human
caggaacagaagg

SEQ ID NO: 2900874 - RNA, 23 nt, Human
caggcacccaccaucaugucugg

SEQ ID NO: 2900875 - RNA, 22 nt, Human
caggcacccaccaucaugucug

SEQ ID NO: 2900876 - RNA, 18 nt, Human
caggcacccaccaucaug

SEQ ID NO: 2900877 - RNA, 22 nt, Human
caggcagaucugugccccaugc

SEQ ID NO: 2900878 - RNA, 21 nt, Human
caggcagaucugugccccaug

SEQ ID NO: 2900879 - RNA, 19 nt, Human
caggcagaucugugcccca

SEQ ID NO: 2900880 - RNA, 18 nt, Human
caggcagaucugugcccc

SEQ ID NO: 2900881 - RNA, 17 nt, Human
caggcagaucugugccc

SEQ ID NO: 2900882 - RNA, 16 nt, Human
caggcagaucugugcc

SEQ ID NO: 2900883 - RNA, 15 nt, Human
caggcagaucugugc

SEQ ID NO: 2900884 - RNA, 13 nt, Human
caggcagaucugu

SEQ ID NO: 2900885 - RNA, 19 nt, Human
caggagguuuuuuugucaa

SEQ ID NO: 2900886 - RNA, 13 nt, Human
caggaccccuggg

SEQ ID NO: 2900887 - RNA, 12 nt, Human
caggagggaggg

SEQ ID NO: 2900888 - RNA, 15 nt, Human
caggagggaggggga

SEQ ID NO: 2900889 - RNA, 20 nt, Human
caggagguggaggcugcagu

SEQ ID NO: 2900890 - RNA, 15 nt, Human
caggagggucuaugg

SEQ ID NO: 2900891 - RNA, 20 nt, Human
caggagggucuauggggaga

SEQ ID NO: 2900892 - RNA, 19 nt, Human
caggaggggaacacugccc

SEQ ID NO: 2900893 - RNA, 24 nt, Human
caggaggggaacacugcccucgca

SEQ ID NO: 2900894 - RNA, 22 nt, Human
caggagggcguucuuaggcugc

SEQ ID NO: 2900895 - RNA, 12 nt, Human
caggagggcccu

SEQ ID NO: 2900896 - RNA, 16 nt, Human
caggagggcccuaccu

SEQ ID NO: 2900897 - RNA, 16 nt, Human
caggagggcauccaua

SEQ ID NO: 2900898 - RNA, 23 nt, Human
caggagggagggggaaggcaggg

SEQ ID NO: 2900899 - RNA, 20 nt, Human
cauuagggaugccuccuuuc

SEQ ID NO: 2900900 - RNA, 22 nt, Human
cauguugcccccgugagccaau

SEQ ID NO: 2900901 - RNA, 18 nt, Human
cauuagguuguccuagaa

SEQ ID NO: 2900902 - RNA, 14 nt, Human
cauuaguaaauguc

SEQ ID NO: 2900903 - RNA, 16 nt, Human
cauuaguaaaugucuu

SEQ ID NO: 2900904 - RNA, 17 nt, Human
cauuaguaaaugucuuu

SEQ ID NO: 2900905 - RNA, 18 nt, Human
cauuaguaaaugucuuug

SEQ ID NO: 2900906 - RNA, 19 nt, Human
cauuaguaaaugucuuugu

SEQ ID NO: 2900907 - RNA, 21 nt, Human
cauuaguaaaugucuuuguaa

SEQ ID NO: 2900908 - RNA, 22 nt, Human
cauuaguaaaugucuuuguaag

SEQ ID NO: 2900909 - RNA, 23 nt, Human
cauuaguaaaugucuuuguaagu

SEQ ID NO: 2900910 - RNA, 21 nt, Human
cauuaguaacauaauaaauua

SEQ ID NO: 2900911 - RNA, 21 nt, Human
caugucaggccugugugugaa

SEQ ID NO: 2900912 - RNA, 13 nt, Human
cauguuggccagg

SEQ ID NO: 2900913 - RNA, 12 nt, Human
cauguuggccag

SEQ ID NO: 2900914 - RNA, 16 nt, Human
caugucaggccugugu

SEQ ID NO: 2900915 - RNA, 23 nt, Human
cauguugcacacccacucagcuc

SEQ ID NO: 2900916 - RNA, 22 nt, Human
cauguugcacacccacucagcu

SEQ ID NO: 2900917 - RNA, 18 nt, Human
cauguugcacacccacuc

SEQ ID NO: 2900918 - RNA, 12 nt, Human
cauuaugagguc

SEQ ID NO: 2900919 - RNA, 15 nt, Human
cauuaugaggucaga

SEQ ID NO: 2900920 - RNA, 14 nt, Human
cauuccuucuuuga

SEQ ID NO: 2900921 - RNA, 16 nt, Human
cauucgcgcucugcuc

SEQ ID NO: 2900922 - RNA, 17 nt, Human
cauucgcgcucugcuca

SEQ ID NO: 2900923 - RNA, 18 nt, Human
cauucgcgcucugcucag

SEQ ID NO: 2900924 - RNA, 19 nt, Human
cauuccuucuuugauaaug

SEQ ID NO: 2900925 - RNA, 13 nt, Human
cauuccuugccug

SEQ ID NO: 2900926 - RNA, 23 nt, Human
cauuccuucuuugauaauguuaa

SEQ ID NO: 2900927 - RNA, 13 nt, Human
cauuccuucuuuu

SEQ ID NO: 2900928 - RNA, 15 nt, Human
cauuccuucuuugau

SEQ ID NO: 2900929 - RNA, 16 nt, Human
cauuccuucuuugaua

SEQ ID NO: 2900930 - RNA, 18 nt, Human
cauuccuucuuugauaau

SEQ ID NO: 2900931 - RNA, 13 nt, Human
cauucucacuccu

SEQ ID NO: 2900932 - RNA, 18 nt, Human
cauucuagguuugcaaga

SEQ ID NO: 2900933 - RNA, 16 nt, Human
cauucuauuuuagaau

SEQ ID NO: 2900934 - RNA, 17 nt, Human
cauucuauuuuagaaua

SEQ ID NO: 2900935 - RNA, 15 nt, Human
cauucuaucaagccc

SEQ ID NO: 2900936 - RNA, 17 nt, Human
cauucuaucaagcccag

SEQ ID NO: 2900937 - RNA, 18 nt, Human
cauucuaucaagcccagg

SEQ ID NO: 2900938 - RNA, 23 nt, Human
cauucuaucaagcccaggugcca

SEQ ID NO: 2900939 - RNA, 13 nt, Human
cauucuauugccu

SEQ ID NO: 2900940 - RNA, 14 nt, Human
cauucuauugccuu

SEQ ID NO: 2900941 - RNA, 16 nt, Human
cauucuauugccuucu

SEQ ID NO: 2900942 - RNA, 18 nt, Human
cauucuauugccuucuuu

SEQ ID NO: 2900943 - RNA, 19 nt, Human
cauucuauugccuucuuug

SEQ ID NO: 2900944 - RNA, 20 nt, Human
cauucuauugccuucuuuga

SEQ ID NO: 2900945 - RNA, 21 nt, Human
cauucuauugccuucuuugaa

SEQ ID NO: 2900946 - RNA, 22 nt, Human
cauucuauugccuucuuugaag

SEQ ID NO: 2900947 - RNA, 23 nt, Human
cauucuauugccuucuuugaaga

SEQ ID NO: 2900948 - RNA, 15 nt, Human
cauguauaguugcuu

SEQ ID NO: 2900949 - RNA, 17 nt, Human
cauguauaguugcuuuu

SEQ ID NO: 2900950 - RNA, 20 nt, Human
cauguauaguugcuuuugaa

SEQ ID NO: 2900951 - RNA, 19 nt, Human
cauguauaguuuucccuau

SEQ ID NO: 2900952 - RNA, 23 nt, Human
cauguagugugggaggcuccugu

SEQ ID NO: 2900953 - RNA, 14 nt, Human
cauguauaaaugug

SEQ ID NO: 2900954 - RNA, 15 nt, Human
cauguauaaauguga

SEQ ID NO: 2900955 - RNA, 16 nt, Human
cauguauaaaugugau

SEQ ID NO: 2900956 - RNA, 17 nt, Human
cauguauaaaugugaua

SEQ ID NO: 2900957 - RNA, 15 nt, Human
cauguaucaucugga

SEQ ID NO: 2900958 - RNA, 20 nt, Human
caugaaguuuccuuggcugg

SEQ ID NO: 2900959 - RNA, 12 nt, Human
caugacauguua

SEQ ID NO: 2900960 - RNA, 20 nt, Human
caugacagcgcuaaacguug

SEQ ID NO: 2900961 - RNA, 18 nt, Human
caugacaggccugaagau

SEQ ID NO: 2900962 - RNA, 15 nt, Human
caugacauaacagug

SEQ ID NO: 2900963 - RNA, 18 nt, Human
caugacauaacagugcag

SEQ ID NO: 2900964 - RNA, 20 nt, Human
caugacauaacagugcaggg

SEQ ID NO: 2900965 - RNA, 18 nt, Human
caugacauaugacuugau

SEQ ID NO: 2900966 - RNA, 18 nt, Human
caugcaauuuauuaaaau

SEQ ID NO: 2900967 - RNA, 11 nt, Human
caugcacacac

SEQ ID NO: 2900968 - RNA, 10 nt, Human
caugcacaca

SEQ ID NO: 2900969 - RNA, 14 nt, Human
caugcuccucacug

SEQ ID NO: 2900970 - RNA, 15 nt, Human
caugcuccucacugc

SEQ ID NO: 2900971 - RNA, 17 nt, Human
caugcuccucacugccc

SEQ ID NO: 2900972 - RNA, 19 nt, Human
caugcuccucacugcccgc

SEQ ID NO: 2900973 - RNA, 20 nt, Human
caugcuccucacugcccgca

SEQ ID NO: 2900974 - RNA, 16 nt, Human
caugcacgugugugca

SEQ ID NO: 2900975 - RNA, 23 nt, Human
caugcuaucucugugugcacaaa

SEQ ID NO: 2900976 - RNA, 19 nt, Human
caugcaccugcaaucccag

SEQ ID NO: 2900977 - RNA, 20 nt, Human
caugcaccugcaaucccagc

SEQ ID NO: 2900978 - RNA, 12 nt, Human
caugcaccaaac

SEQ ID NO: 2900979 - RNA, 22 nt, Human
caugcuauuuguucuucaagaa

SEQ ID NO: 2900980 - RNA, 20 nt, Human
caugaaguguguuuccuuca

SEQ ID NO: 2900981 - RNA, 18 nt, Human
caugaaguuuccuuggcu

SEQ ID NO: 2900982 - RNA, 12 nt, Human
caugacacugac

SEQ ID NO: 2900983 - RNA, 13 nt, Human
caugacacugacc

SEQ ID NO: 2900984 - RNA, 15 nt, Human
caugacacugaccuu

SEQ ID NO: 2900985 - RNA, 13 nt, Human
caugaaggaaacu

SEQ ID NO: 2900986 - RNA, 22 nt, Human
caugaagcccaagugaaaucaa

SEQ ID NO: 2900987 - RNA, 11 nt, Human
caugaagccug

SEQ ID NO: 2900988 - RNA, 12 nt, Human
caugaagccugu

SEQ ID NO: 2900989 - RNA, 13 nt, Human
caugaagccugug

SEQ ID NO: 2900990 - RNA, 16 nt, Human
caugaagccuguggau

SEQ ID NO: 2900991 - RNA, 11 nt, Human
caugaagccuu

SEQ ID NO: 2900992 - RNA, 12 nt, Human
caugaagccuuu

SEQ ID NO: 2900993 - RNA, 13 nt, Human
caugaagccuuuu

SEQ ID NO: 2900994 - RNA, 15 nt, Human
caugaagccuuuuga

SEQ ID NO: 2900995 - RNA, 16 nt, Human
caugaagccuuuugaa

SEQ ID NO: 2900996 - RNA, 19 nt, Human
caugaagccuuuugaaagg

SEQ ID NO: 2900997 - RNA, 14 nt, Human
cauggccacacugu

SEQ ID NO: 2900998 - RNA, 15 nt, Human
cauggccacacugug

SEQ ID NO: 2900999 - RNA, 16 nt, Human
cauggccacacuguga

SEQ ID NO: 2901000 - RNA, 18 nt, Human
cauggccacacugugaca

SEQ ID NO: 2901001 - RNA, 19 nt, Human
cauggccacacugugacac

SEQ ID NO: 2901002 - RNA, 20 nt, Human
cauggccacacugugacaca

SEQ ID NO: 2901003 - RNA, 22 nt, Human
cauggccacacugugacacacu

SEQ ID NO: 2901004 - RNA, 21 nt, Human
cauggcaucuucgucuucacu

SEQ ID NO: 2901005 - RNA, 19 nt, Human
cauggcaucaccuccacca

SEQ ID NO: 2901006 - RNA, 13 nt, Human
cauggccaggugg

SEQ ID NO: 2901007 - RNA, 22 nt, Human
cauagcuuacaagccagcugga

SEQ ID NO: 2901008 - RNA, 18 nt, Human
cauagcuuauuauugaag

SEQ ID NO: 2901009 - RNA, 20 nt, Human
cauagcuuauuauugaagga

SEQ ID NO: 2901010 - RNA, 14 nt, Human
cauagcugucuaga

SEQ ID NO: 2901011 - RNA, 15 nt, Human
cauagcugucuagag

SEQ ID NO: 2901012 - RNA, 22 nt, Human
cauagcagagaaugaaagggcc

SEQ ID NO: 2901013 - RNA, 19 nt, Human
cauagcagagaaugaaagg

SEQ ID NO: 2901014 - RNA, 14 nt, Human
cauagcaagacaca

SEQ ID NO: 2901015 - RNA, 20 nt, Human
cauagcaagacacaucccua

SEQ ID NO: 2901016 - RNA, 15 nt, Human
cauagcaagacacau

SEQ ID NO: 2901017 - RNA, 23 nt, Human
cauagcaagauugcuuaaaauag

SEQ ID NO: 2901018 - RNA, 15 nt, Human
cauaauuuguacaua

SEQ ID NO: 2901019 - RNA, 19 nt, Human
cauacacuaaccaaaucuc

SEQ ID NO: 2901020 - RNA, 16 nt, Human
cauacacuuguauaaa

SEQ ID NO: 2901021 - RNA, 18 nt, Human
cauacacuuguauaaaug

SEQ ID NO: 2901022 - RNA, 19 nt, Human
cauacacuuguauaaaugu

SEQ ID NO: 2901023 - RNA, 20 nt, Human
cauacacuuguauaaaugua

SEQ ID NO: 2901024 - RNA, 21 nt, Human
cauacacuuguauaaauguau

SEQ ID NO: 2901025 - RNA, 23 nt, Human
cauacacccccucuucugagcac

SEQ ID NO: 2901026 - RNA, 17 nt, Human
cauacacgaaagagaga

SEQ ID NO: 2901027 - RNA, 13 nt, Human
cauacacgaaaga

SEQ ID NO: 2901028 - RNA, 22 nt, Human
cauacacccccucuucugagca

SEQ ID NO: 2901029 - RNA, 21 nt, Human
cauacacccccucuucugagc

SEQ ID NO: 2901030 - RNA, 23 nt, Human
cauaauuuguacauauguaaaau

SEQ ID NO: 2901031 - RNA, 21 nt, Human
cauaauuuguacauauguaaa

SEQ ID NO: 2901032 - RNA, 22 nt, Human
cauaugccuuggggaggacaaa

SEQ ID NO: 2901033 - RNA, 15 nt, Human
cauccauguuuguaa

SEQ ID NO: 2901034 - RNA, 18 nt, Human
cauccauguuuguaaaac

SEQ ID NO: 2901035 - RNA, 19 nt, Human
cauccauguuuguaaaacu

SEQ ID NO: 2901036 - RNA, 12 nt, Human
cauccauuccca

SEQ ID NO: 2901037 - RNA, 14 nt, Human
cauccauucccaag

SEQ ID NO: 2901038 - RNA, 18 nt, Human
cauccauucccaagaaau

SEQ ID NO: 2901039 - RNA, 16 nt, Human
caucccagccccaauu

SEQ ID NO: 2901040 - RNA, 20 nt, Human
caucccagccccaauuuucu

SEQ ID NO: 2901041 - RNA, 13 nt, Human
caucccaggacac

SEQ ID NO: 2901042 - RNA, 19 nt, Human
caucccaggacaccacacc

SEQ ID NO: 2901043 - RNA, 16 nt, Human
cauccauguccuaugu

SEQ ID NO: 2901044 - RNA, 18 nt, Human
cauccauguccuaugugu

SEQ ID NO: 2901045 - RNA, 20 nt, Human
cauccauguccuauguguga

SEQ ID NO: 2901046 - RNA, 21 nt, Human
caucccaggacaccacaccca

SEQ ID NO: 2901047 - RNA, 22 nt, Human
caucccaggacaccacacccag

SEQ ID NO: 2901048 - RNA, 23 nt, Human
caucccaggacaccacacccagc

SEQ ID NO: 2901049 - RNA, 20 nt, Human
caucccaggaugcugggugg

SEQ ID NO: 2901050 - RNA, 12 nt, Human
caucccccaaag

SEQ ID NO: 2901051 - RNA, 14 nt, Human
caucccccaaaguu

SEQ ID NO: 2901052 - RNA, 14 nt, Human
cauccccuggacug

SEQ ID NO: 2901053 - RNA, 14 nt, Human
cauccccucccauc

SEQ ID NO: 2901054 - RNA, 19 nt, Human
cauccccuggacugggagg

SEQ ID NO: 2901055 - RNA, 21 nt, Human
cauccuucaagaacucugggc

SEQ ID NO: 2901056 - RNA, 15 nt, Human
cauccuuauccuuca

SEQ ID NO: 2901057 - RNA, 19 nt, Human
cauccuuauccuucaucuu

SEQ ID NO: 2901058 - RNA, 20 nt, Human
cauccuuauccuucaucuuu

SEQ ID NO: 2901059 - RNA, 22 nt, Human
cauccuuauccuucaucuuuua

SEQ ID NO: 2901060 - RNA, 19 nt, Human
caucugccccucccccaac

SEQ ID NO: 2901061 - RNA, 12 nt, Human
caucugcccgcc

SEQ ID NO: 2901062 - RNA, 13 nt, Human
caucugcccgccu

SEQ ID NO: 2901063 - RNA, 14 nt, Human
caucugcccgccug

SEQ ID NO: 2901064 - RNA, 19 nt, Human
caucugcccgccugcccac

SEQ ID NO: 2901065 - RNA, 20 nt, Human
caucugcccgccugcccacc

SEQ ID NO: 2901066 - RNA, 21 nt, Human
caucugcccgccugcccaccu

SEQ ID NO: 2901067 - RNA, 22 nt, Human
caucugcccgccugcccaccug

SEQ ID NO: 2901068 - RNA, 23 nt, Human
caucugcccgccugcccaccugc

SEQ ID NO: 2901069 - RNA, 13 nt, Human
cauccuucccuuu

SEQ ID NO: 2901070 - RNA, 12 nt, Human
cauccuuccuau

SEQ ID NO: 2901071 - RNA, 13 nt, Human
cauccuuccuaua

SEQ ID NO: 2901072 - RNA, 18 nt, Human
caucugccccucccccaa

SEQ ID NO: 2901073 - RNA, 18 nt, Human
cauccuuccucacaccag

SEQ ID NO: 2901074 - RNA, 23 nt, Human
cauccuucaagaacucugggcug

SEQ ID NO: 2901075 - RNA, 22 nt, Human
cauccuucaagaacucugggcu

SEQ ID NO: 2901076 - RNA, 11 nt, Human
cauccuuaaag

SEQ ID NO: 2901077 - RNA, 21 nt, Human
caucugggaagauuucuaccu

SEQ ID NO: 2901078 - RNA, 23 nt, Human
caucuggcuuauuuuaaugugau

SEQ ID NO: 2901079 - RNA, 11 nt, Human
caucugggcuc

SEQ ID NO: 2901080 - RNA, 13 nt, Human
caucugggcuccu

SEQ ID NO: 2901081 - RNA, 21 nt, Human
ccacacuucaggcucuucucc

SEQ ID NO: 2901082 - RNA, 16 nt, Human
ccacacuucaggcucu

SEQ ID NO: 2901083 - RNA, 20 nt, Human
ccacacuucaggcucuucuc

SEQ ID NO: 2901084 - RNA, 13 nt, Human
ccacacugugaca

SEQ ID NO: 2901085 - RNA, 17 nt, Human
ccacacugugacacacu

SEQ ID NO: 2901086 - RNA, 18 nt, Human
ccacacugugacacacua

SEQ ID NO: 2901087 - RNA, 19 nt, Human
ccacacugugacacacuac

SEQ ID NO: 2901088 - RNA, 21 nt, Human
ccacacugugacacacuacac

SEQ ID NO: 2901089 - RNA, 21 nt, Human
ccacacuggacuccggcccuc

SEQ ID NO: 2901090 - RNA, 14 nt, Human
ccacacuggacucc

SEQ ID NO: 2901091 - RNA, 22 nt, Human
ccacacuggacuccggcccucc

SEQ ID NO: 2901092 - RNA, 16 nt, Human
ccaccaggugccuuuc

SEQ ID NO: 2901093 - RNA, 19 nt, Human
ccaccaggugccuuucaaa

SEQ ID NO: 2901094 - RNA, 20 nt, Human
ccaccaggugccuuucaaau

SEQ ID NO: 2901095 - RNA, 20 nt, Human
ccaccacuaggacucugagg

SEQ ID NO: 2901096 - RNA, 13 nt, Human
ccaccacuauaaa

SEQ ID NO: 2901097 - RNA, 14 nt, Human
ccaccacuauaaaa

SEQ ID NO: 2901098 - RNA, 17 nt, Human
ccaccacuaggacucug

SEQ ID NO: 2901099 - RNA, 18 nt, Human
ccaccaccgcccgucugu

SEQ ID NO: 2901100 - RNA, 12 nt, Human
ccaccaccuccc

SEQ ID NO: 2901101 - RNA, 17 nt, Human
ccaccaccucccucacc

SEQ ID NO: 2901102 - RNA, 14 nt, Human
ccaccaccucugug

SEQ ID NO: 2901103 - RNA, 15 nt, Human
ccaccaccucugugg

SEQ ID NO: 2901104 - RNA, 15 nt, Human
ccaccacgcccggcu

SEQ ID NO: 2901105 - RNA, 18 nt, Human
ccacagccgcagccuccc

SEQ ID NO: 2901106 - RNA, 15 nt, Human
ccacagccgcagccu

SEQ ID NO: 2901107 - RNA, 12 nt, Human
ccacagccgcag

SEQ ID NO: 2901108 - RNA, 23 nt, Human
ccacagacaauacguuugauaau

SEQ ID NO: 2901109 - RNA, 11 nt, Human
ccacagacaca

SEQ ID NO: 2901110 - RNA, 12 nt, Human
ccacagacacac

SEQ ID NO: 2901111 - RNA, 22 nt, Human
ccacagagaaaguacuucucca

SEQ ID NO: 2901112 - RNA, 21 nt, Human
ccacagacacacacacgcacg

SEQ ID NO: 2901113 - RNA, 13 nt, Human
ccacagacacaca

SEQ ID NO: 2901114 - RNA, 14 nt, Human
ccacagacacacac

SEQ ID NO: 2901115 - RNA, 15 nt, Human
ccacagacacacaca

SEQ ID NO: 2901116 - RNA, 20 nt, Human
ccacagacacacacacgcac

SEQ ID NO: 2901117 - RNA, 14 nt, Human
ccacagagcgggga

SEQ ID NO: 2901118 - RNA, 21 nt, Human
ccacagagagggagagcagag

SEQ ID NO: 2901119 - RNA, 16 nt, Human
ccacagacugguuuug

SEQ ID NO: 2901120 - RNA, 16 nt, Human
ccacagaguaagacau

SEQ ID NO: 2901121 - RNA, 17 nt, Human
ccacagaguaagacauu

SEQ ID NO: 2901122 - RNA, 18 nt, Human
ccacagaguaagacauug

SEQ ID NO: 2901123 - RNA, 16 nt, Human
ccacagaguguagcca

SEQ ID NO: 2901124 - RNA, 22 nt, Human
ccacagaguguagccagguccc

SEQ ID NO: 2901125 - RNA, 23 nt, Human
ccacagaguguagccaggucccc

SEQ ID NO: 2901126 - RNA, 18 nt, Human
ccaccaucaugucuggcu

SEQ ID NO: 2901127 - RNA, 19 nt, Human
ccaccaucaugucuggcua

SEQ ID NO: 2901128 - RNA, 13 nt, Human
ccaccgcugcucc

SEQ ID NO: 2901129 - RNA, 19 nt, Human
ccaccgcugcuccacgcgc

SEQ ID NO: 2901130 - RNA, 19 nt, Human
ccaccgggcugggagcucu

SEQ ID NO: 2901131 - RNA, 16 nt, Human
ccaccuuggcugcagg

SEQ ID NO: 2901132 - RNA, 15 nt, Human
ccaccuuggcugcag

SEQ ID NO: 2901133 - RNA, 14 nt, Human
ccaccuuggcugca

SEQ ID NO: 2901134 - RNA, 12 nt, Human
ccaccuuggcug

SEQ ID NO: 2901135 - RNA, 21 nt, Human
ccaccuagacuguaaaccucu

SEQ ID NO: 2901136 - RNA, 19 nt, Human
ccaccuagaacacuaacuc

SEQ ID NO: 2901137 - RNA, 19 nt, Human
ccaccuuggcugcagggag

SEQ ID NO: 2901138 - RNA, 18 nt, Human
ccaccuuggcugcaggga

SEQ ID NO: 2901139 - RNA, 16 nt, Human
ccacgauuuucuccag

SEQ ID NO: 2901140 - RNA, 17 nt, Human
ccacgauuuucuccagc

SEQ ID NO: 2901141 - RNA, 19 nt, Human
ccacgauuuucuccagcuc

SEQ ID NO: 2901142 - RNA, 20 nt, Human
ccacgauuuucuccagcuca

SEQ ID NO: 2901143 - RNA, 21 nt, Human
ccacgauuuucuccagcucag

SEQ ID NO: 2901144 - RNA, 22 nt, Human
ccacgauuuucuccagcucaga

SEQ ID NO: 2901145 - RNA, 16 nt, Human
ccacgagggucaggac

SEQ ID NO: 2901146 - RNA, 15 nt, Human
ccacgauccugccac

SEQ ID NO: 2901147 - RNA, 16 nt, Human
ccacgauccugccacc

SEQ ID NO: 2901148 - RNA, 19 nt, Human
ccacgauccugccacccug

SEQ ID NO: 2901149 - RNA, 23 nt, Human
ccacgauccugccacccuguagc

SEQ ID NO: 2901150 - RNA, 20 nt, Human
ccacgcccuccccuccccug

SEQ ID NO: 2901151 - RNA, 18 nt, Human
ccacgcuggaccuugaac

SEQ ID NO: 2901152 - RNA, 14 nt, Human
ccacgcuagggcgg

SEQ ID NO: 2901153 - RNA, 22 nt, Human
ccacgcuagggcggggcacaga

SEQ ID NO: 2901154 - RNA, 21 nt, Human
ccacgcccuccccuccccugc

SEQ ID NO: 2901155 - RNA, 22 nt, Human
ccacgcccuccccuccccugcu

SEQ ID NO: 2901156 - RNA, 17 nt, Human
ccacgccuguaauccca

SEQ ID NO: 2901157 - RNA, 18 nt, Human
ccacgcgggggccuugag

SEQ ID NO: 2901158 - RNA, 17 nt, Human
cauuuggaauacuuuuu

SEQ ID NO: 2901159 - RNA, 17 nt, Human
cauuuggaauuuuugcu

SEQ ID NO: 2901160 - RNA, 23 nt, Human
cauuuggaauuuuugcuugacuu

SEQ ID NO: 2901161 - RNA, 21 nt, Human
cauuuggagacacaacuauuu

SEQ ID NO: 2901162 - RNA, 15 nt, Human
cauuuggaauacuuu

SEQ ID NO: 2901163 - RNA, 22 nt, Human
cauuuggaggaaaaaaagcaug

SEQ ID NO: 2901164 - RNA, 18 nt, Human
cauuuguauuuuguguga

SEQ ID NO: 2901165 - RNA, 17 nt, Human
cauuugucacacacuuu

SEQ ID NO: 2901166 - RNA, 16 nt, Human
cauuugucucuacuuu

SEQ ID NO: 2901167 - RNA, 18 nt, Human
cauuugucucuacuuuuc

SEQ ID NO: 2901168 - RNA, 14 nt, Human
cauuugugaaauga

SEQ ID NO: 2901169 - RNA, 15 nt, Human
cauuuauucugcuca

SEQ ID NO: 2901170 - RNA, 14 nt, Human
cauuuauucugcuc

SEQ ID NO: 2901171 - RNA, 23 nt, Human
cauuuaugauuuaauaaaauaau

SEQ ID NO: 2901172 - RNA, 14 nt, Human
cauuuaugcacauu

SEQ ID NO: 2901173 - RNA, 17 nt, Human
cauuuaugauuuaauaa

SEQ ID NO: 2901174 - RNA, 18 nt, Human
cauuuaugauuuaauaaa

SEQ ID NO: 2901175 - RNA, 20 nt, Human
cauuuaugauuuaauaaaau

SEQ ID NO: 2901176 - RNA, 21 nt, Human
cauuuaugauuuaauaaaaua

SEQ ID NO: 2901177 - RNA, 16 nt, Human
cauuuaugauuuaaua

SEQ ID NO: 2901178 - RNA, 13 nt, Human
cauuuauauguac

SEQ ID NO: 2901179 - RNA, 14 nt, Human
cauuucaugcucug

SEQ ID NO: 2901180 - RNA, 22 nt, Human
cauuucaugcucugcaaaagga

SEQ ID NO: 2901181 - RNA, 15 nt, Human
cauuucauguauagu

SEQ ID NO: 2901182 - RNA, 16 nt, Human
cauuucauguauaguu

SEQ ID NO: 2901183 - RNA, 12 nt, Human
cauuucauucca

SEQ ID NO: 2901184 - RNA, 13 nt, Human
cauuucauuccau

SEQ ID NO: 2901185 - RNA, 15 nt, Human
cauuucauuccauug

SEQ ID NO: 2901186 - RNA, 18 nt, Human
cauuucauuccauugccu

SEQ ID NO: 2901187 - RNA, 19 nt, Human
cauuucauuccauugccua

SEQ ID NO: 2901188 - RNA, 21 nt, Human
cauuucauuccauugccuagc

SEQ ID NO: 2901189 - RNA, 16 nt, Human
cauuucaggagcagcc

SEQ ID NO: 2901190 - RNA, 22 nt, Human
cauuucaggagcagccucagaa

SEQ ID NO: 2901191 - RNA, 15 nt, Human
cauuucauaaacuaa

SEQ ID NO: 2901192 - RNA, 19 nt, Human
cauuucauauucuuucaau

SEQ ID NO: 2901193 - RNA, 20 nt, Human
cauuucauauucuuucaauu

SEQ ID NO: 2901194 - RNA, 16 nt, Human
cauuucaucauuguuu

SEQ ID NO: 2901195 - RNA, 17 nt, Human
cauuucaucauuguuuc

SEQ ID NO: 2901196 - RNA, 18 nt, Human
cauuucaucauuguuucu

SEQ ID NO: 2901197 - RNA, 19 nt, Human
cauuucaucauuguuucug

SEQ ID NO: 2901198 - RNA, 21 nt, Human
cauuucaucauuguuucugca

SEQ ID NO: 2901199 - RNA, 15 nt, Human
cauuucaggagcagc

SEQ ID NO: 2901200 - RNA, 18 nt, Human
cauuuaugugucaguuca

SEQ ID NO: 2901201 - RNA, 21 nt, Human
cauuuaugugucaguucauuu

SEQ ID NO: 2901202 - RNA, 19 nt, Human
cauuguaaauaguauuuga

SEQ ID NO: 2901203 - RNA, 15 nt, Human
cauuguaaacaaacu

SEQ ID NO: 2901204 - RNA, 18 nt, Human
cauuguaaacaaacucuu

SEQ ID NO: 2901205 - RNA, 23 nt, Human
cauuguaaacaaacucuugaaga

SEQ ID NO: 2901206 - RNA, 16 nt, Human
cauuuauaagaagaga

SEQ ID NO: 2901207 - RNA, 15 nt, Human
cauuuauaauugcau

SEQ ID NO: 2901208 - RNA, 17 nt, Human
cauuuauaauugcaucu

SEQ ID NO: 2901209 - RNA, 12 nt, Human
cauuuauauaug

SEQ ID NO: 2901210 - RNA, 14 nt, Human
cauuuauauaugaa

SEQ ID NO: 2901211 - RNA, 15 nt, Human
cauuuauauaugaaa

SEQ ID NO: 2901212 - RNA, 16 nt, Human
cauuuauauaugaaaa

SEQ ID NO: 2901213 - RNA, 20 nt, Human
cauuuauauaugaaaacuau

SEQ ID NO: 2901214 - RNA, 13 nt, Human
cauuguaaacaaa

SEQ ID NO: 2901215 - RNA, 23 nt, Human
cauugcuuugaagcaguuguguc

SEQ ID NO: 2901216 - RNA, 15 nt, Human
cauugcuuuuauuuu

SEQ ID NO: 2901217 - RNA, 17 nt, Human
cauugcuuuuauuuuga

SEQ ID NO: 2901218 - RNA, 18 nt, Human
cauugcuuuuauuuugaa

SEQ ID NO: 2901219 - RNA, 19 nt, Human
cauugcuuuuauuuugaaa

SEQ ID NO: 2901220 - RNA, 20 nt, Human
cauugcuuuuauuuugaaaa

SEQ ID NO: 2901221 - RNA, 21 nt, Human
cauugcuuuuauuuugaaaag

SEQ ID NO: 2901222 - RNA, 16 nt, Human
cauugcuuugaagcag

SEQ ID NO: 2901223 - RNA, 18 nt, Human
cauugcuuugaagcaguu

SEQ ID NO: 2901224 - RNA, 22 nt, Human
cauugcuuugaagcaguugugu

SEQ ID NO: 2901225 - RNA, 18 nt, Human
cauugcuuucguguaaau

SEQ ID NO: 2901226 - RNA, 19 nt, Human
cauugcuuucguguaaauu

SEQ ID NO: 2901227 - RNA, 22 nt, Human
cauugcuugugccacacccucc

SEQ ID NO: 2901228 - RNA, 17 nt, Human
cauuuuuuaaggaaaca

SEQ ID NO: 2901229 - RNA, 18 nt, Human
ccaaucccagcuaccuca

SEQ ID NO: 2901230 - RNA, 20 nt, Human
ccaaggcauaucaugcuuug

SEQ ID NO: 2901231 - RNA, 20 nt, Human
ccaauccagguacgcacaga

SEQ ID NO: 2901232 - RNA, 21 nt, Human
ccaauccagguacgcacagac

SEQ ID NO: 2901233 - RNA, 22 nt, Human
ccaauccagguacgcacagaca

SEQ ID NO: 2901234 - RNA, 23 nt, Human
ccaauccagguacgcacagacag

SEQ ID NO: 2901235 - RNA, 13 nt, Human
ccaagaaagcagg

SEQ ID NO: 2901236 - RNA, 14 nt, Human
ccaagaaacgucuu

SEQ ID NO: 2901237 - RNA, 22 nt, Human
ccaagaaagaugaauacauuuu

SEQ ID NO: 2901238 - RNA, 15 nt, Human
ccaagaaagauguau

SEQ ID NO: 2901239 - RNA, 22 nt, Human
ccaagaaagauguauauaggug

SEQ ID NO: 2901240 - RNA, 20 nt, Human
ccaacggcccugcagccagc

SEQ ID NO: 2901241 - RNA, 21 nt, Human
ccaacggcccugcagccagcu

SEQ ID NO: 2901242 - RNA, 13 nt, Human
ccaacgcacagga

SEQ ID NO: 2901243 - RNA, 15 nt, Human
ccaacgcacaggaaa

SEQ ID NO: 2901244 - RNA, 22 nt, Human
ccaacgcgaaaccaauuccuca

SEQ ID NO: 2901245 - RNA, 18 nt, Human
ccaaggaugccccguccc

SEQ ID NO: 2901246 - RNA, 19 nt, Human
ccaagcuggucccacucag

SEQ ID NO: 2901247 - RNA, 12 nt, Human
ccaagcuggucc

SEQ ID NO: 2901248 - RNA, 15 nt, Human
ccaaauaacuucagu

SEQ ID NO: 2901249 - RNA, 16 nt, Human
ccaaauaacuucaguc

SEQ ID NO: 2901250 - RNA, 18 nt, Human
ccaaauaacuucaguccu

SEQ ID NO: 2901251 - RNA, 13 nt, Human
ccaaauaauaaag

SEQ ID NO: 2901252 - RNA, 23 nt, Human
ccaaaguucuaauaauuucuaau

SEQ ID NO: 2901253 - RNA, 12 nt, Human
ccaaaguucuaa

SEQ ID NO: 2901254 - RNA, 14 nt, Human
ccaaaguucuaaua

SEQ ID NO: 2901255 - RNA, 19 nt, Human
ccaaaguucuaauaauuuc

SEQ ID NO: 2901256 - RNA, 20 nt, Human
ccaaaguucuaauaauuucu

SEQ ID NO: 2901257 - RNA, 11 nt, Human
ccaaaguucua

SEQ ID NO: 2901258 - RNA, 18 nt, Human
ccaaauauagcguuccca

SEQ ID NO: 2901259 - RNA, 12 nt, Human
ccaaaugcagcu

SEQ ID NO: 2901260 - RNA, 18 nt, Human
ccaaaugcagcuuuaaaa

SEQ ID NO: 2901261 - RNA, 15 nt, Human
ccaaaugcagcuuua

SEQ ID NO: 2901262 - RNA, 13 nt, Human
ccaaaugcagcuu

SEQ ID NO: 2901263 - RNA, 13 nt, Human
auuuaauaacauu

SEQ ID NO: 2901264 - RNA, 12 nt, Human
auuuaauaacau

SEQ ID NO: 2901265 - RNA, 14 nt, Human
auuuaauaacauua

SEQ ID NO: 2901266 - RNA, 16 nt, Human
auuuaauaacaauugu

SEQ ID NO: 2901267 - RNA, 11 nt, Human
auuuaauaaag

SEQ ID NO: 2901268 - RNA, 15 nt, Human
auuuaauaacauuac

SEQ ID NO: 2901269 - RNA, 17 nt, Human
auuuaauaacauuaccu

SEQ ID NO: 2901270 - RNA, 18 nt, Human
auuuaauaacauuaccuu

SEQ ID NO: 2901271 - RNA, 19 nt, Human
auuuaauaacauuaccuua

SEQ ID NO: 2901272 - RNA, 23 nt, Human
auuuauaacucaucauaaaauaa

SEQ ID NO: 2901273 - RNA, 22 nt, Human
auuuauaacucaucauaaaaua

SEQ ID NO: 2901274 - RNA, 19 nt, Human
auuuauauauuuauaacuc

SEQ ID NO: 2901275 - RNA, 16 nt, Human
auuuauaagguuuuaa

SEQ ID NO: 2901276 - RNA, 21 nt, Human
auuuauaacucaucauaaaau

SEQ ID NO: 2901277 - RNA, 20 nt, Human
auuuauaacucaucauaaaa

SEQ ID NO: 2901278 - RNA, 19 nt, Human
auuuauaacucaucauaaa

SEQ ID NO: 2901279 - RNA, 18 nt, Human
auuuauaacucaucauaa

SEQ ID NO: 2901280 - RNA, 17 nt, Human
auuuauaacucaucaua

SEQ ID NO: 2901281 - RNA, 16 nt, Human
auuuauaacucaucau

SEQ ID NO: 2901282 - RNA, 15 nt, Human
auuuauaacucauca

SEQ ID NO: 2901283 - RNA, 14 nt, Human
auuuauaacucauc

SEQ ID NO: 2901284 - RNA, 23 nt, Human
auuuaauaacauuaccuuacugu

SEQ ID NO: 2901285 - RNA, 16 nt, Human
auuuaucugugcaaau

SEQ ID NO: 2901286 - RNA, 16 nt, Human
auuuaucucuauuuaa

SEQ ID NO: 2901287 - RNA, 19 nt, Human
auuuaucucuauuuaauau

SEQ ID NO: 2901288 - RNA, 22 nt, Human
auuuaucucuauuuaauauuua

SEQ ID NO: 2901289 - RNA, 22 nt, Human
auuuaucuuuacuuuuaaacag

SEQ ID NO: 2901290 - RNA, 16 nt, Human
auuuaucuuucaaaga

SEQ ID NO: 2901291 - RNA, 20 nt, Human
auuuaugaguaacuauuauu

SEQ ID NO: 2901292 - RNA, 13 nt, Human
auuuaugaaguuu

SEQ ID NO: 2901293 - RNA, 22 nt, Human
auuuaugaaguuuaaaacagua

SEQ ID NO: 2901294 - RNA, 17 nt, Human
auuuauauguacuguuu

SEQ ID NO: 2901295 - RNA, 16 nt, Human
auuuauauguacuguu

SEQ ID NO: 2901296 - RNA, 15 nt, Human
auuuauauguacugu

SEQ ID NO: 2901297 - RNA, 13 nt, Human
auuuauauguacu

SEQ ID NO: 2901298 - RNA, 19 nt, Human
auuuauauggggaauauau

SEQ ID NO: 2901299 - RNA, 11 nt, Human
auuuauaugaa

SEQ ID NO: 2901300 - RNA, 20 nt, Human
auuuauauauuuauaacuca

SEQ ID NO: 2901301 - RNA, 20 nt, Human
auuuauauggggaauauauu

SEQ ID NO: 2901302 - RNA, 15 nt, Human
auuuauauguacaug

SEQ ID NO: 2901303 - RNA, 17 nt, Human
auuuauauguacaugag

SEQ ID NO: 2901304 - RNA, 16 nt, Human
auuuauauguacauga

SEQ ID NO: 2901305 - RNA, 16 nt, Human
auuuaugauuuaauaa

SEQ ID NO: 2901306 - RNA, 17 nt, Human
auuuaugauuuaauaaa

SEQ ID NO: 2901307 - RNA, 19 nt, Human
auuuaugauuuaauaaaau

SEQ ID NO: 2901308 - RNA, 13 nt, Human
auuuaugcacauu

SEQ ID NO: 2901309 - RNA, 17 nt, Human
auuuaugcacauucacg

SEQ ID NO: 2901310 - RNA, 19 nt, Human
auuuaugcacuuauaaggu

SEQ ID NO: 2901311 - RNA, 19 nt, Human
auuuaugaguuuuugauag

SEQ ID NO: 2901312 - RNA, 13 nt, Human
auuuaugauuuaa

SEQ ID NO: 2901313 - RNA, 15 nt, Human
auuuaugauuuaaua

SEQ ID NO: 2901314 - RNA, 18 nt, Human
auuuaugaguuuuugaua

SEQ ID NO: 2901315 - RNA, 15 nt, Human
auuuaugaguuuuug

SEQ ID NO: 2901316 - RNA, 12 nt, Human
auuucacuugau

SEQ ID NO: 2901317 - RNA, 19 nt, Human
auuucacuugaugauacaa

SEQ ID NO: 2901318 - RNA, 21 nt, Human
auuuaugccuugaugauuuaa

SEQ ID NO: 2901319 - RNA, 22 nt, Human
auuuaugccuugaugauuuaau

SEQ ID NO: 2901320 - RNA, 19 nt, Human
auuuaugcauggaaaccug

SEQ ID NO: 2901321 - RNA, 16 nt, Human
auuucauaugcuguau

SEQ ID NO: 2901322 - RNA, 15 nt, Human
auuucauauucuuuc

SEQ ID NO: 2901323 - RNA, 18 nt, Human
auuucauauucuuucaau

SEQ ID NO: 2901324 - RNA, 14 nt, Human
auuucauaucuaca

SEQ ID NO: 2901325 - RNA, 18 nt, Human
auuucauaucuacagaua

SEQ ID NO: 2901326 - RNA, 20 nt, Human
auuucauaucuacagauaga

SEQ ID NO: 2901327 - RNA, 22 nt, Human
auuucauaucuacagauagaga

SEQ ID NO: 2901328 - RNA, 22 nt, Human
auuucaguuccgucagaaagug

SEQ ID NO: 2901329 - RNA, 21 nt, Human
auuucauaccucagaauguaa

SEQ ID NO: 2901330 - RNA, 20 nt, Human
auuucaguguaguuaauuua

SEQ ID NO: 2901331 - RNA, 21 nt, Human
auuucaguguaguuaauuuau

SEQ ID NO: 2901332 - RNA, 10 nt, Human
auuucaguuu

SEQ ID NO: 2901333 - RNA, 19 nt, Human
auuucuaucuuguuccaag

SEQ ID NO: 2901334 - RNA, 23 nt, Human
auuucuauucaagguggccaaau

SEQ ID NO: 2901335 - RNA, 16 nt, Human
auuucugggucuuuug

SEQ ID NO: 2901336 - RNA, 18 nt, Human
auuucugggucuuuugcu

SEQ ID NO: 2901337 - RNA, 20 nt, Human
auuucugggucuuuugcuac

SEQ ID NO: 2901338 - RNA, 16 nt, Human
auuucugguucugaug

SEQ ID NO: 2901339 - RNA, 17 nt, Human
auuucugguucugaugc

SEQ ID NO: 2901340 - RNA, 16 nt, Human
auuucugcuuucuuug

SEQ ID NO: 2901341 - RNA, 17 nt, Human
auuucugcuuucuuuga

SEQ ID NO: 2901342 - RNA, 16 nt, Human
auuucuguaaauacca

SEQ ID NO: 2901343 - RNA, 17 nt, Human
auuucuguaaauaccau

SEQ ID NO: 2901344 - RNA, 23 nt, Human
auuucuguaaauaccauugacac

SEQ ID NO: 2901345 - RNA, 13 nt, Human
auuucugucagaa

SEQ ID NO: 2901346 - RNA, 15 nt, Human
auuucugucagaaug

SEQ ID NO: 2901347 - RNA, 21 nt, Human
auuucugucauucaaaugggu

SEQ ID NO: 2901348 - RNA, 13 nt, Human
auuucugcauaug

SEQ ID NO: 2901349 - RNA, 23 nt, Human
auuucugcauauguugaauacuu

SEQ ID NO: 2901350 - RNA, 22 nt, Human
auuucugcauauguugaauacu

SEQ ID NO: 2901351 - RNA, 18 nt, Human
auuucugcauauguugaa

SEQ ID NO: 2901352 - RNA, 22 nt, Human
auuguuguuugccauacuuugu

SEQ ID NO: 2901353 - RNA, 12 nt, Human
auuguaauuuug

SEQ ID NO: 2901354 - RNA, 17 nt, Human
auuguuguuuuuuuaau

SEQ ID NO: 2901355 - RNA, 14 nt, Human
auuguguugugaau

SEQ ID NO: 2901356 - RNA, 14 nt, Human
auuguguuccuuuu

SEQ ID NO: 2901357 - RNA, 13 nt, Human
auuguguugacau

SEQ ID NO: 2901358 - RNA, 17 nt, Human
auuguguugacauuaag

SEQ ID NO: 2901359 - RNA, 20 nt, Human
auuguguugacauuaagaau

SEQ ID NO: 2901360 - RNA, 17 nt, Human
auuguguugugaauguu

SEQ ID NO: 2901361 - RNA, 17 nt, Human
auuguguuauuuuacua

SEQ ID NO: 2901362 - RNA, 15 nt, Human
auuguuaaaauaacu

SEQ ID NO: 2901363 - RNA, 13 nt, Human
auuguuaaaauaa

SEQ ID NO: 2901364 - RNA, 13 nt, Human
auuguguuugugu

SEQ ID NO: 2901365 - RNA, 12 nt, Human
auuguuguuucu

SEQ ID NO: 2901366 - RNA, 14 nt, Human
auuguuguuucuuu

SEQ ID NO: 2901367 - RNA, 16 nt, Human
auuguuguuucuuucu

SEQ ID NO: 2901368 - RNA, 19 nt, Human
auuguuguuucuuucuagu

SEQ ID NO: 2901369 - RNA, 20 nt, Human
auuguuguuucuuucuagug

SEQ ID NO: 2901370 - RNA, 19 nt, Human
auuguuguuugccauacuu

SEQ ID NO: 2901371 - RNA, 17 nt, Human
auuguuaaucucuguua

SEQ ID NO: 2901372 - RNA, 18 nt, Human
auuguuaaucucuguuau

SEQ ID NO: 2901373 - RNA, 17 nt, Human
auuguuaacucuugucu

SEQ ID NO: 2901374 - RNA, 17 nt, Human
auuguuacacauuaagu

SEQ ID NO: 2901375 - RNA, 14 nt, Human
auuguuaauuucag

SEQ ID NO: 2901376 - RNA, 15 nt, Human
auuguuaauuucagu

SEQ ID NO: 2901377 - RNA, 16 nt, Human
auuguuaauuucaguc

SEQ ID NO: 2901378 - RNA, 18 nt, Human
auuguuaauuucaguccu

SEQ ID NO: 2901379 - RNA, 20 nt, Human
auugcuguuaugucuguuua

SEQ ID NO: 2901380 - RNA, 23 nt, Human
auugcuguuaugucuguuuaaga

SEQ ID NO: 2901381 - RNA, 15 nt, Human
auugcuguugaaagc

SEQ ID NO: 2901382 - RNA, 17 nt, Human
auugcuguugaaagcaa

SEQ ID NO: 2901383 - RNA, 18 nt, Human
auugcuguugaaagcaaa

SEQ ID NO: 2901384 - RNA, 19 nt, Human
auugcuguugaaagcaaaa

SEQ ID NO: 2901385 - RNA, 21 nt, Human
auugcuguugaaagcaaaaau

SEQ ID NO: 2901386 - RNA, 22 nt, Human
auugcuguugaaagcaaaaaug

SEQ ID NO: 2901387 - RNA, 23 nt, Human
auugcuguugaaagcaaaaaugc

SEQ ID NO: 2901388 - RNA, 12 nt, Human
auugcuguugcu

SEQ ID NO: 2901389 - RNA, 15 nt, Human
auugcuguugcuuga

SEQ ID NO: 2901390 - RNA, 17 nt, Human
auugcuguugcuugaau

SEQ ID NO: 2901391 - RNA, 18 nt, Human
auugcugugcuuuaugga

SEQ ID NO: 2901392 - RNA, 22 nt, Human
auugcuguccuugaaugccaua

SEQ ID NO: 2901393 - RNA, 15 nt, Human
auugcugucugcagc

SEQ ID NO: 2901394 - RNA, 17 nt, Human
auugcugucugcagccu

SEQ ID NO: 2901395 - RNA, 17 nt, Human
auugcuuaaaauagcaa

SEQ ID NO: 2901396 - RNA, 16 nt, Human
auugcuuaaaauagca

SEQ ID NO: 2901397 - RNA, 13 nt, Human
auugcuuaguaaa

SEQ ID NO: 2901398 - RNA, 15 nt, Human
auugcuuaguaaaau

SEQ ID NO: 2901399 - RNA, 16 nt, Human
auugcuuaguaaaauu

SEQ ID NO: 2901400 - RNA, 22 nt, Human
auugcuuaguaaaauuuauuuc

SEQ ID NO: 2901401 - RNA, 23 nt, Human
auugcuuaguaaaauuuauuuca

SEQ ID NO: 2901402 - RNA, 18 nt, Human
auugcuuucguguaaauu

SEQ ID NO: 2901403 - RNA, 21 nt, Human
auugcuuugaagcaguugugu

SEQ ID NO: 2901404 - RNA, 16 nt, Human
auugcuuugaaaaagu

SEQ ID NO: 2901405 - RNA, 17 nt, Human
auugcuuugaaaaaguu

SEQ ID NO: 2901406 - RNA, 23 nt, Human
auugcuuugaagcaguuguguca

SEQ ID NO: 2901407 - RNA, 15 nt, Human
auuguaaauuuuaga

SEQ ID NO: 2901408 - RNA, 19 nt, Human
auuaguacugcucuuguuu

SEQ ID NO: 2901409 - RNA, 16 nt, Human
auuaguaaaugcuuau

SEQ ID NO: 2901410 - RNA, 13 nt, Human
auuaguaaauguc

SEQ ID NO: 2901411 - RNA, 14 nt, Human
auuaguaaaugucu

SEQ ID NO: 2901412 - RNA, 15 nt, Human
auuaguaaaugucuu

SEQ ID NO: 2901413 - RNA, 16 nt, Human
auuaguaaaugucuuu

SEQ ID NO: 2901414 - RNA, 17 nt, Human
auuaguaaaugucuuug

SEQ ID NO: 2901415 - RNA, 20 nt, Human
auuaguaaaugucuuuguaa

SEQ ID NO: 2901416 - RNA, 21 nt, Human
auuaguaaaugucuuuguaag

SEQ ID NO: 2901417 - RNA, 23 nt, Human
auuaguaaaugucuuuguaaguc

SEQ ID NO: 2901418 - RNA, 23 nt, Human
auuaguaacauaauaaauuaaaa

SEQ ID NO: 2901419 - RNA, 20 nt, Human
auuaggcaaggcuaugugau

SEQ ID NO: 2901420 - RNA, 14 nt, Human
auuaggauuuugau

SEQ ID NO: 2901421 - RNA, 21 nt, Human
auuaggcaaggcuaugugauu

SEQ ID NO: 2901422 - RNA, 17 nt, Human
auuaggaggcucaacaa

SEQ ID NO: 2901423 - RNA, 21 nt, Human
auuaggaggcucaacaauaaa

SEQ ID NO: 2901424 - RNA, 22 nt, Human
auuaggaggcucaacaauaaaa

SEQ ID NO: 2901425 - RNA, 14 nt, Human
auuaggauuucaug

SEQ ID NO: 2901426 - RNA, 16 nt, Human
auuaggauuucaugau

SEQ ID NO: 2901427 - RNA, 14 nt, Human
auuaaaugucuuau

SEQ ID NO: 2901428 - RNA, 11 nt, Human
auuaaauguuu

SEQ ID NO: 2901429 - RNA, 13 nt, Human
auuaaauguuuga

SEQ ID NO: 2901430 - RNA, 13 nt, Human
auuaaauuaagac

SEQ ID NO: 2901431 - RNA, 22 nt, Human
auucaacacucccuucccauga

SEQ ID NO: 2901432 - RNA, 17 nt, Human
auucaaccauggacuuu

SEQ ID NO: 2901433 - RNA, 14 nt, Human
auucaaccauggac

SEQ ID NO: 2901434 - RNA, 22 nt, Human
auuauguaaaauguuuuagcaa

SEQ ID NO: 2901435 - RNA, 23 nt, Human
auuauggguuaggcauuaauguu

SEQ ID NO: 2901436 - RNA, 18 nt, Human
auuaugcggaaagguauu

SEQ ID NO: 2901437 - RNA, 20 nt, Human
auuaugcggaaagguauuug

SEQ ID NO: 2901438 - RNA, 18 nt, Human
auucaaccauggacuuua

SEQ ID NO: 2901439 - RNA, 13 nt, Human
auucaauauugac

SEQ ID NO: 2901440 - RNA, 15 nt, Human
auucaauauugacau

SEQ ID NO: 2901441 - RNA, 16 nt, Human
auucaauauugacauu

SEQ ID NO: 2901442 - RNA, 17 nt, Human
auucaauauugacauuu

SEQ ID NO: 2901443 - RNA, 19 nt, Human
auucaauauugacauuugu

SEQ ID NO: 2901444 - RNA, 20 nt, Human
auucaauauugacauuugua

SEQ ID NO: 2901445 - RNA, 21 nt, Human
auucaauauugacauuuguag

SEQ ID NO: 2901446 - RNA, 15 nt, Human
auucaauacaaacaa

SEQ ID NO: 2901447 - RNA, 21 nt, Human
auucaauacaaacaaucucuu

SEQ ID NO: 2901448 - RNA, 22 nt, Human
auucaauacaaacaaucucuua

SEQ ID NO: 2901449 - RNA, 14 nt, Human
auuccuucuuugau

SEQ ID NO: 2901450 - RNA, 15 nt, Human
auuccuucuuugaua

SEQ ID NO: 2901451 - RNA, 16 nt, Human
auuccuucuuugauaa

SEQ ID NO: 2901452 - RNA, 17 nt, Human
auuccuucuuugauaau

SEQ ID NO: 2901453 - RNA, 20 nt, Human
auuccuucuuugauaauguu

SEQ ID NO: 2901454 - RNA, 21 nt, Human
auuccuucuuugauaauguua

SEQ ID NO: 2901455 - RNA, 11 nt, Human
auuccuucucu

SEQ ID NO: 2901456 - RNA, 14 nt, Human
auuccuucucugaa

SEQ ID NO: 2901457 - RNA, 15 nt, Human
auuccuucucugaac

SEQ ID NO: 2901458 - RNA, 16 nt, Human
auuccuucucugaaca

SEQ ID NO: 2901459 - RNA, 22 nt, Human
auuccuucucugaacacaggca

SEQ ID NO: 2901460 - RNA, 14 nt, Human
auuccuucuggccu

SEQ ID NO: 2901461 - RNA, 16 nt, Human
auuccuucuggccuuu

SEQ ID NO: 2901462 - RNA, 22 nt, Human
auuccuucuggccuuuccucuc

SEQ ID NO: 2901463 - RNA, 13 nt, Human
auuccuguauguu

SEQ ID NO: 2901464 - RNA, 16 nt, Human
auuccuguauguuguc

SEQ ID NO: 2901465 - RNA, 17 nt, Human
auuccuguauguugucc

SEQ ID NO: 2901466 - RNA, 18 nt, Human
auuccuguauguugucca

SEQ ID NO: 2901467 - RNA, 10 nt, Human
auuccugggc

SEQ ID NO: 2901468 - RNA, 19 nt, Human
auuccucauccucagaugc

SEQ ID NO: 2901469 - RNA, 21 nt, Human
auuccucauccucagaugcuc

SEQ ID NO: 2901470 - RNA, 17 nt, Human
auuccucaacguauugu

SEQ ID NO: 2901471 - RNA, 18 nt, Human
auuccugcauuugugaaa

SEQ ID NO: 2901472 - RNA, 15 nt, Human
auuccugcauuugug

SEQ ID NO: 2901473 - RNA, 22 nt, Human
auucuucuguacgucugacagg

SEQ ID NO: 2901474 - RNA, 20 nt, Human
auucuucugcuucagccucc

SEQ ID NO: 2901475 - RNA, 19 nt, Human
auucuucugcuucagccuc

SEQ ID NO: 2901476 - RNA, 17 nt, Human
auucucugugucuaaga

SEQ ID NO: 2901477 - RNA, 18 nt, Human
auucucugugucuaagau

SEQ ID NO: 2901478 - RNA, 20 nt, Human
auucucugugucuaagauuc

SEQ ID NO: 2901479 - RNA, 22 nt, Human
auuccuuccacuaacucauagu

SEQ ID NO: 2901480 - RNA, 18 nt, Human
auucuccuuguuguuggu

SEQ ID NO: 2901481 - RNA, 16 nt, Human
auucuccuuuuaugug

SEQ ID NO: 2901482 - RNA, 17 nt, Human
auucuccuuuuaugugu

SEQ ID NO: 2901483 - RNA, 18 nt, Human
auucuccuuuuaugugua

SEQ ID NO: 2901484 - RNA, 19 nt, Human
auucuccuuuuauguguag

SEQ ID NO: 2901485 - RNA, 19 nt, Human
auucucgugagucauuuaa

SEQ ID NO: 2901486 - RNA, 17 nt, Human
auucucuaauaagaaaa

SEQ ID NO: 2901487 - RNA, 17 nt, Human
auucucuggcuguaagg

SEQ ID NO: 2901488 - RNA, 19 nt, Human
auucucuggcuguaaggcu

SEQ ID NO: 2901489 - RNA, 20 nt, Human
auucucuggcuguaaggcuc

SEQ ID NO: 2901490 - RNA, 21 nt, Human
auucucuggcuguaaggcucu

SEQ ID NO: 2901491 - RNA, 22 nt, Human
auucucuggcuguaaggcucua

SEQ ID NO: 2901492 - RNA, 12 nt, Human
auuccuuucccu

SEQ ID NO: 2901493 - RNA, 13 nt, Human
auuccuuucccuu

SEQ ID NO: 2901494 - RNA, 14 nt, Human
auuccuuucccuuc

SEQ ID NO: 2901495 - RNA, 15 nt, Human
auuccuuucccuucc

SEQ ID NO: 2901496 - RNA, 16 nt, Human
auuccuuucccuuccu

SEQ ID NO: 2901497 - RNA, 17 nt, Human
auuccuuucccuuccuc

SEQ ID NO: 2901498 - RNA, 12 nt, Human
auuccuugugaa

SEQ ID NO: 2901499 - RNA, 22 nt, Human
auuccuucuuugauaauguuaa

SEQ ID NO: 2901500 - RNA, 23 nt, Human
auuccuucuuugauaauguuaaa

SEQ ID NO: 2901501 - RNA, 18 nt, Human
auuccuucuuuuuaaaau

SEQ ID NO: 2901502 - RNA, 19 nt, Human
auuccuugaucauuuuggg

SEQ ID NO: 2901503 - RNA, 20 nt, Human
auuccuugaucauuuuggga

SEQ ID NO: 2901504 - RNA, 21 nt, Human
auucucugugucuaagauucu

SEQ ID NO: 2901505 - RNA, 21 nt, Human
caaaucuggcuccuuuacaaa

SEQ ID NO: 2901506 - RNA, 22 nt, Human
caaagucaugcaaaggcuggga

SEQ ID NO: 2901507 - RNA, 17 nt, Human
caaaguccuuuuuuucc

SEQ ID NO: 2901508 - RNA, 14 nt, Human
caaaguccuuuuuu

SEQ ID NO: 2901509 - RNA, 23 nt, Human
caaaguccuuuuuuuccaucuuu

SEQ ID NO: 2901510 - RNA, 19 nt, Human
caaaguccuuuuuuuccau

SEQ ID NO: 2901511 - RNA, 22 nt, Human
caaaugaccagcagauucaaau

SEQ ID NO: 2901512 - RNA, 10 nt, Human
caaaugaauu

SEQ ID NO: 2901513 - RNA, 10 nt, Human
caaaugacau

SEQ ID NO: 2901514 - RNA, 14 nt, Human
caaaugacaugcac

SEQ ID NO: 2901515 - RNA, 15 nt, Human
caaaugacaugcacu

SEQ ID NO: 2901516 - RNA, 16 nt, Human
caaaugacaugcacug

SEQ ID NO: 2901517 - RNA, 17 nt, Human
caaaugacaugcacuga

SEQ ID NO: 2901518 - RNA, 18 nt, Human
caaaugacaugcacugac

SEQ ID NO: 2901519 - RNA, 19 nt, Human
caaaugacaugcacugacc

SEQ ID NO: 2901520 - RNA, 20 nt, Human
caaaugacaugcacugaccc

SEQ ID NO: 2901521 - RNA, 21 nt, Human
caaaugacaugcacugacccu

SEQ ID NO: 2901522 - RNA, 13 nt, Human
caaaucuugaaau

SEQ ID NO: 2901523 - RNA, 19 nt, Human
caaaucuugaaauuaagaa

SEQ ID NO: 2901524 - RNA, 21 nt, Human
caaaucuuggcaauauuccuu

SEQ ID NO: 2901525 - RNA, 22 nt, Human
caaaucuuggcaauauuccuua

SEQ ID NO: 2901526 - RNA, 12 nt, Human
caaaucuugaaa

SEQ ID NO: 2901527 - RNA, 12 nt, Human
caaaucugugua

SEQ ID NO: 2901528 - RNA, 13 nt, Human
caaaucuguguau

SEQ ID NO: 2901529 - RNA, 15 nt, Human
caaaucuguguauau

SEQ ID NO: 2901530 - RNA, 16 nt, Human
caaaucuguguauauu

SEQ ID NO: 2901531 - RNA, 17 nt, Human
caaaucuguguauauua

SEQ ID NO: 2901532 - RNA, 18 nt, Human
caaaucuguguauauuau

SEQ ID NO: 2901533 - RNA, 16 nt, Human
caaaugcaugaacaag

SEQ ID NO: 2901534 - RNA, 17 nt, Human
caaaugcaugaacaagu

SEQ ID NO: 2901535 - RNA, 19 nt, Human
caaaugcccaagggaaaga

SEQ ID NO: 2901536 - RNA, 17 nt, Human
caaaugccuuaaaaugg

SEQ ID NO: 2901537 - RNA, 18 nt, Human
caaaugccuuaaaaugga

SEQ ID NO: 2901538 - RNA, 19 nt, Human
caaaugccuuaaaauggaa

SEQ ID NO: 2901539 - RNA, 18 nt, Human
caaaugcccaagggaaag

SEQ ID NO: 2901540 - RNA, 22 nt, Human
caaaugcucucucaaauuguca

SEQ ID NO: 2901541 - RNA, 13 nt, Human
caaaugcuauuaa

SEQ ID NO: 2901542 - RNA, 17 nt, Human
caaaugcuauuaaagug

SEQ ID NO: 2901543 - RNA, 13 nt, Human
caacaacauccau

SEQ ID NO: 2901544 - RNA, 14 nt, Human
caacaacauccaug

SEQ ID NO: 2901545 - RNA, 13 nt, Human
caacaaagaaaua

SEQ ID NO: 2901546 - RNA, 14 nt, Human
caacaaagaaauau

SEQ ID NO: 2901547 - RNA, 17 nt, Human
caacaaagcacaguguu

SEQ ID NO: 2901548 - RNA, 12 nt, Human
caacaaaggaag

SEQ ID NO: 2901549 - RNA, 22 nt, Human
caacaaaggauuaauugcugca

SEQ ID NO: 2901550 - RNA, 23 nt, Human
caacaaaggauuaauugcugcaa

SEQ ID NO: 2901551 - RNA, 18 nt, Human
caacaaaggcaaguuaag

SEQ ID NO: 2901552 - RNA, 14 nt, Human
caaagcauggacua

SEQ ID NO: 2901553 - RNA, 13 nt, Human
caaagcauagaug

SEQ ID NO: 2901554 - RNA, 19 nt, Human
caaagcauagauguuuugg

SEQ ID NO: 2901555 - RNA, 23 nt, Human
caaaggguugggagcugaugaaa

SEQ ID NO: 2901556 - RNA, 13 nt, Human
caaaguauaacca

SEQ ID NO: 2901557 - RNA, 20 nt, Human
caaagucaugcaaaggcugg

SEQ ID NO: 2901558 - RNA, 21 nt, Human
caaagucaugcaaaggcuggg

SEQ ID NO: 2901559 - RNA, 16 nt, Human
caacacagccugggcc

SEQ ID NO: 2901560 - RNA, 15 nt, Human
caacacagccugggc

SEQ ID NO: 2901561 - RNA, 13 nt, Human
caacacagccugg

SEQ ID NO: 2901562 - RNA, 16 nt, Human
caacacaccuggugaa

SEQ ID NO: 2901563 - RNA, 14 nt, Human
caacacagaggaau

SEQ ID NO: 2901564 - RNA, 16 nt, Human
caacacagaggaauuu

SEQ ID NO: 2901565 - RNA, 22 nt, Human
caacacagccugggccccagcu

SEQ ID NO: 2901566 - RNA, 22 nt, Human
caacaacgcuugugaauguauu

SEQ ID NO: 2901567 - RNA, 16 nt, Human
caacacaauaacacua

SEQ ID NO: 2901568 - RNA, 14 nt, Human
caacacacacacuc

SEQ ID NO: 2901569 - RNA, 22 nt, Human
caacacacagauuugagcucag

SEQ ID NO: 2901570 - RNA, 21 nt, Human
caacacacagauuugagcuca

SEQ ID NO: 2901571 - RNA, 21 nt, Human
caagaauuuccuguuggauuu

SEQ ID NO: 2901572 - RNA, 12 nt, Human
caagaccagacu

SEQ ID NO: 2901573 - RNA, 22 nt, Human
caagaccagacucgccaacaug

SEQ ID NO: 2901574 - RNA, 18 nt, Human
caagaugccaucuguguc

SEQ ID NO: 2901575 - RNA, 17 nt, Human
caagaugucagacuggc

SEQ ID NO: 2901576 - RNA, 16 nt, Human
caagaugucagacugg

SEQ ID NO: 2901577 - RNA, 15 nt, Human
caagaugucagacug

SEQ ID NO: 2901578 - RNA, 22 nt, Human
caagaugcuggaugucugccaa

SEQ ID NO: 2901579 - RNA, 16 nt, Human
caagauggaaaggauu

SEQ ID NO: 2901580 - RNA, 20 nt, Human
caagaugccaucuguguccu

SEQ ID NO: 2901581 - RNA, 19 nt, Human
caacuccucgacaucacug

SEQ ID NO: 2901582 - RNA, 21 nt, Human
caacuccucgacaucacuguu

SEQ ID NO: 2901583 - RNA, 13 nt, Human
caacuccaaaacc

SEQ ID NO: 2901584 - RNA, 19 nt, Human
caacuccuagggccacuga

SEQ ID NO: 2901585 - RNA, 21 nt, Human
caagaauuggaagcugcccug

SEQ ID NO: 2901586 - RNA, 15 nt, Human
caagaaugguggcuu

SEQ ID NO: 2901587 - RNA, 20 nt, Human
caagaaugguggcuucuuuu

SEQ ID NO: 2901588 - RNA, 23 nt, Human
caagaaugacggaauaagagacc

SEQ ID NO: 2901589 - RNA, 14 nt, Human
caagaaugcauuga

SEQ ID NO: 2901590 - RNA, 15 nt, Human
caagaaugcauugau

SEQ ID NO: 2901591 - RNA, 16 nt, Human
caagaaugcauugaua

SEQ ID NO: 2901592 - RNA, 17 nt, Human
caagaaugcauugauau

SEQ ID NO: 2901593 - RNA, 22 nt, Human
caagaaugcauugauauuguga

SEQ ID NO: 2901594 - RNA, 16 nt, Human
caacuaagcagucccu

SEQ ID NO: 2901595 - RNA, 18 nt, Human
caacuaauuuuuguauuu

SEQ ID NO: 2901596 - RNA, 16 nt, Human
caacuacccaaaacaa

SEQ ID NO: 2901597 - RNA, 17 nt, Human
caacuacccaaaacaag

SEQ ID NO: 2901598 - RNA, 20 nt, Human
caacuacccaaaacaagccu

SEQ ID NO: 2901599 - RNA, 21 nt, Human
caacuacccaaaacaagccug

SEQ ID NO: 2901600 - RNA, 22 nt, Human
caacuacccaaaacaagccugg

SEQ ID NO: 2901601 - RNA, 15 nt, Human
caacuagacauuacc

SEQ ID NO: 2901602 - RNA, 20 nt, Human
caacuacuaucucagagaua

SEQ ID NO: 2901603 - RNA, 13 nt, Human
caacuacuauuca

SEQ ID NO: 2901604 - RNA, 20 nt, Human
caaccagauaacauaccuuu

SEQ ID NO: 2901605 - RNA, 18 nt, Human
caaccagacagaggguca

SEQ ID NO: 2901606 - RNA, 22 nt, Human
caaccagcaucccuugaccagg

SEQ ID NO: 2901607 - RNA, 12 nt, Human
caaccagugcca

SEQ ID NO: 2901608 - RNA, 15 nt, Human
caaccagugccaagg

SEQ ID NO: 2901609 - RNA, 16 nt, Human
caaccagugccaagga

SEQ ID NO: 2901610 - RNA, 17 nt, Human
caaccagugccaaggac

SEQ ID NO: 2901611 - RNA, 19 nt, Human
caaccagugccaaggaccu

SEQ ID NO: 2901612 - RNA, 12 nt, Human
caaccauauuua

SEQ ID NO: 2901613 - RNA, 15 nt, Human
caaccauauuuagca

SEQ ID NO: 2901614 - RNA, 13 nt, Human
caaccauggacuu

SEQ ID NO: 2901615 - RNA, 17 nt, Human
caaccccccaccugcca

SEQ ID NO: 2901616 - RNA, 16 nt, Human
caaccccccaccugcc

SEQ ID NO: 2901617 - RNA, 14 nt, Human
caaccauggacuuu

SEQ ID NO: 2901618 - RNA, 15 nt, Human
caaccauggacuuua

SEQ ID NO: 2901619 - RNA, 21 nt, Human
caacccccauucucaucugca

SEQ ID NO: 2901620 - RNA, 18 nt, Human
auuuuaggagcuaaggcu

SEQ ID NO: 2901621 - RNA, 19 nt, Human
auuuuaggagcuaaggcuc

SEQ ID NO: 2901622 - RNA, 20 nt, Human
auuuuaggagcuaaggcucu

SEQ ID NO: 2901623 - RNA, 20 nt, Human
auuuuaggcacucuuaaaug

SEQ ID NO: 2901624 - RNA, 22 nt, Human
auuuuaggcacucuuaaaugau

SEQ ID NO: 2901625 - RNA, 21 nt, Human
auuuuaggagcuaaggcucua

SEQ ID NO: 2901626 - RNA, 22 nt, Human
auuuuaggagcuaaggcucuau

SEQ ID NO: 2901627 - RNA, 15 nt, Human
auuuuaggaacuuca

SEQ ID NO: 2901628 - RNA, 17 nt, Human
auuuuaggaacuucaga

SEQ ID NO: 2901629 - RNA, 18 nt, Human
auuuuaggaacuucagag

SEQ ID NO: 2901630 - RNA, 19 nt, Human
auuuuaggaacuucagaga

SEQ ID NO: 2901631 - RNA, 13 nt, Human
auuuuaggaaagg

SEQ ID NO: 2901632 - RNA, 15 nt, Human
auuuuaggaaaggau

SEQ ID NO: 2901633 - RNA, 19 nt, Human
auuuuagcuaggauuugaa

SEQ ID NO: 2901634 - RNA, 23 nt, Human
auuuuagcucuauugauacucuu

SEQ ID NO: 2901635 - RNA, 15 nt, Human
auuuucugguucuaa

SEQ ID NO: 2901636 - RNA, 17 nt, Human
auuuucugguucuaaca

SEQ ID NO: 2901637 - RNA, 14 nt, Human
auuuucugguucua

SEQ ID NO: 2901638 - RNA, 19 nt, Human
auuuucugguucuaacauu

SEQ ID NO: 2901639 - RNA, 12 nt, Human
auuuucugucag

SEQ ID NO: 2901640 - RNA, 13 nt, Human
auuuucugucaga

SEQ ID NO: 2901641 - RNA, 14 nt, Human
auuuucugucagau

SEQ ID NO: 2901642 - RNA, 18 nt, Human
auuuucugucagaugaga

SEQ ID NO: 2901643 - RNA, 20 nt, Human
auuuucugucagaugagaac

SEQ ID NO: 2901644 - RNA, 22 nt, Human
auuuucugucagaugagaacaa

SEQ ID NO: 2901645 - RNA, 12 nt, Human
auuuugaaguuu

SEQ ID NO: 2901646 - RNA, 14 nt, Human
auuuugaaguuuac

SEQ ID NO: 2901647 - RNA, 15 nt, Human
auuuugaaguuuaca

SEQ ID NO: 2901648 - RNA, 16 nt, Human
auuuugaaguuuacau

SEQ ID NO: 2901649 - RNA, 17 nt, Human
auuuugaaguuuacauu

SEQ ID NO: 2901650 - RNA, 18 nt, Human
auuuugaaguuuacauuu

SEQ ID NO: 2901651 - RNA, 19 nt, Human
auuuugaaguuuacauuuu

SEQ ID NO: 2901652 - RNA, 15 nt, Human
auuuugaaauguggu

SEQ ID NO: 2901653 - RNA, 15 nt, Human
auuuucuuaaccagu

SEQ ID NO: 2901654 - RNA, 17 nt, Human
auuuucuuaaccaguug

SEQ ID NO: 2901655 - RNA, 20 nt, Human
auuuucuuacccaauuuccc

SEQ ID NO: 2901656 - RNA, 21 nt, Human
auuuucuuacccaauuuccca

SEQ ID NO: 2901657 - RNA, 19 nt, Human
auuuucuuauugcgcugcu

SEQ ID NO: 2901658 - RNA, 21 nt, Human
auuuucuuauugcgcugcuac

SEQ ID NO: 2901659 - RNA, 11 nt, Human
auuuugaauac

SEQ ID NO: 2901660 - RNA, 12 nt, Human
auuuugaauacc

SEQ ID NO: 2901661 - RNA, 14 nt, Human
auuuugaauaccau

SEQ ID NO: 2901662 - RNA, 15 nt, Human
auuuugaauaccauu

SEQ ID NO: 2901663 - RNA, 22 nt, Human
auuuugaauaccauuaaaacug

SEQ ID NO: 2901664 - RNA, 14 nt, Human
auuuuuagacagag

SEQ ID NO: 2901665 - RNA, 14 nt, Human
auuuuuaaucauga

SEQ ID NO: 2901666 - RNA, 17 nt, Human
auuuuuauacaaaccua

SEQ ID NO: 2901667 - RNA, 20 nt, Human
auuuuuauacaaaccuacca

SEQ ID NO: 2901668 - RNA, 22 nt, Human
auuuuuaguagagacugguuuc

SEQ ID NO: 2901669 - RNA, 21 nt, Human
auuuuuagauaguuagaaccu

SEQ ID NO: 2901670 - RNA, 21 nt, Human
auuuuuaggaaguuuucugua

SEQ ID NO: 2901671 - RNA, 22 nt, Human
auuuuuaggaaguuuucuguag

SEQ ID NO: 2901672 - RNA, 15 nt, Human
auuuuuauauuuagu

SEQ ID NO: 2901673 - RNA, 18 nt, Human
auuuuuauauuaguugcu

SEQ ID NO: 2901674 - RNA, 19 nt, Human
auuuuuauauuaguugcuu

SEQ ID NO: 2901675 - RNA, 20 nt, Human
auuuuuauauuaguugcuuu

SEQ ID NO: 2901676 - RNA, 17 nt, Human
auuuuuauauaauaucu

SEQ ID NO: 2901677 - RNA, 21 nt, Human
auuuuuauauaauaucuaaag

SEQ ID NO: 2901678 - RNA, 23 nt, Human
auuuuuauauaauaucuaaaguu

SEQ ID NO: 2901679 - RNA, 14 nt, Human
auuuuuuuguaauu

SEQ ID NO: 2901680 - RNA, 15 nt, Human
auuuuuuuguaauug

SEQ ID NO: 2901681 - RNA, 18 nt, Human
auuuuuuuguaauugcuu

SEQ ID NO: 2901682 - RNA, 16 nt, Human
auuuuuuugagacaga

SEQ ID NO: 2901683 - RNA, 22 nt, Human
auuuuuuugguaccuauuugac

SEQ ID NO: 2901684 - RNA, 16 nt, Human
caaaagcuucaaauua

SEQ ID NO: 2901685 - RNA, 17 nt, Human
caaaagcuucaaauuaa

SEQ ID NO: 2901686 - RNA, 15 nt, Human
caaaagacauguugu

SEQ ID NO: 2901687 - RNA, 16 nt, Human
caaaagacauguugua

SEQ ID NO: 2901688 - RNA, 21 nt, Human
caaaagacauguuguaaauua

SEQ ID NO: 2901689 - RNA, 12 nt, Human
caaaagagaaaa

SEQ ID NO: 2901690 - RNA, 14 nt, Human
caaaagagaaaaaa

SEQ ID NO: 2901691 - RNA, 19 nt, Human
caaaagagaaaaaaaauua

SEQ ID NO: 2901692 - RNA, 13 nt, Human
auuuuuuugucuu

SEQ ID NO: 2901693 - RNA, 13 nt, Human
caaaaggaagucu

SEQ ID NO: 2901694 - RNA, 11 nt, Human
caaaaggaaaa

SEQ ID NO: 2901695 - RNA, 12 nt, Human
caaaaggaaaaa

SEQ ID NO: 2901696 - RNA, 14 nt, Human
caaaaggaaaaagc

SEQ ID NO: 2901697 - RNA, 15 nt, Human
caaaaggaaaaagcu

SEQ ID NO: 2901698 - RNA, 16 nt, Human
caaaaggaaaaagcuc

SEQ ID NO: 2901699 - RNA, 17 nt, Human
caaaaggaaaaagcucc

SEQ ID NO: 2901700 - RNA, 22 nt, Human
caaaaggagagacucccaugaa

SEQ ID NO: 2901701 - RNA, 13 nt, Human
caaacccaugagg

SEQ ID NO: 2901702 - RNA, 18 nt, Human
caaaccccgaccaccugc

SEQ ID NO: 2901703 - RNA, 17 nt, Human
caaaccccacccuaguu

SEQ ID NO: 2901704 - RNA, 21 nt, Human
caaaccccgaccaccugccca

SEQ ID NO: 2901705 - RNA, 21 nt, Human
caaacccuagguucccggucc

SEQ ID NO: 2901706 - RNA, 14 nt, Human
caaaccaaauaaaa

SEQ ID NO: 2901707 - RNA, 15 nt, Human
caaaccaaauaaaaa

SEQ ID NO: 2901708 - RNA, 11 nt, Human
caaacauugug

SEQ ID NO: 2901709 - RNA, 17 nt, Human
caaacauuguguugaca

SEQ ID NO: 2901710 - RNA, 18 nt, Human
caaacauuguguugacau

SEQ ID NO: 2901711 - RNA, 19 nt, Human
caaacauuguguugacauu

SEQ ID NO: 2901712 - RNA, 12 nt, Human
caaagauaucuu

SEQ ID NO: 2901713 - RNA, 14 nt, Human
caaagauaucuuuu

SEQ ID NO: 2901714 - RNA, 17 nt, Human
caaagauaucuuuucuu

SEQ ID NO: 2901715 - RNA, 21 nt, Human
caaagauaucuuuucuuuaga

SEQ ID NO: 2901716 - RNA, 24 nt, Human
caaagaguucuggaaaagaacugu

SEQ ID NO: 2901717 - RNA, 23 nt, Human
caaacccccuccuuacgcuuugu

SEQ ID NO: 2901718 - RNA, 20 nt, Human
caauaaaaucuugaaaaugc

SEQ ID NO: 2901719 - RNA, 12 nt, Human
caauaaaagcuu

SEQ ID NO: 2901720 - RNA, 12 nt, Human
caauaaaacauu

SEQ ID NO: 2901721 - RNA, 16 nt, Human
caaguuuccauagcaa

SEQ ID NO: 2901722 - RNA, 17 nt, Human
caaguuuccauagcaac

SEQ ID NO: 2901723 - RNA, 20 nt, Human
caaguuuccauagcaacagg

SEQ ID NO: 2901724 - RNA, 17 nt, Human
caaguuuucuuccauga

SEQ ID NO: 2901725 - RNA, 21 nt, Human
caaguuuucuuccaugauuuu

SEQ ID NO: 2901726 - RNA, 13 nt, Human
caagucaguuucu

SEQ ID NO: 2901727 - RNA, 16 nt, Human
caagucaguuucuaca

SEQ ID NO: 2901728 - RNA, 14 nt, Human
caagucauguaaau

SEQ ID NO: 2901729 - RNA, 17 nt, Human
caagucauguaaauacu

SEQ ID NO: 2901730 - RNA, 19 nt, Human
caagucauguaaauacugu

SEQ ID NO: 2901731 - RNA, 13 nt, Human
caagucaugugca

SEQ ID NO: 2901732 - RNA, 16 nt, Human
caagucaugugcauuu

SEQ ID NO: 2901733 - RNA, 14 nt, Human
caaggccccugaca

SEQ ID NO: 2901734 - RNA, 19 nt, Human
caagucaggcccuuauuuu

SEQ ID NO: 2901735 - RNA, 12 nt, Human
caaggccuuaag

SEQ ID NO: 2901736 - RNA, 13 nt, Human
caaggcggccccu

SEQ ID NO: 2901737 - RNA, 14 nt, Human
caaggccuucuccu

SEQ ID NO: 2901738 - RNA, 14 nt, Human
caaggcuaugugau

SEQ ID NO: 2901739 - RNA, 19 nt, Human
caaggcuccugaucauucu

SEQ ID NO: 2901740 - RNA, 15 nt, Human
caaggcucugagcaa

SEQ ID NO: 2901741 - RNA, 19 nt, Human
caaggcgggagcaucucuu

SEQ ID NO: 2901742 - RNA, 14 nt, Human
caaggcggccccuc

SEQ ID NO: 2901743 - RNA, 15 nt, Human
caaggcggccccucc

SEQ ID NO: 2901744 - RNA, 16 nt, Human
caaggcggccccuccc

SEQ ID NO: 2901745 - RNA, 21 nt, Human
caaggcgguggacuugaacuu

SEQ ID NO: 2901746 - RNA, 22 nt, Human
caaggcgguggacuugaacuuu

SEQ ID NO: 2901747 - RNA, 14 nt, Human
caaggcacucuaga

SEQ ID NO: 2901748 - RNA, 15 nt, Human
caaggcacucuagau

SEQ ID NO: 2901749 - RNA, 14 nt, Human
caagauuuagaaaa

SEQ ID NO: 2901750 - RNA, 15 nt, Human
caagauuuagaaaaa

SEQ ID NO: 2901751 - RNA, 16 nt, Human
caagauuuagaaaaaa

SEQ ID NO: 2901752 - RNA, 13 nt, Human
caagauuuccuug

SEQ ID NO: 2901753 - RNA, 16 nt, Human
caagauuuccuugugc

SEQ ID NO: 2901754 - RNA, 12 nt, Human
caagauucuaga

SEQ ID NO: 2901755 - RNA, 13 nt, Human
caagaugucuguc

SEQ ID NO: 2901756 - RNA, 13 nt, Human
caagauucuagau

SEQ ID NO: 2901757 - RNA, 14 nt, Human
caagauucuagaug

SEQ ID NO: 2901758 - RNA, 17 nt, Human
caagauucuagaugauu

SEQ ID NO: 2901759 - RNA, 13 nt, Human
caagauugcuuaa

SEQ ID NO: 2901760 - RNA, 12 nt, Human
caagauugaaaa

SEQ ID NO: 2901761 - RNA, 18 nt, Human
caagauucuagaugauua

SEQ ID NO: 2901762 - RNA, 18 nt, Human
caagauugcuuaaaauag

SEQ ID NO: 2901763 - RNA, 16 nt, Human
caagauugcuuaaaau

SEQ ID NO: 2901764 - RNA, 21 nt, Human
caagauugcuuaaaauagcaa

SEQ ID NO: 2901765 - RNA, 16 nt, Human
caaggcacucuagauu

SEQ ID NO: 2901766 - RNA, 17 nt, Human
caaggcacucuagauuc

SEQ ID NO: 2901767 - RNA, 14 nt, Human
caaggccagagugg

SEQ ID NO: 2901768 - RNA, 12 nt, Human
caaggcccugcu

SEQ ID NO: 2901769 - RNA, 13 nt, Human
caaggcccugcug

SEQ ID NO: 2901770 - RNA, 14 nt, Human
caaggcccugcugc

SEQ ID NO: 2901771 - RNA, 16 nt, Human
caaggcccugcugccc

SEQ ID NO: 2901772 - RNA, 17 nt, Human
caaggcccugcugccca

SEQ ID NO: 2901773 - RNA, 22 nt, Human
caaggcccugcugcccaaucuc

SEQ ID NO: 2901774 - RNA, 13 nt, Human
caaugcuggcugu

SEQ ID NO: 2901775 - RNA, 20 nt, Human
caaucccuuuauuacccccu

SEQ ID NO: 2901776 - RNA, 20 nt, Human
caaucccucaccuucugagu

SEQ ID NO: 2901777 - RNA, 17 nt, Human
caaucccagcuaccuca

SEQ ID NO: 2901778 - RNA, 16 nt, Human
caauccccagcccuuu

SEQ ID NO: 2901779 - RNA, 12 nt, Human
caaucccagcua

SEQ ID NO: 2901780 - RNA, 23 nt, Human
caaucccaccaacccucagagcc

SEQ ID NO: 2901781 - RNA, 21 nt, Human
caaugcuggcuguuggcuggg

SEQ ID NO: 2901782 - RNA, 20 nt, Human
caaugcuggcuguuggcugg

SEQ ID NO: 2901783 - RNA, 12 nt, Human
caaugcuggcug

SEQ ID NO: 2901784 - RNA, 16 nt, Human
caauggcagccuuggc

SEQ ID NO: 2901785 - RNA, 21 nt, Human
caauggccuaaaacuggccug

SEQ ID NO: 2901786 - RNA, 15 nt, Human
caauccaagagucug

SEQ ID NO: 2901787 - RNA, 18 nt, Human
caauccagauggugggau

SEQ ID NO: 2901788 - RNA, 16 nt, Human
caauccagguacgcac

SEQ ID NO: 2901789 - RNA, 19 nt, Human
caauccagguacgcacaga

SEQ ID NO: 2901790 - RNA, 20 nt, Human
caauccagguacgcacagac

SEQ ID NO: 2901791 - RNA, 21 nt, Human
caauccagguacgcacagaca

SEQ ID NO: 2901792 - RNA, 22 nt, Human
caauccagguacgcacagacag

SEQ ID NO: 2901793 - RNA, 23 nt, Human
caauccagguacgcacagacagg

SEQ ID NO: 2901794 - RNA, 12 nt, Human
caaucauuguuu

SEQ ID NO: 2901795 - RNA, 17 nt, Human
caaucauuguuuugaau

SEQ ID NO: 2901796 - RNA, 19 nt, Human
caaucauuguuuugaauau

SEQ ID NO: 2901797 - RNA, 20 nt, Human
caaucauuguuuugaauauu

SEQ ID NO: 2901798 - RNA, 12 nt, Human
caaucauuucuc

SEQ ID NO: 2901799 - RNA, 13 nt, Human
caaucauuucuca

SEQ ID NO: 2901800 - RNA, 14 nt, Human
caaucauuucucac

SEQ ID NO: 2901801 - RNA, 17 nt, Human
caaucauuucucacugu

SEQ ID NO: 2901802 - RNA, 18 nt, Human
caaucauuucucacugug

SEQ ID NO: 2901803 - RNA, 18 nt, Human
caaucccaaaagucacca

SEQ ID NO: 2901804 - RNA, 16 nt, Human
caaucccaccaacccu

SEQ ID NO: 2901805 - RNA, 17 nt, Human
caaucccaccaacccuc

SEQ ID NO: 2901806 - RNA, 22 nt, Human
caaucccaccaacccucagagc

SEQ ID NO: 2901807 - RNA, 15 nt, Human
caaucaucuguguga

SEQ ID NO: 2901808 - RNA, 13 nt, Human
caaucauauguga

SEQ ID NO: 2901809 - RNA, 14 nt, Human
caaucauaugugau

SEQ ID NO: 2901810 - RNA, 15 nt, Human
caaucauaugugauc

SEQ ID NO: 2901811 - RNA, 17 nt, Human
caaucauaugugaucug

SEQ ID NO: 2901812 - RNA, 17 nt, Human
caaucaugaaauaugca

SEQ ID NO: 2901813 - RNA, 17 nt, Human
caaucaucugugugaaa

SEQ ID NO: 2901814 - RNA, 19 nt, Human
caaucaucugugugaaaau

SEQ ID NO: 2901815 - RNA, 20 nt, Human
caaucaucugugugaaaaug

SEQ ID NO: 2901816 - RNA, 19 nt, Human
caaucaguauguauucuuu

SEQ ID NO: 2901817 - RNA, 22 nt, Human
caauggcuauauggcaagaaag

SEQ ID NO: 2901818 - RNA, 20 nt, Human
caauugaaggaucaucugaa

SEQ ID NO: 2901819 - RNA, 22 nt, Human
caauugaaggaucaucugaagg

SEQ ID NO: 2901820 - RNA, 16 nt, Human
caauuuccuuuauauu

SEQ ID NO: 2901821 - RNA, 15 nt, Human
caauuuccuuuauau

SEQ ID NO: 2901822 - RNA, 21 nt, Human
caauuuccuuuauauuuagug

SEQ ID NO: 2901823 - RNA, 19 nt, Human
caauuuccuuuauauuuag

SEQ ID NO: 2901824 - RNA, 20 nt, Human
caauuuccuuuauauuuagu

SEQ ID NO: 2901825 - RNA, 19 nt, Human
caauugacugucacuguuc

SEQ ID NO: 2901826 - RNA, 23 nt, Human
caauugagaaaaauauauacuaa

SEQ ID NO: 2901827 - RNA, 14 nt, Human
caauugagaaaaau

SEQ ID NO: 2901828 - RNA, 17 nt, Human
cacccaccucagccucc

SEQ ID NO: 2901829 - RNA, 20 nt, Human
caccaggcuugccugcaggc

SEQ ID NO: 2901830 - RNA, 13 nt, Human
caccagggaaggg

SEQ ID NO: 2901831 - RNA, 21 nt, Human
caccagggaaggggacaagga

SEQ ID NO: 2901832 - RNA, 18 nt, Human
caccagggaaggggacaa

SEQ ID NO: 2901833 - RNA, 13 nt, Human
caccagccccagu

SEQ ID NO: 2901834 - RNA, 14 nt, Human
caccagccccacug

SEQ ID NO: 2901835 - RNA, 12 nt, Human
caccagccccac

SEQ ID NO: 2901836 - RNA, 19 nt, Human
caccagcccauggcccugu

SEQ ID NO: 2901837 - RNA, 21 nt, Human
caccagcccauggcccugugc

SEQ ID NO: 2901838 - RNA, 16 nt, Human
caccagccccagugcc

SEQ ID NO: 2901839 - RNA, 22 nt, Human
caccagccccacugccagcagc

SEQ ID NO: 2901840 - RNA, 21 nt, Human
caccagccccacugccagcag

SEQ ID NO: 2901841 - RNA, 20 nt, Human
caccagccccacugccagca

SEQ ID NO: 2901842 - RNA, 18 nt, Human
caccagccccacugccag

SEQ ID NO: 2901843 - RNA, 23 nt, Human
caccagccccacugccagcagca

SEQ ID NO: 2901844 - RNA, 18 nt, Human
cacccaccucagccuccc

SEQ ID NO: 2901845 - RNA, 14 nt, Human
cacccacucagcuc

SEQ ID NO: 2901846 - RNA, 13 nt, Human
cacccacucagcu

SEQ ID NO: 2901847 - RNA, 16 nt, Human
cacccaggagccccga

SEQ ID NO: 2901848 - RNA, 22 nt, Human
cacccagccucaguccuccccu

SEQ ID NO: 2901849 - RNA, 15 nt, Human
cacccagccucaguc

SEQ ID NO: 2901850 - RNA, 19 nt, Human
cacccagccucaguccucc

SEQ ID NO: 2901851 - RNA, 11 nt, Human
cacccagccuc

SEQ ID NO: 2901852 - RNA, 12 nt, Human
cacccagccuca

SEQ ID NO: 2901853 - RNA, 13 nt, Human
cacccagccucag

SEQ ID NO: 2901854 - RNA, 14 nt, Human
cacccagccucagu

SEQ ID NO: 2901855 - RNA, 13 nt, Human
cacccaugguacc

SEQ ID NO: 2901856 - RNA, 20 nt, Human
cacccaugggcucugacaga

SEQ ID NO: 2901857 - RNA, 18 nt, Human
cacccaugggcucugaca

SEQ ID NO: 2901858 - RNA, 19 nt, Human
cacccaugggcucugacag

SEQ ID NO: 2901859 - RNA, 13 nt, Human
cacccaugggcuc

SEQ ID NO: 2901860 - RNA, 22 nt, Human
cacccaugaagacaggacagug

SEQ ID NO: 2901861 - RNA, 15 nt, Human
cacccaugaagacag

SEQ ID NO: 2901862 - RNA, 21 nt, Human
caccccaaguagucugcucac

SEQ ID NO: 2901863 - RNA, 22 nt, Human
caccccaaguagucugcucaca

SEQ ID NO: 2901864 - RNA, 15 nt, Human
cacccauuuucacau

SEQ ID NO: 2901865 - RNA, 12 nt, Human
caccccacacuu

SEQ ID NO: 2901866 - RNA, 11 nt, Human
caccccacacu

SEQ ID NO: 2901867 - RNA, 15 nt, Human
caccaaccgacaggc

SEQ ID NO: 2901868 - RNA, 13 nt, Human
caccaacccucag

SEQ ID NO: 2901869 - RNA, 18 nt, Human
caccaaagcugcccacug

SEQ ID NO: 2901870 - RNA, 14 nt, Human
caccaaagcugccc

SEQ ID NO: 2901871 - RNA, 13 nt, Human
caccaaagcugcc

SEQ ID NO: 2901872 - RNA, 22 nt, Human
caccaaagggagaguuccagag

SEQ ID NO: 2901873 - RNA, 12 nt, Human
caccaaaguucu

SEQ ID NO: 2901874 - RNA, 13 nt, Human
caccaaaguucua

SEQ ID NO: 2901875 - RNA, 14 nt, Human
caccaaagaugcag

SEQ ID NO: 2901876 - RNA, 15 nt, Human
caccaaagaugcagc

SEQ ID NO: 2901877 - RNA, 17 nt, Human
caccaaagaugcagccg

SEQ ID NO: 2901878 - RNA, 18 nt, Human
caccaaagaugcagccgc

SEQ ID NO: 2901879 - RNA, 14 nt, Human
caccaaaguucuaa

SEQ ID NO: 2901880 - RNA, 16 nt, Human
caccaaaguucuaaua

SEQ ID NO: 2901881 - RNA, 17 nt, Human
caccaaaguucuaauaa

SEQ ID NO: 2901882 - RNA, 22 nt, Human
caccaaaguucuaauaauuucu

SEQ ID NO: 2901883 - RNA, 15 nt, Human
caccaacaccacggu

SEQ ID NO: 2901884 - RNA, 21 nt, Human
cacaucugcauuuucacccca

SEQ ID NO: 2901885 - RNA, 13 nt, Human
cacaucugcauuu

SEQ ID NO: 2901886 - RNA, 13 nt, Human
cacaucucugaaa

SEQ ID NO: 2901887 - RNA, 21 nt, Human
cacaucucugaaagcacagga

SEQ ID NO: 2901888 - RNA, 16 nt, Human
cacagaagcacaugca

SEQ ID NO: 2901889 - RNA, 10 nt, Human
cacagcuccu

SEQ ID NO: 2901890 - RNA, 15 nt, Human
cacagcuccucccac

SEQ ID NO: 2901891 - RNA, 14 nt, Human
cacagcucuguccu

SEQ ID NO: 2901892 - RNA, 11 nt, Human
cacagcucugu

SEQ ID NO: 2901893 - RNA, 18 nt, Human
cacagcucuguccuggga

SEQ ID NO: 2901894 - RNA, 16 nt, Human
cacagcucuguccugg

SEQ ID NO: 2901895 - RNA, 15 nt, Human
cacagcucuguccug

SEQ ID NO: 2901896 - RNA, 15 nt, Human
cacagcucuucucca

SEQ ID NO: 2901897 - RNA, 14 nt, Human
cacagcucuucucc

SEQ ID NO: 2901898 - RNA, 17 nt, Human
cacagcucuucuccagg

SEQ ID NO: 2901899 - RNA, 21 nt, Human
cacagcucuccggucucucuc

SEQ ID NO: 2901900 - RNA, 20 nt, Human
cacagcucuccggucucucu

SEQ ID NO: 2901901 - RNA, 20 nt, Human
cacaccaaagggagaguucc

SEQ ID NO: 2901902 - RNA, 22 nt, Human
cacacauggaaacccauaggcc

SEQ ID NO: 2901903 - RNA, 18 nt, Human
cacacuuguuccagcucu

SEQ ID NO: 2901904 - RNA, 19 nt, Human
cacacuuguuccagcucuu

SEQ ID NO: 2901905 - RNA, 20 nt, Human
cacacuuguuccagcucuuu

SEQ ID NO: 2901906 - RNA, 17 nt, Human
cacacuuuuuaagaaau

SEQ ID NO: 2901907 - RNA, 13 nt, Human
cacagaaaagcau

SEQ ID NO: 2901908 - RNA, 14 nt, Human
cacagaaaagcaua

SEQ ID NO: 2901909 - RNA, 12 nt, Human
cacagaaaccuu

SEQ ID NO: 2901910 - RNA, 12 nt, Human
cacagaaauaua

SEQ ID NO: 2901911 - RNA, 13 nt, Human
cacagaaauauau

SEQ ID NO: 2901912 - RNA, 15 nt, Human
cacagaaauauauau

SEQ ID NO: 2901913 - RNA, 18 nt, Human
cacagaaauauauauaca

SEQ ID NO: 2901914 - RNA, 19 nt, Human
cacagaaauauauauacau

SEQ ID NO: 2901915 - RNA, 20 nt, Human
cacagaaauauauauacaua

SEQ ID NO: 2901916 - RNA, 21 nt, Human
cacagaaauauauauacauau

SEQ ID NO: 2901917 - RNA, 23 nt, Human
cacagaaauauauauacauaugu

SEQ ID NO: 2901918 - RNA, 13 nt, Human
cacagaacccuug

SEQ ID NO: 2901919 - RNA, 22 nt, Human
cacagggacugaaaaccucucc

SEQ ID NO: 2901920 - RNA, 19 nt, Human
cacagggaagagcuccccu

SEQ ID NO: 2901921 - RNA, 13 nt, Human
cacagggaagugg

SEQ ID NO: 2901922 - RNA, 14 nt, Human
cacuguuuuuagac

SEQ ID NO: 2901923 - RNA, 20 nt, Human
cacuguuuuuagacaccuuc

SEQ ID NO: 2901924 - RNA, 21 nt, Human
cacuguuuuuagacaccuuca

SEQ ID NO: 2901925 - RNA, 13 nt, Human
cacuguuuuucca

SEQ ID NO: 2901926 - RNA, 14 nt, Human
cacuguuuuuccau

SEQ ID NO: 2901927 - RNA, 15 nt, Human
cacuguuuuuccaua

SEQ ID NO: 2901928 - RNA, 16 nt, Human
cacuguuuuuccauag

SEQ ID NO: 2901929 - RNA, 19 nt, Human
cacuguuuuuccauaguuu

SEQ ID NO: 2901930 - RNA, 21 nt, Human
cacuguuucucuugagcuggc

SEQ ID NO: 2901931 - RNA, 19 nt, Human
cacugguauuccugccucc

SEQ ID NO: 2901932 - RNA, 19 nt, Human
cacuguugcccaggcuggc

SEQ ID NO: 2901933 - RNA, 18 nt, Human
cacuguugcccaggcugg

SEQ ID NO: 2901934 - RNA, 23 nt, Human
cacuguugcccaggcuggcgugc

SEQ ID NO: 2901935 - RNA, 22 nt, Human
cacuguuucucuugagcuggcc

SEQ ID NO: 2901936 - RNA, 15 nt, Human
cacuguuucuugcuu

SEQ ID NO: 2901937 - RNA, 17 nt, Human
cacuguuucuugcuugu

SEQ ID NO: 2901938 - RNA, 18 nt, Human
cacuguuucuugcuugua

SEQ ID NO: 2901939 - RNA, 19 nt, Human
cacuguuucuugcuuguac

SEQ ID NO: 2901940 - RNA, 21 nt, Human
cacuguuucuugcuuguaccu

SEQ ID NO: 2901941 - RNA, 24 nt, Human
cacuguuucuugcuuguaccucug

SEQ ID NO: 2901942 - RNA, 20 nt, Human
cacugguauuccugccucca

SEQ ID NO: 2901943 - RNA, 22 nt, Human
cacugggaugagccgcugugag

SEQ ID NO: 2901944 - RNA, 21 nt, Human
cacugguacuuagaguuucug

SEQ ID NO: 2901945 - RNA, 22 nt, Human
cacugguacuuagaguuucugu

SEQ ID NO: 2901946 - RNA, 20 nt, Human
cacugguagaccaaaauaaa

SEQ ID NO: 2901947 - RNA, 16 nt, Human
cacugguauuccugcc

SEQ ID NO: 2901948 - RNA, 17 nt, Human
cacugguauuccugccu

SEQ ID NO: 2901949 - RNA, 15 nt, Human
cacuggguugacuuu

SEQ ID NO: 2901950 - RNA, 22 nt, Human
cacugccaucuuaguuuggauu

SEQ ID NO: 2901951 - RNA, 17 nt, Human
cacugccaugcagggcc

SEQ ID NO: 2901952 - RNA, 19 nt, Human
cacugccaugcagggccuc

SEQ ID NO: 2901953 - RNA, 20 nt, Human
cacugggaugagccgcugug

SEQ ID NO: 2901954 - RNA, 23 nt, Human
cacugggaugagccgcugugagc

SEQ ID NO: 2901955 - RNA, 15 nt, Human
cacugggcacaacug

SEQ ID NO: 2901956 - RNA, 11 nt, Human
cacugggccaa

SEQ ID NO: 2901957 - RNA, 20 nt, Human
cacugggccaauucaauaca

SEQ ID NO: 2901958 - RNA, 12 nt, Human
cacugggaucac

SEQ ID NO: 2901959 - RNA, 22 nt, Human
cacugggaucacaggugucagc

SEQ ID NO: 2901960 - RNA, 13 nt, Human
cacugggcuucua

SEQ ID NO: 2901961 - RNA, 14 nt, Human
cacugcagccucaa

SEQ ID NO: 2901962 - RNA, 19 nt, Human
cacugcagccucaaccucc

SEQ ID NO: 2901963 - RNA, 23 nt, Human
cacugcagccucaaccuccuggg

SEQ ID NO: 2901964 - RNA, 22 nt, Human
cacugcagccucaaccuccugg

SEQ ID NO: 2901965 - RNA, 21 nt, Human
cacugcagccucaaccuccug

SEQ ID NO: 2901966 - RNA, 20 nt, Human
cacugcagccucaaccuccu

SEQ ID NO: 2901967 - RNA, 16 nt, Human
cacugccaucuuaguu

SEQ ID NO: 2901968 - RNA, 20 nt, Human
cacugccaucuuaguuugga

SEQ ID NO: 2901969 - RNA, 20 nt, Human
cacugccaucaaacuguaaa

SEQ ID NO: 2901970 - RNA, 17 nt, Human
cacugccaucugaugcc

SEQ ID NO: 2901971 - RNA, 20 nt, Human
cacugcaggcaucacagcua

SEQ ID NO: 2901972 - RNA, 18 nt, Human
cacuuguuccagcucuuu

SEQ ID NO: 2901973 - RNA, 18 nt, Human
cacuuguguuaugaagca

SEQ ID NO: 2901974 - RNA, 19 nt, Human
cacuuguugauuaauggaa

SEQ ID NO: 2901975 - RNA, 13 nt, Human
cacuuuaaaccug

SEQ ID NO: 2901976 - RNA, 18 nt, Human
cacuuuaagagagaaauc

SEQ ID NO: 2901977 - RNA, 16 nt, Human
cacuugugcuuugcuc

SEQ ID NO: 2901978 - RNA, 18 nt, Human
cacuugugcuuugcucuu

SEQ ID NO: 2901979 - RNA, 19 nt, Human
cacuugugcuuugcucuug

SEQ ID NO: 2901980 - RNA, 20 nt, Human
cacuugugcuuugcucuugu

SEQ ID NO: 2901981 - RNA, 21 nt, Human
cacuuaacauuccuaaaaugc

SEQ ID NO: 2901982 - RNA, 17 nt, Human
cacuuaaaaugugcagu

SEQ ID NO: 2901983 - RNA, 17 nt, Human
cacuuaaggcacucugu

SEQ ID NO: 2901984 - RNA, 18 nt, Human
cacuuuauaagucauugu

SEQ ID NO: 2901985 - RNA, 17 nt, Human
cacuuucuaauguuucu

SEQ ID NO: 2901986 - RNA, 18 nt, Human
cacuuucuaauguuucug

SEQ ID NO: 2901987 - RNA, 14 nt, Human
cacuuuacccaccu

SEQ ID NO: 2901988 - RNA, 22 nt, Human
cacuuuacccaccuagaacacu

SEQ ID NO: 2901989 - RNA, 20 nt, Human
cacuuuacccaccuagaaca

SEQ ID NO: 2901990 - RNA, 19 nt, Human
cacuuuacccaccuagaac

SEQ ID NO: 2901991 - RNA, 17 nt, Human
cacuuuacccaccuaga

SEQ ID NO: 2901992 - RNA, 17 nt, Human
cagaacagcuucagguu

SEQ ID NO: 2901993 - RNA, 18 nt, Human
cagaacagcuucagguua

SEQ ID NO: 2901994 - RNA, 19 nt, Human
cagaacagcuucagguuau

SEQ ID NO: 2901995 - RNA, 24 nt, Human
cagaacagcuucagguuaucgaaa

SEQ ID NO: 2901996 - RNA, 12 nt, Human
cagaacaggguc

SEQ ID NO: 2901997 - RNA, 13 nt, Human
cagaacaggguca

SEQ ID NO: 2901998 - RNA, 14 nt, Human
cagaacagggucau

SEQ ID NO: 2901999 - RNA, 20 nt, Human
cagaacagguguuggugaca

SEQ ID NO: 2902000 - RNA, 24 nt, Human
cagaacagguguuggugacaauug

SEQ ID NO: 2902001 - RNA, 14 nt, Human
cagaacaguaucuu

SEQ ID NO: 2902002 - RNA, 15 nt, Human
cagaacaguaucuuu

SEQ ID NO: 2902003 - RNA, 15 nt, Human
cagaaguuucucagc

SEQ ID NO: 2902004 - RNA, 19 nt, Human
cagaaguuucucagcuccc

SEQ ID NO: 2902005 - RNA, 21 nt, Human
cagaaaugucuaaaugcugaa

SEQ ID NO: 2902006 - RNA, 12 nt, Human
cagaacagcuuc

SEQ ID NO: 2902007 - RNA, 13 nt, Human
cagaacagcuuca

SEQ ID NO: 2902008 - RNA, 15 nt, Human
cagaacagcuucagg

SEQ ID NO: 2902009 - RNA, 16 nt, Human
cagaacagcuucaggu

SEQ ID NO: 2902010 - RNA, 11 nt, Human
cagaaaugucu

SEQ ID NO: 2902011 - RNA, 14 nt, Human
cagaaaugucuaaa

SEQ ID NO: 2902012 - RNA, 21 nt, Human
cagaaauggggaauucucuaa

SEQ ID NO: 2902013 - RNA, 21 nt, Human
cagaaauauaauaaaaugugu

SEQ ID NO: 2902014 - RNA, 13 nt, Human
cagaaauauauau

SEQ ID NO: 2902015 - RNA, 16 nt, Human
cagaaauauauauaca

SEQ ID NO: 2902016 - RNA, 17 nt, Human
cagaaauauauauacau

SEQ ID NO: 2902017 - RNA, 18 nt, Human
cagaaauauauauacaua

SEQ ID NO: 2902018 - RNA, 19 nt, Human
cagaaauauauauacauau

SEQ ID NO: 2902019 - RNA, 20 nt, Human
cagaaauauauauacauaug

SEQ ID NO: 2902020 - RNA, 22 nt, Human
cagaaauauauauacauaugua

SEQ ID NO: 2902021 - RNA, 20 nt, Human
cagaaaucaguaauauuuau

SEQ ID NO: 2902022 - RNA, 14 nt, Human
cagaaaguguaaau

SEQ ID NO: 2902023 - RNA, 22 nt, Human
cagaaauacuauaacauaugua

SEQ ID NO: 2902024 - RNA, 20 nt, Human
cagaaagguuuucuucuuuu

SEQ ID NO: 2902025 - RNA, 15 nt, Human
cagaaagguucugcc

SEQ ID NO: 2902026 - RNA, 16 nt, Human
cagaaagguucugccc

SEQ ID NO: 2902027 - RNA, 17 nt, Human
cagaaagguucugcccg

SEQ ID NO: 2902028 - RNA, 21 nt, Human
cagaaagguucugcccgggaa

SEQ ID NO: 2902029 - RNA, 21 nt, Human
cagaaagucauuccuucuuuu

SEQ ID NO: 2902030 - RNA, 15 nt, Human
cagaaaggaaaaccu

SEQ ID NO: 2902031 - RNA, 18 nt, Human
cagaaaggaaaaccugaa

SEQ ID NO: 2902032 - RNA, 20 nt, Human
cagaaaggaaaaccugaaga

SEQ ID NO: 2902033 - RNA, 12 nt, Human
cagaaaggagac

SEQ ID NO: 2902034 - RNA, 12 nt, Human
cagaaaggagag

SEQ ID NO: 2902035 - RNA, 13 nt, Human
cagaaaggagagu

SEQ ID NO: 2902036 - RNA, 15 nt, Human
cagaaaggcuuuuua

SEQ ID NO: 2902037 - RNA, 12 nt, Human
cacuccagccug

SEQ ID NO: 2902038 - RNA, 13 nt, Human
cacuccagccuga

SEQ ID NO: 2902039 - RNA, 23 nt, Human
cacuaccagcguauauauaagaa

SEQ ID NO: 2902040 - RNA, 20 nt, Human
cacuacaugugguuuauaga

SEQ ID NO: 2902041 - RNA, 19 nt, Human
cacuacaugugguuuauag

SEQ ID NO: 2902042 - RNA, 15 nt, Human
cacuacaugcagccc

SEQ ID NO: 2902043 - RNA, 21 nt, Human
cacuacacuccagccugagca

SEQ ID NO: 2902044 - RNA, 20 nt, Human
cacuacacuccagccugagc

SEQ ID NO: 2902045 - RNA, 23 nt, Human
cacuacaugcagcccaugcccac

SEQ ID NO: 2902046 - RNA, 21 nt, Human
cacuacaugcagcccaugccc

SEQ ID NO: 2902047 - RNA, 21 nt, Human
cacuccagccugagcaacaga

SEQ ID NO: 2902048 - RNA, 15 nt, Human
cacuccagccugagc

SEQ ID NO: 2902049 - RNA, 14 nt, Human
cacuccagccugag

SEQ ID NO: 2902050 - RNA, 14 nt, Human
cacuccagccuggg

SEQ ID NO: 2902051 - RNA, 13 nt, Human
cacuccagccugg

SEQ ID NO: 2902052 - RNA, 20 nt, Human
cacucugucgcccagucugg

SEQ ID NO: 2902053 - RNA, 16 nt, Human
cacuccagccugggcg

SEQ ID NO: 2902054 - RNA, 15 nt, Human
cacuccagccugggc

SEQ ID NO: 2902055 - RNA, 21 nt, Human
cacuccagccugggcgacaga

SEQ ID NO: 2902056 - RNA, 15 nt, Human
cacuaccgauucuuu

SEQ ID NO: 2902057 - RNA, 17 nt, Human
cacucuguuauuuagac

SEQ ID NO: 2902058 - RNA, 13 nt, Human
cacucuguuauuu

SEQ ID NO: 2902059 - RNA, 13 nt, Human
cacggccaggcca

SEQ ID NO: 2902060 - RNA, 12 nt, Human
cacggccaggcc

SEQ ID NO: 2902061 - RNA, 17 nt, Human
cacggccaggccagagg

SEQ ID NO: 2902062 - RNA, 21 nt, Human
cacggccccgaagggccccca

SEQ ID NO: 2902063 - RNA, 14 nt, Human
cacggcucacugca

SEQ ID NO: 2902064 - RNA, 15 nt, Human
cacggcguuguaccu

SEQ ID NO: 2902065 - RNA, 16 nt, Human
cacggcuaagaggcug

SEQ ID NO: 2902066 - RNA, 20 nt, Human
cacggcuaagaggcugcuga

SEQ ID NO: 2902067 - RNA, 19 nt, Human
cacuacacuccagccugag

SEQ ID NO: 2902068 - RNA, 18 nt, Human
cacuacacuccagccuga

SEQ ID NO: 2902069 - RNA, 17 nt, Human
cacuacacuccagccug

SEQ ID NO: 2902070 - RNA, 16 nt, Human
cacuacacuccagccu

SEQ ID NO: 2902071 - RNA, 22 nt, Human
cacucuuauugcccacgcugga

SEQ ID NO: 2902072 - RNA, 21 nt, Human
cacucuuauugcccacgcugg

SEQ ID NO: 2902073 - RNA, 20 nt, Human
cacucuuauugcccacgcug

SEQ ID NO: 2902074 - RNA, 16 nt, Human
cacucuuaagcuuccg

SEQ ID NO: 2902075 - RNA, 14 nt, Human
cacucuuaaagcaa

SEQ ID NO: 2902076 - RNA, 22 nt, Human
cacucuuaaagcaaaaaaugaa

SEQ ID NO: 2902077 - RNA, 14 nt, Human
cacucuuaaaugau

SEQ ID NO: 2902078 - RNA, 20 nt, Human
cacucuguuauuuagacuca

SEQ ID NO: 2902079 - RNA, 16 nt, Human
caccuuggcugcaggg

SEQ ID NO: 2902080 - RNA, 15 nt, Human
caccuuggcugcagg

SEQ ID NO: 2902081 - RNA, 18 nt, Human
caccuuggcugcagggag

SEQ ID NO: 2902082 - RNA, 21 nt, Human
caccugcccccugguggacag

SEQ ID NO: 2902083 - RNA, 23 nt, Human
caccuuuauucuggcagaggagg

SEQ ID NO: 2902084 - RNA, 22 nt, Human
caccugcccaucacaggguugg

SEQ ID NO: 2902085 - RNA, 18 nt, Human
caccugcccaucacaggg

SEQ ID NO: 2902086 - RNA, 22 nt, Human
caccugccauuugcacccuccg

SEQ ID NO: 2902087 - RNA, 15 nt, Human
caccugcccccuggu

SEQ ID NO: 2902088 - RNA, 14 nt, Human
caccugcccccugg

SEQ ID NO: 2902089 - RNA, 18 nt, Human
caccugcccaaccugcuc

SEQ ID NO: 2902090 - RNA, 19 nt, Human
caccugcccaaccugcucu

SEQ ID NO: 2902091 - RNA, 13 nt, Human
caccugcccaacc

SEQ ID NO: 2902092 - RNA, 14 nt, Human
caccuuuauucugg

SEQ ID NO: 2902093 - RNA, 14 nt, Human
caccuuucagccca

SEQ ID NO: 2902094 - RNA, 17 nt, Human
caccuuucagcccacgu

SEQ ID NO: 2902095 - RNA, 13 nt, Human
caccuuuguguau

SEQ ID NO: 2902096 - RNA, 14 nt, Human
caccuuuguguauu

SEQ ID NO: 2902097 - RNA, 17 nt, Human
caccuuuguguauuuuu

SEQ ID NO: 2902098 - RNA, 21 nt, Human
caccuuuguguauuuuucaau

SEQ ID NO: 2902099 - RNA, 19 nt, Human
caccuuuccucaaauguug

SEQ ID NO: 2902100 - RNA, 17 nt, Human
caccuuuucuugccuga

SEQ ID NO: 2902101 - RNA, 14 nt, Human
caccuuuuuuccua

SEQ ID NO: 2902102 - RNA, 12 nt, Human
cacgaaacuugu

SEQ ID NO: 2902103 - RNA, 14 nt, Human
cacgaaacuuguua

SEQ ID NO: 2902104 - RNA, 20 nt, Human
cacgaaacuuguuauuguga

SEQ ID NO: 2902105 - RNA, 21 nt, Human
cacgaaacuuguuauugugaa

SEQ ID NO: 2902106 - RNA, 22 nt, Human
cacgaaacuuguuauugugaau

SEQ ID NO: 2902107 - RNA, 13 nt, Human
cacgaaagagaga

SEQ ID NO: 2902108 - RNA, 17 nt, Human
caccuuuuuuaaggaaa

SEQ ID NO: 2902109 - RNA, 22 nt, Human
cacgaaagagagagaaacaaac

SEQ ID NO: 2902110 - RNA, 11 nt, Human
cacgaaagcac

SEQ ID NO: 2902111 - RNA, 14 nt, Human
cacgaaagcacaca

SEQ ID NO: 2902112 - RNA, 12 nt, Human
caccucagccuc

SEQ ID NO: 2902113 - RNA, 19 nt, Human
caccucagaguauggagcu

SEQ ID NO: 2902114 - RNA, 22 nt, Human
caccucagaguauggagcucag

SEQ ID NO: 2902115 - RNA, 18 nt, Human
caccucaccccguuacag

SEQ ID NO: 2902116 - RNA, 23 nt, Human
caccuagaacacuaacucaccag

SEQ ID NO: 2902117 - RNA, 16 nt, Human
caccuagaauuggcug

SEQ ID NO: 2902118 - RNA, 14 nt, Human
caccuagagccaga

SEQ ID NO: 2902119 - RNA, 16 nt, Human
caccuagagccagacc

SEQ ID NO: 2902120 - RNA, 17 nt, Human
caccuagagccagacca

SEQ ID NO: 2902121 - RNA, 20 nt, Human
caccuagcaauuccaucacc

SEQ ID NO: 2902122 - RNA, 22 nt, Human
caccuacuuuucuuuccucaga

SEQ ID NO: 2902123 - RNA, 16 nt, Human
caccuagcuuuauucu

SEQ ID NO: 2902124 - RNA, 15 nt, Human
caccuagcugugcaa

SEQ ID NO: 2902125 - RNA, 12 nt, Human
caccuacugagu

SEQ ID NO: 2902126 - RNA, 12 nt, Human
ccucgcuuggac

SEQ ID NO: 2902127 - RNA, 18 nt, Human
ccucggaaccgcucaccu

SEQ ID NO: 2902128 - RNA, 21 nt, Human
ccucggaaccgcucaccuaga

SEQ ID NO: 2902129 - RNA, 23 nt, Human
ccucggaaccgcucaccuagagc

SEQ ID NO: 2902130 - RNA, 20 nt, Human
ccucggacuuagcugggaga

SEQ ID NO: 2902131 - RNA, 19 nt, Human
ccucggacuuagcugggag

SEQ ID NO: 2902132 - RNA, 13 nt, Human
ccucgcugcuucu

SEQ ID NO: 2902133 - RNA, 12 nt, Human
ccucgcugcuuc

SEQ ID NO: 2902134 - RNA, 20 nt, Human
ccucgaaacacagaaaccuu

SEQ ID NO: 2902135 - RNA, 16 nt, Human
ccucgaaacacagaaa

SEQ ID NO: 2902136 - RNA, 18 nt, Human
ccucgcacggccccgaag

SEQ ID NO: 2902137 - RNA, 21 nt, Human
ccucgaugggagggauggccc

SEQ ID NO: 2902138 - RNA, 12 nt, Human
ccuccucaccuc

SEQ ID NO: 2902139 - RNA, 19 nt, Human
ccuccuaucagaaguuucu

SEQ ID NO: 2902140 - RNA, 16 nt, Human
ccuccucacccccagc

SEQ ID NO: 2902141 - RNA, 14 nt, Human
ccuccucaccccca

SEQ ID NO: 2902142 - RNA, 13 nt, Human
ccuccucaccccc

SEQ ID NO: 2902143 - RNA, 20 nt, Human
ccucccuuggggccuaugca

SEQ ID NO: 2902144 - RNA, 19 nt, Human
ccucccuuccgacccucug

SEQ ID NO: 2902145 - RNA, 20 nt, Human
ccucccuuccgacccucugg

SEQ ID NO: 2902146 - RNA, 21 nt, Human
ccucccuuccgacccucuggg

SEQ ID NO: 2902147 - RNA, 22 nt, Human
ccucccuuccgacccucuggga

SEQ ID NO: 2902148 - RNA, 23 nt, Human
ccucccuuccgacccucugggaa

SEQ ID NO: 2902149 - RNA, 14 nt, Human
ccuccgccucuugg

SEQ ID NO: 2902150 - RNA, 20 nt, Human
ccuccgcgugaucaaagcca

SEQ ID NO: 2902151 - RNA, 19 nt, Human
ccuccgccuucacuccggu

SEQ ID NO: 2902152 - RNA, 18 nt, Human
ccuccgccuucacauucc

SEQ ID NO: 2902153 - RNA, 13 nt, Human
ccuccgccucuug

SEQ ID NO: 2902154 - RNA, 22 nt, Human
ccuccgaccacuuccaggggaa

SEQ ID NO: 2902155 - RNA, 20 nt, Human
ccuccgaccacuuccagggg

SEQ ID NO: 2902156 - RNA, 15 nt, Human
ccucaaccuccuggg

SEQ ID NO: 2902157 - RNA, 15 nt, Human
ccucaaaucguccag

SEQ ID NO: 2902158 - RNA, 19 nt, Human
ccucaggcaggaagggcag

SEQ ID NO: 2902159 - RNA, 15 nt, Human
ccucaggcaggaagg

SEQ ID NO: 2902160 - RNA, 13 nt, Human
ccucaggcaggaa

SEQ ID NO: 2902161 - RNA, 14 nt, Human
ccucagcugaaugc

SEQ ID NO: 2902162 - RNA, 21 nt, Human
ccucaggccaggugcaguggc

SEQ ID NO: 2902163 - RNA, 20 nt, Human
ccucauucaaagggacgguc

SEQ ID NO: 2902164 - RNA, 21 nt, Human
ccucauuccaccuucccaugc

SEQ ID NO: 2902165 - RNA, 18 nt, Human
ccucagcugccucacuuc

SEQ ID NO: 2902166 - RNA, 17 nt, Human
ccucagcugccucacuu

SEQ ID NO: 2902167 - RNA, 16 nt, Human
ccucagcugccucacu

SEQ ID NO: 2902168 - RNA, 15 nt, Human
ccucagcugccucac

SEQ ID NO: 2902169 - RNA, 14 nt, Human
ccucagcugccuca

SEQ ID NO: 2902170 - RNA, 13 nt, Human
ccucagcugccuc

SEQ ID NO: 2902171 - RNA, 20 nt, Human
ccucaagugauucuccugcc

SEQ ID NO: 2902172 - RNA, 20 nt, Human
ccucaagguuuuagguucua

SEQ ID NO: 2902173 - RNA, 22 nt, Human
ccucaagguuuuagguucuaaa

SEQ ID NO: 2902174 - RNA, 23 nt, Human
ccucaagguuuuagguucuaaag

SEQ ID NO: 2902175 - RNA, 16 nt, Human
ccucaaguaaacuccc

SEQ ID NO: 2902176 - RNA, 12 nt, Human
ccucaaccuccu

SEQ ID NO: 2902177 - RNA, 23 nt, Human
ccucaagugauucuccugccuca

SEQ ID NO: 2902178 - RNA, 17 nt, Human
ccucaagugauccuccc

SEQ ID NO: 2902179 - RNA, 18 nt, Human
ccucaagugauccuccca

SEQ ID NO: 2902180 - RNA, 19 nt, Human
ccucaagugauccucccac

SEQ ID NO: 2902181 - RNA, 13 nt, Human
ccucagcuaccca

SEQ ID NO: 2902182 - RNA, 20 nt, Human
ccucagcuacccacuauccu

SEQ ID NO: 2902183 - RNA, 23 nt, Human
ccucccaucauuacccuucccug

SEQ ID NO: 2902184 - RNA, 20 nt, Human
ccucauuuaucccucaaccc

SEQ ID NO: 2902185 - RNA, 22 nt, Human
ccucauuucaggagcagccuca

SEQ ID NO: 2902186 - RNA, 11 nt, Human
ccucauuucuc

SEQ ID NO: 2902187 - RNA, 19 nt, Human
ccucauuuaucccucaacc

SEQ ID NO: 2902188 - RNA, 16 nt, Human
ccucauuuaucccuca

SEQ ID NO: 2902189 - RNA, 21 nt, Human
ccucccagggccagggcccug

SEQ ID NO: 2902190 - RNA, 17 nt, Human
ccucccaguaccuccug

SEQ ID NO: 2902191 - RNA, 19 nt, Human
ccucauugacaagaacuga

SEQ ID NO: 2902192 - RNA, 15 nt, Human
ccucccaggcucuca

SEQ ID NO: 2902193 - RNA, 14 nt, Human
ccucccagggccag

SEQ ID NO: 2902194 - RNA, 18 nt, Human
ccuaauaaacauccuuca

SEQ ID NO: 2902195 - RNA, 20 nt, Human
ccgugagcgccugugcacac

SEQ ID NO: 2902196 - RNA, 21 nt, Human
ccgugagcgccugugcacaca

SEQ ID NO: 2902197 - RNA, 22 nt, Human
ccgugagcgccugugcacacac

SEQ ID NO: 2902198 - RNA, 13 nt, Human
ccgucugugaauu

SEQ ID NO: 2902199 - RNA, 23 nt, Human
ccgucugugugugaccccuccug

SEQ ID NO: 2902200 - RNA, 17 nt, Human
ccgugaaaacggagcug

SEQ ID NO: 2902201 - RNA, 18 nt, Human
ccgugaaaacggagcuga

SEQ ID NO: 2902202 - RNA, 16 nt, Human
ccgugaacugugcaua

SEQ ID NO: 2902203 - RNA, 22 nt, Human
ccgugagccaaucccucaccuu

SEQ ID NO: 2902204 - RNA, 19 nt, Human
ccgugagcaggaaggccug

SEQ ID NO: 2902205 - RNA, 20 nt, Human
ccgugagcaggaaggccugg

SEQ ID NO: 2902206 - RNA, 21 nt, Human
ccgugagcaggaaggccuggg

SEQ ID NO: 2902207 - RNA, 22 nt, Human
ccgugagcaggaaggccugggu

SEQ ID NO: 2902208 - RNA, 23 nt, Human
ccgugaaggcuucucuguucuac

SEQ ID NO: 2902209 - RNA, 17 nt, Human
ccuaaugucuucauaaa

SEQ ID NO: 2902210 - RNA, 12 nt, Human
ccuaaugcugca

SEQ ID NO: 2902211 - RNA, 22 nt, Human
ccuaauaaacauccuucaagaa

SEQ ID NO: 2902212 - RNA, 20 nt, Human
ccuaaugcgcaggcuggccc

SEQ ID NO: 2902213 - RNA, 21 nt, Human
ccuaaugcgcaggcuggcccu

SEQ ID NO: 2902214 - RNA, 12 nt, Human
ccuaauucagcc

SEQ ID NO: 2902215 - RNA, 20 nt, Human
ccuaauucagccauguacag

SEQ ID NO: 2902216 - RNA, 17 nt, Human
ccuagcccaggagagag

SEQ ID NO: 2902217 - RNA, 18 nt, Human
ccuagcccaggagagaga

SEQ ID NO: 2902218 - RNA, 19 nt, Human
ccuagcccaggagagagaa

SEQ ID NO: 2902219 - RNA, 20 nt, Human
ccuagcccaggagagagaaa

SEQ ID NO: 2902220 - RNA, 13 nt, Human
ccuagccauucug

SEQ ID NO: 2902221 - RNA, 13 nt, Human
ccuagcccacccu

SEQ ID NO: 2902222 - RNA, 14 nt, Human
ccuagcccacccug

SEQ ID NO: 2902223 - RNA, 15 nt, Human
ccuagcccacccugc

SEQ ID NO: 2902224 - RNA, 16 nt, Human
ccuagcccacccugcu

SEQ ID NO: 2902225 - RNA, 17 nt, Human
ccuagcccacccugcug

SEQ ID NO: 2902226 - RNA, 20 nt, Human
ccuagcccacccugcugccu

SEQ ID NO: 2902227 - RNA, 13 nt, Human
ccuagcccagcgc

SEQ ID NO: 2902228 - RNA, 17 nt, Human
ccuagcccagcgcucug

SEQ ID NO: 2902229 - RNA, 20 nt, Human
ccuagcccagcgcucugccu

SEQ ID NO: 2902230 - RNA, 23 nt, Human
ccuagcccagcgcucugccucac

SEQ ID NO: 2902231 - RNA, 11 nt, Human
ccuagcccagg

SEQ ID NO: 2902232 - RNA, 13 nt, Human
ccuagcccaggag

SEQ ID NO: 2902233 - RNA, 15 nt, Human
ccuagcccaggagag

SEQ ID NO: 2902234 - RNA, 19 nt, Human
ccuagccuuagaagucaca

SEQ ID NO: 2902235 - RNA, 22 nt, Human
ccuagccuuagaagucacacag

SEQ ID NO: 2902236 - RNA, 16 nt, Human
ccuaauuaccagucuu

SEQ ID NO: 2902237 - RNA, 17 nt, Human
ccuagccuguuucuucc

SEQ ID NO: 2902238 - RNA, 11 nt, Human
ccggccagcca

SEQ ID NO: 2902239 - RNA, 14 nt, Human
ccggccagccagcc

SEQ ID NO: 2902240 - RNA, 17 nt, Human
ccggccagccagccacu

SEQ ID NO: 2902241 - RNA, 18 nt, Human
ccggccagccagccacuc

SEQ ID NO: 2902242 - RNA, 14 nt, Human
ccgguguucuaaga

SEQ ID NO: 2902243 - RNA, 15 nt, Human
ccgguguucuaagau

SEQ ID NO: 2902244 - RNA, 11 nt, Human
ccggcaggccc

SEQ ID NO: 2902245 - RNA, 12 nt, Human
ccggcaggcccu

SEQ ID NO: 2902246 - RNA, 13 nt, Human
ccggcaggcccug

SEQ ID NO: 2902247 - RNA, 14 nt, Human
ccggcaggcccugc

SEQ ID NO: 2902248 - RNA, 15 nt, Human
ccggcaggcccugca

SEQ ID NO: 2902249 - RNA, 16 nt, Human
ccggcaggcccugcag

SEQ ID NO: 2902250 - RNA, 17 nt, Human
ccggcaggcccugcagu

SEQ ID NO: 2902251 - RNA, 18 nt, Human
ccggcaggcccugcagug

SEQ ID NO: 2902252 - RNA, 20 nt, Human
ccggcaggcccugcaguguu

SEQ ID NO: 2902253 - RNA, 21 nt, Human
ccggcaggcccugcaguguuc

SEQ ID NO: 2902254 - RNA, 15 nt, Human
ccgucuguccaucug

SEQ ID NO: 2902255 - RNA, 16 nt, Human
ccgucuguccaucugc

SEQ ID NO: 2902256 - RNA, 22 nt, Human
ccgucuguccaucugcccgccu

SEQ ID NO: 2902257 - RNA, 11 nt, Human
ccguccucacc

SEQ ID NO: 2902258 - RNA, 14 nt, Human
ccguccucaccccu

SEQ ID NO: 2902259 - RNA, 16 nt, Human
ccguccucaccccugu

SEQ ID NO: 2902260 - RNA, 19 nt, Human
ccguccucaccccuguccu

SEQ ID NO: 2902261 - RNA, 20 nt, Human
ccguccucaccccuguccuc

SEQ ID NO: 2902262 - RNA, 23 nt, Human
ccguccucaccccuguccucacu

SEQ ID NO: 2902263 - RNA, 24 nt, Human
ccguccucaccccuguccucacug

SEQ ID NO: 2902264 - RNA, 14 nt, Human
ccgucccccucugg

SEQ ID NO: 2902265 - RNA, 18 nt, Human
ccguccaggagccugugc

SEQ ID NO: 2902266 - RNA, 15 nt, Human
ccgguuucuuuuuaa

SEQ ID NO: 2902267 - RNA, 19 nt, Human
ccguaauaacacccuuccu

SEQ ID NO: 2902268 - RNA, 20 nt, Human
ccguaauaacacccuuccuu

SEQ ID NO: 2902269 - RNA, 17 nt, Human
ccguaauaauuauuauu

SEQ ID NO: 2902270 - RNA, 21 nt, Human
ccguaaacacgccugcaaacg

SEQ ID NO: 2902271 - RNA, 18 nt, Human
ccguacauucaauguuua

SEQ ID NO: 2902272 - RNA, 16 nt, Human
cccuuuuuuguccccc

SEQ ID NO: 2902273 - RNA, 17 nt, Human
cccuuuuuuguccccca

SEQ ID NO: 2902274 - RNA, 18 nt, Human
cccuuuuuugucccccaa

SEQ ID NO: 2902275 - RNA, 19 nt, Human
cccuuuuuugucccccaac

SEQ ID NO: 2902276 - RNA, 21 nt, Human
cccuuuuuugucccccaacuu

SEQ ID NO: 2902277 - RNA, 21 nt, Human
cccuuuuuuuccuuuuucuga

SEQ ID NO: 2902278 - RNA, 23 nt, Human
cccuuuuuuuccuuuuucugauu

SEQ ID NO: 2902279 - RNA, 14 nt, Human
ccgacaggcccugg

SEQ ID NO: 2902280 - RNA, 15 nt, Human
ccgacaggcccuggc

SEQ ID NO: 2902281 - RNA, 15 nt, Human
ccgacagccuggcac

SEQ ID NO: 2902282 - RNA, 22 nt, Human
ccgacagccuggcacagggcag

SEQ ID NO: 2902283 - RNA, 13 nt, Human
ccgacagccuggc

SEQ ID NO: 2902284 - RNA, 14 nt, Human
ccgacagccuggca

SEQ ID NO: 2902285 - RNA, 12 nt, Human
ccgacagccugg

SEQ ID NO: 2902286 - RNA, 18 nt, Human
ccgaagaauggagaggaa

SEQ ID NO: 2902287 - RNA, 23 nt, Human
ccgaacaucaccgacgcgucucc

SEQ ID NO: 2902288 - RNA, 15 nt, Human
ccgaacacccucgaa

SEQ ID NO: 2902289 - RNA, 18 nt, Human
cccuccuuguccacccac

SEQ ID NO: 2902290 - RNA, 14 nt, Human
cccuccuuucacca

SEQ ID NO: 2902291 - RNA, 12 nt, Human
cccuccuucaga

SEQ ID NO: 2902292 - RNA, 19 nt, Human
cccuccugugcugggggaa

SEQ ID NO: 2902293 - RNA, 23 nt, Human
cccuccugugcugggggaaugag

SEQ ID NO: 2902294 - RNA, 23 nt, Human
cccugugaguuuguacagucuug

SEQ ID NO: 2902295 - RNA, 16 nt, Human
cccuguggagacuggg

SEQ ID NO: 2902296 - RNA, 21 nt, Human
cccuguggaugagcccucaga

SEQ ID NO: 2902297 - RNA, 20 nt, Human
cccuguggaugagcccucag

SEQ ID NO: 2902298 - RNA, 23 nt, Human
cccuguggaugagcccucagaac

SEQ ID NO: 2902299 - RNA, 22 nt, Human
cccuguggaugagcccucagaa

SEQ ID NO: 2902300 - RNA, 23 nt, Human
cccuucucauuccaacagugagu

SEQ ID NO: 2902301 - RNA, 14 nt, Human
cccuguggcccugg

SEQ ID NO: 2902302 - RNA, 15 nt, Human
cccuguggcccuggc

SEQ ID NO: 2902303 - RNA, 12 nt, Human
cccugugggacc

SEQ ID NO: 2902304 - RNA, 16 nt, Human
cccugugggaccccag

SEQ ID NO: 2902305 - RNA, 17 nt, Human
cccugugggaccccagg

SEQ ID NO: 2902306 - RNA, 18 nt, Human
cccugugggaccccaggc

SEQ ID NO: 2902307 - RNA, 19 nt, Human
cccugugggaccccaggcc

SEQ ID NO: 2902308 - RNA, 13 nt, Human
cccuucucacagc

SEQ ID NO: 2902309 - RNA, 15 nt, Human
cccuucucacagcac

SEQ ID NO: 2902310 - RNA, 19 nt, Human
cccuucucacagcacaugc

SEQ ID NO: 2902311 - RNA, 15 nt, Human
ccgcagaccucugga

SEQ ID NO: 2902312 - RNA, 13 nt, Human
ccugucuccuuuc

SEQ ID NO: 2902313 - RNA, 23 nt, Human
ccugucuccuuucaccccagggc

SEQ ID NO: 2902314 - RNA, 20 nt, Human
ccugucucauccccaggggu

SEQ ID NO: 2902315 - RNA, 15 nt, Human
ccugucuccacugug

SEQ ID NO: 2902316 - RNA, 16 nt, Human
ccugucuccacugugc

SEQ ID NO: 2902317 - RNA, 23 nt, Human
ccugucuccacugugccuuugca

SEQ ID NO: 2902318 - RNA, 18 nt, Human
ccugucucauccccaggg

SEQ ID NO: 2902319 - RNA, 19 nt, Human
ccuguaacauacuggccug

SEQ ID NO: 2902320 - RNA, 23 nt, Human
ccuguaacauacuggccuggacu

SEQ ID NO: 2902321 - RNA, 22 nt, Human
ccugguuuccugcccugggagg

SEQ ID NO: 2902322 - RNA, 22 nt, Human
ccugguuuuuaaauagaguuug

SEQ ID NO: 2902323 - RNA, 12 nt, Human
ccugcugcaggg

SEQ ID NO: 2902324 - RNA, 13 nt, Human
ccugcugcagggg

SEQ ID NO: 2902325 - RNA, 12 nt, Human
ccuggaugucug

SEQ ID NO: 2902326 - RNA, 17 nt, Human
ccuggaugucugaacuu

SEQ ID NO: 2902327 - RNA, 18 nt, Human
ccuggaugucugaacuuu

SEQ ID NO: 2902328 - RNA, 17 nt, Human
ccuggauguugugugua

SEQ ID NO: 2902329 - RNA, 12 nt, Human
ccuggauguuug

SEQ ID NO: 2902330 - RNA, 14 nt, Human
ccuggauuucuggu

SEQ ID NO: 2902331 - RNA, 21 nt, Human
ccuggauuucugguucugaug

SEQ ID NO: 2902332 - RNA, 12 nt, Human
ccuggcacacau

SEQ ID NO: 2902333 - RNA, 13 nt, Human
ccuggcacacauc

SEQ ID NO: 2902334 - RNA, 15 nt, Human
ccuggcacacaucag

SEQ ID NO: 2902335 - RNA, 22 nt, Human
ccuggccucaagugauucuccu

SEQ ID NO: 2902336 - RNA, 14 nt, Human
ccuggccccucgcc

SEQ ID NO: 2902337 - RNA, 15 nt, Human
ccuggccccucgccu

SEQ ID NO: 2902338 - RNA, 17 nt, Human
ccuggccccucgccugu

SEQ ID NO: 2902339 - RNA, 13 nt, Human
ccuggccucagac

SEQ ID NO: 2902340 - RNA, 15 nt, Human
ccuggccucagacug

SEQ ID NO: 2902341 - RNA, 16 nt, Human
ccuggccucagacugc

SEQ ID NO: 2902342 - RNA, 20 nt, Human
ccuggccucagacugcaccc

SEQ ID NO: 2902343 - RNA, 22 nt, Human
ccuggccucagacugcacccag

SEQ ID NO: 2902344 - RNA, 23 nt, Human
ccuggccucagacugcacccagg

SEQ ID NO: 2902345 - RNA, 11 nt, Human
ccuggccucca

SEQ ID NO: 2902346 - RNA, 13 nt, Human
ccuggccuccagg

SEQ ID NO: 2902347 - RNA, 14 nt, Human
ccuggccuccaggc

SEQ ID NO: 2902348 - RNA, 15 nt, Human
ccuggccuccaggcc

SEQ ID NO: 2902349 - RNA, 16 nt, Human
ccuggccuccaggccc

SEQ ID NO: 2902350 - RNA, 17 nt, Human
ccuggccuccaggcccg

SEQ ID NO: 2902351 - RNA, 18 nt, Human
ccuggccuccaggcccgu

SEQ ID NO: 2902352 - RNA, 19 nt, Human
ccuggccuccaggcccguc

SEQ ID NO: 2902353 - RNA, 12 nt, Human
ccuggccuggca

SEQ ID NO: 2902354 - RNA, 13 nt, Human
ccuggccuggcac

SEQ ID NO: 2902355 - RNA, 19 nt, Human
ccugguggcagugggagcu

SEQ ID NO: 2902356 - RNA, 18 nt, Human
ccugguggcagugggagc

SEQ ID NO: 2902357 - RNA, 14 nt, Human
ccuggggcugcugg

SEQ ID NO: 2902358 - RNA, 18 nt, Human
ccuggggcucugugcagg

SEQ ID NO: 2902359 - RNA, 15 nt, Human
ccuggggcucugugc

SEQ ID NO: 2902360 - RNA, 15 nt, Human
ccuggggcugcuggc

SEQ ID NO: 2902361 - RNA, 15 nt, Human
ccugguggcaguggg

SEQ ID NO: 2902362 - RNA, 17 nt, Human
ccuggggcugcuggccu

SEQ ID NO: 2902363 - RNA, 20 nt, Human
ccugguggcagugggagcug

SEQ ID NO: 2902364 - RNA, 12 nt, Human
ccuggugucacc

SEQ ID NO: 2902365 - RNA, 13 nt, Human
ccuggugucaccc

SEQ ID NO: 2902366 - RNA, 16 nt, Human
ccuggugucaccccag

SEQ ID NO: 2902367 - RNA, 17 nt, Human
ccuggugucaccccaga

SEQ ID NO: 2902368 - RNA, 18 nt, Human
ccuggugucaccccagag

SEQ ID NO: 2902369 - RNA, 19 nt, Human
ccuggugucaccccagagc

SEQ ID NO: 2902370 - RNA, 20 nt, Human
ccuggugucaccccagagcc

SEQ ID NO: 2902371 - RNA, 21 nt, Human
ccuggugucaccccagagcca

SEQ ID NO: 2902372 - RNA, 23 nt, Human
ccuggugucaccccagagccaca

SEQ ID NO: 2902373 - RNA, 13 nt, Human
ccugguucccguu

SEQ ID NO: 2902374 - RNA, 16 nt, Human
ccugguuuccugcccu

SEQ ID NO: 2902375 - RNA, 22 nt, Human
ccugguucccguuucuccaccu

SEQ ID NO: 2902376 - RNA, 21 nt, Human
ccugguuuccugcccugggag

SEQ ID NO: 2902377 - RNA, 20 nt, Human
ccugguuuccugcccuggga

SEQ ID NO: 2902378 - RNA, 19 nt, Human
ccugguuuccugcccuggg

SEQ ID NO: 2902379 - RNA, 18 nt, Human
ccugguuuccugcccugg

SEQ ID NO: 2902380 - RNA, 15 nt, Human
ccuggggagaaagua

SEQ ID NO: 2902381 - RNA, 12 nt, Human
ccuggggaccca

SEQ ID NO: 2902382 - RNA, 13 nt, Human
ccuggggacccac

SEQ ID NO: 2902383 - RNA, 17 nt, Human
ccuggggacccacgugg

SEQ ID NO: 2902384 - RNA, 13 nt, Human
ccuggggcacagu

SEQ ID NO: 2902385 - RNA, 14 nt, Human
ccuggggcacaguc

SEQ ID NO: 2902386 - RNA, 22 nt, Human
ccuggggcacaguccaggaaca

SEQ ID NO: 2902387 - RNA, 18 nt, Human
ccuggggaaccugacccc

SEQ ID NO: 2902388 - RNA, 24 nt, Human
ccugggcucugccccagcucuggc

SEQ ID NO: 2902389 - RNA, 22 nt, Human
ccugggcucugccccagcucug

SEQ ID NO: 2902390 - RNA, 20 nt, Human
ccugggcucugccccagcuc

SEQ ID NO: 2902391 - RNA, 14 nt, Human
ccugggcucugccc

SEQ ID NO: 2902392 - RNA, 12 nt, Human
ccugggcucugc

SEQ ID NO: 2902393 - RNA, 22 nt, Human
ccugggcucggaggcugccccc

SEQ ID NO: 2902394 - RNA, 16 nt, Human
ccugggcucggaggcu

SEQ ID NO: 2902395 - RNA, 18 nt, Human
ccugggcucggaggcugc

SEQ ID NO: 2902396 - RNA, 19 nt, Human
ccugggcucggaggcugcc

SEQ ID NO: 2902397 - RNA, 21 nt, Human
ccugggcucggaggcugcccc

SEQ ID NO: 2902398 - RNA, 14 nt, Human
ccugggcucggagg

SEQ ID NO: 2902399 - RNA, 15 nt, Human
ccugggcucggaggc

SEQ ID NO: 2902400 - RNA, 15 nt, Human
ccuggccuggcacac

SEQ ID NO: 2902401 - RNA, 16 nt, Human
ccuggccuggcacaca

SEQ ID NO: 2902402 - RNA, 19 nt, Human
ccuggccuggcacacauca

SEQ ID NO: 2902403 - RNA, 13 nt, Human
ccuggccuggccc

SEQ ID NO: 2902404 - RNA, 14 nt, Human
ccuggccuggcccu

SEQ ID NO: 2902405 - RNA, 15 nt, Human
ccuggccuggcccug

SEQ ID NO: 2902406 - RNA, 16 nt, Human
ccuggccuggcccugc

SEQ ID NO: 2902407 - RNA, 17 nt, Human
ccuggccuggcccugcc

SEQ ID NO: 2902408 - RNA, 18 nt, Human
ccuggccuggcccugccc

SEQ ID NO: 2902409 - RNA, 20 nt, Human
ccuggccuggcccugcccug

SEQ ID NO: 2902410 - RNA, 22 nt, Human
ccuggccuggcccugcccugag

SEQ ID NO: 2902411 - RNA, 15 nt, Human
ccuggccuuccuguc

SEQ ID NO: 2902412 - RNA, 22 nt, Human
ccucggccucccaaagugcugg

SEQ ID NO: 2902413 - RNA, 12 nt, Human
ccucuuucucuc

SEQ ID NO: 2902414 - RNA, 13 nt, Human
ccucuuucucucc

SEQ ID NO: 2902415 - RNA, 15 nt, Human
ccucuuucucucccc

SEQ ID NO: 2902416 - RNA, 18 nt, Human
ccucuuucucuccccaac

SEQ ID NO: 2902417 - RNA, 21 nt, Human
ccucuuucucuccccaacccc

SEQ ID NO: 2902418 - RNA, 12 nt, Human
ccucuuucucuu

SEQ ID NO: 2902419 - RNA, 13 nt, Human
ccucuuucucuuu

SEQ ID NO: 2902420 - RNA, 18 nt, Human
ccucuuucucuuucuucc

SEQ ID NO: 2902421 - RNA, 20 nt, Human
ccucuuucucuuucuuccuu

SEQ ID NO: 2902422 - RNA, 21 nt, Human
ccucuuucucuuucuuccuuu

SEQ ID NO: 2902423 - RNA, 15 nt, Human
ccucuuucuuauaau

SEQ ID NO: 2902424 - RNA, 12 nt, Human
ccucuugcuguc

SEQ ID NO: 2902425 - RNA, 13 nt, Human
ccucuugcugucu

SEQ ID NO: 2902426 - RNA, 14 nt, Human
ccucuugcugucuc

SEQ ID NO: 2902427 - RNA, 15 nt, Human
ccucuugcugucucu

SEQ ID NO: 2902428 - RNA, 16 nt, Human
ccucuugcugucucug

SEQ ID NO: 2902429 - RNA, 23 nt, Human
ccucuugccacugccucuuccuc

SEQ ID NO: 2902430 - RNA, 22 nt, Human
ccucuugccacugccucuuccu

SEQ ID NO: 2902431 - RNA, 14 nt, Human
ccucuugccacugc

SEQ ID NO: 2902432 - RNA, 20 nt, Human
ccugcaggaccugccuguag

SEQ ID NO: 2902433 - RNA, 19 nt, Human
ccugcaggaccugccugua

SEQ ID NO: 2902434 - RNA, 17 nt, Human
ccugauaaagcacagcu

SEQ ID NO: 2902435 - RNA, 18 nt, Human
ccugauaaagcacagcug

SEQ ID NO: 2902436 - RNA, 23 nt, Human
ccugaguuuccuuuucugucucu

SEQ ID NO: 2902437 - RNA, 20 nt, Human
ccugauaaaacaacagcucg

SEQ ID NO: 2902438 - RNA, 14 nt, Human
ccugauaugauuua

SEQ ID NO: 2902439 - RNA, 18 nt, Human
ccugcaggaccugccugu

SEQ ID NO: 2902440 - RNA, 19 nt, Human
ccugauaugauuuaaaaca

SEQ ID NO: 2902441 - RNA, 20 nt, Human
ccugauaugauuuaaaacau

SEQ ID NO: 2902442 - RNA, 12 nt, Human
ccugacccgucu

SEQ ID NO: 2902443 - RNA, 18 nt, Human
ccugaccccucauagccc

SEQ ID NO: 2902444 - RNA, 22 nt, Human
ccugacccgucuaauauauaaa

SEQ ID NO: 2902445 - RNA, 23 nt, Human
ccugagcaacagagugagacccu

SEQ ID NO: 2902446 - RNA, 21 nt, Human
ccugagcaacagagugagacc

SEQ ID NO: 2902447 - RNA, 23 nt, Human
ccugaggucgggaguuggagacc

SEQ ID NO: 2902448 - RNA, 14 nt, Human
ccugaggucaggga

SEQ ID NO: 2902449 - RNA, 20 nt, Human
ccugaggucagggagugcug

SEQ ID NO: 2902450 - RNA, 22 nt, Human
ccugaggucagggagugcuggc

SEQ ID NO: 2902451 - RNA, 20 nt, Human
ccugaggugaaagggagcua

SEQ ID NO: 2902452 - RNA, 14 nt, Human
ccugagguguacca

SEQ ID NO: 2902453 - RNA, 22 nt, Human
ccugagggcagaaagguucugc

SEQ ID NO: 2902454 - RNA, 16 nt, Human
ccugagggaggaccug

SEQ ID NO: 2902455 - RNA, 17 nt, Human
ccugagggaggaccugg

SEQ ID NO: 2902456 - RNA, 18 nt, Human
ccugagggaggaccuggg

SEQ ID NO: 2902457 - RNA, 21 nt, Human
ccugagggaggaccuggggca

SEQ ID NO: 2902458 - RNA, 22 nt, Human
ccugagggaggaccuggggcac

SEQ ID NO: 2902459 - RNA, 23 nt, Human
ccugagggaggaccuggggcaca

SEQ ID NO: 2902460 - RNA, 22 nt, Human
ccugaggcuuuggauuugacau

SEQ ID NO: 2902461 - RNA, 20 nt, Human
ccugaggcuuuggauuugac

SEQ ID NO: 2902462 - RNA, 23 nt, Human
ccugagggcagaaagguucugcc

SEQ ID NO: 2902463 - RNA, 19 nt, Human
ccugaggguccccaccugg

SEQ ID NO: 2902464 - RNA, 13 nt, Human
ccugagggucccc

SEQ ID NO: 2902465 - RNA, 23 nt, Human
ccugccauuugcacccuccgccu

SEQ ID NO: 2902466 - RNA, 16 nt, Human
ccugcccaagcccagg

SEQ ID NO: 2902467 - RNA, 17 nt, Human
ccugcccaagcccaggc

SEQ ID NO: 2902468 - RNA, 18 nt, Human
ccugcccaagcccaggcc

SEQ ID NO: 2902469 - RNA, 17 nt, Human
ccugccauuugcacccu

SEQ ID NO: 2902470 - RNA, 19 nt, Human
ccugccauguaccuccccu

SEQ ID NO: 2902471 - RNA, 21 nt, Human
ccugccauguaccuccccugc

SEQ ID NO: 2902472 - RNA, 23 nt, Human
ccugccauguaccuccccugccu

SEQ ID NO: 2902473 - RNA, 14 nt, Human
ccugccauuuaaaa

SEQ ID NO: 2902474 - RNA, 18 nt, Human
ccugccauuuaaaaaguu

SEQ ID NO: 2902475 - RNA, 16 nt, Human
ccugccaugcaagaac

SEQ ID NO: 2902476 - RNA, 15 nt, Human
ccugccaugccagga

SEQ ID NO: 2902477 - RNA, 19 nt, Human
ccugcccaggccccugcca

SEQ ID NO: 2902478 - RNA, 18 nt, Human
ccugcccaggccccugcc

SEQ ID NO: 2902479 - RNA, 14 nt, Human
ccugcccacacagg

SEQ ID NO: 2902480 - RNA, 23 nt, Human
ccugcccaaugagacucuagggu

SEQ ID NO: 2902481 - RNA, 19 nt, Human
ccugccaugccaggaaccu

SEQ ID NO: 2902482 - RNA, 21 nt, Human
ccugcccaggccccugccacc

SEQ ID NO: 2902483 - RNA, 15 nt, Human
ccugccucagccucc

SEQ ID NO: 2902484 - RNA, 16 nt, Human
ccugccucagccuccc

SEQ ID NO: 2902485 - RNA, 19 nt, Human
ccugccucagccucccgag

SEQ ID NO: 2902486 - RNA, 17 nt, Human
ccugccucagccucccg

SEQ ID NO: 2902487 - RNA, 22 nt, Human
ccugcccacacagguucacgug

SEQ ID NO: 2902488 - RNA, 20 nt, Human
ccugcugagucccaggcuga

SEQ ID NO: 2902489 - RNA, 19 nt, Human
ccugcugagucccaggcug

SEQ ID NO: 2902490 - RNA, 15 nt, Human
ccugcugagucccag

SEQ ID NO: 2902491 - RNA, 18 nt, Human
ccugcugagucccaggcu

SEQ ID NO: 2902492 - RNA, 20 nt, Human
cccaacuacuaucucagaga

SEQ ID NO: 2902493 - RNA, 20 nt, Human
cccaacuaauuuuuguauuu

SEQ ID NO: 2902494 - RNA, 18 nt, Human
cccaagacagaugcccca

SEQ ID NO: 2902495 - RNA, 20 nt, Human
cccaacuccaccagauagca

SEQ ID NO: 2902496 - RNA, 20 nt, Human
cccaagacuucauugucccu

SEQ ID NO: 2902497 - RNA, 21 nt, Human
cccaagagaaggggaagcacu

SEQ ID NO: 2902498 - RNA, 21 nt, Human
cccaagacagaugccccagag

SEQ ID NO: 2902499 - RNA, 17 nt, Human
cccaagaccuaaggguu

SEQ ID NO: 2902500 - RNA, 20 nt, Human
cccaagacagaugccccaga

SEQ ID NO: 2902501 - RNA, 19 nt, Human
cccaagacagaugccccag

SEQ ID NO: 2902502 - RNA, 15 nt, Human
cccaagcucugcucc

SEQ ID NO: 2902503 - RNA, 15 nt, Human
cccacccacauguga

SEQ ID NO: 2902504 - RNA, 14 nt, Human
cccacccacaugug

SEQ ID NO: 2902505 - RNA, 12 nt, Human
cccaccccacac

SEQ ID NO: 2902506 - RNA, 13 nt, Human
cccacccagucuc

SEQ ID NO: 2902507 - RNA, 16 nt, Human
cccacccagucucugc

SEQ ID NO: 2902508 - RNA, 20 nt, Human
cccacccagucucugcucca

SEQ ID NO: 2902509 - RNA, 12 nt, Human
cccacccaggag

SEQ ID NO: 2902510 - RNA, 13 nt, Human
cccacccaggagg

SEQ ID NO: 2902511 - RNA, 12 nt, Human
cccaagcucugc

SEQ ID NO: 2902512 - RNA, 23 nt, Human
cccaagaggucaaggcugcagug

SEQ ID NO: 2902513 - RNA, 14 nt, Human
cccaagcucugcuc

SEQ ID NO: 2902514 - RNA, 13 nt, Human
cccaagcucugcu

SEQ ID NO: 2902515 - RNA, 22 nt, Human
cccacugcuuuuggucugugug

SEQ ID NO: 2902516 - RNA, 23 nt, Human
cccacugcuuuuggucuguguga

SEQ ID NO: 2902517 - RNA, 16 nt, Human
cccacugacagccucc

SEQ ID NO: 2902518 - RNA, 15 nt, Human
cccacugcaauccug

SEQ ID NO: 2902519 - RNA, 18 nt, Human
cccacugcaauccugucu

SEQ ID NO: 2902520 - RNA, 12 nt, Human
cccacugaugcu

SEQ ID NO: 2902521 - RNA, 22 nt, Human
cccacugaugcuguucucuucu

SEQ ID NO: 2902522 - RNA, 15 nt, Human
cccacucuccccaca

SEQ ID NO: 2902523 - RNA, 14 nt, Human
cccacucuccccac

SEQ ID NO: 2902524 - RNA, 11 nt, Human
cccacucuccc

SEQ ID NO: 2902525 - RNA, 17 nt, Human
cccacucuccccacacu

SEQ ID NO: 2902526 - RNA, 14 nt, Human
cccacccucccugg

SEQ ID NO: 2902527 - RNA, 13 nt, Human
cccaccccucccu

SEQ ID NO: 2902528 - RNA, 11 nt, Human
cccaccccugc

SEQ ID NO: 2902529 - RNA, 15 nt, Human
cccaccccaccugca

SEQ ID NO: 2902530 - RNA, 16 nt, Human
cccaccccaccugcag

SEQ ID NO: 2902531 - RNA, 14 nt, Human
cccaccccacacuu

SEQ ID NO: 2902532 - RNA, 13 nt, Human
cccaccccacacu

SEQ ID NO: 2902533 - RNA, 22 nt, Human
ccauuuccauguccccucccag

SEQ ID NO: 2902534 - RNA, 22 nt, Human
ccauuucauuugugccagaaug

SEQ ID NO: 2902535 - RNA, 21 nt, Human
ccauuucauuugugccagaau

SEQ ID NO: 2902536 - RNA, 12 nt, Human
ccauuuauuuau

SEQ ID NO: 2902537 - RNA, 17 nt, Human
ccauuucaauucucaaa

SEQ ID NO: 2902538 - RNA, 20 nt, Human
ccauuuaugugagugugugu

SEQ ID NO: 2902539 - RNA, 13 nt, Human
ccauuucagagag

SEQ ID NO: 2902540 - RNA, 19 nt, Human
ccauuucauauucuuucaa

SEQ ID NO: 2902541 - RNA, 19 nt, Human
ccauugcuguucuacuuuu

SEQ ID NO: 2902542 - RNA, 20 nt, Human
ccauugcuguucuacuuuuu

SEQ ID NO: 2902543 - RNA, 17 nt, Human
ccauugccuagcucuuu

SEQ ID NO: 2902544 - RNA, 21 nt, Human
ccauugccaccaggagaacca

SEQ ID NO: 2902545 - RNA, 17 nt, Human
ccauugccaccaggaga

SEQ ID NO: 2902546 - RNA, 16 nt, Human
ccauugccaccaggag

SEQ ID NO: 2902547 - RNA, 15 nt, Human
ccauugccaccagga

SEQ ID NO: 2902548 - RNA, 19 nt, Human
ccauugcacuccagccugg

SEQ ID NO: 2902549 - RNA, 20 nt, Human
ccauugcacuccagccuggg

SEQ ID NO: 2902550 - RNA, 20 nt, Human
ccauugcaucaccucuguaa

SEQ ID NO: 2902551 - RNA, 13 nt, Human
ccauugcacccag

SEQ ID NO: 2902552 - RNA, 16 nt, Human
ccauugcacccagccc

SEQ ID NO: 2902553 - RNA, 20 nt, Human
ccauucuuccuaguuuucuc

SEQ ID NO: 2902554 - RNA, 22 nt, Human
ccauucuggauuuugucaagca

SEQ ID NO: 2902555 - RNA, 22 nt, Human
ccauucuuacuuacuaaaauau

SEQ ID NO: 2902556 - RNA, 23 nt, Human
ccauucuuacuuacuaaaauaua

SEQ ID NO: 2902557 - RNA, 19 nt, Human
ccauucuuccuaguuuucu

SEQ ID NO: 2902558 - RNA, 14 nt, Human
ccauucuuccuagu

SEQ ID NO: 2902559 - RNA, 16 nt, Human
ccaucccuccccaguu

SEQ ID NO: 2902560 - RNA, 21 nt, Human
ccauccauaaauccaguucua

SEQ ID NO: 2902561 - RNA, 19 nt, Human
ccauccagguucagcuugu

SEQ ID NO: 2902562 - RNA, 18 nt, Human
ccauccagguucagcuug

SEQ ID NO: 2902563 - RNA, 14 nt, Human
ccauaaucuggacu

SEQ ID NO: 2902564 - RNA, 21 nt, Human
ccauaaucuggacuccucugu

SEQ ID NO: 2902565 - RNA, 21 nt, Human
ccauaaugcuacugucucacu

SEQ ID NO: 2902566 - RNA, 23 nt, Human
ccauaaugcuaauuuaaagagac

SEQ ID NO: 2902567 - RNA, 20 nt, Human
ccauaagguuucguuucugu

SEQ ID NO: 2902568 - RNA, 22 nt, Human
ccauaagguuucguuucuguau

SEQ ID NO: 2902569 - RNA, 12 nt, Human
ccauaauacaaa

SEQ ID NO: 2902570 - RNA, 14 nt, Human
ccauaauacaaaag

SEQ ID NO: 2902571 - RNA, 23 nt, Human
ccaguuggguggaugccuggugg

SEQ ID NO: 2902572 - RNA, 17 nt, Human
ccaguugaauaaaagug

SEQ ID NO: 2902573 - RNA, 18 nt, Human
ccaguugaauaaaagugc

SEQ ID NO: 2902574 - RNA, 18 nt, Human
ccaguucgccuggagccc

SEQ ID NO: 2902575 - RNA, 19 nt, Human
ccaguucgccuggagcccu

SEQ ID NO: 2902576 - RNA, 20 nt, Human
ccaguucgccuggagcccuc

SEQ ID NO: 2902577 - RNA, 17 nt, Human
ccaugaggaaggaacag

SEQ ID NO: 2902578 - RNA, 22 nt, Human
ccaugaggagaaaaaaagcaug

SEQ ID NO: 2902579 - RNA, 23 nt, Human
ccaugaggagaaaaaaagcaugu

SEQ ID NO: 2902580 - RNA, 17 nt, Human
ccaugaguccuugaaaa

SEQ ID NO: 2902581 - RNA, 18 nt, Human
ccaugaguuugcccuggu

SEQ ID NO: 2902582 - RNA, 17 nt, Human
ccaugaguuugcccugg

SEQ ID NO: 2902583 - RNA, 22 nt, Human
ccauguagcccccuggccucug

SEQ ID NO: 2902584 - RNA, 23 nt, Human
ccauguagcccccuggccucugu

SEQ ID NO: 2902585 - RNA, 17 nt, Human
ccauguauaaaugugau

SEQ ID NO: 2902586 - RNA, 23 nt, Human
ccauguccaaagaggcugccccu

SEQ ID NO: 2902587 - RNA, 20 nt, Human
ccauguccaaagaggcugcc

SEQ ID NO: 2902588 - RNA, 12 nt, Human
ccaugucgccuc

SEQ ID NO: 2902589 - RNA, 16 nt, Human
ccauguccccucccag

SEQ ID NO: 2902590 - RNA, 16 nt, Human
ccauguccuaugugug

SEQ ID NO: 2902591 - RNA, 17 nt, Human
ccauguccuauguguga

SEQ ID NO: 2902592 - RNA, 19 nt, Human
ccauguccuaugugugacu

SEQ ID NO: 2902593 - RNA, 15 nt, Human
ccauguccucagcau

SEQ ID NO: 2902594 - RNA, 15 nt, Human
ccauguccccuccca

SEQ ID NO: 2902595 - RNA, 13 nt, Human
ccauguccccucc

SEQ ID NO: 2902596 - RNA, 15 nt, Human
ccaugucgccucugc

SEQ ID NO: 2902597 - RNA, 16 nt, Human
ccaugucgccucugca

SEQ ID NO: 2902598 - RNA, 17 nt, Human
ccaugucgccucugcau

SEQ ID NO: 2902599 - RNA, 14 nt, Human
ccauguagcccccu

SEQ ID NO: 2902600 - RNA, 20 nt, Human
ccauguagcccccuggccuc

SEQ ID NO: 2902601 - RNA, 14 nt, Human
ccauguagaagcug

SEQ ID NO: 2902602 - RNA, 15 nt, Human
ccauguagaagcugc

SEQ ID NO: 2902603 - RNA, 18 nt, Human
ccauguagaagcugcauc

SEQ ID NO: 2902604 - RNA, 19 nt, Human
ccauguagaagcugcaucu

SEQ ID NO: 2902605 - RNA, 13 nt, Human
ccauguaccuccc

SEQ ID NO: 2902606 - RNA, 14 nt, Human
ccauguaccucccc

SEQ ID NO: 2902607 - RNA, 17 nt, Human
ccauguaccuccccugc

SEQ ID NO: 2902608 - RNA, 19 nt, Human
ccauguaccuccccugccu

SEQ ID NO: 2902609 - RNA, 20 nt, Human
ccauguaccuccccugccuu

SEQ ID NO: 2902610 - RNA, 17 nt, Human
ccauguacuaguuuuag

SEQ ID NO: 2902611 - RNA, 18 nt, Human
ccauccagugacaaacca

SEQ ID NO: 2902612 - RNA, 16 nt, Human
ccagccccucccccau

SEQ ID NO: 2902613 - RNA, 17 nt, Human
ccagccccucccccauc

SEQ ID NO: 2902614 - RNA, 18 nt, Human
ccagccccucccccaucu

SEQ ID NO: 2902615 - RNA, 21 nt, Human
ccagccccucccccaucuccc

SEQ ID NO: 2902616 - RNA, 14 nt, Human
ccagccccuagccc

SEQ ID NO: 2902617 - RNA, 15 nt, Human
ccagccccuagccca

SEQ ID NO: 2902618 - RNA, 16 nt, Human
ccagccccuagcccag

SEQ ID NO: 2902619 - RNA, 17 nt, Human
ccagccccuagcccagg

SEQ ID NO: 2902620 - RNA, 18 nt, Human
ccagccccuagcccagga

SEQ ID NO: 2902621 - RNA, 19 nt, Human
ccagccccuagcccaggag

SEQ ID NO: 2902622 - RNA, 22 nt, Human
ccagccccuagcccaggagaga

SEQ ID NO: 2902623 - RNA, 23 nt, Human
ccagccccuagcccaggagagag

SEQ ID NO: 2902624 - RNA, 15 nt, Human
ccagcuacuuccucc

SEQ ID NO: 2902625 - RNA, 17 nt, Human
ccagcuacuuccuccuc

SEQ ID NO: 2902626 - RNA, 22 nt, Human
ccagcccggccgcuccaccagc

SEQ ID NO: 2902627 - RNA, 14 nt, Human
ccagccccuuucca

SEQ ID NO: 2902628 - RNA, 15 nt, Human
ccagccccuuuccaa

SEQ ID NO: 2902629 - RNA, 17 nt, Human
ccagccccuuuccaaaa

SEQ ID NO: 2902630 - RNA, 13 nt, Human
ccagcccgggagc

SEQ ID NO: 2902631 - RNA, 14 nt, Human
ccagcccgggagcc

SEQ ID NO: 2902632 - RNA, 15 nt, Human
ccagcccgggagccu

SEQ ID NO: 2902633 - RNA, 16 nt, Human
ccagcccgggagccua

SEQ ID NO: 2902634 - RNA, 17 nt, Human
ccagcccgggagccuag

SEQ ID NO: 2902635 - RNA, 14 nt, Human
ccagcucccuagga

SEQ ID NO: 2902636 - RNA, 18 nt, Human
ccagcuuucuccccgcua

SEQ ID NO: 2902637 - RNA, 19 nt, Human
ccagcuauaccugugccuc

SEQ ID NO: 2902638 - RNA, 15 nt, Human
ccagcuauacuguau

SEQ ID NO: 2902639 - RNA, 18 nt, Human
ccagcuauaccugugccu

SEQ ID NO: 2902640 - RNA, 16 nt, Human
ccagcuauaccugugc

SEQ ID NO: 2902641 - RNA, 15 nt, Human
ccagcuauaccugug

SEQ ID NO: 2902642 - RNA, 14 nt, Human
ccagcuauaccugu

SEQ ID NO: 2902643 - RNA, 16 nt, Human
ccagcucauucauuuu

SEQ ID NO: 2902644 - RNA, 17 nt, Human
ccagcucauucauuuua

SEQ ID NO: 2902645 - RNA, 17 nt, Human
ccagccccagugcccac

SEQ ID NO: 2902646 - RNA, 13 nt, Human
ccagccccuagcc

SEQ ID NO: 2902647 - RNA, 12 nt, Human
ccagccccuaga

SEQ ID NO: 2902648 - RNA, 15 nt, Human
ccagccccuagaaac

SEQ ID NO: 2902649 - RNA, 21 nt, Human
ccagccccuagaaacccaagc

SEQ ID NO: 2902650 - RNA, 22 nt, Human
ccagccccuagaaacccaagcu

SEQ ID NO: 2902651 - RNA, 23 nt, Human
ccagccccuagaaacccaagcuc

SEQ ID NO: 2902652 - RNA, 18 nt, Human
ccagccccggcccugggc

SEQ ID NO: 2902653 - RNA, 15 nt, Human
ccagcacuuguauau

SEQ ID NO: 2902654 - RNA, 21 nt, Human
ccacucgcuucccccauagcc

SEQ ID NO: 2902655 - RNA, 18 nt, Human
ccacucgcuucccccaua

SEQ ID NO: 2902656 - RNA, 15 nt, Human
ccacucuaccagugc

SEQ ID NO: 2902657 - RNA, 19 nt, Human
ccacucuaccagugcaggc

SEQ ID NO: 2902658 - RNA, 20 nt, Human
ccacucuaccagugcaggcu

SEQ ID NO: 2902659 - RNA, 23 nt, Human
ccacucuaccagugcaggcuggc

SEQ ID NO: 2902660 - RNA, 16 nt, Human
ccacucgcuuccccca

SEQ ID NO: 2902661 - RNA, 13 nt, Human
ccacucgcuuccc

SEQ ID NO: 2902662 - RNA, 21 nt, Human
ccagcacuuugggaggcugag

SEQ ID NO: 2902663 - RNA, 19 nt, Human
ccagcacuuugggagacca

SEQ ID NO: 2902664 - RNA, 11 nt, Human
ccagcacuuug

SEQ ID NO: 2902665 - RNA, 14 nt, Human
ccagcacuuuggga

SEQ ID NO: 2902666 - RNA, 20 nt, Human
ccagcuuugcuaccaaagca

SEQ ID NO: 2902667 - RNA, 16 nt, Human
ccagcuuuuaaccauc

SEQ ID NO: 2902668 - RNA, 18 nt, Human
ccagcuuuuaaccaucug

SEQ ID NO: 2902669 - RNA, 21 nt, Human
ccagcuuuuaaccaucugaua

SEQ ID NO: 2902670 - RNA, 14 nt, Human
ccaggcaggucuug

SEQ ID NO: 2902671 - RNA, 12 nt, Human
ccaggcaggucu

SEQ ID NO: 2902672 - RNA, 23 nt, Human
ccaggcaggucuugaacuccugg

SEQ ID NO: 2902673 - RNA, 17 nt, Human
ccaggaucccaggggcc

SEQ ID NO: 2902674 - RNA, 19 nt, Human
ccaggcagguagccagggg

SEQ ID NO: 2902675 - RNA, 17 nt, Human
ccaggcaggugccugga

SEQ ID NO: 2902676 - RNA, 13 nt, Human
ccaggcugccaag

SEQ ID NO: 2902677 - RNA, 20 nt, Human
ccaggcugccaaggccagag

SEQ ID NO: 2902678 - RNA, 19 nt, Human
ccaggcugccaaggccaga

SEQ ID NO: 2902679 - RNA, 21 nt, Human
ccaggcugcucuugaacuccu

SEQ ID NO: 2902680 - RNA, 13 nt, Human
ccaggcuggacau

SEQ ID NO: 2902681 - RNA, 18 nt, Human
ccaggcuggacaugcuga

SEQ ID NO: 2902682 - RNA, 21 nt, Human
ccaggcuggacaugcugacug

SEQ ID NO: 2902683 - RNA, 12 nt, Human
ccaggcuggcgu

SEQ ID NO: 2902684 - RNA, 12 nt, Human
ccaggggaaccu

SEQ ID NO: 2902685 - RNA, 17 nt, Human
ccaggggaaccugccau

SEQ ID NO: 2902686 - RNA, 16 nt, Human
ccaggggaaccugcca

SEQ ID NO: 2902687 - RNA, 15 nt, Human
ccaggggaaccugcc

SEQ ID NO: 2902688 - RNA, 13 nt, Human
ccaggggaaccug

SEQ ID NO: 2902689 - RNA, 16 nt, Human
ccaggggaguuguguc

SEQ ID NO: 2902690 - RNA, 18 nt, Human
ccaggggaguugugucug

SEQ ID NO: 2902691 - RNA, 24 nt, Human
ccaggggaaccugccaugccagga

SEQ ID NO: 2902692 - RNA, 18 nt, Human
ccaggaucguuuuuuccc

SEQ ID NO: 2902693 - RNA, 20 nt, Human
ccaggaugagcaucccagga

SEQ ID NO: 2902694 - RNA, 21 nt, Human
ccaggaugauaaguuccuuuc

SEQ ID NO: 2902695 - RNA, 18 nt, Human
ccaggaugcuggguggcc

SEQ ID NO: 2902696 - RNA, 14 nt, Human
ccaggaucauggug

SEQ ID NO: 2902697 - RNA, 14 nt, Human
ccaggaucagccag

SEQ ID NO: 2902698 - RNA, 15 nt, Human
ccaggaucauggugu

SEQ ID NO: 2902699 - RNA, 17 nt, Human
ccaggaucaugguguaa

SEQ ID NO: 2902700 - RNA, 20 nt, Human
ccaggaucaugguguaauaa

SEQ ID NO: 2902701 - RNA, 23 nt, Human
ccaggaucaugguguaauaagac

SEQ ID NO: 2902702 - RNA, 23 nt, Human
ccaggauagugggcaccccacug

SEQ ID NO: 2902703 - RNA, 18 nt, Human
ccaguccaaauguccucc

SEQ ID NO: 2902704 - RNA, 21 nt, Human
ccaguccaaauguccuccaga

SEQ ID NO: 2902705 - RNA, 14 nt, Human
ccaguccaaggaaa

SEQ ID NO: 2902706 - RNA, 18 nt, Human
ccaggggucccagccacc

SEQ ID NO: 2902707 - RNA, 17 nt, Human
ccaggggucccagccac

SEQ ID NO: 2902708 - RNA, 14 nt, Human
ccaggggucccagc

SEQ ID NO: 2902709 - RNA, 18 nt, Human
ccagucccccugccccag

SEQ ID NO: 2902710 - RNA, 22 nt, Human
ccagucccaaugguccugacuu

SEQ ID NO: 2902711 - RNA, 18 nt, Human
ccagucccuguccggaau

SEQ ID NO: 2902712 - RNA, 13 nt, Human
ccagucccugucc

SEQ ID NO: 2902713 - RNA, 22 nt, Human
ccaguccucucccaaguccaca

SEQ ID NO: 2902714 - RNA, 15 nt, Human
cccuccucucugccc

SEQ ID NO: 2902715 - RNA, 16 nt, Human
cccuccucucugcccu

SEQ ID NO: 2902716 - RNA, 20 nt, Human
cccuccugagggaggaccug

SEQ ID NO: 2902717 - RNA, 21 nt, Human
cccuccugagggaggaccugg

SEQ ID NO: 2902718 - RNA, 22 nt, Human
cccuccugagggaggaccuggg

SEQ ID NO: 2902719 - RNA, 23 nt, Human
cccuccugaaccgcacagcucag

SEQ ID NO: 2902720 - RNA, 22 nt, Human
cccuccugaaccgcacagcuca

SEQ ID NO: 2902721 - RNA, 13 nt, Human
cccuccuggcucu

SEQ ID NO: 2902722 - RNA, 16 nt, Human
cccuccuggccucaga

SEQ ID NO: 2902723 - RNA, 19 nt, Human
cccuccuggccucagacug

SEQ ID NO: 2902724 - RNA, 19 nt, Human
cccuccuggugucacccca

SEQ ID NO: 2902725 - RNA, 20 nt, Human
cccuccuggugucaccccag

SEQ ID NO: 2902726 - RNA, 21 nt, Human
cccuccuggugucaccccaga

SEQ ID NO: 2902727 - RNA, 22 nt, Human
cccuccuggugucaccccagag

SEQ ID NO: 2902728 - RNA, 23 nt, Human
cccuccuggugucaccccagagc

SEQ ID NO: 2902729 - RNA, 13 nt, Human
cccuccuggggcc

SEQ ID NO: 2902730 - RNA, 14 nt, Human
cccuccuggggcca

SEQ ID NO: 2902731 - RNA, 16 nt, Human
cccuccuggggccagg

SEQ ID NO: 2902732 - RNA, 17 nt, Human
cccuccuggggccaggc

SEQ ID NO: 2902733 - RNA, 18 nt, Human
cccuccuggggccaggcc

SEQ ID NO: 2902734 - RNA, 19 nt, Human
cccuccuggggccaggccg

SEQ ID NO: 2902735 - RNA, 10 nt, Human
cccuccuggu

SEQ ID NO: 2902736 - RNA, 13 nt, Human
cccuccucaccuc

SEQ ID NO: 2902737 - RNA, 12 nt, Human
cccuccucaccu

SEQ ID NO: 2902738 - RNA, 23 nt, Human
cccuccucaccucuggacuggcu

SEQ ID NO: 2902739 - RNA, 18 nt, Human
cccuccucaccucuggac

SEQ ID NO: 2902740 - RNA, 17 nt, Human
cccuccucaccucugga

SEQ ID NO: 2902741 - RNA, 16 nt, Human
cccuccucaccucugg

SEQ ID NO: 2902742 - RNA, 14 nt, Human
cccuccucacuggc

SEQ ID NO: 2902743 - RNA, 12 nt, Human
cccuccucacug

SEQ ID NO: 2902744 - RNA, 15 nt, Human
cccuccucacuggcc

SEQ ID NO: 2902745 - RNA, 16 nt, Human
cccuccucacuggcca

SEQ ID NO: 2902746 - RNA, 19 nt, Human
cccuccucacuggccaucc

SEQ ID NO: 2902747 - RNA, 21 nt, Human
cccuccucacuggccaucccu

SEQ ID NO: 2902748 - RNA, 21 nt, Human
ccccugcaaagcccagcuuga

SEQ ID NO: 2902749 - RNA, 17 nt, Human
ccccugcaaagcccagc

SEQ ID NO: 2902750 - RNA, 20 nt, Human
ccccugcaaagcccagcuug

SEQ ID NO: 2902751 - RNA, 18 nt, Human
ccccugcaaagcccagcu

SEQ ID NO: 2902752 - RNA, 12 nt, Human
ccccucuuucuc

SEQ ID NO: 2902753 - RNA, 13 nt, Human
ccccucuuucucu

SEQ ID NO: 2902754 - RNA, 14 nt, Human
ccccucuuucucuu

SEQ ID NO: 2902755 - RNA, 16 nt, Human
ccccucuuucucuuuc

SEQ ID NO: 2902756 - RNA, 17 nt, Human
ccccucuuucucuuucu

SEQ ID NO: 2902757 - RNA, 18 nt, Human
ccccucuuucucuuucuu

SEQ ID NO: 2902758 - RNA, 22 nt, Human
ccccucuuucucuuucuuccuu

SEQ ID NO: 2902759 - RNA, 16 nt, Human
ccccucuggcuccagc

SEQ ID NO: 2902760 - RNA, 16 nt, Human
ccccugccacccuggg

SEQ ID NO: 2902761 - RNA, 14 nt, Human
ccccugccacccug

SEQ ID NO: 2902762 - RNA, 18 nt, Human
ccccugccaccucccuga

SEQ ID NO: 2902763 - RNA, 21 nt, Human
ccccugccaccucccugaccc

SEQ ID NO: 2902764 - RNA, 17 nt, Human
ccccugccccccagccu

SEQ ID NO: 2902765 - RNA, 16 nt, Human
ccccucugcugcuguc

SEQ ID NO: 2902766 - RNA, 23 nt, Human
ccccucugcccugcgggucacag

SEQ ID NO: 2902767 - RNA, 20 nt, Human
ccccucugcccugcggguca

SEQ ID NO: 2902768 - RNA, 15 nt, Human
ccccucugcccugcg

SEQ ID NO: 2902769 - RNA, 14 nt, Human
ccccucugcccugc

SEQ ID NO: 2902770 - RNA, 17 nt, Human
cccggcuaauuuuugua

SEQ ID NO: 2902771 - RNA, 16 nt, Human
cccucaaccucuucug

SEQ ID NO: 2902772 - RNA, 15 nt, Human
cccucacccuggggc

SEQ ID NO: 2902773 - RNA, 14 nt, Human
cccucaccuccucu

SEQ ID NO: 2902774 - RNA, 16 nt, Human
cccucacccuggggcu

SEQ ID NO: 2902775 - RNA, 13 nt, Human
cccucaggacugc

SEQ ID NO: 2902776 - RNA, 17 nt, Human
cccucaggacugcaaca

SEQ ID NO: 2902777 - RNA, 13 nt, Human
cccucacucugcc

SEQ ID NO: 2902778 - RNA, 15 nt, Human
cccucacucugccag

SEQ ID NO: 2902779 - RNA, 16 nt, Human
cccucacucugccagg

SEQ ID NO: 2902780 - RNA, 19 nt, Human
cccucagccacacccaggc

SEQ ID NO: 2902781 - RNA, 16 nt, Human
cccucaccuucugagu

SEQ ID NO: 2902782 - RNA, 18 nt, Human
cccgaauagcugggacua

SEQ ID NO: 2902783 - RNA, 17 nt, Human
cccgaauagcugggacu

SEQ ID NO: 2902784 - RNA, 16 nt, Human
cccgaauagcugggac

SEQ ID NO: 2902785 - RNA, 22 nt, Human
ccccuucucugcuccaccacau

SEQ ID NO: 2902786 - RNA, 13 nt, Human
ccccuucucugug

SEQ ID NO: 2902787 - RNA, 15 nt, Human
ccccuucucugugac

SEQ ID NO: 2902788 - RNA, 16 nt, Human
ccccuucucugcucca

SEQ ID NO: 2902789 - RNA, 12 nt, Human
ccccuucucugc

SEQ ID NO: 2902790 - RNA, 14 nt, Human
ccccuucucugcuc

SEQ ID NO: 2902791 - RNA, 13 nt, Human
ccccuucucugcu

SEQ ID NO: 2902792 - RNA, 20 nt, Human
cccggcuaauuuuuguauuu

SEQ ID NO: 2902793 - RNA, 23 nt, Human
cccggcgccccgcaccuguacag

SEQ ID NO: 2902794 - RNA, 16 nt, Human
cccggcgccuggccuc

SEQ ID NO: 2902795 - RNA, 20 nt, Human
cccggcgccuggccuccagg

SEQ ID NO: 2902796 - RNA, 21 nt, Human
cccggcgccuggccuccaggc

SEQ ID NO: 2902797 - RNA, 15 nt, Human
cccggccccugcugg

SEQ ID NO: 2902798 - RNA, 15 nt, Human
cccggcccccugccc

SEQ ID NO: 2902799 - RNA, 12 nt, Human
cccggcccccug

SEQ ID NO: 2902800 - RNA, 16 nt, Human
cccggccccugcuggu

SEQ ID NO: 2902801 - RNA, 17 nt, Human
cccggccgcuccaccag

SEQ ID NO: 2902802 - RNA, 22 nt, Human
cccggcccugggcucggaggcu

SEQ ID NO: 2902803 - RNA, 13 nt, Human
cccggcccccugg

SEQ ID NO: 2902804 - RNA, 21 nt, Human
cccggcccccuggucucuggu

SEQ ID NO: 2902805 - RNA, 22 nt, Human
cccagcaccucagccugcacag

SEQ ID NO: 2902806 - RNA, 14 nt, Human
cccagcaccugccu

SEQ ID NO: 2902807 - RNA, 16 nt, Human
cccagcaccugccucc

SEQ ID NO: 2902808 - RNA, 17 nt, Human
cccagcaccugccuccu

SEQ ID NO: 2902809 - RNA, 18 nt, Human
cccagcaccucagccugc

SEQ ID NO: 2902810 - RNA, 17 nt, Human
cccagcaccucagccug

SEQ ID NO: 2902811 - RNA, 21 nt, Human
cccacugguuccuucuuccug

SEQ ID NO: 2902812 - RNA, 21 nt, Human
cccacugggguccagggagca

SEQ ID NO: 2902813 - RNA, 16 nt, Human
cccacuggacucaccu

SEQ ID NO: 2902814 - RNA, 10 nt, Human
cccagccauu

SEQ ID NO: 2902815 - RNA, 22 nt, Human
cccaucacaggguugggcccag

SEQ ID NO: 2902816 - RNA, 21 nt, Human
cccaucacaggguugggccca

SEQ ID NO: 2902817 - RNA, 20 nt, Human
cccaucacguguacuggcuc

SEQ ID NO: 2902818 - RNA, 21 nt, Human
cccauccccuggacugggagg

SEQ ID NO: 2902819 - RNA, 17 nt, Human
cccaggcugagccucag

SEQ ID NO: 2902820 - RNA, 16 nt, Human
cccaggcugagccuca

SEQ ID NO: 2902821 - RNA, 15 nt, Human
cccaggcugagccuc

SEQ ID NO: 2902822 - RNA, 13 nt, Human
cccaggcuggagu

SEQ ID NO: 2902823 - RNA, 11 nt, Human
cccaggcugga

SEQ ID NO: 2902824 - RNA, 19 nt, Human
cccaggcuggacaugcuga

SEQ ID NO: 2902825 - RNA, 21 nt, Human
cccaggcuggacaugcugacu

SEQ ID NO: 2902826 - RNA, 22 nt, Human
cccaggcuggacaugcugacug

SEQ ID NO: 2902827 - RNA, 18 nt, Human
cccaggcugagccucagu

SEQ ID NO: 2902828 - RNA, 12 nt, Human
cccaucccugcc

SEQ ID NO: 2902829 - RNA, 13 nt, Human
cccaucccugccu

SEQ ID NO: 2902830 - RNA, 14 nt, Human
cccaucccugccug

SEQ ID NO: 2902831 - RNA, 15 nt, Human
cccaucccuccccag

SEQ ID NO: 2902832 - RNA, 16 nt, Human
cccaucccuccccagu

SEQ ID NO: 2902833 - RNA, 15 nt, Human
cccaucccugccugg

SEQ ID NO: 2902834 - RNA, 17 nt, Human
cccaucccugccugguc

SEQ ID NO: 2902835 - RNA, 18 nt, Human
cccaucccugccugguca

SEQ ID NO: 2902836 - RNA, 13 nt, Human
cccaucccugucu

SEQ ID NO: 2902837 - RNA, 16 nt, Human
cccaucccugucuuua

SEQ ID NO: 2902838 - RNA, 14 nt, Human
cccccuugaguggg

SEQ ID NO: 2902839 - RNA, 15 nt, Human
cccccuugccacccc

SEQ ID NO: 2902840 - RNA, 12 nt, Human
cccccuuuccug

SEQ ID NO: 2902841 - RNA, 20 nt, Human
cccccuuuccuggacacuca

SEQ ID NO: 2902842 - RNA, 16 nt, Human
ccccgaagggccccca

SEQ ID NO: 2902843 - RNA, 12 nt, Human
ccccgcagaccu

SEQ ID NO: 2902844 - RNA, 23 nt, Human
ccccgcaccuguacaguggaacc

SEQ ID NO: 2902845 - RNA, 13 nt, Human
ccccgcagaccuc

SEQ ID NO: 2902846 - RNA, 14 nt, Human
ccccgcagaccucc

SEQ ID NO: 2902847 - RNA, 17 nt, Human
ccccgcagaccucccca

SEQ ID NO: 2902848 - RNA, 17 nt, Human
ccccauggcugcacagu

SEQ ID NO: 2902849 - RNA, 24 nt, Human
ccccaugccuguccagccugggca

SEQ ID NO: 2902850 - RNA, 18 nt, Human
ccccaugccuguggcugc

SEQ ID NO: 2902851 - RNA, 15 nt, Human
ccccagcccagggug

SEQ ID NO: 2902852 - RNA, 23 nt, Human
ccccaugccuguccagccugggc

SEQ ID NO: 2902853 - RNA, 22 nt, Human
ccccaugccuguccagccuggg

SEQ ID NO: 2902854 - RNA, 21 nt, Human
ccccaugccuguccagccugg

SEQ ID NO: 2902855 - RNA, 20 nt, Human
ccccaugccuguccagccug

SEQ ID NO: 2902856 - RNA, 19 nt, Human
ccccaugccuguccagccu

SEQ ID NO: 2902857 - RNA, 18 nt, Human
ccccaugccuguccagcc

SEQ ID NO: 2902858 - RNA, 17 nt, Human
ccccauuagagucagcc

SEQ ID NO: 2902859 - RNA, 19 nt, Human
ccccauguuguaaugcugc

SEQ ID NO: 2902860 - RNA, 20 nt, Human
ccccauguuguaaugcugca

SEQ ID NO: 2902861 - RNA, 21 nt, Human
ccccauguuguaaugcugcac

SEQ ID NO: 2902862 - RNA, 22 nt, Human
ccccauguuguaaugcugcacu

SEQ ID NO: 2902863 - RNA, 23 nt, Human
ccccauguuguaaugcugcacuu

SEQ ID NO: 2902864 - RNA, 18 nt, Human
ccccauguguccugguuc

SEQ ID NO: 2902865 - RNA, 23 nt, Human
ccccauguguccugguucccguu

SEQ ID NO: 2902866 - RNA, 22 nt, Human
cccccuucucugcuccaccaca

SEQ ID NO: 2902867 - RNA, 14 nt, Human
ccccauguguccug

SEQ ID NO: 2902868 - RNA, 16 nt, Human
ccccauguguccuggu

SEQ ID NO: 2902869 - RNA, 20 nt, Human
ccccagauugcaacaggcug

SEQ ID NO: 2902870 - RNA, 11 nt, Human
ccccagcccag

SEQ ID NO: 2902871 - RNA, 15 nt, Human
ccccagauugcaaca

SEQ ID NO: 2902872 - RNA, 17 nt, Human
ccccagaggcuggguga

SEQ ID NO: 2902873 - RNA, 12 nt, Human
ccccagcccagg

SEQ ID NO: 2902874 - RNA, 13 nt, Human
ccccagcccaggg

SEQ ID NO: 2902875 - RNA, 12 nt, Human
ccccaugccugu

SEQ ID NO: 2902876 - RNA, 13 nt, Human
ccccaugccuguc

SEQ ID NO: 2902877 - RNA, 17 nt, Human
ccccaugccuguccagc

SEQ ID NO: 2902878 - RNA, 15 nt, Human
ccccaugccugucca

SEQ ID NO: 2902879 - RNA, 15 nt, Human
cccauucugccugcc

SEQ ID NO: 2902880 - RNA, 14 nt, Human
cccauucugccugc

SEQ ID NO: 2902881 - RNA, 19 nt, Human
cccauucugccugcccagg

SEQ ID NO: 2902882 - RNA, 14 nt, Human
cccauuucuccaga

SEQ ID NO: 2902883 - RNA, 15 nt, Human
cccauuucuccagaa

SEQ ID NO: 2902884 - RNA, 17 nt, Human
cccauuucuccagaacc

SEQ ID NO: 2902885 - RNA, 18 nt, Human
cccauuucuccagaaccc

SEQ ID NO: 2902886 - RNA, 18 nt, Human
cccauuugugccagagga

SEQ ID NO: 2902887 - RNA, 16 nt, Human
cccauuugugccagag

SEQ ID NO: 2902888 - RNA, 20 nt, Human
cccauuuuuauaucgaucuc

SEQ ID NO: 2902889 - RNA, 13 nt, Human
ccccagaggcugg

SEQ ID NO: 2902890 - RNA, 15 nt, Human
cggagacggaguccc

SEQ ID NO: 2902891 - RNA, 20 nt, Human
cggugugccugcagccccgc

SEQ ID NO: 2902892 - RNA, 17 nt, Human
cggugugccugcagccc

SEQ ID NO: 2902893 - RNA, 15 nt, Human
cggugugccugcagc

SEQ ID NO: 2902894 - RNA, 15 nt, Human
cggugucuuguucug

SEQ ID NO: 2902895 - RNA, 18 nt, Human
cggugucuuguucuguca

SEQ ID NO: 2902896 - RNA, 20 nt, Human
cgguuaugaaauucaccccc

SEQ ID NO: 2902897 - RNA, 14 nt, Human
cggugggcacuguu

SEQ ID NO: 2902898 - RNA, 14 nt, Human
cgguguccccagag

SEQ ID NO: 2902899 - RNA, 14 nt, Human
cgguugaaaccugu

SEQ ID NO: 2902900 - RNA, 16 nt, Human
cguaaguuuaaaggau

SEQ ID NO: 2902901 - RNA, 21 nt, Human
cgguuggagcgagcauccccc

SEQ ID NO: 2902902 - RNA, 14 nt, Human
cguaauaauuauua

SEQ ID NO: 2902903 - RNA, 21 nt, Human
cguaaugcuuagagaauguuc

SEQ ID NO: 2902904 - RNA, 13 nt, Human
cguaaugcuuaga

SEQ ID NO: 2902905 - RNA, 17 nt, Human
cguaauaauuauuauua

SEQ ID NO: 2902906 - RNA, 17 nt, Human
cguaaugacuuauugug

SEQ ID NO: 2902907 - RNA, 21 nt, Human
cuaacucaccagccccacugc

SEQ ID NO: 2902908 - RNA, 14 nt, Human
cuaacucaccagcc

SEQ ID NO: 2902909 - RNA, 17 nt, Human
cuaacucagaauuauuu

SEQ ID NO: 2902910 - RNA, 14 nt, Human
cuaacuccagugaa

SEQ ID NO: 2902911 - RNA, 14 nt, Human
cuaacuccugagaa

SEQ ID NO: 2902912 - RNA, 16 nt, Human
cuaacugaacuuugaa

SEQ ID NO: 2902913 - RNA, 17 nt, Human
cuaacugaacuuugaag

SEQ ID NO: 2902914 - RNA, 15 nt, Human
cuaacugaagagaca

SEQ ID NO: 2902915 - RNA, 14 nt, Human
cguuacagcucccc

SEQ ID NO: 2902916 - RNA, 19 nt, Human
cguuacucagggcuccucc

SEQ ID NO: 2902917 - RNA, 21 nt, Human
cguuacucagggcuccuccca

SEQ ID NO: 2902918 - RNA, 22 nt, Human
cguuacucagggcuccucccag

SEQ ID NO: 2902919 - RNA, 23 nt, Human
cguuacucagggcuccucccagc

SEQ ID NO: 2902920 - RNA, 14 nt, Human
cguuaccaggcagg

SEQ ID NO: 2902921 - RNA, 12 nt, Human
cguguuuguguu

SEQ ID NO: 2902922 - RNA, 15 nt, Human
cgugucgugggugug

SEQ ID NO: 2902923 - RNA, 12 nt, Human
cgugucugaauc

SEQ ID NO: 2902924 - RNA, 15 nt, Human
cgugucccucucgga

SEQ ID NO: 2902925 - RNA, 22 nt, Human
cguguccccuauccuacuuccc

SEQ ID NO: 2902926 - RNA, 13 nt, Human
cguguccccgggg

SEQ ID NO: 2902927 - RNA, 18 nt, Human
cguguccccggggcccag

SEQ ID NO: 2902928 - RNA, 17 nt, Human
cguguauugagauuucu

SEQ ID NO: 2902929 - RNA, 22 nt, Human
cguguauugagauuucuuaaau

SEQ ID NO: 2902930 - RNA, 21 nt, Human
cguguuuuauuccuguauguu

SEQ ID NO: 2902931 - RNA, 21 nt, Human
cuaaagaagguuucagaaaga

SEQ ID NO: 2902932 - RNA, 12 nt, Human
cuaaagaccaaa

SEQ ID NO: 2902933 - RNA, 15 nt, Human
cuaaagaccaaacuu

SEQ ID NO: 2902934 - RNA, 16 nt, Human
cuaaagaccaaacuuc

SEQ ID NO: 2902935 - RNA, 23 nt, Human
cuaaagaccaaacuucacucugg

SEQ ID NO: 2902936 - RNA, 14 nt, Human
cuaaagaagaucug

SEQ ID NO: 2902937 - RNA, 16 nt, Human
cuaaagaagaucugua

SEQ ID NO: 2902938 - RNA, 10 nt, Human
cuaaaguuau

SEQ ID NO: 2902939 - RNA, 11 nt, Human
cuaaaguuaua

SEQ ID NO: 2902940 - RNA, 13 nt, Human
cuaaaguuauauu

SEQ ID NO: 2902941 - RNA, 14 nt, Human
cuaaaguuauauuu

SEQ ID NO: 2902942 - RNA, 15 nt, Human
cuaaaguuauauuuc

SEQ ID NO: 2902943 - RNA, 16 nt, Human
cuaaaguuauauuuca

SEQ ID NO: 2902944 - RNA, 22 nt, Human
cuaaaguuauauuucagaugua

SEQ ID NO: 2902945 - RNA, 11 nt, Human
cuaaaguucua

SEQ ID NO: 2902946 - RNA, 12 nt, Human
cuaaaguucuaa

SEQ ID NO: 2902947 - RNA, 13 nt, Human
cuaaaguucuaag

SEQ ID NO: 2902948 - RNA, 14 nt, Human
cuaaaguucuaaga

SEQ ID NO: 2902949 - RNA, 15 nt, Human
cuaaaguucuaagau

SEQ ID NO: 2902950 - RNA, 17 nt, Human
cuaaaguucuaagauuc

SEQ ID NO: 2902951 - RNA, 18 nt, Human
cuaaaguucuaagauucu

SEQ ID NO: 2902952 - RNA, 19 nt, Human
cuaaaguucuaagauucug

SEQ ID NO: 2902953 - RNA, 20 nt, Human
cuaaaguucuaagauucuga

SEQ ID NO: 2902954 - RNA, 23 nt, Human
cuaacuagacaccaaaguucuaa

SEQ ID NO: 2902955 - RNA, 21 nt, Human
cuaacuagacaccaaaguucu

SEQ ID NO: 2902956 - RNA, 22 nt, Human
cuaacuagacaccaaaguucua

SEQ ID NO: 2902957 - RNA, 19 nt, Human
cguguaguguccauuuugu

SEQ ID NO: 2902958 - RNA, 15 nt, Human
cuaacuagacaccaa

SEQ ID NO: 2902959 - RNA, 17 nt, Human
cuaaaggauagaucaaa

SEQ ID NO: 2902960 - RNA, 19 nt, Human
cuaaaggauagaucaaagu

SEQ ID NO: 2902961 - RNA, 15 nt, Human
cuaaagguccacagg

SEQ ID NO: 2902962 - RNA, 19 nt, Human
cuaaagguccacaggucua

SEQ ID NO: 2902963 - RNA, 20 nt, Human
cuaaagguccacaggucuag

SEQ ID NO: 2902964 - RNA, 21 nt, Human
cuaaagguccacaggucuaga

SEQ ID NO: 2902965 - RNA, 14 nt, Human
cgcugggcacuucc

SEQ ID NO: 2902966 - RNA, 15 nt, Human
cgcugggcacuuccc

SEQ ID NO: 2902967 - RNA, 16 nt, Human
cgcugggcacuucccu

SEQ ID NO: 2902968 - RNA, 18 nt, Human
cgcugggcacuucccugc

SEQ ID NO: 2902969 - RNA, 19 nt, Human
cgcugggcacuucccugcu

SEQ ID NO: 2902970 - RNA, 20 nt, Human
cgcugggcacuucccugcug

SEQ ID NO: 2902971 - RNA, 21 nt, Human
cgcugggcacuucccugcugc

SEQ ID NO: 2902972 - RNA, 23 nt, Human
cgcugggcacuucccugcugccu

SEQ ID NO: 2902973 - RNA, 19 nt, Human
cgcaucuucccaaccccuu

SEQ ID NO: 2902974 - RNA, 23 nt, Human
cgcuggccccuuugggcccugca

SEQ ID NO: 2902975 - RNA, 15 nt, Human
cgcugcugcugcugc

SEQ ID NO: 2902976 - RNA, 20 nt, Human
cgcugcugcugcugcgcccu

SEQ ID NO: 2902977 - RNA, 22 nt, Human
cgccuucacuccggugugccug

SEQ ID NO: 2902978 - RNA, 22 nt, Human
cgccuuagcacuaccacuccug

SEQ ID NO: 2902979 - RNA, 14 nt, Human
cgccuuaagcugau

SEQ ID NO: 2902980 - RNA, 23 nt, Human
cgcuggaccuugaacuggguacu

SEQ ID NO: 2902981 - RNA, 19 nt, Human
cgcuggaccuugaacuggg

SEQ ID NO: 2902982 - RNA, 15 nt, Human
cgcugcuccuuggcu

SEQ ID NO: 2902983 - RNA, 20 nt, Human
cgccuguaguccuagccacu

SEQ ID NO: 2902984 - RNA, 15 nt, Human
cgccugugaugcugg

SEQ ID NO: 2902985 - RNA, 16 nt, Human
cgccugugaugcuggg

SEQ ID NO: 2902986 - RNA, 17 nt, Human
cgccugugaugcugggc

SEQ ID NO: 2902987 - RNA, 13 nt, Human
cgccugugcacac

SEQ ID NO: 2902988 - RNA, 14 nt, Human
cgccugugcacaca

SEQ ID NO: 2902989 - RNA, 15 nt, Human
cgccugugcacacac

SEQ ID NO: 2902990 - RNA, 16 nt, Human
cgccugugcacacaca

SEQ ID NO: 2902991 - RNA, 18 nt, Human
cgccuguggagcucagcc

SEQ ID NO: 2902992 - RNA, 19 nt, Human
cgccuguggagcucagccc

SEQ ID NO: 2902993 - RNA, 20 nt, Human
cgccuguagucccagcuacu

SEQ ID NO: 2902994 - RNA, 17 nt, Human
cgccuguaguccuagcc

SEQ ID NO: 2902995 - RNA, 23 nt, Human
cgauacccaggaccaagccacag

SEQ ID NO: 2902996 - RNA, 12 nt, Human
cgcauccagcaa

SEQ ID NO: 2902997 - RNA, 14 nt, Human
cgcauccagcaaga

SEQ ID NO: 2902998 - RNA, 19 nt, Human
cgaguagcugagauuauag

SEQ ID NO: 2902999 - RNA, 22 nt, Human
cgaguuguggaaagccucugcu

SEQ ID NO: 2903000 - RNA, 13 nt, Human
cgauaaggaagaa

SEQ ID NO: 2903001 - RNA, 15 nt, Human
cgauaaggaagaaac

SEQ ID NO: 2903002 - RNA, 16 nt, Human
cgauaaggaagaaaca

SEQ ID NO: 2903003 - RNA, 18 nt, Human
cgauacaccgggccugga

SEQ ID NO: 2903004 - RNA, 20 nt, Human
cgauacaccgggccuggaga

SEQ ID NO: 2903005 - RNA, 21 nt, Human
cgauacaccgggccuggagaa

SEQ ID NO: 2903006 - RNA, 21 nt, Human
cgaggugccuucuucagggcc

SEQ ID NO: 2903007 - RNA, 21 nt, Human
cucacuuuuuuuuuuuguuug

SEQ ID NO: 2903008 - RNA, 12 nt, Human
cucagaauauug

SEQ ID NO: 2903009 - RNA, 17 nt, Human
cucagaauaaggcaggc

SEQ ID NO: 2903010 - RNA, 19 nt, Human
cucagaauaaggcaggcau

SEQ ID NO: 2903011 - RNA, 22 nt, Human
cucagaagugaaaaucuuggag

SEQ ID NO: 2903012 - RNA, 12 nt, Human
cucagaaggcuu

SEQ ID NO: 2903013 - RNA, 21 nt, Human
cucaccuggggcugcuggccu

SEQ ID NO: 2903014 - RNA, 17 nt, Human
cucaccuggggcugcug

SEQ ID NO: 2903015 - RNA, 20 nt, Human
cucaccuggggcugcuggcc

SEQ ID NO: 2903016 - RNA, 14 nt, Human
cucaccuucugagu

SEQ ID NO: 2903017 - RNA, 21 nt, Human
cucaccuucugaguacagagu

SEQ ID NO: 2903018 - RNA, 20 nt, Human
cucacuuuccuccugaggcu

SEQ ID NO: 2903019 - RNA, 13 nt, Human
cucacuuuaaacc

SEQ ID NO: 2903020 - RNA, 16 nt, Human
cucacuuuaaaccugu

SEQ ID NO: 2903021 - RNA, 18 nt, Human
cucacuuggucugccagg

SEQ ID NO: 2903022 - RNA, 19 nt, Human
cucacuuggucugccaggc

SEQ ID NO: 2903023 - RNA, 20 nt, Human
cucacuuggucugccaggcc

SEQ ID NO: 2903024 - RNA, 21 nt, Human
cucaccucuggacuggcuaga

SEQ ID NO: 2903025 - RNA, 15 nt, Human
cucaccucuggacug

SEQ ID NO: 2903026 - RNA, 22 nt, Human
cucaccucuggacuggcuagag

SEQ ID NO: 2903027 - RNA, 19 nt, Human
cucaccugagucacccuac

SEQ ID NO: 2903028 - RNA, 13 nt, Human
cucaccucuaccc

SEQ ID NO: 2903029 - RNA, 15 nt, Human
cucaccucuacccaa

SEQ ID NO: 2903030 - RNA, 18 nt, Human
cucaccucuacccaaacc

SEQ ID NO: 2903031 - RNA, 19 nt, Human
cucaccucuacccaaaccc

SEQ ID NO: 2903032 - RNA, 14 nt, Human
cucaccucuggacu

SEQ ID NO: 2903033 - RNA, 16 nt, Human
cucaccucccccaucu

SEQ ID NO: 2903034 - RNA, 12 nt, Human
cucaccgcuucc

SEQ ID NO: 2903035 - RNA, 18 nt, Human
cucaccgcuucccuccug

SEQ ID NO: 2903036 - RNA, 12 nt, Human
cucaccuagagc

SEQ ID NO: 2903037 - RNA, 13 nt, Human
cucaccuagagcc

SEQ ID NO: 2903038 - RNA, 14 nt, Human
cucaccuagagcca

SEQ ID NO: 2903039 - RNA, 15 nt, Human
cucaccuagagccag

SEQ ID NO: 2903040 - RNA, 17 nt, Human
cucaccuagagccagac

SEQ ID NO: 2903041 - RNA, 18 nt, Human
cucaccuagagccagacc

SEQ ID NO: 2903042 - RNA, 19 nt, Human
cucaccuagagccagacca

SEQ ID NO: 2903043 - RNA, 20 nt, Human
cucaccuagagccagaccaa

SEQ ID NO: 2903044 - RNA, 14 nt, Human
cucacccuggggcu

SEQ ID NO: 2903045 - RNA, 15 nt, Human
cucacccugcuacac

SEQ ID NO: 2903046 - RNA, 19 nt, Human
cucaaaacccaucugggcu

SEQ ID NO: 2903047 - RNA, 20 nt, Human
cucaaaaauacaaaauaaaa

SEQ ID NO: 2903048 - RNA, 22 nt, Human
cucaaaacccaucugggcuccu

SEQ ID NO: 2903049 - RNA, 14 nt, Human
cucaaacuucuggc

SEQ ID NO: 2903050 - RNA, 16 nt, Human
cucaaacuucuggcuc

SEQ ID NO: 2903051 - RNA, 12 nt, Human
cucaaaguuuug

SEQ ID NO: 2903052 - RNA, 14 nt, Human
cucaaaguuuugaa

SEQ ID NO: 2903053 - RNA, 15 nt, Human
cucaaaguuuugaaa

SEQ ID NO: 2903054 - RNA, 17 nt, Human
cucaaaguuuugaaaag

SEQ ID NO: 2903055 - RNA, 18 nt, Human
cucaaaguuuugaaaagc

SEQ ID NO: 2903056 - RNA, 19 nt, Human
cucaaaguuuugaaaagcu

SEQ ID NO: 2903057 - RNA, 17 nt, Human
cuauguugcccaggcag

SEQ ID NO: 2903058 - RNA, 16 nt, Human
cuauguugcccaggca

SEQ ID NO: 2903059 - RNA, 19 nt, Human
cuauuuuguaaacucaaaa

SEQ ID NO: 2903060 - RNA, 19 nt, Human
cuaucuggaggccuuccag

SEQ ID NO: 2903061 - RNA, 20 nt, Human
cuaucuggaggccuuccagc

SEQ ID NO: 2903062 - RNA, 23 nt, Human
cuaucuggaggccuuccagcugc

SEQ ID NO: 2903063 - RNA, 24 nt, Human
cuaucuggccauauuuacuaccuu

SEQ ID NO: 2903064 - RNA, 12 nt, Human
cuaucugggccu

SEQ ID NO: 2903065 - RNA, 13 nt, Human
cuaucugggccug

SEQ ID NO: 2903066 - RNA, 21 nt, Human
cuaucucugugugcacaaaua

SEQ ID NO: 2903067 - RNA, 17 nt, Human
cuaucugauuuugugca

SEQ ID NO: 2903068 - RNA, 18 nt, Human
cuaucugauuuugugcaa

SEQ ID NO: 2903069 - RNA, 19 nt, Human
cuaucuccugacagaaggu

SEQ ID NO: 2903070 - RNA, 15 nt, Human
cuaucuccugacaga

SEQ ID NO: 2903071 - RNA, 14 nt, Human
cuaucuccugacag

SEQ ID NO: 2903072 - RNA, 12 nt, Human
cuaucuccugac

SEQ ID NO: 2903073 - RNA, 17 nt, Human
cuaucucugugugcaca

SEQ ID NO: 2903074 - RNA, 15 nt, Human
cuaucuccuagggcu

SEQ ID NO: 2903075 - RNA, 14 nt, Human
cuauguugcccagg

SEQ ID NO: 2903076 - RNA, 15 nt, Human
cuauguugcccaggc

SEQ ID NO: 2903077 - RNA, 22 nt, Human
cuauguguagggcgggaggaug

SEQ ID NO: 2903078 - RNA, 13 nt, Human
cuauguauuugca

SEQ ID NO: 2903079 - RNA, 17 nt, Human
cuaucucucaaaacuug

SEQ ID NO: 2903080 - RNA, 22 nt, Human
cuauguauuugcaguucaccug

SEQ ID NO: 2903081 - RNA, 19 nt, Human
cucacaacauggugucugg

SEQ ID NO: 2903082 - RNA, 21 nt, Human
cucaaaguuuugaaaagcuau

SEQ ID NO: 2903083 - RNA, 23 nt, Human
cucaaaguuuugaaaagcuauua

SEQ ID NO: 2903084 - RNA, 23 nt, Human
cucacaacuuaguguaauauacc

SEQ ID NO: 2903085 - RNA, 15 nt, Human
cucacacacccugag

SEQ ID NO: 2903086 - RNA, 16 nt, Human
cucacacacccugagg

SEQ ID NO: 2903087 - RNA, 17 nt, Human
cucacacacccugaggu

SEQ ID NO: 2903088 - RNA, 15 nt, Human
cuacuaauuccacac

SEQ ID NO: 2903089 - RNA, 12 nt, Human
cuacuaauucca

SEQ ID NO: 2903090 - RNA, 17 nt, Human
cuacuaauuccacaccu

SEQ ID NO: 2903091 - RNA, 20 nt, Human
cuacuaaggcuuuccuaccu

SEQ ID NO: 2903092 - RNA, 20 nt, Human
cuacuaaguucacauuagaa

SEQ ID NO: 2903093 - RNA, 19 nt, Human
cuaccuugaaaauaagaau

SEQ ID NO: 2903094 - RNA, 14 nt, Human
cuaccuugaaaaua

SEQ ID NO: 2903095 - RNA, 18 nt, Human
cuaccuuccaguuccuca

SEQ ID NO: 2903096 - RNA, 14 nt, Human
cuacuauaaagaga

SEQ ID NO: 2903097 - RNA, 15 nt, Human
cuacuauaaagagaa

SEQ ID NO: 2903098 - RNA, 17 nt, Human
cuacuauaaagagaaga

SEQ ID NO: 2903099 - RNA, 18 nt, Human
cuacuauggcugaguucu

SEQ ID NO: 2903100 - RNA, 12 nt, Human
cuacuauuuucu

SEQ ID NO: 2903101 - RNA, 13 nt, Human
cuagacacugcca

SEQ ID NO: 2903102 - RNA, 18 nt, Human
cuagacagauccccguuc

SEQ ID NO: 2903103 - RNA, 21 nt, Human
cuagacaccaaaguucuaaua

SEQ ID NO: 2903104 - RNA, 17 nt, Human
cuagacauggagguucu

SEQ ID NO: 2903105 - RNA, 18 nt, Human
cuagacauggagguucua

SEQ ID NO: 2903106 - RNA, 19 nt, Human
cuagacauggagguucuaa

SEQ ID NO: 2903107 - RNA, 20 nt, Human
cuagacauggagguucuaag

SEQ ID NO: 2903108 - RNA, 21 nt, Human
cuagacauggagguucuaagg

SEQ ID NO: 2903109 - RNA, 15 nt, Human
cuagacaccaaaguu

SEQ ID NO: 2903110 - RNA, 16 nt, Human
cuagacaccaaaguuc

SEQ ID NO: 2903111 - RNA, 17 nt, Human
cuagacaccaaaguucu

SEQ ID NO: 2903112 - RNA, 18 nt, Human
cuagacaccaaaguucua

SEQ ID NO: 2903113 - RNA, 19 nt, Human
cuagacaccaaaguucuaa

SEQ ID NO: 2903114 - RNA, 22 nt, Human
cuagacauggagguucuaaggc

SEQ ID NO: 2903115 - RNA, 23 nt, Human
cuagacauggagguucuaaggcc

SEQ ID NO: 2903116 - RNA, 13 nt, Human
cuagacauuacca

SEQ ID NO: 2903117 - RNA, 12 nt, Human
cuagaauggaua

SEQ ID NO: 2903118 - RNA, 19 nt, Human
cuagaaucugcaauucaaa

SEQ ID NO: 2903119 - RNA, 20 nt, Human
cuagaauuauaagucacaaa

SEQ ID NO: 2903120 - RNA, 18 nt, Human
cuagaaguuucccuuccu

SEQ ID NO: 2903121 - RNA, 19 nt, Human
cuagaaguuucccuuccuc

SEQ ID NO: 2903122 - RNA, 20 nt, Human
cuagaaguuucccuuccucc

SEQ ID NO: 2903123 - RNA, 22 nt, Human
cuagaaguuucccuuccuccau

SEQ ID NO: 2903124 - RNA, 16 nt, Human
cuagaauaaucuugcu

SEQ ID NO: 2903125 - RNA, 17 nt, Human
cuagaauaaucuugcuc

SEQ ID NO: 2903126 - RNA, 12 nt, Human
cuagaauacuuu

SEQ ID NO: 2903127 - RNA, 14 nt, Human
cuagaauacuuuuu

SEQ ID NO: 2903128 - RNA, 18 nt, Human
cuagaauacuuuuuaaaa

SEQ ID NO: 2903129 - RNA, 21 nt, Human
cuagaauuuaucacacuucug

SEQ ID NO: 2903130 - RNA, 20 nt, Human
cuagaauucuguauuggaua

SEQ ID NO: 2903131 - RNA, 19 nt, Human
cuaggccuggccagaugca

SEQ ID NO: 2903132 - RNA, 18 nt, Human
cuaggccuggccagaugc

SEQ ID NO: 2903133 - RNA, 15 nt, Human
cuaggccuggccaga

SEQ ID NO: 2903134 - RNA, 14 nt, Human
cuaggccuggccag

SEQ ID NO: 2903135 - RNA, 23 nt, Human
cuaggccucucaccucugugccu

SEQ ID NO: 2903136 - RNA, 15 nt, Human
cuaggcgugagaagc

SEQ ID NO: 2903137 - RNA, 13 nt, Human
cuaggccuggcca

SEQ ID NO: 2903138 - RNA, 22 nt, Human
cuagccaggaaguacuuccacc

SEQ ID NO: 2903139 - RNA, 23 nt, Human
cuagccaggaaguacuuccaccu

SEQ ID NO: 2903140 - RNA, 19 nt, Human
cuagccagugcuccaggca

SEQ ID NO: 2903141 - RNA, 20 nt, Human
cuagccagcacuuguauaua

SEQ ID NO: 2903142 - RNA, 12 nt, Human
cuagcccacccu

SEQ ID NO: 2903143 - RNA, 14 nt, Human
cuagcccacccugc

SEQ ID NO: 2903144 - RNA, 15 nt, Human
cuagcccacccugcu

SEQ ID NO: 2903145 - RNA, 17 nt, Human
cuagcccacccugcugc

SEQ ID NO: 2903146 - RNA, 18 nt, Human
cuagcccacccugcugcc

SEQ ID NO: 2903147 - RNA, 19 nt, Human
cuagcccacccugcugccu

SEQ ID NO: 2903148 - RNA, 20 nt, Human
cuagcccacccugcugccuu

SEQ ID NO: 2903149 - RNA, 21 nt, Human
cuagcccacccugcugccuuc

SEQ ID NO: 2903150 - RNA, 19 nt, Human
cuagcccagcgcucugccu

SEQ ID NO: 2903151 - RNA, 13 nt, Human
cuagcccaggaga

SEQ ID NO: 2903152 - RNA, 13 nt, Human
cuaggcucugccu

SEQ ID NO: 2903153 - RNA, 14 nt, Human
cuaggcucugccuu

SEQ ID NO: 2903154 - RNA, 15 nt, Human
cuaggcucugccuuc

SEQ ID NO: 2903155 - RNA, 20 nt, Human
cuaggcucagagaugugcac

SEQ ID NO: 2903156 - RNA, 13 nt, Human
cuaggcuccaccc

SEQ ID NO: 2903157 - RNA, 22 nt, Human
cuaggcucagagaugugcaccc

SEQ ID NO: 2903158 - RNA, 15 nt, Human
cuaggcucagcggcg

SEQ ID NO: 2903159 - RNA, 12 nt, Human
cuaggcucagag

SEQ ID NO: 2903160 - RNA, 13 nt, Human
cuaggcucagaga

SEQ ID NO: 2903161 - RNA, 15 nt, Human
cuaggcucagagaug

SEQ ID NO: 2903162 - RNA, 14 nt, Human
cuagggaagggugg

SEQ ID NO: 2903163 - RNA, 15 nt, Human
cuaggggucacugua

SEQ ID NO: 2903164 - RNA, 17 nt, Human
cuaggguggcccuugca

SEQ ID NO: 2903165 - RNA, 18 nt, Human
cuaguucccucugcucag

SEQ ID NO: 2903166 - RNA, 20 nt, Human
cuaguucccucugcucagcc

SEQ ID NO: 2903167 - RNA, 21 nt, Human
cuaguucccucugcucagcca

SEQ ID NO: 2903168 - RNA, 22 nt, Human
cuaguucccucugcucagccaa

SEQ ID NO: 2903169 - RNA, 13 nt, Human
cuaggguggcccu

SEQ ID NO: 2903170 - RNA, 15 nt, Human
cuaggguccugggga

SEQ ID NO: 2903171 - RNA, 14 nt, Human
cuaggguccugggg

SEQ ID NO: 2903172 - RNA, 13 nt, Human
cuaggguccuggg

SEQ ID NO: 2903173 - RNA, 20 nt, Human
cuaguuuucuccucccagga

SEQ ID NO: 2903174 - RNA, 13 nt, Human
cuaguuuuguuua

SEQ ID NO: 2903175 - RNA, 14 nt, Human
cuaguuuuuaguaa

SEQ ID NO: 2903176 - RNA, 19 nt, Human
cuaguuuuuaguaaucugu

SEQ ID NO: 2903177 - RNA, 22 nt, Human
cuaguuuuuaguaaucuguaca

SEQ ID NO: 2903178 - RNA, 23 nt, Human
cuaguuuuuaguaaucuguacau

SEQ ID NO: 2903179 - RNA, 16 nt, Human
cuauaaaaugucuuca

SEQ ID NO: 2903180 - RNA, 18 nt, Human
cuauaaaaugucuucaag

SEQ ID NO: 2903181 - RNA, 19 nt, Human
cuauaaaaugucuucaagg

SEQ ID NO: 2903182 - RNA, 20 nt, Human
cuauaaagcgauauacagau

SEQ ID NO: 2903183 - RNA, 18 nt, Human
cuauaaagcuagaugcuu

SEQ ID NO: 2903184 - RNA, 19 nt, Human
cuauaaagcuagaugcuuu

SEQ ID NO: 2903185 - RNA, 23 nt, Human
cuauaaagaagaacuugcaugga

SEQ ID NO: 2903186 - RNA, 13 nt, Human
cuauaaagagaag

SEQ ID NO: 2903187 - RNA, 19 nt, Human
cuauaaagagaagacgaaa

SEQ ID NO: 2903188 - RNA, 18 nt, Human
cuccagugccagcaauga

SEQ ID NO: 2903189 - RNA, 22 nt, Human
cuccagugcuguccaugcuucu

SEQ ID NO: 2903190 - RNA, 15 nt, Human
cuccauaaacagacu

SEQ ID NO: 2903191 - RNA, 14 nt, Human
cuccaguguacaua

SEQ ID NO: 2903192 - RNA, 21 nt, Human
cuccaguguacauaguguaau

SEQ ID NO: 2903193 - RNA, 22 nt, Human
cuccagggaauccaagccucca

SEQ ID NO: 2903194 - RNA, 18 nt, Human
cuccagggagauuuugag

SEQ ID NO: 2903195 - RNA, 22 nt, Human
cuccagggagccuagaagcugg

SEQ ID NO: 2903196 - RNA, 12 nt, Human
cucccagaggcg

SEQ ID NO: 2903197 - RNA, 14 nt, Human
cucccagaggucca

SEQ ID NO: 2903198 - RNA, 15 nt, Human
cucccagagguccag

SEQ ID NO: 2903199 - RNA, 16 nt, Human
cucccagagguccagc

SEQ ID NO: 2903200 - RNA, 17 nt, Human
cucccagagguccagcc

SEQ ID NO: 2903201 - RNA, 18 nt, Human
cucccagagguccagccc

SEQ ID NO: 2903202 - RNA, 19 nt, Human
cucccagagguccagccca

SEQ ID NO: 2903203 - RNA, 20 nt, Human
cucccagagguccagcccau

SEQ ID NO: 2903204 - RNA, 21 nt, Human
cucccagagguccagcccauc

SEQ ID NO: 2903205 - RNA, 22 nt, Human
cucccagagguccagcccaucu

SEQ ID NO: 2903206 - RNA, 23 nt, Human
cucccagagguccagcccaucuc

SEQ ID NO: 2903207 - RNA, 21 nt, Human
cucccagaucagucagagccc

SEQ ID NO: 2903208 - RNA, 13 nt, Human
cucccaccucagc

SEQ ID NO: 2903209 - RNA, 17 nt, Human
cucccaccucagccucc

SEQ ID NO: 2903210 - RNA, 16 nt, Human
cucccaccucagccuc

SEQ ID NO: 2903211 - RNA, 14 nt, Human
cucccaccucagcc

SEQ ID NO: 2903212 - RNA, 22 nt, Human
cuccaggcuguaucccaugagc

SEQ ID NO: 2903213 - RNA, 23 nt, Human
cuccaggcuguaucccaugagcc

SEQ ID NO: 2903214 - RNA, 21 nt, Human
cuccagggaauccaagccucc

SEQ ID NO: 2903215 - RNA, 20 nt, Human
cuccagggaauccaagccuc

SEQ ID NO: 2903216 - RNA, 19 nt, Human
cuccagggaauccaagccu

SEQ ID NO: 2903217 - RNA, 16 nt, Human
cuccagggaauccaag

SEQ ID NO: 2903218 - RNA, 17 nt, Human
cuccagaauuuggaaau

SEQ ID NO: 2903219 - RNA, 18 nt, Human
cuccagaauuuggaaauc

SEQ ID NO: 2903220 - RNA, 19 nt, Human
cuccagaauuuggaaaucc

SEQ ID NO: 2903221 - RNA, 20 nt, Human
cuccagaauuuggaaauccu

SEQ ID NO: 2903222 - RNA, 22 nt, Human
cuccagaauuuggaaauccuag

SEQ ID NO: 2903223 - RNA, 20 nt, Human
cucagacauguuuuccguga

SEQ ID NO: 2903224 - RNA, 19 nt, Human
cucagacauguuuuccgug

SEQ ID NO: 2903225 - RNA, 17 nt, Human
cucagaauguaaaagaa

SEQ ID NO: 2903226 - RNA, 14 nt, Human
cucagaauuauuuu

SEQ ID NO: 2903227 - RNA, 17 nt, Human
cucagaauuauuuuuaa

SEQ ID NO: 2903228 - RNA, 18 nt, Human
cuccggcuugaccuguuu

SEQ ID NO: 2903229 - RNA, 22 nt, Human
cuccgcuuucuacccagcgagc

SEQ ID NO: 2903230 - RNA, 23 nt, Human
cuccggugugccugcagccccgc

SEQ ID NO: 2903231 - RNA, 19 nt, Human
cuccggugugccugcagcc

SEQ ID NO: 2903232 - RNA, 18 nt, Human
cuccggugugccugcagc

SEQ ID NO: 2903233 - RNA, 13 nt, Human
cuccggugugccu

SEQ ID NO: 2903234 - RNA, 15 nt, Human
cuccuagagaacgca

SEQ ID NO: 2903235 - RNA, 18 nt, Human
cuccuagagaacgcagcc

SEQ ID NO: 2903236 - RNA, 20 nt, Human
cuccuagagaacgcagcccu

SEQ ID NO: 2903237 - RNA, 21 nt, Human
cuccuagagaacgcagcccua

SEQ ID NO: 2903238 - RNA, 20 nt, Human
cuccgcuuucuacccagcga

SEQ ID NO: 2903239 - RNA, 21 nt, Human
cuccgcuuucuacccagcgag

SEQ ID NO: 2903240 - RNA, 18 nt, Human
cucccucuguccaccagc

SEQ ID NO: 2903241 - RNA, 21 nt, Human
cucccuccccugcccuggucc

SEQ ID NO: 2903242 - RNA, 18 nt, Human
cucccuccccugcccugg

SEQ ID NO: 2903243 - RNA, 16 nt, Human
cucccuccccugcccu

SEQ ID NO: 2903244 - RNA, 18 nt, Human
cucccuccccugccauuu

SEQ ID NO: 2903245 - RNA, 15 nt, Human
cuccccaucccaugu

SEQ ID NO: 2903246 - RNA, 14 nt, Human
cucccucccaggac

SEQ ID NO: 2903247 - RNA, 13 nt, Human
cucccucccagga

SEQ ID NO: 2903248 - RNA, 15 nt, Human
cucccuccccugcca

SEQ ID NO: 2903249 - RNA, 14 nt, Human
cucccuccccugcc

SEQ ID NO: 2903250 - RNA, 11 nt, Human
cucccuccccu

SEQ ID NO: 2903251 - RNA, 16 nt, Human
cucccuccccgucuca

SEQ ID NO: 2903252 - RNA, 20 nt, Human
cucccuccccgucucauucc

SEQ ID NO: 2903253 - RNA, 17 nt, Human
cucccucccaggacucu

SEQ ID NO: 2903254 - RNA, 22 nt, Human
cuccccagucucucuuaaaguu

SEQ ID NO: 2903255 - RNA, 11 nt, Human
cuccccagugu

SEQ ID NO: 2903256 - RNA, 16 nt, Human
cuccccaguguauguc

SEQ ID NO: 2903257 - RNA, 11 nt, Human
cuccccaguuc

SEQ ID NO: 2903258 - RNA, 14 nt, Human
cuccccaucccaug

SEQ ID NO: 2903259 - RNA, 11 nt, Human
cucccagccug

SEQ ID NO: 2903260 - RNA, 13 nt, Human
cucccucuucuuu

SEQ ID NO: 2903261 - RNA, 14 nt, Human
cucccucuucuuuc

SEQ ID NO: 2903262 - RNA, 11 nt, Human
cucccucuugu

SEQ ID NO: 2903263 - RNA, 12 nt, Human
cucccucuuguu

SEQ ID NO: 2903264 - RNA, 17 nt, Human
cucccucuuguuuuguu

SEQ ID NO: 2903265 - RNA, 18 nt, Human
cucccucugauuuuucau

SEQ ID NO: 2903266 - RNA, 21 nt, Human
cucccucugaccugcaggcca

SEQ ID NO: 2903267 - RNA, 18 nt, Human
cucccucugaccugcagg

SEQ ID NO: 2903268 - RNA, 17 nt, Human
cucccucugaccugcag

SEQ ID NO: 2903269 - RNA, 14 nt, Human
cucccucugaccug

SEQ ID NO: 2903270 - RNA, 13 nt, Human
cucccucugaccu

SEQ ID NO: 2903271 - RNA, 22 nt, Human
cucccucucucuucugcuccac

SEQ ID NO: 2903272 - RNA, 21 nt, Human
cucccucucucuucugcucca

SEQ ID NO: 2903273 - RNA, 20 nt, Human
cucccucucucuucugcucc

SEQ ID NO: 2903274 - RNA, 17 nt, Human
cucccucucucuucugc

SEQ ID NO: 2903275 - RNA, 16 nt, Human
cucccucucucuucug

SEQ ID NO: 2903276 - RNA, 15 nt, Human
cucccucucucuucu

SEQ ID NO: 2903277 - RNA, 23 nt, Human
cucccuccccugcccugguccag

SEQ ID NO: 2903278 - RNA, 13 nt, Human
cucccucccgcac

SEQ ID NO: 2903279 - RNA, 12 nt, Human
cuccuuucugug

SEQ ID NO: 2903280 - RNA, 13 nt, Human
cuccuuucugugc

SEQ ID NO: 2903281 - RNA, 14 nt, Human
cuccuuucugugcc

SEQ ID NO: 2903282 - RNA, 16 nt, Human
cuccuuucugugcccu

SEQ ID NO: 2903283 - RNA, 17 nt, Human
cuccuuucugugcccua

SEQ ID NO: 2903284 - RNA, 18 nt, Human
cuccuuuccccuuccuuu

SEQ ID NO: 2903285 - RNA, 22 nt, Human
cuccuuuccccuuccuuuuaag

SEQ ID NO: 2903286 - RNA, 14 nt, Human
cuccuuucuccucc

SEQ ID NO: 2903287 - RNA, 22 nt, Human
cuccuuuagcgcccaguugggu

SEQ ID NO: 2903288 - RNA, 19 nt, Human
cuccuuucaccccagggcc

SEQ ID NO: 2903289 - RNA, 14 nt, Human
cuccuuucagggcc

SEQ ID NO: 2903290 - RNA, 17 nt, Human
cuccuuuagcgcccagu

SEQ ID NO: 2903291 - RNA, 16 nt, Human
cuccuuuagcgcccag

SEQ ID NO: 2903292 - RNA, 14 nt, Human
cuccuuucuuucua

SEQ ID NO: 2903293 - RNA, 19 nt, Human
cuccuuugaaaccugcucu

SEQ ID NO: 2903294 - RNA, 23 nt, Human
cuccuuugcugaggccuccagcu

SEQ ID NO: 2903295 - RNA, 20 nt, Human
cucgaaacacagaaaccuuu

SEQ ID NO: 2903296 - RNA, 13 nt, Human
cucgaacuccuga

SEQ ID NO: 2903297 - RNA, 19 nt, Human
cucgaaacacagaaaccuu

SEQ ID NO: 2903298 - RNA, 15 nt, Human
cucgaaacacagaaa

SEQ ID NO: 2903299 - RNA, 14 nt, Human
cucgaaacacagaa

SEQ ID NO: 2903300 - RNA, 12 nt, Human
cuccuuuuaugu

SEQ ID NO: 2903301 - RNA, 15 nt, Human
cuccuuuuaugugua

SEQ ID NO: 2903302 - RNA, 10 nt, Human
cuccuuuucu

SEQ ID NO: 2903303 - RNA, 11 nt, Human
cuccuuuucuu

SEQ ID NO: 2903304 - RNA, 16 nt, Human
cuccuuuucuuuuguu

SEQ ID NO: 2903305 - RNA, 17 nt, Human
cuccuuuucuuuuguua

SEQ ID NO: 2903306 - RNA, 18 nt, Human
cuccuuuucuuuuguuac

SEQ ID NO: 2903307 - RNA, 19 nt, Human
cuccuuuucuuuuguuacu

SEQ ID NO: 2903308 - RNA, 20 nt, Human
cuccuuuucuuuuguuacug

SEQ ID NO: 2903309 - RNA, 21 nt, Human
cuccuuuucuuuuguuacugu

SEQ ID NO: 2903310 - RNA, 22 nt, Human
cuccuuuucuuuuguuacuguu

SEQ ID NO: 2903311 - RNA, 23 nt, Human
cuccuuuucuuuuguuacuguuc

SEQ ID NO: 2903312 - RNA, 24 nt, Human
cuccuuuugaccuucauuucaugu

SEQ ID NO: 2903313 - RNA, 17 nt, Human
cucgaacuccugaccuu

SEQ ID NO: 2903314 - RNA, 16 nt, Human
cucgaacuccugaccu

SEQ ID NO: 2903315 - RNA, 14 nt, Human
cucgguugaaaccu

SEQ ID NO: 2903316 - RNA, 15 nt, Human
cucgguugaaaccug

SEQ ID NO: 2903317 - RNA, 18 nt, Human
cucguauaugucucaggu

SEQ ID NO: 2903318 - RNA, 14 nt, Human
cucguagccaucuc

SEQ ID NO: 2903319 - RNA, 20 nt, Human
cucguauaugucucaggucc

SEQ ID NO: 2903320 - RNA, 14 nt, Human
cucggggagccuua

SEQ ID NO: 2903321 - RNA, 13 nt, Human
cucggggagccuu

SEQ ID NO: 2903322 - RNA, 16 nt, Human
cucucuucugcuccac

SEQ ID NO: 2903323 - RNA, 18 nt, Human
cucucuucugcuccaccc

SEQ ID NO: 2903324 - RNA, 20 nt, Human
cucucuugccgaggagccag

SEQ ID NO: 2903325 - RNA, 17 nt, Human
cucucuucugcuccacc

SEQ ID NO: 2903326 - RNA, 12 nt, Human
cucucccuguug

SEQ ID NO: 2903327 - RNA, 13 nt, Human
cucucccuuaccc

SEQ ID NO: 2903328 - RNA, 16 nt, Human
cucuccgaccagacac

SEQ ID NO: 2903329 - RNA, 20 nt, Human
cucuccuccccaaggagaca

SEQ ID NO: 2903330 - RNA, 14 nt, Human
cucugaacacaggc

SEQ ID NO: 2903331 - RNA, 15 nt, Human
cucugaacacaggca

SEQ ID NO: 2903332 - RNA, 16 nt, Human
cucugaacacaggcag

SEQ ID NO: 2903333 - RNA, 17 nt, Human
cucugaacacaggcagc

SEQ ID NO: 2903334 - RNA, 18 nt, Human
cucugaacacaggcagcu

SEQ ID NO: 2903335 - RNA, 19 nt, Human
cucugaacacaggcagcuu

SEQ ID NO: 2903336 - RNA, 20 nt, Human
cucugaacacaggcagcuuu

SEQ ID NO: 2903337 - RNA, 22 nt, Human
cucugaacacaggcagcuuucu

SEQ ID NO: 2903338 - RNA, 16 nt, Human
cucugaaaguuguaca

SEQ ID NO: 2903339 - RNA, 17 nt, Human
cucugaaaguuguacau

SEQ ID NO: 2903340 - RNA, 18 nt, Human
cucugaaaguuguacaug

SEQ ID NO: 2903341 - RNA, 19 nt, Human
cucugaaaguuguacauga

SEQ ID NO: 2903342 - RNA, 22 nt, Human
cucugaaaguuguacaugaaau

SEQ ID NO: 2903343 - RNA, 15 nt, Human
cucugaaacccugga

SEQ ID NO: 2903344 - RNA, 13 nt, Human
cucucuuuuccug

SEQ ID NO: 2903345 - RNA, 12 nt, Human
cucucuuuucug

SEQ ID NO: 2903346 - RNA, 14 nt, Human
cucucuuuucugua

SEQ ID NO: 2903347 - RNA, 17 nt, Human
cucucuuuucuguacuu

SEQ ID NO: 2903348 - RNA, 18 nt, Human
cucucuuuucuguacuuc

SEQ ID NO: 2903349 - RNA, 19 nt, Human
cucucuuuucuguacuucc

SEQ ID NO: 2903350 - RNA, 22 nt, Human
cucucuuuucuguacuuccuga

SEQ ID NO: 2903351 - RNA, 20 nt, Human
cugaaaauauauaagcucag

SEQ ID NO: 2903352 - RNA, 15 nt, Human
cugaaaaucuaauau

SEQ ID NO: 2903353 - RNA, 16 nt, Human
cugaaaaucuaauauu

SEQ ID NO: 2903354 - RNA, 17 nt, Human
cugaaaaucuaauauua

SEQ ID NO: 2903355 - RNA, 20 nt, Human
cugaaaaucuaauauuaaaa

SEQ ID NO: 2903356 - RNA, 18 nt, Human
cugaaaauaccaucaggc

SEQ ID NO: 2903357 - RNA, 15 nt, Human
cugaaaauauaaaac

SEQ ID NO: 2903358 - RNA, 13 nt, Human
cugaaaagagagc

SEQ ID NO: 2903359 - RNA, 17 nt, Human
cugaaaagagagcagag

SEQ ID NO: 2903360 - RNA, 19 nt, Human
cugaaaagagagcagagaa

SEQ ID NO: 2903361 - RNA, 23 nt, Human
cugaaaagagagcagagaauaua

SEQ ID NO: 2903362 - RNA, 21 nt, Human
cugaaaaaugguaauuguugc

SEQ ID NO: 2903363 - RNA, 14 nt, Human
cugaaaaaaaguuu

SEQ ID NO: 2903364 - RNA, 15 nt, Human
cugaaaaaaaguuua

SEQ ID NO: 2903365 - RNA, 18 nt, Human
cugaaaaaaaguuuacaa

SEQ ID NO: 2903366 - RNA, 22 nt, Human
cugaaaaaacaccuagcuuuau

SEQ ID NO: 2903367 - RNA, 20 nt, Human
cugaaaaaaaguuuacaagu

SEQ ID NO: 2903368 - RNA, 21 nt, Human
cugaaaaaacaccuagcuuua

SEQ ID NO: 2903369 - RNA, 15 nt, Human
cugaaaaaguagauu

SEQ ID NO: 2903370 - RNA, 19 nt, Human
cugaaaaaguagauugagu

SEQ ID NO: 2903371 - RNA, 22 nt, Human
cucuugccacugccucuuccuc

SEQ ID NO: 2903372 - RNA, 15 nt, Human
cucuuuuugugaagu

SEQ ID NO: 2903373 - RNA, 17 nt, Human
cucuuuuuuguuuguuu

SEQ ID NO: 2903374 - RNA, 19 nt, Human
cucuuuuuuguuuguuucu

SEQ ID NO: 2903375 - RNA, 20 nt, Human
cucuuuuuuguuuguuucuu

SEQ ID NO: 2903376 - RNA, 21 nt, Human
cucuuuuuuguuuguuucuuu

SEQ ID NO: 2903377 - RNA, 13 nt, Human
cucuuuuuuuccu

SEQ ID NO: 2903378 - RNA, 15 nt, Human
cucuuuuuuacucau

SEQ ID NO: 2903379 - RNA, 16 nt, Human
cucuuuuuuacucauu

SEQ ID NO: 2903380 - RNA, 18 nt, Human
cucuuuuuuacucauuga

SEQ ID NO: 2903381 - RNA, 21 nt, Human
cucuuuuuuacucauugaaau

SEQ ID NO: 2903382 - RNA, 22 nt, Human
cucuuuuuuacucauugaaaug

SEQ ID NO: 2903383 - RNA, 16 nt, Human
cucuugccgaggagcc

SEQ ID NO: 2903384 - RNA, 20 nt, Human
cucuugccgaggagccaggc

SEQ ID NO: 2903385 - RNA, 21 nt, Human
cucuugccgaggagccaggca

SEQ ID NO: 2903386 - RNA, 21 nt, Human
cucuugauaccccccucuguc

SEQ ID NO: 2903387 - RNA, 18 nt, Human
cucuugauaccccccucu

SEQ ID NO: 2903388 - RNA, 19 nt, Human
cucuugauaccccccucug

SEQ ID NO: 2903389 - RNA, 17 nt, Human
cucuugaggccaggagu

SEQ ID NO: 2903390 - RNA, 16 nt, Human
cucuugaggccaggag

SEQ ID NO: 2903391 - RNA, 14 nt, Human
cucuugaggccagg

SEQ ID NO: 2903392 - RNA, 22 nt, Human
cucuugagcuggccucucuagc

SEQ ID NO: 2903393 - RNA, 16 nt, Human
cucuugagcuggccuc

SEQ ID NO: 2903394 - RNA, 15 nt, Human
cucuugagcuggccu

SEQ ID NO: 2903395 - RNA, 14 nt, Human
cucuugagcuggcc

SEQ ID NO: 2903396 - RNA, 13 nt, Human
cucuugagcuggc

SEQ ID NO: 2903397 - RNA, 20 nt, Human
cugacacaaaccugccuggg

SEQ ID NO: 2903398 - RNA, 12 nt, Human
cugacacaaagg

SEQ ID NO: 2903399 - RNA, 13 nt, Human
cugacacaaagga

SEQ ID NO: 2903400 - RNA, 14 nt, Human
cugacacaaaggaa

SEQ ID NO: 2903401 - RNA, 15 nt, Human
cugacacaaaggaag

SEQ ID NO: 2903402 - RNA, 14 nt, Human
cugacacaaaccug

SEQ ID NO: 2903403 - RNA, 16 nt, Human
cugacacaaaccugcc

SEQ ID NO: 2903404 - RNA, 18 nt, Human
cugacacaaaccugccug

SEQ ID NO: 2903405 - RNA, 19 nt, Human
cugacacaaaccugccugg

SEQ ID NO: 2903406 - RNA, 18 nt, Human
cugacacaggaugaaggc

SEQ ID NO: 2903407 - RNA, 10 nt, Human
cugacacagg

SEQ ID NO: 2903408 - RNA, 13 nt, Human
cugacacaggaaa

SEQ ID NO: 2903409 - RNA, 21 nt, Human
cugacacaggaaaccaacacc

SEQ ID NO: 2903410 - RNA, 14 nt, Human
cugacacucccacc

SEQ ID NO: 2903411 - RNA, 15 nt, Human
cugacacucccaccc

SEQ ID NO: 2903412 - RNA, 19 nt, Human
cugacacucccacccaguc

SEQ ID NO: 2903413 - RNA, 14 nt, Human
cugacagaaagcag

SEQ ID NO: 2903414 - RNA, 13 nt, Human
cugacagaaacca

SEQ ID NO: 2903415 - RNA, 22 nt, Human
cugacacugguauuccugccuc

SEQ ID NO: 2903416 - RNA, 16 nt, Human
cugacacuucaaggug

SEQ ID NO: 2903417 - RNA, 19 nt, Human
cugacacuucaaggugaca

SEQ ID NO: 2903418 - RNA, 23 nt, Human
cugacacacagcucuguccuggg

SEQ ID NO: 2903419 - RNA, 22 nt, Human
cugacacacagcucuguccugg

SEQ ID NO: 2903420 - RNA, 21 nt, Human
cugacacacagcucuguccug

SEQ ID NO: 2903421 - RNA, 20 nt, Human
cugacacacagcucuguccu

SEQ ID NO: 2903422 - RNA, 19 nt, Human
cugacacacagcucugucc

SEQ ID NO: 2903423 - RNA, 18 nt, Human
cugacacacagcucuguc

SEQ ID NO: 2903424 - RNA, 17 nt, Human
cugacacacagcucugu

SEQ ID NO: 2903425 - RNA, 16 nt, Human
cugacacacagcucug

SEQ ID NO: 2903426 - RNA, 15 nt, Human
cugacacacagcucu

SEQ ID NO: 2903427 - RNA, 13 nt, Human
cugacacacagcu

SEQ ID NO: 2903428 - RNA, 22 nt, Human
cugacaaugguguuauuugaaa

SEQ ID NO: 2903429 - RNA, 15 nt, Human
cugaagcccucccag

SEQ ID NO: 2903430 - RNA, 18 nt, Human
cugaagcccauuucuccg

SEQ ID NO: 2903431 - RNA, 15 nt, Human
cugaagcauguuuca

SEQ ID NO: 2903432 - RNA, 18 nt, Human
cugaagcauguuucaugu

SEQ ID NO: 2903433 - RNA, 20 nt, Human
cugaagcauguuucauguuu

SEQ ID NO: 2903434 - RNA, 23 nt, Human
cugaagcauguuucauguuuugu

SEQ ID NO: 2903435 - RNA, 16 nt, Human
cugaagccaaagccaa

SEQ ID NO: 2903436 - RNA, 13 nt, Human
cugaagccagccu

SEQ ID NO: 2903437 - RNA, 14 nt, Human
cugaagccagccuu

SEQ ID NO: 2903438 - RNA, 17 nt, Human
cugaagccagccuucuu

SEQ ID NO: 2903439 - RNA, 16 nt, Human
cugaaagcacaggaga

SEQ ID NO: 2903440 - RNA, 13 nt, Human
cugaagcauguuu

SEQ ID NO: 2903441 - RNA, 20 nt, Human
cugaccccgguggcggcccc

SEQ ID NO: 2903442 - RNA, 17 nt, Human
cugaccccucauagccc

SEQ ID NO: 2903443 - RNA, 21 nt, Human
cugaccccucauagcccucac

SEQ ID NO: 2903444 - RNA, 20 nt, Human
cugaccccucauagcccuca

SEQ ID NO: 2903445 - RNA, 12 nt, Human
cugaccccuccu

SEQ ID NO: 2903446 - RNA, 14 nt, Human
cugaccccuccuca

SEQ ID NO: 2903447 - RNA, 15 nt, Human
cugaccccuccucac

SEQ ID NO: 2903448 - RNA, 16 nt, Human
cugaccccuccucacu

SEQ ID NO: 2903449 - RNA, 17 nt, Human
cugaccccuccucacug

SEQ ID NO: 2903450 - RNA, 20 nt, Human
cugaccccuccucacuggcc

SEQ ID NO: 2903451 - RNA, 21 nt, Human
cugaggggaggaucacuggag

SEQ ID NO: 2903452 - RNA, 23 nt, Human
cugaggaauccagacccggcugc

SEQ ID NO: 2903453 - RNA, 19 nt, Human
cugaggggcaucugccccu

SEQ ID NO: 2903454 - RNA, 18 nt, Human
cugaggggcaucugcccc

SEQ ID NO: 2903455 - RNA, 20 nt, Human
cugaggggcaucugccccuc

SEQ ID NO: 2903456 - RNA, 23 nt, Human
cugaggggaggaucacuggagcc

SEQ ID NO: 2903457 - RNA, 22 nt, Human
cugaggggaggaucacuggagc

SEQ ID NO: 2903458 - RNA, 17 nt, Human
cugaggggcaucugccc

SEQ ID NO: 2903459 - RNA, 16 nt, Human
cugaggggcaucugcc

SEQ ID NO: 2903460 - RNA, 19 nt, Human
cugaggguguuucuuccug

SEQ ID NO: 2903461 - RNA, 20 nt, Human
cugaggguguuucuuccugc

SEQ ID NO: 2903462 - RNA, 14 nt, Human
cugaggucagggag

SEQ ID NO: 2903463 - RNA, 15 nt, Human
cugaggucagggagu

SEQ ID NO: 2903464 - RNA, 17 nt, Human
cugaggucagggagugc

SEQ ID NO: 2903465 - RNA, 19 nt, Human
cugaggucagggagugcug

SEQ ID NO: 2903466 - RNA, 20 nt, Human
cugaggguccccaccuggga

SEQ ID NO: 2903467 - RNA, 21 nt, Human
cugaggguccccaccugggac

SEQ ID NO: 2903468 - RNA, 16 nt, Human
cugagggucugggcgg

SEQ ID NO: 2903469 - RNA, 18 nt, Human
cugagggucugggcggcg

SEQ ID NO: 2903470 - RNA, 15 nt, Human
cugaggguccccacc

SEQ ID NO: 2903471 - RNA, 18 nt, Human
cugaggguccccaccugg

SEQ ID NO: 2903472 - RNA, 19 nt, Human
cugaggguccccaccuggg

SEQ ID NO: 2903473 - RNA, 18 nt, Human
cugacccuacucccuugc

SEQ ID NO: 2903474 - RNA, 20 nt, Human
cugacccuacucccuugccc

SEQ ID NO: 2903475 - RNA, 21 nt, Human
cugaggaaggaggggaagcug

SEQ ID NO: 2903476 - RNA, 22 nt, Human
cugaggaaggaggggaagcugc

SEQ ID NO: 2903477 - RNA, 23 nt, Human
cugaggaaggaggggaagcugca

SEQ ID NO: 2903478 - RNA, 22 nt, Human
cugagcuugcagagaugaggcc

SEQ ID NO: 2903479 - RNA, 14 nt, Human
cugagguuucaccc

SEQ ID NO: 2903480 - RNA, 21 nt, Human
cugagguuucacccuuaaccc

SEQ ID NO: 2903481 - RNA, 13 nt, Human
ccaccucccugcc

SEQ ID NO: 2903482 - RNA, 15 nt, Human
ccaccucccugccca

SEQ ID NO: 2903483 - RNA, 16 nt, Human
ccaccucccugcccag

SEQ ID NO: 2903484 - RNA, 17 nt, Human
ccaccucccugcccagg

SEQ ID NO: 2903485 - RNA, 18 nt, Human
ccaccucccugcccaggc

SEQ ID NO: 2903486 - RNA, 12 nt, Human
ccacccugcucu

SEQ ID NO: 2903487 - RNA, 11 nt, Human
ccacccugcuc

SEQ ID NO: 2903488 - RNA, 16 nt, Human
ccaccucuccauccug

SEQ ID NO: 2903489 - RNA, 14 nt, Human
ccaccucucuccuu

SEQ ID NO: 2903490 - RNA, 17 nt, Human
ccaccucucuccuuugc

SEQ ID NO: 2903491 - RNA, 15 nt, Human
ccaccucucuuuuuc

SEQ ID NO: 2903492 - RNA, 19 nt, Human
ccaccucucuccuuugcug

SEQ ID NO: 2903493 - RNA, 24 nt, Human
ccaccucucuccuuugcugaggcc

SEQ ID NO: 2903494 - RNA, 10 nt, Human
ccaccucugc

SEQ ID NO: 2903495 - RNA, 11 nt, Human
ccaccucugcg

SEQ ID NO: 2903496 - RNA, 13 nt, Human
ccaccucugcgga

SEQ ID NO: 2903497 - RNA, 18 nt, Human
ccaccucugcggacccca

SEQ ID NO: 2903498 - RNA, 20 nt, Human
ccaccuucaauuccugggcc

SEQ ID NO: 2903499 - RNA, 19 nt, Human
ccaccuucaauuccugggc

SEQ ID NO: 2903500 - RNA, 18 nt, Human
ccaccuucaauuccuggg

SEQ ID NO: 2903501 - RNA, 11 nt, Human
ccaccuguggg

SEQ ID NO: 2903502 - RNA, 12 nt, Human
ccaccugugggu

SEQ ID NO: 2903503 - RNA, 17 nt, Human
ccaccuucaauuccugg

SEQ ID NO: 2903504 - RNA, 21 nt, Human
ccaccugguacucccucucag

SEQ ID NO: 2903505 - RNA, 22 nt, Human
ccaccugggcauauccaccacc

SEQ ID NO: 2903506 - RNA, 19 nt, Human
ccaccucugugaccucagg

SEQ ID NO: 2903507 - RNA, 22 nt, Human
ccaccucugugaccucaggcac

SEQ ID NO: 2903508 - RNA, 23 nt, Human
ccaccucugugaccucaggcacu

SEQ ID NO: 2903509 - RNA, 14 nt, Human
ccaccucuguggca

SEQ ID NO: 2903510 - RNA, 21 nt, Human
ccaccucuguggcauugaaau

SEQ ID NO: 2903511 - RNA, 22 nt, Human
ccaccucugcggaccccagcug

SEQ ID NO: 2903512 - RNA, 19 nt, Human
ccaccucugcggaccccag

SEQ ID NO: 2903513 - RNA, 20 nt, Human
ccaccucugcggaccccagc

SEQ ID NO: 2903514 - RNA, 15 nt, Human
ccaccucugugaccu

SEQ ID NO: 2903515 - RNA, 18 nt, Human
ccaccucugucauuuguu

SEQ ID NO: 2903516 - RNA, 17 nt, Human
ccaccucugugaccuca

SEQ ID NO: 2903517 - RNA, 18 nt, Human
ccaccucugugaccucag

SEQ ID NO: 2903518 - RNA, 13 nt, Human
ccaccccuccaga

SEQ ID NO: 2903519 - RNA, 15 nt, Human
ccacccccaccccca

SEQ ID NO: 2903520 - RNA, 13 nt, Human
ccacccccagcuc

SEQ ID NO: 2903521 - RNA, 16 nt, Human
ccacccccagcucaau

SEQ ID NO: 2903522 - RNA, 18 nt, Human
ccacccccuucucugcuc

SEQ ID NO: 2903523 - RNA, 13 nt, Human
ccacccccuucuc

SEQ ID NO: 2903524 - RNA, 14 nt, Human
ccacccuccuuuca

SEQ ID NO: 2903525 - RNA, 14 nt, Human
ccaccccucccucu

SEQ ID NO: 2903526 - RNA, 11 nt, Human
ccaccccugcu

SEQ ID NO: 2903527 - RNA, 13 nt, Human
ccaccccuuagau

SEQ ID NO: 2903528 - RNA, 23 nt, Human
ccaccccuuagauugaaguaaac

SEQ ID NO: 2903529 - RNA, 15 nt, Human
ccacccucccuggag

SEQ ID NO: 2903530 - RNA, 16 nt, Human
ccacccucccuggagu

SEQ ID NO: 2903531 - RNA, 17 nt, Human
ccacccucccuggagug

SEQ ID NO: 2903532 - RNA, 12 nt, Human
ccacccuccugg

SEQ ID NO: 2903533 - RNA, 13 nt, Human
ccacccuccuggc

SEQ ID NO: 2903534 - RNA, 17 nt, Human
ccacccuccuggccuca

SEQ ID NO: 2903535 - RNA, 23 nt, Human
ccacccuccuggccucagacugc

SEQ ID NO: 2903536 - RNA, 18 nt, Human
ccagacauacgaaacaca

SEQ ID NO: 2903537 - RNA, 20 nt, Human
ccagacauacgaaacacaaa

SEQ ID NO: 2903538 - RNA, 22 nt, Human
ccagacauacgaaacacaaacc

SEQ ID NO: 2903539 - RNA, 19 nt, Human
ccagacaucaugaauuuua

SEQ ID NO: 2903540 - RNA, 21 nt, Human
ccagaccaacguuacucaggg

SEQ ID NO: 2903541 - RNA, 23 nt, Human
ccagaccaacguuacucagggcu

SEQ ID NO: 2903542 - RNA, 24 nt, Human
ccagaccccuggcuuuucacugcu

SEQ ID NO: 2903543 - RNA, 18 nt, Human
ccagaccccuggcuuuuc

SEQ ID NO: 2903544 - RNA, 16 nt, Human
ccagacagugugcugu

SEQ ID NO: 2903545 - RNA, 15 nt, Human
ccagacccggcugcg

SEQ ID NO: 2903546 - RNA, 14 nt, Human
ccagacccggcugc

SEQ ID NO: 2903547 - RNA, 14 nt, Human
ccagagaguggcuc

SEQ ID NO: 2903548 - RNA, 15 nt, Human
ccagagaguggcucc

SEQ ID NO: 2903549 - RNA, 16 nt, Human
ccagagaguggcuccu

SEQ ID NO: 2903550 - RNA, 18 nt, Human
ccagagaguggcuccucc

SEQ ID NO: 2903551 - RNA, 22 nt, Human
ccagagaguggcuccucccggu

SEQ ID NO: 2903552 - RNA, 20 nt, Human
ccagagcauuuccaacacca

SEQ ID NO: 2903553 - RNA, 14 nt, Human
ccagagaguccugu

SEQ ID NO: 2903554 - RNA, 21 nt, Human
ccagagcauuuccaacaccac

SEQ ID NO: 2903555 - RNA, 22 nt, Human
ccagagcauuuccaacaccaca

SEQ ID NO: 2903556 - RNA, 23 nt, Human
ccagagcauuuccaacaccacag

SEQ ID NO: 2903557 - RNA, 13 nt, Human
ccagagccacaca

SEQ ID NO: 2903558 - RNA, 14 nt, Human
ccagagccacacau

SEQ ID NO: 2903559 - RNA, 15 nt, Human
ccagagccacacaug

SEQ ID NO: 2903560 - RNA, 16 nt, Human
ccagagccacacaugg

SEQ ID NO: 2903561 - RNA, 19 nt, Human
ccagagccacacaugggca

SEQ ID NO: 2903562 - RNA, 16 nt, Human
ccagaaucuaaagcca

SEQ ID NO: 2903563 - RNA, 13 nt, Human
ccagaaucccagc

SEQ ID NO: 2903564 - RNA, 14 nt, Human
ccagaaucccagcc

SEQ ID NO: 2903565 - RNA, 15 nt, Human
ccagaaucccagccg

SEQ ID NO: 2903566 - RNA, 21 nt, Human
ccagaaucccucuacauggac

SEQ ID NO: 2903567 - RNA, 17 nt, Human
ccagaaugcuguacauc

SEQ ID NO: 2903568 - RNA, 16 nt, Human
ccagaaugcuguacau

SEQ ID NO: 2903569 - RNA, 16 nt, Human
ccagaagcuuccauag

SEQ ID NO: 2903570 - RNA, 20 nt, Human
ccagaagccucuggcuagag

SEQ ID NO: 2903571 - RNA, 19 nt, Human
ccagaagccucuggcuaga

SEQ ID NO: 2903572 - RNA, 16 nt, Human
ccagaagccucuggcu

SEQ ID NO: 2903573 - RNA, 15 nt, Human
ccagaagccucuggc

SEQ ID NO: 2903574 - RNA, 15 nt, Human
ccagaagcuuccaua

SEQ ID NO: 2903575 - RNA, 17 nt, Human
ccacugucacccuccac

SEQ ID NO: 2903576 - RNA, 18 nt, Human
ccacugggguccagggag

SEQ ID NO: 2903577 - RNA, 19 nt, Human
ccacugggguccagggagc

SEQ ID NO: 2903578 - RNA, 22 nt, Human
ccacugggguccagggagcagg

SEQ ID NO: 2903579 - RNA, 15 nt, Human
ccacugcucugguua

SEQ ID NO: 2903580 - RNA, 13 nt, Human
ccacugcucuggu

SEQ ID NO: 2903581 - RNA, 12 nt, Human
ccacugcucugg

SEQ ID NO: 2903582 - RNA, 11 nt, Human
ccacugcucug

SEQ ID NO: 2903583 - RNA, 20 nt, Human
ccacugcuuuuggucugugu

SEQ ID NO: 2903584 - RNA, 21 nt, Human
ccacugccuucgauacaccgg

SEQ ID NO: 2903585 - RNA, 18 nt, Human
ccacugcugcaguagggg

SEQ ID NO: 2903586 - RNA, 22 nt, Human
ccacugcuuuuggucuguguga

SEQ ID NO: 2903587 - RNA, 18 nt, Human
ccacugcauaccaaccug

SEQ ID NO: 2903588 - RNA, 14 nt, Human
ccaccuugcgggga

SEQ ID NO: 2903589 - RNA, 14 nt, Human
ccaccuucccaugc

SEQ ID NO: 2903590 - RNA, 23 nt, Human
ccaccugguacucccucucagga

SEQ ID NO: 2903591 - RNA, 20 nt, Human
ccacugccagcagcagcagg

SEQ ID NO: 2903592 - RNA, 20 nt, Human
ccacugccucuggaauugcu

SEQ ID NO: 2903593 - RNA, 16 nt, Human
ccacugccucuuccuc

SEQ ID NO: 2903594 - RNA, 23 nt, Human
ccacugccagcagcagcagguga

SEQ ID NO: 2903595 - RNA, 13 nt, Human
ccacugccucugc

SEQ ID NO: 2903596 - RNA, 14 nt, Human
ccacugccucugcc

SEQ ID NO: 2903597 - RNA, 15 nt, Human
ccacugccucugccu

SEQ ID NO: 2903598 - RNA, 16 nt, Human
ccacugccucugccuu

SEQ ID NO: 2903599 - RNA, 17 nt, Human
ccacugccucugccuua

SEQ ID NO: 2903600 - RNA, 18 nt, Human
ccacugccucugccuuag

SEQ ID NO: 2903601 - RNA, 21 nt, Human
ccacugccucugccuuagagg

SEQ ID NO: 2903602 - RNA, 13 nt, Human
ccacugccucuuc

SEQ ID NO: 2903603 - RNA, 17 nt, Human
ccacugccagcagcagc

SEQ ID NO: 2903604 - RNA, 16 nt, Human
ccacugccagcagcag

SEQ ID NO: 2903605 - RNA, 15 nt, Human
ccacugccagcagca

SEQ ID NO: 2903606 - RNA, 14 nt, Human
ccacugccagcagc

SEQ ID NO: 2903607 - RNA, 13 nt, Human
ccacugccagcag

SEQ ID NO: 2903608 - RNA, 19 nt, Human
ccacugcauaccaaccugg

SEQ ID NO: 2903609 - RNA, 13 nt, Human
ccagaacuucccu

SEQ ID NO: 2903610 - RNA, 14 nt, Human
ccagaacuucccug

SEQ ID NO: 2903611 - RNA, 15 nt, Human
ccagaacuucccuga

SEQ ID NO: 2903612 - RNA, 18 nt, Human
ccagaagaaaauucuccu

SEQ ID NO: 2903613 - RNA, 18 nt, Human
ccagaagaagagaagcug

SEQ ID NO: 2903614 - RNA, 19 nt, Human
ccagaagaagagaagcugc

SEQ ID NO: 2903615 - RNA, 20 nt, Human
ccagaagaagagaagcugcu

SEQ ID NO: 2903616 - RNA, 19 nt, Human
ccagaacucacuggggccu

SEQ ID NO: 2903617 - RNA, 19 nt, Human
ccagaaccaccccggcccc

SEQ ID NO: 2903618 - RNA, 13 nt, Human
ccagaacccauuu

SEQ ID NO: 2903619 - RNA, 16 nt, Human
ccagaaaaccccagca

SEQ ID NO: 2903620 - RNA, 15 nt, Human
ccagaaaaccccagc

SEQ ID NO: 2903621 - RNA, 19 nt, Human
ccagaaaaaaaaaaacuua

SEQ ID NO: 2903622 - RNA, 16 nt, Human
ccacugugccaugugc

SEQ ID NO: 2903623 - RNA, 15 nt, Human
ccacugugccaugug

SEQ ID NO: 2903624 - RNA, 19 nt, Human
ccacugugccaugugccag

SEQ ID NO: 2903625 - RNA, 16 nt, Human
ccacugguuccuucuu

SEQ ID NO: 2903626 - RNA, 20 nt, Human
ccacugugcaggugcuauug

SEQ ID NO: 2903627 - RNA, 13 nt, Human
ccacugugguggc

SEQ ID NO: 2903628 - RNA, 12 nt, Human
ccacuguguaua

SEQ ID NO: 2903629 - RNA, 15 nt, Human
ccacugugccuuugc

SEQ ID NO: 2903630 - RNA, 20 nt, Human
ccacugugccuuugcaaauc

SEQ ID NO: 2903631 - RNA, 21 nt, Human
ccacugugccuuugcaaauca

SEQ ID NO: 2903632 - RNA, 22 nt, Human
ccacugugccuuugcaaaucag

SEQ ID NO: 2903633 - RNA, 23 nt, Human
ccacuguuucucuugagcuggcc

SEQ ID NO: 2903634 - RNA, 15 nt, Human
ccacuguuucuugcu

SEQ ID NO: 2903635 - RNA, 17 nt, Human
ccacuguuucuugcuug

SEQ ID NO: 2903636 - RNA, 18 nt, Human
ccacuguuucuugcuugu

SEQ ID NO: 2903637 - RNA, 20 nt, Human
ccacuguuucuugcuuguac

SEQ ID NO: 2903638 - RNA, 22 nt, Human
ccacuguuucucuugagcuggc

SEQ ID NO: 2903639 - RNA, 21 nt, Human
ccacuguuucucuugagcugg

SEQ ID NO: 2903640 - RNA, 19 nt, Human
ccacuguuucucuugagcu

SEQ ID NO: 2903641 - RNA, 18 nt, Human
ccacuguuucucuugagc

SEQ ID NO: 2903642 - RNA, 17 nt, Human
ccacuguuucucuugag

SEQ ID NO: 2903643 - RNA, 12 nt, Human
ccacuuuuuaac

SEQ ID NO: 2903644 - RNA, 19 nt, Human
ccagccugcccaagcccag

SEQ ID NO: 2903645 - RNA, 20 nt, Human
ccagccugcccaagcccagg

SEQ ID NO: 2903646 - RNA, 22 nt, Human
ccagccugcccaagcccaggcc

SEQ ID NO: 2903647 - RNA, 23 nt, Human
ccagccugcccaagcccaggcca

SEQ ID NO: 2903648 - RNA, 13 nt, Human
ccagcgagcccug

SEQ ID NO: 2903649 - RNA, 16 nt, Human
ccagcucccucuauuu

SEQ ID NO: 2903650 - RNA, 19 nt, Human
ccagccuuuggccuuggcu

SEQ ID NO: 2903651 - RNA, 12 nt, Human
ccagcuccucau

SEQ ID NO: 2903652 - RNA, 23 nt, Human
ccagcuccucauccagggcucug

SEQ ID NO: 2903653 - RNA, 16 nt, Human
ccagccugggcgacag

SEQ ID NO: 2903654 - RNA, 19 nt, Human
ccagccugucccauggaca

SEQ ID NO: 2903655 - RNA, 23 nt, Human
ccagccugucccauggacacucc

SEQ ID NO: 2903656 - RNA, 19 nt, Human
ccagccugggcgacagagc

SEQ ID NO: 2903657 - RNA, 14 nt, Human
ccagccuggggccu

SEQ ID NO: 2903658 - RNA, 17 nt, Human
ccagccuggggccuggc

SEQ ID NO: 2903659 - RNA, 18 nt, Human
ccagccuggggccuggca

SEQ ID NO: 2903660 - RNA, 19 nt, Human
ccagccuggggccuggcag

SEQ ID NO: 2903661 - RNA, 20 nt, Human
ccagccuggggccuggcagg

SEQ ID NO: 2903662 - RNA, 23 nt, Human
ccagccugggcagccaggcugcc

SEQ ID NO: 2903663 - RNA, 22 nt, Human
ccagccugggcagccaggcugc

SEQ ID NO: 2903664 - RNA, 18 nt, Human
ccagccugggcaacaaag

SEQ ID NO: 2903665 - RNA, 18 nt, Human
ccagccugggcagccagg

SEQ ID NO: 2903666 - RNA, 16 nt, Human
ccagccugggcagcca

SEQ ID NO: 2903667 - RNA, 19 nt, Human
ccagccugggcaacagagc

SEQ ID NO: 2903668 - RNA, 13 nt, Human
ccagccugaggca

SEQ ID NO: 2903669 - RNA, 18 nt, Human
ccagccuggcuucuggag

SEQ ID NO: 2903670 - RNA, 17 nt, Human
ccagccuggcuucugga

SEQ ID NO: 2903671 - RNA, 15 nt, Human
ccagccuggcuucug

SEQ ID NO: 2903672 - RNA, 13 nt, Human
ccagccuggcuuc

SEQ ID NO: 2903673 - RNA, 20 nt, Human
ccagccuggcuucuggagcc

SEQ ID NO: 2903674 - RNA, 19 nt, Human
ccagccuggcuucuggagc

SEQ ID NO: 2903675 - RNA, 21 nt, Human
ccagccuggcuucuggagccc

SEQ ID NO: 2903676 - RNA, 16 nt, Human
ccagccugggaggcac

SEQ ID NO: 2903677 - RNA, 17 nt, Human
ccagccugggaggcaca

SEQ ID NO: 2903678 - RNA, 18 nt, Human
ccagccugggaggcacag

SEQ ID NO: 2903679 - RNA, 20 nt, Human
ccagccugggaggcacagca

SEQ ID NO: 2903680 - RNA, 23 nt, Human
ccagccugggaggcacagcaaac

SEQ ID NO: 2903681 - RNA, 15 nt, Human
ccagcccuggggcug

SEQ ID NO: 2903682 - RNA, 19 nt, Human
ccagcccuggggcugggcc

SEQ ID NO: 2903683 - RNA, 23 nt, Human
ccagccgccauugccaccaggag

SEQ ID NO: 2903684 - RNA, 20 nt, Human
ccagccgccauugccaccag

SEQ ID NO: 2903685 - RNA, 17 nt, Human
ccagccgcucuccugcc

SEQ ID NO: 2903686 - RNA, 18 nt, Human
ccagccgcucuccugcca

SEQ ID NO: 2903687 - RNA, 19 nt, Human
ccagccgcucuccugccac

SEQ ID NO: 2903688 - RNA, 20 nt, Human
ccagccgcucuccugccaca

SEQ ID NO: 2903689 - RNA, 21 nt, Human
ccagccgcucuccugccacau

SEQ ID NO: 2903690 - RNA, 16 nt, Human
ccagccggccaaugga

SEQ ID NO: 2903691 - RNA, 17 nt, Human
ccagccggccaauggaa

SEQ ID NO: 2903692 - RNA, 19 nt, Human
ccagccggccaauggaaac

SEQ ID NO: 2903693 - RNA, 22 nt, Human
ccagccggccaauggaaaccuc

SEQ ID NO: 2903694 - RNA, 19 nt, Human
ccagcccauggcccugugc

SEQ ID NO: 2903695 - RNA, 16 nt, Human
ccagcccaucucggag

SEQ ID NO: 2903696 - RNA, 17 nt, Human
ccagcccaucucggagc

SEQ ID NO: 2903697 - RNA, 20 nt, Human
ccagcccaucucggagcauc

SEQ ID NO: 2903698 - RNA, 14 nt, Human
ccagcccagggugg

SEQ ID NO: 2903699 - RNA, 13 nt, Human
ccagcccuggcuc

SEQ ID NO: 2903700 - RNA, 17 nt, Human
ccagcccuggcucugca

SEQ ID NO: 2903701 - RNA, 19 nt, Human
ccagccauuaccauggaga

SEQ ID NO: 2903702 - RNA, 21 nt, Human
ccagccauuaccauggagaca

SEQ ID NO: 2903703 - RNA, 12 nt, Human
ccagcccaaagg

SEQ ID NO: 2903704 - RNA, 21 nt, Human
ccagcccaaaggggacaggcc

SEQ ID NO: 2903705 - RNA, 22 nt, Human
ccagcccaaaggggacaggccu

SEQ ID NO: 2903706 - RNA, 23 nt, Human
ccagcccaaaggggacaggccuc

SEQ ID NO: 2903707 - RNA, 24 nt, Human
ccagcccaaaggggacaggccuca

SEQ ID NO: 2903708 - RNA, 18 nt, Human
ccagccaucaaaaugcuu

SEQ ID NO: 2903709 - RNA, 16 nt, Human
ccagccaucaaaaugc

SEQ ID NO: 2903710 - RNA, 21 nt, Human
ccagccauacuuaucucucug

SEQ ID NO: 2903711 - RNA, 22 nt, Human
ccagccauacuuaucucucugu

SEQ ID NO: 2903712 - RNA, 17 nt, Human
ccagcccacuucugcca

SEQ ID NO: 2903713 - RNA, 16 nt, Human
ccagcccacuucugcc

SEQ ID NO: 2903714 - RNA, 12 nt, Human
ccagcccaaucc

SEQ ID NO: 2903715 - RNA, 15 nt, Human
ccagcccaauccagg

SEQ ID NO: 2903716 - RNA, 18 nt, Human
ccagcccaauccagguac

SEQ ID NO: 2903717 - RNA, 12 nt, Human
ccagcccacauu

SEQ ID NO: 2903718 - RNA, 17 nt, Human
ccagcccagauugucuu

SEQ ID NO: 2903719 - RNA, 22 nt, Human
ccagauuguaucaugugcuaga

SEQ ID NO: 2903720 - RNA, 22 nt, Human
ccagauugcaacaggcugggcu

SEQ ID NO: 2903721 - RNA, 18 nt, Human
ccagauugcaacaggcug

SEQ ID NO: 2903722 - RNA, 23 nt, Human
ccagauugcaacaggcugggcuu

SEQ ID NO: 2903723 - RNA, 14 nt, Human
ccagagcccaccuu

SEQ ID NO: 2903724 - RNA, 16 nt, Human
ccagauugcaacaggc

SEQ ID NO: 2903725 - RNA, 14 nt, Human
ccagauugcaacag

SEQ ID NO: 2903726 - RNA, 19 nt, Human
ccagagcggaggcugugug

SEQ ID NO: 2903727 - RNA, 22 nt, Human
ccagagcggaggcugugugccu

SEQ ID NO: 2903728 - RNA, 19 nt, Human
ccagcaagugagagcuggg

SEQ ID NO: 2903729 - RNA, 18 nt, Human
ccagcaagugagagcugg

SEQ ID NO: 2903730 - RNA, 17 nt, Human
ccagcaagugagagcug

SEQ ID NO: 2903731 - RNA, 20 nt, Human
ccagcaacacagccugggcc

SEQ ID NO: 2903732 - RNA, 19 nt, Human
ccagcaacacagccugggc

SEQ ID NO: 2903733 - RNA, 17 nt, Human
ccagcaacacagccugg

SEQ ID NO: 2903734 - RNA, 16 nt, Human
ccagcaacacagccug

SEQ ID NO: 2903735 - RNA, 15 nt, Human
ccagcaacacagccu

SEQ ID NO: 2903736 - RNA, 14 nt, Human
ccagcaacacagcc

SEQ ID NO: 2903737 - RNA, 19 nt, Human
ccagcaccaacaccacggu

SEQ ID NO: 2903738 - RNA, 15 nt, Human
ccagcacacugggag

SEQ ID NO: 2903739 - RNA, 20 nt, Human
ccagcacacugggaggccga

SEQ ID NO: 2903740 - RNA, 22 nt, Human
ccagcaacacagccugggcccc

SEQ ID NO: 2903741 - RNA, 12 nt, Human
ccagcacaaaca

SEQ ID NO: 2903742 - RNA, 13 nt, Human
ccagcacaaacac

SEQ ID NO: 2903743 - RNA, 17 nt, Human
ccagcacaaacacaagg

SEQ ID NO: 2903744 - RNA, 20 nt, Human
ccagcacaaacacaagguca

SEQ ID NO: 2903745 - RNA, 21 nt, Human
ccagcaauucuccugccucag

SEQ ID NO: 2903746 - RNA, 18 nt, Human
ccagcaccucagccugca

SEQ ID NO: 2903747 - RNA, 15 nt, Human
ccagcaccugccucc

SEQ ID NO: 2903748 - RNA, 16 nt, Human
ccagcaccugccuccu

SEQ ID NO: 2903749 - RNA, 17 nt, Human
ccagcaccugccuccuc

SEQ ID NO: 2903750 - RNA, 17 nt, Human
ccagcaccucagccugc

SEQ ID NO: 2903751 - RNA, 15 nt, Human
ccagcaaaagguugu

SEQ ID NO: 2903752 - RNA, 15 nt, Human
ccagcaaacaaaaug

SEQ ID NO: 2903753 - RNA, 13 nt, Human
ccagauuuuuaau

SEQ ID NO: 2903754 - RNA, 21 nt, Human
ccagauuugcuaauuuauccu

SEQ ID NO: 2903755 - RNA, 24 nt, Human
ccagauuuuuuacagcugccugca

SEQ ID NO: 2903756 - RNA, 18 nt, Human
ccagauuuuucggaggcc

SEQ ID NO: 2903757 - RNA, 22 nt, Human
ccagauuuuucggaggccccac

SEQ ID NO: 2903758 - RNA, 13 nt, Human
ccagguagaaacu

SEQ ID NO: 2903759 - RNA, 19 nt, Human
ccagguacgcacagacagg

SEQ ID NO: 2903760 - RNA, 22 nt, Human
ccaggguggacuuagaaagcag

SEQ ID NO: 2903761 - RNA, 15 nt, Human
ccagggugcccagaa

SEQ ID NO: 2903762 - RNA, 22 nt, Human
ccagggugcccagaacuucccu

SEQ ID NO: 2903763 - RNA, 20 nt, Human
ccaggguggacuuagaaagc

SEQ ID NO: 2903764 - RNA, 21 nt, Human
ccaggguggacuuagaaagca

SEQ ID NO: 2903765 - RNA, 23 nt, Human
ccagggucuucccuaccucaggc

SEQ ID NO: 2903766 - RNA, 14 nt, Human
ccagggucuucccu

SEQ ID NO: 2903767 - RNA, 16 nt, Human
ccagggucucucccuc

SEQ ID NO: 2903768 - RNA, 18 nt, Human
ccagggucucucccucag

SEQ ID NO: 2903769 - RNA, 16 nt, Human
ccagggucugugugaa

SEQ ID NO: 2903770 - RNA, 20 nt, Human
ccagggucugugugaaugug

SEQ ID NO: 2903771 - RNA, 22 nt, Human
ccagggucugugugaauguggg

SEQ ID NO: 2903772 - RNA, 15 nt, Human
ccagggcccugcaga

SEQ ID NO: 2903773 - RNA, 16 nt, Human
ccagggccgaggaggu

SEQ ID NO: 2903774 - RNA, 14 nt, Human
ccagggcccugcag

SEQ ID NO: 2903775 - RNA, 16 nt, Human
ccagggccugagccug

SEQ ID NO: 2903776 - RNA, 14 nt, Human
ccagggccugagcc

SEQ ID NO: 2903777 - RNA, 23 nt, Human
ccagggccugcaggaccugccug

SEQ ID NO: 2903778 - RNA, 19 nt, Human
ccagggccugagccuggcc

SEQ ID NO: 2903779 - RNA, 18 nt, Human
ccagggccugagccuggc

SEQ ID NO: 2903780 - RNA, 17 nt, Human
ccagggccugagccugg

SEQ ID NO: 2903781 - RNA, 14 nt, Human
ccagcucccucuau

SEQ ID NO: 2903782 - RNA, 18 nt, Human
ccagggagccuuugguuc

SEQ ID NO: 2903783 - RNA, 22 nt, Human
ccagggagccuuugguucuggc

SEQ ID NO: 2903784 - RNA, 18 nt, Human
ccaggcugggcaaggagg

SEQ ID NO: 2903785 - RNA, 20 nt, Human
ccaggcugggcaaggaggcc

SEQ ID NO: 2903786 - RNA, 16 nt, Human
ccaggcuggucuaaaa

SEQ ID NO: 2903787 - RNA, 16 nt, Human
ccaggcugggugacag

SEQ ID NO: 2903788 - RNA, 17 nt, Human
ccaggcugggugacaga

SEQ ID NO: 2903789 - RNA, 17 nt, Human
ccaggcuggucuaaaac

SEQ ID NO: 2903790 - RNA, 20 nt, Human
ccaggcuggucuaaaacucc

SEQ ID NO: 2903791 - RNA, 22 nt, Human
ccagggagcuugaaaguuuuca

SEQ ID NO: 2903792 - RNA, 14 nt, Human
ccaggcuggucuca

SEQ ID NO: 2903793 - RNA, 17 nt, Human
ccagcucgcaccccccu

SEQ ID NO: 2903794 - RNA, 13 nt, Human
ccagcucuaaguc

SEQ ID NO: 2903795 - RNA, 16 nt, Human
ccaggccccugccacc

SEQ ID NO: 2903796 - RNA, 15 nt, Human
ccaggccccugccac

SEQ ID NO: 2903797 - RNA, 14 nt, Human
ccaggccccugcca

SEQ ID NO: 2903798 - RNA, 12 nt, Human
ccaggccagagg

SEQ ID NO: 2903799 - RNA, 16 nt, Human
ccaggcccgucugucc

SEQ ID NO: 2903800 - RNA, 17 nt, Human
ccaggcccgucugucca

SEQ ID NO: 2903801 - RNA, 18 nt, Human
ccaggcccgucuguccau

SEQ ID NO: 2903802 - RNA, 20 nt, Human
ccaggcccgucuguccaucu

SEQ ID NO: 2903803 - RNA, 22 nt, Human
ccaggcccgucuguccaucugc

SEQ ID NO: 2903804 - RNA, 23 nt, Human
ccaggcccgucuguccaucugcc

SEQ ID NO: 2903805 - RNA, 22 nt, Human
ccaucuaugucccuugcuguga

SEQ ID NO: 2903806 - RNA, 20 nt, Human
ccaucuaugucccuugcugu

SEQ ID NO: 2903807 - RNA, 14 nt, Human
ccaucucucccucc

SEQ ID NO: 2903808 - RNA, 23 nt, Human
ccaucucucccuccccugccauu

SEQ ID NO: 2903809 - RNA, 17 nt, Human
ccaucucucccuccccu

SEQ ID NO: 2903810 - RNA, 23 nt, Human
ccagugugacaaggauugcuacu

SEQ ID NO: 2903811 - RNA, 14 nt, Human
ccagugugacaagg

SEQ ID NO: 2903812 - RNA, 12 nt, Human
ccaguguggaac

SEQ ID NO: 2903813 - RNA, 22 nt, Human
ccagugugaucccaagugccag

SEQ ID NO: 2903814 - RNA, 15 nt, Human
ccagugugcugaugg

SEQ ID NO: 2903815 - RNA, 19 nt, Human
ccagugugcugaugggcgu

SEQ ID NO: 2903816 - RNA, 15 nt, Human
ccagugugaucccaa

SEQ ID NO: 2903817 - RNA, 21 nt, Human
ccauaugccuuggggaggaca

SEQ ID NO: 2903818 - RNA, 22 nt, Human
ccauaugccuuggggaggacaa

SEQ ID NO: 2903819 - RNA, 13 nt, Human
ccaucaugucugg

SEQ ID NO: 2903820 - RNA, 12 nt, Human
ccaucaugucug

SEQ ID NO: 2903821 - RNA, 16 nt, Human
ccaucaugcccggucc

SEQ ID NO: 2903822 - RNA, 22 nt, Human
ccaucaugcccggucccacccc

SEQ ID NO: 2903823 - RNA, 14 nt, Human
ccaggugcaguggc

SEQ ID NO: 2903824 - RNA, 22 nt, Human
ccaggugcaguggcucacgccu

SEQ ID NO: 2903825 - RNA, 15 nt, Human
ccagguggaaggcag

SEQ ID NO: 2903826 - RNA, 19 nt, Human
ccagguggaaggcagacag

SEQ ID NO: 2903827 - RNA, 20 nt, Human
ccagguggaaggcagacagc

SEQ ID NO: 2903828 - RNA, 16 nt, Human
ccagguggccacucca

SEQ ID NO: 2903829 - RNA, 21 nt, Human
ccagguggccacuccagaccc

SEQ ID NO: 2903830 - RNA, 14 nt, Human
ccagguagaaacuu

SEQ ID NO: 2903831 - RNA, 13 nt, Human
ccagguagcuggg

SEQ ID NO: 2903832 - RNA, 14 nt, Human
ccagguagcuggga

SEQ ID NO: 2903833 - RNA, 16 nt, Human
ccagguagcugggauu

SEQ ID NO: 2903834 - RNA, 20 nt, Human
ccagguagcugggauuacag

SEQ ID NO: 2903835 - RNA, 14 nt, Human
ccagguauggcucu

SEQ ID NO: 2903836 - RNA, 15 nt, Human
ccagguauggcucug

SEQ ID NO: 2903837 - RNA, 17 nt, Human
ccagguauggcucugca

SEQ ID NO: 2903838 - RNA, 22 nt, Human
ccagguauagagaaaggucuau

SEQ ID NO: 2903839 - RNA, 17 nt, Human
ccagguuucuggucucu

SEQ ID NO: 2903840 - RNA, 22 nt, Human
ccagguuucuggucucuaggcu

SEQ ID NO: 2903841 - RNA, 16 nt, Human
ccagguuucuaugugu

SEQ ID NO: 2903842 - RNA, 23 nt, Human
ccagugaauucuugaaggaaaau

SEQ ID NO: 2903843 - RNA, 17 nt, Human
ccagugaccccugaccu

SEQ ID NO: 2903844 - RNA, 18 nt, Human
ccagugaccugcugggua

SEQ ID NO: 2903845 - RNA, 20 nt, Human
ccagugaccugcuggguaaa

SEQ ID NO: 2903846 - RNA, 22 nt, Human
ccagugaccugcuggguaaacu

SEQ ID NO: 2903847 - RNA, 21 nt, Human
ccagugagaugagggaugggc

SEQ ID NO: 2903848 - RNA, 13 nt, Human
ccagugagaugca

SEQ ID NO: 2903849 - RNA, 14 nt, Human
ccagugagaugcau

SEQ ID NO: 2903850 - RNA, 17 nt, Human
ccagugagaugcauucu

SEQ ID NO: 2903851 - RNA, 21 nt, Human
ccagugagaugcauucuuggu

SEQ ID NO: 2903852 - RNA, 13 nt, Human
ccagugcaggcug

SEQ ID NO: 2903853 - RNA, 15 nt, Human
ccagugcaggcuggc

SEQ ID NO: 2903854 - RNA, 16 nt, Human
ccagugcaggcuggcc

SEQ ID NO: 2903855 - RNA, 17 nt, Human
ccagugcaggcuggcca

SEQ ID NO: 2903856 - RNA, 18 nt, Human
ccagugcaggcuggccag

SEQ ID NO: 2903857 - RNA, 19 nt, Human
ccagugcaggcuggccagc

SEQ ID NO: 2903858 - RNA, 20 nt, Human
ccagugcaggcuggccagcc

SEQ ID NO: 2903859 - RNA, 21 nt, Human
ccagugcaggcuggccagccg

SEQ ID NO: 2903860 - RNA, 22 nt, Human
ccagugcaggcuggccagccgc

SEQ ID NO: 2903861 - RNA, 12 nt, Human
ccagugccaagg

SEQ ID NO: 2903862 - RNA, 13 nt, Human
ccagugccaagga

SEQ ID NO: 2903863 - RNA, 14 nt, Human
ccagugccaaggac

SEQ ID NO: 2903864 - RNA, 16 nt, Human
ccagugccaaggaccu

SEQ ID NO: 2903865 - RNA, 19 nt, Human
ccagugcccaaagucugug

SEQ ID NO: 2903866 - RNA, 22 nt, Human
ccagugcccaaagucuguguga

SEQ ID NO: 2903867 - RNA, 23 nt, Human
ccagugagggacgucagacuugg

SEQ ID NO: 2903868 - RNA, 19 nt, Human
ccagugagucucuggggca

SEQ ID NO: 2903869 - RNA, 22 nt, Human
ccagugagggacgucagacuug

SEQ ID NO: 2903870 - RNA, 21 nt, Human
ccaguggccacucagcuuccu

SEQ ID NO: 2903871 - RNA, 19 nt, Human
ccaguggccuuaccccugc

SEQ ID NO: 2903872 - RNA, 22 nt, Human
ccaguggccuuaccccugccuu

SEQ ID NO: 2903873 - RNA, 15 nt, Human
ccaguggccacucag

SEQ ID NO: 2903874 - RNA, 16 nt, Human
ccaguggccacucagc

SEQ ID NO: 2903875 - RNA, 17 nt, Human
ccaguggccacucagcu

SEQ ID NO: 2903876 - RNA, 20 nt, Human
ccaguggcguuguugcaugu

SEQ ID NO: 2903877 - RNA, 13 nt, Human
ccaguggcugcug

SEQ ID NO: 2903878 - RNA, 14 nt, Human
ccaguggcugcugc

SEQ ID NO: 2903879 - RNA, 15 nt, Human
ccaguggcugcugcc

SEQ ID NO: 2903880 - RNA, 16 nt, Human
ccaguggcugcugccc

SEQ ID NO: 2903881 - RNA, 17 nt, Human
ccaguggcugcugccca

SEQ ID NO: 2903882 - RNA, 21 nt, Human
ccauuugcguuccaugaugcu

SEQ ID NO: 2903883 - RNA, 18 nt, Human
ccauuugcuacuguacau

SEQ ID NO: 2903884 - RNA, 20 nt, Human
ccauuugcuacuguacauaa

SEQ ID NO: 2903885 - RNA, 16 nt, Human
ccauuugcuuuuucac

SEQ ID NO: 2903886 - RNA, 18 nt, Human
ccauuuuccuacaggcag

SEQ ID NO: 2903887 - RNA, 22 nt, Human
ccauuuuccuacaggcagucuc

SEQ ID NO: 2903888 - RNA, 23 nt, Human
ccauuuuccuacaggcagucucu

SEQ ID NO: 2903889 - RNA, 22 nt, Human
ccauuuuauaaagugcuugugu

SEQ ID NO: 2903890 - RNA, 15 nt, Human
ccauucugccugccc

SEQ ID NO: 2903891 - RNA, 15 nt, Human
ccauucugcccugug

SEQ ID NO: 2903892 - RNA, 22 nt, Human
ccauucugccgcccccuccuga

SEQ ID NO: 2903893 - RNA, 22 nt, Human
ccauuugccaauuuuccuacuc

SEQ ID NO: 2903894 - RNA, 13 nt, Human
ccauuugaagugu

SEQ ID NO: 2903895 - RNA, 20 nt, Human
ccauuugaggauuuagaagu

SEQ ID NO: 2903896 - RNA, 12 nt, Human
ccauuugauacc

SEQ ID NO: 2903897 - RNA, 19 nt, Human
ccauuugauaccccugggg

SEQ ID NO: 2903898 - RNA, 21 nt, Human
ccauuugauaccccuggggaa

SEQ ID NO: 2903899 - RNA, 17 nt, Human
ccauuugauuuuucuaa

SEQ ID NO: 2903900 - RNA, 15 nt, Human
ccauucucaucugca

SEQ ID NO: 2903901 - RNA, 16 nt, Human
ccauucucaucugcac

SEQ ID NO: 2903902 - RNA, 18 nt, Human
ccauucucaucugcaccc

SEQ ID NO: 2903903 - RNA, 22 nt, Human
ccauucucaucugcacccuucu

SEQ ID NO: 2903904 - RNA, 12 nt, Human
ccauucuaugug

SEQ ID NO: 2903905 - RNA, 17 nt, Human
ccauucuauuuuagaau

SEQ ID NO: 2903906 - RNA, 18 nt, Human
ccauucgcgcucugcuca

SEQ ID NO: 2903907 - RNA, 16 nt, Human
ccauuagagucagccu

SEQ ID NO: 2903908 - RNA, 14 nt, Human
ccauuaucccugaa

SEQ ID NO: 2903909 - RNA, 21 nt, Human
ccauuaucccugaaucccccu

SEQ ID NO: 2903910 - RNA, 14 nt, Human
ccauuaaaacugcu

SEQ ID NO: 2903911 - RNA, 15 nt, Human
ccauuaaaacugcuu

SEQ ID NO: 2903912 - RNA, 16 nt, Human
ccauuaaaacugcuuu

SEQ ID NO: 2903913 - RNA, 15 nt, Human
ccauguuaacaugac

SEQ ID NO: 2903914 - RNA, 22 nt, Human
ccauguuaauuucaugugucaa

SEQ ID NO: 2903915 - RNA, 22 nt, Human
ccauguucacaccgcugcacuc

SEQ ID NO: 2903916 - RNA, 14 nt, Human
ccauguucugcccc

SEQ ID NO: 2903917 - RNA, 16 nt, Human
ccauguucugccccca

SEQ ID NO: 2903918 - RNA, 17 nt, Human
ccauguucugcccccag

SEQ ID NO: 2903919 - RNA, 18 nt, Human
ccauguucugcccccagc

SEQ ID NO: 2903920 - RNA, 19 nt, Human
ccauguucugcccccagcc

SEQ ID NO: 2903921 - RNA, 20 nt, Human
ccauguucugcccccagccc

SEQ ID NO: 2903922 - RNA, 21 nt, Human
ccauguucugcccccagccca

SEQ ID NO: 2903923 - RNA, 22 nt, Human
ccauguucugcccccagcccaa

SEQ ID NO: 2903924 - RNA, 15 nt, Human
ccauuaaaguucuca

SEQ ID NO: 2903925 - RNA, 15 nt, Human
ccauuaaaugaauau

SEQ ID NO: 2903926 - RNA, 16 nt, Human
ccauuaaaugaauauu

SEQ ID NO: 2903927 - RNA, 17 nt, Human
ccauuaaaugaauauuu

SEQ ID NO: 2903928 - RNA, 19 nt, Human
ccauuaaaugaauauuuug

SEQ ID NO: 2903929 - RNA, 13 nt, Human
ccauuaaagucug

SEQ ID NO: 2903930 - RNA, 14 nt, Human
ccauuaaagucuga

SEQ ID NO: 2903931 - RNA, 15 nt, Human
ccauuaaagucugaa

SEQ ID NO: 2903932 - RNA, 16 nt, Human
ccauuaaagucugaau

SEQ ID NO: 2903933 - RNA, 14 nt, Human
ccauuaccauggag

SEQ ID NO: 2903934 - RNA, 16 nt, Human
ccauuaaucauuuccc

SEQ ID NO: 2903935 - RNA, 18 nt, Human
ccauuaaucauuucccca

SEQ ID NO: 2903936 - RNA, 14 nt, Human
ccauguguccuggu

SEQ ID NO: 2903937 - RNA, 20 nt, Human
ccaugugucacuugugcuuu

SEQ ID NO: 2903938 - RNA, 20 nt, Human
ccaucuucgggaccaggauu

SEQ ID NO: 2903939 - RNA, 17 nt, Human
ccauguguccugguucc

SEQ ID NO: 2903940 - RNA, 15 nt, Human
ccaucuguguccugg

SEQ ID NO: 2903941 - RNA, 17 nt, Human
ccaucuaguacuugaaa

SEQ ID NO: 2903942 - RNA, 15 nt, Human
ccaucuuacuugagc

SEQ ID NO: 2903943 - RNA, 15 nt, Human
ccaucuuaguuugga

SEQ ID NO: 2903944 - RNA, 14 nt, Human
ccaucuucacccag

SEQ ID NO: 2903945 - RNA, 16 nt, Human
ccaucuucacccaggc

SEQ ID NO: 2903946 - RNA, 21 nt, Human
ccaucuucacccaggccuaug

SEQ ID NO: 2903947 - RNA, 18 nt, Human
ccaucuucgggaccagga

SEQ ID NO: 2903948 - RNA, 16 nt, Human
ccaucuguacuugguc

SEQ ID NO: 2903949 - RNA, 20 nt, Human
ccaucuguacuugguccaac

SEQ ID NO: 2903950 - RNA, 19 nt, Human
ccaucugucuaaagauaga

SEQ ID NO: 2903951 - RNA, 16 nt, Human
ccaucugugcacgcag

SEQ ID NO: 2903952 - RNA, 12 nt, Human
ccaucugugcau

SEQ ID NO: 2903953 - RNA, 13 nt, Human
ccaucugugcauu

SEQ ID NO: 2903954 - RNA, 14 nt, Human
ccaucugugcauuc

SEQ ID NO: 2903955 - RNA, 20 nt, Human
ccaucucucuacuccuaccu

SEQ ID NO: 2903956 - RNA, 18 nt, Human
ccaucucugauuuucaaa

SEQ ID NO: 2903957 - RNA, 23 nt, Human
ccaucucugauuuucaaagcuuu

SEQ ID NO: 2903958 - RNA, 12 nt, Human
ccaucucuggau

SEQ ID NO: 2903959 - RNA, 15 nt, Human
ccaucucuggaugcc

SEQ ID NO: 2903960 - RNA, 18 nt, Human
ccaucucuggaugccuga

SEQ ID NO: 2903961 - RNA, 22 nt, Human
ccaucucuggaugccugauugc

SEQ ID NO: 2903962 - RNA, 23 nt, Human
ccauuuucuuauugcgcugcuac

SEQ ID NO: 2903963 - RNA, 14 nt, Human
ccauuuugugaaug

SEQ ID NO: 2903964 - RNA, 13 nt, Human
ccauuuugugaau

SEQ ID NO: 2903965 - RNA, 12 nt, Human
ccauuuugugaa

SEQ ID NO: 2903966 - RNA, 13 nt, Human
ccauuuugugaag

SEQ ID NO: 2903967 - RNA, 14 nt, Human
ccauuuugugaagc

SEQ ID NO: 2903968 - RNA, 15 nt, Human
ccauuuugugaagcc

SEQ ID NO: 2903969 - RNA, 16 nt, Human
ccauuuugugaagccc

SEQ ID NO: 2903970 - RNA, 18 nt, Human
ccauuuugugaagcccug

SEQ ID NO: 2903971 - RNA, 19 nt, Human
ccauuuugugaagcccugu

SEQ ID NO: 2903972 - RNA, 17 nt, Human
ccauuuuuuaaggaaac

SEQ ID NO: 2903973 - RNA, 19 nt, Human
ccauuuuuuaaggaaacaa

SEQ ID NO: 2903974 - RNA, 19 nt, Human
ccauuuuucuuccaggaug

SEQ ID NO: 2903975 - RNA, 22 nt, Human
ccauuuuucuuccaggauggug

SEQ ID NO: 2903976 - RNA, 14 nt, Human
cccaaaacaaaguc

SEQ ID NO: 2903977 - RNA, 17 nt, Human
cccaaaacaaagucuuu

SEQ ID NO: 2903978 - RNA, 14 nt, Human
cccaacccccaccc

SEQ ID NO: 2903979 - RNA, 13 nt, Human
cccaacccccacc

SEQ ID NO: 2903980 - RNA, 12 nt, Human
cccaacccccac

SEQ ID NO: 2903981 - RNA, 23 nt, Human
cccaaccccuuaagcccuggccc

SEQ ID NO: 2903982 - RNA, 12 nt, Human
cccaaccagugc

SEQ ID NO: 2903983 - RNA, 17 nt, Human
cccaaccagugccaagg

SEQ ID NO: 2903984 - RNA, 18 nt, Human
cccaaccagugccaagga

SEQ ID NO: 2903985 - RNA, 14 nt, Human
cccaacauauaaaa

SEQ ID NO: 2903986 - RNA, 19 nt, Human
cccaacauauaaaauaaug

SEQ ID NO: 2903987 - RNA, 18 nt, Human
cccaaccccaagccagcc

SEQ ID NO: 2903988 - RNA, 19 nt, Human
cccaacagcgacauagccc

SEQ ID NO: 2903989 - RNA, 23 nt, Human
cccaacagcgacauagcccaucc

SEQ ID NO: 2903990 - RNA, 13 nt, Human
cccacaggaucag

SEQ ID NO: 2903991 - RNA, 17 nt, Human
cccacaggaucagucug

SEQ ID NO: 2903992 - RNA, 23 nt, Human
cccacagacucaaaugcucagac

SEQ ID NO: 2903993 - RNA, 13 nt, Human
cccacagacucaa

SEQ ID NO: 2903994 - RNA, 19 nt, Human
cccacagcacagcucccug

SEQ ID NO: 2903995 - RNA, 22 nt, Human
cccacagcacagcucccugcca

SEQ ID NO: 2903996 - RNA, 16 nt, Human
cccacaggcccuuccu

SEQ ID NO: 2903997 - RNA, 18 nt, Human
cccacaggcccuuccucu

SEQ ID NO: 2903998 - RNA, 19 nt, Human
cccacauccaacuccagca

SEQ ID NO: 2903999 - RNA, 18 nt, Human
cccacauccaacuccagc

SEQ ID NO: 2904000 - RNA, 19 nt, Human
cccacauagugaugguucc

SEQ ID NO: 2904001 - RNA, 23 nt, Human
cccaaguagcugggauuacaggu

SEQ ID NO: 2904002 - RNA, 20 nt, Human
cccaaguaagaggcuggagu

SEQ ID NO: 2904003 - RNA, 18 nt, Human
cccaaguagucugcucac

SEQ ID NO: 2904004 - RNA, 19 nt, Human
cccaaguagucugcucaca

SEQ ID NO: 2904005 - RNA, 20 nt, Human
cccaaguagucugcucacag

SEQ ID NO: 2904006 - RNA, 19 nt, Human
cccacacuuguuccagcuc

SEQ ID NO: 2904007 - RNA, 17 nt, Human
cccacacuuguuccagc

SEQ ID NO: 2904008 - RNA, 16 nt, Human
cccaaguggcagagcu

SEQ ID NO: 2904009 - RNA, 18 nt, Human
cccaagugccagucuugu

SEQ ID NO: 2904010 - RNA, 15 nt, Human
cccaagugccagucu

SEQ ID NO: 2904011 - RNA, 19 nt, Human
cccaagugcacuuucuaau

SEQ ID NO: 2904012 - RNA, 15 nt, Human
cccaccuuggcugca

SEQ ID NO: 2904013 - RNA, 14 nt, Human
cccaccuuggcugc

SEQ ID NO: 2904014 - RNA, 22 nt, Human
cccaccuuggcucaaguccucu

SEQ ID NO: 2904015 - RNA, 15 nt, Human
cccaccuuggcucaa

SEQ ID NO: 2904016 - RNA, 17 nt, Human
cccacgcccuccccucc

SEQ ID NO: 2904017 - RNA, 16 nt, Human
cccacgccgggaacca

SEQ ID NO: 2904018 - RNA, 22 nt, Human
cccaccuucaauuccugggccc

SEQ ID NO: 2904019 - RNA, 14 nt, Human
cccacgccuuaucc

SEQ ID NO: 2904020 - RNA, 12 nt, Human
cccacgugggag

SEQ ID NO: 2904021 - RNA, 18 nt, Human
cccacgugucuuccacuu

SEQ ID NO: 2904022 - RNA, 19 nt, Human
cccacgugucuuccacuuu

SEQ ID NO: 2904023 - RNA, 12 nt, Human
cccagaauccca

SEQ ID NO: 2904024 - RNA, 14 nt, Human
cccagaaucccagc

SEQ ID NO: 2904025 - RNA, 15 nt, Human
cccagaaucccagcc

SEQ ID NO: 2904026 - RNA, 16 nt, Human
cccagaaucccagccg

SEQ ID NO: 2904027 - RNA, 19 nt, Human
cccagaaucccagccggcc

SEQ ID NO: 2904028 - RNA, 20 nt, Human
cccagaaucccagccggcca

SEQ ID NO: 2904029 - RNA, 17 nt, Human
cccacgggaccuggggc

SEQ ID NO: 2904030 - RNA, 19 nt, Human
cccacggggccucgggacc

SEQ ID NO: 2904031 - RNA, 17 nt, Human
cccacgucacguguagu

SEQ ID NO: 2904032 - RNA, 15 nt, Human
cccacggcuaagagg

SEQ ID NO: 2904033 - RNA, 18 nt, Human
cccacggcuaagaggcug

SEQ ID NO: 2904034 - RNA, 19 nt, Human
cccacggcuaagaggcugc

SEQ ID NO: 2904035 - RNA, 21 nt, Human
cccaccucagccucccaaagu

SEQ ID NO: 2904036 - RNA, 12 nt, Human
cccaccuuggcu

SEQ ID NO: 2904037 - RNA, 21 nt, Human
cccaccuucaauuccugggcc

SEQ ID NO: 2904038 - RNA, 20 nt, Human
cccaccuucaauuccugggc

SEQ ID NO: 2904039 - RNA, 19 nt, Human
cccaccuucaauuccuggg

SEQ ID NO: 2904040 - RNA, 13 nt, Human
cccaccugggacc

SEQ ID NO: 2904041 - RNA, 18 nt, Human
cccaccucagccucccaa

SEQ ID NO: 2904042 - RNA, 15 nt, Human
cccaccucagccucc

SEQ ID NO: 2904043 - RNA, 14 nt, Human
cccaccucagccuc

SEQ ID NO: 2904044 - RNA, 12 nt, Human
cccaccucagcc

SEQ ID NO: 2904045 - RNA, 21 nt, Human
cccaccuagaacacuaacuca

SEQ ID NO: 2904046 - RNA, 16 nt, Human
cccaccuaugugccaa

SEQ ID NO: 2904047 - RNA, 13 nt, Human
cccaccucacccc

SEQ ID NO: 2904048 - RNA, 18 nt, Human
cccaccgguccagcuggc

SEQ ID NO: 2904049 - RNA, 21 nt, Human
cccaccgguccagcuggccug

SEQ ID NO: 2904050 - RNA, 18 nt, Human
cccacaugaggacaugau

SEQ ID NO: 2904051 - RNA, 19 nt, Human
cccucugccaccagagacc

SEQ ID NO: 2904052 - RNA, 14 nt, Human
cccucugccaccag

SEQ ID NO: 2904053 - RNA, 14 nt, Human
cccucugcccugcg

SEQ ID NO: 2904054 - RNA, 13 nt, Human
cccucugcccugc

SEQ ID NO: 2904055 - RNA, 12 nt, Human
cccucugcccug

SEQ ID NO: 2904056 - RNA, 11 nt, Human
cccucucccug

SEQ ID NO: 2904057 - RNA, 16 nt, Human
cccucucccucuaggc

SEQ ID NO: 2904058 - RNA, 17 nt, Human
cccucucccucuaggcu

SEQ ID NO: 2904059 - RNA, 18 nt, Human
cccucuccccaccccuac

SEQ ID NO: 2904060 - RNA, 20 nt, Human
cccucuccccaccccuaccc

SEQ ID NO: 2904061 - RNA, 23 nt, Human
cccucgugguccccaacagcgac

SEQ ID NO: 2904062 - RNA, 15 nt, Human
cccucucaucucagg

SEQ ID NO: 2904063 - RNA, 16 nt, Human
cccucucaucucaggu

SEQ ID NO: 2904064 - RNA, 20 nt, Human
cccucucaucucagguagaa

SEQ ID NO: 2904065 - RNA, 18 nt, Human
cccucgugguccccaaca

SEQ ID NO: 2904066 - RNA, 20 nt, Human
cccucgugguccccaacagc

SEQ ID NO: 2904067 - RNA, 17 nt, Human
cccucuuuggcuccccu

SEQ ID NO: 2904068 - RNA, 15 nt, Human
cccucuuguuuuguu

SEQ ID NO: 2904069 - RNA, 20 nt, Human
cccucuuguuuuguuugucu

SEQ ID NO: 2904070 - RNA, 21 nt, Human
cccucuuguuuuguuugucuc

SEQ ID NO: 2904071 - RNA, 22 nt, Human
cccucuuguuuuguuugucucu

SEQ ID NO: 2904072 - RNA, 13 nt, Human
cccucuuucucuu

SEQ ID NO: 2904073 - RNA, 14 nt, Human
cccucuuucucuuu

SEQ ID NO: 2904074 - RNA, 15 nt, Human
cccucuuucucuuuc

SEQ ID NO: 2904075 - RNA, 16 nt, Human
cccucuuucucuuucu

SEQ ID NO: 2904076 - RNA, 18 nt, Human
cccucuuucucuuucuuc

SEQ ID NO: 2904077 - RNA, 19 nt, Human
cccucuuucucuuucuucc

SEQ ID NO: 2904078 - RNA, 21 nt, Human
cccucuuucucuuucuuccuu

SEQ ID NO: 2904079 - RNA, 22 nt, Human
cccucuuucucuuucuuccuuu

SEQ ID NO: 2904080 - RNA, 19 nt, Human
cccucuuuggcuccccugu

SEQ ID NO: 2904081 - RNA, 20 nt, Human
cccucuuuggcuccccugua

SEQ ID NO: 2904082 - RNA, 21 nt, Human
cccucuuuggcuccccuguac

SEQ ID NO: 2904083 - RNA, 12 nt, Human
cccucuuuucuu

SEQ ID NO: 2904084 - RNA, 13 nt, Human
cccucuuuucuua

SEQ ID NO: 2904085 - RNA, 16 nt, Human
cccucuuuucuuacuc

SEQ ID NO: 2904086 - RNA, 21 nt, Human
cccucuuuucuuacuccuccu

SEQ ID NO: 2904087 - RNA, 22 nt, Human
cccucuuuucuuacuccuccuc

SEQ ID NO: 2904088 - RNA, 23 nt, Human
cccucuuuucuuacuccuccucu

SEQ ID NO: 2904089 - RNA, 21 nt, Human
cccucuuuuguuaaauaauau

SEQ ID NO: 2904090 - RNA, 20 nt, Human
cccucuucuuucagacuugc

SEQ ID NO: 2904091 - RNA, 24 nt, Human
cccucuucuuucagacuugccaug

SEQ ID NO: 2904092 - RNA, 15 nt, Human
cccucuucugagcac

SEQ ID NO: 2904093 - RNA, 14 nt, Human
cccucuucugagca

SEQ ID NO: 2904094 - RNA, 15 nt, Human
cccucuuccugugau

SEQ ID NO: 2904095 - RNA, 14 nt, Human
cccucuuccuguga

SEQ ID NO: 2904096 - RNA, 11 nt, Human
cccucuuccug

SEQ ID NO: 2904097 - RNA, 12 nt, Human
cccucuuccuga

SEQ ID NO: 2904098 - RNA, 15 nt, Human
cccucuuccugacga

SEQ ID NO: 2904099 - RNA, 20 nt, Human
cccucuuccugacgaaacug

SEQ ID NO: 2904100 - RNA, 21 nt, Human
cccucuguucugcacacagca

SEQ ID NO: 2904101 - RNA, 20 nt, Human
cccucuguucugcacacagc

SEQ ID NO: 2904102 - RNA, 12 nt, Human
cccucuggcucc

SEQ ID NO: 2904103 - RNA, 17 nt, Human
cccucuggcuccagcug

SEQ ID NO: 2904104 - RNA, 16 nt, Human
cccucuggcuccagcu

SEQ ID NO: 2904105 - RNA, 12 nt, Human
cccucuggccgc

SEQ ID NO: 2904106 - RNA, 22 nt, Human
cccucuggcuccagcuggccgg

SEQ ID NO: 2904107 - RNA, 12 nt, Human
cccucugggaac

SEQ ID NO: 2904108 - RNA, 14 nt, Human
cccucugggaaccu

SEQ ID NO: 2904109 - RNA, 15 nt, Human
cccucugggaaccuc

SEQ ID NO: 2904110 - RNA, 16 nt, Human
cccucugggaaccucc

SEQ ID NO: 2904111 - RNA, 19 nt, Human
cccucugggaaccucccag

SEQ ID NO: 2904112 - RNA, 20 nt, Human
cccucugggaaccucccaga

SEQ ID NO: 2904113 - RNA, 21 nt, Human
cccucugggaaccucccagag

SEQ ID NO: 2904114 - RNA, 22 nt, Human
cccucugggaaccucccagagg

SEQ ID NO: 2904115 - RNA, 13 nt, Human
cccuccccugcug

SEQ ID NO: 2904116 - RNA, 14 nt, Human
cccuccccugcugc

SEQ ID NO: 2904117 - RNA, 14 nt, Human
cccuccccugcccu

SEQ ID NO: 2904118 - RNA, 13 nt, Human
cccuccccugccc

SEQ ID NO: 2904119 - RNA, 16 nt, Human
cccuccccugcugcag

SEQ ID NO: 2904120 - RNA, 15 nt, Human
cccuccccuggggac

SEQ ID NO: 2904121 - RNA, 14 nt, Human
cccuccccuucucu

SEQ ID NO: 2904122 - RNA, 10 nt, Human
cccucccaga

SEQ ID NO: 2904123 - RNA, 19 nt, Human
cccucccaccucugugacc

SEQ ID NO: 2904124 - RNA, 13 nt, Human
cccucccaccucu

SEQ ID NO: 2904125 - RNA, 14 nt, Human
cccucccaccucug

SEQ ID NO: 2904126 - RNA, 15 nt, Human
cccucccaccucugu

SEQ ID NO: 2904127 - RNA, 17 nt, Human
cccucccaccucuguga

SEQ ID NO: 2904128 - RNA, 13 nt, Human
cccuccccugcca

SEQ ID NO: 2904129 - RNA, 13 nt, Human
cccucccagaggc

SEQ ID NO: 2904130 - RNA, 15 nt, Human
cccucccaccuccag

SEQ ID NO: 2904131 - RNA, 13 nt, Human
cccucccaccccc

SEQ ID NO: 2904132 - RNA, 12 nt, Human
cccucccacccc

SEQ ID NO: 2904133 - RNA, 14 nt, Human
cccgcucagcccuc

SEQ ID NO: 2904134 - RNA, 12 nt, Human
cccgcucagccc

SEQ ID NO: 2904135 - RNA, 13 nt, Human
cccgcucagcccu

SEQ ID NO: 2904136 - RNA, 23 nt, Human
cccucccgccccuucccacucac

SEQ ID NO: 2904137 - RNA, 14 nt, Human
cccucccugccccu

SEQ ID NO: 2904138 - RNA, 14 nt, Human
cccucccuggcucc

SEQ ID NO: 2904139 - RNA, 12 nt, Human
cccucccuggag

SEQ ID NO: 2904140 - RNA, 13 nt, Human
cccucccuggagu

SEQ ID NO: 2904141 - RNA, 14 nt, Human
cccucccuggagug

SEQ ID NO: 2904142 - RNA, 19 nt, Human
cccucccuggcucccauga

SEQ ID NO: 2904143 - RNA, 16 nt, Human
cccucccuggcuccca

SEQ ID NO: 2904144 - RNA, 12 nt, Human
cccuucccugca

SEQ ID NO: 2904145 - RNA, 16 nt, Human
cccuugcccuagauag

SEQ ID NO: 2904146 - RNA, 14 nt, Human
cccuugcuguaugc

SEQ ID NO: 2904147 - RNA, 21 nt, Human
cccuugcuguaugcugaucau

SEQ ID NO: 2904148 - RNA, 18 nt, Human
cccuugcucuccccugcc

SEQ ID NO: 2904149 - RNA, 11 nt, Human
cccuugcuuuu

SEQ ID NO: 2904150 - RNA, 14 nt, Human
cccuugcuuuuccc

SEQ ID NO: 2904151 - RNA, 17 nt, Human
cccuugcuuuucccucu

SEQ ID NO: 2904152 - RNA, 18 nt, Human
cccuugcuuuucccucuu

SEQ ID NO: 2904153 - RNA, 21 nt, Human
cccuugcuuuucccucuuuuc

SEQ ID NO: 2904154 - RNA, 19 nt, Human
cccuugcucuccccugccc

SEQ ID NO: 2904155 - RNA, 22 nt, Human
cccuucaacguuucuucacuuu

SEQ ID NO: 2904156 - RNA, 18 nt, Human
cccuucccaaucagcacu

SEQ ID NO: 2904157 - RNA, 14 nt, Human
cccuuccccucccu

SEQ ID NO: 2904158 - RNA, 12 nt, Human
cccuuccccucc

SEQ ID NO: 2904159 - RNA, 19 nt, Human
cccuuccccucccuggcuc

SEQ ID NO: 2904160 - RNA, 17 nt, Human
cccuuccccucccuggc

SEQ ID NO: 2904161 - RNA, 16 nt, Human
cccuuccccucccugg

SEQ ID NO: 2904162 - RNA, 15 nt, Human
cccuuccccucccug

SEQ ID NO: 2904163 - RNA, 13 nt, Human
cccuucccugcac

SEQ ID NO: 2904164 - RNA, 13 nt, Human
cccuuccccuccu

SEQ ID NO: 2904165 - RNA, 22 nt, Human
cccuuccccucccuggcuccca

SEQ ID NO: 2904166 - RNA, 22 nt, Human
cccuugaggaaacaacagcuuu

SEQ ID NO: 2904167 - RNA, 13 nt, Human
cccuugagggaga

SEQ ID NO: 2904168 - RNA, 18 nt, Human
cccuugccaccccacccu

SEQ ID NO: 2904169 - RNA, 15 nt, Human
cccuugccacuuugc

SEQ ID NO: 2904170 - RNA, 16 nt, Human
cccuugccacuuugca

SEQ ID NO: 2904171 - RNA, 17 nt, Human
cccuugccacuuugcac

SEQ ID NO: 2904172 - RNA, 12 nt, Human
cccuugagcccu

SEQ ID NO: 2904173 - RNA, 13 nt, Human
cccuugagcccuc

SEQ ID NO: 2904174 - RNA, 14 nt, Human
cccuugagcccucc

SEQ ID NO: 2904175 - RNA, 15 nt, Human
cccuugagcccuccc

SEQ ID NO: 2904176 - RNA, 18 nt, Human
cccuugagcccuccccag

SEQ ID NO: 2904177 - RNA, 16 nt, Human
cccuucccuguccuug

SEQ ID NO: 2904178 - RNA, 14 nt, Human
cccuucccuuccac

SEQ ID NO: 2904179 - RNA, 17 nt, Human
cccuucccuuccacugc

SEQ ID NO: 2904180 - RNA, 19 nt, Human
cccuucccuuccacugccu

SEQ ID NO: 2904181 - RNA, 13 nt, Human
cccuucccuuccc

SEQ ID NO: 2904182 - RNA, 20 nt, Human
cccuuaucugugcucaggac

SEQ ID NO: 2904183 - RNA, 16 nt, Human
cccuuaucugugcuca

SEQ ID NO: 2904184 - RNA, 14 nt, Human
cccuucaaccauuc

SEQ ID NO: 2904185 - RNA, 18 nt, Human
cccuuccaaauaauaaag

SEQ ID NO: 2904186 - RNA, 20 nt, Human
cccuuccaaauaauaaaguc

SEQ ID NO: 2904187 - RNA, 16 nt, Human
cccuucacauuuuuua

SEQ ID NO: 2904188 - RNA, 18 nt, Human
cccuucaaccauucccca

SEQ ID NO: 2904189 - RNA, 12 nt, Human
cccuuauuuuca

SEQ ID NO: 2904190 - RNA, 20 nt, Human
cccuuccaugucgccucugc

SEQ ID NO: 2904191 - RNA, 20 nt, Human
cccuuccagaucacugccac

SEQ ID NO: 2904192 - RNA, 13 nt, Human
cccuuccagauca

SEQ ID NO: 2904193 - RNA, 12 nt, Human
cccuuccacugc

SEQ ID NO: 2904194 - RNA, 13 nt, Human
cccuuccacugcc

SEQ ID NO: 2904195 - RNA, 14 nt, Human
cccuuccacugccu

SEQ ID NO: 2904196 - RNA, 16 nt, Human
cccuuccacugccucu

SEQ ID NO: 2904197 - RNA, 18 nt, Human
cccuuccacugccucugc

SEQ ID NO: 2904198 - RNA, 20 nt, Human
cccuuccacugccucugccu

SEQ ID NO: 2904199 - RNA, 12 nt, Human
cccuuccagaca

SEQ ID NO: 2904200 - RNA, 13 nt, Human
cccuuccagacau

SEQ ID NO: 2904201 - RNA, 14 nt, Human
cccuuagcagggaa

SEQ ID NO: 2904202 - RNA, 16 nt, Human
cccuuagaaaaugugu

SEQ ID NO: 2904203 - RNA, 16 nt, Human
cccuuacuucuugccc

SEQ ID NO: 2904204 - RNA, 13 nt, Human
cccuuaccuuccc

SEQ ID NO: 2904205 - RNA, 20 nt, Human
cccuuagaaguuuguuguga

SEQ ID NO: 2904206 - RNA, 23 nt, Human
cccuuagcagggaaacagcuaau

SEQ ID NO: 2904207 - RNA, 22 nt, Human
cccuuauaguuugggcuucagc

SEQ ID NO: 2904208 - RNA, 14 nt, Human
cccuuagccucccu

SEQ ID NO: 2904209 - RNA, 17 nt, Human
cccuuagccucccugaa

SEQ ID NO: 2904210 - RNA, 12 nt, Human
cccuuagucccc

SEQ ID NO: 2904211 - RNA, 15 nt, Human
cccuuagucccccaa

SEQ ID NO: 2904212 - RNA, 18 nt, Human
cccuuagucccccaacuc

SEQ ID NO: 2904213 - RNA, 23 nt, Human
cccuuagucccccaacucugagc

SEQ ID NO: 2904214 - RNA, 14 nt, Human
cccuuaacccaagg

SEQ ID NO: 2904215 - RNA, 15 nt, Human
cccuuaacccaagga

SEQ ID NO: 2904216 - RNA, 16 nt, Human
cccuuaacccaaggag

SEQ ID NO: 2904217 - RNA, 17 nt, Human
cccuuaacccaaggagc

SEQ ID NO: 2904218 - RNA, 20 nt, Human
cccuuaacccaaggagcaca

SEQ ID NO: 2904219 - RNA, 22 nt, Human
cccuuaacccaaggagcacagg

SEQ ID NO: 2904220 - RNA, 15 nt, Human
cccuuaagcccuggc

SEQ ID NO: 2904221 - RNA, 12 nt, Human
cccuguucuucc

SEQ ID NO: 2904222 - RNA, 13 nt, Human
cccuguucuuccu

SEQ ID NO: 2904223 - RNA, 14 nt, Human
cccuguucuuccuc

SEQ ID NO: 2904224 - RNA, 16 nt, Human
cccuguucuuccucca

SEQ ID NO: 2904225 - RNA, 20 nt, Human
cccuguucuuccuccagcug

SEQ ID NO: 2904226 - RNA, 21 nt, Human
cccuguucuuccuccagcugc

SEQ ID NO: 2904227 - RNA, 14 nt, Human
cccuuaaaauagaa

SEQ ID NO: 2904228 - RNA, 18 nt, Human
cccugcuuuagagcuagg

SEQ ID NO: 2904229 - RNA, 11 nt, Human
cccuguucuaa

SEQ ID NO: 2904230 - RNA, 12 nt, Human
cccuguucuaag

SEQ ID NO: 2904231 - RNA, 21 nt, Human
cccuguucuaagggggagggg

SEQ ID NO: 2904232 - RNA, 23 nt, Human
cccuguucuaagggggaggggaa

SEQ ID NO: 2904233 - RNA, 15 nt, Human
cccuggugcugccac

SEQ ID NO: 2904234 - RNA, 15 nt, Human
cccuggugccuggcu

SEQ ID NO: 2904235 - RNA, 16 nt, Human
cccuggugccuggcuc

SEQ ID NO: 2904236 - RNA, 13 nt, Human
cccuggggccugg

SEQ ID NO: 2904237 - RNA, 20 nt, Human
cccuggggacagcaagggcu

SEQ ID NO: 2904238 - RNA, 15 nt, Human
cccuggggccuagac

SEQ ID NO: 2904239 - RNA, 14 nt, Human
cccuggggccugga

SEQ ID NO: 2904240 - RNA, 17 nt, Human
cccuggggccuggaccu

SEQ ID NO: 2904241 - RNA, 23 nt, Human
cccuggggccuggaccugccucc

SEQ ID NO: 2904242 - RNA, 18 nt, Human
cccuggggccuggaccug

SEQ ID NO: 2904243 - RNA, 21 nt, Human
cccuggggccuggaccugccu

SEQ ID NO: 2904244 - RNA, 13 nt, Human
cccuggugcugcc

SEQ ID NO: 2904245 - RNA, 14 nt, Human
cccuggugcugcca

SEQ ID NO: 2904246 - RNA, 13 nt, Human
cccugguggcagu

SEQ ID NO: 2904247 - RNA, 14 nt, Human
cccugguggcagug

SEQ ID NO: 2904248 - RNA, 17 nt, Human
cccugcugcugucaccu

SEQ ID NO: 2904249 - RNA, 19 nt, Human
cccugcugcugucaccucu

SEQ ID NO: 2904250 - RNA, 22 nt, Human
cccugcuucagauguggagcca

SEQ ID NO: 2904251 - RNA, 23 nt, Human
cccugcuucagauguggagccag

SEQ ID NO: 2904252 - RNA, 19 nt, Human
cccuggggacagcaagggc

SEQ ID NO: 2904253 - RNA, 17 nt, Human
cccuggggacagcaagg

SEQ ID NO: 2904254 - RNA, 21 nt, Human
cccugcucuccgaccagacac

SEQ ID NO: 2904255 - RNA, 22 nt, Human
cccugcucuccgaccagacacc

SEQ ID NO: 2904256 - RNA, 21 nt, Human
cccugcugagucccaggcuga

SEQ ID NO: 2904257 - RNA, 12 nt, Human
cccugcuccugc

SEQ ID NO: 2904258 - RNA, 13 nt, Human
cccugcuccugca

SEQ ID NO: 2904259 - RNA, 14 nt, Human
cccugcuccugcag

SEQ ID NO: 2904260 - RNA, 15 nt, Human
cccugcuccugcagc

SEQ ID NO: 2904261 - RNA, 16 nt, Human
cccugcuccugcagca

SEQ ID NO: 2904262 - RNA, 18 nt, Human
cccugcuccugcagcaug

SEQ ID NO: 2904263 - RNA, 23 nt, Human
cccugcugccgccucccagccug

SEQ ID NO: 2904264 - RNA, 22 nt, Human
cccugcugccgccucccagccu

SEQ ID NO: 2904265 - RNA, 20 nt, Human
cccugcugccgccucccagc

SEQ ID NO: 2904266 - RNA, 13 nt, Human
cccugcugccuuc

SEQ ID NO: 2904267 - RNA, 19 nt, Human
cccugcugccuucugacgg

SEQ ID NO: 2904268 - RNA, 19 nt, Human
cccugcugccgccucccag

SEQ ID NO: 2904269 - RNA, 11 nt, Human
cccugcugccc

SEQ ID NO: 2904270 - RNA, 12 nt, Human
cccugcugccca

SEQ ID NO: 2904271 - RNA, 13 nt, Human
cccugcugcccaa

SEQ ID NO: 2904272 - RNA, 21 nt, Human
cccugcugcccaaucuccauc

SEQ ID NO: 2904273 - RNA, 16 nt, Human
cccugcugcaggggcu

SEQ ID NO: 2904274 - RNA, 19 nt, Human
cccugcugcaggggcucug

SEQ ID NO: 2904275 - RNA, 21 nt, Human
cccugcugcaggggcucugga

SEQ ID NO: 2904276 - RNA, 22 nt, Human
cccugcugcaggggcucuggag

SEQ ID NO: 2904277 - RNA, 23 nt, Human
cccugcugagucccaggcugagc

SEQ ID NO: 2904278 - RNA, 19 nt, Human
cccugcucccucucccccu

SEQ ID NO: 2904279 - RNA, 13 nt, Human
cccugcugcaggg

SEQ ID NO: 2904280 - RNA, 15 nt, Human
cccugcugcaggggc

SEQ ID NO: 2904281 - RNA, 21 nt, Human
cccugcgaaggggcccugguc

SEQ ID NO: 2904282 - RNA, 15 nt, Human
cccugcgccugugau

SEQ ID NO: 2904283 - RNA, 22 nt, Human
cccugcgccugugaugcugggc

SEQ ID NO: 2904284 - RNA, 20 nt, Human
cccugcgaaggggcccuggu

SEQ ID NO: 2904285 - RNA, 19 nt, Human
cccugcgaaggggcccugg

SEQ ID NO: 2904286 - RNA, 17 nt, Human
cccugcgaaggggcccu

SEQ ID NO: 2904287 - RNA, 18 nt, Human
cccugccuuugggagcag

SEQ ID NO: 2904288 - RNA, 19 nt, Human
cccugccuuugggagcagg

SEQ ID NO: 2904289 - RNA, 13 nt, Human
cccugccugguca

SEQ ID NO: 2904290 - RNA, 21 nt, Human
cccugcgggucacaggaggga

SEQ ID NO: 2904291 - RNA, 19 nt, Human
cccugcgggucacaggagg

SEQ ID NO: 2904292 - RNA, 19 nt, Human
cccugcuccagaagauagc

SEQ ID NO: 2904293 - RNA, 12 nt, Human
cccugcucccuc

SEQ ID NO: 2904294 - RNA, 11 nt, Human
cccugcucccu

SEQ ID NO: 2904295 - RNA, 16 nt, Human
cccugcuacccuagau

SEQ ID NO: 2904296 - RNA, 12 nt, Human
cccugcaucccc

SEQ ID NO: 2904297 - RNA, 13 nt, Human
cccugcauccccu

SEQ ID NO: 2904298 - RNA, 15 nt, Human
cccugcccugugggg

SEQ ID NO: 2904299 - RNA, 19 nt, Human
cccugaggagccaggccgg

SEQ ID NO: 2904300 - RNA, 14 nt, Human
cccugaggagccag

SEQ ID NO: 2904301 - RNA, 20 nt, Human
cccugcagaugccacccuag

SEQ ID NO: 2904302 - RNA, 14 nt, Human
cccugcagcacgga

SEQ ID NO: 2904303 - RNA, 19 nt, Human
cccugcagcacggacaaua

SEQ ID NO: 2904304 - RNA, 21 nt, Human
cccugcagcacggacaauaaa

SEQ ID NO: 2904305 - RNA, 22 nt, Human
cccugcagcacggacaauaaac

SEQ ID NO: 2904306 - RNA, 14 nt, Human
cccugcagccagcu

SEQ ID NO: 2904307 - RNA, 15 nt, Human
cccugcagaugccac

SEQ ID NO: 2904308 - RNA, 18 nt, Human
cccugcagaugccacccu

SEQ ID NO: 2904309 - RNA, 17 nt, Human
cccugcagcuaguccua

SEQ ID NO: 2904310 - RNA, 13 nt, Human
cccugcaguguuc

SEQ ID NO: 2904311 - RNA, 20 nt, Human
cccugcaguguucgcuuggc

SEQ ID NO: 2904312 - RNA, 21 nt, Human
cccugcaguguucgcuuggcu

SEQ ID NO: 2904313 - RNA, 18 nt, Human
ccuacaggagugagcacu

SEQ ID NO: 2904314 - RNA, 14 nt, Human
ccuaaccugugucu

SEQ ID NO: 2904315 - RNA, 17 nt, Human
ccuaaccugugucugcg

SEQ ID NO: 2904316 - RNA, 18 nt, Human
ccuaaccugugucugcga

SEQ ID NO: 2904317 - RNA, 15 nt, Human
ccuacaggcagucuc

SEQ ID NO: 2904318 - RNA, 21 nt, Human
ccuacaggcagucucucucuu

SEQ ID NO: 2904319 - RNA, 19 nt, Human
ccguugauguuggcuggga

SEQ ID NO: 2904320 - RNA, 13 nt, Human
ccguugccaaccg

SEQ ID NO: 2904321 - RNA, 18 nt, Human
ccguugauguuggcuggg

SEQ ID NO: 2904322 - RNA, 14 nt, Human
ccuaaccccuucca

SEQ ID NO: 2904323 - RNA, 16 nt, Human
ccuaaccccuuccaga

SEQ ID NO: 2904324 - RNA, 15 nt, Human
ccuaaccccuuccag

SEQ ID NO: 2904325 - RNA, 18 nt, Human
ccuaaccccuuccagauc

SEQ ID NO: 2904326 - RNA, 18 nt, Human
ccguuccugacaucacag

SEQ ID NO: 2904327 - RNA, 19 nt, Human
ccguuccugacaucacagc

SEQ ID NO: 2904328 - RNA, 22 nt, Human
ccguuccugacaucacagcagc

SEQ ID NO: 2904329 - RNA, 23 nt, Human
ccguuccugacaucacagcagcc

SEQ ID NO: 2904330 - RNA, 24 nt, Human
ccguuccugacaucacagcagccu

SEQ ID NO: 2904331 - RNA, 11 nt, Human
ccguggcuucc

SEQ ID NO: 2904332 - RNA, 18 nt, Human
ccgugcauuagcacagau

SEQ ID NO: 2904333 - RNA, 22 nt, Human
ccgugcauuagcacagauuuua

SEQ ID NO: 2904334 - RNA, 11 nt, Human
ccgugccaaag

SEQ ID NO: 2904335 - RNA, 19 nt, Human
ccgugccaaagucucccuu

SEQ ID NO: 2904336 - RNA, 20 nt, Human
ccgugccaaagucucccuuc

SEQ ID NO: 2904337 - RNA, 15 nt, Human
ccguggcccugcccu

SEQ ID NO: 2904338 - RNA, 16 nt, Human
ccguggcccugcccuc

SEQ ID NO: 2904339 - RNA, 20 nt, Human
ccguggcccugcccucuccu

SEQ ID NO: 2904340 - RNA, 18 nt, Human
ccuaggugacagagugag

SEQ ID NO: 2904341 - RNA, 16 nt, Human
ccuaguccagugaccu

SEQ ID NO: 2904342 - RNA, 13 nt, Human
ccuaguacugccc

SEQ ID NO: 2904343 - RNA, 16 nt, Human
ccuagguucccggucc

SEQ ID NO: 2904344 - RNA, 18 nt, Human
ccuagguucccggucccg

SEQ ID NO: 2904345 - RNA, 19 nt, Human
ccuagguucccggucccga

SEQ ID NO: 2904346 - RNA, 20 nt, Human
ccuagguucccggucccgag

SEQ ID NO: 2904347 - RNA, 21 nt, Human
ccuagguucccggucccgagu

SEQ ID NO: 2904348 - RNA, 18 nt, Human
ccuagguucccuguucuu

SEQ ID NO: 2904349 - RNA, 20 nt, Human
ccuagguucccuguucuucc

SEQ ID NO: 2904350 - RNA, 21 nt, Human
ccuagguucccuguucuuccu

SEQ ID NO: 2904351 - RNA, 22 nt, Human
ccuagguucccuguucuuccuc

SEQ ID NO: 2904352 - RNA, 20 nt, Human
ccuacucccugcagaugcca

SEQ ID NO: 2904353 - RNA, 11 nt, Human
ccuacuccuga

SEQ ID NO: 2904354 - RNA, 13 nt, Human
ccuacuccugacu

SEQ ID NO: 2904355 - RNA, 20 nt, Human
ccuacuccugacuccuaccu

SEQ ID NO: 2904356 - RNA, 23 nt, Human
ccuaggccacaccaucuccuuuc

SEQ ID NO: 2904357 - RNA, 16 nt, Human
ccuaccgagucucuuc

SEQ ID NO: 2904358 - RNA, 17 nt, Human
ccuaccgagucucuucu

SEQ ID NO: 2904359 - RNA, 20 nt, Human
ccuacgucaaacaugaagug

SEQ ID NO: 2904360 - RNA, 13 nt, Human
ccuacggaccagg

SEQ ID NO: 2904361 - RNA, 19 nt, Human
ccuaccgagucucuucucc

SEQ ID NO: 2904362 - RNA, 20 nt, Human
ccuaccgagucucuucucca

SEQ ID NO: 2904363 - RNA, 15 nt, Human
ccuacucccugcaga

SEQ ID NO: 2904364 - RNA, 17 nt, Human
ccuacucauugggguuc

SEQ ID NO: 2904365 - RNA, 13 nt, Human
ccuacucccugca

SEQ ID NO: 2904366 - RNA, 16 nt, Human
ccuacuaucacugaac

SEQ ID NO: 2904367 - RNA, 21 nt, Human
ccuacgucaaacaugaagugu

SEQ ID NO: 2904368 - RNA, 14 nt, Human
ccguggcuucccgc

SEQ ID NO: 2904369 - RNA, 14 nt, Human
ccgccugcccucau

SEQ ID NO: 2904370 - RNA, 16 nt, Human
ccgccugcccucaugg

SEQ ID NO: 2904371 - RNA, 17 nt, Human
ccgccugacagaaacca

SEQ ID NO: 2904372 - RNA, 12 nt, Human
ccgccugcccac

SEQ ID NO: 2904373 - RNA, 13 nt, Human
ccgccugcccacc

SEQ ID NO: 2904374 - RNA, 14 nt, Human
ccgccugcccaccu

SEQ ID NO: 2904375 - RNA, 16 nt, Human
ccgccugcccaccugc

SEQ ID NO: 2904376 - RNA, 17 nt, Human
ccgccugcccaccugcc

SEQ ID NO: 2904377 - RNA, 20 nt, Human
ccgccugcccaccugccugg

SEQ ID NO: 2904378 - RNA, 21 nt, Human
ccgccugcccaccugccuggc

SEQ ID NO: 2904379 - RNA, 22 nt, Human
ccgccugcccaccugccuggcc

SEQ ID NO: 2904380 - RNA, 16 nt, Human
ccgaccuuagauuuag

SEQ ID NO: 2904381 - RNA, 15 nt, Human
ccgccucccagccug

SEQ ID NO: 2904382 - RNA, 18 nt, Human
ccggagcugccccucucu

SEQ ID NO: 2904383 - RNA, 19 nt, Human
ccggagcugccccucucug

SEQ ID NO: 2904384 - RNA, 20 nt, Human
ccggagcugccccucucugg

SEQ ID NO: 2904385 - RNA, 21 nt, Human
ccggagcugccccucucuggg

SEQ ID NO: 2904386 - RNA, 22 nt, Human
ccggagcugccccucucugggc

SEQ ID NO: 2904387 - RNA, 23 nt, Human
ccggagcugccccucucugggcc

SEQ ID NO: 2904388 - RNA, 15 nt, Human
ccggaggggccuggc

SEQ ID NO: 2904389 - RNA, 16 nt, Human
ccggaggggccuggca

SEQ ID NO: 2904390 - RNA, 14 nt, Human
ccggaggaaaucug

SEQ ID NO: 2904391 - RNA, 17 nt, Human
ccggagggaagggacgg

SEQ ID NO: 2904392 - RNA, 14 nt, Human
ccggaggggccugg

SEQ ID NO: 2904393 - RNA, 23 nt, Human
ccgcugccgugccgccugcacuc

SEQ ID NO: 2904394 - RNA, 14 nt, Human
ccgcugcuccacgc

SEQ ID NO: 2904395 - RNA, 15 nt, Human
ccgcugcuccacgcg

SEQ ID NO: 2904396 - RNA, 17 nt, Human
ccgcugcuccacgcgcu

SEQ ID NO: 2904397 - RNA, 18 nt, Human
ccgcugcuccuuggcuua

SEQ ID NO: 2904398 - RNA, 11 nt, Human
ccgcugcugcu

SEQ ID NO: 2904399 - RNA, 14 nt, Human
ccgcugcugcugcu

SEQ ID NO: 2904400 - RNA, 16 nt, Human
ccgcugcugcugcugc

SEQ ID NO: 2904401 - RNA, 18 nt, Human
ccgcucuacaucuucugc

SEQ ID NO: 2904402 - RNA, 19 nt, Human
ccgcucuacaucuucugcc

SEQ ID NO: 2904403 - RNA, 13 nt, Human
ccgggccacagag

SEQ ID NO: 2904404 - RNA, 22 nt, Human
ccgggcacucagaagacacuga

SEQ ID NO: 2904405 - RNA, 20 nt, Human
ccgggcacucagaagacacu

SEQ ID NO: 2904406 - RNA, 17 nt, Human
ccggcucuacgggggcc

SEQ ID NO: 2904407 - RNA, 21 nt, Human
ccggcuccaggcuccuuuagc

SEQ ID NO: 2904408 - RNA, 16 nt, Human
ccggcuccaggcuccu

SEQ ID NO: 2904409 - RNA, 23 nt, Human
ccggcucgagcaguccugccuca

SEQ ID NO: 2904410 - RNA, 21 nt, Human
ccgggguggagcaugggccug

SEQ ID NO: 2904411 - RNA, 15 nt, Human
ccgagcaaagaucaa

SEQ ID NO: 2904412 - RNA, 20 nt, Human
ccgagaucgugccauugcac

SEQ ID NO: 2904413 - RNA, 23 nt, Human
ccgacugcacagcggccccugca

SEQ ID NO: 2904414 - RNA, 21 nt, Human
ccgagaucacgccacugcacu

SEQ ID NO: 2904415 - RNA, 13 nt, Human
ccgacgcccaccc

SEQ ID NO: 2904416 - RNA, 16 nt, Human
ccgacgcgucuccugu

SEQ ID NO: 2904417 - RNA, 17 nt, Human
ccgacgcgucuccuguu

SEQ ID NO: 2904418 - RNA, 12 nt, Human
cccuuggaagag

SEQ ID NO: 2904419 - RNA, 17 nt, Human
ccgcacuuuccacuucu

SEQ ID NO: 2904420 - RNA, 21 nt, Human
ccgcacuuuccacuucuuccu

SEQ ID NO: 2904421 - RNA, 22 nt, Human
ccgcacuuuccacuucuuccuu

SEQ ID NO: 2904422 - RNA, 14 nt, Human
ccgcagaagcccug

SEQ ID NO: 2904423 - RNA, 19 nt, Human
ccgagucucuucuccacug

SEQ ID NO: 2904424 - RNA, 20 nt, Human
ccgagucucuucuccacugg

SEQ ID NO: 2904425 - RNA, 14 nt, Human
ccgccucccagccu

SEQ ID NO: 2904426 - RNA, 16 nt, Human
ccgccuaguuuacugu

SEQ ID NO: 2904427 - RNA, 18 nt, Human
ccgccuaguuuacuguuu

SEQ ID NO: 2904428 - RNA, 14 nt, Human
ccgccucaaaaugu

SEQ ID NO: 2904429 - RNA, 15 nt, Human
ccgccucaaaaugug

SEQ ID NO: 2904430 - RNA, 16 nt, Human
ccgaguagcugggacu

SEQ ID NO: 2904431 - RNA, 14 nt, Human
ccgaguagcuggga

SEQ ID NO: 2904432 - RNA, 14 nt, Human
ccgagucucuucuc

SEQ ID NO: 2904433 - RNA, 20 nt, Human
ccgaguagcugagauuauag

SEQ ID NO: 2904434 - RNA, 16 nt, Human
ccgagucucuucucca

SEQ ID NO: 2904435 - RNA, 18 nt, Human
ccgagucucuucuccacu

SEQ ID NO: 2904436 - RNA, 13 nt, Human
ccgagcugucccc

SEQ ID NO: 2904437 - RNA, 14 nt, Human
ccgagcuguuuaug

SEQ ID NO: 2904438 - RNA, 16 nt, Human
ccgaggagccaggcaa

SEQ ID NO: 2904439 - RNA, 17 nt, Human
ccgaggguccuggcucc

SEQ ID NO: 2904440 - RNA, 23 nt, Human
ccgaggguccuggcuccugaggg

SEQ ID NO: 2904441 - RNA, 17 nt, Human
ccgaggguugauuaagg

SEQ ID NO: 2904442 - RNA, 21 nt, Human
ccgaggguugauuaaggcagu

SEQ ID NO: 2904443 - RNA, 22 nt, Human
ccgaggguugauuaaggcagua

SEQ ID NO: 2904444 - RNA, 17 nt, Human
ccgaggugguuuuaaag

SEQ ID NO: 2904445 - RNA, 13 nt, Human
ccgaguacagucu

SEQ ID NO: 2904446 - RNA, 14 nt, Human
ccgaguacagucug

SEQ ID NO: 2904447 - RNA, 21 nt, Human
ccgaggguccuggcuccugag

SEQ ID NO: 2904448 - RNA, 19 nt, Human
ccgaggguccuggcuccug

SEQ ID NO: 2904449 - RNA, 20 nt, Human
ccgcucuacaucuucugccu

SEQ ID NO: 2904450 - RNA, 14 nt, Human
ccgcucuccugcca

SEQ ID NO: 2904451 - RNA, 15 nt, Human
ccgcucuccugccac

SEQ ID NO: 2904452 - RNA, 16 nt, Human
ccgcucuccugccaca

SEQ ID NO: 2904453 - RNA, 17 nt, Human
ccgcucuccugccacau

SEQ ID NO: 2904454 - RNA, 13 nt, Human
ccgcucucuuccu

SEQ ID NO: 2904455 - RNA, 14 nt, Human
ccgcucucuuccug

SEQ ID NO: 2904456 - RNA, 15 nt, Human
ccgcucucuuccugc

SEQ ID NO: 2904457 - RNA, 16 nt, Human
ccgcucucuuccugcc

SEQ ID NO: 2904458 - RNA, 17 nt, Human
ccgcucucuuccugccc

SEQ ID NO: 2904459 - RNA, 13 nt, Human
ccccuccuucaga

SEQ ID NO: 2904460 - RNA, 11 nt, Human
ccccuccuggg

SEQ ID NO: 2904461 - RNA, 14 nt, Human
ccccuccuggggcc

SEQ ID NO: 2904462 - RNA, 15 nt, Human
ccccuccuggggcca

SEQ ID NO: 2904463 - RNA, 18 nt, Human
ccccuccuggggccaggc

SEQ ID NO: 2904464 - RNA, 20 nt, Human
ccccuccugaaccgcacagc

SEQ ID NO: 2904465 - RNA, 12 nt, Human
ccccuccuucuc

SEQ ID NO: 2904466 - RNA, 12 nt, Human
ccccucucacca

SEQ ID NO: 2904467 - RNA, 21 nt, Human
ccccucgcuuggacggcuggg

SEQ ID NO: 2904468 - RNA, 16 nt, Human
ccccucucaggagcca

SEQ ID NO: 2904469 - RNA, 17 nt, Human
ccccucucaggagccau

SEQ ID NO: 2904470 - RNA, 15 nt, Human
ccccucuccuucuua

SEQ ID NO: 2904471 - RNA, 17 nt, Human
ccccuccucucugcccu

SEQ ID NO: 2904472 - RNA, 15 nt, Human
ccccuccucucugcc

SEQ ID NO: 2904473 - RNA, 21 nt, Human
ccccuccucuagcuguggggg

SEQ ID NO: 2904474 - RNA, 19 nt, Human
ccccuccuaguuugggagg

SEQ ID NO: 2904475 - RNA, 12 nt, Human
ccccuccucacu

SEQ ID NO: 2904476 - RNA, 13 nt, Human
ccccuccucacug

SEQ ID NO: 2904477 - RNA, 23 nt, Human
ccccuccucacuggccaucccuc

SEQ ID NO: 2904478 - RNA, 18 nt, Human
ccccuccuccuggacucc

SEQ ID NO: 2904479 - RNA, 22 nt, Human
ccccuccuccuggacuccugca

SEQ ID NO: 2904480 - RNA, 17 nt, Human
ccccuccucuagcugug

SEQ ID NO: 2904481 - RNA, 19 nt, Human
ccccuccucuagcuguggg

SEQ ID NO: 2904482 - RNA, 15 nt, Human
ccccucaggacugca

SEQ ID NO: 2904483 - RNA, 12 nt, Human
ccccucacucug

SEQ ID NO: 2904484 - RNA, 14 nt, Human
ccccucacucuggc

SEQ ID NO: 2904485 - RNA, 14 nt, Human
ccccucaccuccuc

SEQ ID NO: 2904486 - RNA, 12 nt, Human
ccccucaccucc

SEQ ID NO: 2904487 - RNA, 13 nt, Human
ccccucaccuccu

SEQ ID NO: 2904488 - RNA, 16 nt, Human
ccccucaguugugcag

SEQ ID NO: 2904489 - RNA, 17 nt, Human
ccccucaguugugcagc

SEQ ID NO: 2904490 - RNA, 18 nt, Human
ccccucaguugugcagcu

SEQ ID NO: 2904491 - RNA, 23 nt, Human
ccccuccaaucccaccaacccuc

SEQ ID NO: 2904492 - RNA, 20 nt, Human
ccccucauagcccucacccu

SEQ ID NO: 2904493 - RNA, 12 nt, Human
ccccuccacugu

SEQ ID NO: 2904494 - RNA, 12 nt, Human
ccccuccaugug

SEQ ID NO: 2904495 - RNA, 11 nt, Human
ccccuccagga

SEQ ID NO: 2904496 - RNA, 14 nt, Human
ccccuccacuguca

SEQ ID NO: 2904497 - RNA, 13 nt, Human
ccccuccagccuu

SEQ ID NO: 2904498 - RNA, 14 nt, Human
ccccucccaccucc

SEQ ID NO: 2904499 - RNA, 12 nt, Human
ccccucccaggg

SEQ ID NO: 2904500 - RNA, 12 nt, Human
ccccucccagag

SEQ ID NO: 2904501 - RNA, 13 nt, Human
ccccucccagagg

SEQ ID NO: 2904502 - RNA, 14 nt, Human
ccccucccagaggc

SEQ ID NO: 2904503 - RNA, 13 nt, Human
ccccucccuguca

SEQ ID NO: 2904504 - RNA, 22 nt, Human
ccccucccuggcucccaugacc

SEQ ID NO: 2904505 - RNA, 15 nt, Human
ccccucccuucaacc

SEQ ID NO: 2904506 - RNA, 15 nt, Human
ccccucccuggcucc

SEQ ID NO: 2904507 - RNA, 14 nt, Human
ccccucccuggcuc

SEQ ID NO: 2904508 - RNA, 13 nt, Human
ccccucccuggcu

SEQ ID NO: 2904509 - RNA, 12 nt, Human
ccccucccuggc

SEQ ID NO: 2904510 - RNA, 13 nt, Human
ccccucccucugu

SEQ ID NO: 2904511 - RNA, 14 nt, Human
ccccucccucuguc

SEQ ID NO: 2904512 - RNA, 13 nt, Human
ccccuaguucccu

SEQ ID NO: 2904513 - RNA, 15 nt, Human
ccccuaguucccucu

SEQ ID NO: 2904514 - RNA, 23 nt, Human
ccccuagcuuuauauauggacau

SEQ ID NO: 2904515 - RNA, 20 nt, Human
ccccgguggcggccccagca

SEQ ID NO: 2904516 - RNA, 20 nt, Human
ccccuagcccaggagagaga

SEQ ID NO: 2904517 - RNA, 18 nt, Human
ccccuagcccaggagaga

SEQ ID NO: 2904518 - RNA, 18 nt, Human
ccccgguggcggccccag

SEQ ID NO: 2904519 - RNA, 14 nt, Human
ccccuauccuuggc

SEQ ID NO: 2904520 - RNA, 15 nt, Human
ccccuauccuuggca

SEQ ID NO: 2904521 - RNA, 20 nt, Human
ccccuauccuuggcaccaaa

SEQ ID NO: 2904522 - RNA, 19 nt, Human
ccccuauggaauuuauaau

SEQ ID NO: 2904523 - RNA, 18 nt, Human
ccccucaaaucguccagc

SEQ ID NO: 2904524 - RNA, 13 nt, Human
ccccucacagccu

SEQ ID NO: 2904525 - RNA, 19 nt, Human
ccccucaaccuccugugga

SEQ ID NO: 2904526 - RNA, 21 nt, Human
ccccucaaccuccuguggaac

SEQ ID NO: 2904527 - RNA, 14 nt, Human
ccccucacagccuc

SEQ ID NO: 2904528 - RNA, 17 nt, Human
ccccucacagccucuga

SEQ ID NO: 2904529 - RNA, 18 nt, Human
ccccucacagccucugac

SEQ ID NO: 2904530 - RNA, 20 nt, Human
ccccucacagccucugaccc

SEQ ID NO: 2904531 - RNA, 17 nt, Human
ccccggcuuccuuuccc

SEQ ID NO: 2904532 - RNA, 21 nt, Human
ccccggcccugggcucggagg

SEQ ID NO: 2904533 - RNA, 15 nt, Human
ccccgggcucucugc

SEQ ID NO: 2904534 - RNA, 13 nt, Human
ccccggcccuggg

SEQ ID NO: 2904535 - RNA, 12 nt, Human
ccccggcccugg

SEQ ID NO: 2904536 - RNA, 14 nt, Human
ccccggggcccagg

SEQ ID NO: 2904537 - RNA, 18 nt, Human
ccccgggcucucugcugu

SEQ ID NO: 2904538 - RNA, 17 nt, Human
ccccgggcucucugcug

SEQ ID NO: 2904539 - RNA, 16 nt, Human
ccccgggcucucugcu

SEQ ID NO: 2904540 - RNA, 20 nt, Human
ccccggucaccuagcaagcu

SEQ ID NO: 2904541 - RNA, 20 nt, Human
cccccugguggacaguccug

SEQ ID NO: 2904542 - RNA, 19 nt, Human
cccccugguggacaguccu

SEQ ID NO: 2904543 - RNA, 15 nt, Human
cccccuggucucugg

SEQ ID NO: 2904544 - RNA, 13 nt, Human
cccccugggcucu

SEQ ID NO: 2904545 - RNA, 11 nt, Human
cccccugggcu

SEQ ID NO: 2904546 - RNA, 23 nt, Human
cccccugguggacaguccuggga

SEQ ID NO: 2904547 - RNA, 21 nt, Human
cccccugguggacaguccugg

SEQ ID NO: 2904548 - RNA, 16 nt, Human
cccccuggucucuggu

SEQ ID NO: 2904549 - RNA, 12 nt, Human
cccccagccugc

SEQ ID NO: 2904550 - RNA, 15 nt, Human
cccccagccuaugag

SEQ ID NO: 2904551 - RNA, 20 nt, Human
cccccagccuaugagcaucc

SEQ ID NO: 2904552 - RNA, 23 nt, Human
cccccagccuaugagcauccuga

SEQ ID NO: 2904553 - RNA, 14 nt, Human
cccccagcucaggg

SEQ ID NO: 2904554 - RNA, 21 nt, Human
cccccagcucaggggcagcuc

SEQ ID NO: 2904555 - RNA, 15 nt, Human
cccccagccucuggc

SEQ ID NO: 2904556 - RNA, 14 nt, Human
cccccucccagagg

SEQ ID NO: 2904557 - RNA, 15 nt, Human
cccccucccagaggc

SEQ ID NO: 2904558 - RNA, 13 nt, Human
cccccucccaggg

SEQ ID NO: 2904559 - RNA, 19 nt, Human
cccccuaaaccccuguccc

SEQ ID NO: 2904560 - RNA, 16 nt, Human
cccccuauccuuggca

SEQ ID NO: 2904561 - RNA, 21 nt, Human
cccccucaucucauucaaacc

SEQ ID NO: 2904562 - RNA, 19 nt, Human
cccccugcaaagcccagcu

SEQ ID NO: 2904563 - RNA, 18 nt, Human
cccccugcaaagcccagc

SEQ ID NO: 2904564 - RNA, 16 nt, Human
cccccugccccccagc

SEQ ID NO: 2904565 - RNA, 22 nt, Human
cccccugagauccccugagccc

SEQ ID NO: 2904566 - RNA, 11 nt, Human
cccccugcagc

SEQ ID NO: 2904567 - RNA, 12 nt, Human
cccccugcagcu

SEQ ID NO: 2904568 - RNA, 13 nt, Human
cccccugcagcua

SEQ ID NO: 2904569 - RNA, 21 nt, Human
cccccugcaaagcccagcuug

SEQ ID NO: 2904570 - RNA, 21 nt, Human
cccccucuggcuccagcuggc

SEQ ID NO: 2904571 - RNA, 16 nt, Human
cccccucugucuugug

SEQ ID NO: 2904572 - RNA, 19 nt, Human
cccccucuggcuccagcug

SEQ ID NO: 2904573 - RNA, 12 nt, Human
cccccucuggcu

SEQ ID NO: 2904574 - RNA, 21 nt, Human
ccccaggcccacucagggguc

SEQ ID NO: 2904575 - RNA, 22 nt, Human
ccccaggcccacucagggguca

SEQ ID NO: 2904576 - RNA, 15 nt, Human
ccccaggccucugug

SEQ ID NO: 2904577 - RNA, 17 nt, Human
ccccaggccucuguguc

SEQ ID NO: 2904578 - RNA, 11 nt, Human
ccccagggcac

SEQ ID NO: 2904579 - RNA, 19 nt, Human
ccccaggcuggacaugcug

SEQ ID NO: 2904580 - RNA, 22 nt, Human
ccccaggcuggacaugcugacu

SEQ ID NO: 2904581 - RNA, 11 nt, Human
ccccaguccca

SEQ ID NO: 2904582 - RNA, 20 nt, Human
ccccagugcccacaggauca

SEQ ID NO: 2904583 - RNA, 16 nt, Human
ccccagugcccacagg

SEQ ID NO: 2904584 - RNA, 15 nt, Human
ccccagugcccacag

SEQ ID NO: 2904585 - RNA, 14 nt, Human
ccccagugcccaca

SEQ ID NO: 2904586 - RNA, 16 nt, Human
ccccauaacucaaugg

SEQ ID NO: 2904587 - RNA, 15 nt, Human
ccccaguucgccugg

SEQ ID NO: 2904588 - RNA, 21 nt, Human
ccccaguucgccuggagcccu

SEQ ID NO: 2904589 - RNA, 14 nt, Human
ccccauagccaccc

SEQ ID NO: 2904590 - RNA, 12 nt, Human
ccccauagccac

SEQ ID NO: 2904591 - RNA, 22 nt, Human
ccccauaauuuuuuuuuuccuu

SEQ ID NO: 2904592 - RNA, 15 nt, Human
cccccacccccagcu

SEQ ID NO: 2904593 - RNA, 17 nt, Human
cccccacccccagcuca

SEQ ID NO: 2904594 - RNA, 19 nt, Human
cccccaccgguccagcugg

SEQ ID NO: 2904595 - RNA, 18 nt, Human
cccccaccgguccagcug

SEQ ID NO: 2904596 - RNA, 16 nt, Human
cccccaccgguccagc

SEQ ID NO: 2904597 - RNA, 21 nt, Human
cccccaccgguccagcuggcc

SEQ ID NO: 2904598 - RNA, 20 nt, Human
cccccaccgguccagcuggc

SEQ ID NO: 2904599 - RNA, 16 nt, Human
ccccaucccacacccu

SEQ ID NO: 2904600 - RNA, 17 nt, Human
cccccacaccucaguuc

SEQ ID NO: 2904601 - RNA, 14 nt, Human
cccccaccacacau

SEQ ID NO: 2904602 - RNA, 15 nt, Human
cccccaccacuagga

SEQ ID NO: 2904603 - RNA, 14 nt, Human
cccccacccccagc

SEQ ID NO: 2904604 - RNA, 20 nt, Human
ccccugcugguucaggguug

SEQ ID NO: 2904605 - RNA, 15 nt, Human
ccccugcugguucag

SEQ ID NO: 2904606 - RNA, 13 nt, Human
ccccugcugguuc

SEQ ID NO: 2904607 - RNA, 11 nt, Human
ccccugcuggu

SEQ ID NO: 2904608 - RNA, 14 nt, Human
ccccugcugcuguc

SEQ ID NO: 2904609 - RNA, 20 nt, Human
ccccugcugcugucaccucu

SEQ ID NO: 2904610 - RNA, 21 nt, Human
ccccugcugcugucaccucuc

SEQ ID NO: 2904611 - RNA, 14 nt, Human
ccccugcuggcucu

SEQ ID NO: 2904612 - RNA, 21 nt, Human
ccccugcuggcucuucugccc

SEQ ID NO: 2904613 - RNA, 19 nt, Human
ccccugcugcaggggcucu

SEQ ID NO: 2904614 - RNA, 22 nt, Human
ccccugcugcaggggcucugga

SEQ ID NO: 2904615 - RNA, 23 nt, Human
ccccugcugcaggggcucuggag

SEQ ID NO: 2904616 - RNA, 12 nt, Human
ccccugccuugc

SEQ ID NO: 2904617 - RNA, 15 nt, Human
ccccugccuuuggga

SEQ ID NO: 2904618 - RNA, 19 nt, Human
ccccugccuuugggagcag

SEQ ID NO: 2904619 - RNA, 12 nt, Human
ccccuggccucu

SEQ ID NO: 2904620 - RNA, 15 nt, Human
ccccuggacugggag

SEQ ID NO: 2904621 - RNA, 20 nt, Human
ccccuggaggcacugaagug

SEQ ID NO: 2904622 - RNA, 22 nt, Human
ccccugcuggcucuucugccca

SEQ ID NO: 2904623 - RNA, 23 nt, Human
ccccugcuucagauguggagcca

SEQ ID NO: 2904624 - RNA, 19 nt, Human
ccccugcccggcugcggaa

SEQ ID NO: 2904625 - RNA, 17 nt, Human
ccccugcccggcugcgg

SEQ ID NO: 2904626 - RNA, 13 nt, Human
ccccugcccugcu

SEQ ID NO: 2904627 - RNA, 23 nt, Human
ccccugcccuccccucucugcac

SEQ ID NO: 2904628 - RNA, 18 nt, Human
ccccucugaccugcacug

SEQ ID NO: 2904629 - RNA, 15 nt, Human
ccccucugaccugca

SEQ ID NO: 2904630 - RNA, 11 nt, Human
ccccucucugg

SEQ ID NO: 2904631 - RNA, 12 nt, Human
ccccucucuggg

SEQ ID NO: 2904632 - RNA, 13 nt, Human
ccccucucugggc

SEQ ID NO: 2904633 - RNA, 20 nt, Human
ccccucugaaaguuguacau

SEQ ID NO: 2904634 - RNA, 12 nt, Human
ccccucugcccu

SEQ ID NO: 2904635 - RNA, 13 nt, Human
ccccucugcccug

SEQ ID NO: 2904636 - RNA, 10 nt, Human
ccccugccug

SEQ ID NO: 2904637 - RNA, 11 nt, Human
ccccugccugc

SEQ ID NO: 2904638 - RNA, 12 nt, Human
ccccugccugcc

SEQ ID NO: 2904639 - RNA, 13 nt, Human
ccccugccugcca

SEQ ID NO: 2904640 - RNA, 14 nt, Human
ccccugccugccau

SEQ ID NO: 2904641 - RNA, 15 nt, Human
ccccugccugccaug

SEQ ID NO: 2904642 - RNA, 16 nt, Human
ccccugccugccaugu

SEQ ID NO: 2904643 - RNA, 17 nt, Human
ccccugcccugguccag

SEQ ID NO: 2904644 - RNA, 13 nt, Human
ccccugcccuggu

SEQ ID NO: 2904645 - RNA, 15 nt, Human
ccccugcccugcugc

SEQ ID NO: 2904646 - RNA, 14 nt, Human
ccccugcccugcug

SEQ ID NO: 2904647 - RNA, 12 nt, Human
ccccugcccugu

SEQ ID NO: 2904648 - RNA, 15 nt, Human
ccccugcccuguggg

SEQ ID NO: 2904649 - RNA, 14 nt, Human
ccccugcccugugg

SEQ ID NO: 2904650 - RNA, 13 nt, Human
cccgcuaaggaag

SEQ ID NO: 2904651 - RNA, 15 nt, Human
cccgcuaaggaagau

SEQ ID NO: 2904652 - RNA, 13 nt, Human
cccgcagcccugg

SEQ ID NO: 2904653 - RNA, 21 nt, Human
cccgcagaccuccccagcccc

SEQ ID NO: 2904654 - RNA, 14 nt, Human
cccgcagaccucug

SEQ ID NO: 2904655 - RNA, 15 nt, Human
cccgcagaccucugg

SEQ ID NO: 2904656 - RNA, 17 nt, Human
cccgcagaccucuggau

SEQ ID NO: 2904657 - RNA, 21 nt, Human
cccgcagaccucuggauuagg

SEQ ID NO: 2904658 - RNA, 16 nt, Human
cccgcagcccuggcag

SEQ ID NO: 2904659 - RNA, 15 nt, Human
cccgccaaaagcugc

SEQ ID NO: 2904660 - RNA, 14 nt, Human
cccgccacacagac

SEQ ID NO: 2904661 - RNA, 13 nt, Human
cccgcccagcugc

SEQ ID NO: 2904662 - RNA, 15 nt, Human
cccgacagccuggca

SEQ ID NO: 2904663 - RNA, 18 nt, Human
cccgacagccuggcacag

SEQ ID NO: 2904664 - RNA, 12 nt, Human
cccgcagaccuc

SEQ ID NO: 2904665 - RNA, 14 nt, Human
cccgcagaccuccc

SEQ ID NO: 2904666 - RNA, 18 nt, Human
cccgcagaccuccccagc

SEQ ID NO: 2904667 - RNA, 19 nt, Human
cccgcagaccuccccagcc

SEQ ID NO: 2904668 - RNA, 20 nt, Human
cccgcagaccuccccagccc

SEQ ID NO: 2904669 - RNA, 19 nt, Human
cccgcaccccccaagcugu

SEQ ID NO: 2904670 - RNA, 15 nt, Human
cccgcaccuguacag

SEQ ID NO: 2904671 - RNA, 14 nt, Human
cccgcaccugucug

SEQ ID NO: 2904672 - RNA, 14 nt, Human
cccgagcugucccc

SEQ ID NO: 2904673 - RNA, 14 nt, Human
cccgagcuguuuau

SEQ ID NO: 2904674 - RNA, 22 nt, Human
cccgaauagcugggacuacagg

SEQ ID NO: 2904675 - RNA, 14 nt, Human
cccgacagccuggc

SEQ ID NO: 2904676 - RNA, 22 nt, Human
ccccuuccagaucacugccaca

SEQ ID NO: 2904677 - RNA, 11 nt, Human
ccccuguucua

SEQ ID NO: 2904678 - RNA, 13 nt, Human
ccccuguucuaag

SEQ ID NO: 2904679 - RNA, 17 nt, Human
ccccuuccaaauaauaa

SEQ ID NO: 2904680 - RNA, 15 nt, Human
ccccuguucacucua

SEQ ID NO: 2904681 - RNA, 14 nt, Human
ccccuggccucugu

SEQ ID NO: 2904682 - RNA, 18 nt, Human
ccccuggcuuuucacugc

SEQ ID NO: 2904683 - RNA, 23 nt, Human
ccccuggcuguacugcucaggcu

SEQ ID NO: 2904684 - RNA, 17 nt, Human
ccccuggcuguuuggac

SEQ ID NO: 2904685 - RNA, 20 nt, Human
ccccuggcuuuucacugcug

SEQ ID NO: 2904686 - RNA, 22 nt, Human
ccccuggggucucugcugcauu

SEQ ID NO: 2904687 - RNA, 20 nt, Human
ccccugggucagucuggugg

SEQ ID NO: 2904688 - RNA, 21 nt, Human
ccccugggucagucugguggg

SEQ ID NO: 2904689 - RNA, 23 nt, Human
ccccugguggacaguccugggag

SEQ ID NO: 2904690 - RNA, 22 nt, Human
ccccugguggacaguccuggga

SEQ ID NO: 2904691 - RNA, 21 nt, Human
ccccugguggacaguccuggg

SEQ ID NO: 2904692 - RNA, 20 nt, Human
ccccugguggacaguccugg

SEQ ID NO: 2904693 - RNA, 19 nt, Human
ccccugguggacaguccug

SEQ ID NO: 2904694 - RNA, 15 nt, Human
ccccugguggacagu

SEQ ID NO: 2904695 - RNA, 15 nt, Human
ccccuggucucuggu

SEQ ID NO: 2904696 - RNA, 13 nt, Human
cccauggaauauu

SEQ ID NO: 2904697 - RNA, 17 nt, Human
cccauggaauauuucca

SEQ ID NO: 2904698 - RNA, 15 nt, Human
cccauggacacucca

SEQ ID NO: 2904699 - RNA, 16 nt, Human
cccauggacacuccag

SEQ ID NO: 2904700 - RNA, 20 nt, Human
cccauggacacuccagugcc

SEQ ID NO: 2904701 - RNA, 21 nt, Human
cccauggacacuccagugcca

SEQ ID NO: 2904702 - RNA, 18 nt, Human
cccaugcccaccugccca

SEQ ID NO: 2904703 - RNA, 15 nt, Human
cccaugcccaccugc

SEQ ID NO: 2904704 - RNA, 14 nt, Human
cccaugcccaccug

SEQ ID NO: 2904705 - RNA, 21 nt, Human
cccaugccaaagcuagggugg

SEQ ID NO: 2904706 - RNA, 17 nt, Human
cccaugccacguuccac

SEQ ID NO: 2904707 - RNA, 18 nt, Human
cccaugccacguuccaca

SEQ ID NO: 2904708 - RNA, 22 nt, Human
cccaugccacguuccacaguug

SEQ ID NO: 2904709 - RNA, 14 nt, Human
cccaugcaggcccu

SEQ ID NO: 2904710 - RNA, 19 nt, Human
cccaugcaggcccuuugaa

SEQ ID NO: 2904711 - RNA, 22 nt, Human
cccaugagccucagcauccugg

SEQ ID NO: 2904712 - RNA, 20 nt, Human
cccaugaccuuauccuuccu

SEQ ID NO: 2904713 - RNA, 22 nt, Human
cccaugaccuuauccuuccucu

SEQ ID NO: 2904714 - RNA, 22 nt, Human
cccaugacuuuauauggaugau

SEQ ID NO: 2904715 - RNA, 21 nt, Human
cccaugagacccuggugccug

SEQ ID NO: 2904716 - RNA, 14 nt, Human
cccaugagccucag

SEQ ID NO: 2904717 - RNA, 19 nt, Human
cccaugacccaggcugggc

SEQ ID NO: 2904718 - RNA, 17 nt, Human
cccaugacccaggcugg

SEQ ID NO: 2904719 - RNA, 18 nt, Human
cccaugacccaggcuggg

SEQ ID NO: 2904720 - RNA, 22 nt, Human
cccaucuggguccuugcacccc

SEQ ID NO: 2904721 - RNA, 16 nt, Human
cccaucugucggccua

SEQ ID NO: 2904722 - RNA, 14 nt, Human
cccaucugucuaaa

SEQ ID NO: 2904723 - RNA, 19 nt, Human
cccaugaccauacugaggg

SEQ ID NO: 2904724 - RNA, 14 nt, Human
cccaguugggugga

SEQ ID NO: 2904725 - RNA, 15 nt, Human
cccaucucccacccu

SEQ ID NO: 2904726 - RNA, 23 nt, Human
cccaucucccacccuguaccuca

SEQ ID NO: 2904727 - RNA, 20 nt, Human
cccaucucgcucccucccag

SEQ ID NO: 2904728 - RNA, 22 nt, Human
cccaucucgcucccucccagga

SEQ ID NO: 2904729 - RNA, 21 nt, Human
cccaucucgcucccucccagg

SEQ ID NO: 2904730 - RNA, 23 nt, Human
cccaucucucccuccccugccau

SEQ ID NO: 2904731 - RNA, 14 nt, Human
cccaucucuucugg

SEQ ID NO: 2904732 - RNA, 21 nt, Human
cccaucucucccuccccugcc

SEQ ID NO: 2904733 - RNA, 18 nt, Human
cccaucucucccuccccu

SEQ ID NO: 2904734 - RNA, 13 nt, Human
cccaucucucccu

SEQ ID NO: 2904735 - RNA, 23 nt, Human
cccaucucgcucccucccaggac

SEQ ID NO: 2904736 - RNA, 13 nt, Human
cccaucucggagc

SEQ ID NO: 2904737 - RNA, 18 nt, Human
cccaucucggagcauccc

SEQ ID NO: 2904738 - RNA, 18 nt, Human
cccaucuggguccuugca

SEQ ID NO: 2904739 - RNA, 11 nt, Human
cccagagacuu

SEQ ID NO: 2904740 - RNA, 21 nt, Human
cccagagacuuuguagauccu

SEQ ID NO: 2904741 - RNA, 19 nt, Human
cccagagacuuuguagauc

SEQ ID NO: 2904742 - RNA, 22 nt, Human
cccaguucaggagucccaagga

SEQ ID NO: 2904743 - RNA, 19 nt, Human
cccaguucgccuggagccc

SEQ ID NO: 2904744 - RNA, 20 nt, Human
cccaguucgccuggagcccu

SEQ ID NO: 2904745 - RNA, 21 nt, Human
cccaguucgccuggagcccuc

SEQ ID NO: 2904746 - RNA, 13 nt, Human
cccagagaacagc

SEQ ID NO: 2904747 - RNA, 17 nt, Human
cccagagaacagcgaag

SEQ ID NO: 2904748 - RNA, 20 nt, Human
cccagagaccaggcuguguc

SEQ ID NO: 2904749 - RNA, 15 nt, Human
ccccacccucccugg

SEQ ID NO: 2904750 - RNA, 16 nt, Human
ccccacccucccugga

SEQ ID NO: 2904751 - RNA, 18 nt, Human
ccccacccucccuggagu

SEQ ID NO: 2904752 - RNA, 12 nt, Human
ccccacccuccu

SEQ ID NO: 2904753 - RNA, 15 nt, Human
ccccacccuccuggc

SEQ ID NO: 2904754 - RNA, 21 nt, Human
ccccacccuccuggccucaga

SEQ ID NO: 2904755 - RNA, 22 nt, Human
ccccacccuccuggccucagac

SEQ ID NO: 2904756 - RNA, 13 nt, Human
ccccacccaggag

SEQ ID NO: 2904757 - RNA, 12 nt, Human
ccccacccagga

SEQ ID NO: 2904758 - RNA, 14 nt, Human
ccccaccccacacu

SEQ ID NO: 2904759 - RNA, 16 nt, Human
ccccaccccacacuug

SEQ ID NO: 2904760 - RNA, 13 nt, Human
ccccacccccagc

SEQ ID NO: 2904761 - RNA, 16 nt, Human
ccccacccccagcuca

SEQ ID NO: 2904762 - RNA, 17 nt, Human
ccccacccccagcucaa

SEQ ID NO: 2904763 - RNA, 20 nt, Human
ccccacccccagcucaaugg

SEQ ID NO: 2904764 - RNA, 18 nt, Human
cccauucagagacugucc

SEQ ID NO: 2904765 - RNA, 18 nt, Human
cccauuccaaagcuuuau

SEQ ID NO: 2904766 - RNA, 22 nt, Human
cccauggacacuccagugccag

SEQ ID NO: 2904767 - RNA, 13 nt, Human
ccccaaucccagc

SEQ ID NO: 2904768 - RNA, 19 nt, Human
ccccaaugagacuugccuu

SEQ ID NO: 2904769 - RNA, 19 nt, Human
ccccaaguagucugcucac

SEQ ID NO: 2904770 - RNA, 20 nt, Human
ccccaaguagucugcucaca

SEQ ID NO: 2904771 - RNA, 16 nt, Human
ccccacaccucaguuc

SEQ ID NO: 2904772 - RNA, 14 nt, Human
ccccacaccucagu

SEQ ID NO: 2904773 - RNA, 12 nt, Human
ccccacacagcu

SEQ ID NO: 2904774 - RNA, 17 nt, Human
ccccacacagcuacagc

SEQ ID NO: 2904775 - RNA, 12 nt, Human
ccccacaacuuu

SEQ ID NO: 2904776 - RNA, 22 nt, Human
ccccaccgguccagcuggccug

SEQ ID NO: 2904777 - RNA, 21 nt, Human
ccccaccgguccagcuggccu

SEQ ID NO: 2904778 - RNA, 19 nt, Human
ccccaccgguccagcuggc

SEQ ID NO: 2904779 - RNA, 18 nt, Human
ccccaccgguccagcugg

SEQ ID NO: 2904780 - RNA, 17 nt, Human
ccccaccgguccagcug

SEQ ID NO: 2904781 - RNA, 13 nt, Human
ccccacccuguuu

SEQ ID NO: 2904782 - RNA, 20 nt, Human
ccccacccuguuuggauuuu

SEQ ID NO: 2904783 - RNA, 12 nt, Human
ccccaccugcag

SEQ ID NO: 2904784 - RNA, 13 nt, Human
ccccaccugcagg

SEQ ID NO: 2904785 - RNA, 12 nt, Human
ccccaccugcca

SEQ ID NO: 2904786 - RNA, 21 nt, Human
ccccaccuucaauuccugggc

SEQ ID NO: 2904787 - RNA, 11 nt, Human
ccccaccuggg

SEQ ID NO: 2904788 - RNA, 14 nt, Human
ccccacgcccuccc

SEQ ID NO: 2904789 - RNA, 17 nt, Human
ccccacgagggucagga

SEQ ID NO: 2904790 - RNA, 18 nt, Human
ccccacucuccccacacu

SEQ ID NO: 2904791 - RNA, 15 nt, Human
ccccacucuccccac

SEQ ID NO: 2904792 - RNA, 12 nt, Human
ccccacucuccc

SEQ ID NO: 2904793 - RNA, 21 nt, Human
ccccacggggccucgggaccu

SEQ ID NO: 2904794 - RNA, 22 nt, Human
ccccacggggccucgggaccuc

SEQ ID NO: 2904795 - RNA, 18 nt, Human
ccccacucaccagugucc

SEQ ID NO: 2904796 - RNA, 14 nt, Human
ccccacuccccacc

SEQ ID NO: 2904797 - RNA, 18 nt, Human
cucauuugucacacacuu

SEQ ID NO: 2904798 - RNA, 21 nt, Human
cucauuugucacacacuuugg

SEQ ID NO: 2904799 - RNA, 17 nt, Human
cucauuuguuaaaauua

SEQ ID NO: 2904800 - RNA, 15 nt, Human
cucauuuguuuuucu

SEQ ID NO: 2904801 - RNA, 16 nt, Human
cucauuucaggagcag

SEQ ID NO: 2904802 - RNA, 21 nt, Human
cucauuucaggagcagccuca

SEQ ID NO: 2904803 - RNA, 16 nt, Human
cucauuuuaguugccu

SEQ ID NO: 2904804 - RNA, 20 nt, Human
cucauuuucuauaacagaua

SEQ ID NO: 2904805 - RNA, 13 nt, Human
cucauuuuaaugu

SEQ ID NO: 2904806 - RNA, 15 nt, Human
cucauuuuaauguaa

SEQ ID NO: 2904807 - RNA, 21 nt, Human
cucauuuuaauguaaagauuu

SEQ ID NO: 2904808 - RNA, 23 nt, Human
cucauuuuugccauacaucaguu

SEQ ID NO: 2904809 - RNA, 21 nt, Human
cucauaaaaagccugcaauuu

SEQ ID NO: 2904810 - RNA, 12 nt, Human
cucauuccugua

SEQ ID NO: 2904811 - RNA, 22 nt, Human
cucaguuugugugucuuaauua

SEQ ID NO: 2904812 - RNA, 20 nt, Human
cucaguugugacuaacuaga

SEQ ID NO: 2904813 - RNA, 12 nt, Human
cucaguugugca

SEQ ID NO: 2904814 - RNA, 14 nt, Human
cucaguugugcagc

SEQ ID NO: 2904815 - RNA, 15 nt, Human
cucaguugugcagcu

SEQ ID NO: 2904816 - RNA, 21 nt, Human
cucaguugugcagcuuuuggu

SEQ ID NO: 2904817 - RNA, 17 nt, Human
cucaguugcuaaacacu

SEQ ID NO: 2904818 - RNA, 18 nt, Human
cucaguugcuaaacacug

SEQ ID NO: 2904819 - RNA, 13 nt, Human
cucaguuggaaau

SEQ ID NO: 2904820 - RNA, 14 nt, Human
cucaguuggaaaua

SEQ ID NO: 2904821 - RNA, 21 nt, Human
cucaguuggaaauaauaaaag

SEQ ID NO: 2904822 - RNA, 22 nt, Human
cucaguucccuuggccucagaa

SEQ ID NO: 2904823 - RNA, 15 nt, Human
cucauugcugagccu

SEQ ID NO: 2904824 - RNA, 16 nt, Human
cucauugcugagccuc

SEQ ID NO: 2904825 - RNA, 17 nt, Human
cuccagauguuuccaga

SEQ ID NO: 2904826 - RNA, 20 nt, Human
cuccagaguggggaugacau

SEQ ID NO: 2904827 - RNA, 20 nt, Human
cuccagaggggcucagguca

SEQ ID NO: 2904828 - RNA, 21 nt, Human
cuccagauagcucauuucauu

SEQ ID NO: 2904829 - RNA, 19 nt, Human
cuccagagcaacgaccagg

SEQ ID NO: 2904830 - RNA, 21 nt, Human
cuccagaccccuggcuuuuca

SEQ ID NO: 2904831 - RNA, 14 nt, Human
cuccacuggaugga

SEQ ID NO: 2904832 - RNA, 14 nt, Human
cuccagauuuuuaa

SEQ ID NO: 2904833 - RNA, 16 nt, Human
cuccagauuuuuaaua

SEQ ID NO: 2904834 - RNA, 20 nt, Human
cuccagauuuuucggaggcc

SEQ ID NO: 2904835 - RNA, 23 nt, Human
cuccagauuuuucggaggcccca

SEQ ID NO: 2904836 - RNA, 19 nt, Human
cuccagauguuuccagacu

SEQ ID NO: 2904837 - RNA, 18 nt, Human
cuccagcucaccagcccc

SEQ ID NO: 2904838 - RNA, 16 nt, Human
cuccagcucaccagcc

SEQ ID NO: 2904839 - RNA, 15 nt, Human
cuccagcucaccagc

SEQ ID NO: 2904840 - RNA, 16 nt, Human
cuccagcaacacagcc

SEQ ID NO: 2904841 - RNA, 14 nt, Human
cuccagcucaccag

SEQ ID NO: 2904842 - RNA, 23 nt, Human
cuccaccagcaucaccugccugu

SEQ ID NO: 2904843 - RNA, 22 nt, Human
cuccaccagcaucaccugccug

SEQ ID NO: 2904844 - RNA, 20 nt, Human
cuccaccagcaucaccugcc

SEQ ID NO: 2904845 - RNA, 12 nt, Human
cuccaccaccgc

SEQ ID NO: 2904846 - RNA, 13 nt, Human
cuccaccaccgcc

SEQ ID NO: 2904847 - RNA, 14 nt, Human
cuccaccaccgccc

SEQ ID NO: 2904848 - RNA, 19 nt, Human
cuccaccaccgcccgucug

SEQ ID NO: 2904849 - RNA, 20 nt, Human
cuccaccaccgcccgucugu

SEQ ID NO: 2904850 - RNA, 22 nt, Human
cuccaccaccgcccgucugugu

SEQ ID NO: 2904851 - RNA, 16 nt, Human
cuccaccccagccccc

SEQ ID NO: 2904852 - RNA, 17 nt, Human
cuccaccccagccccca

SEQ ID NO: 2904853 - RNA, 16 nt, Human
cuccacccuuggccug

SEQ ID NO: 2904854 - RNA, 15 nt, Human
cuccacccuuggccu

SEQ ID NO: 2904855 - RNA, 14 nt, Human
cuccacccuuggcc

SEQ ID NO: 2904856 - RNA, 13 nt, Human
cuccacccuuggc

SEQ ID NO: 2904857 - RNA, 21 nt, Human
cuccacccuuggccugucuca

SEQ ID NO: 2904858 - RNA, 17 nt, Human
cuccacccuuggccugu

SEQ ID NO: 2904859 - RNA, 15 nt, Human
cuccaccuagacugu

SEQ ID NO: 2904860 - RNA, 12 nt, Human
cuccaccuacca

SEQ ID NO: 2904861 - RNA, 13 nt, Human
cuccacugccuuc

SEQ ID NO: 2904862 - RNA, 14 nt, Human
cuccacugccuucg

SEQ ID NO: 2904863 - RNA, 15 nt, Human
cuccacugccuucga

SEQ ID NO: 2904864 - RNA, 16 nt, Human
cuccacugccuucgau

SEQ ID NO: 2904865 - RNA, 13 nt, Human
cuccacuggaugg

SEQ ID NO: 2904866 - RNA, 11 nt, Human
cuccccagccc

SEQ ID NO: 2904867 - RNA, 15 nt, Human
cuccccacgcccucc

SEQ ID NO: 2904868 - RNA, 23 nt, Human
cuccccacggggccucgggaccu

SEQ ID NO: 2904869 - RNA, 13 nt, Human
cuccccucugaaa

SEQ ID NO: 2904870 - RNA, 22 nt, Human
cuccccucugaaaguuguacau

SEQ ID NO: 2904871 - RNA, 23 nt, Human
cuccccucugaaaguuguacaug

SEQ ID NO: 2904872 - RNA, 22 nt, Human
cucccuucaaccauuccccaug

SEQ ID NO: 2904873 - RNA, 23 nt, Human
cucccuucaaccauuccccaugg

SEQ ID NO: 2904874 - RNA, 21 nt, Human
cucccuucaaccauuccccau

SEQ ID NO: 2904875 - RNA, 23 nt, Human
cucccuggaguguggcugaggag

SEQ ID NO: 2904876 - RNA, 11 nt, Human
cucccuggagu

SEQ ID NO: 2904877 - RNA, 12 nt, Human
cucccuggagug

SEQ ID NO: 2904878 - RNA, 22 nt, Human
cucccuggaguguggcugagga

SEQ ID NO: 2904879 - RNA, 19 nt, Human
cucccgaauagcugggacu

SEQ ID NO: 2904880 - RNA, 14 nt, Human
cuccccuguaccuu

SEQ ID NO: 2904881 - RNA, 23 nt, Human
cuccccuggggacagcaagggcu

SEQ ID NO: 2904882 - RNA, 23 nt, Human
cucccgaauagcugggacuacag

SEQ ID NO: 2904883 - RNA, 20 nt, Human
cucccgaauagcugggacua

SEQ ID NO: 2904884 - RNA, 16 nt, Human
cucccgaccucaggug

SEQ ID NO: 2904885 - RNA, 14 nt, Human
cucccucaacccca

SEQ ID NO: 2904886 - RNA, 17 nt, Human
cuccaugcugccuccag

SEQ ID NO: 2904887 - RNA, 14 nt, Human
cuccauggcaucuu

SEQ ID NO: 2904888 - RNA, 13 nt, Human
cuccaugcugccu

SEQ ID NO: 2904889 - RNA, 14 nt, Human
cuccaugcugccuc

SEQ ID NO: 2904890 - RNA, 15 nt, Human
cuccaugcugccucc

SEQ ID NO: 2904891 - RNA, 16 nt, Human
cuccaugcugccucca

SEQ ID NO: 2904892 - RNA, 14 nt, Human
cuccagcugcacca

SEQ ID NO: 2904893 - RNA, 17 nt, Human
cuccagcugcaccagag

SEQ ID NO: 2904894 - RNA, 23 nt, Human
cuccagcuggccgggagccugau

SEQ ID NO: 2904895 - RNA, 22 nt, Human
cuccagcuggccgggagccuga

SEQ ID NO: 2904896 - RNA, 15 nt, Human
cuccagcugggcucu

SEQ ID NO: 2904897 - RNA, 19 nt, Human
cuccagcugggcucugcaa

SEQ ID NO: 2904898 - RNA, 20 nt, Human
cuccagcugggcucugcaau

SEQ ID NO: 2904899 - RNA, 23 nt, Human
cucccaaagugcugggauuacag

SEQ ID NO: 2904900 - RNA, 16 nt, Human
cucccaaagugcuggg

SEQ ID NO: 2904901 - RNA, 20 nt, Human
cucccaaagugcugagauua

SEQ ID NO: 2904902 - RNA, 22 nt, Human
cucccaaagugcugagauuaca

SEQ ID NO: 2904903 - RNA, 19 nt, Human
cucccagggccagggcccu

SEQ ID NO: 2904904 - RNA, 15 nt, Human
cucccaucaccucua

SEQ ID NO: 2904905 - RNA, 13 nt, Human
cucccaggcucuc

SEQ ID NO: 2904906 - RNA, 12 nt, Human
cucccaggcucu

SEQ ID NO: 2904907 - RNA, 16 nt, Human
cucccagggccagggc

SEQ ID NO: 2904908 - RNA, 20 nt, Human
cucccaggcgccccuucccc

SEQ ID NO: 2904909 - RNA, 22 nt, Human
cucccaggcgccccuucccccu

SEQ ID NO: 2904910 - RNA, 17 nt, Human
cucccaggcgccccuuc

SEQ ID NO: 2904911 - RNA, 19 nt, Human
cucccaggcgccccuuccc

SEQ ID NO: 2904912 - RNA, 12 nt, Human
cuccccacgccc

SEQ ID NO: 2904913 - RNA, 23 nt, Human
cuccccaccuucaauuccugggc

SEQ ID NO: 2904914 - RNA, 21 nt, Human
cuccccaccuucaauuccugg

SEQ ID NO: 2904915 - RNA, 12 nt, Human
cuccccaccccu

SEQ ID NO: 2904916 - RNA, 14 nt, Human
cuccccacccgccc

SEQ ID NO: 2904917 - RNA, 16 nt, Human
cuccccacccuccugg

SEQ ID NO: 2904918 - RNA, 17 nt, Human
cuccccacccuccuggc

SEQ ID NO: 2904919 - RNA, 23 nt, Human
cuccccacccuccuggccucaga

SEQ ID NO: 2904920 - RNA, 19 nt, Human
cucccaucaugcccggucc

SEQ ID NO: 2904921 - RNA, 23 nt, Human
cucccaucaugcccggucccacc

SEQ ID NO: 2904922 - RNA, 21 nt, Human
cucccaucauuacccuucccu

SEQ ID NO: 2904923 - RNA, 23 nt, Human
cucccaucauuacccuucccugc

SEQ ID NO: 2904924 - RNA, 13 nt, Human
cucccauccccug

SEQ ID NO: 2904925 - RNA, 15 nt, Human
cucccauccccugga

SEQ ID NO: 2904926 - RNA, 16 nt, Human
cucccauccccuggac

SEQ ID NO: 2904927 - RNA, 14 nt, Human
cucccauguaugga

SEQ ID NO: 2904928 - RNA, 22 nt, Human
cucagcuuugagaagccuucag

SEQ ID NO: 2904929 - RNA, 11 nt, Human
cucaggaaaga

SEQ ID NO: 2904930 - RNA, 15 nt, Human
cucaggaaagaauag

SEQ ID NO: 2904931 - RNA, 20 nt, Human
cucaggaaagaauagaaaga

SEQ ID NO: 2904932 - RNA, 21 nt, Human
cucaggaaagaauagaaagaa

SEQ ID NO: 2904933 - RNA, 12 nt, Human
cucagcuuugag

SEQ ID NO: 2904934 - RNA, 16 nt, Human
cucagcuuccuaccca

SEQ ID NO: 2904935 - RNA, 22 nt, Human
cucagcuuccuacccacaccuc

SEQ ID NO: 2904936 - RNA, 14 nt, Human
cucagcuuccuacc

SEQ ID NO: 2904937 - RNA, 21 nt, Human
cucagcuuugagaagccuuca

SEQ ID NO: 2904938 - RNA, 16 nt, Human
cucagcuuugagaagc

SEQ ID NO: 2904939 - RNA, 13 nt, Human
cucagcuuugaga

SEQ ID NO: 2904940 - RNA, 21 nt, Human
cucagcuuuuugucuuuucug

SEQ ID NO: 2904941 - RNA, 17 nt, Human
cucagcuuuuugucuuu

SEQ ID NO: 2904942 - RNA, 15 nt, Human
cucaggaacuagacu

SEQ ID NO: 2904943 - RNA, 19 nt, Human
cucagcucggggagccuua

SEQ ID NO: 2904944 - RNA, 18 nt, Human
cucagcucggggagccuu

SEQ ID NO: 2904945 - RNA, 15 nt, Human
cucagcucggggagc

SEQ ID NO: 2904946 - RNA, 18 nt, Human
cucagcucuuggcuccac

SEQ ID NO: 2904947 - RNA, 17 nt, Human
cucagcucuuggcucca

SEQ ID NO: 2904948 - RNA, 16 nt, Human
cucagcugucuguggc

SEQ ID NO: 2904949 - RNA, 18 nt, Human
cucagcugucuguggcuu

SEQ ID NO: 2904950 - RNA, 23 nt, Human
cucagcuggaugauggucuucag

SEQ ID NO: 2904951 - RNA, 14 nt, Human
cucagcuuaucucu

SEQ ID NO: 2904952 - RNA, 20 nt, Human
cucagcuuaucucuuuuaua

SEQ ID NO: 2904953 - RNA, 20 nt, Human
cucagcucuuggcuccacug

SEQ ID NO: 2904954 - RNA, 23 nt, Human
cucagcugaaugccuccuguggg

SEQ ID NO: 2904955 - RNA, 12 nt, Human
cucagcugccuc

SEQ ID NO: 2904956 - RNA, 16 nt, Human
cucagcugccucacuu

SEQ ID NO: 2904957 - RNA, 14 nt, Human
cucagcugccucac

SEQ ID NO: 2904958 - RNA, 18 nt, Human
cucagcugccucacuucc

SEQ ID NO: 2904959 - RNA, 12 nt, Human
cucaggaccagg

SEQ ID NO: 2904960 - RNA, 14 nt, Human
cucaggaccaggca

SEQ ID NO: 2904961 - RNA, 21 nt, Human
cucaggacucagaagccucug

SEQ ID NO: 2904962 - RNA, 16 nt, Human
cucaggacucagaagc

SEQ ID NO: 2904963 - RNA, 14 nt, Human
cucaggacucagaa

SEQ ID NO: 2904964 - RNA, 15 nt, Human
cucaggaccaggcaa

SEQ ID NO: 2904965 - RNA, 16 nt, Human
cucaggacugcaacag

SEQ ID NO: 2904966 - RNA, 17 nt, Human
cucaggacugcaacagg

SEQ ID NO: 2904967 - RNA, 19 nt, Human
cucaggacugcaacaggcu

SEQ ID NO: 2904968 - RNA, 20 nt, Human
cucagggccaugccugcccc

SEQ ID NO: 2904969 - RNA, 18 nt, Human
cucaggaggcugaggcag

SEQ ID NO: 2904970 - RNA, 20 nt, Human
cucaggaggcgcccuuggcu

SEQ ID NO: 2904971 - RNA, 14 nt, Human
cucaggaggcugag

SEQ ID NO: 2904972 - RNA, 17 nt, Human
cucaggaggcugaggca

SEQ ID NO: 2904973 - RNA, 15 nt, Human
cucaggaggcugagg

SEQ ID NO: 2904974 - RNA, 19 nt, Human
cucaggaggcgcccuuggc

SEQ ID NO: 2904975 - RNA, 12 nt, Human
cucaggagccau

SEQ ID NO: 2904976 - RNA, 16 nt, Human
cucaggagccucugcu

SEQ ID NO: 2904977 - RNA, 23 nt, Human
cucaggugauccacccaccucag

SEQ ID NO: 2904978 - RNA, 22 nt, Human
cucaggugauccacccaccuca

SEQ ID NO: 2904979 - RNA, 19 nt, Human
cucaguucccuuggccuca

SEQ ID NO: 2904980 - RNA, 21 nt, Human
cucaguucccuuggccucaga

SEQ ID NO: 2904981 - RNA, 20 nt, Human
cucaguucccuuggccucag

SEQ ID NO: 2904982 - RNA, 13 nt, Human
cucagggucucug

SEQ ID NO: 2904983 - RNA, 14 nt, Human
cucagggucucugc

SEQ ID NO: 2904984 - RNA, 16 nt, Human
cucagggucucugcug

SEQ ID NO: 2904985 - RNA, 17 nt, Human
cucagggucucugcugc

SEQ ID NO: 2904986 - RNA, 18 nt, Human
cucagggucucugcugcc

SEQ ID NO: 2904987 - RNA, 19 nt, Human
cucagggucucugcugccg

SEQ ID NO: 2904988 - RNA, 15 nt, Human
cucagggugcagagg

SEQ ID NO: 2904989 - RNA, 16 nt, Human
cucagggugcagaggu

SEQ ID NO: 2904990 - RNA, 20 nt, Human
cucagguaaucgaccugccu

SEQ ID NO: 2904991 - RNA, 24 nt, Human
cucagguaaucgaccugccucggc

SEQ ID NO: 2904992 - RNA, 22 nt, Human
cucagguaaucgaccugccucg

SEQ ID NO: 2904993 - RNA, 23 nt, Human
cucagaugucccuugaugcacag

SEQ ID NO: 2904994 - RNA, 18 nt, Human
cucagaugcaguuuggag

SEQ ID NO: 2904995 - RNA, 13 nt, Human
cucagaugcucaa

SEQ ID NO: 2904996 - RNA, 14 nt, Human
cucagaugcucaaa

SEQ ID NO: 2904997 - RNA, 15 nt, Human
cucagaugcucaaag

SEQ ID NO: 2904998 - RNA, 19 nt, Human
cucagaugcucaaaguugu

SEQ ID NO: 2904999 - RNA, 21 nt, Human
cucagaugcucaaaguuguuu

SEQ ID NO: 2905000 - RNA, 22 nt, Human
cucagagaugugcacccauggg

SEQ ID NO: 2905001 - RNA, 18 nt, Human
cucagaguauggagcuca

SEQ ID NO: 2905002 - RNA, 16 nt, Human
cucagaguauggagcu

SEQ ID NO: 2905003 - RNA, 17 nt, Human
cucagaguauggagcuc

SEQ ID NO: 2905004 - RNA, 19 nt, Human
cucagagguagggcugcca

SEQ ID NO: 2905005 - RNA, 23 nt, Human
cucagagguuuaccuagagaaca

SEQ ID NO: 2905006 - RNA, 13 nt, Human
cucagagggggac

SEQ ID NO: 2905007 - RNA, 17 nt, Human
cucagagggggacugcu

SEQ ID NO: 2905008 - RNA, 18 nt, Human
cucagagggggacugcug

SEQ ID NO: 2905009 - RNA, 19 nt, Human
cucagagggggacugcugc

SEQ ID NO: 2905010 - RNA, 19 nt, Human
cucacuguugcccaggcug

SEQ ID NO: 2905011 - RNA, 18 nt, Human
cucacuguugcccaggcu

SEQ ID NO: 2905012 - RNA, 17 nt, Human
cucacuguugcccaggc

SEQ ID NO: 2905013 - RNA, 16 nt, Human
cucacuguugcccagg

SEQ ID NO: 2905014 - RNA, 21 nt, Human
cucacuguugaauuuucucua

SEQ ID NO: 2905015 - RNA, 20 nt, Human
cucagagaugugcacccaug

SEQ ID NO: 2905016 - RNA, 19 nt, Human
cucagagauauugugagga

SEQ ID NO: 2905017 - RNA, 15 nt, Human
cucagagccaccccu

SEQ ID NO: 2905018 - RNA, 15 nt, Human
cucacuguugaauuu

SEQ ID NO: 2905019 - RNA, 21 nt, Human
cucacuguucuauucaucuca

SEQ ID NO: 2905020 - RNA, 16 nt, Human
cucacuggggccuaca

SEQ ID NO: 2905021 - RNA, 18 nt, Human
cucacuggggccuacagc

SEQ ID NO: 2905022 - RNA, 13 nt, Human
cucacuggggccu

SEQ ID NO: 2905023 - RNA, 16 nt, Human
cucacuggccaucccu

SEQ ID NO: 2905024 - RNA, 21 nt, Human
cucacuggccaucccucgugg

SEQ ID NO: 2905025 - RNA, 14 nt, Human
cucacuggccaucc

SEQ ID NO: 2905026 - RNA, 23 nt, Human
cucacugcucccugaagccagcc

SEQ ID NO: 2905027 - RNA, 19 nt, Human
cucacugcucccugaagcc

SEQ ID NO: 2905028 - RNA, 20 nt, Human
cucacugcucccugaagcca

SEQ ID NO: 2905029 - RNA, 15 nt, Human
cucacugcucccuga

SEQ ID NO: 2905030 - RNA, 17 nt, Human
cucacugcucccugaag

SEQ ID NO: 2905031 - RNA, 19 nt, Human
cucacugugguaaaugcca

SEQ ID NO: 2905032 - RNA, 20 nt, Human
cucacugugguaaaugccac

SEQ ID NO: 2905033 - RNA, 22 nt, Human
cucacugugguaaaugccacac

SEQ ID NO: 2905034 - RNA, 19 nt, Human
cucacugugucacccaggc

SEQ ID NO: 2905035 - RNA, 15 nt, Human
cucacuguugcccag

SEQ ID NO: 2905036 - RNA, 14 nt, Human
cucacuguugccca

SEQ ID NO: 2905037 - RNA, 14 nt, Human
cucacugcagccuc

SEQ ID NO: 2905038 - RNA, 20 nt, Human
cucacugcauccuccgccuc

SEQ ID NO: 2905039 - RNA, 16 nt, Human
cucacugcagccucaa

SEQ ID NO: 2905040 - RNA, 15 nt, Human
cucacugcagccuca

SEQ ID NO: 2905041 - RNA, 20 nt, Human
cucacagaugugacuguaua

SEQ ID NO: 2905042 - RNA, 19 nt, Human
cucacagauugcugccuca

SEQ ID NO: 2905043 - RNA, 15 nt, Human
cucacagcacaugcu

SEQ ID NO: 2905044 - RNA, 19 nt, Human
cucacagcacaugcuggcc

SEQ ID NO: 2905045 - RNA, 20 nt, Human
cucacagcacaugcuggcca

SEQ ID NO: 2905046 - RNA, 21 nt, Human
cucacagcacaugcuggccag

SEQ ID NO: 2905047 - RNA, 22 nt, Human
cucacagcacaugcuggccagc

SEQ ID NO: 2905048 - RNA, 22 nt, Human
cucagcauccuggcacccggcc

SEQ ID NO: 2905049 - RNA, 21 nt, Human
cucagcauccuggcacccggc

SEQ ID NO: 2905050 - RNA, 13 nt, Human
cucagcauccugg

SEQ ID NO: 2905051 - RNA, 15 nt, Human
cucagauuauuuaaa

SEQ ID NO: 2905052 - RNA, 16 nt, Human
cucagccccgagcugu

SEQ ID NO: 2905053 - RNA, 19 nt, Human
cucagccccgagcuguccc

SEQ ID NO: 2905054 - RNA, 13 nt, Human
cucagcccagaag

SEQ ID NO: 2905055 - RNA, 20 nt, Human
cucagcccagaagaaaauuc

SEQ ID NO: 2905056 - RNA, 21 nt, Human
cucagcccacauagugauggu

SEQ ID NO: 2905057 - RNA, 20 nt, Human
cucagccccugauccuguga

SEQ ID NO: 2905058 - RNA, 22 nt, Human
cucagccccugauccugugaag

SEQ ID NO: 2905059 - RNA, 23 nt, Human
cucagccccugauccugugaagu

SEQ ID NO: 2905060 - RNA, 11 nt, Human
cucagccccua

SEQ ID NO: 2905061 - RNA, 12 nt, Human
cucagccccuag

SEQ ID NO: 2905062 - RNA, 14 nt, Human
cucagccccuagga

SEQ ID NO: 2905063 - RNA, 15 nt, Human
cucagccccuaggag

SEQ ID NO: 2905064 - RNA, 23 nt, Human
cucagccccuaggaguauauuuc

SEQ ID NO: 2905065 - RNA, 14 nt, Human
cucagcccucccug

SEQ ID NO: 2905066 - RNA, 19 nt, Human
cucagcccucccugccccu

SEQ ID NO: 2905067 - RNA, 20 nt, Human
cucagcccucccugccccuc

SEQ ID NO: 2905068 - RNA, 21 nt, Human
cucagcccucccugccccucc

SEQ ID NO: 2905069 - RNA, 21 nt, Human
cucagcggggacagcuccuuc

SEQ ID NO: 2905070 - RNA, 20 nt, Human
cucagcggggacagcuccuu

SEQ ID NO: 2905071 - RNA, 19 nt, Human
cucagcggggacagcuccu

SEQ ID NO: 2905072 - RNA, 18 nt, Human
cucagcggggacagcucc

SEQ ID NO: 2905073 - RNA, 16 nt, Human
cucagcggggacagcu

SEQ ID NO: 2905074 - RNA, 15 nt, Human
cucagcggggacagc

SEQ ID NO: 2905075 - RNA, 14 nt, Human
cucagcggggacag

SEQ ID NO: 2905076 - RNA, 11 nt, Human
cucagcccuga

SEQ ID NO: 2905077 - RNA, 23 nt, Human
cucagcggggacagcuccuucug

SEQ ID NO: 2905078 - RNA, 13 nt, Human
cucagcggggaca

SEQ ID NO: 2905079 - RNA, 23 nt, Human
cucagcguuuuuuuguuuuuaau

SEQ ID NO: 2905080 - RNA, 19 nt, Human
cucagcuacccacuauccu

SEQ ID NO: 2905081 - RNA, 21 nt, Human
cucagcuacccacuauccuuc

SEQ ID NO: 2905082 - RNA, 15 nt, Human
cucagcauuucuuuu

SEQ ID NO: 2905083 - RNA, 15 nt, Human
cucagcucagcgcca

SEQ ID NO: 2905084 - RNA, 16 nt, Human
cucagcucagcgccag

SEQ ID NO: 2905085 - RNA, 17 nt, Human
cucagcucagcgccagc

SEQ ID NO: 2905086 - RNA, 13 nt, Human
cucagcucagcgc

SEQ ID NO: 2905087 - RNA, 19 nt, Human
cucagcucccaaggcucug

SEQ ID NO: 2905088 - RNA, 15 nt, Human
cucagcucccaaggc

SEQ ID NO: 2905089 - RNA, 19 nt, Human
cucagcuccagguggcucu

SEQ ID NO: 2905090 - RNA, 20 nt, Human
cucagcuccagguggcucug

SEQ ID NO: 2905091 - RNA, 12 nt, Human
cucagcucccca

SEQ ID NO: 2905092 - RNA, 14 nt, Human
cucagcuccccaga

SEQ ID NO: 2905093 - RNA, 16 nt, Human
cucagcuccccagagu

SEQ ID NO: 2905094 - RNA, 19 nt, Human
cucagcuccccagaguccu

SEQ ID NO: 2905095 - RNA, 13 nt, Human
cuauaaugugugu

SEQ ID NO: 2905096 - RNA, 16 nt, Human
cuauaauguguguaug

SEQ ID NO: 2905097 - RNA, 21 nt, Human
cuauagccuaggugacagagu

SEQ ID NO: 2905098 - RNA, 20 nt, Human
cuauagccuaggugacagag

SEQ ID NO: 2905099 - RNA, 18 nt, Human
cuauagccuaggugacag

SEQ ID NO: 2905100 - RNA, 19 nt, Human
cuauagccuaggugacaga

SEQ ID NO: 2905101 - RNA, 15 nt, Human
cuauaccugugccuc

SEQ ID NO: 2905102 - RNA, 14 nt, Human
cuauaccugugccu

SEQ ID NO: 2905103 - RNA, 19 nt, Human
cuauaccugugccucggcu

SEQ ID NO: 2905104 - RNA, 11 nt, Human
cuauacuugaa

SEQ ID NO: 2905105 - RNA, 14 nt, Human
cuauacuugaacaa

SEQ ID NO: 2905106 - RNA, 15 nt, Human
cuauacuugaacaaa

SEQ ID NO: 2905107 - RNA, 16 nt, Human
cuauacuugaacaaaa

SEQ ID NO: 2905108 - RNA, 17 nt, Human
cuauacuugaacaaaag

SEQ ID NO: 2905109 - RNA, 20 nt, Human
cuauacuugaacaaaagggu

SEQ ID NO: 2905110 - RNA, 21 nt, Human
cuauacuugaacaaaaggguc

SEQ ID NO: 2905111 - RNA, 22 nt, Human
cuauacuugaacaaaaggguca

SEQ ID NO: 2905112 - RNA, 14 nt, Human
cuauauagagaugu

SEQ ID NO: 2905113 - RNA, 13 nt, Human
cuauaguucuaga

SEQ ID NO: 2905114 - RNA, 11 nt, Human
cuauauacaug

SEQ ID NO: 2905115 - RNA, 13 nt, Human
cuauauacaugug

SEQ ID NO: 2905116 - RNA, 16 nt, Human
cuauauacaugugugu

SEQ ID NO: 2905117 - RNA, 17 nt, Human
cuauauacaugugugua

SEQ ID NO: 2905118 - RNA, 19 nt, Human
cuauauacauguguguaua

SEQ ID NO: 2905119 - RNA, 22 nt, Human
cuauauacauguguguauauau

SEQ ID NO: 2905120 - RNA, 17 nt, Human
cuauauagaaugcugca

SEQ ID NO: 2905121 - RNA, 18 nt, Human
cuauauagaaugcugcac

SEQ ID NO: 2905122 - RNA, 14 nt, Human
cuauaguucuagac

SEQ ID NO: 2905123 - RNA, 15 nt, Human
cuauaguucuagaca

SEQ ID NO: 2905124 - RNA, 19 nt, Human
cuauaguuuaaaacacauu

SEQ ID NO: 2905125 - RNA, 19 nt, Human
cuauagccuggacuuuccu

SEQ ID NO: 2905126 - RNA, 17 nt, Human
cuauagcuaaguacaca

SEQ ID NO: 2905127 - RNA, 15 nt, Human
cuauagcuaaguaca

SEQ ID NO: 2905128 - RNA, 19 nt, Human
cuaugaugugaaacacuuu

SEQ ID NO: 2905129 - RNA, 23 nt, Human
cuaugaugugaaacacuuugccu

SEQ ID NO: 2905130 - RNA, 15 nt, Human
cuaugaaugcuuugc

SEQ ID NO: 2905131 - RNA, 22 nt, Human
cuaugaucccagcacuuuggga

SEQ ID NO: 2905132 - RNA, 16 nt, Human
cuaugaacugaaggca

SEQ ID NO: 2905133 - RNA, 15 nt, Human
cuauauagagauguu

SEQ ID NO: 2905134 - RNA, 23 nt, Human
cuauaguauuugauucaaaauau

SEQ ID NO: 2905135 - RNA, 12 nt, Human
cuaugaacaacu

SEQ ID NO: 2905136 - RNA, 19 nt, Human
cuaugaaguaaagaacugc

SEQ ID NO: 2905137 - RNA, 17 nt, Human
cuaugaacuucucucag

SEQ ID NO: 2905138 - RNA, 20 nt, Human
cuaugccagcucagucccau

SEQ ID NO: 2905139 - RNA, 17 nt, Human
cuaugccccaaauauag

SEQ ID NO: 2905140 - RNA, 19 nt, Human
cuaugccagcucaguccca

SEQ ID NO: 2905141 - RNA, 14 nt, Human
cuaugccugugucu

SEQ ID NO: 2905142 - RNA, 12 nt, Human
cuaugcacauau

SEQ ID NO: 2905143 - RNA, 19 nt, Human
cuaugauuuggaaaauaaa

SEQ ID NO: 2905144 - RNA, 15 nt, Human
cuaugauuuggaaaa

SEQ ID NO: 2905145 - RNA, 22 nt, Human
cuauggggagaggaacuccuug

SEQ ID NO: 2905146 - RNA, 19 nt, Human
cuaugggagccccaggguc

SEQ ID NO: 2905147 - RNA, 17 nt, Human
cuaugggagccccaggg

SEQ ID NO: 2905148 - RNA, 14 nt, Human
cuauguauauacau

SEQ ID NO: 2905149 - RNA, 21 nt, Human
cuauguaagaauucagaagac

SEQ ID NO: 2905150 - RNA, 17 nt, Human
cuauguacuaguacugu

SEQ ID NO: 2905151 - RNA, 18 nt, Human
cuauguacuaguacugug

SEQ ID NO: 2905152 - RNA, 19 nt, Human
cuauguacuaguacugugu

SEQ ID NO: 2905153 - RNA, 20 nt, Human
cuauguacuaguacugugua

SEQ ID NO: 2905154 - RNA, 23 nt, Human
cuauguacuaguacuguguacug

SEQ ID NO: 2905155 - RNA, 14 nt, Human
cuauguaggaaaaa

SEQ ID NO: 2905156 - RNA, 15 nt, Human
cuauguaggaaaaaa

SEQ ID NO: 2905157 - RNA, 19 nt, Human
cuauguaggaaaaaaauag

SEQ ID NO: 2905158 - RNA, 18 nt, Human
cuauuauguuguuagaga

SEQ ID NO: 2905159 - RNA, 20 nt, Human
cuauuauguuguuagagaaa

SEQ ID NO: 2905160 - RNA, 22 nt, Human
cuauuauuuucacuguagaaug

SEQ ID NO: 2905161 - RNA, 20 nt, Human
cuauuauuuucacuguagaa

SEQ ID NO: 2905162 - RNA, 21 nt, Human
cuauucaggagaguagaacag

SEQ ID NO: 2905163 - RNA, 15 nt, Human
cuauuauaauuuaau

SEQ ID NO: 2905164 - RNA, 21 nt, Human
cuauuauaauuuaaugcaugu

SEQ ID NO: 2905165 - RNA, 17 nt, Human
cuauuauaauuuaaugc

SEQ ID NO: 2905166 - RNA, 16 nt, Human
cuauuauaauuuaaug

SEQ ID NO: 2905167 - RNA, 12 nt, Human
cuauucucucuu

SEQ ID NO: 2905168 - RNA, 16 nt, Human
cuauucugagaaaaca

SEQ ID NO: 2905169 - RNA, 15 nt, Human
cuauucugagaaaac

SEQ ID NO: 2905170 - RNA, 17 nt, Human
cuauucugagaaaacaa

SEQ ID NO: 2905171 - RNA, 19 nt, Human
cuauucuguguugcauuau

SEQ ID NO: 2905172 - RNA, 24 nt, Human
cuauucuguguugcauuauucauu

SEQ ID NO: 2905173 - RNA, 18 nt, Human
cuauugauuuuuacuuca

SEQ ID NO: 2905174 - RNA, 14 nt, Human
cuauugauacucuu

SEQ ID NO: 2905175 - RNA, 18 nt, Human
cuauugauacucuuucua

SEQ ID NO: 2905176 - RNA, 14 nt, Human
cuauugacuucaau

SEQ ID NO: 2905177 - RNA, 16 nt, Human
cuauugacuucaauga

SEQ ID NO: 2905178 - RNA, 13 nt, Human
cuauugacuucaa

SEQ ID NO: 2905179 - RNA, 19 nt, Human
cuauuuauuuuccuaaaga

SEQ ID NO: 2905180 - RNA, 18 nt, Human
cuauuuauuuuccuaaag

SEQ ID NO: 2905181 - RNA, 21 nt, Human
cuauuuauuuuccuaaagaga

SEQ ID NO: 2905182 - RNA, 14 nt, Human
cuauuuauuuuuac

SEQ ID NO: 2905183 - RNA, 17 nt, Human
cuauuuauuuuccuaaa

SEQ ID NO: 2905184 - RNA, 16 nt, Human
cuauuuauuuuccuaa

SEQ ID NO: 2905185 - RNA, 13 nt, Human
cuauuuauuuucc

SEQ ID NO: 2905186 - RNA, 21 nt, Human
cuauuuauuaauauuuaacau

SEQ ID NO: 2905187 - RNA, 22 nt, Human
cuauuuauuaaguucucaaugu

SEQ ID NO: 2905188 - RNA, 21 nt, Human
cuauuucuuuauauuuaucca

SEQ ID NO: 2905189 - RNA, 19 nt, Human
cuauuugaaaugaauuccu

SEQ ID NO: 2905190 - RNA, 21 nt, Human
cuauuucugggucuuuugcua

SEQ ID NO: 2905191 - RNA, 22 nt, Human
cuauuucugggucuuuugcuac

SEQ ID NO: 2905192 - RNA, 18 nt, Human
cucaaccccaccacuucu

SEQ ID NO: 2905193 - RNA, 12 nt, Human
cucaaauuugga

SEQ ID NO: 2905194 - RNA, 22 nt, Human
cucaagcagcgaccgcccccuc

SEQ ID NO: 2905195 - RNA, 12 nt, Human
cucaagcacuga

SEQ ID NO: 2905196 - RNA, 14 nt, Human
cucaagcacugaua

SEQ ID NO: 2905197 - RNA, 17 nt, Human
cucaagcccgcggggac

SEQ ID NO: 2905198 - RNA, 23 nt, Human
cucaagcagcgaccgcccccucc

SEQ ID NO: 2905199 - RNA, 15 nt, Human
cucaagggacaagga

SEQ ID NO: 2905200 - RNA, 17 nt, Human
cucaagggacaaggaca

SEQ ID NO: 2905201 - RNA, 20 nt, Human
cucaagggacaaggacacgc

SEQ ID NO: 2905202 - RNA, 14 nt, Human
cucaagggcaugag

SEQ ID NO: 2905203 - RNA, 21 nt, Human
cucaagggcuagcaucccuga

SEQ ID NO: 2905204 - RNA, 21 nt, Human
cucacaccgcgucuggugaca

SEQ ID NO: 2905205 - RNA, 16 nt, Human
cucacaccucacucuu

SEQ ID NO: 2905206 - RNA, 19 nt, Human
cucacaccucacucuuuau

SEQ ID NO: 2905207 - RNA, 14 nt, Human
cucaagguuuuagg

SEQ ID NO: 2905208 - RNA, 19 nt, Human
cucaagguuuuagguucua

SEQ ID NO: 2905209 - RNA, 23 nt, Human
cucaagguuuuagguucuaaagu

SEQ ID NO: 2905210 - RNA, 20 nt, Human
cucaagguuuuagguucuaa

SEQ ID NO: 2905211 - RNA, 22 nt, Human
cucaagguuuuagguucuaaag

SEQ ID NO: 2905212 - RNA, 23 nt, Human
cucacacugguucucaaugaaaa

SEQ ID NO: 2905213 - RNA, 20 nt, Human
cucacacuuacuguaagaca

SEQ ID NO: 2905214 - RNA, 21 nt, Human
cucacacuuacuguaagacau

SEQ ID NO: 2905215 - RNA, 22 nt, Human
cucacacuuacuguaagacauu

SEQ ID NO: 2905216 - RNA, 17 nt, Human
cucacagaacccuugga

SEQ ID NO: 2905217 - RNA, 21 nt, Human
cucacacugguucucaaugaa

SEQ ID NO: 2905218 - RNA, 22 nt, Human
cucacaccuguaaucccagcac

SEQ ID NO: 2905219 - RNA, 11 nt, Human
cuauugguaaa

SEQ ID NO: 2905220 - RNA, 9 nt, Human
cuauuuaag

SEQ ID NO: 2905221 - RNA, 12 nt, Human
cuauuuaauauu

SEQ ID NO: 2905222 - RNA, 14 nt, Human
cuauuuaauauuua

SEQ ID NO: 2905223 - RNA, 22 nt, Human
cuauuuaugugauccuuuugga

SEQ ID NO: 2905224 - RNA, 13 nt, Human
cuauuuauuaaua

SEQ ID NO: 2905225 - RNA, 15 nt, Human
cuauuuaauauuuau

SEQ ID NO: 2905226 - RNA, 14 nt, Human
cuauuuauuaauau

SEQ ID NO: 2905227 - RNA, 15 nt, Human
cuauuuauuaauauu

SEQ ID NO: 2905228 - RNA, 17 nt, Human
cuauuuauuaauauuua

SEQ ID NO: 2905229 - RNA, 20 nt, Human
cuauuuauuaauauuuaaca

SEQ ID NO: 2905230 - RNA, 22 nt, Human
cuauuuaacuggcuucagccuc

SEQ ID NO: 2905231 - RNA, 15 nt, Human
cuauuuaaagccucc

SEQ ID NO: 2905232 - RNA, 18 nt, Human
cuauuuaaacuuauaaau

SEQ ID NO: 2905233 - RNA, 20 nt, Human
cuauuuaaacuuauaaauca

SEQ ID NO: 2905234 - RNA, 21 nt, Human
cuauuggaggaucaguuuuuu

SEQ ID NO: 2905235 - RNA, 18 nt, Human
cuauucugccacuccuga

SEQ ID NO: 2905236 - RNA, 12 nt, Human
cuauugcccagg

SEQ ID NO: 2905237 - RNA, 19 nt, Human
cuauugcauuuauauguac

SEQ ID NO: 2905238 - RNA, 12 nt, Human
cuauugccuucu

SEQ ID NO: 2905239 - RNA, 19 nt, Human
cuauugccuucuuugaaga

SEQ ID NO: 2905240 - RNA, 20 nt, Human
cuauugccuucuuugaagaa

SEQ ID NO: 2905241 - RNA, 21 nt, Human
cuauugcaaagguuccaacug

SEQ ID NO: 2905242 - RNA, 22 nt, Human
cuauugcaaagguuccaacugu

SEQ ID NO: 2905243 - RNA, 20 nt, Human
cuauugcagcaauuaaaaau

SEQ ID NO: 2905244 - RNA, 17 nt, Human
cuauugcauuuauaugu

SEQ ID NO: 2905245 - RNA, 14 nt, Human
cuauugcauuuaua

SEQ ID NO: 2905246 - RNA, 12 nt, Human
cuagauaaaagc

SEQ ID NO: 2905247 - RNA, 17 nt, Human
cuagauaccuaaaacau

SEQ ID NO: 2905248 - RNA, 24 nt, Human
cuagauaccuaaaacauaagauca

SEQ ID NO: 2905249 - RNA, 16 nt, Human
cuagagggaccucucc

SEQ ID NO: 2905250 - RNA, 15 nt, Human
cuagagggaccucuc

SEQ ID NO: 2905251 - RNA, 14 nt, Human
cuagagggaccucu

SEQ ID NO: 2905252 - RNA, 23 nt, Human
cuagaggccagccccacccagga

SEQ ID NO: 2905253 - RNA, 22 nt, Human
cuagaggccagccccacccagg

SEQ ID NO: 2905254 - RNA, 14 nt, Human
cuagagccugccug

SEQ ID NO: 2905255 - RNA, 21 nt, Human
cuagaggccagccccacccag

SEQ ID NO: 2905256 - RNA, 14 nt, Human
cuagagccagacca

SEQ ID NO: 2905257 - RNA, 15 nt, Human
cuagagccagaccaa

SEQ ID NO: 2905258 - RNA, 11 nt, Human
cuagagccugc

SEQ ID NO: 2905259 - RNA, 12 nt, Human
cuagagccugcc

SEQ ID NO: 2905260 - RNA, 13 nt, Human
cuagagccugccu

SEQ ID NO: 2905261 - RNA, 16 nt, Human
cuagagaacagguggu

SEQ ID NO: 2905262 - RNA, 19 nt, Human
cuagagaauguuagaggau

SEQ ID NO: 2905263 - RNA, 15 nt, Human
cuagagaaugcacag

SEQ ID NO: 2905264 - RNA, 16 nt, Human
cuagagaaugcacaga

SEQ ID NO: 2905265 - RNA, 21 nt, Human
cuagagaaugcacagauauac

SEQ ID NO: 2905266 - RNA, 14 nt, Human
cuagagaagauaau

SEQ ID NO: 2905267 - RNA, 15 nt, Human
cuagagaagauaauu

SEQ ID NO: 2905268 - RNA, 16 nt, Human
cuagagaagauaauug

SEQ ID NO: 2905269 - RNA, 17 nt, Human
cuagagaagauaauugu

SEQ ID NO: 2905270 - RNA, 18 nt, Human
cuagagaagauaauuguu

SEQ ID NO: 2905271 - RNA, 20 nt, Human
cuagagaagauaauuguuga

SEQ ID NO: 2905272 - RNA, 21 nt, Human
cuagagaagauaauuguugaa

SEQ ID NO: 2905273 - RNA, 21 nt, Human
cuagagcagcccaaauuuuuc

SEQ ID NO: 2905274 - RNA, 22 nt, Human
cuagagcagcccaaauuuuucu

SEQ ID NO: 2905275 - RNA, 21 nt, Human
cuagagaugugcaauugauuu

SEQ ID NO: 2905276 - RNA, 12 nt, Human
cuagacuuucug

SEQ ID NO: 2905277 - RNA, 16 nt, Human
cuagacuuuaggcuuu

SEQ ID NO: 2905278 - RNA, 18 nt, Human
cuagacuuuaggcuuuca

SEQ ID NO: 2905279 - RNA, 21 nt, Human
cuagacuuuaggcuuucagcu

SEQ ID NO: 2905280 - RNA, 22 nt, Human
cuagacuuuaggcuuucagcuu

SEQ ID NO: 2905281 - RNA, 13 nt, Human
cuagacuuucugu

SEQ ID NO: 2905282 - RNA, 14 nt, Human
cuagacuuucuguu

SEQ ID NO: 2905283 - RNA, 15 nt, Human
cuagagaacgcagcc

SEQ ID NO: 2905284 - RNA, 16 nt, Human
cuagagaacgcagccc

SEQ ID NO: 2905285 - RNA, 17 nt, Human
cuagagaacgcagcccu

SEQ ID NO: 2905286 - RNA, 18 nt, Human
cuagagaacgcagcccua

SEQ ID NO: 2905287 - RNA, 15 nt, Human
cuagacucuagacaa

SEQ ID NO: 2905288 - RNA, 18 nt, Human
cuagacucccaagcugga

SEQ ID NO: 2905289 - RNA, 20 nt, Human
cuacuguccuacccacccuc

SEQ ID NO: 2905290 - RNA, 13 nt, Human
cuacuguacauaa

SEQ ID NO: 2905291 - RNA, 20 nt, Human
cuacuguacauaaacaauga

SEQ ID NO: 2905292 - RNA, 20 nt, Human
cuacugucucacugaaacau

SEQ ID NO: 2905293 - RNA, 17 nt, Human
cuacugucuuuggaaaa

SEQ ID NO: 2905294 - RNA, 21 nt, Human
cuacuuaccuaccacaugcca

SEQ ID NO: 2905295 - RNA, 13 nt, Human
cuacuuaagagaa

SEQ ID NO: 2905296 - RNA, 20 nt, Human
cuacuguucuaaagcucuga

SEQ ID NO: 2905297 - RNA, 22 nt, Human
cuacuguucuaaagcucugaca

SEQ ID NO: 2905298 - RNA, 12 nt, Human
cuacuguucuaa

SEQ ID NO: 2905299 - RNA, 14 nt, Human
cuacuguucuaaag

SEQ ID NO: 2905300 - RNA, 15 nt, Human
cuacuguucuaaagc

SEQ ID NO: 2905301 - RNA, 18 nt, Human
cuacuguucuaaagcucu

SEQ ID NO: 2905302 - RNA, 17 nt, Human
cuacuuagcaugucccu

SEQ ID NO: 2905303 - RNA, 12 nt, Human
cuacuuagcauc

SEQ ID NO: 2905304 - RNA, 19 nt, Human
cuacuuagcauccuaagaa

SEQ ID NO: 2905305 - RNA, 20 nt, Human
cuacuuagcauccuaagaaa

SEQ ID NO: 2905306 - RNA, 22 nt, Human
cuacuuagcauccuaagaaaua

SEQ ID NO: 2905307 - RNA, 23 nt, Human
cuacuuagcauccuaagaaauau

SEQ ID NO: 2905308 - RNA, 16 nt, Human
cuagaaacagaucuug

SEQ ID NO: 2905309 - RNA, 14 nt, Human
cuagaaacccaagc

SEQ ID NO: 2905310 - RNA, 17 nt, Human
cuagaaacccaagcucc

SEQ ID NO: 2905311 - RNA, 18 nt, Human
cuagaaacccaagcuccu

SEQ ID NO: 2905312 - RNA, 21 nt, Human
cuagaaacccaagcuccuccu

SEQ ID NO: 2905313 - RNA, 23 nt, Human
cuagaaacccaagcuccuccucg

SEQ ID NO: 2905314 - RNA, 21 nt, Human
cuagaaacgaguuggugucuu

SEQ ID NO: 2905315 - RNA, 22 nt, Human
cuagaaaacuugacuccauuuc

SEQ ID NO: 2905316 - RNA, 18 nt, Human
cuagaaaagcugaucaua

SEQ ID NO: 2905317 - RNA, 22 nt, Human
cuagaaaacaaugcaaaaccuu

SEQ ID NO: 2905318 - RNA, 16 nt, Human
cuagaaaacauuuuuu

SEQ ID NO: 2905319 - RNA, 23 nt, Human
cuagaaaacauuuuuuuuuuaaa

SEQ ID NO: 2905320 - RNA, 11 nt, Human
cuaccucagcc

SEQ ID NO: 2905321 - RNA, 13 nt, Human
cuaccucaggcag

SEQ ID NO: 2905322 - RNA, 15 nt, Human
cuaccucagccuaga

SEQ ID NO: 2905323 - RNA, 14 nt, Human
cuaccucagccuag

SEQ ID NO: 2905324 - RNA, 12 nt, Human
cuaccucagccu

SEQ ID NO: 2905325 - RNA, 20 nt, Human
cuaccucaggcaggaagggc

SEQ ID NO: 2905326 - RNA, 14 nt, Human
cuaccucaggcagg

SEQ ID NO: 2905327 - RNA, 17 nt, Human
cuaccucaggcagcuca

SEQ ID NO: 2905328 - RNA, 18 nt, Human
cuaccucaggcagcucaa

SEQ ID NO: 2905329 - RNA, 23 nt, Human
cuaccucaggcaggaagggcagg

SEQ ID NO: 2905330 - RNA, 13 nt, Human
cuaccgaguucaa

SEQ ID NO: 2905331 - RNA, 14 nt, Human
cuaccgaguucaag

SEQ ID NO: 2905332 - RNA, 23 nt, Human
cuaccgccccaaaguaaaagaaa

SEQ ID NO: 2905333 - RNA, 23 nt, Human
cuaccgagucucuucuccacugg

SEQ ID NO: 2905334 - RNA, 21 nt, Human
cuaccgagucucuucuccacu

SEQ ID NO: 2905335 - RNA, 22 nt, Human
cuaccgagucucuucuccacug

SEQ ID NO: 2905336 - RNA, 18 nt, Human
cuacccuuuuucuccagc

SEQ ID NO: 2905337 - RNA, 19 nt, Human
cuacccuuuuucuccagcu

SEQ ID NO: 2905338 - RNA, 17 nt, Human
cuaccgagucucuucuc

SEQ ID NO: 2905339 - RNA, 19 nt, Human
cuaccgagucucuucucca

SEQ ID NO: 2905340 - RNA, 11 nt, Human
cuacuccugac

SEQ ID NO: 2905341 - RNA, 12 nt, Human
cuacuccugacu

SEQ ID NO: 2905342 - RNA, 13 nt, Human
cuacuccugacuc

SEQ ID NO: 2905343 - RNA, 14 nt, Human
cuacucccugcaga

SEQ ID NO: 2905344 - RNA, 13 nt, Human
cuacucccugcag

SEQ ID NO: 2905345 - RNA, 11 nt, Human
cuaccucccuc

SEQ ID NO: 2905346 - RNA, 12 nt, Human
cuaccucccucc

SEQ ID NO: 2905347 - RNA, 13 nt, Human
cuaccucccuccc

SEQ ID NO: 2905348 - RNA, 23 nt, Human
cuaccucccuccccgucucauuc

SEQ ID NO: 2905349 - RNA, 18 nt, Human
cuacucccugcagaugcc

SEQ ID NO: 2905350 - RNA, 17 nt, Human
cuacucccugcagaugc

SEQ ID NO: 2905351 - RNA, 22 nt, Human
cuacucccugcagaugccaccc

SEQ ID NO: 2905352 - RNA, 16 nt, Human
cuacuccuaccucagc

SEQ ID NO: 2905353 - RNA, 15 nt, Human
cuacuccuaccucag

SEQ ID NO: 2905354 - RNA, 21 nt, Human
cuacuccuaccucagccuaga

SEQ ID NO: 2905355 - RNA, 18 nt, Human
cuacuccuaccucagccu

SEQ ID NO: 2905356 - RNA, 17 nt, Human
cuacuccuaccucagcc

SEQ ID NO: 2905357 - RNA, 12 nt, Human
cuacucuguguc

SEQ ID NO: 2905358 - RNA, 14 nt, Human
cuacugcagcuuua

SEQ ID NO: 2905359 - RNA, 16 nt, Human
cuacugauuuuuguga

SEQ ID NO: 2905360 - RNA, 23 nt, Human
cuacucucacacugguucucaau

SEQ ID NO: 2905361 - RNA, 21 nt, Human
cuacucucacacugguucuca

SEQ ID NO: 2905362 - RNA, 16 nt, Human
cuaccacucacaugac

SEQ ID NO: 2905363 - RNA, 20 nt, Human
cuacucgcuugcuagaagua

SEQ ID NO: 2905364 - RNA, 19 nt, Human
cuacuguccuacccacccu

SEQ ID NO: 2905365 - RNA, 17 nt, Human
cuacuggcauaguuuca

SEQ ID NO: 2905366 - RNA, 18 nt, Human
cuacuggcauaguuucau

SEQ ID NO: 2905367 - RNA, 14 nt, Human
cuacugggugucau

SEQ ID NO: 2905368 - RNA, 16 nt, Human
cuacugggugucauuu

SEQ ID NO: 2905369 - RNA, 18 nt, Human
cuacugggugucauuuca

SEQ ID NO: 2905370 - RNA, 19 nt, Human
cuacugggugucauuucau

SEQ ID NO: 2905371 - RNA, 23 nt, Human
cuacugggugucauuucauucca

SEQ ID NO: 2905372 - RNA, 17 nt, Human
cuacugcagcuuuacau

SEQ ID NO: 2905373 - RNA, 19 nt, Human
cuagcuuuauauauggaca

SEQ ID NO: 2905374 - RNA, 20 nt, Human
cuagcuuuauauauggacau

SEQ ID NO: 2905375 - RNA, 21 nt, Human
cuagcuuuauauauggacaug

SEQ ID NO: 2905376 - RNA, 22 nt, Human
cuagcuuuauauauggacaugg

SEQ ID NO: 2905377 - RNA, 23 nt, Human
cuagcuuuauauauggacauggc

SEQ ID NO: 2905378 - RNA, 14 nt, Human
cuagcuuuuaggaa

SEQ ID NO: 2905379 - RNA, 15 nt, Human
cuagcuuuuaggaaa

SEQ ID NO: 2905380 - RNA, 20 nt, Human
cuagcuugggaggcuucccc

SEQ ID NO: 2905381 - RNA, 14 nt, Human
cuagcugugcaaga

SEQ ID NO: 2905382 - RNA, 13 nt, Human
cuagcuggagccu

SEQ ID NO: 2905383 - RNA, 16 nt, Human
cuagcuaucaagaggc

SEQ ID NO: 2905384 - RNA, 15 nt, Human
cuagcuaugugaccu

SEQ ID NO: 2905385 - RNA, 20 nt, Human
cuagcugccuagcaagcugg

SEQ ID NO: 2905386 - RNA, 21 nt, Human
cuagcugccuagcaagcuggc

SEQ ID NO: 2905387 - RNA, 22 nt, Human
cuagcugccuagcaagcuggcc

SEQ ID NO: 2905388 - RNA, 14 nt, Human
cuagcugugggggu

SEQ ID NO: 2905389 - RNA, 21 nt, Human
cuagccuuagaagucacacag

SEQ ID NO: 2905390 - RNA, 14 nt, Human
cuagauaugaauau

SEQ ID NO: 2905391 - RNA, 22 nt, Human
cuagauaugaauauauggcauu

SEQ ID NO: 2905392 - RNA, 24 nt, Human
cuagauaugaauauauggcauuug

SEQ ID NO: 2905393 - RNA, 14 nt, Human
cuagauauuuuccu

SEQ ID NO: 2905394 - RNA, 12 nt, Human
cuagauaguuua

SEQ ID NO: 2905395 - RNA, 23 nt, Human
cuagccuuagaagucacacagua

SEQ ID NO: 2905396 - RNA, 22 nt, Human
cuagccuuagaagucacacagu

SEQ ID NO: 2905397 - RNA, 15 nt, Human
cuagccuuuggcucu

SEQ ID NO: 2905398 - RNA, 16 nt, Human
cuagccuuuggcucug

SEQ ID NO: 2905399 - RNA, 22 nt, Human
cuagccuuaaucagguccucag

SEQ ID NO: 2905400 - RNA, 22 nt, Human
cuagcuaauguaauaacuguga

SEQ ID NO: 2905401 - RNA, 16 nt, Human
cuagccuguuucuucc

SEQ ID NO: 2905402 - RNA, 21 nt, Human
cuagccuuuggcucuggagac

SEQ ID NO: 2905403 - RNA, 23 nt, Human
cuagccuuuggcucuggagacag

SEQ ID NO: 2905404 - RNA, 17 nt, Human
cuagccuuuggcucugg

SEQ ID NO: 2905405 - RNA, 18 nt, Human
cuagccuuuggcucugga

SEQ ID NO: 2905406 - RNA, 19 nt, Human
cuagccuuuggcucuggag

SEQ ID NO: 2905407 - RNA, 20 nt, Human
cuagccuuuggcucuggaga

SEQ ID NO: 2905408 - RNA, 22 nt, Human
cuagcggaguuccagcaaacaa

SEQ ID NO: 2905409 - RNA, 22 nt, Human
cuagcgcguugccugucgcuuu

SEQ ID NO: 2905410 - RNA, 11 nt, Human
cuaauaaauac

SEQ ID NO: 2905411 - RNA, 13 nt, Human
cuaauaaauacau

SEQ ID NO: 2905412 - RNA, 15 nt, Human
cuaauaaauacauac

SEQ ID NO: 2905413 - RNA, 12 nt, Human
cuaauaaauuau

SEQ ID NO: 2905414 - RNA, 17 nt, Human
cuaauaaauuauacaaa

SEQ ID NO: 2905415 - RNA, 19 nt, Human
cuaauaaugagcuauuaaa

SEQ ID NO: 2905416 - RNA, 20 nt, Human
cuaauaaugagcuauuaaaa

SEQ ID NO: 2905417 - RNA, 22 nt, Human
cuaauaaugagcuauuaaaacu

SEQ ID NO: 2905418 - RNA, 14 nt, Human
cuaauaauuucuaa

SEQ ID NO: 2905419 - RNA, 15 nt, Human
cuaauaauuucuaau

SEQ ID NO: 2905420 - RNA, 16 nt, Human
cuaauaauuucuaaug

SEQ ID NO: 2905421 - RNA, 17 nt, Human
cuaauaauuucuaaugu

SEQ ID NO: 2905422 - RNA, 18 nt, Human
cuaauaauuucuaauguu

SEQ ID NO: 2905423 - RNA, 13 nt, Human
cuaauaccucugu

SEQ ID NO: 2905424 - RNA, 15 nt, Human
cuaauaccucugugu

SEQ ID NO: 2905425 - RNA, 16 nt, Human
cuaauaccucugugug

SEQ ID NO: 2905426 - RNA, 17 nt, Human
cuaauaccucugugugc

SEQ ID NO: 2905427 - RNA, 23 nt, Human
cuaauagcggguuacuuucacau

SEQ ID NO: 2905428 - RNA, 13 nt, Human
cuaauauauauga

SEQ ID NO: 2905429 - RNA, 18 nt, Human
cuaauauauaugaauaaa

SEQ ID NO: 2905430 - RNA, 11 nt, Human
cuaauauauuu

SEQ ID NO: 2905431 - RNA, 15 nt, Human
cuaauauauaugaau

SEQ ID NO: 2905432 - RNA, 17 nt, Human
cuaauauauaugaauaa

SEQ ID NO: 2905433 - RNA, 15 nt, Human
cuaauauauuuuuau

SEQ ID NO: 2905434 - RNA, 12 nt, Human
cuaauauauuuu

SEQ ID NO: 2905435 - RNA, 21 nt, Human
cuaauauauuuuuauauuuag

SEQ ID NO: 2905436 - RNA, 15 nt, Human
cuaauaucaaaugca

SEQ ID NO: 2905437 - RNA, 23 nt, Human
cuaauaucaaaugcaguauauuu

SEQ ID NO: 2905438 - RNA, 14 nt, Human
cuaagauucuaaag

SEQ ID NO: 2905439 - RNA, 15 nt, Human
cuaagauucuaaagg

SEQ ID NO: 2905440 - RNA, 11 nt, Human
cuaagauucua

SEQ ID NO: 2905441 - RNA, 12 nt, Human
cuaagauucuaa

SEQ ID NO: 2905442 - RNA, 13 nt, Human
cuaagauucuaaa

SEQ ID NO: 2905443 - RNA, 12 nt, Human
cuaagcugcagc

SEQ ID NO: 2905444 - RNA, 13 nt, Human
cuaagcugcagcu

SEQ ID NO: 2905445 - RNA, 14 nt, Human
cuaagcugcagcuu

SEQ ID NO: 2905446 - RNA, 16 nt, Human
cuaagcugcagcuucc

SEQ ID NO: 2905447 - RNA, 17 nt, Human
cuaagcugcagcuuccu

SEQ ID NO: 2905448 - RNA, 19 nt, Human
cuaagcugcagcuuccugu

SEQ ID NO: 2905449 - RNA, 18 nt, Human
cuaagaugugauauucua

SEQ ID NO: 2905450 - RNA, 19 nt, Human
cuaagaugugauauucuaa

SEQ ID NO: 2905451 - RNA, 20 nt, Human
cuaagaugugauauucuaag

SEQ ID NO: 2905452 - RNA, 21 nt, Human
cuaagaugugauauucuaaga

SEQ ID NO: 2905453 - RNA, 22 nt, Human
cuaagaugugauauucuaagac

SEQ ID NO: 2905454 - RNA, 23 nt, Human
cuaagaugugauauucuaagacu

SEQ ID NO: 2905455 - RNA, 22 nt, Human
cuaaggaccugaaauuccaaag

SEQ ID NO: 2905456 - RNA, 19 nt, Human
cuaaggaccugaaauucca

SEQ ID NO: 2905457 - RNA, 20 nt, Human
cuaaggaccugaaauuccaa

SEQ ID NO: 2905458 - RNA, 15 nt, Human
cuaaggaaccuuccu

SEQ ID NO: 2905459 - RNA, 14 nt, Human
cuaaggaaccuucc

SEQ ID NO: 2905460 - RNA, 18 nt, Human
cuaaggcucuaugagucu

SEQ ID NO: 2905461 - RNA, 21 nt, Human
cuaaggcguggagcugccuga

SEQ ID NO: 2905462 - RNA, 22 nt, Human
cuaaggcguggagcugccugau

SEQ ID NO: 2905463 - RNA, 17 nt, Human
cuaaggcguggagcugc

SEQ ID NO: 2905464 - RNA, 18 nt, Human
cuaaggcguggagcugcc

SEQ ID NO: 2905465 - RNA, 19 nt, Human
cuaaggcguggagcugccu

SEQ ID NO: 2905466 - RNA, 20 nt, Human
cuaaggcguggagcugccug

SEQ ID NO: 2905467 - RNA, 13 nt, Human
cuaaggccuacuu

SEQ ID NO: 2905468 - RNA, 14 nt, Human
cuaaggccuaggau

SEQ ID NO: 2905469 - RNA, 19 nt, Human
cuaaggccuaggauucuaa

SEQ ID NO: 2905470 - RNA, 16 nt, Human
cuaaggcguggagcug

SEQ ID NO: 2905471 - RNA, 22 nt, Human
cuaaggccuaggauucuaaaau

SEQ ID NO: 2905472 - RNA, 20 nt, Human
cuaaggccuaggauucuaaa

SEQ ID NO: 2905473 - RNA, 21 nt, Human
cuaaggccuaggauucuaaaa

SEQ ID NO: 2905474 - RNA, 17 nt, Human
cuaagguucuaaggccu

SEQ ID NO: 2905475 - RNA, 15 nt, Human
cuaagguucuaaggc

SEQ ID NO: 2905476 - RNA, 16 nt, Human
cuaagguucuaaggcc

SEQ ID NO: 2905477 - RNA, 15 nt, Human
cuaaggcucugagag

SEQ ID NO: 2905478 - RNA, 19 nt, Human
cuaaggcucugagagucua

SEQ ID NO: 2905479 - RNA, 13 nt, Human
cuaagguucuaag

SEQ ID NO: 2905480 - RNA, 14 nt, Human
cuaagguucuaagg

SEQ ID NO: 2905481 - RNA, 19 nt, Human
cuaaggcucuaugagucua

SEQ ID NO: 2905482 - RNA, 20 nt, Human
cuaaggcucuaugagucuag

SEQ ID NO: 2905483 - RNA, 21 nt, Human
cuaaggcucuaugagucuaga

SEQ ID NO: 2905484 - RNA, 22 nt, Human
cuaaggcucuaugagucuagau

SEQ ID NO: 2905485 - RNA, 23 nt, Human
cuaaggcucuaugagucuagaug

SEQ ID NO: 2905486 - RNA, 11 nt, Human
cuaaggcucug

SEQ ID NO: 2905487 - RNA, 13 nt, Human
cuaaggcucugag

SEQ ID NO: 2905488 - RNA, 14 nt, Human
cuaaggcucugaga

SEQ ID NO: 2905489 - RNA, 14 nt, Human
cuacacuccagccu

SEQ ID NO: 2905490 - RNA, 13 nt, Human
cuaauucauuuau

SEQ ID NO: 2905491 - RNA, 14 nt, Human
cuaauuccacagcu

SEQ ID NO: 2905492 - RNA, 17 nt, Human
cuaauuccacaccuuuu

SEQ ID NO: 2905493 - RNA, 15 nt, Human
cuaauuccacaccuu

SEQ ID NO: 2905494 - RNA, 19 nt, Human
cuaauucagccauguacag

SEQ ID NO: 2905495 - RNA, 20 nt, Human
cuaauucagccauguacaga

SEQ ID NO: 2905496 - RNA, 16 nt, Human
cuaauuccacagcugc

SEQ ID NO: 2905497 - RNA, 15 nt, Human
cuaauuccacagcug

SEQ ID NO: 2905498 - RNA, 15 nt, Human
cuaauuccuuucuau

SEQ ID NO: 2905499 - RNA, 16 nt, Human
cuaauucgaugaaggc

SEQ ID NO: 2905500 - RNA, 17 nt, Human
cuaauucgaugaaggcu

SEQ ID NO: 2905501 - RNA, 22 nt, Human
cuacacacugucaugcuucauc

SEQ ID NO: 2905502 - RNA, 13 nt, Human
cuacacauuuuua

SEQ ID NO: 2905503 - RNA, 14 nt, Human
cuacacauuuuuaa

SEQ ID NO: 2905504 - RNA, 17 nt, Human
cuacacauuuuuaaauu

SEQ ID NO: 2905505 - RNA, 19 nt, Human
cuacacauuuuuaaauugu

SEQ ID NO: 2905506 - RNA, 12 nt, Human
cuacaccacaca

SEQ ID NO: 2905507 - RNA, 14 nt, Human
cuacaccacacaca

SEQ ID NO: 2905508 - RNA, 15 nt, Human
cuacaccacacacaa

SEQ ID NO: 2905509 - RNA, 16 nt, Human
cuacaccacacacaac

SEQ ID NO: 2905510 - RNA, 19 nt, Human
cuacaccacacacaacagc

SEQ ID NO: 2905511 - RNA, 21 nt, Human
cuacaccacacacaacagcca

SEQ ID NO: 2905512 - RNA, 14 nt, Human
cuacacagggaugu

SEQ ID NO: 2905513 - RNA, 21 nt, Human
cuacacagggauguacaaggc

SEQ ID NO: 2905514 - RNA, 19 nt, Human
cuacacagugggaacucug

SEQ ID NO: 2905515 - RNA, 20 nt, Human
cuacacagugggaacucuga

SEQ ID NO: 2905516 - RNA, 21 nt, Human
cuacacagugggaacucugac

SEQ ID NO: 2905517 - RNA, 22 nt, Human
cuacacagugggaacucugaca

SEQ ID NO: 2905518 - RNA, 23 nt, Human
cuacacagugggaacucugacaa

SEQ ID NO: 2905519 - RNA, 18 nt, Human
cuaauuaggguacauuua

SEQ ID NO: 2905520 - RNA, 19 nt, Human
cuaauuaggguacauuuau

SEQ ID NO: 2905521 - RNA, 20 nt, Human
cuaauuaggguacauuuaua

SEQ ID NO: 2905522 - RNA, 22 nt, Human
cuaauuauacccccugcaaagc

SEQ ID NO: 2905523 - RNA, 19 nt, Human
cuaauggguauuuaaacaa

SEQ ID NO: 2905524 - RNA, 14 nt, Human
cuaauguaaaauga

SEQ ID NO: 2905525 - RNA, 16 nt, Human
cuaauguaaaaugauu

SEQ ID NO: 2905526 - RNA, 20 nt, Human
cuaauuacgauaaggaagaa

SEQ ID NO: 2905527 - RNA, 22 nt, Human
cuaauuacgauaaggaagaaac

SEQ ID NO: 2905528 - RNA, 13 nt, Human
cuaaugggacacu

SEQ ID NO: 2905529 - RNA, 12 nt, Human
cuaaugggacac

SEQ ID NO: 2905530 - RNA, 23 nt, Human
cuaaugcugcagauuugggcugg

SEQ ID NO: 2905531 - RNA, 23 nt, Human
cuaaugcgcaggcuggcccugcc

SEQ ID NO: 2905532 - RNA, 22 nt, Human
cuaaugcgcaggcuggcccugc

SEQ ID NO: 2905533 - RNA, 18 nt, Human
cuaauauguaacaagcca

SEQ ID NO: 2905534 - RNA, 13 nt, Human
cuaauauggcaaa

SEQ ID NO: 2905535 - RNA, 17 nt, Human
cuaauauccccaaauua

SEQ ID NO: 2905536 - RNA, 22 nt, Human
cuaauauccccaaauuagggca

SEQ ID NO: 2905537 - RNA, 20 nt, Human
cuaaucagcauucucacucc

SEQ ID NO: 2905538 - RNA, 21 nt, Human
cuaaucagcauucucacuccu

SEQ ID NO: 2905539 - RNA, 20 nt, Human
cuaauauggccacaguaguc

SEQ ID NO: 2905540 - RNA, 15 nt, Human
cuaauccaacccaug

SEQ ID NO: 2905541 - RNA, 13 nt, Human
cuaauccaaccca

SEQ ID NO: 2905542 - RNA, 20 nt, Human
cuaaugcgcaggcuggcccu

SEQ ID NO: 2905543 - RNA, 19 nt, Human
cuaaugcgcaggcuggccc

SEQ ID NO: 2905544 - RNA, 16 nt, Human
cuaaugcgcaggcugg

SEQ ID NO: 2905545 - RNA, 15 nt, Human
cuaaugcgcaggcug

SEQ ID NO: 2905546 - RNA, 18 nt, Human
cgggacaccugcccugcc

SEQ ID NO: 2905547 - RNA, 21 nt, Human
cgggaggauguucugggacac

SEQ ID NO: 2905548 - RNA, 23 nt, Human
cgggaggauguucugggacacag

SEQ ID NO: 2905549 - RNA, 14 nt, Human
cguuuguaugugug

SEQ ID NO: 2905550 - RNA, 15 nt, Human
cguuuguaugugugu

SEQ ID NO: 2905551 - RNA, 17 nt, Human
cguuuggaagauccugu

SEQ ID NO: 2905552 - RNA, 19 nt, Human
cguuuggaagauccuguga

SEQ ID NO: 2905553 - RNA, 22 nt, Human
cguuuggaagauccugugagga

SEQ ID NO: 2905554 - RNA, 20 nt, Human
cgggaggcagagguuguagu

SEQ ID NO: 2905555 - RNA, 14 nt, Human
cgggaggcagaguu

SEQ ID NO: 2905556 - RNA, 16 nt, Human
cgggaggcagaguuug

SEQ ID NO: 2905557 - RNA, 20 nt, Human
cguuuguuccccaagacauu

SEQ ID NO: 2905558 - RNA, 17 nt, Human
cuaaaaacaaacccuuu

SEQ ID NO: 2905559 - RNA, 15 nt, Human
cuaaaaagauuagca

SEQ ID NO: 2905560 - RNA, 16 nt, Human
cuaaaaagauuagcaa

SEQ ID NO: 2905561 - RNA, 22 nt, Human
cuaaaaaacauaaauuucuuua

SEQ ID NO: 2905562 - RNA, 17 nt, Human
cuaaaaaacagaggcca

SEQ ID NO: 2905563 - RNA, 11 nt, Human
cuaaaaaacag

SEQ ID NO: 2905564 - RNA, 19 nt, Human
cuaaaagugggcuugauuc

SEQ ID NO: 2905565 - RNA, 23 nt, Human
cuaaaagugggcuugauucugca

SEQ ID NO: 2905566 - RNA, 12 nt, Human
cuaaaaguguca

SEQ ID NO: 2905567 - RNA, 13 nt, Human
cuaaaagugucac

SEQ ID NO: 2905568 - RNA, 11 nt, Human
cuaaaaauaaa

SEQ ID NO: 2905569 - RNA, 15 nt, Human
cuaaaaauaaaccaa

SEQ ID NO: 2905570 - RNA, 20 nt, Human
cuaaaagugggcuugauucu

SEQ ID NO: 2905571 - RNA, 22 nt, Human
cuaaaauaagggcagagucaca

SEQ ID NO: 2905572 - RNA, 14 nt, Human
cuaaaauacauuua

SEQ ID NO: 2905573 - RNA, 22 nt, Human
cuaaaauacauuuaaaacuuac

SEQ ID NO: 2905574 - RNA, 18 nt, Human
cuaaaaugugauguucua

SEQ ID NO: 2905575 - RNA, 19 nt, Human
cuaaaaugugauguucuaa

SEQ ID NO: 2905576 - RNA, 20 nt, Human
cuaaaaugugauguucuaag

SEQ ID NO: 2905577 - RNA, 21 nt, Human
cuaaaaugugauguucuaagg

SEQ ID NO: 2905578 - RNA, 22 nt, Human
cuaaaaugugauguucuaaggc

SEQ ID NO: 2905579 - RNA, 23 nt, Human
cuaaaaugugauguucuaaggcu

SEQ ID NO: 2905580 - RNA, 13 nt, Human
cuaaacugccccc

SEQ ID NO: 2905581 - RNA, 12 nt, Human
cuaaacugcccc

SEQ ID NO: 2905582 - RNA, 12 nt, Human
cuaaaaugcuuc

SEQ ID NO: 2905583 - RNA, 13 nt, Human
cuaaaaugcuuca

SEQ ID NO: 2905584 - RNA, 17 nt, Human
cuaaaaucuuauaguuc

SEQ ID NO: 2905585 - RNA, 19 nt, Human
cuaaaaucuuauaguucua

SEQ ID NO: 2905586 - RNA, 21 nt, Human
cuaaaaucuuauaguucuagg

SEQ ID NO: 2905587 - RNA, 22 nt, Human
cuaaaaucuuauaguucuaggc

SEQ ID NO: 2905588 - RNA, 14 nt, Human
cuaaaaucuuggaa

SEQ ID NO: 2905589 - RNA, 16 nt, Human
cuaaaaucuuggaagu

SEQ ID NO: 2905590 - RNA, 18 nt, Human
cuaaaauauauaauuuau

SEQ ID NO: 2905591 - RNA, 11 nt, Human
cuaaaauauau

SEQ ID NO: 2905592 - RNA, 14 nt, Human
cuaaaauauuuauu

SEQ ID NO: 2905593 - RNA, 23 nt, Human
cuaaaauauuuauuuuuuuuaag

SEQ ID NO: 2905594 - RNA, 15 nt, Human
cuaaaauauuuauuu

SEQ ID NO: 2905595 - RNA, 22 nt, Human
cuaaaugaaaaucgugacaaca

SEQ ID NO: 2905596 - RNA, 15 nt, Human
cuaaaucucuaauau

SEQ ID NO: 2905597 - RNA, 18 nt, Human
cuaaauaagaaaauaaca

SEQ ID NO: 2905598 - RNA, 17 nt, Human
cuaaauacuugcuccau

SEQ ID NO: 2905599 - RNA, 20 nt, Human
cuaaauaaucuuacucuaga

SEQ ID NO: 2905600 - RNA, 21 nt, Human
cuaaauaaucuuacucuagau

SEQ ID NO: 2905601 - RNA, 21 nt, Human
cuaaacugcccccucugcccu

SEQ ID NO: 2905602 - RNA, 18 nt, Human
cuaaauaaaaguuuuaca

SEQ ID NO: 2905603 - RNA, 20 nt, Human
cuaaauaaaaguuuuacaaa

SEQ ID NO: 2905604 - RNA, 22 nt, Human
cuaaauaaaaguuuuacaaagg

SEQ ID NO: 2905605 - RNA, 15 nt, Human
cuaagagaaugaauu

SEQ ID NO: 2905606 - RNA, 20 nt, Human
cuaagagccauuuaggggcc

SEQ ID NO: 2905607 - RNA, 11 nt, Human
cuaagagccau

SEQ ID NO: 2905608 - RNA, 16 nt, Human
cuaagagauucugauu

SEQ ID NO: 2905609 - RNA, 18 nt, Human
cuaagagauucugauuug

SEQ ID NO: 2905610 - RNA, 14 nt, Human
cuaaccccuuccag

SEQ ID NO: 2905611 - RNA, 13 nt, Human
cuaaccccuucca

SEQ ID NO: 2905612 - RNA, 19 nt, Human
cuaaccccuuccagaucac

SEQ ID NO: 2905613 - RNA, 24 nt, Human
cuaacagcauccccaaaacaaagu

SEQ ID NO: 2905614 - RNA, 21 nt, Human
cuaaccagggaagcugucccu

SEQ ID NO: 2905615 - RNA, 17 nt, Human
cuaaccccaacgcacag

SEQ ID NO: 2905616 - RNA, 18 nt, Human
cuaaccccaacgcacagg

SEQ ID NO: 2905617 - RNA, 19 nt, Human
cuaaccccaacgcacagga

SEQ ID NO: 2905618 - RNA, 22 nt, Human
cuaaccccaacgcacaggaaaa

SEQ ID NO: 2905619 - RNA, 22 nt, Human
cuaaccucaagugauccuccca

SEQ ID NO: 2905620 - RNA, 23 nt, Human
cuaacccuauacuguaguauucu

SEQ ID NO: 2905621 - RNA, 11 nt, Human
cuaagaggcug

SEQ ID NO: 2905622 - RNA, 12 nt, Human
cuaagaggcugc

SEQ ID NO: 2905623 - RNA, 16 nt, Human
cuaagauaguaacaau

SEQ ID NO: 2905624 - RNA, 14 nt, Human
cuaagaggcugcug

SEQ ID NO: 2905625 - RNA, 22 nt, Human
cuaagagugcugggcauuuuua

SEQ ID NO: 2905626 - RNA, 20 nt, Human
cuaagaucuuagauucucug

SEQ ID NO: 2905627 - RNA, 16 nt, Human
cuaagaucuuagauuc

SEQ ID NO: 2905628 - RNA, 17 nt, Human
cuaagaucuuagauucu

SEQ ID NO: 2905629 - RNA, 12 nt, Human
cuaagaucuuag

SEQ ID NO: 2905630 - RNA, 14 nt, Human
cuaagaucuuagau

SEQ ID NO: 2905631 - RNA, 13 nt, Human
cuaaaugaagugc

SEQ ID NO: 2905632 - RNA, 14 nt, Human
cuaaauuccacacu

SEQ ID NO: 2905633 - RNA, 15 nt, Human
cuaaauucuuuauuu

SEQ ID NO: 2905634 - RNA, 17 nt, Human
cuaaauucuuuauuucu

SEQ ID NO: 2905635 - RNA, 19 nt, Human
cuaaauucuuuauuucugu

SEQ ID NO: 2905636 - RNA, 21 nt, Human
cuaaauucuuuauuucuguca

SEQ ID NO: 2905637 - RNA, 20 nt, Human
cuaaauuuggggacagauuc

SEQ ID NO: 2905638 - RNA, 23 nt, Human
cuaaauuuggggacagauucagu

SEQ ID NO: 2905639 - RNA, 13 nt, Human
cuaaauuuucuga

SEQ ID NO: 2905640 - RNA, 15 nt, Human
cuaaauuuucugaaa

SEQ ID NO: 2905641 - RNA, 16 nt, Human
cuaaauuuucugaaac

SEQ ID NO: 2905642 - RNA, 16 nt, Human
cuaacaaaagaugaaa

SEQ ID NO: 2905643 - RNA, 17 nt, Human
cuaacaaaagaugaaag

SEQ ID NO: 2905644 - RNA, 19 nt, Human
cuaacaaaagaugaaagca

SEQ ID NO: 2905645 - RNA, 20 nt, Human
cuaacaaaagaugaaagcag

SEQ ID NO: 2905646 - RNA, 14 nt, Human
cuaacacuuacccc

SEQ ID NO: 2905647 - RNA, 16 nt, Human
cuaacacuuaccccau

SEQ ID NO: 2905648 - RNA, 23 nt, Human
cuaacacuuaccccauggcugca

SEQ ID NO: 2905649 - RNA, 14 nt, Human
cuaaccacgcugga

SEQ ID NO: 2905650 - RNA, 12 nt, Human
cuaaccacgcug

SEQ ID NO: 2905651 - RNA, 15 nt, Human
cuaacauuauuuauu

SEQ ID NO: 2905652 - RNA, 18 nt, Human
cuaacauuuuaaauaaaa

SEQ ID NO: 2905653 - RNA, 21 nt, Human
cuaacauuuuaaauaaaagaa

SEQ ID NO: 2905654 - RNA, 21 nt, Human
cuaacauuuuugauaaagccu

SEQ ID NO: 2905655 - RNA, 21 nt, Human
cuaaccaaaagacaccagcca

SEQ ID NO: 2905656 - RNA, 22 nt, Human
cuaaccaaaucucucaaaucug

SEQ ID NO: 2905657 - RNA, 19 nt, Human
cuaccaugaacagaaaaca

SEQ ID NO: 2905658 - RNA, 21 nt, Human
cuaccauugcuguucuacuuu

SEQ ID NO: 2905659 - RNA, 19 nt, Human
cuacccaaaacaagccugg

SEQ ID NO: 2905660 - RNA, 16 nt, Human
cuacccaaacccuagg

SEQ ID NO: 2905661 - RNA, 17 nt, Human
cuacccaaacccuaggu

SEQ ID NO: 2905662 - RNA, 13 nt, Human
cuaccauuucaga

SEQ ID NO: 2905663 - RNA, 12 nt, Human
cuaccauuucag

SEQ ID NO: 2905664 - RNA, 19 nt, Human
cuaccaagcuauccuggcu

SEQ ID NO: 2905665 - RNA, 18 nt, Human
cuaccaaggcauaucaug

SEQ ID NO: 2905666 - RNA, 15 nt, Human
cuaccaaagcaccuu

SEQ ID NO: 2905667 - RNA, 18 nt, Human
cuaccacaugccaagcac

SEQ ID NO: 2905668 - RNA, 19 nt, Human
cuaccaaugccaagauaau

SEQ ID NO: 2905669 - RNA, 22 nt, Human
cuacauuauaaaugucucuuua

SEQ ID NO: 2905670 - RNA, 12 nt, Human
cuaccaaaaugg

SEQ ID NO: 2905671 - RNA, 14 nt, Human
cuaccaaagcaccu

SEQ ID NO: 2905672 - RNA, 12 nt, Human
cuacauucauuu

SEQ ID NO: 2905673 - RNA, 14 nt, Human
cuacauuuuuucau

SEQ ID NO: 2905674 - RNA, 16 nt, Human
cuacauuuuuucauca

SEQ ID NO: 2905675 - RNA, 22 nt, Human
cuacauugaguagacacauuua

SEQ ID NO: 2905676 - RNA, 17 nt, Human
cuacauuauaaacgcuu

SEQ ID NO: 2905677 - RNA, 23 nt, Human
cuacauuauugcuuauugcuuag

SEQ ID NO: 2905678 - RNA, 17 nt, Human
cuacccagcgagcccug

SEQ ID NO: 2905679 - RNA, 15 nt, Human
cuacccagcgagccc

SEQ ID NO: 2905680 - RNA, 21 nt, Human
cuacccagagauugcuucuca

SEQ ID NO: 2905681 - RNA, 16 nt, Human
cuacccacaccucugc

SEQ ID NO: 2905682 - RNA, 18 nt, Human
cuacccacaccucugcca

SEQ ID NO: 2905683 - RNA, 19 nt, Human
cuacccacaccucugccag

SEQ ID NO: 2905684 - RNA, 20 nt, Human
cuacccacaccucugccaga

SEQ ID NO: 2905685 - RNA, 18 nt, Human
cuacccagcgagcccugg

SEQ ID NO: 2905686 - RNA, 17 nt, Human
cuacccuccugcacugu

SEQ ID NO: 2905687 - RNA, 19 nt, Human
cuacccuccugcacuguuu

SEQ ID NO: 2905688 - RNA, 16 nt, Human
cuacccuuuuucucca

SEQ ID NO: 2905689 - RNA, 14 nt, Human
cuacccuguguaua

SEQ ID NO: 2905690 - RNA, 13 nt, Human
cuacccuuaauua

SEQ ID NO: 2905691 - RNA, 19 nt, Human
cuacccuuaauuacuuaaa

SEQ ID NO: 2905692 - RNA, 12 nt, Human
cuacccucccac

SEQ ID NO: 2905693 - RNA, 17 nt, Human
cuacccccuaagagcca

SEQ ID NO: 2905694 - RNA, 14 nt, Human
cuacccucccccag

SEQ ID NO: 2905695 - RNA, 19 nt, Human
cuacccucccacccccuuc

SEQ ID NO: 2905696 - RNA, 16 nt, Human
cuacccucccaccccc

SEQ ID NO: 2905697 - RNA, 14 nt, Human
cuacccucccaccc

SEQ ID NO: 2905698 - RNA, 13 nt, Human
cuacccucccacc

SEQ ID NO: 2905699 - RNA, 17 nt, Human
cuacagaggccaugggc

SEQ ID NO: 2905700 - RNA, 20 nt, Human
cuacagaggccaugggccuc

SEQ ID NO: 2905701 - RNA, 18 nt, Human
cuacagaggccaugggcc

SEQ ID NO: 2905702 - RNA, 22 nt, Human
cuacagaggccaugggccuccu

SEQ ID NO: 2905703 - RNA, 15 nt, Human
cuacacugacacugg

SEQ ID NO: 2905704 - RNA, 16 nt, Human
cuacacugacacuggu

SEQ ID NO: 2905705 - RNA, 13 nt, Human
cuacacugaggag

SEQ ID NO: 2905706 - RNA, 14 nt, Human
cuacacugcaauca

SEQ ID NO: 2905707 - RNA, 21 nt, Human
cuacacugcaaucauauguga

SEQ ID NO: 2905708 - RNA, 14 nt, Human
cuacacugggugcu

SEQ ID NO: 2905709 - RNA, 19 nt, Human
cuacagcuuugaucccuga

SEQ ID NO: 2905710 - RNA, 11 nt, Human
cuacagcuuuc

SEQ ID NO: 2905711 - RNA, 17 nt, Human
cuacagcuuucuugcuc

SEQ ID NO: 2905712 - RNA, 19 nt, Human
cuacagcuuucuugcuccc

SEQ ID NO: 2905713 - RNA, 20 nt, Human
cuacagcuuucuugcucccu

SEQ ID NO: 2905714 - RNA, 23 nt, Human
cuacagcuuucuugcucccuuca

SEQ ID NO: 2905715 - RNA, 21 nt, Human
cuacagcuaaucagcauucuc

SEQ ID NO: 2905716 - RNA, 22 nt, Human
cuacagcuaaucagcauucuca

SEQ ID NO: 2905717 - RNA, 11 nt, Human
cuacagcucuu

SEQ ID NO: 2905718 - RNA, 19 nt, Human
cuacagcucuuaaauguag

SEQ ID NO: 2905719 - RNA, 13 nt, Human
cuacagcuaugaa

SEQ ID NO: 2905720 - RNA, 14 nt, Human
cuacagcuaugaag

SEQ ID NO: 2905721 - RNA, 16 nt, Human
cuacagcuaugaagaa

SEQ ID NO: 2905722 - RNA, 17 nt, Human
cuacagcuaugaagaaa

SEQ ID NO: 2905723 - RNA, 23 nt, Human
cuacagaugauagaggauuuuau

SEQ ID NO: 2905724 - RNA, 22 nt, Human
cuacagauagagaguuguugug

SEQ ID NO: 2905725 - RNA, 15 nt, Human
cuacagcacuacugg

SEQ ID NO: 2905726 - RNA, 19 nt, Human
cuacagcacuacugggugu

SEQ ID NO: 2905727 - RNA, 20 nt, Human
cuacagcacuacuggguguc

SEQ ID NO: 2905728 - RNA, 21 nt, Human
cuacagcacuacuggguguca

SEQ ID NO: 2905729 - RNA, 22 nt, Human
cuacagcacuacugggugucau

SEQ ID NO: 2905730 - RNA, 23 nt, Human
cuacagcacuacugggugucauu

SEQ ID NO: 2905731 - RNA, 18 nt, Human
cuacagcuaaucagcauu

SEQ ID NO: 2905732 - RNA, 19 nt, Human
cuacagcuaaucagcauuc

SEQ ID NO: 2905733 - RNA, 16 nt, Human
cuacaggagugagcac

SEQ ID NO: 2905734 - RNA, 15 nt, Human
cuacaggagugagca

SEQ ID NO: 2905735 - RNA, 14 nt, Human
cuacaggagugagc

SEQ ID NO: 2905736 - RNA, 22 nt, Human
cuacaggaagcaccccaugcca

SEQ ID NO: 2905737 - RNA, 20 nt, Human
cuacaggaagcaccccaugc

SEQ ID NO: 2905738 - RNA, 18 nt, Human
cuacaggaagcaccccau

SEQ ID NO: 2905739 - RNA, 17 nt, Human
cuacaggcacccaccau

SEQ ID NO: 2905740 - RNA, 15 nt, Human
cuacaggcacccacc

SEQ ID NO: 2905741 - RNA, 17 nt, Human
cuacaggcagucucucu

SEQ ID NO: 2905742 - RNA, 18 nt, Human
cuacaggcagucucucuc

SEQ ID NO: 2905743 - RNA, 20 nt, Human
cuacaggcagucucucucuu

SEQ ID NO: 2905744 - RNA, 14 nt, Human
cuacaggugugagu

SEQ ID NO: 2905745 - RNA, 16 nt, Human
cuacaggugugaguca

SEQ ID NO: 2905746 - RNA, 16 nt, Human
ccuuccuucccgccag

SEQ ID NO: 2905747 - RNA, 17 nt, Human
ccuucgugaacaucccc

SEQ ID NO: 2905748 - RNA, 22 nt, Human
ccuucgugaacauccccuccca

SEQ ID NO: 2905749 - RNA, 19 nt, Human
ccuucgguggaagagcuca

SEQ ID NO: 2905750 - RNA, 20 nt, Human
ccuucgguggaagagcucaa

SEQ ID NO: 2905751 - RNA, 14 nt, Human
ccuucguaucccga

SEQ ID NO: 2905752 - RNA, 22 nt, Human
ccuucguaucccgagucuggga

SEQ ID NO: 2905753 - RNA, 19 nt, Human
ccuuccuggggcaucuggc

SEQ ID NO: 2905754 - RNA, 19 nt, Human
ccuuccaucccuacccccu

SEQ ID NO: 2905755 - RNA, 12 nt, Human
ccuuccaucccu

SEQ ID NO: 2905756 - RNA, 18 nt, Human
ccuuccaugucgccucug

SEQ ID NO: 2905757 - RNA, 12 nt, Human
ccuuccagcucc

SEQ ID NO: 2905758 - RNA, 13 nt, Human
ccuuccagcuccu

SEQ ID NO: 2905759 - RNA, 15 nt, Human
ccuuccagcuccugu

SEQ ID NO: 2905760 - RNA, 16 nt, Human
ccuuccagcuccugua

SEQ ID NO: 2905761 - RNA, 13 nt, Human
ccuuccaggcccc

SEQ ID NO: 2905762 - RNA, 17 nt, Human
ccuuccagcuccuguaa

SEQ ID NO: 2905763 - RNA, 12 nt, Human
ccuuccagcugc

SEQ ID NO: 2905764 - RNA, 13 nt, Human
ccuuccagcugcu

SEQ ID NO: 2905765 - RNA, 14 nt, Human
ccuuccagcugcug

SEQ ID NO: 2905766 - RNA, 15 nt, Human
ccuuccagcugcugu

SEQ ID NO: 2905767 - RNA, 16 nt, Human
ccuuccagcugcuguc

SEQ ID NO: 2905768 - RNA, 16 nt, Human
ccuuccaggaccccug

SEQ ID NO: 2905769 - RNA, 14 nt, Human
ccuuccauacauuu

SEQ ID NO: 2905770 - RNA, 21 nt, Human
ccuucuccuccccacccgccc

SEQ ID NO: 2905771 - RNA, 16 nt, Human
ccuucucccucauuuc

SEQ ID NO: 2905772 - RNA, 13 nt, Human
ccuucgugccccc

SEQ ID NO: 2905773 - RNA, 19 nt, Human
ccuucguuuacuaugccug

SEQ ID NO: 2905774 - RNA, 17 nt, Human
ccuucguuuacuaugcc

SEQ ID NO: 2905775 - RNA, 23 nt, Human
ccuucguuuacuaugccuguguc

SEQ ID NO: 2905776 - RNA, 22 nt, Human
ccuucguuuacuaugccugugu

SEQ ID NO: 2905777 - RNA, 20 nt, Human
ccuucguuuacuaugccugu

SEQ ID NO: 2905778 - RNA, 18 nt, Human
ccuucuccaccccagccc

SEQ ID NO: 2905779 - RNA, 14 nt, Human
ccuucucacagcac

SEQ ID NO: 2905780 - RNA, 20 nt, Human
ccuguggaugagcccucaga

SEQ ID NO: 2905781 - RNA, 21 nt, Human
ccuguggaugaucaauccuuu

SEQ ID NO: 2905782 - RNA, 13 nt, Human
ccuguggcugugg

SEQ ID NO: 2905783 - RNA, 16 nt, Human
ccuguggcuguggaga

SEQ ID NO: 2905784 - RNA, 19 nt, Human
ccugugggaccccaggccc

SEQ ID NO: 2905785 - RNA, 12 nt, Human
ccuguggcugcg

SEQ ID NO: 2905786 - RNA, 18 nt, Human
ccuguggcugcgcuuccu

SEQ ID NO: 2905787 - RNA, 13 nt, Human
ccuguccucacug

SEQ ID NO: 2905788 - RNA, 21 nt, Human
ccuguccuaaggaaccuuccu

SEQ ID NO: 2905789 - RNA, 14 nt, Human
ccuguccucacugc

SEQ ID NO: 2905790 - RNA, 15 nt, Human
ccuguccucacugcu

SEQ ID NO: 2905791 - RNA, 12 nt, Human
ccuguccucacu

SEQ ID NO: 2905792 - RNA, 18 nt, Human
ccuguccuaaggaaccuu

SEQ ID NO: 2905793 - RNA, 17 nt, Human
ccuguccuaaggaaccu

SEQ ID NO: 2905794 - RNA, 20 nt, Human
ccugucccucccaccucugu

SEQ ID NO: 2905795 - RNA, 21 nt, Human
ccugucccucccaccucugug

SEQ ID NO: 2905796 - RNA, 16 nt, Human
ccugucccucccaccu

SEQ ID NO: 2905797 - RNA, 17 nt, Human
ccugucccucccaccuc

SEQ ID NO: 2905798 - RNA, 18 nt, Human
ccugucccucccaccucu

SEQ ID NO: 2905799 - RNA, 19 nt, Human
ccugucccucccaccucug

SEQ ID NO: 2905800 - RNA, 15 nt, Human
ccuguggagcucagc

SEQ ID NO: 2905801 - RNA, 16 nt, Human
ccuguggagcucagcc

SEQ ID NO: 2905802 - RNA, 17 nt, Human
ccuguggagcucagccc

SEQ ID NO: 2905803 - RNA, 18 nt, Human
ccuguggagcucagcccc

SEQ ID NO: 2905804 - RNA, 19 nt, Human
ccuguggagcucagccccg

SEQ ID NO: 2905805 - RNA, 14 nt, Human
ccuguggagacugg

SEQ ID NO: 2905806 - RNA, 11 nt, Human
ccuguggagac

SEQ ID NO: 2905807 - RNA, 15 nt, Human
ccugugccugacccu

SEQ ID NO: 2905808 - RNA, 16 nt, Human
ccuguccucacugcuc

SEQ ID NO: 2905809 - RNA, 13 nt, Human
ccuuccagaucac

SEQ ID NO: 2905810 - RNA, 20 nt, Human
ccuuccagaucacugccaca

SEQ ID NO: 2905811 - RNA, 20 nt, Human
ccuucauugauuuccugugu

SEQ ID NO: 2905812 - RNA, 21 nt, Human
ccuucauugauuuccuguguc

SEQ ID NO: 2905813 - RNA, 22 nt, Human
ccuucauugauuuccuguguca

SEQ ID NO: 2905814 - RNA, 21 nt, Human
ccuucauuaccuuuuuugaua

SEQ ID NO: 2905815 - RNA, 19 nt, Human
ccuucauucugagaccaaa

SEQ ID NO: 2905816 - RNA, 21 nt, Human
ccuguggggucaacccuucug

SEQ ID NO: 2905817 - RNA, 23 nt, Human
ccuguggggucaacccuucugga

SEQ ID NO: 2905818 - RNA, 17 nt, Human
ccuguggguguagccag

SEQ ID NO: 2905819 - RNA, 18 nt, Human
ccuguggguguagccagg

SEQ ID NO: 2905820 - RNA, 23 nt, Human
ccuguggguguagccagguaugg

SEQ ID NO: 2905821 - RNA, 16 nt, Human
ccuucauggccccagc

SEQ ID NO: 2905822 - RNA, 13 nt, Human
ccuucaucuuuua

SEQ ID NO: 2905823 - RNA, 16 nt, Human
ccuuggagagacacag

SEQ ID NO: 2905824 - RNA, 17 nt, Human
ccuuggagagacacagc

SEQ ID NO: 2905825 - RNA, 19 nt, Human
ccuuggagagacacagcgu

SEQ ID NO: 2905826 - RNA, 16 nt, Human
ccuuggagcuuacaua

SEQ ID NO: 2905827 - RNA, 18 nt, Human
ccuugaggaaacaacagc

SEQ ID NO: 2905828 - RNA, 22 nt, Human
ccuuggcucaaguccucuuuuc

SEQ ID NO: 2905829 - RNA, 19 nt, Human
ccuuggccugucucauccc

SEQ ID NO: 2905830 - RNA, 15 nt, Human
ccuuggccugucuca

SEQ ID NO: 2905831 - RNA, 13 nt, Human
ccuuggccucaga

SEQ ID NO: 2905832 - RNA, 11 nt, Human
ccuuggccuca

SEQ ID NO: 2905833 - RNA, 14 nt, Human
ccuuggccucagaa

SEQ ID NO: 2905834 - RNA, 16 nt, Human
ccuuggccggcugugc

SEQ ID NO: 2905835 - RNA, 19 nt, Human
ccuuggccggcugugcuca

SEQ ID NO: 2905836 - RNA, 20 nt, Human
ccuuggccggcugugcucag

SEQ ID NO: 2905837 - RNA, 21 nt, Human
ccuuggccggcugugcucaga

SEQ ID NO: 2905838 - RNA, 23 nt, Human
ccuuggccggcugugcucagaga

SEQ ID NO: 2905839 - RNA, 15 nt, Human
ccuuggccuagccca

SEQ ID NO: 2905840 - RNA, 20 nt, Human
ccuuggccuagcccacccug

SEQ ID NO: 2905841 - RNA, 22 nt, Human
ccuuggccuagcccacccugcu

SEQ ID NO: 2905842 - RNA, 23 nt, Human
ccuuggccuagcccacccugcug

SEQ ID NO: 2905843 - RNA, 21 nt, Human
ccuugacagggcacaccgggc

SEQ ID NO: 2905844 - RNA, 18 nt, Human
ccuugacagggcacaccg

SEQ ID NO: 2905845 - RNA, 21 nt, Human
ccuugagagaccaggcaaagc

SEQ ID NO: 2905846 - RNA, 18 nt, Human
ccuugagagaccaggcaa

SEQ ID NO: 2905847 - RNA, 20 nt, Human
ccuugagagaccaggcaaag

SEQ ID NO: 2905848 - RNA, 21 nt, Human
ccuugagaguaucaggucucc

SEQ ID NO: 2905849 - RNA, 11 nt, Human
ccuugagcccu

SEQ ID NO: 2905850 - RNA, 18 nt, Human
ccuugagcccuccccagg

SEQ ID NO: 2905851 - RNA, 20 nt, Human
ccuugagcccuccccaggaa

SEQ ID NO: 2905852 - RNA, 16 nt, Human
ccuugagagaccaggc

SEQ ID NO: 2905853 - RNA, 14 nt, Human
ccuugacaucaguu

SEQ ID NO: 2905854 - RNA, 15 nt, Human
ccuugacaucaguuc

SEQ ID NO: 2905855 - RNA, 23 nt, Human
ccuugacauuguagagcuucugg

SEQ ID NO: 2905856 - RNA, 17 nt, Human
ccuugguucccuugugu

SEQ ID NO: 2905857 - RNA, 18 nt, Human
ccuugggcugcuccucau

SEQ ID NO: 2905858 - RNA, 19 nt, Human
ccuuggggaggacaaaacu

SEQ ID NO: 2905859 - RNA, 20 nt, Human
ccuuggggaggacaaaacuu

SEQ ID NO: 2905860 - RNA, 22 nt, Human
ccuuggggaggacaaaacuucu

SEQ ID NO: 2905861 - RNA, 17 nt, Human
ccuugguggcaagagcc

SEQ ID NO: 2905862 - RNA, 17 nt, Human
ccuugggcugcuccuca

SEQ ID NO: 2905863 - RNA, 15 nt, Human
ccuugggcugcuccu

SEQ ID NO: 2905864 - RNA, 14 nt, Human
ccuugggcugcucc

SEQ ID NO: 2905865 - RNA, 18 nt, Human
ccuuggcuugcccacgug

SEQ ID NO: 2905866 - RNA, 16 nt, Human
ccuuggcugcagggag

SEQ ID NO: 2905867 - RNA, 14 nt, Human
ccuuggcugcaggg

SEQ ID NO: 2905868 - RNA, 23 nt, Human
ccuuggccugucucauccccagg

SEQ ID NO: 2905869 - RNA, 22 nt, Human
ccuuggccugucucauccccag

SEQ ID NO: 2905870 - RNA, 17 nt, Human
ccuuggcuucugugaug

SEQ ID NO: 2905871 - RNA, 13 nt, Human
ccuuggcuugccc

SEQ ID NO: 2905872 - RNA, 16 nt, Human
ccuuggcuugcccacg

SEQ ID NO: 2905873 - RNA, 15 nt, Human
ccuuggcuugcccac

SEQ ID NO: 2905874 - RNA, 12 nt, Human
ccuuggcuggug

SEQ ID NO: 2905875 - RNA, 13 nt, Human
ccuuggcuggugc

SEQ ID NO: 2905876 - RNA, 14 nt, Human
ccuuggcuggugca

SEQ ID NO: 2905877 - RNA, 21 nt, Human
ccuuggcugugaggccccugg

SEQ ID NO: 2905878 - RNA, 21 nt, Human
ccuuggcuguuggcagugagu

SEQ ID NO: 2905879 - RNA, 17 nt, Human
ccuuggcuuaccugacc

SEQ ID NO: 2905880 - RNA, 18 nt, Human
ccuuggcuuaccugaccu

SEQ ID NO: 2905881 - RNA, 19 nt, Human
ccuugucuccuacuccuga

SEQ ID NO: 2905882 - RNA, 20 nt, Human
ccuugucuccuacuccugac

SEQ ID NO: 2905883 - RNA, 17 nt, Human
ccuugucugaacuggag

SEQ ID NO: 2905884 - RNA, 17 nt, Human
ccuugugaccuucucua

SEQ ID NO: 2905885 - RNA, 22 nt, Human
ccuuguggccugggccuccuca

SEQ ID NO: 2905886 - RNA, 16 nt, Human
ccuuguggccugggcc

SEQ ID NO: 2905887 - RNA, 12 nt, Human
ccuuguggcaga

SEQ ID NO: 2905888 - RNA, 13 nt, Human
ccuuguggcagag

SEQ ID NO: 2905889 - RNA, 16 nt, Human
ccuuguggcagaggau

SEQ ID NO: 2905890 - RNA, 15 nt, Human
ccuuugguucuggcc

SEQ ID NO: 2905891 - RNA, 20 nt, Human
ccuuugguucuggccagaau

SEQ ID NO: 2905892 - RNA, 21 nt, Human
ccuuuguaaauugucagaugc

SEQ ID NO: 2905893 - RNA, 14 nt, Human
ccuuugguucuggc

SEQ ID NO: 2905894 - RNA, 14 nt, Human
ccuuugggagcagg

SEQ ID NO: 2905895 - RNA, 14 nt, Human
ccuuugggcccugc

SEQ ID NO: 2905896 - RNA, 15 nt, Human
ccuuugggcccugca

SEQ ID NO: 2905897 - RNA, 16 nt, Human
ccuuugggcccugcau

SEQ ID NO: 2905898 - RNA, 17 nt, Human
ccuuugggcccugcaug

SEQ ID NO: 2905899 - RNA, 18 nt, Human
ccuuugggcccugcaugu

SEQ ID NO: 2905900 - RNA, 23 nt, Human
ccuuugggccucugcuucucuca

SEQ ID NO: 2905901 - RNA, 18 nt, Human
ccuuugucaucuuucuuc

SEQ ID NO: 2905902 - RNA, 17 nt, Human
ccuuugguccugucccc

SEQ ID NO: 2905903 - RNA, 23 nt, Human
ccuuugucaucuuucuucuauuu

SEQ ID NO: 2905904 - RNA, 12 nt, Human
ccuuugucuuuc

SEQ ID NO: 2905905 - RNA, 15 nt, Human
ccuuugucuuucaaa

SEQ ID NO: 2905906 - RNA, 13 nt, Human
ccuuuuaacauuu

SEQ ID NO: 2905907 - RNA, 14 nt, Human
ccuuuuaacauuuu

SEQ ID NO: 2905908 - RNA, 15 nt, Human
ccuuuuaacauuuug

SEQ ID NO: 2905909 - RNA, 20 nt, Human
ccuuuuaacauuuuguucuu

SEQ ID NO: 2905910 - RNA, 12 nt, Human
ccuuuuuucaaa

SEQ ID NO: 2905911 - RNA, 13 nt, Human
ccuuuguuucuug

SEQ ID NO: 2905912 - RNA, 14 nt, Human
ccuuuguuucuugu

SEQ ID NO: 2905913 - RNA, 23 nt, Human
ccuuuguuuugauguuuguggcc

SEQ ID NO: 2905914 - RNA, 16 nt, Human
ccuuuuaaaguguuuc

SEQ ID NO: 2905915 - RNA, 19 nt, Human
ccuuuuaaaguguuucagc

SEQ ID NO: 2905916 - RNA, 13 nt, Human
ccuuuguguuucu

SEQ ID NO: 2905917 - RNA, 19 nt, Human
ccuuuguguguacucacug

SEQ ID NO: 2905918 - RNA, 20 nt, Human
ccuuuguguguacucacuga

SEQ ID NO: 2905919 - RNA, 22 nt, Human
ccuuugugguuuuauggagacc

SEQ ID NO: 2905920 - RNA, 16 nt, Human
cgaauagcugggacua

SEQ ID NO: 2905921 - RNA, 15 nt, Human
cgaauagcugggacu

SEQ ID NO: 2905922 - RNA, 14 nt, Human
cgaagggcccccac

SEQ ID NO: 2905923 - RNA, 16 nt, Human
cgaaggugcuggaggu

SEQ ID NO: 2905924 - RNA, 15 nt, Human
cgaaguagcuugcuc

SEQ ID NO: 2905925 - RNA, 21 nt, Human
cgaaguagcuugcucccugug

SEQ ID NO: 2905926 - RNA, 18 nt, Human
cgaagucaagcucaacag

SEQ ID NO: 2905927 - RNA, 13 nt, Human
cgaaggugcugga

SEQ ID NO: 2905928 - RNA, 13 nt, Human
cgaaggggcccug

SEQ ID NO: 2905929 - RNA, 23 nt, Human
cgaagcgcgccacucgcuucccc

SEQ ID NO: 2905930 - RNA, 18 nt, Human
cgaaucagcuauuuacug

SEQ ID NO: 2905931 - RNA, 15 nt, Human
cgaaguccuauggaa

SEQ ID NO: 2905932 - RNA, 16 nt, Human
cgaaguccuauggaaa

SEQ ID NO: 2905933 - RNA, 17 nt, Human
cgaaguccuauggaaac

SEQ ID NO: 2905934 - RNA, 20 nt, Human
cgaaguccuauggaaacccg

SEQ ID NO: 2905935 - RNA, 19 nt, Human
cgaaguggacuggccccug

SEQ ID NO: 2905936 - RNA, 17 nt, Human
cgaaucuacuaauucca

SEQ ID NO: 2905937 - RNA, 18 nt, Human
cgaauccccucccuguca

SEQ ID NO: 2905938 - RNA, 16 nt, Human
cgaauccaagcucccu

SEQ ID NO: 2905939 - RNA, 18 nt, Human
cgaauccaagcucccugc

SEQ ID NO: 2905940 - RNA, 22 nt, Human
cgaauccaagcucccugcccca

SEQ ID NO: 2905941 - RNA, 20 nt, Human
cgagaccccggcuuccuuuc

SEQ ID NO: 2905942 - RNA, 17 nt, Human
cgagacccaagggcaga

SEQ ID NO: 2905943 - RNA, 16 nt, Human
cgaauuaauagcuuuu

SEQ ID NO: 2905944 - RNA, 14 nt, Human
cgaauuaauagcuu

SEQ ID NO: 2905945 - RNA, 19 nt, Human
cgaauccccucccugucaa

SEQ ID NO: 2905946 - RNA, 15 nt, Human
cgaaugaaaagacaa

SEQ ID NO: 2905947 - RNA, 12 nt, Human
cgaauggacuuu

SEQ ID NO: 2905948 - RNA, 20 nt, Human
cgaauggacuuuggaagcag

SEQ ID NO: 2905949 - RNA, 16 nt, Human
cgaagcgcgccacucg

SEQ ID NO: 2905950 - RNA, 11 nt, Human
cgaagcgcgcc

SEQ ID NO: 2905951 - RNA, 19 nt, Human
cgaacauccaaccuuccca

SEQ ID NO: 2905952 - RNA, 22 nt, Human
cgaacacccucgaagcgcgcca

SEQ ID NO: 2905953 - RNA, 21 nt, Human
cgaacacccucgaagcgcgcc

SEQ ID NO: 2905954 - RNA, 18 nt, Human
cgaacacccucgaagcgc

SEQ ID NO: 2905955 - RNA, 11 nt, Human
cgaacaaaaca

SEQ ID NO: 2905956 - RNA, 23 nt, Human
cgaaagggacuuggaagcuccgc

SEQ ID NO: 2905957 - RNA, 23 nt, Human
ccuuuuuugauaaaguuucucag

SEQ ID NO: 2905958 - RNA, 14 nt, Human
ccuuuuuuguaguu

SEQ ID NO: 2905959 - RNA, 17 nt, Human
ccuuuuuugucccccaa

SEQ ID NO: 2905960 - RNA, 23 nt, Human
ccuuuuuugucccccaacuugag

SEQ ID NO: 2905961 - RNA, 22 nt, Human
ccuuuuuuguuuuuucaaaaua

SEQ ID NO: 2905962 - RNA, 23 nt, Human
ccuuuuuuguuuuuucaaaauag

SEQ ID NO: 2905963 - RNA, 11 nt, Human
cgaaauaacaa

SEQ ID NO: 2905964 - RNA, 16 nt, Human
cgaaauaacaauguua

SEQ ID NO: 2905965 - RNA, 17 nt, Human
cgaaauaacaauguuaa

SEQ ID NO: 2905966 - RNA, 20 nt, Human
cgaaauaacaauguuaagga

SEQ ID NO: 2905967 - RNA, 17 nt, Human
cgcguugccugucgcuu

SEQ ID NO: 2905968 - RNA, 15 nt, Human
cgcguuuagaccaag

SEQ ID NO: 2905969 - RNA, 15 nt, Human
cgcggggacauuggg

SEQ ID NO: 2905970 - RNA, 13 nt, Human
cgccuuuuguaua

SEQ ID NO: 2905971 - RNA, 14 nt, Human
cgccuuuuguauac

SEQ ID NO: 2905972 - RNA, 15 nt, Human
cgccuuuuguauaca

SEQ ID NO: 2905973 - RNA, 16 nt, Human
cgccuuuuguauacau

SEQ ID NO: 2905974 - RNA, 19 nt, Human
cgcgaaaccaauuccucau

SEQ ID NO: 2905975 - RNA, 19 nt, Human
cgccuugucuccuacuccu

SEQ ID NO: 2905976 - RNA, 21 nt, Human
cgccuugucuccuacuccuga

SEQ ID NO: 2905977 - RNA, 22 nt, Human
cgccuuccgccccuucccuucc

SEQ ID NO: 2905978 - RNA, 13 nt, Human
cgccuuccuugac

SEQ ID NO: 2905979 - RNA, 19 nt, Human
cgccuuccuugaccuuccu

SEQ ID NO: 2905980 - RNA, 12 nt, Human
cgcccagucugg

SEQ ID NO: 2905981 - RNA, 13 nt, Human
cgccccuuccccc

SEQ ID NO: 2905982 - RNA, 13 nt, Human
cgcccaacuccac

SEQ ID NO: 2905983 - RNA, 15 nt, Human
cgcccgagcuguuua

SEQ ID NO: 2905984 - RNA, 21 nt, Human
cgcccagucuggaaugcagug

SEQ ID NO: 2905985 - RNA, 14 nt, Human
cgcccgccccugca

SEQ ID NO: 2905986 - RNA, 15 nt, Human
cgcccgccccugcag

SEQ ID NO: 2905987 - RNA, 16 nt, Human
cgcccgccccugcagc

SEQ ID NO: 2905988 - RNA, 17 nt, Human
cgcccgccccugcagca

SEQ ID NO: 2905989 - RNA, 18 nt, Human
cgcccgccccugcagcac

SEQ ID NO: 2905990 - RNA, 18 nt, Human
cgcccggcuaauuuuugu

SEQ ID NO: 2905991 - RNA, 19 nt, Human
cgcccagucuggaaugcag

SEQ ID NO: 2905992 - RNA, 13 nt, Human
cgcccagucugga

SEQ ID NO: 2905993 - RNA, 12 nt, Human
cgcccaaggccc

SEQ ID NO: 2905994 - RNA, 18 nt, Human
cgcccaacuaauuuuugu

SEQ ID NO: 2905995 - RNA, 22 nt, Human
cgcacuucagaauuccauaucu

SEQ ID NO: 2905996 - RNA, 13 nt, Human
cgcagcccugcuu

SEQ ID NO: 2905997 - RNA, 15 nt, Human
cgcagcccugcuuug

SEQ ID NO: 2905998 - RNA, 24 nt, Human
cgcagcccugcuuugggcugcccu

SEQ ID NO: 2905999 - RNA, 11 nt, Human
cgcagccugag

SEQ ID NO: 2906000 - RNA, 12 nt, Human
cgcagccugagu

SEQ ID NO: 2906001 - RNA, 23 nt, Human
cgcagcccuggcagggggcaugc

SEQ ID NO: 2906002 - RNA, 16 nt, Human
cgcagcccuggcaggg

SEQ ID NO: 2906003 - RNA, 16 nt, Human
cgcagccucccucuga

SEQ ID NO: 2906004 - RNA, 12 nt, Human
cgcagcugaagu

SEQ ID NO: 2906005 - RNA, 13 nt, Human
cgcagcuggacuc

SEQ ID NO: 2906006 - RNA, 17 nt, Human
cgcagcuggacucugca

SEQ ID NO: 2906007 - RNA, 14 nt, Human
cgccauugccacca

SEQ ID NO: 2906008 - RNA, 17 nt, Human
cgccauugccaccagga

SEQ ID NO: 2906009 - RNA, 16 nt, Human
cgccauugccaccagg

SEQ ID NO: 2906010 - RNA, 18 nt, Human
cgccauugccaccaggag

SEQ ID NO: 2906011 - RNA, 13 nt, Human
cgccauuuaaaag

SEQ ID NO: 2906012 - RNA, 21 nt, Human
cgcucccucccaggacucuga

SEQ ID NO: 2906013 - RNA, 13 nt, Human
cgcucccucccag

SEQ ID NO: 2906014 - RNA, 20 nt, Human
cgcucccucccaggacucug

SEQ ID NO: 2906015 - RNA, 15 nt, Human
cgcucccucccagga

SEQ ID NO: 2906016 - RNA, 12 nt, Human
cgcuaccucccu

SEQ ID NO: 2906017 - RNA, 13 nt, Human
cgcuaccucccuc

SEQ ID NO: 2906018 - RNA, 10 nt, Human
cgcuccaggu

SEQ ID NO: 2906019 - RNA, 11 nt, Human
cgcuccaggua

SEQ ID NO: 2906020 - RNA, 16 nt, Human
cgcugugagccccugg

SEQ ID NO: 2906021 - RNA, 19 nt, Human
cgcugugagccccuggucc

SEQ ID NO: 2906022 - RNA, 20 nt, Human
cgcugugcuaucaugaugga

SEQ ID NO: 2906023 - RNA, 15 nt, Human
cgcuucugccuuuuc

SEQ ID NO: 2906024 - RNA, 20 nt, Human
cgcuucuguguaucucuuuc

SEQ ID NO: 2906025 - RNA, 12 nt, Human
cgcuucugacug

SEQ ID NO: 2906026 - RNA, 20 nt, Human
cgcuucccccauagccaccc

SEQ ID NO: 2906027 - RNA, 15 nt, Human
cgcuucccuccugcc

SEQ ID NO: 2906028 - RNA, 16 nt, Human
cgcuucccuccugccc

SEQ ID NO: 2906029 - RNA, 18 nt, Human
cgcuucccuccugcccgc

SEQ ID NO: 2906030 - RNA, 18 nt, Human
cgcuucccccauagccac

SEQ ID NO: 2906031 - RNA, 16 nt, Human
cgcuucgacuuuucuu

SEQ ID NO: 2906032 - RNA, 21 nt, Human
cgcuguuuuuguugugugugc

SEQ ID NO: 2906033 - RNA, 16 nt, Human
cgcuucccccauagcc

SEQ ID NO: 2906034 - RNA, 13 nt, Human
cgcuucccccaua

SEQ ID NO: 2906035 - RNA, 22 nt, Human
cggacagccacggccaggccag

SEQ ID NO: 2906036 - RNA, 21 nt, Human
cggacagccacggccaggcca

SEQ ID NO: 2906037 - RNA, 16 nt, Human
cggacuuagcugggag

SEQ ID NO: 2906038 - RNA, 17 nt, Human
cggacuuagcugggaga

SEQ ID NO: 2906039 - RNA, 17 nt, Human
cggaauaguuggcuagg

SEQ ID NO: 2906040 - RNA, 16 nt, Human
cggaauaguuggcuag

SEQ ID NO: 2906041 - RNA, 14 nt, Human
cggaauaguuggcu

SEQ ID NO: 2906042 - RNA, 21 nt, Human
cggaaucacucuguccuugga

SEQ ID NO: 2906043 - RNA, 20 nt, Human
cggacagccacggccaggcc

SEQ ID NO: 2906044 - RNA, 16 nt, Human
cgcuuucuacccagcg

SEQ ID NO: 2906045 - RNA, 14 nt, Human
cgcuuucuacccag

SEQ ID NO: 2906046 - RNA, 18 nt, Human
cgcuuguggggacccagg

SEQ ID NO: 2906047 - RNA, 19 nt, Human
cgcuuguggggacccaggc

SEQ ID NO: 2906048 - RNA, 20 nt, Human
cgcuuguggggacccaggcu

SEQ ID NO: 2906049 - RNA, 21 nt, Human
cgcuuguggggacccaggcuc

SEQ ID NO: 2906050 - RNA, 22 nt, Human
cgcuuguggggacccaggcucc

SEQ ID NO: 2906051 - RNA, 13 nt, Human
cgcuuuauuuucu

SEQ ID NO: 2906052 - RNA, 16 nt, Human
cgggaaggucaccagc

SEQ ID NO: 2906053 - RNA, 17 nt, Human
cgggaaggucaccagca

SEQ ID NO: 2906054 - RNA, 15 nt, Human
cgggacaccugcccu

SEQ ID NO: 2906055 - RNA, 20 nt, Human
cgggaaggucaccagcacca

SEQ ID NO: 2906056 - RNA, 17 nt, Human
cgggaauaaccuuccau

SEQ ID NO: 2906057 - RNA, 10 nt, Human
cgggaauauu

SEQ ID NO: 2906058 - RNA, 15 nt, Human
cgggaauauuguuuc

SEQ ID NO: 2906059 - RNA, 16 nt, Human
cgggaauauuguuucu

SEQ ID NO: 2906060 - RNA, 17 nt, Human
cgggaauauuguuucuu

SEQ ID NO: 2906061 - RNA, 12 nt, Human
cgggaagcggag

SEQ ID NO: 2906062 - RNA, 15 nt, Human
cggcuucaugccagc

SEQ ID NO: 2906063 - RNA, 16 nt, Human
cggcuucaugccagcu

SEQ ID NO: 2906064 - RNA, 14 nt, Human
cgggaaccaagcag

SEQ ID NO: 2906065 - RNA, 16 nt, Human
cgggaaccaagcagga

SEQ ID NO: 2906066 - RNA, 15 nt, Human
cggcuuccuuuccca

SEQ ID NO: 2906067 - RNA, 14 nt, Human
cggcuuccuuuccc

SEQ ID NO: 2906068 - RNA, 19 nt, Human
cggcuucaugccagcuacu

SEQ ID NO: 2906069 - RNA, 16 nt, Human
cggcuuuucucagcug

SEQ ID NO: 2906070 - RNA, 19 nt, Human
cggcuuccuuucccaagcc

SEQ ID NO: 2906071 - RNA, 20 nt, Human
cggcuucguuagaccgcucu

SEQ ID NO: 2906072 - RNA, 15 nt, Human
cgggaacagacaaca

SEQ ID NO: 2906073 - RNA, 16 nt, Human
cggccugaugcucccu

SEQ ID NO: 2906074 - RNA, 15 nt, Human
cggccugaugcuccc

SEQ ID NO: 2906075 - RNA, 15 nt, Human
cggccgcuccaccag

SEQ ID NO: 2906076 - RNA, 15 nt, Human
cggccucccaaagug

SEQ ID NO: 2906077 - RNA, 21 nt, Human
cggccuccguccaggagccug

SEQ ID NO: 2906078 - RNA, 22 nt, Human
cggccuccguccaggagccugg

SEQ ID NO: 2906079 - RNA, 19 nt, Human
cggccuccuaaagugcugg

SEQ ID NO: 2906080 - RNA, 20 nt, Human
cggccuccuaaagugcuggg

SEQ ID NO: 2906081 - RNA, 23 nt, Human
cggccuccucuucaccccggcag

SEQ ID NO: 2906082 - RNA, 22 nt, Human
cggcccugggcucggaggcugc

SEQ ID NO: 2906083 - RNA, 22 nt, Human
cggcccuccuacccugcgccca

SEQ ID NO: 2906084 - RNA, 13 nt, Human
cggcccugggcuc

SEQ ID NO: 2906085 - RNA, 18 nt, Human
cggcccugggcucggagg

SEQ ID NO: 2906086 - RNA, 20 nt, Human
cggcccuccuacccugcgcc

SEQ ID NO: 2906087 - RNA, 23 nt, Human
cggcccuccuacccugcgcccag

SEQ ID NO: 2906088 - RNA, 12 nt, Human
cggcccugcaau

SEQ ID NO: 2906089 - RNA, 22 nt, Human
cggcccugcaauguaucccuuc

SEQ ID NO: 2906090 - RNA, 17 nt, Human
cggcccugcagccagcu

SEQ ID NO: 2906091 - RNA, 19 nt, Human
cggcccugcagccagcuca

SEQ ID NO: 2906092 - RNA, 11 nt, Human
cggccaggcca

SEQ ID NO: 2906093 - RNA, 15 nt, Human
cggaucaucaacaag

SEQ ID NO: 2906094 - RNA, 19 nt, Human
cggaucaucaacaagauuu

SEQ ID NO: 2906095 - RNA, 21 nt, Human
cggaucaucaacaagauuucc

SEQ ID NO: 2906096 - RNA, 19 nt, Human
cggaguguguaugccaaga

SEQ ID NO: 2906097 - RNA, 22 nt, Human
cggaguuuugcucuuguagccc

SEQ ID NO: 2906098 - RNA, 13 nt, Human
cggaucagagcag

SEQ ID NO: 2906099 - RNA, 18 nt, Human
cggaucagagcaggaccu

SEQ ID NO: 2906100 - RNA, 19 nt, Human
cggaucagagcaggaccuc

SEQ ID NO: 2906101 - RNA, 22 nt, Human
cggaucagagcaggaccucccu

SEQ ID NO: 2906102 - RNA, 20 nt, Human
cggccaggccagagggagug

SEQ ID NO: 2906103 - RNA, 12 nt, Human
cggccaggccag

SEQ ID NO: 2906104 - RNA, 22 nt, Human
cggccagccccggcccugggcu

SEQ ID NO: 2906105 - RNA, 14 nt, Human
cggauccuaagcau

SEQ ID NO: 2906106 - RNA, 12 nt, Human
cggcccuaaggg

SEQ ID NO: 2906107 - RNA, 14 nt, Human
cggcccuagcccag

SEQ ID NO: 2906108 - RNA, 18 nt, Human
cggcccuagcccagcgcu

SEQ ID NO: 2906109 - RNA, 18 nt, Human
cggcccucaucuaugagg

SEQ ID NO: 2906110 - RNA, 13 nt, Human
cgaggcaggcaga

SEQ ID NO: 2906111 - RNA, 14 nt, Human
cgaggauuuuaauu

SEQ ID NO: 2906112 - RNA, 23 nt, Human
cgaggauuuuaauuuuuuuuagu

SEQ ID NO: 2906113 - RNA, 11 nt, Human
cgaggcccugc

SEQ ID NO: 2906114 - RNA, 12 nt, Human
cgaggcccugca

SEQ ID NO: 2906115 - RNA, 13 nt, Human
cgaggcccugcau

SEQ ID NO: 2906116 - RNA, 14 nt, Human
cgaggcccugcaug

SEQ ID NO: 2906117 - RNA, 15 nt, Human
cgaggcccugcaugg

SEQ ID NO: 2906118 - RNA, 23 nt, Human
cgaugaauuuggagacucugugg

SEQ ID NO: 2906119 - RNA, 16 nt, Human
cgaugauucaggugca

SEQ ID NO: 2906120 - RNA, 17 nt, Human
cgaugauucaggugcag

SEQ ID NO: 2906121 - RNA, 20 nt, Human
cgaugauucaggugcagagg

SEQ ID NO: 2906122 - RNA, 21 nt, Human
cgaugauucaggugcagagga

SEQ ID NO: 2906123 - RNA, 16 nt, Human
cgaggacagggaggug

SEQ ID NO: 2906124 - RNA, 21 nt, Human
cgaggacaugaaacuccaccu

SEQ ID NO: 2906125 - RNA, 16 nt, Human
cgaggaggugccugga

SEQ ID NO: 2906126 - RNA, 23 nt, Human
cgaggaggugccuggagugccca

SEQ ID NO: 2906127 - RNA, 20 nt, Human
cgaggacuuugauugcacau

SEQ ID NO: 2906128 - RNA, 17 nt, Human
cgaggagccaggcaacu

SEQ ID NO: 2906129 - RNA, 19 nt, Human
cgagcccugguggcagugg

SEQ ID NO: 2906130 - RNA, 19 nt, Human
cgagaggccaaaggcuggu

SEQ ID NO: 2906131 - RNA, 14 nt, Human
cgagacugcaaugu

SEQ ID NO: 2906132 - RNA, 15 nt, Human
cgagagaggagccag

SEQ ID NO: 2906133 - RNA, 16 nt, Human
cgagagaggagccaga

SEQ ID NO: 2906134 - RNA, 20 nt, Human
cgagagaggagccagacaga

SEQ ID NO: 2906135 - RNA, 21 nt, Human
cgagagaggagccagacagac

SEQ ID NO: 2906136 - RNA, 14 nt, Human
cgaggacagggagg

SEQ ID NO: 2906137 - RNA, 18 nt, Human
cgagcccugguggcagug

SEQ ID NO: 2906138 - RNA, 23 nt, Human
cgagcccuguggaugagcccuca

SEQ ID NO: 2906139 - RNA, 14 nt, Human
cgcagaugauccau

SEQ ID NO: 2906140 - RNA, 17 nt, Human
cgcagaugugcagcaga

SEQ ID NO: 2906141 - RNA, 18 nt, Human
cgcagaugugcagcagau

SEQ ID NO: 2906142 - RNA, 19 nt, Human
cgcagaugugcagcagauu

SEQ ID NO: 2906143 - RNA, 20 nt, Human
cgcagaugugcagcagauug

SEQ ID NO: 2906144 - RNA, 16 nt, Human
cgcagcaggaggccag

SEQ ID NO: 2906145 - RNA, 18 nt, Human
cgcagcaggaggccaggc

SEQ ID NO: 2906146 - RNA, 17 nt, Human
cgcagcaggaggccagg

SEQ ID NO: 2906147 - RNA, 20 nt, Human
cgcacggccccgaagggccc

SEQ ID NO: 2906148 - RNA, 22 nt, Human
cgcacuacaugugguuuauaga

SEQ ID NO: 2906149 - RNA, 17 nt, Human
cgcaccugcccccuggu

SEQ ID NO: 2906150 - RNA, 16 nt, Human
cgcaccugcccccugg

SEQ ID NO: 2906151 - RNA, 11 nt, Human
cgcacgcacac

SEQ ID NO: 2906152 - RNA, 13 nt, Human
cgcaccuguacag

SEQ ID NO: 2906153 - RNA, 14 nt, Human
cgcaccuguacagu

SEQ ID NO: 2906154 - RNA, 13 nt, Human
cgcacgcacacac

SEQ ID NO: 2906155 - RNA, 14 nt, Human
cgcacgcacacaca

SEQ ID NO: 2906156 - RNA, 15 nt, Human
cgcacgcacacacac

SEQ ID NO: 2906157 - RNA, 16 nt, Human
cgcacgcacacacaca

SEQ ID NO: 2906158 - RNA, 18 nt, Human
cgaugguacgugacccuc

SEQ ID NO: 2906159 - RNA, 16 nt, Human
cgcaccuaccaucagg

SEQ ID NO: 2906160 - RNA, 19 nt, Human
cgcaccuaccaucagggac

SEQ ID NO: 2906161 - RNA, 22 nt, Human
cgaugggagggauggcccuucc

SEQ ID NO: 2906162 - RNA, 14 nt, Human
cgaugcuuuaccaa

SEQ ID NO: 2906163 - RNA, 21 nt, Human
cgaugcuuuaccaaacagcaa

SEQ ID NO: 2906164 - RNA, 22 nt, Human
cgaugcuuuaccaaacagcaaa

SEQ ID NO: 2906165 - RNA, 23 nt, Human
ccugggcagccaggcugccaagg

SEQ ID NO: 2906166 - RNA, 13 nt, Human
ccugggguuguca

SEQ ID NO: 2906167 - RNA, 20 nt, Human
ccuggguaaaugcagcguga

SEQ ID NO: 2906168 - RNA, 21 nt, Human
ccugggguggggauagggagc

SEQ ID NO: 2906169 - RNA, 22 nt, Human
ccuggguaaaugcagcgugaag

SEQ ID NO: 2906170 - RNA, 18 nt, Human
ccuggguacugaaagccu

SEQ ID NO: 2906171 - RNA, 14 nt, Human
ccugggucagucug

SEQ ID NO: 2906172 - RNA, 15 nt, Human
ccugggucagucugg

SEQ ID NO: 2906173 - RNA, 19 nt, Human
ccugggucagucugguggg

SEQ ID NO: 2906174 - RNA, 21 nt, Human
ccugggucagucuggugggag

SEQ ID NO: 2906175 - RNA, 22 nt, Human
ccugggucagucuggugggagg

SEQ ID NO: 2906176 - RNA, 13 nt, Human
ccugggaggcaca

SEQ ID NO: 2906177 - RNA, 16 nt, Human
ccugggaggcacagca

SEQ ID NO: 2906178 - RNA, 18 nt, Human
ccugggagugagcugguu

SEQ ID NO: 2906179 - RNA, 19 nt, Human
ccugggcagccaggcugcc

SEQ ID NO: 2906180 - RNA, 18 nt, Human
ccugggcagccaggcugc

SEQ ID NO: 2906181 - RNA, 17 nt, Human
ccugggcagccaggcug

SEQ ID NO: 2906182 - RNA, 15 nt, Human
ccugggagguggagg

SEQ ID NO: 2906183 - RNA, 18 nt, Human
ccugggaguggguggagg

SEQ ID NO: 2906184 - RNA, 16 nt, Human
ccugggagugagcugg

SEQ ID NO: 2906185 - RNA, 17 nt, Human
ccugggagaaccucagg

SEQ ID NO: 2906186 - RNA, 13 nt, Human
ccuggccacugcu

SEQ ID NO: 2906187 - RNA, 23 nt, Human
ccugggacaguuuaucaugaagc

SEQ ID NO: 2906188 - RNA, 19 nt, Human
ccugggagaaccucaggcu

SEQ ID NO: 2906189 - RNA, 18 nt, Human
ccugggagaaccucaggc

SEQ ID NO: 2906190 - RNA, 14 nt, Human
ccugggagacagac

SEQ ID NO: 2906191 - RNA, 15 nt, Human
ccugggagacagacc

SEQ ID NO: 2906192 - RNA, 13 nt, Human
ccuggcccauaga

SEQ ID NO: 2906193 - RNA, 18 nt, Human
ccuggcccauagaaacau

SEQ ID NO: 2906194 - RNA, 22 nt, Human
ccuggcccauagaaacaugaca

SEQ ID NO: 2906195 - RNA, 23 nt, Human
ccuggcccauagaaacaugacac

SEQ ID NO: 2906196 - RNA, 24 nt, Human
ccuggcccauagaaacaugacacu

SEQ ID NO: 2906197 - RNA, 21 nt, Human
ccuggcucccaugaccauacu

SEQ ID NO: 2906198 - RNA, 22 nt, Human
ccuggcucccaugaccauacug

SEQ ID NO: 2906199 - RNA, 15 nt, Human
ccuggcucccaugac

SEQ ID NO: 2906200 - RNA, 14 nt, Human
ccuggcucccauga

SEQ ID NO: 2906201 - RNA, 21 nt, Human
ccuggcuccguccaggagccu

SEQ ID NO: 2906202 - RNA, 15 nt, Human
ccuggcuccugaggg

SEQ ID NO: 2906203 - RNA, 23 nt, Human
ccuggcuccugaggggcaucugc

SEQ ID NO: 2906204 - RNA, 23 nt, Human
ccuggcuucuggagcccuugggu

SEQ ID NO: 2906205 - RNA, 22 nt, Human
ccuggcuucuggagcccuuggg

SEQ ID NO: 2906206 - RNA, 21 nt, Human
ccuggcuucuggagcccuugg

SEQ ID NO: 2906207 - RNA, 20 nt, Human
ccuggcuucuggagcccuug

SEQ ID NO: 2906208 - RNA, 16 nt, Human
ccuggcuuguuuauuu

SEQ ID NO: 2906209 - RNA, 17 nt, Human
ccuggcuucuggagccc

SEQ ID NO: 2906210 - RNA, 22 nt, Human
ccuggcuucuuucucucagccu

SEQ ID NO: 2906211 - RNA, 17 nt, Human
ccuggcuuuucacugcu

SEQ ID NO: 2906212 - RNA, 16 nt, Human
ccuggcuuuucacugc

SEQ ID NO: 2906213 - RNA, 22 nt, Human
ccugggaaggccucuuggagac

SEQ ID NO: 2906214 - RNA, 18 nt, Human
ccuggcacccggccccug

SEQ ID NO: 2906215 - RNA, 21 nt, Human
ccuggcacccggccccugcug

SEQ ID NO: 2906216 - RNA, 20 nt, Human
ccuggcacccggccccugcu

SEQ ID NO: 2906217 - RNA, 19 nt, Human
ccuggcacccggccccugc

SEQ ID NO: 2906218 - RNA, 16 nt, Human
ccuggagaacuagaga

SEQ ID NO: 2906219 - RNA, 16 nt, Human
ccuggagacccacccc

SEQ ID NO: 2906220 - RNA, 21 nt, Human
ccuggagacccaccccaccug

SEQ ID NO: 2906221 - RNA, 22 nt, Human
ccuggagacccaccccaccugc

SEQ ID NO: 2906222 - RNA, 12 nt, Human
ccuggagaacua

SEQ ID NO: 2906223 - RNA, 13 nt, Human
ccuggagaacuag

SEQ ID NO: 2906224 - RNA, 21 nt, Human
ccugcuaauuccccagauugc

SEQ ID NO: 2906225 - RNA, 17 nt, Human
ccugcuaauuccccaga

SEQ ID NO: 2906226 - RNA, 12 nt, Human
ccugcccuggaa

SEQ ID NO: 2906227 - RNA, 20 nt, Human
ccuggcagggaggucaggcc

SEQ ID NO: 2906228 - RNA, 21 nt, Human
ccuggcagggaggucaggccc

SEQ ID NO: 2906229 - RNA, 22 nt, Human
ccuggcagggaggucaggcccu

SEQ ID NO: 2906230 - RNA, 23 nt, Human
ccuggcagggaggucaggcccug

SEQ ID NO: 2906231 - RNA, 22 nt, Human
ccuggcagggucauccugugcu

SEQ ID NO: 2906232 - RNA, 23 nt, Human
ccuggcagggucauccugugcuc

SEQ ID NO: 2906233 - RNA, 22 nt, Human
ccuggcaggaugacccugcgaa

SEQ ID NO: 2906234 - RNA, 17 nt, Human
ccuggagacguggaacc

SEQ ID NO: 2906235 - RNA, 22 nt, Human
ccuggagacguggaaccucugu

SEQ ID NO: 2906236 - RNA, 19 nt, Human
ccuggcauuauguccacug

SEQ ID NO: 2906237 - RNA, 17 nt, Human
ccuggcauucuuguaca

SEQ ID NO: 2906238 - RNA, 18 nt, Human
ccuggcauucuuguacag

SEQ ID NO: 2906239 - RNA, 19 nt, Human
ccuggcauucuuguacagu

SEQ ID NO: 2906240 - RNA, 20 nt, Human
ccuggcauucuuguacagug

SEQ ID NO: 2906241 - RNA, 13 nt, Human
ccuggcauuucac

SEQ ID NO: 2906242 - RNA, 14 nt, Human
ccuggccaacaugg

SEQ ID NO: 2906243 - RNA, 13 nt, Human
ccuggccaccucu

SEQ ID NO: 2906244 - RNA, 14 nt, Human
ccuggccaccucuc

SEQ ID NO: 2906245 - RNA, 15 nt, Human
ccuggccaccucucu

SEQ ID NO: 2906246 - RNA, 20 nt, Human
ccuggccagaugcaccagcc

SEQ ID NO: 2906247 - RNA, 18 nt, Human
ccuggccaccucucuccu

SEQ ID NO: 2906248 - RNA, 23 nt, Human
ccuggccagaugcaccagcccuu

SEQ ID NO: 2906249 - RNA, 21 nt, Human
ccuggccagaugcaccagccc

SEQ ID NO: 2906250 - RNA, 15 nt, Human
ccuggccagccuaca

SEQ ID NO: 2906251 - RNA, 13 nt, Human
ccuggccacgccc

SEQ ID NO: 2906252 - RNA, 16 nt, Human
ccuggccagauggccc

SEQ ID NO: 2906253 - RNA, 19 nt, Human
ccuggccagauggcccgga

SEQ ID NO: 2906254 - RNA, 13 nt, Human
ccugucccuccca

SEQ ID NO: 2906255 - RNA, 14 nt, Human
ccugucccucccac

SEQ ID NO: 2906256 - RNA, 15 nt, Human
ccugucccucccacc

SEQ ID NO: 2906257 - RNA, 15 nt, Human
ccuguccccaucugu

SEQ ID NO: 2906258 - RNA, 16 nt, Human
ccuguccccaucuguc

SEQ ID NO: 2906259 - RNA, 21 nt, Human
ccuguccccaucugucggccu

SEQ ID NO: 2906260 - RNA, 16 nt, Human
ccuguaccucauccca

SEQ ID NO: 2906261 - RNA, 18 nt, Human
ccugucccacccccaccc

SEQ ID NO: 2906262 - RNA, 15 nt, Human
ccugucccaccccca

SEQ ID NO: 2906263 - RNA, 17 nt, Human
ccugucccacccccacc

SEQ ID NO: 2906264 - RNA, 16 nt, Human
ccugucccauggacac

SEQ ID NO: 2906265 - RNA, 19 nt, Human
ccugucccauggacacucc

SEQ ID NO: 2906266 - RNA, 23 nt, Human
ccugucccauggacacuccagug

SEQ ID NO: 2906267 - RNA, 16 nt, Human
ccugucccaugcaggc

SEQ ID NO: 2906268 - RNA, 19 nt, Human
ccugucccaugcaggcccu

SEQ ID NO: 2906269 - RNA, 12 nt, Human
ccuguauacuuu

SEQ ID NO: 2906270 - RNA, 13 nt, Human
ccuguauacuuua

SEQ ID NO: 2906271 - RNA, 14 nt, Human
ccuguauacuuuag

SEQ ID NO: 2906272 - RNA, 12 nt, Human
ccuguauaguua

SEQ ID NO: 2906273 - RNA, 22 nt, Human
ccuguauaguuaggauagcauu

SEQ ID NO: 2906274 - RNA, 14 nt, Human
ccuguaucuuucua

SEQ ID NO: 2906275 - RNA, 21 nt, Human
ccuguaucuuucuaugcugcu

SEQ ID NO: 2906276 - RNA, 18 nt, Human
ccuguccaucagccagga

SEQ ID NO: 2906277 - RNA, 11 nt, Human
ccugucccacc

SEQ ID NO: 2906278 - RNA, 13 nt, Human
ccugucccacccc

SEQ ID NO: 2906279 - RNA, 11 nt, Human
ccuguacaguc

SEQ ID NO: 2906280 - RNA, 12 nt, Human
ccuguacagucu

SEQ ID NO: 2906281 - RNA, 14 nt, Human
ccuguacagucugu

SEQ ID NO: 2906282 - RNA, 16 nt, Human
ccuguacagucugucu

SEQ ID NO: 2906283 - RNA, 17 nt, Human
ccuguacagucugucuu

SEQ ID NO: 2906284 - RNA, 19 nt, Human
ccuguacagucugucuucu

SEQ ID NO: 2906285 - RNA, 20 nt, Human
ccuguacagucugucuucug

SEQ ID NO: 2906286 - RNA, 22 nt, Human
ccuguacagucugucuucugua

SEQ ID NO: 2906287 - RNA, 16 nt, Human
ccuggugaauggccuu

SEQ ID NO: 2906288 - RNA, 20 nt, Human
ccuggugaauggccuuccuu

SEQ ID NO: 2906289 - RNA, 20 nt, Human
ccuguagaauagccuguggc

SEQ ID NO: 2906290 - RNA, 21 nt, Human
ccuguagaauagccuguggcc

SEQ ID NO: 2906291 - RNA, 20 nt, Human
ccuguacuguucugugucuu

SEQ ID NO: 2906292 - RNA, 17 nt, Human
ccuguaccccagcacuu

SEQ ID NO: 2906293 - RNA, 14 nt, Human
ccuguaccccagca

SEQ ID NO: 2906294 - RNA, 14 nt, Human
ccugguggcagugg

SEQ ID NO: 2906295 - RNA, 13 nt, Human
ccugguggcagug

SEQ ID NO: 2906296 - RNA, 16 nt, Human
ccuggucuuuccucug

SEQ ID NO: 2906297 - RNA, 24 nt, Human
ccuguagcccacucugcucgccuu

SEQ ID NO: 2906298 - RNA, 23 nt, Human
ccuguagcccacucugcucgccu

SEQ ID NO: 2906299 - RNA, 22 nt, Human
ccuguagcccacucugcucgcc

SEQ ID NO: 2906300 - RNA, 19 nt, Human
ccuguagcccacucugcuc

SEQ ID NO: 2906301 - RNA, 23 nt, Human
ccuguaguugcguggacucugca

SEQ ID NO: 2906302 - RNA, 17 nt, Human
ccuguaguuuuauuuua

SEQ ID NO: 2906303 - RNA, 19 nt, Human
ccuguaguuuuauuuuaug

SEQ ID NO: 2906304 - RNA, 17 nt, Human
ccuguauaacccuguua

SEQ ID NO: 2906305 - RNA, 13 nt, Human
ccuguauaagcac

SEQ ID NO: 2906306 - RNA, 17 nt, Human
ccuguauaagcacugaa

SEQ ID NO: 2906307 - RNA, 21 nt, Human
ccuguaguugcguggacucug

SEQ ID NO: 2906308 - RNA, 20 nt, Human
ccuguaguugcguggacucu

SEQ ID NO: 2906309 - RNA, 13 nt, Human
ccuguagcaguga

SEQ ID NO: 2906310 - RNA, 16 nt, Human
ccuguagcccacucug

SEQ ID NO: 2906311 - RNA, 12 nt, Human
ccuguagcccac

SEQ ID NO: 2906312 - RNA, 21 nt, Human
ccuguagcagugagaaaaagc

SEQ ID NO: 2906313 - RNA, 18 nt, Human
ccugguggcagcugcggu

SEQ ID NO: 2906314 - RNA, 17 nt, Human
ccugguggcagcugcgg

SEQ ID NO: 2906315 - RNA, 16 nt, Human
ccugguggcagcugcg

SEQ ID NO: 2906316 - RNA, 15 nt, Human
ccugguggcagcugc

SEQ ID NO: 2906317 - RNA, 14 nt, Human
ccugguggcagcug

SEQ ID NO: 2906318 - RNA, 23 nt, Human
ccuggguccaggggaggccuucc

SEQ ID NO: 2906319 - RNA, 18 nt, Human
ccuggggucucugcugca

SEQ ID NO: 2906320 - RNA, 18 nt, Human
ccugguccuuccaggccc

SEQ ID NO: 2906321 - RNA, 15 nt, Human
ccugguccuuccagg

SEQ ID NO: 2906322 - RNA, 14 nt, Human
ccugguccugaggg

SEQ ID NO: 2906323 - RNA, 20 nt, Human
ccuggguuccaauccuggcu

SEQ ID NO: 2906324 - RNA, 18 nt, Human
ccuggguuccaauccugg

SEQ ID NO: 2906325 - RNA, 13 nt, Human
ccuggucucuggu

SEQ ID NO: 2906326 - RNA, 14 nt, Human
ccuggucucugguc

SEQ ID NO: 2906327 - RNA, 19 nt, Human
ccugguccuuccaggcccc

SEQ ID NO: 2906328 - RNA, 23 nt, Human
ccugguccugaggguccccaccu

SEQ ID NO: 2906329 - RNA, 15 nt, Human
ccugccccucucccg

SEQ ID NO: 2906330 - RNA, 16 nt, Human
ccugccccucucccgc

SEQ ID NO: 2906331 - RNA, 12 nt, Human
ccugccccucuu

SEQ ID NO: 2906332 - RNA, 14 nt, Human
ccugccccucuuuc

SEQ ID NO: 2906333 - RNA, 15 nt, Human
ccugccccucuuucu

SEQ ID NO: 2906334 - RNA, 17 nt, Human
ccugccccucuuucucu

SEQ ID NO: 2906335 - RNA, 18 nt, Human
ccugccccucuuucucuu

SEQ ID NO: 2906336 - RNA, 19 nt, Human
ccugccccucuuucucuuu

SEQ ID NO: 2906337 - RNA, 20 nt, Human
ccugccccucuuucucuuuc

SEQ ID NO: 2906338 - RNA, 23 nt, Human
ccugccccucuuucucuuucuuc

SEQ ID NO: 2906339 - RNA, 22 nt, Human
ccugccccuccucucugcccua

SEQ ID NO: 2906340 - RNA, 21 nt, Human
ccugccccuccucucugcccu

SEQ ID NO: 2906341 - RNA, 20 nt, Human
ccugccccuccucucugccc

SEQ ID NO: 2906342 - RNA, 19 nt, Human
ccugccccuccucucugcc

SEQ ID NO: 2906343 - RNA, 15 nt, Human
ccugccccucccuuc

SEQ ID NO: 2906344 - RNA, 16 nt, Human
ccugccccucccuuca

SEQ ID NO: 2906345 - RNA, 18 nt, Human
ccugccccucccuucaac

SEQ ID NO: 2906346 - RNA, 18 nt, Human
ccugccccuccucucugc

SEQ ID NO: 2906347 - RNA, 16 nt, Human
ccugcccccuggugga

SEQ ID NO: 2906348 - RNA, 15 nt, Human
ccugcccccuggugg

SEQ ID NO: 2906349 - RNA, 14 nt, Human
ccugcccccuggug

SEQ ID NO: 2906350 - RNA, 13 nt, Human
ccugcccccuggu

SEQ ID NO: 2906351 - RNA, 14 nt, Human
ccugccccucccuu

SEQ ID NO: 2906352 - RNA, 21 nt, Human
ccugcccucauggccccucug

SEQ ID NO: 2906353 - RNA, 23 nt, Human
ccugcccucauggccccucugac

SEQ ID NO: 2906354 - RNA, 14 nt, Human
ccugcccguucuug

SEQ ID NO: 2906355 - RNA, 15 nt, Human
ccugcccguguacau

SEQ ID NO: 2906356 - RNA, 16 nt, Human
ccugcccguguacaua

SEQ ID NO: 2906357 - RNA, 17 nt, Human
ccugcccguguacauag

SEQ ID NO: 2906358 - RNA, 23 nt, Human
ccugcccguaaacacgccugcaa

SEQ ID NO: 2906359 - RNA, 22 nt, Human
ccugcccgggcgcggccagccc

SEQ ID NO: 2906360 - RNA, 16 nt, Human
ccugcccggcugcgga

SEQ ID NO: 2906361 - RNA, 14 nt, Human
ccugcccggcugcg

SEQ ID NO: 2906362 - RNA, 10 nt, Human
ccugcccggg

SEQ ID NO: 2906363 - RNA, 16 nt, Human
ccugccccuuccuuua

SEQ ID NO: 2906364 - RNA, 13 nt, Human
ccugcccgcacag

SEQ ID NO: 2906365 - RNA, 15 nt, Human
ccugcccgcacagca

SEQ ID NO: 2906366 - RNA, 16 nt, Human
ccugcccgcacagcag

SEQ ID NO: 2906367 - RNA, 17 nt, Human
ccugcccgcacagcagc

SEQ ID NO: 2906368 - RNA, 20 nt, Human
ccugcccgcacagcagccug

SEQ ID NO: 2906369 - RNA, 22 nt, Human
ccugcccgcacagcagccugcu

SEQ ID NO: 2906370 - RNA, 18 nt, Human
ccugcccgcagaccucug

SEQ ID NO: 2906371 - RNA, 19 nt, Human
ccugcccgcagaccucugg

SEQ ID NO: 2906372 - RNA, 20 nt, Human
ccugcccgcagaccucugga

SEQ ID NO: 2906373 - RNA, 22 nt, Human
ccugcccguaaacacgccugca

SEQ ID NO: 2906374 - RNA, 21 nt, Human
ccugcccguaaacacgccugc

SEQ ID NO: 2906375 - RNA, 20 nt, Human
ccugcccguaaacacgccug

SEQ ID NO: 2906376 - RNA, 15 nt, Human
ccugcccguaaacac

SEQ ID NO: 2906377 - RNA, 12 nt, Human
ccugcccccugg

SEQ ID NO: 2906378 - RNA, 18 nt, Human
ccugccccccagccucug

SEQ ID NO: 2906379 - RNA, 22 nt, Human
ccugccccccagccucuggcau

SEQ ID NO: 2906380 - RNA, 16 nt, Human
ccugccaccacuauaa

SEQ ID NO: 2906381 - RNA, 14 nt, Human
ccugccccccagcc

SEQ ID NO: 2906382 - RNA, 15 nt, Human
ccugccccccagccu

SEQ ID NO: 2906383 - RNA, 17 nt, Human
ccugccccccagccucu

SEQ ID NO: 2906384 - RNA, 12 nt, Human
ccugccugugcu

SEQ ID NO: 2906385 - RNA, 22 nt, Human
ccugccuguucccauucuugca

SEQ ID NO: 2906386 - RNA, 16 nt, Human
ccugccuguagcccac

SEQ ID NO: 2906387 - RNA, 11 nt, Human
ccugccucagc

SEQ ID NO: 2906388 - RNA, 12 nt, Human
ccugccucagcc

SEQ ID NO: 2906389 - RNA, 14 nt, Human
ccugccucagccuc

SEQ ID NO: 2906390 - RNA, 13 nt, Human
ccugccucagccu

SEQ ID NO: 2906391 - RNA, 15 nt, Human
ccugcccugguccag

SEQ ID NO: 2906392 - RNA, 23 nt, Human
ccugcccugguuuccugcccugg

SEQ ID NO: 2906393 - RNA, 12 nt, Human
ccugcccugguc

SEQ ID NO: 2906394 - RNA, 20 nt, Human
ccugcccugcugccgccucc

SEQ ID NO: 2906395 - RNA, 14 nt, Human
ccugcccugguuuc

SEQ ID NO: 2906396 - RNA, 22 nt, Human
ccugcccugggaggcagugaug

SEQ ID NO: 2906397 - RNA, 20 nt, Human
ccugcccugggaggcaguga

SEQ ID NO: 2906398 - RNA, 22 nt, Human
ccugcccugguuuccugcccug

SEQ ID NO: 2906399 - RNA, 21 nt, Human
ccugcccugguuuccugcccu

SEQ ID NO: 2906400 - RNA, 20 nt, Human
ccugcccugguuuccugccc

SEQ ID NO: 2906401 - RNA, 19 nt, Human
ccugcccugguuuccugcc

SEQ ID NO: 2906402 - RNA, 13 nt, Human
ccugcccugagga

SEQ ID NO: 2906403 - RNA, 13 nt, Human
ccugcccuccccu

SEQ ID NO: 2906404 - RNA, 13 nt, Human
ccugcccugcugc

SEQ ID NO: 2906405 - RNA, 15 nt, Human
ccugcccugccccca

SEQ ID NO: 2906406 - RNA, 15 nt, Human
ccugcccugggaggc

SEQ ID NO: 2906407 - RNA, 14 nt, Human
ccugcccugggagg

SEQ ID NO: 2906408 - RNA, 12 nt, Human
ccugcccuggga

SEQ ID NO: 2906409 - RNA, 10 nt, Human
ccugcccugg

SEQ ID NO: 2906410 - RNA, 14 nt, Human
ccugaggcugagac

SEQ ID NO: 2906411 - RNA, 21 nt, Human
ccugaggcugagacugcggga

SEQ ID NO: 2906412 - RNA, 21 nt, Human
ccugauauuucccuccccugg

SEQ ID NO: 2906413 - RNA, 19 nt, Human
ccugaagucacacagugag

SEQ ID NO: 2906414 - RNA, 20 nt, Human
ccugaagucacacagugagu

SEQ ID NO: 2906415 - RNA, 19 nt, Human
ccugaaguaagcaaagacu

SEQ ID NO: 2906416 - RNA, 22 nt, Human
ccugagcccuacucccugcaga

SEQ ID NO: 2906417 - RNA, 21 nt, Human
ccugagcccuacucccugcag

SEQ ID NO: 2906418 - RNA, 19 nt, Human
ccugagcccuacucccugc

SEQ ID NO: 2906419 - RNA, 17 nt, Human
ccugagcccuacucccu

SEQ ID NO: 2906420 - RNA, 14 nt, Human
ccugagccccgccc

SEQ ID NO: 2906421 - RNA, 18 nt, Human
ccugagccccgcccucuu

SEQ ID NO: 2906422 - RNA, 20 nt, Human
ccugagccccgcccucuucc

SEQ ID NO: 2906423 - RNA, 21 nt, Human
ccugagccccgcccucuuccu

SEQ ID NO: 2906424 - RNA, 22 nt, Human
ccugagccccgcccucuuccug

SEQ ID NO: 2906425 - RNA, 23 nt, Human
ccugagccccgcccucuuccuga

SEQ ID NO: 2906426 - RNA, 21 nt, Human
ccugagccccagggugcccag

SEQ ID NO: 2906427 - RNA, 23 nt, Human
ccugagccccagggugcccagaa

SEQ ID NO: 2906428 - RNA, 13 nt, Human
ccugagcucacuc

SEQ ID NO: 2906429 - RNA, 17 nt, Human
ccugagcgccugggucc

SEQ ID NO: 2906430 - RNA, 21 nt, Human
ccugagcgccuggauuucugg

SEQ ID NO: 2906431 - RNA, 16 nt, Human
ccugagccuggccagc

SEQ ID NO: 2906432 - RNA, 15 nt, Human
ccugagccuggccag

SEQ ID NO: 2906433 - RNA, 14 nt, Human
ccugagccuggcca

SEQ ID NO: 2906434 - RNA, 13 nt, Human
ccugagccuggcc

SEQ ID NO: 2906435 - RNA, 12 nt, Human
ccugagccuggc

SEQ ID NO: 2906436 - RNA, 13 nt, Human
ccugccacccugg

SEQ ID NO: 2906437 - RNA, 12 nt, Human
ccugccacccug

SEQ ID NO: 2906438 - RNA, 14 nt, Human
ccugccacccuggg

SEQ ID NO: 2906439 - RNA, 22 nt, Human
ccugccacccuggggagaaagu

SEQ ID NO: 2906440 - RNA, 16 nt, Human
ccugccacccugggga

SEQ ID NO: 2906441 - RNA, 13 nt, Human
ccugccaccuccc

SEQ ID NO: 2906442 - RNA, 14 nt, Human
ccugccaccucccu

SEQ ID NO: 2906443 - RNA, 16 nt, Human
ccugccaccucccuga

SEQ ID NO: 2906444 - RNA, 13 nt, Human
ccugccacccugu

SEQ ID NO: 2906445 - RNA, 14 nt, Human
ccugccacccugua

SEQ ID NO: 2906446 - RNA, 16 nt, Human
ccugccacccuguagc

SEQ ID NO: 2906447 - RNA, 19 nt, Human
ccugccaccacgcccggcu

SEQ ID NO: 2906448 - RNA, 15 nt, Human
ccugccaccacgccc

SEQ ID NO: 2906449 - RNA, 16 nt, Human
ccugcauuucugaguu

SEQ ID NO: 2906450 - RNA, 18 nt, Human
ccugccacauuagaacuu

SEQ ID NO: 2906451 - RNA, 19 nt, Human
ccugccacauuagaacuuc

SEQ ID NO: 2906452 - RNA, 14 nt, Human
ccugcauuucugag

SEQ ID NO: 2906453 - RNA, 12 nt, Human
ccugcauuguua

SEQ ID NO: 2906454 - RNA, 23 nt, Human
ccugcauuugugaaaugauggug

SEQ ID NO: 2906455 - RNA, 20 nt, Human
ccugcacagugucccccagg

SEQ ID NO: 2906456 - RNA, 14 nt, Human
ccugcacuggggag

SEQ ID NO: 2906457 - RNA, 21 nt, Human
ccugcacuggggagcccgucu

SEQ ID NO: 2906458 - RNA, 19 nt, Human
ccugcacagugucccccag

SEQ ID NO: 2906459 - RNA, 23 nt, Human
ccugcacaaagcccuuccauguc

SEQ ID NO: 2906460 - RNA, 21 nt, Human
ccugcacacgcuccuuccucu

SEQ ID NO: 2906461 - RNA, 10 nt, Human
ccugcacaca

SEQ ID NO: 2906462 - RNA, 11 nt, Human
ccugcacacaa

SEQ ID NO: 2906463 - RNA, 12 nt, Human
ccugcacacaag

SEQ ID NO: 2906464 - RNA, 22 nt, Human
ccugcacacaagcccacagcac

SEQ ID NO: 2906465 - RNA, 23 nt, Human
ccugcacacaagcccacagcaca

SEQ ID NO: 2906466 - RNA, 17 nt, Human
ccugaucacuagccugu

SEQ ID NO: 2906467 - RNA, 22 nt, Human
ccugcacaaagcccuuccaugu

SEQ ID NO: 2906468 - RNA, 20 nt, Human
ccugcacaaagcccuuccau

SEQ ID NO: 2906469 - RNA, 18 nt, Human
ccugcaaagcccagcuug

SEQ ID NO: 2906470 - RNA, 17 nt, Human
ccugcaaagcccagcuu

SEQ ID NO: 2906471 - RNA, 14 nt, Human
ccugcaaagcccag

SEQ ID NO: 2906472 - RNA, 16 nt, Human
ccugcaaagcccagcu

SEQ ID NO: 2906473 - RNA, 15 nt, Human
ccugcaaagcccagc

SEQ ID NO: 2906474 - RNA, 17 nt, Human
ccugaagccagccuucu

SEQ ID NO: 2906475 - RNA, 18 nt, Human
ccugaagccagccuucuu

SEQ ID NO: 2906476 - RNA, 12 nt, Human
ccugaagccagc

SEQ ID NO: 2906477 - RNA, 14 nt, Human
ccugaagccagccu

SEQ ID NO: 2906478 - RNA, 15 nt, Human
ccugaagccagccuu

SEQ ID NO: 2906479 - RNA, 16 nt, Human
ccugaagccagccuuc

SEQ ID NO: 2906480 - RNA, 12 nt, Human
ccugaagacuga

SEQ ID NO: 2906481 - RNA, 14 nt, Human
ccugaagacugagg

SEQ ID NO: 2906482 - RNA, 15 nt, Human
ccugaagacugagga

SEQ ID NO: 2906483 - RNA, 21 nt, Human
ccugaagaguccucugaauga

SEQ ID NO: 2906484 - RNA, 20 nt, Human
ccugaaaccuaguacugccc

SEQ ID NO: 2906485 - RNA, 21 nt, Human
ccuaugaaguaaagaacugca

SEQ ID NO: 2906486 - RNA, 16 nt, Human
ccuaugaaugcuuugc

SEQ ID NO: 2906487 - RNA, 15 nt, Human
ccuaugagcauccug

SEQ ID NO: 2906488 - RNA, 16 nt, Human
ccuaugagcauccuga

SEQ ID NO: 2906489 - RNA, 20 nt, Human
ccuaugagcauccugagccc

SEQ ID NO: 2906490 - RNA, 21 nt, Human
ccuaugagcauccugagcccc

SEQ ID NO: 2906491 - RNA, 22 nt, Human
ccuaugagcauccugagccccg

SEQ ID NO: 2906492 - RNA, 15 nt, Human
ccuagucccuucccc

SEQ ID NO: 2906493 - RNA, 14 nt, Human
ccuagucccuuccc

SEQ ID NO: 2906494 - RNA, 19 nt, Human
ccuagucccuuccccuccc

SEQ ID NO: 2906495 - RNA, 16 nt, Human
ccuagucccuuccccu

SEQ ID NO: 2906496 - RNA, 21 nt, Human
ccuagucccuuccccucccug

SEQ ID NO: 2906497 - RNA, 15 nt, Human
ccuaugaucccagca

SEQ ID NO: 2906498 - RNA, 14 nt, Human
ccuaugaucccagc

SEQ ID NO: 2906499 - RNA, 13 nt, Human
ccuaugaucccag

SEQ ID NO: 2906500 - RNA, 12 nt, Human
ccucuuccccac

SEQ ID NO: 2906501 - RNA, 11 nt, Human
ccucuucccca

SEQ ID NO: 2906502 - RNA, 21 nt, Human
ccucuuccugugauccaccca

SEQ ID NO: 2906503 - RNA, 13 nt, Human
ccucuuccuguga

SEQ ID NO: 2906504 - RNA, 11 nt, Human
ccucuuccuga

SEQ ID NO: 2906505 - RNA, 22 nt, Human
ccucuuccccagaaaggagacu

SEQ ID NO: 2906506 - RNA, 14 nt, Human
ccucuuccccagaa

SEQ ID NO: 2906507 - RNA, 13 nt, Human
ccucuuccccaga

SEQ ID NO: 2906508 - RNA, 15 nt, Human
ccucuucccccuucc

SEQ ID NO: 2906509 - RNA, 22 nt, Human
ccugaaaauguuuuucugccag

SEQ ID NO: 2906510 - RNA, 21 nt, Human
ccugaaaauguuuuucugcca

SEQ ID NO: 2906511 - RNA, 23 nt, Human
ccugaaaauguuuuucugccagg

SEQ ID NO: 2906512 - RNA, 19 nt, Human
ccugaaacacgaaacuugu

SEQ ID NO: 2906513 - RNA, 22 nt, Human
ccugaaaaguaacuuggcuuuc

SEQ ID NO: 2906514 - RNA, 20 nt, Human
ccucuuccugacgaaacugg

SEQ ID NO: 2906515 - RNA, 13 nt, Human
ccucuucggcccu

SEQ ID NO: 2906516 - RNA, 15 nt, Human
ccucuucggcccuca

SEQ ID NO: 2906517 - RNA, 16 nt, Human
ccucuucggcccucag

SEQ ID NO: 2906518 - RNA, 18 nt, Human
ccucuucuauuuuguaaa

SEQ ID NO: 2906519 - RNA, 17 nt, Human
ccucuucuauuuuguaa

SEQ ID NO: 2906520 - RNA, 13 nt, Human
gaaacacagaaac

SEQ ID NO: 2906521 - RNA, 16 nt, Human
gaaacauuuuuuaaaa

SEQ ID NO: 2906522 - RNA, 20 nt, Human
gaaaaugauacgcaacauaa

SEQ ID NO: 2906523 - RNA, 22 nt, Human
gaaaaugaauaucuauuaauau

SEQ ID NO: 2906524 - RNA, 18 nt, Human
gaaaaugaguugugaaag

SEQ ID NO: 2906525 - RNA, 21 nt, Human
gaaaaugaguugugaaaguuu

SEQ ID NO: 2906526 - RNA, 17 nt, Human
gaaacaagugaaagcau

SEQ ID NO: 2906527 - RNA, 15 nt, Human
gaaacaauaaagaga

SEQ ID NO: 2906528 - RNA, 14 nt, Human
gaaaccacagcugc

SEQ ID NO: 2906529 - RNA, 15 nt, Human
gaaaccacagcugcu

SEQ ID NO: 2906530 - RNA, 22 nt, Human
gaaaccaauuccucauccucag

SEQ ID NO: 2906531 - RNA, 20 nt, Human
gaaaccacagcugcuggaga

SEQ ID NO: 2906532 - RNA, 17 nt, Human
gaaaccacagcugcugg

SEQ ID NO: 2906533 - RNA, 18 nt, Human
gaaaccacagcugcugga

SEQ ID NO: 2906534 - RNA, 20 nt, Human
gaaacuccaccuugcgggga

SEQ ID NO: 2906535 - RNA, 12 nt, Human
gaaaccugugaa

SEQ ID NO: 2906536 - RNA, 14 nt, Human
gaaacuagaaaugu

SEQ ID NO: 2906537 - RNA, 20 nt, Human
gaaacuaauugacuuuagaa

SEQ ID NO: 2906538 - RNA, 21 nt, Human
gaaacuaauugacuuuagaaa

SEQ ID NO: 2906539 - RNA, 13 nt, Human
gaaaccuuaauau

SEQ ID NO: 2906540 - RNA, 19 nt, Human
gaaaccugcucuguaggag

SEQ ID NO: 2906541 - RNA, 16 nt, Human
gaaacgucuucuaaac

SEQ ID NO: 2906542 - RNA, 21 nt, Human
gaaaccgccuaguuuacuguu

SEQ ID NO: 2906543 - RNA, 21 nt, Human
gaaacccuggaccaguggucu

SEQ ID NO: 2906544 - RNA, 14 nt, Human
gaaacccuggacca

SEQ ID NO: 2906545 - RNA, 16 nt, Human
gaaaccugggauucag

SEQ ID NO: 2906546 - RNA, 12 nt, Human
gaaaccugggcu

SEQ ID NO: 2906547 - RNA, 18 nt, Human
gaaaccugggcucugguu

SEQ ID NO: 2906548 - RNA, 18 nt, Human
gaaaccuguauaacccug

SEQ ID NO: 2906549 - RNA, 20 nt, Human
gaaaccuguauaacccuguu

SEQ ID NO: 2906550 - RNA, 21 nt, Human
gaaaccuguauaacccuguua

SEQ ID NO: 2906551 - RNA, 13 nt, Human
gaaaccuguaucu

SEQ ID NO: 2906552 - RNA, 14 nt, Human
gaaaccuguaucuu

SEQ ID NO: 2906553 - RNA, 15 nt, Human
gaaaccuguaucuuu

SEQ ID NO: 2906554 - RNA, 18 nt, Human
gaaaccuguaucuuucua

SEQ ID NO: 2906555 - RNA, 23 nt, Human
gaaaccuguaucuuucuaugcug

SEQ ID NO: 2906556 - RNA, 13 nt, Human
gaaaccugaaaaa

SEQ ID NO: 2906557 - RNA, 18 nt, Human
gaaaccugaaaaaaaguu

SEQ ID NO: 2906558 - RNA, 21 nt, Human
gaaaccuacacacugucaugc

SEQ ID NO: 2906559 - RNA, 18 nt, Human
gaaaccuaguacugcccc

SEQ ID NO: 2906560 - RNA, 16 nt, Human
gaaaccucuacauauu

SEQ ID NO: 2906561 - RNA, 17 nt, Human
gaaaccuaguacugccc

SEQ ID NO: 2906562 - RNA, 13 nt, Human
gaaacccaagcuc

SEQ ID NO: 2906563 - RNA, 14 nt, Human
gaaacccaagcucc

SEQ ID NO: 2906564 - RNA, 17 nt, Human
gaaacccaagcuccucc

SEQ ID NO: 2906565 - RNA, 18 nt, Human
gaaacccaagcuccuccu

SEQ ID NO: 2906566 - RNA, 23 nt, Human
gaaacccaagcuccuccucggaa

SEQ ID NO: 2906567 - RNA, 19 nt, Human
gaaaccaguguagccuugc

SEQ ID NO: 2906568 - RNA, 16 nt, Human
gaaacccauaggccca

SEQ ID NO: 2906569 - RNA, 18 nt, Human
gaaacccauaggcccaca

SEQ ID NO: 2906570 - RNA, 19 nt, Human
gaaacccauaggcccacac

SEQ ID NO: 2906571 - RNA, 21 nt, Human
gaaacccauaggcccacacac

SEQ ID NO: 2906572 - RNA, 22 nt, Human
gaaacccauaggcccacacaca

SEQ ID NO: 2906573 - RNA, 23 nt, Human
gaaacccauaggcccacacacag

SEQ ID NO: 2906574 - RNA, 15 nt, Human
gaaacccgaggguug

SEQ ID NO: 2906575 - RNA, 18 nt, Human
gaaacccgaggguugauu

SEQ ID NO: 2906576 - RNA, 14 nt, Human
gaaacccucuguca

SEQ ID NO: 2906577 - RNA, 19 nt, Human
gaaaccccuucucugugac

SEQ ID NO: 2906578 - RNA, 20 nt, Human
gaaaccccuucucugugacc

SEQ ID NO: 2906579 - RNA, 23 nt, Human
gaaacucuuaucucagucaugca

SEQ ID NO: 2906580 - RNA, 20 nt, Human
gaaacucuugcuauugaauu

SEQ ID NO: 2906581 - RNA, 22 nt, Human
gaaacucuugcuauugaauuga

SEQ ID NO: 2906582 - RNA, 14 nt, Human
gaaagacuuccaaa

SEQ ID NO: 2906583 - RNA, 16 nt, Human
gaaagacuuccaaaga

SEQ ID NO: 2906584 - RNA, 20 nt, Human
gaaagacuuccaaagaaugu

SEQ ID NO: 2906585 - RNA, 21 nt, Human
gaaacuccaccuugcggggau

SEQ ID NO: 2906586 - RNA, 14 nt, Human
gaaacucuuaucuc

SEQ ID NO: 2906587 - RNA, 15 nt, Human
gaaacucuuaucuca

SEQ ID NO: 2906588 - RNA, 16 nt, Human
gaaacucuuaucucag

SEQ ID NO: 2906589 - RNA, 20 nt, Human
gaaacucuuaucucagucau

SEQ ID NO: 2906590 - RNA, 21 nt, Human
gaaacucuuaucucagucaug

SEQ ID NO: 2906591 - RNA, 18 nt, Human
gaaacucccauguaugga

SEQ ID NO: 2906592 - RNA, 14 nt, Human
gaaagagaaggugg

SEQ ID NO: 2906593 - RNA, 15 nt, Human
gaaagagaagguggg

SEQ ID NO: 2906594 - RNA, 22 nt, Human
gaaagcagauaccucacccugc

SEQ ID NO: 2906595 - RNA, 20 nt, Human
gaaagcagauaccucacccu

SEQ ID NO: 2906596 - RNA, 12 nt, Human
gaaagcaggggc

SEQ ID NO: 2906597 - RNA, 13 nt, Human
gaaagcaggggcu

SEQ ID NO: 2906598 - RNA, 14 nt, Human
gaaagcaggggcua

SEQ ID NO: 2906599 - RNA, 19 nt, Human
gaaagcaggggcuacaaga

SEQ ID NO: 2906600 - RNA, 23 nt, Human
gaaagcaggggcuacaagaggga

SEQ ID NO: 2906601 - RNA, 15 nt, Human
gaaagcaguugaaau

SEQ ID NO: 2906602 - RNA, 23 nt, Human
gaaagcauauggguuagauguug

SEQ ID NO: 2906603 - RNA, 17 nt, Human
gaaagcaucaccucagg

SEQ ID NO: 2906604 - RNA, 16 nt, Human
gaaagcaucaccucag

SEQ ID NO: 2906605 - RNA, 19 nt, Human
gaaagcaucaccucaggcc

SEQ ID NO: 2906606 - RNA, 18 nt, Human
gaaagcaucaccucaggc

SEQ ID NO: 2906607 - RNA, 18 nt, Human
gaaagccccagcacuaac

SEQ ID NO: 2906608 - RNA, 14 nt, Human
gaaagccccagcac

SEQ ID NO: 2906609 - RNA, 13 nt, Human
gaaagcucuagaa

SEQ ID NO: 2906610 - RNA, 18 nt, Human
gaaagcucuguugcaauu

SEQ ID NO: 2906611 - RNA, 12 nt, Human
gaaagcucuaga

SEQ ID NO: 2906612 - RNA, 17 nt, Human
gaaagcugagaacuccu

SEQ ID NO: 2906613 - RNA, 19 nt, Human
gaaagcugagaacuccuga

SEQ ID NO: 2906614 - RNA, 21 nt, Human
gaaagcugagaacuccugacu

SEQ ID NO: 2906615 - RNA, 22 nt, Human
gaaagcugagaacuccugacug

SEQ ID NO: 2906616 - RNA, 21 nt, Human
gaaagcugguaaacuauuugu

SEQ ID NO: 2906617 - RNA, 17 nt, Human
gaaagcugugaacaggc

SEQ ID NO: 2906618 - RNA, 24 nt, Human
gaaagcugugaacaggcugggcug

SEQ ID NO: 2906619 - RNA, 17 nt, Human
gaaagcuucaaacugca

SEQ ID NO: 2906620 - RNA, 16 nt, Human
gaaagccuuagggaag

SEQ ID NO: 2906621 - RNA, 16 nt, Human
gaaagccucugcugcc

SEQ ID NO: 2906622 - RNA, 22 nt, Human
gaaagccuguaagccugcaagc

SEQ ID NO: 2906623 - RNA, 15 nt, Human
gaaagccucugcugc

SEQ ID NO: 2906624 - RNA, 18 nt, Human
gaaagccucacugauaua

SEQ ID NO: 2906625 - RNA, 20 nt, Human
gaaaaugaauaucuauuaau

SEQ ID NO: 2906626 - RNA, 14 nt, Human
gaaaaugaaaaaca

SEQ ID NO: 2906627 - RNA, 14 nt, Human
gaaaaucuaauauu

SEQ ID NO: 2906628 - RNA, 20 nt, Human
gaaaaucuaauauuaaaaau

SEQ ID NO: 2906629 - RNA, 21 nt, Human
gaaaaucuaauauuaaaaaua

SEQ ID NO: 2906630 - RNA, 23 nt, Human
gaaaaucuaauauuaaaaauaug

SEQ ID NO: 2906631 - RNA, 21 nt, Human
gaaaauauuauguguuuccau

SEQ ID NO: 2906632 - RNA, 19 nt, Human
gaaaagugcauauuuaucc

SEQ ID NO: 2906633 - RNA, 20 nt, Human
gaaaagugcauauuuaucca

SEQ ID NO: 2906634 - RNA, 10 nt, Human
gaaaaguuau

SEQ ID NO: 2906635 - RNA, 16 nt, Human
gaaaagucguuuucca

SEQ ID NO: 2906636 - RNA, 14 nt, Human
gaaaagcuucuuaa

SEQ ID NO: 2906637 - RNA, 16 nt, Human
gaaaagcuucuuaauu

SEQ ID NO: 2906638 - RNA, 18 nt, Human
gaaaagcuucuuaauuaa

SEQ ID NO: 2906639 - RNA, 22 nt, Human
gaaaagcuucuuaauuaauuug

SEQ ID NO: 2906640 - RNA, 23 nt, Human
gaaaagcuucuuaauuaauuuga

SEQ ID NO: 2906641 - RNA, 14 nt, Human
gaaaaggaaaagaa

SEQ ID NO: 2906642 - RNA, 15 nt, Human
gaaaaggaaaagaaa

SEQ ID NO: 2906643 - RNA, 16 nt, Human
gaaaaggaaaagaaaa

SEQ ID NO: 2906644 - RNA, 17 nt, Human
gaaaaggaaaagaaaaa

SEQ ID NO: 2906645 - RNA, 18 nt, Human
gaaaaggaaaagaaaaaa

SEQ ID NO: 2906646 - RNA, 19 nt, Human
gaaaagcugcugacagugu

SEQ ID NO: 2906647 - RNA, 21 nt, Human
gaaaacagucaaccaacccca

SEQ ID NO: 2906648 - RNA, 21 nt, Human
gaaaacagaacaucauuagaa

SEQ ID NO: 2906649 - RNA, 18 nt, Human
cuuuuuguaagugagugu

SEQ ID NO: 2906650 - RNA, 19 nt, Human
cuuuuuguaagugagugug

SEQ ID NO: 2906651 - RNA, 23 nt, Human
cuuuuugguguauagaaguuugu

SEQ ID NO: 2906652 - RNA, 15 nt, Human
cuuuuucuuuuguaa

SEQ ID NO: 2906653 - RNA, 16 nt, Human
cuuuuucuuuuguaag

SEQ ID NO: 2906654 - RNA, 17 nt, Human
cuuuuucuuuuguaagu

SEQ ID NO: 2906655 - RNA, 18 nt, Human
cuuuuucuuuuguaagug

SEQ ID NO: 2906656 - RNA, 13 nt, Human
cuuuuugaaauga

SEQ ID NO: 2906657 - RNA, 15 nt, Human
cuuuuugaaaugaaa

SEQ ID NO: 2906658 - RNA, 17 nt, Human
cuuuuugaaaugaaauu

SEQ ID NO: 2906659 - RNA, 18 nt, Human
cuuuuugaaaugaaauuu

SEQ ID NO: 2906660 - RNA, 22 nt, Human
cuuuuugaaaugaaauuuaaac

SEQ ID NO: 2906661 - RNA, 13 nt, Human
cuuuuugugaaga

SEQ ID NO: 2906662 - RNA, 18 nt, Human
cuuuuugugaaguuaggu

SEQ ID NO: 2906663 - RNA, 21 nt, Human
gaaaaagcuccuguccuccca

SEQ ID NO: 2906664 - RNA, 11 nt, Human
gaaaaagcucc

SEQ ID NO: 2906665 - RNA, 20 nt, Human
gaaaaagcuccaugugccuc

SEQ ID NO: 2906666 - RNA, 19 nt, Human
cuuuuguuacuguucuugc

SEQ ID NO: 2906667 - RNA, 20 nt, Human
cuuuuguuacuguucuugcu

SEQ ID NO: 2906668 - RNA, 21 nt, Human
cuuuuguuacuguucuugcug

SEQ ID NO: 2906669 - RNA, 22 nt, Human
cuuuuguuacuguucuugcugc

SEQ ID NO: 2906670 - RNA, 23 nt, Human
cuuuuguuacuguucuugcugcu

SEQ ID NO: 2906671 - RNA, 22 nt, Human
cuuuuguucagggcugugaucg

SEQ ID NO: 2906672 - RNA, 14 nt, Human
cuuuguuauaccau

SEQ ID NO: 2906673 - RNA, 14 nt, Human
cuuuguguuucuau

SEQ ID NO: 2906674 - RNA, 16 nt, Human
cuuuguuaagguccug

SEQ ID NO: 2906675 - RNA, 23 nt, Human
cuuuguguuucuauugacuucaa

SEQ ID NO: 2906676 - RNA, 17 nt, Human
cuuuguguuugguuuac

SEQ ID NO: 2906677 - RNA, 18 nt, Human
cuuuguguuugguuuaca

SEQ ID NO: 2906678 - RNA, 19 nt, Human
cuuuguguuugguuuacau

SEQ ID NO: 2906679 - RNA, 20 nt, Human
cuuuguguuugguuuacauu

SEQ ID NO: 2906680 - RNA, 21 nt, Human
cuuuguguuugguuuacauuu

SEQ ID NO: 2906681 - RNA, 22 nt, Human
cuuuguguuugguuuacauuua

SEQ ID NO: 2906682 - RNA, 14 nt, Human
cuuuguuaaaaaaa

SEQ ID NO: 2906683 - RNA, 18 nt, Human
cuuuguguguacucacug

SEQ ID NO: 2906684 - RNA, 20 nt, Human
cuuuguggauucugaggccc

SEQ ID NO: 2906685 - RNA, 18 nt, Human
cuuuguguagcuuugcuc

SEQ ID NO: 2906686 - RNA, 22 nt, Human
cuuuguguauuuuucaauaaua

SEQ ID NO: 2906687 - RNA, 11 nt, Human
cuuuguguugg

SEQ ID NO: 2906688 - RNA, 20 nt, Human
cuuuguguugggagggauua

SEQ ID NO: 2906689 - RNA, 13 nt, Human
cuuuguguuguaa

SEQ ID NO: 2906690 - RNA, 14 nt, Human
cuuuguguuguaau

SEQ ID NO: 2906691 - RNA, 15 nt, Human
cuuuguguuguaauu

SEQ ID NO: 2906692 - RNA, 17 nt, Human
cuuuguguuguaauucu

SEQ ID NO: 2906693 - RNA, 22 nt, Human
cuuuguguuguaauucuucagu

SEQ ID NO: 2906694 - RNA, 19 nt, Human
cuuuguggaccaauuauug

SEQ ID NO: 2906695 - RNA, 13 nt, Human
cuuuuucugauua

SEQ ID NO: 2906696 - RNA, 16 nt, Human
cuuuuucugauuagcu

SEQ ID NO: 2906697 - RNA, 18 nt, Human
cuuuuucugauuagcuuu

SEQ ID NO: 2906698 - RNA, 19 nt, Human
cuuuuucugauuagcuuug

SEQ ID NO: 2906699 - RNA, 21 nt, Human
cuuuuucugauuagcuuugug

SEQ ID NO: 2906700 - RNA, 22 nt, Human
cuuuuucugauuagcuuugugu

SEQ ID NO: 2906701 - RNA, 20 nt, Human
cuuuuuauuuauauguacug

SEQ ID NO: 2906702 - RNA, 19 nt, Human
cuuuuuauuuauauguacu

SEQ ID NO: 2906703 - RNA, 13 nt, Human
cuuuuuauuuaua

SEQ ID NO: 2906704 - RNA, 19 nt, Human
cuuuuuauugaaucuauuu

SEQ ID NO: 2906705 - RNA, 14 nt, Human
cuuuuucuguugua

SEQ ID NO: 2906706 - RNA, 15 nt, Human
cuuuuucuguuguaa

SEQ ID NO: 2906707 - RNA, 16 nt, Human
cuuuuucuguuguaac

SEQ ID NO: 2906708 - RNA, 17 nt, Human
cuuuuucuguuguaacu

SEQ ID NO: 2906709 - RNA, 18 nt, Human
cuuuuucuguuguaacuu

SEQ ID NO: 2906710 - RNA, 14 nt, Human
cuuuuucuuccuca

SEQ ID NO: 2906711 - RNA, 13 nt, Human
cuuuuucuuccuc

SEQ ID NO: 2906712 - RNA, 13 nt, Human
cuuuuuauugaau

SEQ ID NO: 2906713 - RNA, 14 nt, Human
cuuuuuauugaauc

SEQ ID NO: 2906714 - RNA, 12 nt, Human
cuuuuuauuuau

SEQ ID NO: 2906715 - RNA, 15 nt, Human
cuuuuuauugaaucu

SEQ ID NO: 2906716 - RNA, 17 nt, Human
cuuuuuauugaaucuau

SEQ ID NO: 2906717 - RNA, 13 nt, Human
cuuuuguucgcau

SEQ ID NO: 2906718 - RNA, 16 nt, Human
cuuguaaauagcucag

SEQ ID NO: 2906719 - RNA, 13 nt, Human
cuuguacaugugu

SEQ ID NO: 2906720 - RNA, 18 nt, Human
cuuguaaauagcucaggu

SEQ ID NO: 2906721 - RNA, 17 nt, Human
cuuguaaauagcucagg

SEQ ID NO: 2906722 - RNA, 18 nt, Human
cuugucaagccugugcaa

SEQ ID NO: 2906723 - RNA, 19 nt, Human
cuugucaagccugugcaaa

SEQ ID NO: 2906724 - RNA, 23 nt, Human
cuugucaagccugugcaaaaaaa

SEQ ID NO: 2906725 - RNA, 15 nt, Human
cuuguauaguguaaa

SEQ ID NO: 2906726 - RNA, 16 nt, Human
cuuguauaguguaaaa

SEQ ID NO: 2906727 - RNA, 17 nt, Human
cuuguauaguguaaaau

SEQ ID NO: 2906728 - RNA, 19 nt, Human
cuuguauaagauccuagau

SEQ ID NO: 2906729 - RNA, 20 nt, Human
cuuguauauacgcaucuaua

SEQ ID NO: 2906730 - RNA, 23 nt, Human
cuuguacauguguagccugugca

SEQ ID NO: 2906731 - RNA, 22 nt, Human
cuuguacccccagguggaaggc

SEQ ID NO: 2906732 - RNA, 18 nt, Human
cuuguaccucuggcugac

SEQ ID NO: 2906733 - RNA, 20 nt, Human
cuuguaccucuggcugacua

SEQ ID NO: 2906734 - RNA, 23 nt, Human
cuuguaccucuggcugacuaaau

SEQ ID NO: 2906735 - RNA, 21 nt, Human
cuuguaguuuaccucuuuaaa

SEQ ID NO: 2906736 - RNA, 13 nt, Human
cuuguauaaaugu

SEQ ID NO: 2906737 - RNA, 14 nt, Human
cuuguauaaaugua

SEQ ID NO: 2906738 - RNA, 15 nt, Human
cuuguauaaauguau

SEQ ID NO: 2906739 - RNA, 17 nt, Human
cuuguauaaauguauau

SEQ ID NO: 2906740 - RNA, 18 nt, Human
cuuguauaaauguauaua

SEQ ID NO: 2906741 - RNA, 19 nt, Human
cuuguauaaauguauauac

SEQ ID NO: 2906742 - RNA, 21 nt, Human
cuuguauaaauguauauacac

SEQ ID NO: 2906743 - RNA, 23 nt, Human
cuuguauaaauguauauacacau

SEQ ID NO: 2906744 - RNA, 14 nt, Human
cuuguacaugugua

SEQ ID NO: 2906745 - RNA, 19 nt, Human
cuuguacauguguagccug

SEQ ID NO: 2906746 - RNA, 20 nt, Human
cuuguacauguguagccugu

SEQ ID NO: 2906747 - RNA, 22 nt, Human
cuuguacauguguagccugugc

SEQ ID NO: 2906748 - RNA, 22 nt, Human
cuuguagcuguaaaacgcuguc

SEQ ID NO: 2906749 - RNA, 21 nt, Human
cuuguaggagcugagguuuca

SEQ ID NO: 2906750 - RNA, 20 nt, Human
cuugugguuuucaaauugga

SEQ ID NO: 2906751 - RNA, 16 nt, Human
cuuguguaauuuaugu

SEQ ID NO: 2906752 - RNA, 18 nt, Human
cuuguguaauuuauguga

SEQ ID NO: 2906753 - RNA, 20 nt, Human
cuuguguaauuuaugugaaa

SEQ ID NO: 2906754 - RNA, 21 nt, Human
cuugucccacgugucuuccac

SEQ ID NO: 2906755 - RNA, 22 nt, Human
cuugucccacgugucuuccacu

SEQ ID NO: 2906756 - RNA, 15 nt, Human
cuuguccacccaccu

SEQ ID NO: 2906757 - RNA, 20 nt, Human
cuuguuauauuaagcagaaa

SEQ ID NO: 2906758 - RNA, 13 nt, Human
cuuguuauuguga

SEQ ID NO: 2906759 - RNA, 14 nt, Human
cuuguuauugugaa

SEQ ID NO: 2906760 - RNA, 15 nt, Human
cuuguuauugugaau

SEQ ID NO: 2906761 - RNA, 16 nt, Human
cuuguuauugugaaug

SEQ ID NO: 2906762 - RNA, 17 nt, Human
cuuguuauugugaauga

SEQ ID NO: 2906763 - RNA, 18 nt, Human
cuuguuauugugaaugau

SEQ ID NO: 2906764 - RNA, 15 nt, Human
cuuguuccaaggcca

SEQ ID NO: 2906765 - RNA, 16 nt, Human
cuuguuccaaggccag

SEQ ID NO: 2906766 - RNA, 17 nt, Human
cuuguuccaaggccagg

SEQ ID NO: 2906767 - RNA, 18 nt, Human
cuuguuccaaugccacau

SEQ ID NO: 2906768 - RNA, 21 nt, Human
cuuguuccaaugccacauacu

SEQ ID NO: 2906769 - RNA, 20 nt, Human
cuuguuccagcccuauucug

SEQ ID NO: 2906770 - RNA, 13 nt, Human
cuuguuccagcuc

SEQ ID NO: 2906771 - RNA, 14 nt, Human
cuuuaaaagugauc

SEQ ID NO: 2906772 - RNA, 22 nt, Human
cuuuaaaagagagagagagaaa

SEQ ID NO: 2906773 - RNA, 21 nt, Human
cuuguuccccacugacagccu

SEQ ID NO: 2906774 - RNA, 16 nt, Human
cuuguuccagcucuuu

SEQ ID NO: 2906775 - RNA, 14 nt, Human
cuuguucccucucc

SEQ ID NO: 2906776 - RNA, 17 nt, Human
cuuuaaacaguauuuca

SEQ ID NO: 2906777 - RNA, 18 nt, Human
cuuuaaacaguauuucau

SEQ ID NO: 2906778 - RNA, 18 nt, Human
cuuuacggacacccccuc

SEQ ID NO: 2906779 - RNA, 21 nt, Human
cuuuacguguuuaaaaaaaag

SEQ ID NO: 2906780 - RNA, 22 nt, Human
cuuuacguguuuaaaaaaaagc

SEQ ID NO: 2906781 - RNA, 13 nt, Human
cuuuacucccaag

SEQ ID NO: 2906782 - RNA, 22 nt, Human
cuuuacucccaagacuucauug

SEQ ID NO: 2906783 - RNA, 14 nt, Human
cuuuacuccucaca

SEQ ID NO: 2906784 - RNA, 17 nt, Human
cuuuacuccucacacuu

SEQ ID NO: 2906785 - RNA, 18 nt, Human
cuuuacuccucacacuua

SEQ ID NO: 2906786 - RNA, 19 nt, Human
cuuuacuccucacacuuac

SEQ ID NO: 2906787 - RNA, 14 nt, Human
cuuuacugacccug

SEQ ID NO: 2906788 - RNA, 16 nt, Human
cuuuacugacccuggg

SEQ ID NO: 2906789 - RNA, 19 nt, Human
cuuuacugacccuggggcu

SEQ ID NO: 2906790 - RNA, 23 nt, Human
cuuuagcaaaaaaaacccaugug

SEQ ID NO: 2906791 - RNA, 18 nt, Human
cuuuagccccucccaagc

SEQ ID NO: 2906792 - RNA, 22 nt, Human
cuuuagccccucccaagcuggc

SEQ ID NO: 2906793 - RNA, 23 nt, Human
cuuuagccccucccaagcuggcu

SEQ ID NO: 2906794 - RNA, 19 nt, Human
cuuuaugauaauagauucu

SEQ ID NO: 2906795 - RNA, 20 nt, Human
cuuuaugauaauagauucuc

SEQ ID NO: 2906796 - RNA, 16 nt, Human
cuuuaugauuuucaua

SEQ ID NO: 2906797 - RNA, 18 nt, Human
cuuuaugauuuucauaac

SEQ ID NO: 2906798 - RNA, 21 nt, Human
cuuuaugauuuucauaacuua

SEQ ID NO: 2906799 - RNA, 22 nt, Human
cuuuaugaaugaaaaaacaguc

SEQ ID NO: 2906800 - RNA, 13 nt, Human
cuuuaucuguucu

SEQ ID NO: 2906801 - RNA, 18 nt, Human
cuuuaucuguucuugcua

SEQ ID NO: 2906802 - RNA, 19 nt, Human
cuuuaucaccuggcuuguu

SEQ ID NO: 2906803 - RNA, 20 nt, Human
cuuuaucaccuggcuuguuu

SEQ ID NO: 2906804 - RNA, 22 nt, Human
cuuuaucaccuggcuuguuuau

SEQ ID NO: 2906805 - RNA, 13 nt, Human
cuuuaucacuuuu

SEQ ID NO: 2906806 - RNA, 17 nt, Human
cuuuaucacuuuuugaa

SEQ ID NO: 2906807 - RNA, 18 nt, Human
cuuuaucacuuuuugaac

SEQ ID NO: 2906808 - RNA, 22 nt, Human
cuuuaucacuuuuugaacuaag

SEQ ID NO: 2906809 - RNA, 13 nt, Human
cuuuauauuuagu

SEQ ID NO: 2906810 - RNA, 15 nt, Human
cuuuauauuuaucca

SEQ ID NO: 2906811 - RNA, 18 nt, Human
cuuuauauuuauccacua

SEQ ID NO: 2906812 - RNA, 12 nt, Human
cuuuauauuuag

SEQ ID NO: 2906813 - RNA, 21 nt, Human
cuuuaucuaauaccucugugu

SEQ ID NO: 2906814 - RNA, 22 nt, Human
cuuuaucuaauaccucugugug

SEQ ID NO: 2906815 - RNA, 15 nt, Human
cuuuagcgcccaguu

SEQ ID NO: 2906816 - RNA, 14 nt, Human
cuuuagcgcccagu

SEQ ID NO: 2906817 - RNA, 20 nt, Human
cuuuauagugcacaaaauga

SEQ ID NO: 2906818 - RNA, 21 nt, Human
cuuuauagugcacaaaaugaa

SEQ ID NO: 2906819 - RNA, 16 nt, Human
cuuuauauacaauaau

SEQ ID NO: 2906820 - RNA, 19 nt, Human
cuuuauauacaauaaugga

SEQ ID NO: 2906821 - RNA, 21 nt, Human
cuuuauauacaauaauggaaa

SEQ ID NO: 2906822 - RNA, 22 nt, Human
cuuuauauacaauaauggaaaa

SEQ ID NO: 2906823 - RNA, 23 nt, Human
cuuuauauacaauaauggaaaaa

SEQ ID NO: 2906824 - RNA, 15 nt, Human
cuuuauauauggaca

SEQ ID NO: 2906825 - RNA, 16 nt, Human
cuuuauauauggacau

SEQ ID NO: 2906826 - RNA, 12 nt, Human
cuuuauacauua

SEQ ID NO: 2906827 - RNA, 14 nt, Human
cuuuauacauuagu

SEQ ID NO: 2906828 - RNA, 19 nt, Human
cuuuauacauuaguaaaug

SEQ ID NO: 2906829 - RNA, 20 nt, Human
cuuuauacauuaguaaaugu

SEQ ID NO: 2906830 - RNA, 22 nt, Human
cuuuauacauuaguaaaugucu

SEQ ID NO: 2906831 - RNA, 23 nt, Human
cuuuauacauuaguaaaugucuu

SEQ ID NO: 2906832 - RNA, 16 nt, Human
cuuucugcuuguguua

SEQ ID NO: 2906833 - RNA, 13 nt, Human
cuuucucuuucuc

SEQ ID NO: 2906834 - RNA, 13 nt, Human
cuuucucucuucc

SEQ ID NO: 2906835 - RNA, 15 nt, Human
cuuucucucuucccu

SEQ ID NO: 2906836 - RNA, 20 nt, Human
cuuucucucagccuuacauu

SEQ ID NO: 2906837 - RNA, 21 nt, Human
cuuucucucagccuuacauuu

SEQ ID NO: 2906838 - RNA, 22 nt, Human
cuuucucucagccuuacauuug

SEQ ID NO: 2906839 - RNA, 13 nt, Human
cuuucucucccca

SEQ ID NO: 2906840 - RNA, 14 nt, Human
cuuucucuccccaa

SEQ ID NO: 2906841 - RNA, 17 nt, Human
cuuucucuccccaaccc

SEQ ID NO: 2906842 - RNA, 18 nt, Human
cuuucucuccccaacccc

SEQ ID NO: 2906843 - RNA, 13 nt, Human
cuuucuguaaacu

SEQ ID NO: 2906844 - RNA, 17 nt, Human
cuuucuguaccauuuau

SEQ ID NO: 2906845 - RNA, 13 nt, Human
cuuucuguauaua

SEQ ID NO: 2906846 - RNA, 11 nt, Human
cuuucuuccuc

SEQ ID NO: 2906847 - RNA, 14 nt, Human
cuuucugggccaag

SEQ ID NO: 2906848 - RNA, 20 nt, Human
cuuucugggcaccggggccu

SEQ ID NO: 2906849 - RNA, 16 nt, Human
cuuucuguaaccauaa

SEQ ID NO: 2906850 - RNA, 13 nt, Human
cuuucuggcucuc

SEQ ID NO: 2906851 - RNA, 12 nt, Human
cuuucccuuccu

SEQ ID NO: 2906852 - RNA, 14 nt, Human
cuuucccuuccucu

SEQ ID NO: 2906853 - RNA, 16 nt, Human
cuuucccuuccucuuc

SEQ ID NO: 2906854 - RNA, 17 nt, Human
cuuucccuuccucuucg

SEQ ID NO: 2906855 - RNA, 17 nt, Human
cuuucccuucaguaccc

SEQ ID NO: 2906856 - RNA, 13 nt, Human
cuuuccaguuaag

SEQ ID NO: 2906857 - RNA, 20 nt, Human
cuuuaugguccuaaaagcaa

SEQ ID NO: 2906858 - RNA, 22 nt, Human
cuuuaugguccuaaaagcaaaa

SEQ ID NO: 2906859 - RNA, 23 nt, Human
cuuuaucacaaccaccguuacaa

SEQ ID NO: 2906860 - RNA, 12 nt, Human
cuuuccauuuug

SEQ ID NO: 2906861 - RNA, 17 nt, Human
cuuuccccuuccuuuua

SEQ ID NO: 2906862 - RNA, 18 nt, Human
cuuuccccuuccuuuuaa

SEQ ID NO: 2906863 - RNA, 15 nt, Human
cuuugucugaaaaau

SEQ ID NO: 2906864 - RNA, 13 nt, Human
cuuugucuuucaa

SEQ ID NO: 2906865 - RNA, 14 nt, Human
cuuugucuuucaaa

SEQ ID NO: 2906866 - RNA, 16 nt, Human
cuuugucuuucaaacu

SEQ ID NO: 2906867 - RNA, 19 nt, Human
cuuuggcuauuagagauca

SEQ ID NO: 2906868 - RNA, 13 nt, Human
cuuuggccugagu

SEQ ID NO: 2906869 - RNA, 14 nt, Human
cuuuggccugaguu

SEQ ID NO: 2906870 - RNA, 15 nt, Human
cuuugcgccugugac

SEQ ID NO: 2906871 - RNA, 23 nt, Human
cuuugccuugggcugcuccucau

SEQ ID NO: 2906872 - RNA, 16 nt, Human
cuuugucaaaaggaag

SEQ ID NO: 2906873 - RNA, 18 nt, Human
cuuugucaucuuucuucu

SEQ ID NO: 2906874 - RNA, 13 nt, Human
cuuuggcucugga

SEQ ID NO: 2906875 - RNA, 14 nt, Human
cuuuggcucuggag

SEQ ID NO: 2906876 - RNA, 15 nt, Human
cuuuggcucuggaga

SEQ ID NO: 2906877 - RNA, 13 nt, Human
cuuuggcuccccu

SEQ ID NO: 2906878 - RNA, 15 nt, Human
cuuuggcuccccugu

SEQ ID NO: 2906879 - RNA, 20 nt, Human
cuuugcagacaggcaagcac

SEQ ID NO: 2906880 - RNA, 13 nt, Human
cuuugcagggcag

SEQ ID NO: 2906881 - RNA, 14 nt, Human
cuuugcagggcagc

SEQ ID NO: 2906882 - RNA, 15 nt, Human
cuuugcagggcagcc

SEQ ID NO: 2906883 - RNA, 17 nt, Human
cuuugcagggcagcccc

SEQ ID NO: 2906884 - RNA, 18 nt, Human
cuuugcagggcagcccca

SEQ ID NO: 2906885 - RNA, 19 nt, Human
cuuugcagggcagccccac

SEQ ID NO: 2906886 - RNA, 16 nt, Human
cuuugcagacaggcaa

SEQ ID NO: 2906887 - RNA, 22 nt, Human
cuuugccuugggcugcuccuca

SEQ ID NO: 2906888 - RNA, 19 nt, Human
cuuugccuugggcugcucc

SEQ ID NO: 2906889 - RNA, 18 nt, Human
cuuugccuugggcugcuc

SEQ ID NO: 2906890 - RNA, 16 nt, Human
cuuugccuugggcugc

SEQ ID NO: 2906891 - RNA, 13 nt, Human
cuuugccuugggc

SEQ ID NO: 2906892 - RNA, 15 nt, Human
cuuugccuucuuuug

SEQ ID NO: 2906893 - RNA, 13 nt, Human
cuuugccuccccg

SEQ ID NO: 2906894 - RNA, 14 nt, Human
cuuugccuccugug

SEQ ID NO: 2906895 - RNA, 22 nt, Human
cuuugccuccuguguacugugu

SEQ ID NO: 2906896 - RNA, 11 nt, Human
cuuugccuggu

SEQ ID NO: 2906897 - RNA, 12 nt, Human
cuuugccuccag

SEQ ID NO: 2906898 - RNA, 21 nt, Human
cuuugccuccagaagcacugg

SEQ ID NO: 2906899 - RNA, 12 nt, Human
cuuucuuccucu

SEQ ID NO: 2906900 - RNA, 13 nt, Human
cuuucuuccucug

SEQ ID NO: 2906901 - RNA, 14 nt, Human
cuuucuuccucugc

SEQ ID NO: 2906902 - RNA, 15 nt, Human
cuuucuuccucugcu

SEQ ID NO: 2906903 - RNA, 13 nt, Human
cuuauuuagagau

SEQ ID NO: 2906904 - RNA, 19 nt, Human
cuuauuuauguuaaaagau

SEQ ID NO: 2906905 - RNA, 19 nt, Human
cuuaucucagucaugcaua

SEQ ID NO: 2906906 - RNA, 20 nt, Human
cuuaucucagucaugcauaa

SEQ ID NO: 2906907 - RNA, 13 nt, Human
cuuauccuuccuc

SEQ ID NO: 2906908 - RNA, 18 nt, Human
cuuauccuuccucuccuu

SEQ ID NO: 2906909 - RNA, 13 nt, Human
cuuauccugcauu

SEQ ID NO: 2906910 - RNA, 14 nt, Human
cuuauccugcauug

SEQ ID NO: 2906911 - RNA, 17 nt, Human
cuuauccugcauuguua

SEQ ID NO: 2906912 - RNA, 19 nt, Human
cuuauccuucaucuuuuaa

SEQ ID NO: 2906913 - RNA, 22 nt, Human
cuuauccuucaucuuuuaaaga

SEQ ID NO: 2906914 - RNA, 20 nt, Human
cuuauuuuaagcauugugag

SEQ ID NO: 2906915 - RNA, 12 nt, Human
cuuauuuuaaug

SEQ ID NO: 2906916 - RNA, 16 nt, Human
cuuauuuuaaugugau

SEQ ID NO: 2906917 - RNA, 17 nt, Human
cuuauuuuaaugugaug

SEQ ID NO: 2906918 - RNA, 15 nt, Human
cuuauuuuauuucca

SEQ ID NO: 2906919 - RNA, 20 nt, Human
cuuauuuuauuuccaucaug

SEQ ID NO: 2906920 - RNA, 15 nt, Human
cuuauuugcuucauu

SEQ ID NO: 2906921 - RNA, 17 nt, Human
cuuauuugcuucauugu

SEQ ID NO: 2906922 - RNA, 23 nt, Human
cuucaacauaacccacuugucac

SEQ ID NO: 2906923 - RNA, 17 nt, Human
cuucaaagcaaaugucu

SEQ ID NO: 2906924 - RNA, 22 nt, Human
cuucaaaauguuaucuucucaa

SEQ ID NO: 2906925 - RNA, 23 nt, Human
cuucaaaauguuaucuucucaag

SEQ ID NO: 2906926 - RNA, 20 nt, Human
cuucaaaauguuaucuucuc

SEQ ID NO: 2906927 - RNA, 15 nt, Human
cuucaaaauguauau

SEQ ID NO: 2906928 - RNA, 19 nt, Human
cuucaaaauguauauauuu

SEQ ID NO: 2906929 - RNA, 20 nt, Human
cuucaaaauguauauauuua

SEQ ID NO: 2906930 - RNA, 15 nt, Human
cuucaauuaauaaaa

SEQ ID NO: 2906931 - RNA, 16 nt, Human
cuucaauuccugggcc

SEQ ID NO: 2906932 - RNA, 15 nt, Human
cuucaauuccugggc

SEQ ID NO: 2906933 - RNA, 13 nt, Human
cuucaaucccagc

SEQ ID NO: 2906934 - RNA, 14 nt, Human
cuucaaucccagcc

SEQ ID NO: 2906935 - RNA, 18 nt, Human
cuucaaugggcucuucca

SEQ ID NO: 2906936 - RNA, 19 nt, Human
cuucaaugggcucuuccaa

SEQ ID NO: 2906937 - RNA, 19 nt, Human
cuucaaguuagcucaggag

SEQ ID NO: 2906938 - RNA, 18 nt, Human
cuucaaguuagcucagga

SEQ ID NO: 2906939 - RNA, 17 nt, Human
cuucaaguuagcucagg

SEQ ID NO: 2906940 - RNA, 16 nt, Human
cuucaaguuagcucag

SEQ ID NO: 2906941 - RNA, 15 nt, Human
cuucaauaaaucuuu

SEQ ID NO: 2906942 - RNA, 20 nt, Human
cuucaauaaaucuuuggaaa

SEQ ID NO: 2906943 - RNA, 20 nt, Human
cuucaaguuagcucaggagg

SEQ ID NO: 2906944 - RNA, 16 nt, Human
cuucaauaauugucca

SEQ ID NO: 2906945 - RNA, 19 nt, Human
cuucaauaguucaaggaac

SEQ ID NO: 2906946 - RNA, 17 nt, Human
cuucacaguagagccag

SEQ ID NO: 2906947 - RNA, 14 nt, Human
cuucacauuaaaaa

SEQ ID NO: 2906948 - RNA, 15 nt, Human
cuucacauuaaaaaa

SEQ ID NO: 2906949 - RNA, 17 nt, Human
cuucacauuaaaaaaug

SEQ ID NO: 2906950 - RNA, 21 nt, Human
cuucacauuccccuggggacc

SEQ ID NO: 2906951 - RNA, 22 nt, Human
cuucacauuccccuggggaccc

SEQ ID NO: 2906952 - RNA, 15 nt, Human
cuucacaguagagcc

SEQ ID NO: 2906953 - RNA, 16 nt, Human
cuucacagcucugugu

SEQ ID NO: 2906954 - RNA, 19 nt, Human
cuucaaggcuucagucuca

SEQ ID NO: 2906955 - RNA, 16 nt, Human
cuucaaggcuuccacu

SEQ ID NO: 2906956 - RNA, 15 nt, Human
cuucaaggugacaga

SEQ ID NO: 2906957 - RNA, 23 nt, Human
cuucaaggugacagaaggaccag

SEQ ID NO: 2906958 - RNA, 15 nt, Human
cuucaacauuuacau

SEQ ID NO: 2906959 - RNA, 16 nt, Human
cuucaacguuucuuca

SEQ ID NO: 2906960 - RNA, 17 nt, Human
cuucaacguuucuucac

SEQ ID NO: 2906961 - RNA, 19 nt, Human
cuucaacguuucuucacuu

SEQ ID NO: 2906962 - RNA, 21 nt, Human
cuucaacguuucuucacuuuu

SEQ ID NO: 2906963 - RNA, 22 nt, Human
cuucaacguuucuucacuuuug

SEQ ID NO: 2906964 - RNA, 20 nt, Human
cuucaaccauuccccauggg

SEQ ID NO: 2906965 - RNA, 13 nt, Human
cuucaacauccug

SEQ ID NO: 2906966 - RNA, 16 nt, Human
cuucaacauccugcca

SEQ ID NO: 2906967 - RNA, 17 nt, Human
cuucaacauccugccag

SEQ ID NO: 2906968 - RNA, 18 nt, Human
cuucaacauccugccagc

SEQ ID NO: 2906969 - RNA, 20 nt, Human
cuucaacauccugccagccc

SEQ ID NO: 2906970 - RNA, 21 nt, Human
cuucaacauccugccagcccc

SEQ ID NO: 2906971 - RNA, 16 nt, Human
cuucaaccauucccca

SEQ ID NO: 2906972 - RNA, 15 nt, Human
cuguucucuucuuca

SEQ ID NO: 2906973 - RNA, 16 nt, Human
cuguucucuucuucau

SEQ ID NO: 2906974 - RNA, 13 nt, Human
cuguucugcacug

SEQ ID NO: 2906975 - RNA, 14 nt, Human
cuguucugcacuga

SEQ ID NO: 2906976 - RNA, 15 nt, Human
cuguucugcacugaa

SEQ ID NO: 2906977 - RNA, 16 nt, Human
cuguucugcacugaaa

SEQ ID NO: 2906978 - RNA, 17 nt, Human
cuguucugcacugaaaa

SEQ ID NO: 2906979 - RNA, 18 nt, Human
cuguucugcacugaaaag

SEQ ID NO: 2906980 - RNA, 14 nt, Human
cuguucugcagaca

SEQ ID NO: 2906981 - RNA, 20 nt, Human
cuguucugggugcagcugag

SEQ ID NO: 2906982 - RNA, 21 nt, Human
cuguguggccacuucugucca

SEQ ID NO: 2906983 - RNA, 14 nt, Human
cuguucugggcucu

SEQ ID NO: 2906984 - RNA, 16 nt, Human
cuguucugcacacagc

SEQ ID NO: 2906985 - RNA, 21 nt, Human
cuguucucuugggaacugaac

SEQ ID NO: 2906986 - RNA, 17 nt, Human
cuuagugguuccccacc

SEQ ID NO: 2906987 - RNA, 13 nt, Human
cuuagugggccag

SEQ ID NO: 2906988 - RNA, 14 nt, Human
cuuagugggccagg

SEQ ID NO: 2906989 - RNA, 17 nt, Human
cuuagugggccagggcu

SEQ ID NO: 2906990 - RNA, 18 nt, Human
cuuagugggccagggcug

SEQ ID NO: 2906991 - RNA, 21 nt, Human
cuuagugggccagggcugccc

SEQ ID NO: 2906992 - RNA, 23 nt, Human
cuuagugggccagggcugcccug

SEQ ID NO: 2906993 - RNA, 20 nt, Human
cuuagucucaguuugugugu

SEQ ID NO: 2906994 - RNA, 23 nt, Human
cuuagucucaguuugugugucuu

SEQ ID NO: 2906995 - RNA, 12 nt, Human
cuuagucucagu

SEQ ID NO: 2906996 - RNA, 13 nt, Human
cuuagucucaguu

SEQ ID NO: 2906997 - RNA, 18 nt, Human
cuuagucucaguuugugu

SEQ ID NO: 2906998 - RNA, 19 nt, Human
cuuagucucaguuugugug

SEQ ID NO: 2906999 - RNA, 21 nt, Human
cuuauccuaaaacaaauaguu

SEQ ID NO: 2907000 - RNA, 21 nt, Human
cuuauccuagcacaugcuuca

SEQ ID NO: 2907001 - RNA, 15 nt, Human
cuuauccagcuggug

SEQ ID NO: 2907002 - RNA, 15 nt, Human
cuuauccauaaaaaa

SEQ ID NO: 2907003 - RNA, 21 nt, Human
cuuauccauaaaaaaaaauag

SEQ ID NO: 2907004 - RNA, 15 nt, Human
cuuaucccugcccau

SEQ ID NO: 2907005 - RNA, 16 nt, Human
cuuaucccugcccauu

SEQ ID NO: 2907006 - RNA, 19 nt, Human
cuuaucccugcccauuuca

SEQ ID NO: 2907007 - RNA, 22 nt, Human
cuuaucccugcccauuucauau

SEQ ID NO: 2907008 - RNA, 21 nt, Human
cuuaucacugcauuauucucu

SEQ ID NO: 2907009 - RNA, 12 nt, Human
cuuaucagagcu

SEQ ID NO: 2907010 - RNA, 13 nt, Human
cuuaucagagcua

SEQ ID NO: 2907011 - RNA, 22 nt, Human
cuuaucagcuacuuaagagaaa

SEQ ID NO: 2907012 - RNA, 23 nt, Human
cuuaucagcuacuuaagagaaau

SEQ ID NO: 2907013 - RNA, 21 nt, Human
cuuaucauccacauuguuuua

SEQ ID NO: 2907014 - RNA, 15 nt, Human
cuuaucauccacauu

SEQ ID NO: 2907015 - RNA, 19 nt, Human
cuuaucauccacauuguuu

SEQ ID NO: 2907016 - RNA, 19 nt, Human
cuuaguuuggauucuuaug

SEQ ID NO: 2907017 - RNA, 22 nt, Human
cuuaguuuggauucuuauguag

SEQ ID NO: 2907018 - RNA, 21 nt, Human
cuuaguguuuuaaaacaccuc

SEQ ID NO: 2907019 - RNA, 16 nt, Human
cuuaguuaucagcuuu

SEQ ID NO: 2907020 - RNA, 19 nt, Human
cuuauauagcagcaaaaau

SEQ ID NO: 2907021 - RNA, 21 nt, Human
cuuauauagcagcaaaaauau

SEQ ID NO: 2907022 - RNA, 15 nt, Human
cuuauagcacuuuga

SEQ ID NO: 2907023 - RNA, 17 nt, Human
cuuauagcacuuugaaa

SEQ ID NO: 2907024 - RNA, 20 nt, Human
cuuauagcacuuugaaauac

SEQ ID NO: 2907025 - RNA, 22 nt, Human
cuuauagcacuuugaaauaccu

SEQ ID NO: 2907026 - RNA, 16 nt, Human
cuuauaguucuaggca

SEQ ID NO: 2907027 - RNA, 16 nt, Human
cuuauaguuugggcuu

SEQ ID NO: 2907028 - RNA, 17 nt, Human
cuuauaguuugggcuuc

SEQ ID NO: 2907029 - RNA, 20 nt, Human
cuuauaguuugggcuucagc

SEQ ID NO: 2907030 - RNA, 23 nt, Human
cuuauaguuugggcuucagccua

SEQ ID NO: 2907031 - RNA, 19 nt, Human
cuuauacgcuuuucuuugu

SEQ ID NO: 2907032 - RNA, 15 nt, Human
cuuauacuguacaau

SEQ ID NO: 2907033 - RNA, 16 nt, Human
cuuauacuguacaaua

SEQ ID NO: 2907034 - RNA, 18 nt, Human
cuuauacuguacaauaaa

SEQ ID NO: 2907035 - RNA, 19 nt, Human
cuuauacuguacaauaaaa

SEQ ID NO: 2907036 - RNA, 14 nt, Human
cuuauagacaacau

SEQ ID NO: 2907037 - RNA, 15 nt, Human
cuucagggagugagg

SEQ ID NO: 2907038 - RNA, 14 nt, Human
cuucagggcaggug

SEQ ID NO: 2907039 - RNA, 15 nt, Human
cuucagggcaggugg

SEQ ID NO: 2907040 - RNA, 16 nt, Human
cuucagggcagguggg

SEQ ID NO: 2907041 - RNA, 13 nt, Human
cuucagggccugg

SEQ ID NO: 2907042 - RNA, 15 nt, Human
cuucagggccugguu

SEQ ID NO: 2907043 - RNA, 15 nt, Human
cuucaggcugccuaa

SEQ ID NO: 2907044 - RNA, 21 nt, Human
cuucaggcuuccugcaauuuu

SEQ ID NO: 2907045 - RNA, 22 nt, Human
cuucaggcucuucuccuuucac

SEQ ID NO: 2907046 - RNA, 19 nt, Human
cuucaccuaagucucugug

SEQ ID NO: 2907047 - RNA, 18 nt, Human
cuucaccuaagucucugu

SEQ ID NO: 2907048 - RNA, 19 nt, Human
cuucaggcucuucuccuuu

SEQ ID NO: 2907049 - RNA, 18 nt, Human
cuucaccccaaucccagc

SEQ ID NO: 2907050 - RNA, 14 nt, Human
cuucacccaggccu

SEQ ID NO: 2907051 - RNA, 15 nt, Human
cuucacccaggccua

SEQ ID NO: 2907052 - RNA, 17 nt, Human
cuucacccaggccuaug

SEQ ID NO: 2907053 - RNA, 21 nt, Human
cuucacccaggccuauguuga

SEQ ID NO: 2907054 - RNA, 19 nt, Human
cuucaccagagcauuucca

SEQ ID NO: 2907055 - RNA, 15 nt, Human
cuucaccccccacuc

SEQ ID NO: 2907056 - RNA, 14 nt, Human
cuucaccccggcag

SEQ ID NO: 2907057 - RNA, 15 nt, Human
cuucaccccggcagg

SEQ ID NO: 2907058 - RNA, 17 nt, Human
cuucaccccggcaggcc

SEQ ID NO: 2907059 - RNA, 18 nt, Human
cuucaccccggcaggccc

SEQ ID NO: 2907060 - RNA, 19 nt, Human
cuucaccccggcaggcccu

SEQ ID NO: 2907061 - RNA, 20 nt, Human
cuucaccccggcaggcccug

SEQ ID NO: 2907062 - RNA, 21 nt, Human
cuucaccccggcaggcccugc

SEQ ID NO: 2907063 - RNA, 22 nt, Human
cuucaccccggcaggcccugca

SEQ ID NO: 2907064 - RNA, 23 nt, Human
cuucaccccggcaggcccugcag

SEQ ID NO: 2907065 - RNA, 14 nt, Human
cuucaccccagugg

SEQ ID NO: 2907066 - RNA, 19 nt, Human
cuucaccccaguggccacu

SEQ ID NO: 2907067 - RNA, 23 nt, Human
cuucaccccaguggccacucagc

SEQ ID NO: 2907068 - RNA, 15 nt, Human
cuucacccugaguuu

SEQ ID NO: 2907069 - RNA, 16 nt, Human
cuucaguggcagcugc

SEQ ID NO: 2907070 - RNA, 15 nt, Human
cuucaguggcagcug

SEQ ID NO: 2907071 - RNA, 14 nt, Human
cuucaguggcagcu

SEQ ID NO: 2907072 - RNA, 13 nt, Human
cuucaguggcagc

SEQ ID NO: 2907073 - RNA, 19 nt, Human
cuucaguacccucucagcu

SEQ ID NO: 2907074 - RNA, 22 nt, Human
cuucaguacccucucagcucca

SEQ ID NO: 2907075 - RNA, 23 nt, Human
cuucaguacccucucagcuccag

SEQ ID NO: 2907076 - RNA, 17 nt, Human
cuucaguggcagcugcu

SEQ ID NO: 2907077 - RNA, 19 nt, Human
cuucauucaauauugacau

SEQ ID NO: 2907078 - RNA, 20 nt, Human
cuucauucaauauugacauu

SEQ ID NO: 2907079 - RNA, 22 nt, Human
cuucauucaauauugacauuug

SEQ ID NO: 2907080 - RNA, 17 nt, Human
cuucauuccuuccacua

SEQ ID NO: 2907081 - RNA, 13 nt, Human
cuucauucuauca

SEQ ID NO: 2907082 - RNA, 18 nt, Human
cuucauucuaucaagccc

SEQ ID NO: 2907083 - RNA, 13 nt, Human
cuucauucuccuu

SEQ ID NO: 2907084 - RNA, 22 nt, Human
cuucauucuccuuguuguuggu

SEQ ID NO: 2907085 - RNA, 12 nt, Human
cuucauucucgu

SEQ ID NO: 2907086 - RNA, 14 nt, Human
cuucauucucguga

SEQ ID NO: 2907087 - RNA, 22 nt, Human
cuucauucucgugagucauuua

SEQ ID NO: 2907088 - RNA, 18 nt, Human
cuucauucugagaccaaa

SEQ ID NO: 2907089 - RNA, 15 nt, Human
cuucauucugcaggg

SEQ ID NO: 2907090 - RNA, 14 nt, Human
cuucauugagaguu

SEQ ID NO: 2907091 - RNA, 17 nt, Human
cuucaguggagaauuau

SEQ ID NO: 2907092 - RNA, 21 nt, Human
cuucauugagaguuuugucuu

SEQ ID NO: 2907093 - RNA, 22 nt, Human
cuucauuguacuaccuguguau

SEQ ID NO: 2907094 - RNA, 23 nt, Human
cuucauuguacuaccuguguaua

SEQ ID NO: 2907095 - RNA, 15 nt, Human
cuucauugucccucu

SEQ ID NO: 2907096 - RNA, 16 nt, Human
cuucauugucccucuu

SEQ ID NO: 2907097 - RNA, 17 nt, Human
cuucauugucccucuuc

SEQ ID NO: 2907098 - RNA, 19 nt, Human
cuucauugucccucuucac

SEQ ID NO: 2907099 - RNA, 20 nt, Human
cuucauugucccucuucacu

SEQ ID NO: 2907100 - RNA, 21 nt, Human
cuucauugucccucuucacuc

SEQ ID NO: 2907101 - RNA, 23 nt, Human
cuucauugagaguuuugucuuga

SEQ ID NO: 2907102 - RNA, 17 nt, Human
cuucauugauuuccugu

SEQ ID NO: 2907103 - RNA, 18 nt, Human
cuucauugauuuccugug

SEQ ID NO: 2907104 - RNA, 20 nt, Human
cuucauugauuuccuguguc

SEQ ID NO: 2907105 - RNA, 21 nt, Human
cuucauugauuuccuguguca

SEQ ID NO: 2907106 - RNA, 13 nt, Human
cuucauuuaaaaa

SEQ ID NO: 2907107 - RNA, 14 nt, Human
cuucauuuaaaaaa

SEQ ID NO: 2907108 - RNA, 19 nt, Human
cuucauuuaaaaaaaucac

SEQ ID NO: 2907109 - RNA, 9 nt, Human
cuucagggc

SEQ ID NO: 2907110 - RNA, 15 nt, Human
cuuccaggaccccug

SEQ ID NO: 2907111 - RNA, 17 nt, Human
cuuccaggaccccuggg

SEQ ID NO: 2907112 - RNA, 17 nt, Human
cuuccaggaugguguua

SEQ ID NO: 2907113 - RNA, 19 nt, Human
cuuccaggcccccaccacu

SEQ ID NO: 2907114 - RNA, 19 nt, Human
cuuccagggacgaagaaga

SEQ ID NO: 2907115 - RNA, 16 nt, Human
cuuccaggcccccacc

SEQ ID NO: 2907116 - RNA, 22 nt, Human
cuuccagggacgaagaagagcc

SEQ ID NO: 2907117 - RNA, 15 nt, Human
cuuccaggggaaccu

SEQ ID NO: 2907118 - RNA, 19 nt, Human
cuuccaggggaaccugcca

SEQ ID NO: 2907119 - RNA, 16 nt, Human
cuuccaggggaaccug

SEQ ID NO: 2907120 - RNA, 12 nt, Human
cuuccccucacu

SEQ ID NO: 2907121 - RNA, 16 nt, Human
cuuccccucccuggcu

SEQ ID NO: 2907122 - RNA, 14 nt, Human
cuuccccucccugg

SEQ ID NO: 2907123 - RNA, 13 nt, Human
cuucccccuucca

SEQ ID NO: 2907124 - RNA, 16 nt, Human
cuucccccuuuuuugu

SEQ ID NO: 2907125 - RNA, 18 nt, Human
cuucccccuuuuuugucc

SEQ ID NO: 2907126 - RNA, 20 nt, Human
cuuccccucccuggcuccca

SEQ ID NO: 2907127 - RNA, 18 nt, Human
cuuccccucccuggcucc

SEQ ID NO: 2907128 - RNA, 13 nt, Human
cuuccccuucccu

SEQ ID NO: 2907129 - RNA, 23 nt, Human
cuucccaguucaggagucccaag

SEQ ID NO: 2907130 - RNA, 20 nt, Human
cuucccaguggcugcugccc

SEQ ID NO: 2907131 - RNA, 20 nt, Human
cuucccauaccacccaaugc

SEQ ID NO: 2907132 - RNA, 22 nt, Human
cuucccaguucaggagucccaa

SEQ ID NO: 2907133 - RNA, 18 nt, Human
cuucccaguggcugcugc

SEQ ID NO: 2907134 - RNA, 19 nt, Human
cuucccaguggcugcugcc

SEQ ID NO: 2907135 - RNA, 15 nt, Human
cuucccaguggcugc

SEQ ID NO: 2907136 - RNA, 17 nt, Human
cuucccaguggcugcug

SEQ ID NO: 2907137 - RNA, 13 nt, Human
cuuccagggggaa

SEQ ID NO: 2907138 - RNA, 20 nt, Human
cuuccagggggaaggccaag

SEQ ID NO: 2907139 - RNA, 15 nt, Human
cuucccaucgcuguc

SEQ ID NO: 2907140 - RNA, 15 nt, Human
cuucccaugacccag

SEQ ID NO: 2907141 - RNA, 17 nt, Human
cuucccaugacccaggc

SEQ ID NO: 2907142 - RNA, 19 nt, Human
cuucccaugacccaggcug

SEQ ID NO: 2907143 - RNA, 20 nt, Human
cuucccaugacccaggcugg

SEQ ID NO: 2907144 - RNA, 21 nt, Human
cuucccaugacccaggcuggg

SEQ ID NO: 2907145 - RNA, 16 nt, Human
cuucccccucccaggg

SEQ ID NO: 2907146 - RNA, 16 nt, Human
cuucccuaaaaucagg

SEQ ID NO: 2907147 - RNA, 16 nt, Human
cuucccuaacacuuac

SEQ ID NO: 2907148 - RNA, 23 nt, Human
cuucccgcucagcccucccugcc

SEQ ID NO: 2907149 - RNA, 18 nt, Human
cuucccgcucagcccucc

SEQ ID NO: 2907150 - RNA, 19 nt, Human
cuucccgcucagcccuccc

SEQ ID NO: 2907151 - RNA, 13 nt, Human
cuucccuuucugc

SEQ ID NO: 2907152 - RNA, 12 nt, Human
cuucccuugcca

SEQ ID NO: 2907153 - RNA, 14 nt, Human
cuucccuugccacu

SEQ ID NO: 2907154 - RNA, 15 nt, Human
cuucccuugccacuu

SEQ ID NO: 2907155 - RNA, 16 nt, Human
cuucccuugccacuuu

SEQ ID NO: 2907156 - RNA, 17 nt, Human
cuucccuugccacuuug

SEQ ID NO: 2907157 - RNA, 18 nt, Human
cuucccuugccacuuugc

SEQ ID NO: 2907158 - RNA, 19 nt, Human
cuucccuugccacuuugca

SEQ ID NO: 2907159 - RNA, 20 nt, Human
cuucccuugccacuuugcac

SEQ ID NO: 2907160 - RNA, 15 nt, Human
cuucccuuccacugc

SEQ ID NO: 2907161 - RNA, 16 nt, Human
cuucccuuccacugcc

SEQ ID NO: 2907162 - RNA, 17 nt, Human
cuucccuuccacugccu

SEQ ID NO: 2907163 - RNA, 20 nt, Human
cuucccuuccacugccucug

SEQ ID NO: 2907164 - RNA, 22 nt, Human
cuucccuuccacugccucugcc

SEQ ID NO: 2907165 - RNA, 23 nt, Human
cuucccuuccacugccucugccu

SEQ ID NO: 2907166 - RNA, 13 nt, Human
cuuccucccucau

SEQ ID NO: 2907167 - RNA, 13 nt, Human
cuuccuccagcug

SEQ ID NO: 2907168 - RNA, 15 nt, Human
cuuccuccagcugca

SEQ ID NO: 2907169 - RNA, 17 nt, Human
cuuccuccagcugcacc

SEQ ID NO: 2907170 - RNA, 18 nt, Human
cuuccuccagcugcacca

SEQ ID NO: 2907171 - RNA, 20 nt, Human
cuuccuccagcugcaccaga

SEQ ID NO: 2907172 - RNA, 22 nt, Human
cuuccuccagcugcaccagagc

SEQ ID NO: 2907173 - RNA, 23 nt, Human
cuuccucauccaccccaucccuc

SEQ ID NO: 2907174 - RNA, 18 nt, Human
cuuccucauccaccccau

SEQ ID NO: 2907175 - RNA, 22 nt, Human
cuuccucauccaccccaucccu

SEQ ID NO: 2907176 - RNA, 15 nt, Human
cuuccuaagccugug

SEQ ID NO: 2907177 - RNA, 16 nt, Human
cuuccuaagccugugg

SEQ ID NO: 2907178 - RNA, 18 nt, Human
cuuccuaagccuguggcu

SEQ ID NO: 2907179 - RNA, 20 nt, Human
cuuccuaagccuguggcugu

SEQ ID NO: 2907180 - RNA, 16 nt, Human
cuucccuuuccccagc

SEQ ID NO: 2907181 - RNA, 19 nt, Human
cuuccgguagggaggcagc

SEQ ID NO: 2907182 - RNA, 20 nt, Human
cuuccgguagggaggcagcc

SEQ ID NO: 2907183 - RNA, 21 nt, Human
cuuccgguagggaggcagccu

SEQ ID NO: 2907184 - RNA, 22 nt, Human
cuuccgguagggaggcagccuc

SEQ ID NO: 2907185 - RNA, 23 nt, Human
cuuccgguagggaggcagccucc

SEQ ID NO: 2907186 - RNA, 19 nt, Human
cuuccuaauuccacagcug

SEQ ID NO: 2907187 - RNA, 18 nt, Human
cuuccuaauuccacagcu

SEQ ID NO: 2907188 - RNA, 17 nt, Human
cuuccuaauuccacagc

SEQ ID NO: 2907189 - RNA, 13 nt, Human
cuuccuaauucca

SEQ ID NO: 2907190 - RNA, 21 nt, Human
cuucuguccuacucuguguca

SEQ ID NO: 2907191 - RNA, 19 nt, Human
cuucuguccuacucugugu

SEQ ID NO: 2907192 - RNA, 18 nt, Human
cuucuguccuacucugug

SEQ ID NO: 2907193 - RNA, 17 nt, Human
cuucuguccuacucugu

SEQ ID NO: 2907194 - RNA, 16 nt, Human
cuucuguccuacucug

SEQ ID NO: 2907195 - RNA, 20 nt, Human
cuucuguacgucugacaggc

SEQ ID NO: 2907196 - RNA, 18 nt, Human
cuucuguacgucugacag

SEQ ID NO: 2907197 - RNA, 15 nt, Human
cuucuguacgucuga

SEQ ID NO: 2907198 - RNA, 14 nt, Human
cuucuguacgucug

SEQ ID NO: 2907199 - RNA, 21 nt, Human
cuucuguacgucugacaggca

SEQ ID NO: 2907200 - RNA, 19 nt, Human
cuucugguuuaaacuuguu

SEQ ID NO: 2907201 - RNA, 15 nt, Human
cuucugucccucaca

SEQ ID NO: 2907202 - RNA, 14 nt, Human
cuucugucccucac

SEQ ID NO: 2907203 - RNA, 18 nt, Human
cuucuguauacuguggag

SEQ ID NO: 2907204 - RNA, 12 nt, Human
cuucuguauaua

SEQ ID NO: 2907205 - RNA, 16 nt, Human
cuucuguauauaaaug

SEQ ID NO: 2907206 - RNA, 17 nt, Human
cuucuguauauaaaugg

SEQ ID NO: 2907207 - RNA, 18 nt, Human
cuucuguauauaaauggg

SEQ ID NO: 2907208 - RNA, 20 nt, Human
cuucuguauauaaaugggaa

SEQ ID NO: 2907209 - RNA, 21 nt, Human
cuucuguauauaaaugggaac

SEQ ID NO: 2907210 - RNA, 13 nt, Human
cuucugcuucagc

SEQ ID NO: 2907211 - RNA, 23 nt, Human
cuucugcuccacccuuggccugu

SEQ ID NO: 2907212 - RNA, 21 nt, Human
cuucugcuccacccuuggccu

SEQ ID NO: 2907213 - RNA, 19 nt, Human
cuucugcuccacccuuggc

SEQ ID NO: 2907214 - RNA, 17 nt, Human
cuucugcuccacccuug

SEQ ID NO: 2907215 - RNA, 15 nt, Human
cuucugcuccacccu

SEQ ID NO: 2907216 - RNA, 18 nt, Human
cuucugccuuagucucag

SEQ ID NO: 2907217 - RNA, 23 nt, Human
cuucugcccaauuggaggaaagc

SEQ ID NO: 2907218 - RNA, 18 nt, Human
cuucugcccucccuggag

SEQ ID NO: 2907219 - RNA, 14 nt, Human
cuucuggggcaggc

SEQ ID NO: 2907220 - RNA, 20 nt, Human
cuucuggggcaggcugggcc

SEQ ID NO: 2907221 - RNA, 19 nt, Human
cuucuggggcaggcugggc

SEQ ID NO: 2907222 - RNA, 16 nt, Human
cuucuggggcaggcug

SEQ ID NO: 2907223 - RNA, 15 nt, Human
cuucuggggcaggcu

SEQ ID NO: 2907224 - RNA, 22 nt, Human
cuucuggggcaggcugggccau

SEQ ID NO: 2907225 - RNA, 11 nt, Human
cuucugggguc

SEQ ID NO: 2907226 - RNA, 16 nt, Human
cuucugggguccccag

SEQ ID NO: 2907227 - RNA, 17 nt, Human
cuucugggguccccagg

SEQ ID NO: 2907228 - RNA, 19 nt, Human
cuucugggguccccagggc

SEQ ID NO: 2907229 - RNA, 20 nt, Human
cuucugggguccccagggcu

SEQ ID NO: 2907230 - RNA, 21 nt, Human
cuucuggggcaggcugggcca

SEQ ID NO: 2907231 - RNA, 23 nt, Human
cuucuggguuccuuccucugagc

SEQ ID NO: 2907232 - RNA, 17 nt, Human
cuucuggguuccuuccu

SEQ ID NO: 2907233 - RNA, 16 nt, Human
cuucuggguuccuucc

SEQ ID NO: 2907234 - RNA, 14 nt, Human
cuucugguugaugc

SEQ ID NO: 2907235 - RNA, 13 nt, Human
cuucucucccugc

SEQ ID NO: 2907236 - RNA, 15 nt, Human
cuucucucccugcca

SEQ ID NO: 2907237 - RNA, 21 nt, Human
cuucuccuggaguugcauuga

SEQ ID NO: 2907238 - RNA, 12 nt, Human
cuucucugaaca

SEQ ID NO: 2907239 - RNA, 13 nt, Human
cuucucugaacac

SEQ ID NO: 2907240 - RNA, 15 nt, Human
cuucucugaacacag

SEQ ID NO: 2907241 - RNA, 16 nt, Human
cuucucugaacacagg

SEQ ID NO: 2907242 - RNA, 17 nt, Human
cuucucugaacacaggc

SEQ ID NO: 2907243 - RNA, 18 nt, Human
cuucucugaacacaggca

SEQ ID NO: 2907244 - RNA, 19 nt, Human
cuucucugaacacaggcag

SEQ ID NO: 2907245 - RNA, 20 nt, Human
cuucucugaacacaggcagc

SEQ ID NO: 2907246 - RNA, 21 nt, Human
cuucucugaacacaggcagcu

SEQ ID NO: 2907247 - RNA, 22 nt, Human
cuucucugaacacaggcagcuu

SEQ ID NO: 2907248 - RNA, 23 nt, Human
cuucucugaacacaggcagcuuu

SEQ ID NO: 2907249 - RNA, 13 nt, Human
cuucucugaagga

SEQ ID NO: 2907250 - RNA, 22 nt, Human
cuuccugggucuucagcauucc

SEQ ID NO: 2907251 - RNA, 18 nt, Human
cuucuccuccccacccgc

SEQ ID NO: 2907252 - RNA, 13 nt, Human
cuucuccacugga

SEQ ID NO: 2907253 - RNA, 14 nt, Human
cuucuccacuggau

SEQ ID NO: 2907254 - RNA, 15 nt, Human
cuucuccacuggaug

SEQ ID NO: 2907255 - RNA, 23 nt, Human
cuuccuggggcaucuggcgaauc

SEQ ID NO: 2907256 - RNA, 20 nt, Human
cuuccuggggcaucuggcga

SEQ ID NO: 2907257 - RNA, 13 nt, Human
cuucuccaggcug

SEQ ID NO: 2907258 - RNA, 12 nt, Human
cuucuccaggcu

SEQ ID NO: 2907259 - RNA, 13 nt, Human
cuucuccagauuu

SEQ ID NO: 2907260 - RNA, 17 nt, Human
cuucuccacuggaugga

SEQ ID NO: 2907261 - RNA, 13 nt, Human
cuucuccguccuc

SEQ ID NO: 2907262 - RNA, 22 nt, Human
cuucucccucauuucaggagca

SEQ ID NO: 2907263 - RNA, 14 nt, Human
cuucuguucugcag

SEQ ID NO: 2907264 - RNA, 13 nt, Human
cuucuugucagac

SEQ ID NO: 2907265 - RNA, 14 nt, Human
cuucuugucagaca

SEQ ID NO: 2907266 - RNA, 16 nt, Human
cuucuugucagacaua

SEQ ID NO: 2907267 - RNA, 18 nt, Human
cuucuugucagacauaaa

SEQ ID NO: 2907268 - RNA, 19 nt, Human
cuucuugucagacauaaag

SEQ ID NO: 2907269 - RNA, 20 nt, Human
cuucuugucagacauaaagc

SEQ ID NO: 2907270 - RNA, 21 nt, Human
cuucuugucagacauaaagcc

SEQ ID NO: 2907271 - RNA, 22 nt, Human
cuucuugucagacauaaagcca

SEQ ID NO: 2907272 - RNA, 12 nt, Human
cuucuugugaag

SEQ ID NO: 2907273 - RNA, 13 nt, Human
cuucuugugaagg

SEQ ID NO: 2907274 - RNA, 13 nt, Human
cuucuuguucccc

SEQ ID NO: 2907275 - RNA, 20 nt, Human
cuucuuuaaucacuuaacau

SEQ ID NO: 2907276 - RNA, 21 nt, Human
cuucuuggggguaagcugauu

SEQ ID NO: 2907277 - RNA, 13 nt, Human
cuucuguguaucu

SEQ ID NO: 2907278 - RNA, 22 nt, Human
cuucuguguaucucuuucacau

SEQ ID NO: 2907279 - RNA, 14 nt, Human
cuucuguguuuaua

SEQ ID NO: 2907280 - RNA, 11 nt, Human
cuucuguguuu

SEQ ID NO: 2907281 - RNA, 15 nt, Human
cuucuguggcucaca

SEQ ID NO: 2907282 - RNA, 22 nt, Human
cuucuguggcucacagaacccu

SEQ ID NO: 2907283 - RNA, 14 nt, Human
cuucugugaaagua

SEQ ID NO: 2907284 - RNA, 19 nt, Human
cuucugugagacccccaca

SEQ ID NO: 2907285 - RNA, 16 nt, Human
cuucuguccugugagg

SEQ ID NO: 2907286 - RNA, 14 nt, Human
cuucugugaugagc

SEQ ID NO: 2907287 - RNA, 22 nt, Human
cuucugugagacccccacaccu

SEQ ID NO: 2907288 - RNA, 21 nt, Human
cuucugugagacccccacacc

SEQ ID NO: 2907289 - RNA, 20 nt, Human
cuucugugagacccccacac

SEQ ID NO: 2907290 - RNA, 19 nt, Human
cuucugugaugagcugauc

SEQ ID NO: 2907291 - RNA, 16 nt, Human
cuucugugaugagcug

SEQ ID NO: 2907292 - RNA, 15 nt, Human
cuucugugaugagcu

SEQ ID NO: 2907293 - RNA, 17 nt, Human
cuucugugaugagcuga

SEQ ID NO: 2907294 - RNA, 13 nt, Human
cuucuguggcuca

SEQ ID NO: 2907295 - RNA, 17 nt, Human
cuucuuuuuuugugaug

SEQ ID NO: 2907296 - RNA, 16 nt, Human
cuucuuuuuuuucauu

SEQ ID NO: 2907297 - RNA, 12 nt, Human
cuugaaaaauac

SEQ ID NO: 2907298 - RNA, 20 nt, Human
cuugaaaaauacuuuuccuu

SEQ ID NO: 2907299 - RNA, 21 nt, Human
cuugaaaaauacuuuuccuua

SEQ ID NO: 2907300 - RNA, 15 nt, Human
cuugaaaaggguguu

SEQ ID NO: 2907301 - RNA, 16 nt, Human
cuugaaaauaagaaua

SEQ ID NO: 2907302 - RNA, 11 nt, Human
cuugaacaaaa

SEQ ID NO: 2907303 - RNA, 14 nt, Human
cuugaacaaaaggg

SEQ ID NO: 2907304 - RNA, 15 nt, Human
cuugaacaaaagggu

SEQ ID NO: 2907305 - RNA, 17 nt, Human
cuugaacaaaaggguca

SEQ ID NO: 2907306 - RNA, 19 nt, Human
cuugaacaaaagggucaga

SEQ ID NO: 2907307 - RNA, 20 nt, Human
cuugaacaaaagggucagag

SEQ ID NO: 2907308 - RNA, 22 nt, Human
cuugaacaaaagggucagagga

SEQ ID NO: 2907309 - RNA, 17 nt, Human
cuugaacaaaaucuguu

SEQ ID NO: 2907310 - RNA, 18 nt, Human
cuugaacaaaaucuguug

SEQ ID NO: 2907311 - RNA, 20 nt, Human
cuugaacaaaaucuguugcc

SEQ ID NO: 2907312 - RNA, 14 nt, Human
cuugaaagaauuuu

SEQ ID NO: 2907313 - RNA, 17 nt, Human
cuugaaagaauuuuccu

SEQ ID NO: 2907314 - RNA, 22 nt, Human
cuugaaaauaagaauagaaaua

SEQ ID NO: 2907315 - RNA, 20 nt, Human
cuugaaaauauaugauggcu

SEQ ID NO: 2907316 - RNA, 23 nt, Human
cuugaaaauauuuuuuauauaua

SEQ ID NO: 2907317 - RNA, 20 nt, Human
cuugaggguugggcuggugu

SEQ ID NO: 2907318 - RNA, 19 nt, Human
cuugaggguugggcuggug

SEQ ID NO: 2907319 - RNA, 21 nt, Human
cuugaggguugggcugguguc

SEQ ID NO: 2907320 - RNA, 12 nt, Human
cuugagcuggcc

SEQ ID NO: 2907321 - RNA, 13 nt, Human
cuugagcuggccu

SEQ ID NO: 2907322 - RNA, 23 nt, Human
cuugagcuggccucucuagcaca

SEQ ID NO: 2907323 - RNA, 17 nt, Human
cuugagcuggccucucu

SEQ ID NO: 2907324 - RNA, 16 nt, Human
cuugagcuggccucuc

SEQ ID NO: 2907325 - RNA, 14 nt, Human
cuugagcuggccuc

SEQ ID NO: 2907326 - RNA, 20 nt, Human
cuugagcuuggcagcugaac

SEQ ID NO: 2907327 - RNA, 12 nt, Human
cuugagcuuggc

SEQ ID NO: 2907328 - RNA, 20 nt, Human
cuugaggaaacaacagcuuu

SEQ ID NO: 2907329 - RNA, 18 nt, Human
cuugaggaaacaacagcu

SEQ ID NO: 2907330 - RNA, 13 nt, Human
cuugaggaaacaa

SEQ ID NO: 2907331 - RNA, 21 nt, Human
cuugagcuuggcagcugaacu

SEQ ID NO: 2907332 - RNA, 19 nt, Human
cuugacuucaguuauuggu

SEQ ID NO: 2907333 - RNA, 17 nt, Human
cuugacuugauuagugc

SEQ ID NO: 2907334 - RNA, 19 nt, Human
cuugacuuugaacuaauga

SEQ ID NO: 2907335 - RNA, 15 nt, Human
cuugacucaggauuu

SEQ ID NO: 2907336 - RNA, 16 nt, Human
cuugacucaggauuua

SEQ ID NO: 2907337 - RNA, 21 nt, Human
cuugacucccaaguuuccaua

SEQ ID NO: 2907338 - RNA, 18 nt, Human
cuugaccuguuucucugc

SEQ ID NO: 2907339 - RNA, 12 nt, Human
cuugaccuuccu

SEQ ID NO: 2907340 - RNA, 13 nt, Human
cuugaccuuccuc

SEQ ID NO: 2907341 - RNA, 14 nt, Human
cuugaccuuccucu

SEQ ID NO: 2907342 - RNA, 17 nt, Human
cuugaccuuccucuggg

SEQ ID NO: 2907343 - RNA, 18 nt, Human
cuugaccuuccucugggg

SEQ ID NO: 2907344 - RNA, 21 nt, Human
cuugaccuuccucuggggcuc

SEQ ID NO: 2907345 - RNA, 22 nt, Human
cuugaccuuccucuggggcucu

SEQ ID NO: 2907346 - RNA, 15 nt, Human
cuugaccuuguagag

SEQ ID NO: 2907347 - RNA, 13 nt, Human
cuugaccuuugua

SEQ ID NO: 2907348 - RNA, 14 nt, Human
cuugaccuuuguac

SEQ ID NO: 2907349 - RNA, 16 nt, Human
cuugaccuuuguacag

SEQ ID NO: 2907350 - RNA, 17 nt, Human
cuugaccuuuguacagc

SEQ ID NO: 2907351 - RNA, 21 nt, Human
cuugaccuuuguacagcccag

SEQ ID NO: 2907352 - RNA, 22 nt, Human
cuugaccuuuguacagcccaga

SEQ ID NO: 2907353 - RNA, 13 nt, Human
cuugaccucaggu

SEQ ID NO: 2907354 - RNA, 13 nt, Human
cuugaacuccugg

SEQ ID NO: 2907355 - RNA, 16 nt, Human
cuugaacuccugaccu

SEQ ID NO: 2907356 - RNA, 13 nt, Human
cuugaacuccuga

SEQ ID NO: 2907357 - RNA, 18 nt, Human
cuugaaccuaugaagcaa

SEQ ID NO: 2907358 - RNA, 15 nt, Human
cuugaaccugggagg

SEQ ID NO: 2907359 - RNA, 16 nt, Human
cuugaaccugggaggu

SEQ ID NO: 2907360 - RNA, 19 nt, Human
cuugaaccugggaggugga

SEQ ID NO: 2907361 - RNA, 16 nt, Human
cuugaaccugugagua

SEQ ID NO: 2907362 - RNA, 21 nt, Human
cuugaaccugugaguaaauau

SEQ ID NO: 2907363 - RNA, 18 nt, Human
cuugaacuccugaccuca

SEQ ID NO: 2907364 - RNA, 11 nt, Human
cugcccugcug

SEQ ID NO: 2907365 - RNA, 17 nt, Human
cugcccucuccuuccuu

SEQ ID NO: 2907366 - RNA, 18 nt, Human
cugcccucuccuuccuua

SEQ ID NO: 2907367 - RNA, 20 nt, Human
cugcccugcgggucacagga

SEQ ID NO: 2907368 - RNA, 12 nt, Human
cugcccucaugg

SEQ ID NO: 2907369 - RNA, 14 nt, Human
cugcccuucuuccc

SEQ ID NO: 2907370 - RNA, 18 nt, Human
cugcccuucuuccccuuc

SEQ ID NO: 2907371 - RNA, 22 nt, Human
cugcccugcugccgccucccag

SEQ ID NO: 2907372 - RNA, 21 nt, Human
cugcccugcugccgccuccca

SEQ ID NO: 2907373 - RNA, 22 nt, Human
cugcccugcugagucccaggcu

SEQ ID NO: 2907374 - RNA, 17 nt, Human
cugcccuggaacauccu

SEQ ID NO: 2907375 - RNA, 22 nt, Human
cugcccuggaacauccuuugca

SEQ ID NO: 2907376 - RNA, 23 nt, Human
cugcccuggaacauccuuugcag

SEQ ID NO: 2907377 - RNA, 17 nt, Human
cugcccuggcaggguca

SEQ ID NO: 2907378 - RNA, 13 nt, Human
cucccuucagccc

SEQ ID NO: 2907379 - RNA, 16 nt, Human
cucccuucagccccca

SEQ ID NO: 2907380 - RNA, 18 nt, Human
cucccuucagcccccagc

SEQ ID NO: 2907381 - RNA, 19 nt, Human
cugcccucauggccccucu

SEQ ID NO: 2907382 - RNA, 20 nt, Human
cugcccucauuacugggccu

SEQ ID NO: 2907383 - RNA, 21 nt, Human
cugcccucauuacugggccuu

SEQ ID NO: 2907384 - RNA, 23 nt, Human
cugcccucauuacugggccuuag

SEQ ID NO: 2907385 - RNA, 15 nt, Human
cugccgugccgccug

SEQ ID NO: 2907386 - RNA, 17 nt, Human
cugccgucucuggagcg

SEQ ID NO: 2907387 - RNA, 20 nt, Human
cugccgugcauuagcacaga

SEQ ID NO: 2907388 - RNA, 15 nt, Human
cugccgucucuggag

SEQ ID NO: 2907389 - RNA, 14 nt, Human
cugccgucucugga

SEQ ID NO: 2907390 - RNA, 19 nt, Human
cugccgugccgccugcacu

SEQ ID NO: 2907391 - RNA, 17 nt, Human
cugccgugccgccugca

SEQ ID NO: 2907392 - RNA, 14 nt, Human
cugccgguuugaaa

SEQ ID NO: 2907393 - RNA, 20 nt, Human
cugccgguuugaaaauaugc

SEQ ID NO: 2907394 - RNA, 21 nt, Human
cugccgguaaacacgccugca

SEQ ID NO: 2907395 - RNA, 18 nt, Human
cugccgguaaacacgccu

SEQ ID NO: 2907396 - RNA, 12 nt, Human
cugcccuugggc

SEQ ID NO: 2907397 - RNA, 13 nt, Human
cugcccuugggcc

SEQ ID NO: 2907398 - RNA, 21 nt, Human
cugcccuuucugggcaccggg

SEQ ID NO: 2907399 - RNA, 15 nt, Human
cugccuaagacaugu

SEQ ID NO: 2907400 - RNA, 16 nt, Human
cugccucccauucuga

SEQ ID NO: 2907401 - RNA, 23 nt, Human
cugccucugacacacagcucugu

SEQ ID NO: 2907402 - RNA, 22 nt, Human
cugccucugacacacagcucug

SEQ ID NO: 2907403 - RNA, 15 nt, Human
cugccucugacacac

SEQ ID NO: 2907404 - RNA, 22 nt, Human
cugccgugccgccugcacuccu

SEQ ID NO: 2907405 - RNA, 13 nt, Human
cugccucugccuu

SEQ ID NO: 2907406 - RNA, 14 nt, Human
cugccucugccuua

SEQ ID NO: 2907407 - RNA, 15 nt, Human
cugccucugccuuag

SEQ ID NO: 2907408 - RNA, 12 nt, Human
cugccucugcca

SEQ ID NO: 2907409 - RNA, 13 nt, Human
cugccucugccac

SEQ ID NO: 2907410 - RNA, 14 nt, Human
cugccucugccaca

SEQ ID NO: 2907411 - RNA, 16 nt, Human
cugccucugccacacu

SEQ ID NO: 2907412 - RNA, 20 nt, Human
cugccucugccacacucuga

SEQ ID NO: 2907413 - RNA, 21 nt, Human
cugccucugccacacucugac

SEQ ID NO: 2907414 - RNA, 12 nt, Human
cugccucugccu

SEQ ID NO: 2907415 - RNA, 17 nt, Human
cugccugcccaggcccc

SEQ ID NO: 2907416 - RNA, 16 nt, Human
cugccugcccaggccc

SEQ ID NO: 2907417 - RNA, 15 nt, Human
cugccugaagucaca

SEQ ID NO: 2907418 - RNA, 22 nt, Human
cugccuugaagccacugaagcu

SEQ ID NO: 2907419 - RNA, 15 nt, Human
cugccuuggcucaga

SEQ ID NO: 2907420 - RNA, 17 nt, Human
cugccuuggcucagaca

SEQ ID NO: 2907421 - RNA, 18 nt, Human
cugccuuggcucagacau

SEQ ID NO: 2907422 - RNA, 22 nt, Human
cugccuuggcucagacauguuu

SEQ ID NO: 2907423 - RNA, 14 nt, Human
cugccuuggcucag

SEQ ID NO: 2907424 - RNA, 14 nt, Human
cugccuuggccucc

SEQ ID NO: 2907425 - RNA, 17 nt, Human
cugccuuggccucccaa

SEQ ID NO: 2907426 - RNA, 23 nt, Human
cugccuuggacuguguuuuuccu

SEQ ID NO: 2907427 - RNA, 12 nt, Human
cugccuugccuu

SEQ ID NO: 2907428 - RNA, 13 nt, Human
cugccuugccuuu

SEQ ID NO: 2907429 - RNA, 14 nt, Human
cugccuugccuuua

SEQ ID NO: 2907430 - RNA, 16 nt, Human
cugccuugcuguuggu

SEQ ID NO: 2907431 - RNA, 21 nt, Human
cugccuugcuguuggucaugu

SEQ ID NO: 2907432 - RNA, 20 nt, Human
cugccugcccaggccccugc

SEQ ID NO: 2907433 - RNA, 15 nt, Human
cugccuggccaggca

SEQ ID NO: 2907434 - RNA, 13 nt, Human
cugccuggccagg

SEQ ID NO: 2907435 - RNA, 12 nt, Human
cugccuggccag

SEQ ID NO: 2907436 - RNA, 21 nt, Human
cugccuggccacugcucccua

SEQ ID NO: 2907437 - RNA, 21 nt, Human
cugccuggccaggcagaucug

SEQ ID NO: 2907438 - RNA, 17 nt, Human
cugccuggccaggcaga

SEQ ID NO: 2907439 - RNA, 16 nt, Human
cugccuggccaggcag

SEQ ID NO: 2907440 - RNA, 13 nt, Human
cugccuggccccu

SEQ ID NO: 2907441 - RNA, 15 nt, Human
cugccuggccggcca

SEQ ID NO: 2907442 - RNA, 17 nt, Human
cugccuggccggccagc

SEQ ID NO: 2907443 - RNA, 18 nt, Human
cugccuggccggccagcc

SEQ ID NO: 2907444 - RNA, 19 nt, Human
cugccuggccggccagcca

SEQ ID NO: 2907445 - RNA, 22 nt, Human
cugccuggccggccagccagcc

SEQ ID NO: 2907446 - RNA, 21 nt, Human
cugcucuccucuugccacugc

SEQ ID NO: 2907447 - RNA, 17 nt, Human
cugcugaaggaauaaau

SEQ ID NO: 2907448 - RNA, 18 nt, Human
cugcugaaggaauaaauu

SEQ ID NO: 2907449 - RNA, 18 nt, Human
cugcugaagacuugcccc

SEQ ID NO: 2907450 - RNA, 19 nt, Human
cugcugcaggggcucugga

SEQ ID NO: 2907451 - RNA, 11 nt, Human
cugcugcaggg

SEQ ID NO: 2907452 - RNA, 12 nt, Human
cugcugcagggg

SEQ ID NO: 2907453 - RNA, 13 nt, Human
cugcugcaggggc

SEQ ID NO: 2907454 - RNA, 14 nt, Human
cugcugcaggggcu

SEQ ID NO: 2907455 - RNA, 16 nt, Human
cugcugcaggggcucu

SEQ ID NO: 2907456 - RNA, 17 nt, Human
cugcugcaggggcucug

SEQ ID NO: 2907457 - RNA, 18 nt, Human
cugcugcaggggcucugg

SEQ ID NO: 2907458 - RNA, 16 nt, Human
cugcugcauggggugg

SEQ ID NO: 2907459 - RNA, 20 nt, Human
cugcugcauuugugucaucu

SEQ ID NO: 2907460 - RNA, 22 nt, Human
cugcugccauggcgugucccuc

SEQ ID NO: 2907461 - RNA, 14 nt, Human
cugcugcccaaucu

SEQ ID NO: 2907462 - RNA, 12 nt, Human
cugcugcccagg

SEQ ID NO: 2907463 - RNA, 13 nt, Human
cugcugcccaggc

SEQ ID NO: 2907464 - RNA, 19 nt, Human
cugcugcccaggcugugca

SEQ ID NO: 2907465 - RNA, 22 nt, Human
cugcugcccagccuccaagcuc

SEQ ID NO: 2907466 - RNA, 12 nt, Human
cugcugcccagc

SEQ ID NO: 2907467 - RNA, 15 nt, Human
cugcugcccagccuc

SEQ ID NO: 2907468 - RNA, 19 nt, Human
cugcucuccgaccagacac

SEQ ID NO: 2907469 - RNA, 14 nt, Human
cugcucuccucuug

SEQ ID NO: 2907470 - RNA, 20 nt, Human
cugcucuccucuugccacug

SEQ ID NO: 2907471 - RNA, 14 nt, Human
cugcuccucauggu

SEQ ID NO: 2907472 - RNA, 13 nt, Human
cugcuccucaugg

SEQ ID NO: 2907473 - RNA, 11 nt, Human
cugcuccucca

SEQ ID NO: 2907474 - RNA, 12 nt, Human
cugcuccaggcc

SEQ ID NO: 2907475 - RNA, 13 nt, Human
cugcuccaggccu

SEQ ID NO: 2907476 - RNA, 14 nt, Human
cugcuccaggccug

SEQ ID NO: 2907477 - RNA, 15 nt, Human
cugcuccaggccugc

SEQ ID NO: 2907478 - RNA, 19 nt, Human
cugcuccaggccugcagca

SEQ ID NO: 2907479 - RNA, 12 nt, Human
cugcuccaggga

SEQ ID NO: 2907480 - RNA, 14 nt, Human
cugccuuguuugga

SEQ ID NO: 2907481 - RNA, 12 nt, Human
cugcgaaguccu

SEQ ID NO: 2907482 - RNA, 14 nt, Human
cugcgaaguccuau

SEQ ID NO: 2907483 - RNA, 22 nt, Human
cugcgaaguccuauggaaaccc

SEQ ID NO: 2907484 - RNA, 23 nt, Human
cugcugguucaggguuggccccu

SEQ ID NO: 2907485 - RNA, 15 nt, Human
cugcugguucagggu

SEQ ID NO: 2907486 - RNA, 13 nt, Human
cugcugguucagg

SEQ ID NO: 2907487 - RNA, 12 nt, Human
cugcuggcucuu

SEQ ID NO: 2907488 - RNA, 19 nt, Human
cugcuggcucuucugccca

SEQ ID NO: 2907489 - RNA, 21 nt, Human
cugcugguuaacuuguuuggc

SEQ ID NO: 2907490 - RNA, 14 nt, Human
cugcugcugucccu

SEQ ID NO: 2907491 - RNA, 12 nt, Human
cugcugcugccu

SEQ ID NO: 2907492 - RNA, 20 nt, Human
cugcugccgccccacccaga

SEQ ID NO: 2907493 - RNA, 17 nt, Human
cugcugcgcccuuaccu

SEQ ID NO: 2907494 - RNA, 20 nt, Human
cugcugcgcccuuaccuucc

SEQ ID NO: 2907495 - RNA, 21 nt, Human
cugcugcgcccuuaccuuccc

SEQ ID NO: 2907496 - RNA, 19 nt, Human
cugcugccgccucccagcc

SEQ ID NO: 2907497 - RNA, 17 nt, Human
cugcugccgccucccag

SEQ ID NO: 2907498 - RNA, 14 nt, Human
cugcugccgccucc

SEQ ID NO: 2907499 - RNA, 19 nt, Human
cugcugccgccccacccag

SEQ ID NO: 2907500 - RNA, 23 nt, Human
cugcugcccuuaggccacauggg

SEQ ID NO: 2907501 - RNA, 15 nt, Human
cugcuggcccagcca

SEQ ID NO: 2907502 - RNA, 22 nt, Human
cugcuggcccagccaaacccug

SEQ ID NO: 2907503 - RNA, 16 nt, Human
cugcuggcccagccaa

SEQ ID NO: 2907504 - RNA, 15 nt, Human
cugcuggcaucaaga

SEQ ID NO: 2907505 - RNA, 21 nt, Human
cugcuggaguuucauguacaa

SEQ ID NO: 2907506 - RNA, 20 nt, Human
cugcuggaguuucauguaca

SEQ ID NO: 2907507 - RNA, 15 nt, Human
cugcuggaaacagac

SEQ ID NO: 2907508 - RNA, 15 nt, Human
cugcugcugucaccu

SEQ ID NO: 2907509 - RNA, 20 nt, Human
cuggagugcagugagccgag

SEQ ID NO: 2907510 - RNA, 19 nt, Human
cuggcacccggccccugcu

SEQ ID NO: 2907511 - RNA, 14 nt, Human
cuggagugcagugg

SEQ ID NO: 2907512 - RNA, 19 nt, Human
cuggagugcccacccuggg

SEQ ID NO: 2907513 - RNA, 22 nt, Human
cuggagugcccacccugggaga

SEQ ID NO: 2907514 - RNA, 21 nt, Human
cuggcacccggccccugcugg

SEQ ID NO: 2907515 - RNA, 20 nt, Human
cuggcacccggccccugcug

SEQ ID NO: 2907516 - RNA, 14 nt, Human
cuggcacuuggaga

SEQ ID NO: 2907517 - RNA, 23 nt, Human
cuggcagaaagggaacagaaagg

SEQ ID NO: 2907518 - RNA, 21 nt, Human
cuggcacuuggagacuuguau

SEQ ID NO: 2907519 - RNA, 23 nt, Human
cuggccaucccucguggucccca

SEQ ID NO: 2907520 - RNA, 17 nt, Human
cuggccaucccucgugg

SEQ ID NO: 2907521 - RNA, 15 nt, Human
cuggcauaguuucau

SEQ ID NO: 2907522 - RNA, 17 nt, Human
cuggccaguuggaacca

SEQ ID NO: 2907523 - RNA, 23 nt, Human
cuggcccagccaaacccugucug

SEQ ID NO: 2907524 - RNA, 20 nt, Human
cuggcccagccaaacccugu

SEQ ID NO: 2907525 - RNA, 17 nt, Human
cuggcccagccaaaccc

SEQ ID NO: 2907526 - RNA, 13 nt, Human
cuggcccagccaa

SEQ ID NO: 2907527 - RNA, 14 nt, Human
cuggccagaugcac

SEQ ID NO: 2907528 - RNA, 17 nt, Human
cuggccacugcucccua

SEQ ID NO: 2907529 - RNA, 13 nt, Human
cuggccagacucg

SEQ ID NO: 2907530 - RNA, 13 nt, Human
cuggccagaaugc

SEQ ID NO: 2907531 - RNA, 22 nt, Human
cuggcaucaagaggugggaggg

SEQ ID NO: 2907532 - RNA, 22 nt, Human
cuggcaguuuugacaucagcca

SEQ ID NO: 2907533 - RNA, 23 nt, Human
cuggcaucaagaggugggagggc

SEQ ID NO: 2907534 - RNA, 16 nt, Human
cuggcagaagggagca

SEQ ID NO: 2907535 - RNA, 13 nt, Human
cuggccuggccug

SEQ ID NO: 2907536 - RNA, 14 nt, Human
cuggccuggccugg

SEQ ID NO: 2907537 - RNA, 15 nt, Human
cuggccuggccuggc

SEQ ID NO: 2907538 - RNA, 16 nt, Human
cuggccuggccuggcc

SEQ ID NO: 2907539 - RNA, 17 nt, Human
cuggccuggccuggccc

SEQ ID NO: 2907540 - RNA, 18 nt, Human
cuggccuggccuggcccu

SEQ ID NO: 2907541 - RNA, 13 nt, Human
cuggccuggcccu

SEQ ID NO: 2907542 - RNA, 14 nt, Human
cuggccuggcccug

SEQ ID NO: 2907543 - RNA, 15 nt, Human
cuggccuggcccugc

SEQ ID NO: 2907544 - RNA, 16 nt, Human
cuggccuggcccugcc

SEQ ID NO: 2907545 - RNA, 19 nt, Human
cuggccuggcccugcccug

SEQ ID NO: 2907546 - RNA, 21 nt, Human
cuggccuggcccugcccugag

SEQ ID NO: 2907547 - RNA, 23 nt, Human
cuggccuggcccugcccugagga

SEQ ID NO: 2907548 - RNA, 18 nt, Human
cuggccuggcacacauca

SEQ ID NO: 2907549 - RNA, 22 nt, Human
cuggccuggcacacaucaggag

SEQ ID NO: 2907550 - RNA, 11 nt, Human
cuggccuggcc

SEQ ID NO: 2907551 - RNA, 13 nt, Human
cuggccuggcaca

SEQ ID NO: 2907552 - RNA, 14 nt, Human
cuggccuggcacac

SEQ ID NO: 2907553 - RNA, 16 nt, Human
cuggccuggcacacau

SEQ ID NO: 2907554 - RNA, 17 nt, Human
cuggccuggcacacauc

SEQ ID NO: 2907555 - RNA, 22 nt, Human
cuggccuggacuguuuucucuc

SEQ ID NO: 2907556 - RNA, 14 nt, Human
cuggccuggacugu

SEQ ID NO: 2907557 - RNA, 18 nt, Human
cuggccuggacuguuuuc

SEQ ID NO: 2907558 - RNA, 16 nt, Human
cuggcccauagaaaca

SEQ ID NO: 2907559 - RNA, 17 nt, Human
cuggcccauagaaacau

SEQ ID NO: 2907560 - RNA, 21 nt, Human
cuggcccauagaaacaugaca

SEQ ID NO: 2907561 - RNA, 23 nt, Human
cuggcccauagaaacaugacacu

SEQ ID NO: 2907562 - RNA, 19 nt, Human
cuggccuugaaaccaccuu

SEQ ID NO: 2907563 - RNA, 15 nt, Human
cuggcgugcaguggu

SEQ ID NO: 2907564 - RNA, 14 nt, Human
cuggcgugcagugg

SEQ ID NO: 2907565 - RNA, 18 nt, Human
cuggcgucaugcaaaguc

SEQ ID NO: 2907566 - RNA, 19 nt, Human
cuggcgucaugcaaaguca

SEQ ID NO: 2907567 - RNA, 22 nt, Human
cuggcuagaggccagccccacc

SEQ ID NO: 2907568 - RNA, 21 nt, Human
cuggcuagaggccagccccac

SEQ ID NO: 2907569 - RNA, 20 nt, Human
cuggcuagaggccagcccca

SEQ ID NO: 2907570 - RNA, 18 nt, Human
cuggcguggauuaaacuu

SEQ ID NO: 2907571 - RNA, 19 nt, Human
cuggcguggauuaaacuua

SEQ ID NO: 2907572 - RNA, 20 nt, Human
cuggcuaaagauaauugcua

SEQ ID NO: 2907573 - RNA, 14 nt, Human
cuggcuaacaaggc

SEQ ID NO: 2907574 - RNA, 15 nt, Human
cuggcucuucugccc

SEQ ID NO: 2907575 - RNA, 16 nt, Human
cuggcucuucugccca

SEQ ID NO: 2907576 - RNA, 17 nt, Human
cuggcucuucugcccaa

SEQ ID NO: 2907577 - RNA, 19 nt, Human
cuggagcaaucacagauga

SEQ ID NO: 2907578 - RNA, 22 nt, Human
cuggagcccuaaccccuuccag

SEQ ID NO: 2907579 - RNA, 20 nt, Human
cuggagcccuccgccuucac

SEQ ID NO: 2907580 - RNA, 15 nt, Human
cuggagccuggugcc

SEQ ID NO: 2907581 - RNA, 16 nt, Human
cuggagccuggugccc

SEQ ID NO: 2907582 - RNA, 17 nt, Human
cuggagccuggugcccu

SEQ ID NO: 2907583 - RNA, 15 nt, Human
cuggagcccuugggu

SEQ ID NO: 2907584 - RNA, 23 nt, Human
cuggagccuccacugccucugga

SEQ ID NO: 2907585 - RNA, 16 nt, Human
cuggagccugagucag

SEQ ID NO: 2907586 - RNA, 18 nt, Human
cuggagccugagucaggg

SEQ ID NO: 2907587 - RNA, 19 nt, Human
cuggagccugagucagggc

SEQ ID NO: 2907588 - RNA, 22 nt, Human
cuggagccugagucagggccca

SEQ ID NO: 2907589 - RNA, 23 nt, Human
cuggagccugagucagggcccag

SEQ ID NO: 2907590 - RNA, 14 nt, Human
cuggagcccuaacc

SEQ ID NO: 2907591 - RNA, 15 nt, Human
cuggagcccaggagu

SEQ ID NO: 2907592 - RNA, 13 nt, Human
cuggagcccagga

SEQ ID NO: 2907593 - RNA, 12 nt, Human
cuggagcccagg

SEQ ID NO: 2907594 - RNA, 17 nt, Human
cuggagugcagugagcc

SEQ ID NO: 2907595 - RNA, 16 nt, Human
cuggagugcagugagc

SEQ ID NO: 2907596 - RNA, 15 nt, Human
cuggagugcagugag

SEQ ID NO: 2907597 - RNA, 14 nt, Human
cuggagugcaguga

SEQ ID NO: 2907598 - RNA, 12 nt, Human
cuggagucugga

SEQ ID NO: 2907599 - RNA, 13 nt, Human
cuggagucuggag

SEQ ID NO: 2907600 - RNA, 18 nt, Human
cuggagucuggagugggc

SEQ ID NO: 2907601 - RNA, 16 nt, Human
cuggagugagcacuca

SEQ ID NO: 2907602 - RNA, 16 nt, Human
cuggagggguguggcu

SEQ ID NO: 2907603 - RNA, 20 nt, Human
cuggagggguguggcuccuu

SEQ ID NO: 2907604 - RNA, 22 nt, Human
cuggaggugggagcaggagauu

SEQ ID NO: 2907605 - RNA, 16 nt, Human
cuggagguggggcgag

SEQ ID NO: 2907606 - RNA, 20 nt, Human
cuggagguggggcgaggcag

SEQ ID NO: 2907607 - RNA, 21 nt, Human
cuggagguggggcgaggcagg

SEQ ID NO: 2907608 - RNA, 23 nt, Human
cuggagguggggcgaggcaggcc

SEQ ID NO: 2907609 - RNA, 14 nt, Human
cuggaggugggagc

SEQ ID NO: 2907610 - RNA, 16 nt, Human
cuggaggugggagcag

SEQ ID NO: 2907611 - RNA, 17 nt, Human
cuggaggugggagcagg

SEQ ID NO: 2907612 - RNA, 18 nt, Human
cuggaggugggagcagga

SEQ ID NO: 2907613 - RNA, 19 nt, Human
cuggaggugggagcaggag

SEQ ID NO: 2907614 - RNA, 20 nt, Human
cuggaggugggagcaggaga

SEQ ID NO: 2907615 - RNA, 21 nt, Human
cuggaggugggagcaggagau

SEQ ID NO: 2907616 - RNA, 17 nt, Human
cuggacaggcauguucu

SEQ ID NO: 2907617 - RNA, 14 nt, Human
cuggacaggcaugu

SEQ ID NO: 2907618 - RNA, 23 nt, Human
cuggacaggcauguucucugagg

SEQ ID NO: 2907619 - RNA, 15 nt, Human
cuggacacucagacc

SEQ ID NO: 2907620 - RNA, 16 nt, Human
cuggacacucagaccu

SEQ ID NO: 2907621 - RNA, 13 nt, Human
cuggacaggcucu

SEQ ID NO: 2907622 - RNA, 15 nt, Human
cuggacaggcucugc

SEQ ID NO: 2907623 - RNA, 19 nt, Human
cuggacaggcucugcuucu

SEQ ID NO: 2907624 - RNA, 20 nt, Human
cuggacaggcucugcuucuc

SEQ ID NO: 2907625 - RNA, 21 nt, Human
cuggaccaguggucucacaug

SEQ ID NO: 2907626 - RNA, 19 nt, Human
cugcuuccgguagggaggc

SEQ ID NO: 2907627 - RNA, 22 nt, Human
cugcuuccgguagggaggcagc

SEQ ID NO: 2907628 - RNA, 23 nt, Human
cugcuuccgguagggaggcagcc

SEQ ID NO: 2907629 - RNA, 11 nt, Human
cugcuucccac

SEQ ID NO: 2907630 - RNA, 16 nt, Human
cugcuucccaccuccc

SEQ ID NO: 2907631 - RNA, 19 nt, Human
cugcuucccaccucccugc

SEQ ID NO: 2907632 - RNA, 20 nt, Human
cugcuucccaccucccugcc

SEQ ID NO: 2907633 - RNA, 21 nt, Human
cugcuucccaccucccugccc

SEQ ID NO: 2907634 - RNA, 22 nt, Human
cugcuucccaccucccugccca

SEQ ID NO: 2907635 - RNA, 24 nt, Human
cugcuucccaccucccugcccagg

SEQ ID NO: 2907636 - RNA, 12 nt, Human
cugcuucccagg

SEQ ID NO: 2907637 - RNA, 13 nt, Human
cugcuucccaggu

SEQ ID NO: 2907638 - RNA, 23 nt, Human
cugcuucccagguucaagcgauu

SEQ ID NO: 2907639 - RNA, 17 nt, Human
cuggacaccgggccagu

SEQ ID NO: 2907640 - RNA, 22 nt, Human
cuggacaccgggccaguaucua

SEQ ID NO: 2907641 - RNA, 15 nt, Human
cuggacaagcagagg

SEQ ID NO: 2907642 - RNA, 18 nt, Human
cuggacaagcagaggugg

SEQ ID NO: 2907643 - RNA, 20 nt, Human
cuggaccuugaacuggguac

SEQ ID NO: 2907644 - RNA, 17 nt, Human
cuggaccuugaacuggg

SEQ ID NO: 2907645 - RNA, 21 nt, Human
cuggaccuugaacuggguacu

SEQ ID NO: 2907646 - RNA, 14 nt, Human
cuggacggaagugg

SEQ ID NO: 2907647 - RNA, 17 nt, Human
cuggacggaaguggugg

SEQ ID NO: 2907648 - RNA, 20 nt, Human
cuggaccugccuccugccug

SEQ ID NO: 2907649 - RNA, 15 nt, Human
cuggaccugccuccu

SEQ ID NO: 2907650 - RNA, 17 nt, Human
cuggaccugccuccugc

SEQ ID NO: 2907651 - RNA, 21 nt, Human
cuggaccugccuccugccugc

SEQ ID NO: 2907652 - RNA, 15 nt, Human
cuggaccugguggcu

SEQ ID NO: 2907653 - RNA, 13 nt, Human
cuggacuccggcc

SEQ ID NO: 2907654 - RNA, 15 nt, Human
cuggacuccggcccu

SEQ ID NO: 2907655 - RNA, 14 nt, Human
cuggacuccucugu

SEQ ID NO: 2907656 - RNA, 17 nt, Human
cuggacuccucugucca

SEQ ID NO: 2907657 - RNA, 18 nt, Human
cuggacuccggcccuccu

SEQ ID NO: 2907658 - RNA, 22 nt, Human
cuggagauacugguggaaguuc

SEQ ID NO: 2907659 - RNA, 18 nt, Human
cuggacuccucuguccag

SEQ ID NO: 2907660 - RNA, 19 nt, Human
cuggacuccucuguccagg

SEQ ID NO: 2907661 - RNA, 16 nt, Human
cuggaccuugaacugg

SEQ ID NO: 2907662 - RNA, 12 nt, Human
cuggaccugccu

SEQ ID NO: 2907663 - RNA, 15 nt, Human
cuguaucuuucuaug

SEQ ID NO: 2907664 - RNA, 23 nt, Human
cuguaucccaugagccucagcau

SEQ ID NO: 2907665 - RNA, 19 nt, Human
cuguaugaaagauuguggg

SEQ ID NO: 2907666 - RNA, 18 nt, Human
cuguaucuguguagacua

SEQ ID NO: 2907667 - RNA, 14 nt, Human
cuguaucuguguag

SEQ ID NO: 2907668 - RNA, 13 nt, Human
cuguaucugugua

SEQ ID NO: 2907669 - RNA, 12 nt, Human
cugucaagaaga

SEQ ID NO: 2907670 - RNA, 14 nt, Human
cugucaagaagaug

SEQ ID NO: 2907671 - RNA, 11 nt, Human
cuguccagaga

SEQ ID NO: 2907672 - RNA, 19 nt, Human
cugucaaugauuauuuuca

SEQ ID NO: 2907673 - RNA, 20 nt, Human
cugucaaugauuauuuucau

SEQ ID NO: 2907674 - RNA, 21 nt, Human
cugucaagugggaucugucac

SEQ ID NO: 2907675 - RNA, 19 nt, Human
cugucaaguuccuuugggu

SEQ ID NO: 2907676 - RNA, 19 nt, Human
cugucaagaguaguuauau

SEQ ID NO: 2907677 - RNA, 22 nt, Human
cugucaagaguaguuauauaau

SEQ ID NO: 2907678 - RNA, 17 nt, Human
cuguccagccugggcag

SEQ ID NO: 2907679 - RNA, 15 nt, Human
cuguccagccugggc

SEQ ID NO: 2907680 - RNA, 13 nt, Human
cuguccagccugg

SEQ ID NO: 2907681 - RNA, 17 nt, Human
cuguccagcagucacuu

SEQ ID NO: 2907682 - RNA, 19 nt, Human
cuguccagcagucacuucg

SEQ ID NO: 2907683 - RNA, 18 nt, Human
cuguccagccugggcagc

SEQ ID NO: 2907684 - RNA, 23 nt, Human
cuguccaggcacugcugcccagc

SEQ ID NO: 2907685 - RNA, 12 nt, Human
cuguauacuuua

SEQ ID NO: 2907686 - RNA, 13 nt, Human
cuguauacuuuag

SEQ ID NO: 2907687 - RNA, 16 nt, Human
cuguauacuuuaguau

SEQ ID NO: 2907688 - RNA, 19 nt, Human
cuguauacaacccuggcau

SEQ ID NO: 2907689 - RNA, 18 nt, Human
cuguaguuaggaaauaaa

SEQ ID NO: 2907690 - RNA, 20 nt, Human
cuguauaaauaggagaggau

SEQ ID NO: 2907691 - RNA, 17 nt, Human
cuguaguuaggaaauaa

SEQ ID NO: 2907692 - RNA, 16 nt, Human
cuguauaacccuguua

SEQ ID NO: 2907693 - RNA, 17 nt, Human
cuguauaacccuguuac

SEQ ID NO: 2907694 - RNA, 18 nt, Human
cuguauaacccuguuaca

SEQ ID NO: 2907695 - RNA, 14 nt, Human
cuguauaagcacug

SEQ ID NO: 2907696 - RNA, 15 nt, Human
cuguauaagcacuga

SEQ ID NO: 2907697 - RNA, 19 nt, Human
cuguauaagcacugaaaaa

SEQ ID NO: 2907698 - RNA, 21 nt, Human
cuguauaagcacugaaaaaca

SEQ ID NO: 2907699 - RNA, 21 nt, Human
cuguauaaauaggagaggaug

SEQ ID NO: 2907700 - RNA, 17 nt, Human
cuguauauuuuaagaag

SEQ ID NO: 2907701 - RNA, 17 nt, Human
cuguaucaagucauggc

SEQ ID NO: 2907702 - RNA, 15 nt, Human
cuguauauacuuuuu

SEQ ID NO: 2907703 - RNA, 14 nt, Human
cuguauauacuuuu

SEQ ID NO: 2907704 - RNA, 16 nt, Human
cuguauagacaguuug

SEQ ID NO: 2907705 - RNA, 17 nt, Human
cuguauagacaguuugu

SEQ ID NO: 2907706 - RNA, 18 nt, Human
cuguauagacaguuugua

SEQ ID NO: 2907707 - RNA, 20 nt, Human
cuguauagacaguuuguaaa

SEQ ID NO: 2907708 - RNA, 21 nt, Human
cuguauagacaguuuguaaau

SEQ ID NO: 2907709 - RNA, 22 nt, Human
cuguauagacaguuuguaaaug

SEQ ID NO: 2907710 - RNA, 23 nt, Human
cuguauagacaguuuguaaaugu

SEQ ID NO: 2907711 - RNA, 15 nt, Human
cuguacacugacuug

SEQ ID NO: 2907712 - RNA, 17 nt, Human
cuguacacugacuugag

SEQ ID NO: 2907713 - RNA, 21 nt, Human
cuguacacugacuugagacca

SEQ ID NO: 2907714 - RNA, 18 nt, Human
cuguacacguguccugua

SEQ ID NO: 2907715 - RNA, 16 nt, Human
cuguacacguguccug

SEQ ID NO: 2907716 - RNA, 17 nt, Human
cuguacacguguccugu

SEQ ID NO: 2907717 - RNA, 11 nt, Human
cuguacaauaa

SEQ ID NO: 2907718 - RNA, 22 nt, Human
cuguagucccagcuacucggga

SEQ ID NO: 2907719 - RNA, 22 nt, Human
cuguaguccuagccacucagga

SEQ ID NO: 2907720 - RNA, 20 nt, Human
cuguaguccuagccacucag

SEQ ID NO: 2907721 - RNA, 23 nt, Human
cuguaguccuagccacucaggag

SEQ ID NO: 2907722 - RNA, 15 nt, Human
cuguaguuaggaaau

SEQ ID NO: 2907723 - RNA, 14 nt, Human
cuguaguuaggaaa

SEQ ID NO: 2907724 - RNA, 13 nt, Human
cuguaguuaggaa

SEQ ID NO: 2907725 - RNA, 14 nt, Human
cuguccuacccacc

SEQ ID NO: 2907726 - RNA, 20 nt, Human
cuguccggaaugccacccac

SEQ ID NO: 2907727 - RNA, 20 nt, Human
cuguccuaaggaaccuuccu

SEQ ID NO: 2907728 - RNA, 17 nt, Human
cuguccuaaggaaccuu

SEQ ID NO: 2907729 - RNA, 21 nt, Human
cuguccggaaugccacccaca

SEQ ID NO: 2907730 - RNA, 22 nt, Human
cugucucaagagggcacuggug

SEQ ID NO: 2907731 - RNA, 23 nt, Human
cugucucaaaaaaacacaaaagu

SEQ ID NO: 2907732 - RNA, 12 nt, Human
cuguccuccaag

SEQ ID NO: 2907733 - RNA, 16 nt, Human
cugucuagucucuccu

SEQ ID NO: 2907734 - RNA, 18 nt, Human
cugucuagucucuccugu

SEQ ID NO: 2907735 - RNA, 19 nt, Human
cugucuagucucuccugua

SEQ ID NO: 2907736 - RNA, 14 nt, Human
cugucuagcaugcc

SEQ ID NO: 2907737 - RNA, 15 nt, Human
cugucuagcaugcca

SEQ ID NO: 2907738 - RNA, 18 nt, Human
cugucuagcaugccaaca

SEQ ID NO: 2907739 - RNA, 21 nt, Human
cugucuagcaugccaacaaga

SEQ ID NO: 2907740 - RNA, 12 nt, Human
cugucuagagua

SEQ ID NO: 2907741 - RNA, 15 nt, Human
cuguccccgcagccc

SEQ ID NO: 2907742 - RNA, 22 nt, Human
cuguccauauuuauagguaccc

SEQ ID NO: 2907743 - RNA, 16 nt, Human
cuguccaucagccagg

SEQ ID NO: 2907744 - RNA, 12 nt, Human
cuguccaucugc

SEQ ID NO: 2907745 - RNA, 13 nt, Human
cuguccaucugcc

SEQ ID NO: 2907746 - RNA, 15 nt, Human
cuguccaucugcccg

SEQ ID NO: 2907747 - RNA, 17 nt, Human
cuguccaucugcccgcc

SEQ ID NO: 2907748 - RNA, 22 nt, Human
cuguccaucugcccgccugccc

SEQ ID NO: 2907749 - RNA, 15 nt, Human
cugucccugaaaccu

SEQ ID NO: 2907750 - RNA, 15 nt, Human
cugucccugcccuuc

SEQ ID NO: 2907751 - RNA, 16 nt, Human
cugucccugcccuucu

SEQ ID NO: 2907752 - RNA, 13 nt, Human
cugucccuccugg

SEQ ID NO: 2907753 - RNA, 14 nt, Human
cugucccuccuggu

SEQ ID NO: 2907754 - RNA, 15 nt, Human
cugucccuccuggug

SEQ ID NO: 2907755 - RNA, 19 nt, Human
cugucccuccuggugucac

SEQ ID NO: 2907756 - RNA, 23 nt, Human
cuguccccgcagcccuggcaggg

SEQ ID NO: 2907757 - RNA, 18 nt, Human
cuguccccguguugcaug

SEQ ID NO: 2907758 - RNA, 17 nt, Human
cuguccccgcagcccug

SEQ ID NO: 2907759 - RNA, 22 nt, Human
cuguccccuggggucucugcug

SEQ ID NO: 2907760 - RNA, 15 nt, Human
cuguccccuuggcag

SEQ ID NO: 2907761 - RNA, 14 nt, Human
cuguaauaauaccu

SEQ ID NO: 2907762 - RNA, 15 nt, Human
cuguaauaauaccuc

SEQ ID NO: 2907763 - RNA, 16 nt, Human
cuguaauaauaccuca

SEQ ID NO: 2907764 - RNA, 17 nt, Human
cuguaauaauaccucaa

SEQ ID NO: 2907765 - RNA, 22 nt, Human
cuguaauaauaccucaauguuu

SEQ ID NO: 2907766 - RNA, 23 nt, Human
cuguaauaauaccucaauguuug

SEQ ID NO: 2907767 - RNA, 13 nt, Human
cugguuccucccc

SEQ ID NO: 2907768 - RNA, 17 nt, Human
cugguggcucuuugggc

SEQ ID NO: 2907769 - RNA, 22 nt, Human
cuggugggaggggcgcccaccu

SEQ ID NO: 2907770 - RNA, 12 nt, Human
cugguuccuccc

SEQ ID NO: 2907771 - RNA, 21 nt, Human
cugguucccguuucuccaccu

SEQ ID NO: 2907772 - RNA, 23 nt, Human
cuggugggaggggcgcccaccuc

SEQ ID NO: 2907773 - RNA, 18 nt, Human
cugguucccguuucucca

SEQ ID NO: 2907774 - RNA, 23 nt, Human
cuguaauuuuuauuuucacccuc

SEQ ID NO: 2907775 - RNA, 12 nt, Human
cuguacaaaggg

SEQ ID NO: 2907776 - RNA, 20 nt, Human
cuguaaucgcccuacuauuc

SEQ ID NO: 2907777 - RNA, 14 nt, Human
cugguggcagcugc

SEQ ID NO: 2907778 - RNA, 13 nt, Human
cugguggcagcug

SEQ ID NO: 2907779 - RNA, 20 nt, Human
cugguggcccgacagccugg

SEQ ID NO: 2907780 - RNA, 21 nt, Human
cugguggcccgacagccuggc

SEQ ID NO: 2907781 - RNA, 22 nt, Human
cugguggcccgacagccuggca

SEQ ID NO: 2907782 - RNA, 23 nt, Human
cugguggcccgacagccuggcac

SEQ ID NO: 2907783 - RNA, 12 nt, Human
cuggugcugcca

SEQ ID NO: 2907784 - RNA, 13 nt, Human
cuggugcugccac

SEQ ID NO: 2907785 - RNA, 20 nt, Human
cuggugcugccacacuucag

SEQ ID NO: 2907786 - RNA, 22 nt, Human
cuggugcugccacacuucaggc

SEQ ID NO: 2907787 - RNA, 19 nt, Human
cugguccugagggucccca

SEQ ID NO: 2907788 - RNA, 16 nt, Human
cugguccugagggucc

SEQ ID NO: 2907789 - RNA, 20 nt, Human
cugguccggacacuccuaga

SEQ ID NO: 2907790 - RNA, 21 nt, Human
cugguccggacacuccuagag

SEQ ID NO: 2907791 - RNA, 22 nt, Human
cugguccggacacuccuagaga

SEQ ID NO: 2907792 - RNA, 21 nt, Human
cuggucccuugcagcuaguuu

SEQ ID NO: 2907793 - RNA, 17 nt, Human
cuggucccuugcagcua

SEQ ID NO: 2907794 - RNA, 19 nt, Human
cuggucacagccuccucug

SEQ ID NO: 2907795 - RNA, 16 nt, Human
cugguccggacacucc

SEQ ID NO: 2907796 - RNA, 17 nt, Human
cuggucaaacaaacucu

SEQ ID NO: 2907797 - RNA, 21 nt, Human
cugguacucccucucaggauc

SEQ ID NO: 2907798 - RNA, 23 nt, Human
cuggucaaacaaacucucugaac

SEQ ID NO: 2907799 - RNA, 13 nt, Human
cuggucaaagaaa

SEQ ID NO: 2907800 - RNA, 18 nt, Human
cuggucaaacaaacucuc

SEQ ID NO: 2907801 - RNA, 19 nt, Human
cuggucaaucaacacuacc

SEQ ID NO: 2907802 - RNA, 16 nt, Human
cuggucacacacaggu

SEQ ID NO: 2907803 - RNA, 19 nt, Human
cuggucacacacagguguu

SEQ ID NO: 2907804 - RNA, 15 nt, Human
cuggucacagccucc

SEQ ID NO: 2907805 - RNA, 16 nt, Human
cuggucacagccuccu

SEQ ID NO: 2907806 - RNA, 17 nt, Human
cuggucacagccuccuc

SEQ ID NO: 2907807 - RNA, 18 nt, Human
cuggucacagccuccucu

SEQ ID NO: 2907808 - RNA, 18 nt, Human
cuggucacaggacucugc

SEQ ID NO: 2907809 - RNA, 20 nt, Human
cugggggacccaauguagga

SEQ ID NO: 2907810 - RNA, 20 nt, Human
cugggggaaugagcccagag

SEQ ID NO: 2907811 - RNA, 21 nt, Human
cugggggaaugagcccagaga

SEQ ID NO: 2907812 - RNA, 17 nt, Human
cugggggcaacuggcca

SEQ ID NO: 2907813 - RNA, 18 nt, Human
cugggggaguuuuccucu

SEQ ID NO: 2907814 - RNA, 12 nt, Human
cugggggcagga

SEQ ID NO: 2907815 - RNA, 19 nt, Human
cugggggcaggagggcccu

SEQ ID NO: 2907816 - RNA, 14 nt, Human
cugggggcaggagg

SEQ ID NO: 2907817 - RNA, 24 nt, Human
cugggcuucaguggcagcugcuuu

SEQ ID NO: 2907818 - RNA, 16 nt, Human
cuggcugccccaaccu

SEQ ID NO: 2907819 - RNA, 18 nt, Human
cuggcugccccaaccugc

SEQ ID NO: 2907820 - RNA, 13 nt, Human
cuggcugcaguga

SEQ ID NO: 2907821 - RNA, 19 nt, Human
cuggcugccccaaccugcu

SEQ ID NO: 2907822 - RNA, 20 nt, Human
cuggcugccccaaccugcug

SEQ ID NO: 2907823 - RNA, 13 nt, Human
cuggggcuggcuu

SEQ ID NO: 2907824 - RNA, 14 nt, Human
cuggggcuggcuuu

SEQ ID NO: 2907825 - RNA, 12 nt, Human
cuggggcugggc

SEQ ID NO: 2907826 - RNA, 13 nt, Human
cuggggcugggcc

SEQ ID NO: 2907827 - RNA, 14 nt, Human
cuggggcugggccc

SEQ ID NO: 2907828 - RNA, 19 nt, Human
cuggggcuguugaagucac

SEQ ID NO: 2907829 - RNA, 12 nt, Human
cuggggcugcug

SEQ ID NO: 2907830 - RNA, 14 nt, Human
cuggggcugcuggc

SEQ ID NO: 2907831 - RNA, 15 nt, Human
cuggggcugcuggcc

SEQ ID NO: 2907832 - RNA, 16 nt, Human
cuggggcugcuggccu

SEQ ID NO: 2907833 - RNA, 15 nt, Human
cugggguccagggag

SEQ ID NO: 2907834 - RNA, 16 nt, Human
cugggguccagggagc

SEQ ID NO: 2907835 - RNA, 19 nt, Human
cuggggucacccucuccag

SEQ ID NO: 2907836 - RNA, 12 nt, Human
cuggggucccca

SEQ ID NO: 2907837 - RNA, 13 nt, Human
cugggguccccag

SEQ ID NO: 2907838 - RNA, 14 nt, Human
cugggguccccagg

SEQ ID NO: 2907839 - RNA, 16 nt, Human
cugggguccccagggc

SEQ ID NO: 2907840 - RNA, 17 nt, Human
cugggguccccagggcu

SEQ ID NO: 2907841 - RNA, 17 nt, Human
cuggguacugaaagccu

SEQ ID NO: 2907842 - RNA, 18 nt, Human
cuggguacugaaagccuu

SEQ ID NO: 2907843 - RNA, 14 nt, Human
cugguacucaagcc

SEQ ID NO: 2907844 - RNA, 16 nt, Human
cugguacccuccuggc

SEQ ID NO: 2907845 - RNA, 18 nt, Human
cugguacucccucucagg

SEQ ID NO: 2907846 - RNA, 19 nt, Human
cugguacucccucucagga

SEQ ID NO: 2907847 - RNA, 20 nt, Human
cugguacucccucucaggau

SEQ ID NO: 2907848 - RNA, 14 nt, Human
cugguacccuccug

SEQ ID NO: 2907849 - RNA, 15 nt, Human
cugguacccuccugg

SEQ ID NO: 2907850 - RNA, 19 nt, Human
cuguguuuauaaaauauaa

SEQ ID NO: 2907851 - RNA, 17 nt, Human
cuguguuuauaaaauau

SEQ ID NO: 2907852 - RNA, 16 nt, Human
cuguguuuauaaaaua

SEQ ID NO: 2907853 - RNA, 18 nt, Human
cuguguuuuauaaaauag

SEQ ID NO: 2907854 - RNA, 12 nt, Human
cuguuaaaaucu

SEQ ID NO: 2907855 - RNA, 19 nt, Human
cuguuaaaaucuauucugu

SEQ ID NO: 2907856 - RNA, 11 nt, Human
cuguuaaacug

SEQ ID NO: 2907857 - RNA, 12 nt, Human
cuguuaaacugu

SEQ ID NO: 2907858 - RNA, 13 nt, Human
cuguuaaacuguu

SEQ ID NO: 2907859 - RNA, 14 nt, Human
cuguuaaacuguua

SEQ ID NO: 2907860 - RNA, 15 nt, Human
cuguuaaacuguuag

SEQ ID NO: 2907861 - RNA, 19 nt, Human
cuguuaaacuguuagcacu

SEQ ID NO: 2907862 - RNA, 20 nt, Human
cugugugugcgccuacagga

SEQ ID NO: 2907863 - RNA, 18 nt, Human
cugugugugcgccuacag

SEQ ID NO: 2907864 - RNA, 11 nt, Human
cugugugguug

SEQ ID NO: 2907865 - RNA, 12 nt, Human
cuguguguguga

SEQ ID NO: 2907866 - RNA, 16 nt, Human
cugugugugugaauga

SEQ ID NO: 2907867 - RNA, 14 nt, Human
cugugugugugaau

SEQ ID NO: 2907868 - RNA, 18 nt, Human
cugugugugugaaugaac

SEQ ID NO: 2907869 - RNA, 17 nt, Human
cugugugugugaaugaa

SEQ ID NO: 2907870 - RNA, 21 nt, Human
cugugugugugaaugaacacu

SEQ ID NO: 2907871 - RNA, 19 nt, Human
cuguguuguugcuucuugu

SEQ ID NO: 2907872 - RNA, 23 nt, Human
cuguguuguugcuucuugugaag

SEQ ID NO: 2907873 - RNA, 18 nt, Human
cuguguuuaauuucuuca

SEQ ID NO: 2907874 - RNA, 21 nt, Human
cuguguuuaauuucuucaaaa

SEQ ID NO: 2907875 - RNA, 14 nt, Human
cuguguuuaauuug

SEQ ID NO: 2907876 - RNA, 16 nt, Human
cuguguuuaauuugac

SEQ ID NO: 2907877 - RNA, 23 nt, Human
cugugucuugcaauggcagccuu

SEQ ID NO: 2907878 - RNA, 22 nt, Human
cugugucuugcaauggcagccu

SEQ ID NO: 2907879 - RNA, 20 nt, Human
cugugucuugcaauggcagc

SEQ ID NO: 2907880 - RNA, 21 nt, Human
cugugucuugcaauggcagcc

SEQ ID NO: 2907881 - RNA, 14 nt, Human
cuguggggaaaggg

SEQ ID NO: 2907882 - RNA, 23 nt, Human
cugugggcgugagaccugccccu

SEQ ID NO: 2907883 - RNA, 19 nt, Human
cuguggggccuugguuccc

SEQ ID NO: 2907884 - RNA, 18 nt, Human
cugugugcuccuccuugg

SEQ ID NO: 2907885 - RNA, 23 nt, Human
cugugugcuccuccuuggugccu

SEQ ID NO: 2907886 - RNA, 12 nt, Human
cuguguggaacu

SEQ ID NO: 2907887 - RNA, 17 nt, Human
cuguucauacacuaacc

SEQ ID NO: 2907888 - RNA, 21 nt, Human
cuguucauacacuaaccaaau

SEQ ID NO: 2907889 - RNA, 20 nt, Human
cuguucccauguagcccccu

SEQ ID NO: 2907890 - RNA, 18 nt, Human
cuguucccauucuugcau

SEQ ID NO: 2907891 - RNA, 17 nt, Human
cuguucccaccugcugg

SEQ ID NO: 2907892 - RNA, 22 nt, Human
cuguuacccaggguggagugca

SEQ ID NO: 2907893 - RNA, 16 nt, Human
cuguuaccgccugucu

SEQ ID NO: 2907894 - RNA, 17 nt, Human
cuguuaccgccugucuc

SEQ ID NO: 2907895 - RNA, 15 nt, Human
cuguuaccauucaca

SEQ ID NO: 2907896 - RNA, 20 nt, Human
cuguuacauaacaagaaaau

SEQ ID NO: 2907897 - RNA, 21 nt, Human
cuguuacauaacaagaaaauc

SEQ ID NO: 2907898 - RNA, 23 nt, Human
cuguuacauaacaagaaaaucaa

SEQ ID NO: 2907899 - RNA, 15 nt, Human
cuguucucuugggaa

SEQ ID NO: 2907900 - RNA, 16 nt, Human
cuguucucccuucggu

SEQ ID NO: 2907901 - RNA, 16 nt, Human
cuguucuaaagcucug

SEQ ID NO: 2907902 - RNA, 19 nt, Human
cuguucuacccguuccaaa

SEQ ID NO: 2907903 - RNA, 20 nt, Human
cuguucuacccguuccaaaa

SEQ ID NO: 2907904 - RNA, 22 nt, Human
cuguucuagcacuucaucuggc

SEQ ID NO: 2907905 - RNA, 12 nt, Human
cuguucuaaagc

SEQ ID NO: 2907906 - RNA, 17 nt, Human
cuguucuaaagcucuga

SEQ ID NO: 2907907 - RNA, 15 nt, Human
cuguucuaacaugua

SEQ ID NO: 2907908 - RNA, 16 nt, Human
cuguucuaacauguaa

SEQ ID NO: 2907909 - RNA, 12 nt, Human
cuguucuaaggg

SEQ ID NO: 2907910 - RNA, 22 nt, Human
cuguucuaagggggaggggaag

SEQ ID NO: 2907911 - RNA, 15 nt, Human
cuguuccuuagaccu

SEQ ID NO: 2907912 - RNA, 16 nt, Human
cuguuccuuagaccuu

SEQ ID NO: 2907913 - RNA, 21 nt, Human
cuguuccucucuuuuccuguu

SEQ ID NO: 2907914 - RNA, 16 nt, Human
cugugggcgggcccag

SEQ ID NO: 2907915 - RNA, 17 nt, Human
cugugggcgggcccagc

SEQ ID NO: 2907916 - RNA, 18 nt, Human
cugugggcgggcccagca

SEQ ID NO: 2907917 - RNA, 19 nt, Human
cugugggcgggcccagcac

SEQ ID NO: 2907918 - RNA, 22 nt, Human
cugugggcgugagaccugcccc

SEQ ID NO: 2907919 - RNA, 21 nt, Human
cugugggcgugagaccugccc

SEQ ID NO: 2907920 - RNA, 14 nt, Human
cuguggcugcgcuu

SEQ ID NO: 2907921 - RNA, 16 nt, Human
cuguggccugggcaag

SEQ ID NO: 2907922 - RNA, 22 nt, Human
cuguggccacauuuucagccaa

SEQ ID NO: 2907923 - RNA, 16 nt, Human
cuguggcauugaaaug

SEQ ID NO: 2907924 - RNA, 14 nt, Human
cuguggccugggca

SEQ ID NO: 2907925 - RNA, 13 nt, Human
cuguggccugggc

SEQ ID NO: 2907926 - RNA, 11 nt, Human
cuguggccugg

SEQ ID NO: 2907927 - RNA, 21 nt, Human
cuguggcacuugccuggguca

SEQ ID NO: 2907928 - RNA, 20 nt, Human
cuguggcacuugccuggguc

SEQ ID NO: 2907929 - RNA, 19 nt, Human
cuguggcacuugccugggu

SEQ ID NO: 2907930 - RNA, 17 nt, Human
cuguggcacuugccugg

SEQ ID NO: 2907931 - RNA, 16 nt, Human
cuguggcacuugccug

SEQ ID NO: 2907932 - RNA, 17 nt, Human
cuguggcaucuuugccu

SEQ ID NO: 2907933 - RNA, 22 nt, Human
cuguggaaaagaaacacgcacu

SEQ ID NO: 2907934 - RNA, 15 nt, Human
cuguggcacuugccu

SEQ ID NO: 2907935 - RNA, 16 nt, Human
cuguggaugccagggc

SEQ ID NO: 2907936 - RNA, 20 nt, Human
cuguggaugagcccucagaa

SEQ ID NO: 2907937 - RNA, 19 nt, Human
cuguggaugagcccucaga

SEQ ID NO: 2907938 - RNA, 23 nt, Human
cugugccucggcuuuucucagcu

SEQ ID NO: 2907939 - RNA, 22 nt, Human
cugugccucggcuuuucucagc

SEQ ID NO: 2907940 - RNA, 17 nt, Human
cugugccucugccuguc

SEQ ID NO: 2907941 - RNA, 13 nt, Human
cugugccucggcu

SEQ ID NO: 2907942 - RNA, 19 nt, Human
cugugcugcuguuacuguu

SEQ ID NO: 2907943 - RNA, 20 nt, Human
cugugcugcuguuacuguua

SEQ ID NO: 2907944 - RNA, 21 nt, Human
cugugcuguggaagcaacagg

SEQ ID NO: 2907945 - RNA, 17 nt, Human
cugugcuucaauuaaua

SEQ ID NO: 2907946 - RNA, 18 nt, Human
cugugcuucaauuaauaa

SEQ ID NO: 2907947 - RNA, 12 nt, Human
cugugcugugga

SEQ ID NO: 2907948 - RNA, 15 nt, Human
cugugcuguggaagc

SEQ ID NO: 2907949 - RNA, 13 nt, Human
cugugcuggggga

SEQ ID NO: 2907950 - RNA, 23 nt, Human
cugugcugggggaaugagcccag

SEQ ID NO: 2907951 - RNA, 19 nt, Human
cuguggaaaagaaacacgc

SEQ ID NO: 2907952 - RNA, 17 nt, Human
cugugcuuuuaaaugca

SEQ ID NO: 2907953 - RNA, 23 nt, Human
cugucucaagagggcacuggugg

SEQ ID NO: 2907954 - RNA, 12 nt, Human
cugucucagccu

SEQ ID NO: 2907955 - RNA, 14 nt, Human
cugucucagacuuu

SEQ ID NO: 2907956 - RNA, 20 nt, Human
cugucucagacuuuuguaca

SEQ ID NO: 2907957 - RNA, 21 nt, Human
cugucucagacuuuuguacau

SEQ ID NO: 2907958 - RNA, 22 nt, Human
cugucucagacuuuuguacauc

SEQ ID NO: 2907959 - RNA, 17 nt, Human
cugucucagccucccag

SEQ ID NO: 2907960 - RNA, 16 nt, Human
cugucucagccuccca

SEQ ID NO: 2907961 - RNA, 15 nt, Human
cugucucagccuccc

SEQ ID NO: 2907962 - RNA, 14 nt, Human
cugucucagccucc

SEQ ID NO: 2907963 - RNA, 16 nt, Human
cugugagguuucccaa

SEQ ID NO: 2907964 - RNA, 17 nt, Human
cugugagguuucccaau

SEQ ID NO: 2907965 - RNA, 22 nt, Human
cugugagguuucccaauggugu

SEQ ID NO: 2907966 - RNA, 15 nt, Human
cugugaguaaauauu

SEQ ID NO: 2907967 - RNA, 17 nt, Human
cugugaguaaauauuga

SEQ ID NO: 2907968 - RNA, 18 nt, Human
cugugaguaaauauugag

SEQ ID NO: 2907969 - RNA, 20 nt, Human
cugugagucuuugguucuaa

SEQ ID NO: 2907970 - RNA, 23 nt, Human
cugugagucuuugguucuaagga

SEQ ID NO: 2907971 - RNA, 21 nt, Human
cugugagucuuugguucuaag

SEQ ID NO: 2907972 - RNA, 22 nt, Human
cugugagucuuugguucuaagg

SEQ ID NO: 2907973 - RNA, 13 nt, Human
cugugaucauuua

SEQ ID NO: 2907974 - RNA, 15 nt, Human
cugugaucauuuauu

SEQ ID NO: 2907975 - RNA, 19 nt, Human
cugugaucauuuauuuuaa

SEQ ID NO: 2907976 - RNA, 13 nt, Human
cugugaucuuauu

SEQ ID NO: 2907977 - RNA, 14 nt, Human
cugugaucuuauuu

SEQ ID NO: 2907978 - RNA, 15 nt, Human
cugugaucuuauuuu

SEQ ID NO: 2907979 - RNA, 17 nt, Human
cugugaucuuauuuuuc

SEQ ID NO: 2907980 - RNA, 18 nt, Human
cugugaucuuauuuuucu

SEQ ID NO: 2907981 - RNA, 17 nt, Human
cugugaucuuuuaaagu

SEQ ID NO: 2907982 - RNA, 18 nt, Human
cugugaucuuuuaaagug

SEQ ID NO: 2907983 - RNA, 17 nt, Human
cugugaguuuaaagcaa

SEQ ID NO: 2907984 - RNA, 21 nt, Human
cugugauacagaacucuuaaa

SEQ ID NO: 2907985 - RNA, 19 nt, Human
cugugauaguucacccccu

SEQ ID NO: 2907986 - RNA, 18 nt, Human
cugugccaugugccaggu

SEQ ID NO: 2907987 - RNA, 16 nt, Human
cugugccaugugccag

SEQ ID NO: 2907988 - RNA, 17 nt, Human
cugugcauguaugucuu

SEQ ID NO: 2907989 - RNA, 14 nt, Human
cugugcauucuccu

SEQ ID NO: 2907990 - RNA, 15 nt, Human
cugugcauucuccug

SEQ ID NO: 2907991 - RNA, 20 nt, Human
cugugcauucuccuggaugc

SEQ ID NO: 2907992 - RNA, 15 nt, Human
cugugcauugggauu

SEQ ID NO: 2907993 - RNA, 17 nt, Human
cugugcauuucugguug

SEQ ID NO: 2907994 - RNA, 13 nt, Human
cugugccuccuca

SEQ ID NO: 2907995 - RNA, 16 nt, Human
cugugccuccucaccc

SEQ ID NO: 2907996 - RNA, 15 nt, Human
cugugccuccucacc

SEQ ID NO: 2907997 - RNA, 21 nt, Human
cugugcaacgccgugggcugc

SEQ ID NO: 2907998 - RNA, 18 nt, Human
cugugcaacgccgugggc

SEQ ID NO: 2907999 - RNA, 19 nt, Human
cugugauccacccaacccu

SEQ ID NO: 2908000 - RNA, 17 nt, Human
cugugcaacgccguggg

SEQ ID NO: 2908001 - RNA, 16 nt, Human
cugugcauagugcugg

SEQ ID NO: 2908002 - RNA, 18 nt, Human
cugugcauagugcuggga

SEQ ID NO: 2908003 - RNA, 15 nt, Human
cugugcauguauguc

SEQ ID NO: 2908004 - RNA, 16 nt, Human
cugugcauguaugucu

SEQ ID NO: 2908005 - RNA, 11 nt, Human
cugugcacaca

SEQ ID NO: 2908006 - RNA, 12 nt, Human
cugugcacacac

SEQ ID NO: 2908007 - RNA, 15 nt, Human
cugugcacacacaca

SEQ ID NO: 2908008 - RNA, 20 nt, Human
cugugcacacacacacacau

SEQ ID NO: 2908009 - RNA, 21 nt, Human
cugugcacacacacacacaug

SEQ ID NO: 2908010 - RNA, 18 nt, Human
gaauucuugaaggaaaau

SEQ ID NO: 2908011 - RNA, 21 nt, Human
gaauucuuaugcuuauaauau

SEQ ID NO: 2908012 - RNA, 11 nt, Human
gaauucuuccu

SEQ ID NO: 2908013 - RNA, 17 nt, Human
gaauugaccaucugcuu

SEQ ID NO: 2908014 - RNA, 18 nt, Human
gaauugaccaucugcuuu

SEQ ID NO: 2908015 - RNA, 18 nt, Human
gaauugauuugcauugaa

SEQ ID NO: 2908016 - RNA, 22 nt, Human
gaauugauuugcauugaacaca

SEQ ID NO: 2908017 - RNA, 14 nt, Human
gaauugcagaguac

SEQ ID NO: 2908018 - RNA, 13 nt, Human
gaauugcauugac

SEQ ID NO: 2908019 - RNA, 12 nt, Human
gaauugcauuga

SEQ ID NO: 2908020 - RNA, 13 nt, Human
gaauguuuccggg

SEQ ID NO: 2908021 - RNA, 15 nt, Human
gaauguuucuuaacu

SEQ ID NO: 2908022 - RNA, 23 nt, Human
gaauguuucuuaacuauaaauau

SEQ ID NO: 2908023 - RNA, 14 nt, Human
gaauguuuauuccu

SEQ ID NO: 2908024 - RNA, 15 nt, Human
gaauguuaagcagau

SEQ ID NO: 2908025 - RNA, 14 nt, Human
gaauguuagagcac

SEQ ID NO: 2908026 - RNA, 13 nt, Human
gaauguuaauuuu

SEQ ID NO: 2908027 - RNA, 22 nt, Human
gaauguuaauuuuuugguacaa

SEQ ID NO: 2908028 - RNA, 23 nt, Human
gaauguuaauuuuuugguacaaa

SEQ ID NO: 2908029 - RNA, 19 nt, Human
gaauguuaagaauugacca

SEQ ID NO: 2908030 - RNA, 18 nt, Human
gaauguugguuuacuuuc

SEQ ID NO: 2908031 - RNA, 20 nt, Human
gaauguugguuuacuuucaa

SEQ ID NO: 2908032 - RNA, 22 nt, Human
gaauguugguuuacuuucaaau

SEQ ID NO: 2908033 - RNA, 21 nt, Human
gaauguuuaaagaucaugaca

SEQ ID NO: 2908034 - RNA, 21 nt, Human
gaauggccugccuugaagcca

SEQ ID NO: 2908035 - RNA, 14 nt, Human
gaauggcguccgug

SEQ ID NO: 2908036 - RNA, 17 nt, Human
gaauggccugccuugaa

SEQ ID NO: 2908037 - RNA, 14 nt, Human
gaauguacucuguu

SEQ ID NO: 2908038 - RNA, 21 nt, Human
gaauguagcagccccgggagg

SEQ ID NO: 2908039 - RNA, 23 nt, Human
gaauguagcagccccgggagggc

SEQ ID NO: 2908040 - RNA, 23 nt, Human
gaauguauuuauuugggagaccg

SEQ ID NO: 2908041 - RNA, 16 nt, Human
gaaugucuuuugaaua

SEQ ID NO: 2908042 - RNA, 17 nt, Human
gaaucugauuuuuauga

SEQ ID NO: 2908043 - RNA, 17 nt, Human
gaaugucccuuuuccua

SEQ ID NO: 2908044 - RNA, 14 nt, Human
gaaugugaaagcac

SEQ ID NO: 2908045 - RNA, 14 nt, Human
gaauguuaagcaga

SEQ ID NO: 2908046 - RNA, 12 nt, Human
gaaugugucagg

SEQ ID NO: 2908047 - RNA, 13 nt, Human
gaauguguuucaa

SEQ ID NO: 2908048 - RNA, 18 nt, Human
gaauguguuucaaacugu

SEQ ID NO: 2908049 - RNA, 19 nt, Human
gaauguguuucaaacugua

SEQ ID NO: 2908050 - RNA, 18 nt, Human
gaauguggcuugagaaau

SEQ ID NO: 2908051 - RNA, 15 nt, Human
gaaugugggcacugg

SEQ ID NO: 2908052 - RNA, 20 nt, Human
gaaugugggcacuggcccag

SEQ ID NO: 2908053 - RNA, 21 nt, Human
gaaugugggcacuggcccagg

SEQ ID NO: 2908054 - RNA, 13 nt, Human
gaauguggucuca

SEQ ID NO: 2908055 - RNA, 14 nt, Human
gaauguggucucag

SEQ ID NO: 2908056 - RNA, 15 nt, Human
gaauguggucucagg

SEQ ID NO: 2908057 - RNA, 16 nt, Human
gaauguggucucagga

SEQ ID NO: 2908058 - RNA, 17 nt, Human
gaauguggucucaggau

SEQ ID NO: 2908059 - RNA, 22 nt, Human
gaauguggccccugaacaagaa

SEQ ID NO: 2908060 - RNA, 18 nt, Human
gaauguguacaaagugua

SEQ ID NO: 2908061 - RNA, 13 nt, Human
gaaucuauauuua

SEQ ID NO: 2908062 - RNA, 15 nt, Human
gaaucuacuaauucc

SEQ ID NO: 2908063 - RNA, 14 nt, Human
gaauccuuugccug

SEQ ID NO: 2908064 - RNA, 19 nt, Human
gaauccuuuggugccaacu

SEQ ID NO: 2908065 - RNA, 13 nt, Human
gaauccuuuugua

SEQ ID NO: 2908066 - RNA, 22 nt, Human
gaaucuacccccagauccaagc

SEQ ID NO: 2908067 - RNA, 18 nt, Human
gaaucuacccccagaucc

SEQ ID NO: 2908068 - RNA, 20 nt, Human
gaauccagacccggcugcgu

SEQ ID NO: 2908069 - RNA, 18 nt, Human
gaauccagacccggcugc

SEQ ID NO: 2908070 - RNA, 18 nt, Human
gaaucccacccacaugug

SEQ ID NO: 2908071 - RNA, 22 nt, Human
gaaucccacccacaugugacac

SEQ ID NO: 2908072 - RNA, 16 nt, Human
gaaucccaaauuugau

SEQ ID NO: 2908073 - RNA, 19 nt, Human
gaaucccaaauuugauuga

SEQ ID NO: 2908074 - RNA, 17 nt, Human
gaaucccaaauuugauu

SEQ ID NO: 2908075 - RNA, 17 nt, Human
gaaucaugucaggccug

SEQ ID NO: 2908076 - RNA, 20 nt, Human
gaaucaugucaggccugugu

SEQ ID NO: 2908077 - RNA, 21 nt, Human
gaaucaugucaggccugugug

SEQ ID NO: 2908078 - RNA, 19 nt, Human
gaaucauacuuagcaaagu

SEQ ID NO: 2908079 - RNA, 19 nt, Human
gaaucaguuuccaauuauu

SEQ ID NO: 2908080 - RNA, 22 nt, Human
gaaucaguuuccaauuauuuga

SEQ ID NO: 2908081 - RNA, 13 nt, Human
gaaaggccugcac

SEQ ID NO: 2908082 - RNA, 14 nt, Human
gaaaggccugcaca

SEQ ID NO: 2908083 - RNA, 15 nt, Human
gaaaggccugcacac

SEQ ID NO: 2908084 - RNA, 16 nt, Human
gaaaggccugcacaca

SEQ ID NO: 2908085 - RNA, 19 nt, Human
gaaaggcucagucucagga

SEQ ID NO: 2908086 - RNA, 18 nt, Human
gaaaggcucagucucagg

SEQ ID NO: 2908087 - RNA, 14 nt, Human
gaaaggcucagucu

SEQ ID NO: 2908088 - RNA, 22 nt, Human
gaaaggcucagucucaggagca

SEQ ID NO: 2908089 - RNA, 21 nt, Human
gaaaggcucagucucaggagc

SEQ ID NO: 2908090 - RNA, 12 nt, Human
gaaucagcuucu

SEQ ID NO: 2908091 - RNA, 14 nt, Human
gaaugcuguguuaa

SEQ ID NO: 2908092 - RNA, 18 nt, Human
gaaugcuuauagguggcc

SEQ ID NO: 2908093 - RNA, 12 nt, Human
gaaugcuucuca

SEQ ID NO: 2908094 - RNA, 22 nt, Human
gaaugcuuauagguggccucuc

SEQ ID NO: 2908095 - RNA, 16 nt, Human
gaauggcagcugccac

SEQ ID NO: 2908096 - RNA, 13 nt, Human
gaauggcagcugc

SEQ ID NO: 2908097 - RNA, 15 nt, Human
gaaugcacagauaua

SEQ ID NO: 2908098 - RNA, 16 nt, Human
gaaugcacagauauac

SEQ ID NO: 2908099 - RNA, 17 nt, Human
gaaugcacagauauacu

SEQ ID NO: 2908100 - RNA, 22 nt, Human
gaaugcacagauauacuuugug

SEQ ID NO: 2908101 - RNA, 13 nt, Human
gaaugcuguguua

SEQ ID NO: 2908102 - RNA, 15 nt, Human
gaaugcuguauaugu

SEQ ID NO: 2908103 - RNA, 21 nt, Human
gaaugaaagggcccagagagg

SEQ ID NO: 2908104 - RNA, 22 nt, Human
gaaucugcaauucaaaaguucc

SEQ ID NO: 2908105 - RNA, 13 nt, Human
gaaucugcucacu

SEQ ID NO: 2908106 - RNA, 15 nt, Human
gaaucugcucacuuu

SEQ ID NO: 2908107 - RNA, 16 nt, Human
gaaucugcucacuuua

SEQ ID NO: 2908108 - RNA, 17 nt, Human
gaaucucccacuccagc

SEQ ID NO: 2908109 - RNA, 18 nt, Human
gaaucucccacuccagcg

SEQ ID NO: 2908110 - RNA, 15 nt, Human
gaaucugcaauucaa

SEQ ID NO: 2908111 - RNA, 21 nt, Human
gaaucugcaauucaaaaguuc

SEQ ID NO: 2908112 - RNA, 20 nt, Human
gaaugaacacucuuuugcuu

SEQ ID NO: 2908113 - RNA, 23 nt, Human
gaaugaaauccugcuucagugua

SEQ ID NO: 2908114 - RNA, 13 nt, Human
gacaacugugacu

SEQ ID NO: 2908115 - RNA, 13 nt, Human
gacaagaaaauca

SEQ ID NO: 2908116 - RNA, 15 nt, Human
gacaagaaaaucagg

SEQ ID NO: 2908117 - RNA, 12 nt, Human
gacaacugugac

SEQ ID NO: 2908118 - RNA, 12 nt, Human
gacaacagaagc

SEQ ID NO: 2908119 - RNA, 16 nt, Human
gacaacagacuucuga

SEQ ID NO: 2908120 - RNA, 19 nt, Human
gacaaccauauuuagcagu

SEQ ID NO: 2908121 - RNA, 12 nt, Human
gacaaccaugac

SEQ ID NO: 2908122 - RNA, 19 nt, Human
gacaacacugggaaacaga

SEQ ID NO: 2908123 - RNA, 16 nt, Human
gacaacacagccuaua

SEQ ID NO: 2908124 - RNA, 22 nt, Human
gacaacagaagucaugaagccc

SEQ ID NO: 2908125 - RNA, 17 nt, Human
gacaacagaagucauga

SEQ ID NO: 2908126 - RNA, 14 nt, Human
gacaacagaaguca

SEQ ID NO: 2908127 - RNA, 12 nt, Human
gacaacagaagu

SEQ ID NO: 2908128 - RNA, 16 nt, Human
gacaaauguaaacauu

SEQ ID NO: 2908129 - RNA, 11 nt, Human
gacaaauguga

SEQ ID NO: 2908130 - RNA, 13 nt, Human
gacaaaugugaag

SEQ ID NO: 2908131 - RNA, 16 nt, Human
gacaaaugugaagaug

SEQ ID NO: 2908132 - RNA, 18 nt, Human
gacaaaugugaagaugca

SEQ ID NO: 2908133 - RNA, 12 nt, Human
gacaaaucugug

SEQ ID NO: 2908134 - RNA, 14 nt, Human
gacaaaucugugua

SEQ ID NO: 2908135 - RNA, 20 nt, Human
gacaaaucuguguauauuau

SEQ ID NO: 2908136 - RNA, 22 nt, Human
gacaaauguguaucggaugcuu

SEQ ID NO: 2908137 - RNA, 19 nt, Human
gacaaauugagacagugca

SEQ ID NO: 2908138 - RNA, 15 nt, Human
gacaaauugcacaga

SEQ ID NO: 2908139 - RNA, 16 nt, Human
gacaaauugcacagaa

SEQ ID NO: 2908140 - RNA, 21 nt, Human
gaauuucuucaacucccugcc

SEQ ID NO: 2908141 - RNA, 19 nt, Human
gaauuucuucacuguugaa

SEQ ID NO: 2908142 - RNA, 12 nt, Human
gaauuucuuggu

SEQ ID NO: 2908143 - RNA, 21 nt, Human
gaauuucuugguaagaagccg

SEQ ID NO: 2908144 - RNA, 11 nt, Human
gaauuucuugu

SEQ ID NO: 2908145 - RNA, 20 nt, Human
gaauuucuucacuguugaaa

SEQ ID NO: 2908146 - RNA, 14 nt, Human
gaauuugcccuggg

SEQ ID NO: 2908147 - RNA, 23 nt, Human
gaauuugcccugggaaaccccuu

SEQ ID NO: 2908148 - RNA, 19 nt, Human
gaauuuggccugcacuaau

SEQ ID NO: 2908149 - RNA, 19 nt, Human
gaauuugggacccugcuuu

SEQ ID NO: 2908150 - RNA, 20 nt, Human
gaauuugggacccugcuuua

SEQ ID NO: 2908151 - RNA, 21 nt, Human
gaauuugggacccugcuuuag

SEQ ID NO: 2908152 - RNA, 23 nt, Human
gaauuugggacccugcuuuagag

SEQ ID NO: 2908153 - RNA, 19 nt, Human
gaauuuggagacucugugg

SEQ ID NO: 2908154 - RNA, 13 nt, Human
gaauuugcugggg

SEQ ID NO: 2908155 - RNA, 13 nt, Human
gaauuuggaaauc

SEQ ID NO: 2908156 - RNA, 14 nt, Human
gaauuuggaaaucc

SEQ ID NO: 2908157 - RNA, 21 nt, Human
gacaaaucaacagaagcauuu

SEQ ID NO: 2908158 - RNA, 23 nt, Human
gacaaaucaacagaagcauuugu

SEQ ID NO: 2908159 - RNA, 19 nt, Human
gaauuucuaucuaaaugau

SEQ ID NO: 2908160 - RNA, 17 nt, Human
gaauuucuaaaaaacag

SEQ ID NO: 2908161 - RNA, 18 nt, Human
gaauuucuaaaaagauua

SEQ ID NO: 2908162 - RNA, 12 nt, Human
gaauuucuaaaa

SEQ ID NO: 2908163 - RNA, 15 nt, Human
gaauugcguuggucu

SEQ ID NO: 2908164 - RNA, 22 nt, Human
gaauuggaccauccuauuuaac

SEQ ID NO: 2908165 - RNA, 16 nt, Human
gaauugggagcuuggg

SEQ ID NO: 2908166 - RNA, 17 nt, Human
gaauugggagcuuggga

SEQ ID NO: 2908167 - RNA, 16 nt, Human
gaauugggcggcucug

SEQ ID NO: 2908168 - RNA, 17 nt, Human
gaauugggcggcucuga

SEQ ID NO: 2908169 - RNA, 20 nt, Human
gaauugggcggcucugaagc

SEQ ID NO: 2908170 - RNA, 16 nt, Human
gacaagaaaucccugu

SEQ ID NO: 2908171 - RNA, 21 nt, Human
gacaagacaaaccaagucgga

SEQ ID NO: 2908172 - RNA, 15 nt, Human
gacaagaaaucccug

SEQ ID NO: 2908173 - RNA, 17 nt, Human
gacaaggaaaggcaaau

SEQ ID NO: 2908174 - RNA, 19 nt, Human
gacaaggaaaggcaaaugc

SEQ ID NO: 2908175 - RNA, 19 nt, Human
gacaaggauugcuacuguc

SEQ ID NO: 2908176 - RNA, 18 nt, Human
gacaaggauugcuacugu

SEQ ID NO: 2908177 - RNA, 17 nt, Human
gacacaaaacuccgccc

SEQ ID NO: 2908178 - RNA, 18 nt, Human
gacacaaaacuccgcccc

SEQ ID NO: 2908179 - RNA, 21 nt, Human
gacacaaaacuccgcccccag

SEQ ID NO: 2908180 - RNA, 22 nt, Human
gacacaaaacuccgcccccagc

SEQ ID NO: 2908181 - RNA, 23 nt, Human
gacacaaaacuccgcccccagcc

SEQ ID NO: 2908182 - RNA, 19 nt, Human
gacaaauucauauucuuuu

SEQ ID NO: 2908183 - RNA, 22 nt, Human
gacaaugcaccuagcugugcaa

SEQ ID NO: 2908184 - RNA, 17 nt, Human
gacaaugucugcagccc

SEQ ID NO: 2908185 - RNA, 19 nt, Human
gacaaugucugcagcccug

SEQ ID NO: 2908186 - RNA, 18 nt, Human
gacacaaaccugccuggg

SEQ ID NO: 2908187 - RNA, 20 nt, Human
gacacaaaccugccuggguu

SEQ ID NO: 2908188 - RNA, 14 nt, Human
gacacaaaggaagu

SEQ ID NO: 2908189 - RNA, 13 nt, Human
gacacaaaugcau

SEQ ID NO: 2908190 - RNA, 14 nt, Human
gacacaaaugcaug

SEQ ID NO: 2908191 - RNA, 17 nt, Human
gacacaaaccugccugg

SEQ ID NO: 2908192 - RNA, 14 nt, Human
gacacaaaccugcc

SEQ ID NO: 2908193 - RNA, 13 nt, Human
gacacaacuauuu

SEQ ID NO: 2908194 - RNA, 19 nt, Human
gacacaggcccggcuccag

SEQ ID NO: 2908195 - RNA, 21 nt, Human
gacacaggcccggcuccaggc

SEQ ID NO: 2908196 - RNA, 20 nt, Human
gacacaggcccggcuccagg

SEQ ID NO: 2908197 - RNA, 14 nt, Human
gacacaacaacucc

SEQ ID NO: 2908198 - RNA, 23 nt, Human
gacacauccgccuuuuguauaca

SEQ ID NO: 2908199 - RNA, 19 nt, Human
gacaccagagcagaugcag

SEQ ID NO: 2908200 - RNA, 22 nt, Human
gacaccagagcagaugcagaga

SEQ ID NO: 2908201 - RNA, 19 nt, Human
gacaccacacccagccuca

SEQ ID NO: 2908202 - RNA, 20 nt, Human
gacaccacacccagccucag

SEQ ID NO: 2908203 - RNA, 21 nt, Human
gacaccacacccagccucagu

SEQ ID NO: 2908204 - RNA, 12 nt, Human
gacaccagagca

SEQ ID NO: 2908205 - RNA, 13 nt, Human
gacaccagagcag

SEQ ID NO: 2908206 - RNA, 14 nt, Human
gacaccagagcaga

SEQ ID NO: 2908207 - RNA, 15 nt, Human
gacaccagagcagau

SEQ ID NO: 2908208 - RNA, 18 nt, Human
gacaccagagcagaugca

SEQ ID NO: 2908209 - RNA, 14 nt, Human
gacacauuuaagga

SEQ ID NO: 2908210 - RNA, 15 nt, Human
gacacauuuaaggau

SEQ ID NO: 2908211 - RNA, 15 nt, Human
gacaccaaagccacc

SEQ ID NO: 2908212 - RNA, 14 nt, Human
gacaccacacccag

SEQ ID NO: 2908213 - RNA, 14 nt, Human
gacaccaaaguucu

SEQ ID NO: 2908214 - RNA, 15 nt, Human
gacaccaaaguucua

SEQ ID NO: 2908215 - RNA, 23 nt, Human
gacaccaaccgacaggcccuggc

SEQ ID NO: 2908216 - RNA, 15 nt, Human
gacaccacacccagc

SEQ ID NO: 2908217 - RNA, 16 nt, Human
gacaccacacccagcc

SEQ ID NO: 2908218 - RNA, 17 nt, Human
gacaccacacccagccu

SEQ ID NO: 2908219 - RNA, 18 nt, Human
gacaccacacccagccuc

SEQ ID NO: 2908220 - RNA, 16 nt, Human
gacccaaggaaaacug

SEQ ID NO: 2908221 - RNA, 18 nt, Human
gacccaaggaaaacugca

SEQ ID NO: 2908222 - RNA, 18 nt, Human
gacccaauguaggagcug

SEQ ID NO: 2908223 - RNA, 12 nt, Human
gacccccaacca

SEQ ID NO: 2908224 - RNA, 19 nt, Human
gacccaauguaggagcugc

SEQ ID NO: 2908225 - RNA, 13 nt, Human
gacccccacaccu

SEQ ID NO: 2908226 - RNA, 21 nt, Human
gacccccaaccaaguggcucc

SEQ ID NO: 2908227 - RNA, 15 nt, Human
gacccccacaccuca

SEQ ID NO: 2908228 - RNA, 21 nt, Human
gaccccuccaugugggcuagu

SEQ ID NO: 2908229 - RNA, 18 nt, Human
gaccccuccaugugggcu

SEQ ID NO: 2908230 - RNA, 14 nt, Human
gaccccuccaugug

SEQ ID NO: 2908231 - RNA, 18 nt, Human
gacccugcaaacagaaca

SEQ ID NO: 2908232 - RNA, 19 nt, Human
gacccugcaaacagaacag

SEQ ID NO: 2908233 - RNA, 20 nt, Human
gacccugcaaacagaacagg

SEQ ID NO: 2908234 - RNA, 22 nt, Human
gacccugcaaacagaacagggu

SEQ ID NO: 2908235 - RNA, 21 nt, Human
gacccugcgaaggggcccugg

SEQ ID NO: 2908236 - RNA, 12 nt, Human
gaccgcccccuc

SEQ ID NO: 2908237 - RNA, 14 nt, Human
gaccgcccccuccu

SEQ ID NO: 2908238 - RNA, 22 nt, Human
gaccgcccuccgcgaaaauagu

SEQ ID NO: 2908239 - RNA, 15 nt, Human
gaccgcccccuccuc

SEQ ID NO: 2908240 - RNA, 16 nt, Human
gaccgcccccuccucu

SEQ ID NO: 2908241 - RNA, 20 nt, Human
gaccgcuuguggggacccag

SEQ ID NO: 2908242 - RNA, 21 nt, Human
gaccgcuuguggggacccagg

SEQ ID NO: 2908243 - RNA, 22 nt, Human
gaccgcuuguggggacccaggc

SEQ ID NO: 2908244 - RNA, 17 nt, Human
gacccuggugccuggcu

SEQ ID NO: 2908245 - RNA, 18 nt, Human
gacccuggugccuggcuc

SEQ ID NO: 2908246 - RNA, 22 nt, Human
gacccugcgaaggggcccuggu

SEQ ID NO: 2908247 - RNA, 16 nt, Human
gacccugcuuuagagc

SEQ ID NO: 2908248 - RNA, 14 nt, Human
gacccuggggcugg

SEQ ID NO: 2908249 - RNA, 16 nt, Human
gacccuggggcuggcu

SEQ ID NO: 2908250 - RNA, 24 nt, Human
gaccagacaccuugacagggcaca

SEQ ID NO: 2908251 - RNA, 21 nt, Human
gaccacugcaugagcuuuuau

SEQ ID NO: 2908252 - RNA, 15 nt, Human
gaccacuuccagggg

SEQ ID NO: 2908253 - RNA, 23 nt, Human
gaccacuuccaggggaaccugcc

SEQ ID NO: 2908254 - RNA, 22 nt, Human
gaccacuuccaggggaaccugc

SEQ ID NO: 2908255 - RNA, 12 nt, Human
gaccacugcaug

SEQ ID NO: 2908256 - RNA, 16 nt, Human
gaccacuguuucuugc

SEQ ID NO: 2908257 - RNA, 18 nt, Human
gaccacuguuucuugcuu

SEQ ID NO: 2908258 - RNA, 19 nt, Human
gaccacuguuucuugcuug

SEQ ID NO: 2908259 - RNA, 20 nt, Human
gaccacuguuucuugcuugu

SEQ ID NO: 2908260 - RNA, 18 nt, Human
gaccaccccgccugcccu

SEQ ID NO: 2908261 - RNA, 19 nt, Human
gacauggcuuucagaaaac

SEQ ID NO: 2908262 - RNA, 20 nt, Human
gacauggcuuucagaaaacg

SEQ ID NO: 2908263 - RNA, 19 nt, Human
gaccaccccgccugcccuc

SEQ ID NO: 2908264 - RNA, 20 nt, Human
gaccaccccgccugcccuca

SEQ ID NO: 2908265 - RNA, 13 nt, Human
gaccaccugccca

SEQ ID NO: 2908266 - RNA, 14 nt, Human
gaccaccugcccaa

SEQ ID NO: 2908267 - RNA, 21 nt, Human
gaccagccuccaugcugccuc

SEQ ID NO: 2908268 - RNA, 22 nt, Human
gaccagccuccaugcugccucc

SEQ ID NO: 2908269 - RNA, 20 nt, Human
gaccagccuccaugcugccu

SEQ ID NO: 2908270 - RNA, 13 nt, Human
gaccauuuaacau

SEQ ID NO: 2908271 - RNA, 17 nt, Human
gaccauuuaacaugcaa

SEQ ID NO: 2908272 - RNA, 13 nt, Human
gaccagccuggcc

SEQ ID NO: 2908273 - RNA, 18 nt, Human
gaccagccuggccaacau

SEQ ID NO: 2908274 - RNA, 12 nt, Human
gaccagccuggc

SEQ ID NO: 2908275 - RNA, 11 nt, Human
gaccagccugg

SEQ ID NO: 2908276 - RNA, 16 nt, Human
gacagggaggugaccc

SEQ ID NO: 2908277 - RNA, 14 nt, Human
gacagggaugagca

SEQ ID NO: 2908278 - RNA, 21 nt, Human
gacagggaugagcauggagcu

SEQ ID NO: 2908279 - RNA, 23 nt, Human
gacagggaugagcauggagcugg

SEQ ID NO: 2908280 - RNA, 23 nt, Human
gacagggcacaccgggcacucag

SEQ ID NO: 2908281 - RNA, 24 nt, Human
gacagggcacaccgggcacucaga

SEQ ID NO: 2908282 - RNA, 19 nt, Human
gacagugcuucagccugag

SEQ ID NO: 2908283 - RNA, 18 nt, Human
gacagugcuucagccuga

SEQ ID NO: 2908284 - RNA, 20 nt, Human
gacagugcuucagccugagg

SEQ ID NO: 2908285 - RNA, 20 nt, Human
gacaguggauugcauuucuu

SEQ ID NO: 2908286 - RNA, 17 nt, Human
gacagugcuucagccug

SEQ ID NO: 2908287 - RNA, 16 nt, Human
gacagggaagagcaga

SEQ ID NO: 2908288 - RNA, 23 nt, Human
gacaggacagugcuucagccuga

SEQ ID NO: 2908289 - RNA, 22 nt, Human
gacaggacagugcuucagccug

SEQ ID NO: 2908290 - RNA, 14 nt, Human
gacaggacagugcu

SEQ ID NO: 2908291 - RNA, 23 nt, Human
gacaguguugaaaauguucagaa

SEQ ID NO: 2908292 - RNA, 14 nt, Human
gacauccuguauaa

SEQ ID NO: 2908293 - RNA, 19 nt, Human
gacauccuguauaagcacu

SEQ ID NO: 2908294 - RNA, 21 nt, Human
gacauccuguauaagcacuga

SEQ ID NO: 2908295 - RNA, 13 nt, Human
gacaucucagggg

SEQ ID NO: 2908296 - RNA, 15 nt, Human
gacaucucaggggcc

SEQ ID NO: 2908297 - RNA, 16 nt, Human
gacaucucaggggcca

SEQ ID NO: 2908298 - RNA, 17 nt, Human
gacaucucaggggccag

SEQ ID NO: 2908299 - RNA, 18 nt, Human
gacaucucaggggccaga

SEQ ID NO: 2908300 - RNA, 16 nt, Human
gacauccguugugcuu

SEQ ID NO: 2908301 - RNA, 23 nt, Human
gacauccccccgccaaaagcugc

SEQ ID NO: 2908302 - RNA, 22 nt, Human
gacauccauguuuguaaaacua

SEQ ID NO: 2908303 - RNA, 23 nt, Human
gacauccauguuuguaaaacuac

SEQ ID NO: 2908304 - RNA, 19 nt, Human
gacaugagugcgugcucag

SEQ ID NO: 2908305 - RNA, 22 nt, Human
gacaucucaggggccagaggaa

SEQ ID NO: 2908306 - RNA, 20 nt, Human
gacaucucaggggccagagg

SEQ ID NO: 2908307 - RNA, 13 nt, Human
gacaucucugcac

SEQ ID NO: 2908308 - RNA, 21 nt, Human
gacaugauggagcgcaccugc

SEQ ID NO: 2908309 - RNA, 20 nt, Human
gacaugauuagcagaagaaa

SEQ ID NO: 2908310 - RNA, 13 nt, Human
gacaugaugcuuu

SEQ ID NO: 2908311 - RNA, 19 nt, Human
gacaugaugcuuuuacuga

SEQ ID NO: 2908312 - RNA, 14 nt, Human
gacaugauuuccuu

SEQ ID NO: 2908313 - RNA, 20 nt, Human
gacaugauuuccuugaaugu

SEQ ID NO: 2908314 - RNA, 19 nt, Human
gacaugauuuccuugaaug

SEQ ID NO: 2908315 - RNA, 17 nt, Human
gacaugauuuccuugaa

SEQ ID NO: 2908316 - RNA, 16 nt, Human
gacaugauuuccuuga

SEQ ID NO: 2908317 - RNA, 18 nt, Human
gacaugccuauaugagaa

SEQ ID NO: 2908318 - RNA, 22 nt, Human
gacaugccuauaugagaagaau

SEQ ID NO: 2908319 - RNA, 14 nt, Human
gacaugcacucagc

SEQ ID NO: 2908320 - RNA, 12 nt, Human
gacaugcacuga

SEQ ID NO: 2908321 - RNA, 13 nt, Human
gacaugcacugac

SEQ ID NO: 2908322 - RNA, 14 nt, Human
gacaugcacugacc

SEQ ID NO: 2908323 - RNA, 15 nt, Human
gacaugcacugaccc

SEQ ID NO: 2908324 - RNA, 16 nt, Human
gacaugcacugacccu

SEQ ID NO: 2908325 - RNA, 20 nt, Human
gacaugcacugacccuucca

SEQ ID NO: 2908326 - RNA, 24 nt, Human
gacaugauuuccuugaauguggcu

SEQ ID NO: 2908327 - RNA, 22 nt, Human
gacaugauuuccuugaaugugg

SEQ ID NO: 2908328 - RNA, 12 nt, Human
gacagaggcagc

SEQ ID NO: 2908329 - RNA, 13 nt, Human
gacagagccaugc

SEQ ID NO: 2908330 - RNA, 19 nt, Human
gacagagccaugcugggaa

SEQ ID NO: 2908331 - RNA, 16 nt, Human
gacagaggcagcccca

SEQ ID NO: 2908332 - RNA, 14 nt, Human
gacagaggcagccc

SEQ ID NO: 2908333 - RNA, 15 nt, Human
gacacccauuuucac

SEQ ID NO: 2908334 - RNA, 14 nt, Human
gacagagucucacu

SEQ ID NO: 2908335 - RNA, 17 nt, Human
gacagaggcagccccau

SEQ ID NO: 2908336 - RNA, 21 nt, Human
gacagccacggccaggccaga

SEQ ID NO: 2908337 - RNA, 20 nt, Human
gacagccacggccaggccag

SEQ ID NO: 2908338 - RNA, 20 nt, Human
gacagcuuuccccucauuuu

SEQ ID NO: 2908339 - RNA, 19 nt, Human
gacagccacggccaggcca

SEQ ID NO: 2908340 - RNA, 18 nt, Human
gacagccacggccaggcc

SEQ ID NO: 2908341 - RNA, 17 nt, Human
gacagccacggccaggc

SEQ ID NO: 2908342 - RNA, 14 nt, Human
gacagccacggcca

SEQ ID NO: 2908343 - RNA, 22 nt, Human
gacagagugagacucugucuca

SEQ ID NO: 2908344 - RNA, 20 nt, Human
gacagagugagacucugucu

SEQ ID NO: 2908345 - RNA, 16 nt, Human
gacagaguaugaacac

SEQ ID NO: 2908346 - RNA, 18 nt, Human
gacagagggucacagugu

SEQ ID NO: 2908347 - RNA, 20 nt, Human
gacagagggucacaguguuu

SEQ ID NO: 2908348 - RNA, 22 nt, Human
gacugaguccucguagccaucu

SEQ ID NO: 2908349 - RNA, 21 nt, Human
gacugcagguuggaccccaga

SEQ ID NO: 2908350 - RNA, 22 nt, Human
gacugcagguuggaccccagag

SEQ ID NO: 2908351 - RNA, 23 nt, Human
gacugcagguuggaccccagaga

SEQ ID NO: 2908352 - RNA, 17 nt, Human
gacugcacccaggaggg

SEQ ID NO: 2908353 - RNA, 18 nt, Human
gacugcacccaggagggg

SEQ ID NO: 2908354 - RNA, 21 nt, Human
gacugcauguaccauuugcau

SEQ ID NO: 2908355 - RNA, 23 nt, Human
gacugcauguaccauuugcaugg

SEQ ID NO: 2908356 - RNA, 13 nt, Human
gacucucugugac

SEQ ID NO: 2908357 - RNA, 12 nt, Human
gacucucuguga

SEQ ID NO: 2908358 - RNA, 22 nt, Human
gacuccuggucugaaaauguug

SEQ ID NO: 2908359 - RNA, 16 nt, Human
gacucuagaguccaag

SEQ ID NO: 2908360 - RNA, 18 nt, Human
gacucuagaguccaaggu

SEQ ID NO: 2908361 - RNA, 19 nt, Human
gacucuagaguccaagguu

SEQ ID NO: 2908362 - RNA, 15 nt, Human
gacucucagcccaga

SEQ ID NO: 2908363 - RNA, 16 nt, Human
gacucucagcccagaa

SEQ ID NO: 2908364 - RNA, 17 nt, Human
gacucucagcccagaag

SEQ ID NO: 2908365 - RNA, 19 nt, Human
gacucucagcccagaagaa

SEQ ID NO: 2908366 - RNA, 21 nt, Human
gacucucagcccagaagaaaa

SEQ ID NO: 2908367 - RNA, 17 nt, Human
gacuggaccugguggcu

SEQ ID NO: 2908368 - RNA, 18 nt, Human
gacuggaccugguggcua

SEQ ID NO: 2908369 - RNA, 18 nt, Human
gacuggaagcacagcuuc

SEQ ID NO: 2908370 - RNA, 20 nt, Human
gacuggaagcuaauuugcau

SEQ ID NO: 2908371 - RNA, 21 nt, Human
gacuggaagcuaauuugcauu

SEQ ID NO: 2908372 - RNA, 13 nt, Human
gacuggaaguuca

SEQ ID NO: 2908373 - RNA, 19 nt, Human
gacuggaaguucauaccua

SEQ ID NO: 2908374 - RNA, 21 nt, Human
gacuggaaguucauaccuaag

SEQ ID NO: 2908375 - RNA, 14 nt, Human
gacuggggggcuug

SEQ ID NO: 2908376 - RNA, 15 nt, Human
gacuggggugggagg

SEQ ID NO: 2908377 - RNA, 16 nt, Human
gacuggggugggaggu

SEQ ID NO: 2908378 - RNA, 20 nt, Human
gacuggggaugugggaggga

SEQ ID NO: 2908379 - RNA, 23 nt, Human
gacuggggaugugggagggagca

SEQ ID NO: 2908380 - RNA, 16 nt, Human
gacuggggauguggga

SEQ ID NO: 2908381 - RNA, 17 nt, Human
gacuggggaugugggag

SEQ ID NO: 2908382 - RNA, 18 nt, Human
gacuggggaugugggagg

SEQ ID NO: 2908383 - RNA, 13 nt, Human
gacugggagguag

SEQ ID NO: 2908384 - RNA, 16 nt, Human
gacuggaagcacagcu

SEQ ID NO: 2908385 - RNA, 15 nt, Human
gacuggaagcacagc

SEQ ID NO: 2908386 - RNA, 14 nt, Human
gacuggaagcacag

SEQ ID NO: 2908387 - RNA, 14 nt, Human
gacugcugggacug

SEQ ID NO: 2908388 - RNA, 12 nt, Human
gacugcugggac

SEQ ID NO: 2908389 - RNA, 12 nt, Human
gacugccucugc

SEQ ID NO: 2908390 - RNA, 13 nt, Human
gacugccucugcc

SEQ ID NO: 2908391 - RNA, 14 nt, Human
gacugccucugcca

SEQ ID NO: 2908392 - RNA, 15 nt, Human
gacugccucugccac

SEQ ID NO: 2908393 - RNA, 14 nt, Human
gacugcugcugccu

SEQ ID NO: 2908394 - RNA, 16 nt, Human
gacugcugcugccugg

SEQ ID NO: 2908395 - RNA, 17 nt, Human
gacugcugcugccuggc

SEQ ID NO: 2908396 - RNA, 19 nt, Human
gacugcugcugccuggcca

SEQ ID NO: 2908397 - RNA, 21 nt, Human
gacugcugcugccuggccacu

SEQ ID NO: 2908398 - RNA, 22 nt, Human
gacugcugcugccuggccacug

SEQ ID NO: 2908399 - RNA, 19 nt, Human
gacugcugggacuggccag

SEQ ID NO: 2908400 - RNA, 15 nt, Human
gacuccggcccuccu

SEQ ID NO: 2908401 - RNA, 17 nt, Human
gacucagcuccccagag

SEQ ID NO: 2908402 - RNA, 18 nt, Human
gacucagcuccccagagu

SEQ ID NO: 2908403 - RNA, 20 nt, Human
gacucagcuccccagagucc

SEQ ID NO: 2908404 - RNA, 17 nt, Human
gacuccuaggcaggaca

SEQ ID NO: 2908405 - RNA, 19 nt, Human
gacuccuaggcaggacaug

SEQ ID NO: 2908406 - RNA, 16 nt, Human
gacuccuaccugcccu

SEQ ID NO: 2908407 - RNA, 17 nt, Human
gacuccuaccugcccug

SEQ ID NO: 2908408 - RNA, 18 nt, Human
gacuccuaccugcccugg

SEQ ID NO: 2908409 - RNA, 19 nt, Human
gacuccuaccugcccugga

SEQ ID NO: 2908410 - RNA, 22 nt, Human
gacuccggcccuccuacccugc

SEQ ID NO: 2908411 - RNA, 14 nt, Human
gacuccucugucca

SEQ ID NO: 2908412 - RNA, 11 nt, Human
gacuccucugu

SEQ ID NO: 2908413 - RNA, 23 nt, Human
gacuccuaggcaggacaugcuga

SEQ ID NO: 2908414 - RNA, 13 nt, Human
gacuccuccccac

SEQ ID NO: 2908415 - RNA, 19 nt, Human
gacuccuccccacccuccu

SEQ ID NO: 2908416 - RNA, 20 nt, Human
gacuccuccccacccuccug

SEQ ID NO: 2908417 - RNA, 21 nt, Human
gacuccuccccacccuccugg

SEQ ID NO: 2908418 - RNA, 22 nt, Human
gacuccuccccacccuccuggc

SEQ ID NO: 2908419 - RNA, 16 nt, Human
gacuccuccuuucucc

SEQ ID NO: 2908420 - RNA, 23 nt, Human
gacuccugcacacgcuccuuccu

SEQ ID NO: 2908421 - RNA, 22 nt, Human
gacuccuugagagaccaggcaa

SEQ ID NO: 2908422 - RNA, 16 nt, Human
gacuccugugcaacuu

SEQ ID NO: 2908423 - RNA, 19 nt, Human
gacucagaagccucugggu

SEQ ID NO: 2908424 - RNA, 13 nt, Human
gacucagcccuga

SEQ ID NO: 2908425 - RNA, 11 nt, Human
gacucagcccu

SEQ ID NO: 2908426 - RNA, 11 nt, Human
gacucagagaa

SEQ ID NO: 2908427 - RNA, 23 nt, Human
gacuagagggaccucucccaggg

SEQ ID NO: 2908428 - RNA, 20 nt, Human
gacuagagggaccucuccca

SEQ ID NO: 2908429 - RNA, 19 nt, Human
gacuagagggaccucuccc

SEQ ID NO: 2908430 - RNA, 17 nt, Human
gacuagagggaccucuc

SEQ ID NO: 2908431 - RNA, 21 nt, Human
gacuagaugauggaugccaau

SEQ ID NO: 2908432 - RNA, 16 nt, Human
gacuagaugauggaug

SEQ ID NO: 2908433 - RNA, 14 nt, Human
gacuagaugaugga

SEQ ID NO: 2908434 - RNA, 15 nt, Human
gacucauucuucugu

SEQ ID NO: 2908435 - RNA, 14 nt, Human
gacucauucuucug

SEQ ID NO: 2908436 - RNA, 16 nt, Human
gacucagcccugaggu

SEQ ID NO: 2908437 - RNA, 18 nt, Human
gacucagccugcaguuaa

SEQ ID NO: 2908438 - RNA, 15 nt, Human
gacucagcccugagg

SEQ ID NO: 2908439 - RNA, 14 nt, Human
gacucagcucccca

SEQ ID NO: 2908440 - RNA, 21 nt, Human
gacuacaggugugagucacca

SEQ ID NO: 2908441 - RNA, 18 nt, Human
gacuacaggugugaguca

SEQ ID NO: 2908442 - RNA, 17 nt, Human
gaccucaagugaucugc

SEQ ID NO: 2908443 - RNA, 16 nt, Human
gaccucacagugaccc

SEQ ID NO: 2908444 - RNA, 18 nt, Human
gaccucacagugacccuu

SEQ ID NO: 2908445 - RNA, 20 nt, Human
gaccucacagugacccuucc

SEQ ID NO: 2908446 - RNA, 14 nt, Human
gacuacauuuagag

SEQ ID NO: 2908447 - RNA, 13 nt, Human
gacuacaggugug

SEQ ID NO: 2908448 - RNA, 15 nt, Human
gaccuacuguucuaa

SEQ ID NO: 2908449 - RNA, 17 nt, Human
gaccuacuguucuaaag

SEQ ID NO: 2908450 - RNA, 16 nt, Human
gaccuaggcaguaggc

SEQ ID NO: 2908451 - RNA, 18 nt, Human
gaccuacuguucuaaagc

SEQ ID NO: 2908452 - RNA, 14 nt, Human
gacuucggaccgcu

SEQ ID NO: 2908453 - RNA, 17 nt, Human
gacuucggaccgcuugu

SEQ ID NO: 2908454 - RNA, 19 nt, Human
gacuucuaauaucauucac

SEQ ID NO: 2908455 - RNA, 14 nt, Human
gacuucuccagguc

SEQ ID NO: 2908456 - RNA, 22 nt, Human
gacuucuccaggucucacgggc

SEQ ID NO: 2908457 - RNA, 14 nt, Human
gacuucugcuggca

SEQ ID NO: 2908458 - RNA, 16 nt, Human
gacuuccuugagacac

SEQ ID NO: 2908459 - RNA, 20 nt, Human
gacuuccuugagacacggag

SEQ ID NO: 2908460 - RNA, 14 nt, Human
gacuuccuugagac

SEQ ID NO: 2908461 - RNA, 15 nt, Human
gacuuccuugagaca

SEQ ID NO: 2908462 - RNA, 14 nt, Human
gacugggggccaga

SEQ ID NO: 2908463 - RNA, 19 nt, Human
gacuuaaaauauuccugca

SEQ ID NO: 2908464 - RNA, 20 nt, Human
gacuuaagcaaaagaaaaag

SEQ ID NO: 2908465 - RNA, 17 nt, Human
gacuugaacuuuccugg

SEQ ID NO: 2908466 - RNA, 18 nt, Human
gacuuguagcauauucuu

SEQ ID NO: 2908467 - RNA, 20 nt, Human
gacuuggggagauggaguuc

SEQ ID NO: 2908468 - RNA, 22 nt, Human
gacuugggggaacgaugugucu

SEQ ID NO: 2908469 - RNA, 20 nt, Human
gacuugggucucauuuagaa

SEQ ID NO: 2908470 - RNA, 21 nt, Human
gacuugccagagccgggcaca

SEQ ID NO: 2908471 - RNA, 23 nt, Human
gacuugccaugugacucuggcuu

SEQ ID NO: 2908472 - RNA, 16 nt, Human
gacuugccuccguguc

SEQ ID NO: 2908473 - RNA, 17 nt, Human
gacuugccuccguguca

SEQ ID NO: 2908474 - RNA, 22 nt, Human
gacuugccuuccuaagccugug

SEQ ID NO: 2908475 - RNA, 18 nt, Human
gacuugcaugaagagaag

SEQ ID NO: 2908476 - RNA, 22 nt, Human
gacuugccaacaccacagaaau

SEQ ID NO: 2908477 - RNA, 17 nt, Human
gacuuggcaacagaagc

SEQ ID NO: 2908478 - RNA, 19 nt, Human
gacuuggcaacagaagcag

SEQ ID NO: 2908479 - RNA, 21 nt, Human
gagaagcacacucuggucuug

SEQ ID NO: 2908480 - RNA, 19 nt, Human
gagaagcauauagaggcaa

SEQ ID NO: 2908481 - RNA, 18 nt, Human
gagaagcauauagaggca

SEQ ID NO: 2908482 - RNA, 19 nt, Human
gagaagagagaaauagccu

SEQ ID NO: 2908483 - RNA, 12 nt, Human
gagaagagagga

SEQ ID NO: 2908484 - RNA, 15 nt, Human
gagaagagaggagag

SEQ ID NO: 2908485 - RNA, 16 nt, Human
gagaagagaggagagg

SEQ ID NO: 2908486 - RNA, 11 nt, Human
gagaacugaaa

SEQ ID NO: 2908487 - RNA, 16 nt, Human
gagaacugaaaagaga

SEQ ID NO: 2908488 - RNA, 18 nt, Human
gagaacugaaaagagagc

SEQ ID NO: 2908489 - RNA, 13 nt, Human
gagaacuccugac

SEQ ID NO: 2908490 - RNA, 15 nt, Human
gagaacuccugacug

SEQ ID NO: 2908491 - RNA, 23 nt, Human
gagaacucaucccuaaugcugca

SEQ ID NO: 2908492 - RNA, 14 nt, Human
gagaacgcagcccu

SEQ ID NO: 2908493 - RNA, 15 nt, Human
gagaacgcagcccua

SEQ ID NO: 2908494 - RNA, 16 nt, Human
gagaacgcagcccuag

SEQ ID NO: 2908495 - RNA, 24 nt, Human
gagaacgcagcccuagagccugcc

SEQ ID NO: 2908496 - RNA, 16 nt, Human
gagaacuaaagguggc

SEQ ID NO: 2908497 - RNA, 17 nt, Human
gagaacuuuccauuuug

SEQ ID NO: 2908498 - RNA, 15 nt, Human
gagaacuguggccgu

SEQ ID NO: 2908499 - RNA, 21 nt, Human
gagaacuuaaguggcuaaaga

SEQ ID NO: 2908500 - RNA, 20 nt, Human
gagaacuuauggccacagcc

SEQ ID NO: 2908501 - RNA, 14 nt, Human
gagaaccucaggcu

SEQ ID NO: 2908502 - RNA, 19 nt, Human
gagaaccuaacuguaucuu

SEQ ID NO: 2908503 - RNA, 13 nt, Human
gagaacgcagccc

SEQ ID NO: 2908504 - RNA, 11 nt, Human
gagaaauuauu

SEQ ID NO: 2908505 - RNA, 12 nt, Human
gagaaauucugu

SEQ ID NO: 2908506 - RNA, 14 nt, Human
gagaaauucuguua

SEQ ID NO: 2908507 - RNA, 16 nt, Human
gagaaauucuguuaaa

SEQ ID NO: 2908508 - RNA, 17 nt, Human
gagaaauucuguuaaaa

SEQ ID NO: 2908509 - RNA, 20 nt, Human
gagaaauucuguuaaaaucu

SEQ ID NO: 2908510 - RNA, 22 nt, Human
gagaaauucuguuaaaaucuau

SEQ ID NO: 2908511 - RNA, 11 nt, Human
gagaaauguaa

SEQ ID NO: 2908512 - RNA, 13 nt, Human
gagaaauguaaug

SEQ ID NO: 2908513 - RNA, 17 nt, Human
gagaaauguaaugcgau

SEQ ID NO: 2908514 - RNA, 23 nt, Human
gagaaauguaaugcgauuuuauu

SEQ ID NO: 2908515 - RNA, 16 nt, Human
gagaaagguugaagca

SEQ ID NO: 2908516 - RNA, 20 nt, Human
gagaaagccaggcagguagc

SEQ ID NO: 2908517 - RNA, 15 nt, Human
gagaaagccaggcag

SEQ ID NO: 2908518 - RNA, 16 nt, Human
gagaaagccaggcagg

SEQ ID NO: 2908519 - RNA, 18 nt, Human
gagaaaggccugcacaca

SEQ ID NO: 2908520 - RNA, 19 nt, Human
gagaaaggccugcacacaa

SEQ ID NO: 2908521 - RNA, 15 nt, Human
gagaaagggacaaug

SEQ ID NO: 2908522 - RNA, 18 nt, Human
gagaaaagcacacuugua

SEQ ID NO: 2908523 - RNA, 13 nt, Human
gagaaaaggaaaa

SEQ ID NO: 2908524 - RNA, 16 nt, Human
gagaaaaggaaaagaa

SEQ ID NO: 2908525 - RNA, 19 nt, Human
gagaaaaggaaaagaaaaa

SEQ ID NO: 2908526 - RNA, 20 nt, Human
gagaauggcgugaacccggg

SEQ ID NO: 2908527 - RNA, 12 nt, Human
gagacaggaagg

SEQ ID NO: 2908528 - RNA, 12 nt, Human
gagaaugcacag

SEQ ID NO: 2908529 - RNA, 16 nt, Human
gagaaugcacagauau

SEQ ID NO: 2908530 - RNA, 17 nt, Human
gagaaugcacagauaua

SEQ ID NO: 2908531 - RNA, 19 nt, Human
gagaauggaaaccacaacu

SEQ ID NO: 2908532 - RNA, 22 nt, Human
gagaauggaaaccacaacuuuu

SEQ ID NO: 2908533 - RNA, 23 nt, Human
gagaauggcccaguccucuccca

SEQ ID NO: 2908534 - RNA, 18 nt, Human
gagacaguucaagaaagc

SEQ ID NO: 2908535 - RNA, 22 nt, Human
gagacaggguuuugccauguug

SEQ ID NO: 2908536 - RNA, 17 nt, Human
gagacagugcacaugaa

SEQ ID NO: 2908537 - RNA, 16 nt, Human
gagacagucaccccag

SEQ ID NO: 2908538 - RNA, 16 nt, Human
gagacaguucaagaaa

SEQ ID NO: 2908539 - RNA, 17 nt, Human
gagacaguuauuuauag

SEQ ID NO: 2908540 - RNA, 18 nt, Human
gagacaguuauuuauagu

SEQ ID NO: 2908541 - RNA, 19 nt, Human
gagacaggguuucaccaug

SEQ ID NO: 2908542 - RNA, 17 nt, Human
gagacaguccagccugg

SEQ ID NO: 2908543 - RNA, 13 nt, Human
gagacucugucuc

SEQ ID NO: 2908544 - RNA, 16 nt, Human
gagacucuagggucca

SEQ ID NO: 2908545 - RNA, 20 nt, Human
gagacucuaggguccagugg

SEQ ID NO: 2908546 - RNA, 19 nt, Human
gagacucuaggguccagug

SEQ ID NO: 2908547 - RNA, 16 nt, Human
gagacaguuucuuagc

SEQ ID NO: 2908548 - RNA, 20 nt, Human
gagagaaagugggugagaug

SEQ ID NO: 2908549 - RNA, 22 nt, Human
gagagaaagugggugagaugcu

SEQ ID NO: 2908550 - RNA, 15 nt, Human
gagagaaagugggug

SEQ ID NO: 2908551 - RNA, 17 nt, Human
gagagaaagugggugag

SEQ ID NO: 2908552 - RNA, 18 nt, Human
gagagaaagugggugaga

SEQ ID NO: 2908553 - RNA, 16 nt, Human
gagagaaagccaggca

SEQ ID NO: 2908554 - RNA, 13 nt, Human
gagagaaaauaua

SEQ ID NO: 2908555 - RNA, 17 nt, Human
gagagaaaauauaugua

SEQ ID NO: 2908556 - RNA, 21 nt, Human
gagagaaaauauauguauuuu

SEQ ID NO: 2908557 - RNA, 13 nt, Human
gagagaaacaaac

SEQ ID NO: 2908558 - RNA, 21 nt, Human
gagagaaagccaggcagguag

SEQ ID NO: 2908559 - RNA, 18 nt, Human
gagagaaagccaggcagg

SEQ ID NO: 2908560 - RNA, 19 nt, Human
gagagaaagccaggcaggu

SEQ ID NO: 2908561 - RNA, 13 nt, Human
gagacugucccug

SEQ ID NO: 2908562 - RNA, 22 nt, Human
gagacugucccugaaaccuagu

SEQ ID NO: 2908563 - RNA, 16 nt, Human
gagacugguccugugu

SEQ ID NO: 2908564 - RNA, 23 nt, Human
gagacugguccugugugcaguga

SEQ ID NO: 2908565 - RNA, 14 nt, Human
gagacuggggggcu

SEQ ID NO: 2908566 - RNA, 16 nt, Human
gagacuggggggcuug

SEQ ID NO: 2908567 - RNA, 18 nt, Human
gagacuggggggcuugaa

SEQ ID NO: 2908568 - RNA, 19 nt, Human
gagacuggggggcuugaaa

SEQ ID NO: 2908569 - RNA, 21 nt, Human
gagacagcugauacuucauuu

SEQ ID NO: 2908570 - RNA, 18 nt, Human
gagagacacagcgucccu

SEQ ID NO: 2908571 - RNA, 13 nt, Human
gagagaaauucug

SEQ ID NO: 2908572 - RNA, 14 nt, Human
gagagaaauucugu

SEQ ID NO: 2908573 - RNA, 16 nt, Human
gagagaaauucuguua

SEQ ID NO: 2908574 - RNA, 23 nt, Human
gagagaaauucuguuaaaaucua

SEQ ID NO: 2908575 - RNA, 14 nt, Human
gagagaccaggcaa

SEQ ID NO: 2908576 - RNA, 16 nt, Human
gagagaccaggcaaag

SEQ ID NO: 2908577 - RNA, 11 nt, Human
gagagagaaaa

SEQ ID NO: 2908578 - RNA, 13 nt, Human
gagagagaaaaaa

SEQ ID NO: 2908579 - RNA, 19 nt, Human
gagagagaaacaaacuuuu

SEQ ID NO: 2908580 - RNA, 19 nt, Human
gagagacucccaugaagcc

SEQ ID NO: 2908581 - RNA, 20 nt, Human
gagagacucccaugaagccu

SEQ ID NO: 2908582 - RNA, 21 nt, Human
gagagacucccaugaagccuu

SEQ ID NO: 2908583 - RNA, 15 nt, Human
gagagagagagagaa

SEQ ID NO: 2908584 - RNA, 9 nt, Human
gagagagag

SEQ ID NO: 2908585 - RNA, 10 nt, Human
gagagagaga

SEQ ID NO: 2908586 - RNA, 14 nt, Human
gagagagagaaauu

SEQ ID NO: 2908587 - RNA, 11 nt, Human
gagagagagag

SEQ ID NO: 2908588 - RNA, 12 nt, Human
gagagagagaga

SEQ ID NO: 2908589 - RNA, 13 nt, Human
gagagagagagaa

SEQ ID NO: 2908590 - RNA, 14 nt, Human
gagagagagagaaa

SEQ ID NO: 2908591 - RNA, 13 nt, Human
gagagagagagag

SEQ ID NO: 2908592 - RNA, 12 nt, Human
gagagagaaagc

SEQ ID NO: 2908593 - RNA, 15 nt, Human
gagagagaaagccag

SEQ ID NO: 2908594 - RNA, 18 nt, Human
gagagagaaagccaggca

SEQ ID NO: 2908595 - RNA, 11 nt, Human
gagagagaaau

SEQ ID NO: 2908596 - RNA, 20 nt, Human
gagagagaaauucuguuaaa

SEQ ID NO: 2908597 - RNA, 19 nt, Human
gagagagcuucuguugcug

SEQ ID NO: 2908598 - RNA, 16 nt, Human
gagagauagccugugg

SEQ ID NO: 2908599 - RNA, 18 nt, Human
gagagauagccuguggcc

SEQ ID NO: 2908600 - RNA, 20 nt, Human
gagagauagccuguggcccu

SEQ ID NO: 2908601 - RNA, 14 nt, Human
gagagauauaucug

SEQ ID NO: 2908602 - RNA, 17 nt, Human
gagagauauaucugaaa

SEQ ID NO: 2908603 - RNA, 18 nt, Human
gagagauauaucugaaaa

SEQ ID NO: 2908604 - RNA, 18 nt, Human
gagagaugggagcuccuc

SEQ ID NO: 2908605 - RNA, 15 nt, Human
gagagcaacauuuua

SEQ ID NO: 2908606 - RNA, 15 nt, Human
gagagauucugugau

SEQ ID NO: 2908607 - RNA, 17 nt, Human
gagagcaaagugaccug

SEQ ID NO: 2908608 - RNA, 13 nt, Human
gagagcaacucug

SEQ ID NO: 2908609 - RNA, 17 nt, Human
gagagcaacucugagau

SEQ ID NO: 2908610 - RNA, 13 nt, Human
gagagcagagaau

SEQ ID NO: 2908611 - RNA, 14 nt, Human
gagagcagagaaua

SEQ ID NO: 2908612 - RNA, 17 nt, Human
gagagcagagaauauaa

SEQ ID NO: 2908613 - RNA, 20 nt, Human
gagagcaacucugagaucua

SEQ ID NO: 2908614 - RNA, 21 nt, Human
gagagcagcuuuaaacucagg

SEQ ID NO: 2908615 - RNA, 23 nt, Human
gagagcagcuuuaaacucaggga

SEQ ID NO: 2908616 - RNA, 15 nt, Human
gagagccccuggggc

SEQ ID NO: 2908617 - RNA, 17 nt, Human
gagagccccuggggccu

SEQ ID NO: 2908618 - RNA, 20 nt, Human
gagagccccuggggccuaga

SEQ ID NO: 2908619 - RNA, 20 nt, Human
gagagcccggcgccccugcc

SEQ ID NO: 2908620 - RNA, 13 nt, Human
gagagcccagcca

SEQ ID NO: 2908621 - RNA, 16 nt, Human
gagagcccuucauuug

SEQ ID NO: 2908622 - RNA, 14 nt, Human
gagauacuggugga

SEQ ID NO: 2908623 - RNA, 15 nt, Human
gagauacugguggaa

SEQ ID NO: 2908624 - RNA, 14 nt, Human
gagagugucaacca

SEQ ID NO: 2908625 - RNA, 18 nt, Human
gagagugucaaccagaca

SEQ ID NO: 2908626 - RNA, 20 nt, Human
gagagugucaaccagacaga

SEQ ID NO: 2908627 - RNA, 22 nt, Human
gagagugucaaccagacagagg

SEQ ID NO: 2908628 - RNA, 23 nt, Human
gagagugucaaccagacagaggg

SEQ ID NO: 2908629 - RNA, 16 nt, Human
gagaguggcuccuccc

SEQ ID NO: 2908630 - RNA, 21 nt, Human
gagaguggcuccucccggugc

SEQ ID NO: 2908631 - RNA, 15 nt, Human
gagaguagaacagau

SEQ ID NO: 2908632 - RNA, 22 nt, Human
gagaguauuuuuauacaaaccu

SEQ ID NO: 2908633 - RNA, 17 nt, Human
gagaguauuuuuauaca

SEQ ID NO: 2908634 - RNA, 13 nt, Human
gagagucuagauu

SEQ ID NO: 2908635 - RNA, 13 nt, Human
gagaguggcuccu

SEQ ID NO: 2908636 - RNA, 16 nt, Human
gagagucuagauucuc

SEQ ID NO: 2908637 - RNA, 23 nt, Human
gagagucuagcacucauuuucua

SEQ ID NO: 2908638 - RNA, 19 nt, Human
gagaggggaacagacugga

SEQ ID NO: 2908639 - RNA, 13 nt, Human
gagccacaaaaga

SEQ ID NO: 2908640 - RNA, 18 nt, Human
gagccacacaugggcauc

SEQ ID NO: 2908641 - RNA, 14 nt, Human
gagccacagcagca

SEQ ID NO: 2908642 - RNA, 16 nt, Human
gagccacagcagcauu

SEQ ID NO: 2908643 - RNA, 17 nt, Human
gagccacagcagcauuu

SEQ ID NO: 2908644 - RNA, 20 nt, Human
gagccacagcagcauuuuua

SEQ ID NO: 2908645 - RNA, 20 nt, Human
gagccaauguuuuccaccca

SEQ ID NO: 2908646 - RNA, 19 nt, Human
gagccaauuuaaagaaaac

SEQ ID NO: 2908647 - RNA, 23 nt, Human
gagcauuuccaacaccacagaca

SEQ ID NO: 2908648 - RNA, 20 nt, Human
gagcauuuugauaccagaag

SEQ ID NO: 2908649 - RNA, 21 nt, Human
gagcauuagauuucucauuug

SEQ ID NO: 2908650 - RNA, 15 nt, Human
gagcauuagauuucu

SEQ ID NO: 2908651 - RNA, 15 nt, Human
gagcagagaauauaa

SEQ ID NO: 2908652 - RNA, 17 nt, Human
gagcauguuuuguauac

SEQ ID NO: 2908653 - RNA, 18 nt, Human
gagcauguuuuguauaca

SEQ ID NO: 2908654 - RNA, 20 nt, Human
gagcauguuuuguauacaaa

SEQ ID NO: 2908655 - RNA, 22 nt, Human
gagcaggaccucugaaacccug

SEQ ID NO: 2908656 - RNA, 12 nt, Human
gagcaggaccuc

SEQ ID NO: 2908657 - RNA, 13 nt, Human
gagcaggaccucc

SEQ ID NO: 2908658 - RNA, 20 nt, Human
gagcaggaccucccuuccga

SEQ ID NO: 2908659 - RNA, 22 nt, Human
gagcaggaagcauucagagagc

SEQ ID NO: 2908660 - RNA, 17 nt, Human
gagcagcuuuaaacuca

SEQ ID NO: 2908661 - RNA, 18 nt, Human
gagcagcuuuaaacucag

SEQ ID NO: 2908662 - RNA, 21 nt, Human
gagcagcuuuaaacucaggga

SEQ ID NO: 2908663 - RNA, 22 nt, Human
gagcagcuuuaaacucagggac

SEQ ID NO: 2908664 - RNA, 23 nt, Human
gagcagcuuuaaacucagggaca

SEQ ID NO: 2908665 - RNA, 16 nt, Human
gagcaggaagcauuca

SEQ ID NO: 2908666 - RNA, 23 nt, Human
gagcaggaagcauucagagagca

SEQ ID NO: 2908667 - RNA, 14 nt, Human
gagcaggaaggccu

SEQ ID NO: 2908668 - RNA, 15 nt, Human
gagcaggaaggccug

SEQ ID NO: 2908669 - RNA, 17 nt, Human
gagcaggaaggccuggg

SEQ ID NO: 2908670 - RNA, 18 nt, Human
gagcaggaaggccugggu

SEQ ID NO: 2908671 - RNA, 19 nt, Human
gagccaccacaccuggcua

SEQ ID NO: 2908672 - RNA, 23 nt, Human
gagccaccacaccuggcuaauuu

SEQ ID NO: 2908673 - RNA, 14 nt, Human
gagccagggucuca

SEQ ID NO: 2908674 - RNA, 15 nt, Human
gagccagccacacuu

SEQ ID NO: 2908675 - RNA, 19 nt, Human
gagccagggucucacuaug

SEQ ID NO: 2908676 - RNA, 18 nt, Human
gagccaguaaacagagga

SEQ ID NO: 2908677 - RNA, 19 nt, Human
gagccauauaaguuugaag

SEQ ID NO: 2908678 - RNA, 18 nt, Human
gagcccugguggcagugg

SEQ ID NO: 2908679 - RNA, 23 nt, Human
gagcccaggaguucgaggcugca

SEQ ID NO: 2908680 - RNA, 12 nt, Human
gagcccaggagu

SEQ ID NO: 2908681 - RNA, 11 nt, Human
gagcccaggag

SEQ ID NO: 2908682 - RNA, 20 nt, Human
gagcccagcccuguucuggg

SEQ ID NO: 2908683 - RNA, 15 nt, Human
gagcccagcccuccc

SEQ ID NO: 2908684 - RNA, 22 nt, Human
gagcccagccauuaccauggag

SEQ ID NO: 2908685 - RNA, 23 nt, Human
gagcccagagguaacagaacagc

SEQ ID NO: 2908686 - RNA, 20 nt, Human
gagcccagauugugccacug

SEQ ID NO: 2908687 - RNA, 22 nt, Human
gagcccagauugugccacugcu

SEQ ID NO: 2908688 - RNA, 14 nt, Human
gagcccagagaaca

SEQ ID NO: 2908689 - RNA, 16 nt, Human
gagcccagagaacagc

SEQ ID NO: 2908690 - RNA, 21 nt, Human
gagcccagagguaacagaaca

SEQ ID NO: 2908691 - RNA, 22 nt, Human
gagcccagagguaacagaacag

SEQ ID NO: 2908692 - RNA, 18 nt, Human
gagcccagcccuccccau

SEQ ID NO: 2908693 - RNA, 18 nt, Human
gagcccagcccuguucug

SEQ ID NO: 2908694 - RNA, 17 nt, Human
gagcccagcccuguucu

SEQ ID NO: 2908695 - RNA, 15 nt, Human
gagcacuaaggugug

SEQ ID NO: 2908696 - RNA, 21 nt, Human
gagcacuaaggugugcucuga

SEQ ID NO: 2908697 - RNA, 21 nt, Human
gagaugagggaugggccuggc

SEQ ID NO: 2908698 - RNA, 19 nt, Human
gagcacaaaaccuguccua

SEQ ID NO: 2908699 - RNA, 14 nt, Human
gagcacaaacauuu

SEQ ID NO: 2908700 - RNA, 15 nt, Human
gagcacaaacauuuu

SEQ ID NO: 2908701 - RNA, 16 nt, Human
gagcacaaacauuuuu

SEQ ID NO: 2908702 - RNA, 18 nt, Human
gagcacaaacauuuuuca

SEQ ID NO: 2908703 - RNA, 16 nt, Human
gagcaauauuuaugga

SEQ ID NO: 2908704 - RNA, 23 nt, Human
gagcaauauuuauggaugcaaca

SEQ ID NO: 2908705 - RNA, 13 nt, Human
gagcaacauuuua

SEQ ID NO: 2908706 - RNA, 20 nt, Human
gagcaacagagugagacccu

SEQ ID NO: 2908707 - RNA, 15 nt, Human
gagcaaccucucacu

SEQ ID NO: 2908708 - RNA, 16 nt, Human
gagcaaccucucacuc

SEQ ID NO: 2908709 - RNA, 19 nt, Human
gagcaaccucucacucccc

SEQ ID NO: 2908710 - RNA, 20 nt, Human
gagcaaccucucacucccca

SEQ ID NO: 2908711 - RNA, 21 nt, Human
gagcaaccucucacuccccau

SEQ ID NO: 2908712 - RNA, 20 nt, Human
gagcaacgaccagggccgag

SEQ ID NO: 2908713 - RNA, 23 nt, Human
gagaucaaccccuucgcuccugu

SEQ ID NO: 2908714 - RNA, 13 nt, Human
gagauacuuuuuc

SEQ ID NO: 2908715 - RNA, 18 nt, Human
gagauacuuuuucuuuug

SEQ ID NO: 2908716 - RNA, 23 nt, Human
gagauacuuuuucuuuuguaagu

SEQ ID NO: 2908717 - RNA, 18 nt, Human
gagaucacgccacugcac

SEQ ID NO: 2908718 - RNA, 16 nt, Human
gagaucacgccacugc

SEQ ID NO: 2908719 - RNA, 19 nt, Human
gagaucacgccacugcacu

SEQ ID NO: 2908720 - RNA, 21 nt, Human
gagauaccaagaugccaucug

SEQ ID NO: 2908721 - RNA, 16 nt, Human
gagaugacugaguccu

SEQ ID NO: 2908722 - RNA, 13 nt, Human
gagaugacugagu

SEQ ID NO: 2908723 - RNA, 19 nt, Human
gagaucccauccccuuguc

SEQ ID NO: 2908724 - RNA, 15 nt, Human
gagauccccugagcc

SEQ ID NO: 2908725 - RNA, 22 nt, Human
gagcaaaggcugagaacacugu

SEQ ID NO: 2908726 - RNA, 13 nt, Human
gagcaaaggcuga

SEQ ID NO: 2908727 - RNA, 16 nt, Human
gagcaaaggcugagaa

SEQ ID NO: 2908728 - RNA, 21 nt, Human
gagaugacugaguccucguag

SEQ ID NO: 2908729 - RNA, 17 nt, Human
gagaugaggccgccaug

SEQ ID NO: 2908730 - RNA, 15 nt, Human
gauaaaugauagaca

SEQ ID NO: 2908731 - RNA, 15 nt, Human
gaguugaggaacugu

SEQ ID NO: 2908732 - RNA, 16 nt, Human
gaguugaggaacugua

SEQ ID NO: 2908733 - RNA, 19 nt, Human
gaguugaggaacuguacag

SEQ ID NO: 2908734 - RNA, 14 nt, Human
gaguucauccaggc

SEQ ID NO: 2908735 - RNA, 13 nt, Human
gaguucaucccag

SEQ ID NO: 2908736 - RNA, 20 nt, Human
gaguucauacccuguuacca

SEQ ID NO: 2908737 - RNA, 17 nt, Human
gaguguuugggggacgu

SEQ ID NO: 2908738 - RNA, 23 nt, Human
gaguguuugggggacguuucuca

SEQ ID NO: 2908739 - RNA, 22 nt, Human
gaguuaaauagaguauaugcac

SEQ ID NO: 2908740 - RNA, 22 nt, Human
gaguguugggcaugugaucacg

SEQ ID NO: 2908741 - RNA, 15 nt, Human
gaguguuuaauaaag

SEQ ID NO: 2908742 - RNA, 13 nt, Human
gaguuaagaagcu

SEQ ID NO: 2908743 - RNA, 14 nt, Human
gaguuaagaagcug

SEQ ID NO: 2908744 - RNA, 16 nt, Human
gaguuaagaagcuguu

SEQ ID NO: 2908745 - RNA, 21 nt, Human
gaguuaagaagcuguuguaca

SEQ ID NO: 2908746 - RNA, 12 nt, Human
gagugugcugcu

SEQ ID NO: 2908747 - RNA, 15 nt, Human
gagugugcugcugua

SEQ ID NO: 2908748 - RNA, 23 nt, Human
gagugugcugcuguaagaaaucu

SEQ ID NO: 2908749 - RNA, 16 nt, Human
gaguguggcugaggag

SEQ ID NO: 2908750 - RNA, 15 nt, Human
gaguguggacucugg

SEQ ID NO: 2908751 - RNA, 18 nt, Human
gaguguacuuaacuauuc

SEQ ID NO: 2908752 - RNA, 17 nt, Human
gaguguaauguuuguua

SEQ ID NO: 2908753 - RNA, 15 nt, Human
gaguggugcagacag

SEQ ID NO: 2908754 - RNA, 16 nt, Human
gaguggugcagacaga

SEQ ID NO: 2908755 - RNA, 20 nt, Human
gaguguagaagcauuccuuc

SEQ ID NO: 2908756 - RNA, 17 nt, Human
gagugucucugauaaaa

SEQ ID NO: 2908757 - RNA, 17 nt, Human
gagugucaaccagacag

SEQ ID NO: 2908758 - RNA, 18 nt, Human
gagugucaaccagacaga

SEQ ID NO: 2908759 - RNA, 20 nt, Human
gagugucaaccagacagagg

SEQ ID NO: 2908760 - RNA, 21 nt, Human
gagugucaaccagacagaggg

SEQ ID NO: 2908761 - RNA, 11 nt, Human
gaguguagaag

SEQ ID NO: 2908762 - RNA, 13 nt, Human
gaguguagaagca

SEQ ID NO: 2908763 - RNA, 14 nt, Human
gaguguagaagcau

SEQ ID NO: 2908764 - RNA, 15 nt, Human
gaguguagaagcauu

SEQ ID NO: 2908765 - RNA, 16 nt, Human
gaguguagaagcauuc

SEQ ID NO: 2908766 - RNA, 17 nt, Human
gagugacagaggcagcc

SEQ ID NO: 2908767 - RNA, 21 nt, Human
gagugggguuaucucuguguu

SEQ ID NO: 2908768 - RNA, 15 nt, Human
gagugggugacaaga

SEQ ID NO: 2908769 - RNA, 19 nt, Human
gagugggugacaagagccu

SEQ ID NO: 2908770 - RNA, 20 nt, Human
gagugggugacaagagccug

SEQ ID NO: 2908771 - RNA, 21 nt, Human
gagugggugacaagagccuga

SEQ ID NO: 2908772 - RNA, 15 nt, Human
gaguggguggaggca

SEQ ID NO: 2908773 - RNA, 14 nt, Human
gauaugauuggcaa

SEQ ID NO: 2908774 - RNA, 23 nt, Human
gauaugauuguuucucaaaucuu

SEQ ID NO: 2908775 - RNA, 20 nt, Human
gaucaauuauaguuucugag

SEQ ID NO: 2908776 - RNA, 21 nt, Human
gaucaauuauaguuucugagg

SEQ ID NO: 2908777 - RNA, 21 nt, Human
gauaugaagagcaacugggac

SEQ ID NO: 2908778 - RNA, 14 nt, Human
gauaugaauauaug

SEQ ID NO: 2908779 - RNA, 17 nt, Human
gauaugaauauauggca

SEQ ID NO: 2908780 - RNA, 23 nt, Human
gauaugaauauauggcauuugca

SEQ ID NO: 2908781 - RNA, 22 nt, Human
gauaugaguauacaauauauaa

SEQ ID NO: 2908782 - RNA, 14 nt, Human
gauaucuuuucuuu

SEQ ID NO: 2908783 - RNA, 16 nt, Human
gauaucuuuucuuuag

SEQ ID NO: 2908784 - RNA, 22 nt, Human
gauaucuuuucuuuagagaacu

SEQ ID NO: 2908785 - RNA, 16 nt, Human
gaucacggcucacugc

SEQ ID NO: 2908786 - RNA, 15 nt, Human
gaucacggcucacug

SEQ ID NO: 2908787 - RNA, 16 nt, Human
gaucacagcagcuucu

SEQ ID NO: 2908788 - RNA, 15 nt, Human
gaucacacuauuuua

SEQ ID NO: 2908789 - RNA, 18 nt, Human
gaucacggcucacugcag

SEQ ID NO: 2908790 - RNA, 17 nt, Human
gaucacuggagcccagg

SEQ ID NO: 2908791 - RNA, 18 nt, Human
gaucacuggagcccagga

SEQ ID NO: 2908792 - RNA, 18 nt, Human
gaucagaaaaauggagca

SEQ ID NO: 2908793 - RNA, 22 nt, Human
gaucagaaaaauggagcaaagu

SEQ ID NO: 2908794 - RNA, 14 nt, Human
gauagccuguggcc

SEQ ID NO: 2908795 - RNA, 16 nt, Human
gauagccuguggcccu

SEQ ID NO: 2908796 - RNA, 19 nt, Human
gauauaacuauugcccagg

SEQ ID NO: 2908797 - RNA, 12 nt, Human
gauauaaauucu

SEQ ID NO: 2908798 - RNA, 13 nt, Human
gauauaaauucug

SEQ ID NO: 2908799 - RNA, 14 nt, Human
gauauaaauucugu

SEQ ID NO: 2908800 - RNA, 13 nt, Human
gauagcugcaugu

SEQ ID NO: 2908801 - RNA, 19 nt, Human
gauagcugcauguggcuuu

SEQ ID NO: 2908802 - RNA, 22 nt, Human
gauagcuaacauuuuaaauaaa

SEQ ID NO: 2908803 - RNA, 23 nt, Human
gauagcuucaccccaaucccagc

SEQ ID NO: 2908804 - RNA, 16 nt, Human
gauagcuaacauuuua

SEQ ID NO: 2908805 - RNA, 18 nt, Human
gauagcuaacauuuuaaa

SEQ ID NO: 2908806 - RNA, 20 nt, Human
gauagcuaacauuuuaaaua

SEQ ID NO: 2908807 - RNA, 23 nt, Human
gauacaggaaaagcugcugacag

SEQ ID NO: 2908808 - RNA, 21 nt, Human
gauacaggaaaagcugcugac

SEQ ID NO: 2908809 - RNA, 19 nt, Human
gauacaggaaaagcugcug

SEQ ID NO: 2908810 - RNA, 17 nt, Human
gauaagaccaccaccuc

SEQ ID NO: 2908811 - RNA, 15 nt, Human
gauagauuugaccuc

SEQ ID NO: 2908812 - RNA, 15 nt, Human
gauagauuuggaaua

SEQ ID NO: 2908813 - RNA, 16 nt, Human
gauagauuuggaauag

SEQ ID NO: 2908814 - RNA, 20 nt, Human
gauacaggaaaagcugcuga

SEQ ID NO: 2908815 - RNA, 21 nt, Human
gauaacuuagguggcaagcug

SEQ ID NO: 2908816 - RNA, 22 nt, Human
gagucuuugguucuaaggaccu

SEQ ID NO: 2908817 - RNA, 14 nt, Human
gagucuuugguucu

SEQ ID NO: 2908818 - RNA, 19 nt, Human
gagucuugguuucucucua

SEQ ID NO: 2908819 - RNA, 22 nt, Human
gagucuugguuucucucuacag

SEQ ID NO: 2908820 - RNA, 22 nt, Human
gagucuuugaagcugaaaauau

SEQ ID NO: 2908821 - RNA, 15 nt, Human
gagucuuugguucua

SEQ ID NO: 2908822 - RNA, 16 nt, Human
gagucuuugguucuaa

SEQ ID NO: 2908823 - RNA, 17 nt, Human
gagucuuugguucuaag

SEQ ID NO: 2908824 - RNA, 18 nt, Human
gagucuuugguucuaagg

SEQ ID NO: 2908825 - RNA, 16 nt, Human
gagugacagaggcagc

SEQ ID NO: 2908826 - RNA, 15 nt, Human
gagugacagaggcag

SEQ ID NO: 2908827 - RNA, 14 nt, Human
gagugacagaggca

SEQ ID NO: 2908828 - RNA, 17 nt, Human
gagugaaugccagugug

SEQ ID NO: 2908829 - RNA, 13 nt, Human
gagucuagauuca

SEQ ID NO: 2908830 - RNA, 17 nt, Human
gagucuagauucaaagg

SEQ ID NO: 2908831 - RNA, 21 nt, Human
gagucuagauucaaagguucu

SEQ ID NO: 2908832 - RNA, 22 nt, Human
gagucuagauucaaagguucua

SEQ ID NO: 2908833 - RNA, 23 nt, Human
gagucuagauucaaagguucuag

SEQ ID NO: 2908834 - RNA, 13 nt, Human
gagucuagauucu

SEQ ID NO: 2908835 - RNA, 14 nt, Human
gagucuagauucuc

SEQ ID NO: 2908836 - RNA, 16 nt, Human
gagucuagcacucauu

SEQ ID NO: 2908837 - RNA, 20 nt, Human
gagucuagcacucauuuucu

SEQ ID NO: 2908838 - RNA, 22 nt, Human
gagucuagcacucauuuucuau

SEQ ID NO: 2908839 - RNA, 20 nt, Human
gagucuguugugugucaugc

SEQ ID NO: 2908840 - RNA, 11 nt, Human
gagucugggac

SEQ ID NO: 2908841 - RNA, 12 nt, Human
gagucugucuca

SEQ ID NO: 2908842 - RNA, 22 nt, Human
gagucuguugugugucaugcca

SEQ ID NO: 2908843 - RNA, 15 nt, Human
gagucuugcuauauu

SEQ ID NO: 2908844 - RNA, 20 nt, Human
gagucuugcuauauugccca

SEQ ID NO: 2908845 - RNA, 14 nt, Human
gagucgaggacagg

SEQ ID NO: 2908846 - RNA, 13 nt, Human
gaguccucugaau

SEQ ID NO: 2908847 - RNA, 19 nt, Human
gaguccgaaagggacuugg

SEQ ID NO: 2908848 - RNA, 14 nt, Human
gaguauuggucucc

SEQ ID NO: 2908849 - RNA, 17 nt, Human
gaguccucacucccagu

SEQ ID NO: 2908850 - RNA, 16 nt, Human
gaguccucacucccag

SEQ ID NO: 2908851 - RNA, 16 nt, Human
gagucgaggacaggga

SEQ ID NO: 2908852 - RNA, 15 nt, Human
gagucgaggacaggg

SEQ ID NO: 2908853 - RNA, 22 nt, Human
gagucuaaagauggaguuucua

SEQ ID NO: 2908854 - RNA, 13 nt, Human
gagucuaaagaug

SEQ ID NO: 2908855 - RNA, 21 nt, Human
gagucuaaagauggaguuucu

SEQ ID NO: 2908856 - RNA, 20 nt, Human
gagucuagaaguuguuuguc

SEQ ID NO: 2908857 - RNA, 11 nt, Human
gagucuagaug

SEQ ID NO: 2908858 - RNA, 16 nt, Human
gagucuagauguuuau

SEQ ID NO: 2908859 - RNA, 11 nt, Human
gagucuagauu

SEQ ID NO: 2908860 - RNA, 11 nt, Human
gagucuaaaga

SEQ ID NO: 2908861 - RNA, 12 nt, Human
gagucuaaagau

SEQ ID NO: 2908862 - RNA, 14 nt, Human
gaguccuuaaaaug

SEQ ID NO: 2908863 - RNA, 17 nt, Human
gaguaucaggucuccca

SEQ ID NO: 2908864 - RNA, 15 nt, Human
gaguaucagaauuga

SEQ ID NO: 2908865 - RNA, 22 nt, Human
gaguaucagaauugaaacacuu

SEQ ID NO: 2908866 - RNA, 23 nt, Human
gaguaaugcauacagaaauauaa

SEQ ID NO: 2908867 - RNA, 17 nt, Human
gaguagggcuuaguguu

SEQ ID NO: 2908868 - RNA, 21 nt, Human
gaguaguugauguugcauuuu

SEQ ID NO: 2908869 - RNA, 15 nt, Human
gaguauaagaaaugc

SEQ ID NO: 2908870 - RNA, 17 nt, Human
gaguauaagaaaugcau

SEQ ID NO: 2908871 - RNA, 18 nt, Human
gaguauaagaaaugcaua

SEQ ID NO: 2908872 - RNA, 18 nt, Human
gaguauacaauauauaaa

SEQ ID NO: 2908873 - RNA, 19 nt, Human
gaguauacaauauauaaaa

SEQ ID NO: 2908874 - RNA, 20 nt, Human
gaguaguugauguugcauuu

SEQ ID NO: 2908875 - RNA, 14 nt, Human
gaguaguguggaau

SEQ ID NO: 2908876 - RNA, 23 nt, Human
gaguaguuauauaauuguugaac

SEQ ID NO: 2908877 - RNA, 12 nt, Human
gaguauaugcac

SEQ ID NO: 2908878 - RNA, 14 nt, Human
gaguauaugcacuu

SEQ ID NO: 2908879 - RNA, 17 nt, Human
gaguaauaguaaacaca

SEQ ID NO: 2908880 - RNA, 21 nt, Human
gaguaacuauuauuauaggua

SEQ ID NO: 2908881 - RNA, 18 nt, Human
gaguaagaaauuucaggu

SEQ ID NO: 2908882 - RNA, 20 nt, Human
gaguaagaaauuucagguug

SEQ ID NO: 2908883 - RNA, 13 nt, Human
gaguaagacauug

SEQ ID NO: 2908884 - RNA, 22 nt, Human
gaguagcugggacuacaggcac

SEQ ID NO: 2908885 - RNA, 19 nt, Human
gaguagcugggacuacagg

SEQ ID NO: 2908886 - RNA, 18 nt, Human
gaguagauggugaaauuu

SEQ ID NO: 2908887 - RNA, 18 nt, Human
gaguagauauuacuuuau

SEQ ID NO: 2908888 - RNA, 17 nt, Human
gaguagaugcgcagccc

SEQ ID NO: 2908889 - RNA, 17 nt, Human
gaguagaaauaaaagug

SEQ ID NO: 2908890 - RNA, 14 nt, Human
gaguagaauugcau

SEQ ID NO: 2908891 - RNA, 17 nt, Human
gaguagaauugcauuga

SEQ ID NO: 2908892 - RNA, 15 nt, Human
gaguagacacauuua

SEQ ID NO: 2908893 - RNA, 18 nt, Human
gaguagacacauuuaagg

SEQ ID NO: 2908894 - RNA, 22 nt, Human
gagguuuauagaaagauagaua

SEQ ID NO: 2908895 - RNA, 14 nt, Human
gagguugggugggc

SEQ ID NO: 2908896 - RNA, 22 nt, Human
gagguugguuuaaugcaauaga

SEQ ID NO: 2908897 - RNA, 13 nt, Human
gagguuguaguga

SEQ ID NO: 2908898 - RNA, 18 nt, Human
gagguuguagugagccca

SEQ ID NO: 2908899 - RNA, 19 nt, Human
gagguuucccaaugguguu

SEQ ID NO: 2908900 - RNA, 22 nt, Human
gagguuucaccaugauggccag

SEQ ID NO: 2908901 - RNA, 21 nt, Human
gagguuucacccuuaacccaa

SEQ ID NO: 2908902 - RNA, 19 nt, Human
gagguugcagggagccgag

SEQ ID NO: 2908903 - RNA, 14 nt, Human
gagguucuaaggcc

SEQ ID NO: 2908904 - RNA, 13 nt, Human
gagguugcaggga

SEQ ID NO: 2908905 - RNA, 20 nt, Human
gaggucagagccugcaguua

SEQ ID NO: 2908906 - RNA, 17 nt, Human
gaggucagagccugcag

SEQ ID NO: 2908907 - RNA, 18 nt, Human
gagguggggcgaggcagg

SEQ ID NO: 2908908 - RNA, 19 nt, Human
gagguggggcgaggcaggc

SEQ ID NO: 2908909 - RNA, 20 nt, Human
gaggugguggaguggaguga

SEQ ID NO: 2908910 - RNA, 12 nt, Human
gaggugguuuua

SEQ ID NO: 2908911 - RNA, 22 nt, Human
gaggugguaguaaaacacagag

SEQ ID NO: 2908912 - RNA, 23 nt, Human
gaggugguaguaaaacacagagg

SEQ ID NO: 2908913 - RNA, 22 nt, Human
gagcccuguccugccuaaggcu

SEQ ID NO: 2908914 - RNA, 18 nt, Human
gagcccuuaucugugcuc

SEQ ID NO: 2908915 - RNA, 22 nt, Human
gagcccuguggaugagcccuca

SEQ ID NO: 2908916 - RNA, 21 nt, Human
gagcccuguggaugagcccuc

SEQ ID NO: 2908917 - RNA, 18 nt, Human
gagcccuguggaugagcc

SEQ ID NO: 2908918 - RNA, 19 nt, Human
gagcccuuaucugugcuca

SEQ ID NO: 2908919 - RNA, 17 nt, Human
gaggaucccucucugga

SEQ ID NO: 2908920 - RNA, 14 nt, Human
gaggaucaguuuuu

SEQ ID NO: 2908921 - RNA, 19 nt, Human
gaggaucacuggagcccag

SEQ ID NO: 2908922 - RNA, 20 nt, Human
gaggaucacuggagcccagg

SEQ ID NO: 2908923 - RNA, 22 nt, Human
gaggcagacuucccugaaugua

SEQ ID NO: 2908924 - RNA, 17 nt, Human
gaggauuguugaaucua

SEQ ID NO: 2908925 - RNA, 16 nt, Human
gaggcaaagcuggcuc

SEQ ID NO: 2908926 - RNA, 15 nt, Human
gaggcaagcaagcuc

SEQ ID NO: 2908927 - RNA, 20 nt, Human
gaggcaaagcuggcucaccu

SEQ ID NO: 2908928 - RNA, 23 nt, Human
gaggcaaccugauuguaaacuuc

SEQ ID NO: 2908929 - RNA, 19 nt, Human
gaggcaaugucaggaacag

SEQ ID NO: 2908930 - RNA, 12 nt, Human
gaggauuuagaa

SEQ ID NO: 2908931 - RNA, 22 nt, Human
gaggauuuagaagugucauguu

SEQ ID NO: 2908932 - RNA, 22 nt, Human
gaggaugagcucuacccagggc

SEQ ID NO: 2908933 - RNA, 18 nt, Human
gaggaugagagcccagag

SEQ ID NO: 2908934 - RNA, 20 nt, Human
gaggaugagagcccagaggu

SEQ ID NO: 2908935 - RNA, 14 nt, Human
gaggaugagagccc

SEQ ID NO: 2908936 - RNA, 15 nt, Human
gaggaugagagccca

SEQ ID NO: 2908937 - RNA, 16 nt, Human
gaggaugagagcccag

SEQ ID NO: 2908938 - RNA, 17 nt, Human
gaggaugagagcccaga

SEQ ID NO: 2908939 - RNA, 23 nt, Human
gaggccaugggccuccugugugu

SEQ ID NO: 2908940 - RNA, 21 nt, Human
gaggccaugggccuccugugu

SEQ ID NO: 2908941 - RNA, 20 nt, Human
gaggccaugggccuccugug

SEQ ID NO: 2908942 - RNA, 18 nt, Human
gaggccaugggccuccug

SEQ ID NO: 2908943 - RNA, 17 nt, Human
gaggccaugggccuccu

SEQ ID NO: 2908944 - RNA, 14 nt, Human
gaggccaugggccu

SEQ ID NO: 2908945 - RNA, 18 nt, Human
gaggcagccccauucugc

SEQ ID NO: 2908946 - RNA, 19 nt, Human
gaggcagccccauucugcc

SEQ ID NO: 2908947 - RNA, 22 nt, Human
gaggcagagagcggucucaggc

SEQ ID NO: 2908948 - RNA, 11 nt, Human
gaggcagagag

SEQ ID NO: 2908949 - RNA, 12 nt, Human
gaggcagagagc

SEQ ID NO: 2908950 - RNA, 13 nt, Human
gaggcagagagcg

SEQ ID NO: 2908951 - RNA, 15 nt, Human
gaggcagagagcggu

SEQ ID NO: 2908952 - RNA, 9 nt, Human
gaggcaggg

SEQ ID NO: 2908953 - RNA, 20 nt, Human
gaggcagccccauucugccu

SEQ ID NO: 2908954 - RNA, 19 nt, Human
gaggcagggcaaaugacau

SEQ ID NO: 2908955 - RNA, 23 nt, Human
gaggcagggcaaaugacaugcac

SEQ ID NO: 2908956 - RNA, 19 nt, Human
gaggccuucucugaaggac

SEQ ID NO: 2908957 - RNA, 18 nt, Human
gaggccuucucugaagga

SEQ ID NO: 2908958 - RNA, 15 nt, Human
gaggccuugagaggc

SEQ ID NO: 2908959 - RNA, 16 nt, Human
gaggccuucucugaag

SEQ ID NO: 2908960 - RNA, 18 nt, Human
gaggccuacucuuccauc

SEQ ID NO: 2908961 - RNA, 22 nt, Human
gaggcgcccuuggcuucuguga

SEQ ID NO: 2908962 - RNA, 13 nt, Human
gaggcuggcaggu

SEQ ID NO: 2908963 - RNA, 12 nt, Human
gaggcuggcagg

SEQ ID NO: 2908964 - RNA, 15 nt, Human
gaggccccacugaug

SEQ ID NO: 2908965 - RNA, 18 nt, Human
gaggccccacugaugcug

SEQ ID NO: 2908966 - RNA, 19 nt, Human
gagggugggggccaccugc

SEQ ID NO: 2908967 - RNA, 22 nt, Human
gagggugggggccaccugccug

SEQ ID NO: 2908968 - RNA, 14 nt, Human
gaggguugggcugg

SEQ ID NO: 2908969 - RNA, 15 nt, Human
gaggguugggcuggu

SEQ ID NO: 2908970 - RNA, 18 nt, Human
gaggguugauuaaggcag

SEQ ID NO: 2908971 - RNA, 13 nt, Human
gaggguugugcua

SEQ ID NO: 2908972 - RNA, 15 nt, Human
gagguaaagauaugg

SEQ ID NO: 2908973 - RNA, 13 nt, Human
gagguaacagaac

SEQ ID NO: 2908974 - RNA, 14 nt, Human
gagguaacagaaca

SEQ ID NO: 2908975 - RNA, 15 nt, Human
gagguaacagaacag

SEQ ID NO: 2908976 - RNA, 16 nt, Human
gagguaacagaacagc

SEQ ID NO: 2908977 - RNA, 17 nt, Human
gagguaacagaacagcu

SEQ ID NO: 2908978 - RNA, 18 nt, Human
gagguaacagaacagcuu

SEQ ID NO: 2908979 - RNA, 21 nt, Human
gagguaacagaacagcuucag

SEQ ID NO: 2908980 - RNA, 21 nt, Human
gaggguuuuagguagaaaaac

SEQ ID NO: 2908981 - RNA, 16 nt, Human
gagguaagggaggagg

SEQ ID NO: 2908982 - RNA, 12 nt, Human
gagguaaguuuu

SEQ ID NO: 2908983 - RNA, 19 nt, Human
gagguauuuaucuuuacuu

SEQ ID NO: 2908984 - RNA, 14 nt, Human
gagguauauuggaa

SEQ ID NO: 2908985 - RNA, 17 nt, Human
gagguacuagaaugcuu

SEQ ID NO: 2908986 - RNA, 20 nt, Human
gagguagaccaggauuucua

SEQ ID NO: 2908987 - RNA, 21 nt, Human
gagguagaccaggauuucuaa

SEQ ID NO: 2908988 - RNA, 13 nt, Human
gaggucagagccu

SEQ ID NO: 2908989 - RNA, 12 nt, Human
gaggucagagcc

SEQ ID NO: 2908990 - RNA, 19 nt, Human
gaggucaaggcugcaguga

SEQ ID NO: 2908991 - RNA, 22 nt, Human
gagggugucccaaaaagaaagg

SEQ ID NO: 2908992 - RNA, 21 nt, Human
gaggguggugaccucugccug

SEQ ID NO: 2908993 - RNA, 14 nt, Human
gaggguggugaccu

SEQ ID NO: 2908994 - RNA, 17 nt, Human
gagggucuauggggaga

SEQ ID NO: 2908995 - RNA, 15 nt, Human
gagggugagugcaag

SEQ ID NO: 2908996 - RNA, 19 nt, Human
gagggugggagagcccagc

SEQ ID NO: 2908997 - RNA, 18 nt, Human
gagggugggagagcccag

SEQ ID NO: 2908998 - RNA, 14 nt, Human
gagggucugaggaa

SEQ ID NO: 2908999 - RNA, 13 nt, Human
gagggucugagga

SEQ ID NO: 2909000 - RNA, 21 nt, Human
gaggguccuggcuccugaggg

SEQ ID NO: 2909001 - RNA, 17 nt, Human
gaggguccuggcuccug

SEQ ID NO: 2909002 - RNA, 22 nt, Human
gagggucugggaaaugagcagg

SEQ ID NO: 2909003 - RNA, 15 nt, Human
gaggguacagcuggg

SEQ ID NO: 2909004 - RNA, 17 nt, Human
gaggguacagcugggcu

SEQ ID NO: 2909005 - RNA, 19 nt, Human
gagggucaggacugugacu

SEQ ID NO: 2909006 - RNA, 19 nt, Human
gaggguccccaccugggac

SEQ ID NO: 2909007 - RNA, 15 nt, Human
gaggguccuggcucc

SEQ ID NO: 2909008 - RNA, 13 nt, Human
gagggaggaccug

SEQ ID NO: 2909009 - RNA, 14 nt, Human
gagggaggaccugg

SEQ ID NO: 2909010 - RNA, 15 nt, Human
gagggaggaccuggg

SEQ ID NO: 2909011 - RNA, 12 nt, Human
gagggagcagac

SEQ ID NO: 2909012 - RNA, 20 nt, Human
gagggagcagacaggaggaa

SEQ ID NO: 2909013 - RNA, 17 nt, Human
gaggcugugugccuggg

SEQ ID NO: 2909014 - RNA, 20 nt, Human
gaggcugugugccuggggga

SEQ ID NO: 2909015 - RNA, 13 nt, Human
gagggagaaggga

SEQ ID NO: 2909016 - RNA, 21 nt, Human
gagggagacacuggccccuca

SEQ ID NO: 2909017 - RNA, 20 nt, Human
gagggagggggaaggcaggg

SEQ ID NO: 2909018 - RNA, 16 nt, Human
gagggagugacagagg

SEQ ID NO: 2909019 - RNA, 18 nt, Human
gagggagugacagaggca

SEQ ID NO: 2909020 - RNA, 22 nt, Human
gagggagugacagaggcagccc

SEQ ID NO: 2909021 - RNA, 21 nt, Human
gagggagugacagaggcagcc

SEQ ID NO: 2909022 - RNA, 13 nt, Human
gagggagggggcu

SEQ ID NO: 2909023 - RNA, 17 nt, Human
gagggaugcugccugag

SEQ ID NO: 2909024 - RNA, 15 nt, Human
gagggaugcugccug

SEQ ID NO: 2909025 - RNA, 21 nt, Human
gagggguguggcuccuuccca

SEQ ID NO: 2909026 - RNA, 21 nt, Human
gagggggcuauagcuacagga

SEQ ID NO: 2909027 - RNA, 14 nt, Human
gagggggacugcug

SEQ ID NO: 2909028 - RNA, 20 nt, Human
gagggggacugcugcugccu

SEQ ID NO: 2909029 - RNA, 21 nt, Human
gagggggacugcugcugccug

SEQ ID NO: 2909030 - RNA, 14 nt, Human
gagggggagaaaag

SEQ ID NO: 2909031 - RNA, 19 nt, Human
gagggauuucuuugcugua

SEQ ID NO: 2909032 - RNA, 12 nt, Human
gagggcacacac

SEQ ID NO: 2909033 - RNA, 13 nt, Human
gagggaugggccu

SEQ ID NO: 2909034 - RNA, 14 nt, Human
gagggaugggccug

SEQ ID NO: 2909035 - RNA, 15 nt, Human
gagggaugggccugg

SEQ ID NO: 2909036 - RNA, 16 nt, Human
gagggaugggccuggc

SEQ ID NO: 2909037 - RNA, 20 nt, Human
gagggaugcugccugaguca

SEQ ID NO: 2909038 - RNA, 15 nt, Human
gagggcacacacugu

SEQ ID NO: 2909039 - RNA, 14 nt, Human
gagggcagcugcua

SEQ ID NO: 2909040 - RNA, 17 nt, Human
gagggcauccauaccag

SEQ ID NO: 2909041 - RNA, 18 nt, Human
gagggcauccauaccagc

SEQ ID NO: 2909042 - RNA, 13 nt, Human
gagggcagcugcu

SEQ ID NO: 2909043 - RNA, 17 nt, Human
gaggggcuuucuggaga

SEQ ID NO: 2909044 - RNA, 18 nt, Human
gagggccaagacuuggca

SEQ ID NO: 2909045 - RNA, 23 nt, Human
gaggggcucucagcucagcgcca

SEQ ID NO: 2909046 - RNA, 17 nt, Human
gaggggcugugggcgug

SEQ ID NO: 2909047 - RNA, 14 nt, Human
gcacgcacacacac

SEQ ID NO: 2909048 - RNA, 15 nt, Human
gcacgcacacacaca

SEQ ID NO: 2909049 - RNA, 10 nt, Human
gcacgcacac

SEQ ID NO: 2909050 - RNA, 11 nt, Human
gcacgcacaca

SEQ ID NO: 2909051 - RNA, 12 nt, Human
gcacgcacacac

SEQ ID NO: 2909052 - RNA, 13 nt, Human
gcacgcacacaca

SEQ ID NO: 2909053 - RNA, 12 nt, Human
gcacugcugccc

SEQ ID NO: 2909054 - RNA, 14 nt, Human
gcacugcugcccag

SEQ ID NO: 2909055 - RNA, 15 nt, Human
gcacugcugcccagc

SEQ ID NO: 2909056 - RNA, 18 nt, Human
gcacugcugcccagccuc

SEQ ID NO: 2909057 - RNA, 20 nt, Human
gcacugcugcccagccucca

SEQ ID NO: 2909058 - RNA, 23 nt, Human
gcacuggaguggcucgccaggcc

SEQ ID NO: 2909059 - RNA, 18 nt, Human
gcacuggguugacuuuca

SEQ ID NO: 2909060 - RNA, 14 nt, Human
gcacugguggcccg

SEQ ID NO: 2909061 - RNA, 12 nt, Human
gcacuggcccag

SEQ ID NO: 2909062 - RNA, 23 nt, Human
gcacuggggagcccgucucagug

SEQ ID NO: 2909063 - RNA, 20 nt, Human
gcagacacgccuuccccuca

SEQ ID NO: 2909064 - RNA, 17 nt, Human
gcagacagaagucuccu

SEQ ID NO: 2909065 - RNA, 20 nt, Human
gcagacagaagucuccucaa

SEQ ID NO: 2909066 - RNA, 13 nt, Human
gcagacagacaau

SEQ ID NO: 2909067 - RNA, 14 nt, Human
gcagacaggaggaa

SEQ ID NO: 2909068 - RNA, 15 nt, Human
gcagacagcaggcag

SEQ ID NO: 2909069 - RNA, 18 nt, Human
gcagacagcaggcagcgc

SEQ ID NO: 2909070 - RNA, 12 nt, Human
gcagacaggcaa

SEQ ID NO: 2909071 - RNA, 14 nt, Human
gcagacaggcaagc

SEQ ID NO: 2909072 - RNA, 13 nt, Human
gcagacaggcaag

SEQ ID NO: 2909073 - RNA, 13 nt, Human
gcacugugcucag

SEQ ID NO: 2909074 - RNA, 14 nt, Human
gcacugugcucagg

SEQ ID NO: 2909075 - RNA, 16 nt, Human
gcacugugcucagggc

SEQ ID NO: 2909076 - RNA, 18 nt, Human
gcacugugcucagggcua

SEQ ID NO: 2909077 - RNA, 19 nt, Human
gcagaaggauuuuuuaaag

SEQ ID NO: 2909078 - RNA, 18 nt, Human
gcaccuuaccaacuuucu

SEQ ID NO: 2909079 - RNA, 19 nt, Human
gcaccuuaccaacuuucug

SEQ ID NO: 2909080 - RNA, 14 nt, Human
gcaccuugugucug

SEQ ID NO: 2909081 - RNA, 20 nt, Human
gcaccaucacaauacagaua

SEQ ID NO: 2909082 - RNA, 21 nt, Human
gcaccuguacucaggaggcug

SEQ ID NO: 2909083 - RNA, 19 nt, Human
gcaccuguacucaggaggc

SEQ ID NO: 2909084 - RNA, 12 nt, Human
gcaccuguacag

SEQ ID NO: 2909085 - RNA, 13 nt, Human
gcaccuguacagu

SEQ ID NO: 2909086 - RNA, 22 nt, Human
gcaccuguacaguggaaccguu

SEQ ID NO: 2909087 - RNA, 23 nt, Human
gcaccuguacaguggaaccguug

SEQ ID NO: 2909088 - RNA, 17 nt, Human
gcaccccccuguucuaa

SEQ ID NO: 2909089 - RNA, 18 nt, Human
gcaccccccuguucuaag

SEQ ID NO: 2909090 - RNA, 19 nt, Human
gcaccccccuguucuaagg

SEQ ID NO: 2909091 - RNA, 20 nt, Human
gcaccccccuguucuaaggg

SEQ ID NO: 2909092 - RNA, 21 nt, Human
gcaccccccuguucuaagggg

SEQ ID NO: 2909093 - RNA, 14 nt, Human
gcaccccccaagcu

SEQ ID NO: 2909094 - RNA, 19 nt, Human
gcacagauaaaaaguggaa

SEQ ID NO: 2909095 - RNA, 20 nt, Human
gcacagauaaaaaguggaau

SEQ ID NO: 2909096 - RNA, 17 nt, Human
gcacagauauacuuugu

SEQ ID NO: 2909097 - RNA, 19 nt, Human
gcacagauauacuuugugg

SEQ ID NO: 2909098 - RNA, 16 nt, Human
gcacagugaagugcug

SEQ ID NO: 2909099 - RNA, 13 nt, Human
gcacaguccagga

SEQ ID NO: 2909100 - RNA, 16 nt, Human
gcacaguccaggaaca

SEQ ID NO: 2909101 - RNA, 21 nt, Human
gcacaggugggcuucccagug

SEQ ID NO: 2909102 - RNA, 20 nt, Human
gcacaggugggcuucccagu

SEQ ID NO: 2909103 - RNA, 15 nt, Human
gcacaggucccaccu

SEQ ID NO: 2909104 - RNA, 17 nt, Human
gcacaggucccaccucc

SEQ ID NO: 2909105 - RNA, 19 nt, Human
gcacaggucccaccuccag

SEQ ID NO: 2909106 - RNA, 21 nt, Human
gcacaggucccaccuccagcc

SEQ ID NO: 2909107 - RNA, 22 nt, Human
gcacaggucccaccuccagccc

SEQ ID NO: 2909108 - RNA, 23 nt, Human
gcacaggucccaccuccagcccg

SEQ ID NO: 2909109 - RNA, 19 nt, Human
gcacaggucgggcgcagga

SEQ ID NO: 2909110 - RNA, 20 nt, Human
gcacaggucgggcgcaggau

SEQ ID NO: 2909111 - RNA, 23 nt, Human
gcacauuuaagagacagucaccc

SEQ ID NO: 2909112 - RNA, 17 nt, Human
gcacauuuaagagacag

SEQ ID NO: 2909113 - RNA, 21 nt, Human
gcacauuuaagagacagucac

SEQ ID NO: 2909114 - RNA, 14 nt, Human
gcacacuuccagac

SEQ ID NO: 2909115 - RNA, 14 nt, Human
gcaccagucccugu

SEQ ID NO: 2909116 - RNA, 18 nt, Human
gcacauugagcugugcaa

SEQ ID NO: 2909117 - RNA, 17 nt, Human
gcacauuggaaagcaca

SEQ ID NO: 2909118 - RNA, 18 nt, Human
gcacauuguuguuuuuuu

SEQ ID NO: 2909119 - RNA, 14 nt, Human
gcacauugagcugu

SEQ ID NO: 2909120 - RNA, 15 nt, Human
gcacagugcaucuca

SEQ ID NO: 2909121 - RNA, 18 nt, Human
gcacagugcaucucagcc

SEQ ID NO: 2909122 - RNA, 13 nt, Human
gcacagugcaucu

SEQ ID NO: 2909123 - RNA, 14 nt, Human
gcacacuuggccca

SEQ ID NO: 2909124 - RNA, 20 nt, Human
gcacacuuggcccaaguggc

SEQ ID NO: 2909125 - RNA, 20 nt, Human
gcacaccgggcacucagaag

SEQ ID NO: 2909126 - RNA, 14 nt, Human
gcacacgccuccca

SEQ ID NO: 2909127 - RNA, 17 nt, Human
gcacacgccucccacug

SEQ ID NO: 2909128 - RNA, 19 nt, Human
gcacacgccucccacuggg

SEQ ID NO: 2909129 - RNA, 16 nt, Human
gcacacgcguuauagu

SEQ ID NO: 2909130 - RNA, 20 nt, Human
gcacacgcguuauaguaacu

SEQ ID NO: 2909131 - RNA, 20 nt, Human
gcacacucauccccucacuu

SEQ ID NO: 2909132 - RNA, 13 nt, Human
gcacacucugcca

SEQ ID NO: 2909133 - RNA, 19 nt, Human
gcacacucugccagcaaag

SEQ ID NO: 2909134 - RNA, 20 nt, Human
gcacacucugccagcaaaga

SEQ ID NO: 2909135 - RNA, 16 nt, Human
gcacacucuggucuug

SEQ ID NO: 2909136 - RNA, 16 nt, Human
gcacaaauauuuauuu

SEQ ID NO: 2909137 - RNA, 15 nt, Human
gcacaaauauuuauu

SEQ ID NO: 2909138 - RNA, 14 nt, Human
gcacaaauauuuau

SEQ ID NO: 2909139 - RNA, 17 nt, Human
gcacaagaaucacuuga

SEQ ID NO: 2909140 - RNA, 18 nt, Human
gcacaagaaucacuugaa

SEQ ID NO: 2909141 - RNA, 19 nt, Human
gcacaagaaucacuugaac

SEQ ID NO: 2909142 - RNA, 17 nt, Human
gcacaaccugcaucuuu

SEQ ID NO: 2909143 - RNA, 22 nt, Human
gcacaacugcaauaacuucuga

SEQ ID NO: 2909144 - RNA, 14 nt, Human
gcacaagcagagug

SEQ ID NO: 2909145 - RNA, 21 nt, Human
gcacaagcagagugcacagcu

SEQ ID NO: 2909146 - RNA, 22 nt, Human
gcacaagcagagugcacagcug

SEQ ID NO: 2909147 - RNA, 23 nt, Human
gcacaagcagagugcacagcugu

SEQ ID NO: 2909148 - RNA, 22 nt, Human
gcacaagccacaagucuuccag

SEQ ID NO: 2909149 - RNA, 12 nt, Human
gcacagagaagc

SEQ ID NO: 2909150 - RNA, 14 nt, Human
gcacagagaagcug

SEQ ID NO: 2909151 - RNA, 11 nt, Human
gcacagacagg

SEQ ID NO: 2909152 - RNA, 22 nt, Human
gcacagacagguuuucacauaa

SEQ ID NO: 2909153 - RNA, 17 nt, Human
gcacagaagcacaugca

SEQ ID NO: 2909154 - RNA, 13 nt, Human
gcacagaaguccu

SEQ ID NO: 2909155 - RNA, 15 nt, Human
gcacagaaguccugu

SEQ ID NO: 2909156 - RNA, 16 nt, Human
gcacagaaguccugua

SEQ ID NO: 2909157 - RNA, 17 nt, Human
gcacagaaguccuguau

SEQ ID NO: 2909158 - RNA, 18 nt, Human
gcacagaaguccuguaug

SEQ ID NO: 2909159 - RNA, 19 nt, Human
gcacagaaguccuguaugu

SEQ ID NO: 2909160 - RNA, 12 nt, Human
gcacagaauaug

SEQ ID NO: 2909161 - RNA, 23 nt, Human
gcaauuuuuccaugaaguuugaa

SEQ ID NO: 2909162 - RNA, 18 nt, Human
gcaauuuugcauuugaau

SEQ ID NO: 2909163 - RNA, 14 nt, Human
gcaauuuuguaacg

SEQ ID NO: 2909164 - RNA, 22 nt, Human
gcaauuuucuaagcaauuucuu

SEQ ID NO: 2909165 - RNA, 13 nt, Human
gcacaaauauuua

SEQ ID NO: 2909166 - RNA, 16 nt, Human
gcacaaagggcccaga

SEQ ID NO: 2909167 - RNA, 20 nt, Human
gcacaaaaugauggcagugg

SEQ ID NO: 2909168 - RNA, 11 nt, Human
gcacaaaauga

SEQ ID NO: 2909169 - RNA, 23 nt, Human
gcacaaaaugaaugaggucuggg

SEQ ID NO: 2909170 - RNA, 14 nt, Human
gcacaaacacaagg

SEQ ID NO: 2909171 - RNA, 16 nt, Human
gcacaaacacaagguc

SEQ ID NO: 2909172 - RNA, 17 nt, Human
gcacaaacacaagguca

SEQ ID NO: 2909173 - RNA, 18 nt, Human
gcacaaacucaccaucug

SEQ ID NO: 2909174 - RNA, 22 nt, Human
gcacaaacuuuaggguaaaaau

SEQ ID NO: 2909175 - RNA, 13 nt, Human
gcacaaacauuuu

SEQ ID NO: 2909176 - RNA, 14 nt, Human
gcacaaacauuuuu

SEQ ID NO: 2909177 - RNA, 16 nt, Human
gcacaaacauuuuuca

SEQ ID NO: 2909178 - RNA, 17 nt, Human
gcacaaacauuuuucaa

SEQ ID NO: 2909179 - RNA, 18 nt, Human
gcacaaacauuuuucaac

SEQ ID NO: 2909180 - RNA, 14 nt, Human
gcaauuucauaugc

SEQ ID NO: 2909181 - RNA, 17 nt, Human
gcaauuuauuaaaauga

SEQ ID NO: 2909182 - RNA, 13 nt, Human
gcaauuucaaggu

SEQ ID NO: 2909183 - RNA, 18 nt, Human
gcaauuucaagguucuaa

SEQ ID NO: 2909184 - RNA, 18 nt, Human
gcaauuuccuuuuuuguu

SEQ ID NO: 2909185 - RNA, 18 nt, Human
gcaauuggaacaaaguga

SEQ ID NO: 2909186 - RNA, 13 nt, Human
gcaauugucuauu

SEQ ID NO: 2909187 - RNA, 22 nt, Human
gcaauugucuauuuaucuuuua

SEQ ID NO: 2909188 - RNA, 13 nt, Human
gcaauuuaaaugu

SEQ ID NO: 2909189 - RNA, 16 nt, Human
gcaauuuauacaauau

SEQ ID NO: 2909190 - RNA, 19 nt, Human
gcaauuuauacaauaucau

SEQ ID NO: 2909191 - RNA, 23 nt, Human
gcaauuuaauauuuugcacaguu

SEQ ID NO: 2909192 - RNA, 18 nt, Human
gcaauuuaaauguuauga

SEQ ID NO: 2909193 - RNA, 19 nt, Human
gcaauuuaacuagacacag

SEQ ID NO: 2909194 - RNA, 15 nt, Human
gcaauugauuucuuu

SEQ ID NO: 2909195 - RNA, 17 nt, Human
gcaauuccgcauuuaau

SEQ ID NO: 2909196 - RNA, 20 nt, Human
gcaauucuccugccucagcc

SEQ ID NO: 2909197 - RNA, 19 nt, Human
gcaauucuccugccucagc

SEQ ID NO: 2909198 - RNA, 18 nt, Human
gcaauucuccugccucag

SEQ ID NO: 2909199 - RNA, 17 nt, Human
gcaauucuccugccuca

SEQ ID NO: 2909200 - RNA, 16 nt, Human
gcaauucuccugccuc

SEQ ID NO: 2909201 - RNA, 15 nt, Human
gcaauucuccugccu

SEQ ID NO: 2909202 - RNA, 14 nt, Human
gcaauucuccugcc

SEQ ID NO: 2909203 - RNA, 20 nt, Human
gcaaugucaggaacagaagg

SEQ ID NO: 2909204 - RNA, 22 nt, Human
gcaaugucaggaacagaaggau

SEQ ID NO: 2909205 - RNA, 15 nt, Human
gcaauguaucccuuc

SEQ ID NO: 2909206 - RNA, 22 nt, Human
gcaauguaucccuucucacagc

SEQ ID NO: 2909207 - RNA, 15 nt, Human
gcaaugugggcagag

SEQ ID NO: 2909208 - RNA, 16 nt, Human
gcaauuaggauuuuga

SEQ ID NO: 2909209 - RNA, 19 nt, Human
gcaauuaggauuuugaugu

SEQ ID NO: 2909210 - RNA, 19 nt, Human
gcaauuagguuuuuccuua

SEQ ID NO: 2909211 - RNA, 15 nt, Human
gcaauuccgcauuua

SEQ ID NO: 2909212 - RNA, 21 nt, Human
gcaauuccccucugcugcugu

SEQ ID NO: 2909213 - RNA, 14 nt, Human
gcaauuccccucug

SEQ ID NO: 2909214 - RNA, 18 nt, Human
gcaauuccccucugcugc

SEQ ID NO: 2909215 - RNA, 16 nt, Human
gcaauucaaaaguucc

SEQ ID NO: 2909216 - RNA, 22 nt, Human
gcaauucaaaaguuccaagagu

SEQ ID NO: 2909217 - RNA, 14 nt, Human
gcaauucauaaaaa

SEQ ID NO: 2909218 - RNA, 14 nt, Human
gcaauucaucccag

SEQ ID NO: 2909219 - RNA, 11 nt, Human
gcaauuccaau

SEQ ID NO: 2909220 - RNA, 22 nt, Human
gcaacgccgugggcugcguccu

SEQ ID NO: 2909221 - RNA, 15 nt, Human
gcaacacagccuggg

SEQ ID NO: 2909222 - RNA, 22 nt, Human
gcaaccuuucaccuuuguguau

SEQ ID NO: 2909223 - RNA, 23 nt, Human
gcaaccuuucaccuuuguguauu

SEQ ID NO: 2909224 - RNA, 20 nt, Human
gcaacgaccagggccgagga

SEQ ID NO: 2909225 - RNA, 22 nt, Human
gcaacgaccagggccgaggagg

SEQ ID NO: 2909226 - RNA, 14 nt, Human
gcaacacagccugg

SEQ ID NO: 2909227 - RNA, 15 nt, Human
gcaacacagaggaau

SEQ ID NO: 2909228 - RNA, 16 nt, Human
gcaacacagaggaauu

SEQ ID NO: 2909229 - RNA, 22 nt, Human
gcaacguuuacaccgacuagcc

SEQ ID NO: 2909230 - RNA, 22 nt, Human
gcaacuacccaaaacaagccug

SEQ ID NO: 2909231 - RNA, 15 nt, Human
gcaauggcagccuug

SEQ ID NO: 2909232 - RNA, 14 nt, Human
gcaaugggcacugg

SEQ ID NO: 2909233 - RNA, 16 nt, Human
gcaaugggcacuggga

SEQ ID NO: 2909234 - RNA, 23 nt, Human
gcaauggugucaguauccaggcu

SEQ ID NO: 2909235 - RNA, 22 nt, Human
gcaauggugucaguauccaggc

SEQ ID NO: 2909236 - RNA, 16 nt, Human
gaugccccagagcugu

SEQ ID NO: 2909237 - RNA, 12 nt, Human
gaugccccagag

SEQ ID NO: 2909238 - RNA, 16 nt, Human
gaugccccgucccccu

SEQ ID NO: 2909239 - RNA, 17 nt, Human
gaugcugacuguacucc

SEQ ID NO: 2909240 - RNA, 20 nt, Human
gaugcugacuguacuccucc

SEQ ID NO: 2909241 - RNA, 15 nt, Human
gaugcucuucugugg

SEQ ID NO: 2909242 - RNA, 23 nt, Human
gaugcucccuccccugcccuggu

SEQ ID NO: 2909243 - RNA, 21 nt, Human
gaugccaucuguguccugguu

SEQ ID NO: 2909244 - RNA, 20 nt, Human
gaugccaucuguguccuggu

SEQ ID NO: 2909245 - RNA, 18 nt, Human
gaugccaucuguguccug

SEQ ID NO: 2909246 - RNA, 17 nt, Human
gaugccaucuguguccu

SEQ ID NO: 2909247 - RNA, 16 nt, Human
gaugccaucugugucc

SEQ ID NO: 2909248 - RNA, 23 nt, Human
gaugcccagagggcccaggcagg

SEQ ID NO: 2909249 - RNA, 22 nt, Human
gaugcccagagggcccaggcag

SEQ ID NO: 2909250 - RNA, 20 nt, Human
gaugccauucuuccuugcaa

SEQ ID NO: 2909251 - RNA, 18 nt, Human
gaugcccagagggcccag

SEQ ID NO: 2909252 - RNA, 20 nt, Human
gaugcccagagggcccaggc

SEQ ID NO: 2909253 - RNA, 19 nt, Human
gaugcccagagggcccagg

SEQ ID NO: 2909254 - RNA, 17 nt, Human
gaugccagggccgacca

SEQ ID NO: 2909255 - RNA, 11 nt, Human
gaugccaggac

SEQ ID NO: 2909256 - RNA, 15 nt, Human
gaugccauccucuuu

SEQ ID NO: 2909257 - RNA, 22 nt, Human
gaucagaccuuggaucagauga

SEQ ID NO: 2909258 - RNA, 15 nt, Human
gaucagagcaggacc

SEQ ID NO: 2909259 - RNA, 16 nt, Human
gaucagagcaggaccu

SEQ ID NO: 2909260 - RNA, 17 nt, Human
gaucagagcaggaccuc

SEQ ID NO: 2909261 - RNA, 23 nt, Human
gaucagagcaggaccucccuucc

SEQ ID NO: 2909262 - RNA, 22 nt, Human
gaugggugggugggguauuuuu

SEQ ID NO: 2909263 - RNA, 21 nt, Human
gaugggcaacccccagccugc

SEQ ID NO: 2909264 - RNA, 20 nt, Human
gaugggcaacccccagccug

SEQ ID NO: 2909265 - RNA, 23 nt, Human
gaugggagcuccucuccuggagg

SEQ ID NO: 2909266 - RNA, 20 nt, Human
gaugggaggaaagagagcag

SEQ ID NO: 2909267 - RNA, 20 nt, Human
gauggcccggaugcugcuuc

SEQ ID NO: 2909268 - RNA, 22 nt, Human
gauggcccuuccuccuccacca

SEQ ID NO: 2909269 - RNA, 23 nt, Human
gauggcccuuccuccuccaccac

SEQ ID NO: 2909270 - RNA, 21 nt, Human
gauggccgcagggcugugcac

SEQ ID NO: 2909271 - RNA, 13 nt, Human
gauggccaggcug

SEQ ID NO: 2909272 - RNA, 21 nt, Human
gauggcaggauggccuggcca

SEQ ID NO: 2909273 - RNA, 22 nt, Human
gauggcaggauggccuggccag

SEQ ID NO: 2909274 - RNA, 12 nt, Human
gauguucuaagg

SEQ ID NO: 2909275 - RNA, 18 nt, Human
gauguugaagaauacagu

SEQ ID NO: 2909276 - RNA, 20 nt, Human
gauguugaagaauacaguua

SEQ ID NO: 2909277 - RNA, 14 nt, Human
gauguucauuuaga

SEQ ID NO: 2909278 - RNA, 15 nt, Human
gauguugccaugugu

SEQ ID NO: 2909279 - RNA, 13 nt, Human
gauguugccaugu

SEQ ID NO: 2909280 - RNA, 17 nt, Human
gauguugccauguguuu

SEQ ID NO: 2909281 - RNA, 14 nt, Human
gauguuggcuggga

SEQ ID NO: 2909282 - RNA, 15 nt, Human
gauguuggcugggaa

SEQ ID NO: 2909283 - RNA, 19 nt, Human
gauguugccauguguuuua

SEQ ID NO: 2909284 - RNA, 16 nt, Human
gauguugagaaaccug

SEQ ID NO: 2909285 - RNA, 23 nt, Human
gauguuuacagguggacacacaa

SEQ ID NO: 2909286 - RNA, 14 nt, Human
gauguuuauucuuc

SEQ ID NO: 2909287 - RNA, 18 nt, Human
gauguuuuuaaaaguuuc

SEQ ID NO: 2909288 - RNA, 23 nt, Human
gauuacaagcgugagccacugca

SEQ ID NO: 2909289 - RNA, 16 nt, Human
gauuaaauaagauucu

SEQ ID NO: 2909290 - RNA, 17 nt, Human
gauuaaauaagauucua

SEQ ID NO: 2909291 - RNA, 13 nt, Human
gauuacagaggaa

SEQ ID NO: 2909292 - RNA, 10 nt, Human
gauuacaggc

SEQ ID NO: 2909293 - RNA, 18 nt, Human
gauuacaggcaugugcca

SEQ ID NO: 2909294 - RNA, 18 nt, Human
gauuacaggcgugagcca

SEQ ID NO: 2909295 - RNA, 18 nt, Human
gauuaaauaagauucuaa

SEQ ID NO: 2909296 - RNA, 20 nt, Human
gauuacaggcaugagccacu

SEQ ID NO: 2909297 - RNA, 17 nt, Human
gauuacaggcuccugcc

SEQ ID NO: 2909298 - RNA, 20 nt, Human
gauuacaggcgugagccacc

SEQ ID NO: 2909299 - RNA, 22 nt, Human
gauguuuuuaaaaguuucaaug

SEQ ID NO: 2909300 - RNA, 20 nt, Human
gauguuuuuaaaaguuucaa

SEQ ID NO: 2909301 - RNA, 21 nt, Human
gauguuuuuaaaaguuucaau

SEQ ID NO: 2909302 - RNA, 22 nt, Human
gauuacaagcgugagccacugc

SEQ ID NO: 2909303 - RNA, 22 nt, Human
gauguuuugguagauuaaauau

SEQ ID NO: 2909304 - RNA, 12 nt, Human
gauuaaacuuau

SEQ ID NO: 2909305 - RNA, 14 nt, Human
gauuaaacuuauga

SEQ ID NO: 2909306 - RNA, 15 nt, Human
gauuaaacuuaugaa

SEQ ID NO: 2909307 - RNA, 17 nt, Human
gauuaaacuuaugaaug

SEQ ID NO: 2909308 - RNA, 18 nt, Human
gauuaaacuuaugaaugu

SEQ ID NO: 2909309 - RNA, 16 nt, Human
gaugguacgugacccu

SEQ ID NO: 2909310 - RNA, 19 nt, Human
gaugguacgugacccucug

SEQ ID NO: 2909311 - RNA, 20 nt, Human
gaugguacgugacccucugc

SEQ ID NO: 2909312 - RNA, 18 nt, Human
gauggguuuuaugagaug

SEQ ID NO: 2909313 - RNA, 15 nt, Human
gauggucacuuaaaa
